United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 92

SEQ ID NO: 3276736 - RNA, 15 nt, Mycobacterium tuberculosis H37Rv
cgucguaugcgguga

SEQ ID NO: 3276737 - RNA, 20 nt, Mycobacterium tuberculosis H37Rv
cgucgucaccgcgacggaac

SEQ ID NO: 3276738 - RNA, 20 nt, Mycobacterium tuberculosis H37Rv
cgucgucaccuucaccgggu

SEQ ID NO: 3276739 - RNA, 23 nt, Mycobacterium tuberculosis H37Rv
cgucgucagccaggaagcggugg

SEQ ID NO: 3276740 - RNA, 23 nt, Mycobacterium tuberculosis H37Rv
cgucgucaucgagcgggaucggg

SEQ ID NO: 3276741 - RNA, 15 nt, Mycobacterium tuberculosis H37Rv
cgucguccagggcga

SEQ ID NO: 3276742 - RNA, 15 nt, Mycobacterium tuberculosis H37Rv
cgucgucccagcgcg

SEQ ID NO: 3276743 - RNA, 19 nt, Mycobacterium tuberculosis H37Rv
cgucugguuggcuggcggg

SEQ ID NO: 3276744 - RNA, 19 nt, Mycobacterium tuberculosis H37Rv
cgucugugucccgucgaug

SEQ ID NO: 3276745 - RNA, 18 nt, Mycobacterium tuberculosis H37Rv
cgucuuaccugaagccgc

SEQ ID NO: 3276746 - RNA, 16 nt, Mycobacterium tuberculosis H37Rv
cgucuuaucggcgucg

SEQ ID NO: 3276747 - RNA, 17 nt, Mycobacterium tuberculosis H37Rv
cgucuuaucggcgucgu

SEQ ID NO: 3276748 - RNA, 17 nt, Mycobacterium tuberculosis H37Rv
cgucuucacucacgacg

SEQ ID NO: 3276749 - RNA, 17 nt, Mycobacterium tuberculosis H37Rv
cgucuuccucggccacc

SEQ ID NO: 3276750 - RNA, 15 nt, Mycobacterium tuberculosis H37Rv
cgucuucgccgccac

SEQ ID NO: 3276751 - RNA, 18 nt, Mycobacterium tuberculosis H37Rv
cgucuucggucgcggccu

SEQ ID NO: 3276752 - RNA, 23 nt, Mycobacterium tuberculosis H37Rv
cgucuugauguaaugcgggcgca

SEQ ID NO: 3276753 - RNA, 20 nt, Mycobacterium tuberculosis H37Rv
cgucuugcugcacgcucugc

SEQ ID NO: 3276754 - RNA, 19 nt, Mycobacterium tuberculosis H37Rv
cgucuuugacgaacugguc

SEQ ID NO: 3276755 - RNA, 15 nt, Mycobacterium tuberculosis H37Rv
cgugaaagccgacca

SEQ ID NO: 3276756 - RNA, 19 nt, Mycobacterium tuberculosis H37Rv
cgugaaccgcccgcccuug

SEQ ID NO: 3276757 - RNA, 20 nt, Mycobacterium tuberculosis H37Rv
cgugaacuguccgggugggc

SEQ ID NO: 3276758 - RNA, 14 nt, Mycobacterium tuberculosis H37Rv
cgugaaguggucgu

SEQ ID NO: 3276759 - RNA, 15 nt, Mycobacterium tuberculosis H37Rv
cgugaaucgagcacc

SEQ ID NO: 3276760 - RNA, 16 nt, Mycobacterium tuberculosis H37Rv
cgugaaucgagcaccg

SEQ ID NO: 3276761 - RNA, 15 nt, Mycobacterium tuberculosis H37Rv
cgugaauggcagcac

SEQ ID NO: 3276762 - RNA, 16 nt, Mycobacterium tuberculosis H37Rv
cgugacagugaccugg

SEQ ID NO: 3276763 - RNA, 17 nt, Mycobacterium tuberculosis H37Rv
cgugacauucugcagcg

SEQ ID NO: 3276764 - RNA, 15 nt, Mycobacterium tuberculosis H37Rv
cgugaccaccgccga

SEQ ID NO: 3276765 - RNA, 21 nt, Mycobacterium tuberculosis H37Rv
cgugaccagggccugaguguu

SEQ ID NO: 3276766 - RNA, 14 nt, Mycobacterium tuberculosis H37Rv
cgugacccgacaug

SEQ ID NO: 3276767 - RNA, 14 nt, Mycobacterium tuberculosis H37Rv
cgugacccuggggu

SEQ ID NO: 3276768 - RNA, 16 nt, Mycobacterium tuberculosis H37Rv
cgugaccgacgccguc

SEQ ID NO: 3276769 - RNA, 17 nt, Mycobacterium tuberculosis H37Rv
cgugaccgacgccgucg

SEQ ID NO: 3276770 - RNA, 14 nt, Mycobacterium tuberculosis H37Rv
cgugaccgagccgc

SEQ ID NO: 3276771 - RNA, 20 nt, Mycobacterium tuberculosis H37Rv
cgugaccggcaaccgccgug

SEQ ID NO: 3276772 - RNA, 12 nt, Mycobacterium tuberculosis H37Rv
cgugaccgucgg

SEQ ID NO: 3276773 - RNA, 23 nt, Mycobacterium tuberculosis H37Rv
cgugaccgugccgucggcgugca

SEQ ID NO: 3276774 - RNA, 13 nt, Mycobacterium tuberculosis H37Rv
cgugacgaccagc

SEQ ID NO: 3276775 - RNA, 20 nt, Mycobacterium tuberculosis H37Rv
cgugacgaccagccccgcug

SEQ ID NO: 3276776 - RNA, 21 nt, Mycobacterium tuberculosis H37Rv
cgugacguaucgccgcgggcg

SEQ ID NO: 3276777 - RNA, 14 nt, Mycobacterium tuberculosis H37Rv
cgugacgucgucgg

SEQ ID NO: 3276778 - RNA, 20 nt, Mycobacterium tuberculosis H37Rv
cgugacgucguggcgcucgg

SEQ ID NO: 3276779 - RNA, 20 nt, Mycobacterium tuberculosis H37Rv
cgugacguuguaggagaacg

SEQ ID NO: 3276780 - RNA, 22 nt, Mycobacterium tuberculosis H37Rv
cgugacguuguaggagaacguc

SEQ ID NO: 3276781 - RNA, 16 nt, Mycobacterium tuberculosis H37Rv
cgugacucggccgacg

SEQ ID NO: 3276782 - RNA, 17 nt, Mycobacterium tuberculosis H37Rv
cgugacuggugaacggg

SEQ ID NO: 3276783 - RNA, 15 nt, Mycobacterium tuberculosis H37Rv
cgugagaccuagcag

SEQ ID NO: 3276784 - RNA, 13 nt, Mycobacterium tuberculosis H37Rv
cgugagacgccgu

SEQ ID NO: 3276785 - RNA, 16 nt, Mycobacterium tuberculosis H37Rv
cgugagacugggcgcu

SEQ ID NO: 3276786 - RNA, 12 nt, Mycobacterium tuberculosis H37Rv
cgugagaggcca

SEQ ID NO: 3276787 - RNA, 13 nt, Mycobacterium tuberculosis H37Rv
cgugagcaccagc

SEQ ID NO: 3276788 - RNA, 17 nt, Mycobacterium tuberculosis H37Rv
cgugagcaccagcagca

SEQ ID NO: 3276789 - RNA, 23 nt, Mycobacterium tuberculosis H37Rv
cgugagcaguucguuccagauga

SEQ ID NO: 3276790 - RNA, 17 nt, Mycobacterium tuberculosis H37Rv
cgugagccccagcgacg

SEQ ID NO: 3276791 - RNA, 15 nt, Mycobacterium tuberculosis H37Rv
cgugagccuguccac

SEQ ID NO: 3276792 - RNA, 15 nt, Mycobacterium tuberculosis H37Rv
cgugagucacccggc

SEQ ID NO: 3276793 - RNA, 16 nt, Mycobacterium tuberculosis H37Rv
cgugagucacccggcc

SEQ ID NO: 3276794 - RNA, 15 nt, Mycobacterium tuberculosis H37Rv
cgugagugcagcacg

SEQ ID NO: 3276795 - RNA, 15 nt, Mycobacterium tuberculosis H37Rv
cgugaguuucaccac

SEQ ID NO: 3276796 - RNA, 21 nt, Mycobacterium tuberculosis H37Rv
cgugauauccuuugccgccga

SEQ ID NO: 3276797 - RNA, 22 nt, Mycobacterium tuberculosis H37Rv
cgugaucaacuuccgcagcgcc

SEQ ID NO: 3276798 - RNA, 13 nt, Mycobacterium tuberculosis H37Rv
cgugaucagcagg

SEQ ID NO: 3276799 - RNA, 13 nt, Mycobacterium tuberculosis H37Rv
cgugaucgacgac

SEQ ID NO: 3276800 - RNA, 16 nt, Mycobacterium tuberculosis H37Rv
cgugaucgacgaccgu

SEQ ID NO: 3276801 - RNA, 20 nt, Mycobacterium tuberculosis H37Rv
cgugaucgaggcggcggucg

SEQ ID NO: 3276802 - RNA, 21 nt, Mycobacterium tuberculosis H37Rv
cgugaucgcgguccaacagcg

SEQ ID NO: 3276803 - RNA, 17 nt, Mycobacterium tuberculosis H37Rv
cgugaucggcgaaccca

SEQ ID NO: 3276804 - RNA, 18 nt, Mycobacterium tuberculosis H37Rv
cgugaucuucggcgaucg

SEQ ID NO: 3276805 - RNA, 20 nt, Mycobacterium tuberculosis H37Rv
cgugaugaauucgcuugcag

SEQ ID NO: 3276806 - RNA, 18 nt, Mycobacterium tuberculosis H37Rv
cgugaugccacggcgucg

SEQ ID NO: 3276807 - RNA, 13 nt, Mycobacterium tuberculosis H37Rv
cgugaugucaacg

SEQ ID NO: 3276808 - RNA, 23 nt, Mycobacterium tuberculosis H37Rv
cgugaugucaacgugucccaagc

SEQ ID NO: 3276809 - RNA, 22 nt, Mycobacterium tuberculosis H37Rv
cgugauguggucggacagcguc

SEQ ID NO: 3276810 - RNA, 17 nt, Mycobacterium tuberculosis H37Rv
cgugauugucggcgaaa

SEQ ID NO: 3276811 - RNA, 20 nt, Mycobacterium tuberculosis H37Rv
cgugcaauagcucgggcgca

SEQ ID NO: 3276812 - RNA, 21 nt, Mycobacterium tuberculosis H37Rv
cgugcaccgagccgucgucga

SEQ ID NO: 3276813 - RNA, 14 nt, Mycobacterium tuberculosis H37Rv
cgugcaccgcgacc

SEQ ID NO: 3276814 - RNA, 19 nt, Mycobacterium tuberculosis H37Rv
cgugcaccgcgaccgcgca

SEQ ID NO: 3276815 - RNA, 20 nt, Mycobacterium tuberculosis H37Rv
cgugcaccgcgaccgcgcac

SEQ ID NO: 3276816 - RNA, 21 nt, Mycobacterium tuberculosis H37Rv
cgugcaccgucgggauggacg

SEQ ID NO: 3276817 - RNA, 14 nt, Mycobacterium tuberculosis H37Rv
cgugcaccuccagg

SEQ ID NO: 3276818 - RNA, 20 nt, Mycobacterium tuberculosis H37Rv
cgugcaccucgucccagcgg

SEQ ID NO: 3276819 - RNA, 17 nt, Mycobacterium tuberculosis H37Rv
cgugcacgacgacaucg

SEQ ID NO: 3276820 - RNA, 18 nt, Mycobacterium tuberculosis H37Rv
cgugcacgaucgcgguga

SEQ ID NO: 3276821 - RNA, 19 nt, Mycobacterium tuberculosis H37Rv
cgugcacgcacagcccgau

SEQ ID NO: 3276822 - RNA, 15 nt, Mycobacterium tuberculosis H37Rv
cgugcacgcugagcc

SEQ ID NO: 3276823 - RNA, 17 nt, Mycobacterium tuberculosis H37Rv
cgugcacggcggccagg

SEQ ID NO: 3276824 - RNA, 20 nt, Mycobacterium tuberculosis H37Rv
cgugcagcacuuggccagcu

SEQ ID NO: 3276825 - RNA, 16 nt, Mycobacterium tuberculosis H37Rv
cgugcagccauugacg

SEQ ID NO: 3276826 - RNA, 23 nt, Mycobacterium tuberculosis H37Rv
cgugcagccgcaggugggcguug

SEQ ID NO: 3276827 - RNA, 18 nt, Mycobacterium tuberculosis H37Rv
cgugcagcggcgccgcca

SEQ ID NO: 3276828 - RNA, 23 nt, Mycobacterium tuberculosis H37Rv
cgugcagcggcgccgccaagggc

SEQ ID NO: 3276829 - RNA, 18 nt, Mycobacterium tuberculosis H37Rv
cgugcagcggcgggcgau

SEQ ID NO: 3276830 - RNA, 18 nt, Mycobacterium tuberculosis H37Rv
cgugcagcucggucagcg

SEQ ID NO: 3276831 - RNA, 19 nt, Mycobacterium tuberculosis H37Rv
cgugcaggaacacccauac

SEQ ID NO: 3276832 - RNA, 17 nt, Mycobacterium tuberculosis H37Rv
cgugcaggcgacggcuc

SEQ ID NO: 3276833 - RNA, 20 nt, Mycobacterium tuberculosis H37Rv
cgugcagggcauugcggccc

SEQ ID NO: 3276834 - RNA, 18 nt, Mycobacterium tuberculosis H37Rv
cgugcagguagguauagc

SEQ ID NO: 3276835 - RNA, 20 nt, Mycobacterium tuberculosis H37Rv
cgugcauaggccgcgucgau

SEQ ID NO: 3276836 - RNA, 20 nt, Mycobacterium tuberculosis H37Rv
cgugcaugggacauccagau

SEQ ID NO: 3276837 - RNA, 20 nt, Mycobacterium tuberculosis H37Rv
cgugccagcaggggacgggc

SEQ ID NO: 3276838 - RNA, 22 nt, Mycobacterium tuberculosis H37Rv
cgugccagcaggggacgggcgg

SEQ ID NO: 3276839 - RNA, 21 nt, Mycobacterium tuberculosis H37Rv
cguggcccuccucggugaggu

SEQ ID NO: 3276840 - RNA, 15 nt, Mycobacterium tuberculosis H37Rv
cguggcgaaccaggg

SEQ ID NO: 3276841 - RNA, 13 nt, Mycobacterium tuberculosis H37Rv
cguggcgaccggc

SEQ ID NO: 3276842 - RNA, 14 nt, Mycobacterium tuberculosis H37Rv
cguggcgcaccacc

SEQ ID NO: 3276843 - RNA, 18 nt, Mycobacterium tuberculosis H37Rv
cguggcgcccgugccgcc

SEQ ID NO: 3276844 - RNA, 20 nt, Mycobacterium tuberculosis H37Rv
cguggcgccggacaaaccgg

SEQ ID NO: 3276845 - RNA, 12 nt, Mycobacterium tuberculosis H37Rv
cguggcgcgacg

SEQ ID NO: 3276846 - RNA, 13 nt, Mycobacterium tuberculosis H37Rv
cguggcgcgccgc

SEQ ID NO: 3276847 - RNA, 16 nt, Mycobacterium tuberculosis H37Rv
cguggcgcgccgcauc

SEQ ID NO: 3276848 - RNA, 20 nt, Mycobacterium tuberculosis H37Rv
cguggcgcucggcgagcaac

SEQ ID NO: 3276849 - RNA, 13 nt, Mycobacterium tuberculosis H37Rv
cguggcggcagcg

SEQ ID NO: 3276850 - RNA, 12 nt, Mycobacterium tuberculosis H37Rv
cguggcggccuc

SEQ ID NO: 3276851 - RNA, 20 nt, Mycobacterium tuberculosis H37Rv
cguggcggccuccuccccga

SEQ ID NO: 3276852 - RNA, 15 nt, Mycobacterium tuberculosis H37Rv
cguggcggcgggccu

SEQ ID NO: 3276853 - RNA, 20 nt, Mycobacterium tuberculosis H37Rv
cguggcggcgggccucggcg

SEQ ID NO: 3276854 - RNA, 16 nt, Mycobacterium tuberculosis H37Rv
cguggcgggcugcagc

SEQ ID NO: 3276855 - RNA, 17 nt, Mycobacterium tuberculosis H37Rv
cguggcgggcugcagcc

SEQ ID NO: 3276856 - RNA, 15 nt, Mycobacterium tuberculosis H37Rv
cguggcgggggcuua

SEQ ID NO: 3276857 - RNA, 16 nt, Mycobacterium tuberculosis H37Rv
cguggcgucggcguca

SEQ ID NO: 3276858 - RNA, 16 nt, Mycobacterium tuberculosis H37Rv
cguggcuaccgcaggu

SEQ ID NO: 3276859 - RNA, 13 nt, Mycobacterium tuberculosis H37Rv
cguggcuggcacc

SEQ ID NO: 3276860 - RNA, 18 nt, Mycobacterium tuberculosis H37Rv
cguggcuucacccaaccc

SEQ ID NO: 3276861 - RNA, 22 nt, Mycobacterium tuberculosis H37Rv
cguggcuucacccaaccccgcc

SEQ ID NO: 3276862 - RNA, 16 nt, Mycobacterium tuberculosis H37Rv
cgugggaaccaccagc

SEQ ID NO: 3276863 - RNA, 14 nt, Mycobacterium tuberculosis H37Rv
cgugggcagcgcga

SEQ ID NO: 3276864 - RNA, 19 nt, Mycobacterium tuberculosis H37Rv
cgugggcagcgcgaucacc

SEQ ID NO: 3276865 - RNA, 20 nt, Mycobacterium tuberculosis H37Rv
cgugggcagcgcgaucaccg

SEQ ID NO: 3276866 - RNA, 13 nt, Mycobacterium tuberculosis H37Rv
cgugggccaccac

SEQ ID NO: 3276867 - RNA, 13 nt, Mycobacterium tuberculosis H37Rv
cgugggccacgau

SEQ ID NO: 3276868 - RNA, 22 nt, Mycobacterium tuberculosis H37Rv
cgugggccacuugaugcucgau

SEQ ID NO: 3276869 - RNA, 13 nt, Mycobacterium tuberculosis H37Rv
cgugggccucgau

SEQ ID NO: 3276870 - RNA, 15 nt, Mycobacterium tuberculosis H37Rv
cgugggcgacggcgg

SEQ ID NO: 3276871 - RNA, 16 nt, Mycobacterium tuberculosis H37Rv
cgugggcgcggcgcca

SEQ ID NO: 3276872 - RNA, 17 nt, Mycobacterium tuberculosis H37Rv
cgugggcgugagcgcgc

SEQ ID NO: 3276873 - RNA, 16 nt, Mycobacterium tuberculosis H37Rv
cguggggacuggcagg

SEQ ID NO: 3276874 - RNA, 18 nt, Mycobacterium tuberculosis H37Rv
cguggggacuggcaggcc

SEQ ID NO: 3276875 - RNA, 18 nt, Mycobacterium tuberculosis H37Rv
cguggggccgccaccagc

SEQ ID NO: 3276876 - RNA, 16 nt, Mycobacterium tuberculosis H37Rv
cgugggucaacgucag

SEQ ID NO: 3276877 - RNA, 17 nt, Mycobacterium tuberculosis H37Rv
cguggguccaacccgcg

SEQ ID NO: 3276878 - RNA, 18 nt, Mycobacterium tuberculosis H37Rv
cgugggugagcgaccugg

SEQ ID NO: 3276879 - RNA, 18 nt, Mycobacterium tuberculosis H37Rv
cgugggugucggcuagca

SEQ ID NO: 3276880 - RNA, 21 nt, Mycobacterium tuberculosis H37Rv
cgugggugucggcuagcaacg

SEQ ID NO: 3276881 - RNA, 14 nt, Mycobacterium tuberculosis H37Rv
cgugggugucggug

SEQ ID NO: 3276882 - RNA, 21 nt, Mycobacterium tuberculosis H37Rv
cguggguguugaugggcagcc

SEQ ID NO: 3276883 - RNA, 15 nt, Mycobacterium tuberculosis H37Rv
cgugguaaccagggc

SEQ ID NO: 3276884 - RNA, 22 nt, Mycobacterium tuberculosis H37Rv
cgugguaaccauauggcccgcg

SEQ ID NO: 3276885 - RNA, 19 nt, Mycobacterium tuberculosis H37Rv
cgugguagcgccucgugag

SEQ ID NO: 3276886 - RNA, 18 nt, Mycobacterium tuberculosis H37Rv
cgugguauagcgcacugc

SEQ ID NO: 3276887 - RNA, 18 nt, Mycobacterium tuberculosis H37Rv
cguggucaccccuucgcc

SEQ ID NO: 3276888 - RNA, 21 nt, Mycobacterium tuberculosis H37Rv
cguggucaccccuucgccagc

SEQ ID NO: 3276889 - RNA, 20 nt, Mycobacterium tuberculosis H37Rv
cguggucgagggcggcgucg

SEQ ID NO: 3276890 - RNA, 15 nt, Mycobacterium tuberculosis H37Rv
cguggucgcgcggca

SEQ ID NO: 3276891 - RNA, 18 nt, Mycobacterium tuberculosis H37Rv
cguggucgcgcggcaccg

SEQ ID NO: 3276892 - RNA, 15 nt, Mycobacterium tuberculosis H37Rv
cguggucggagcggg

SEQ ID NO: 3276893 - RNA, 13 nt, Mycobacterium tuberculosis H37Rv
cguggucggccac

SEQ ID NO: 3276894 - RNA, 16 nt, Mycobacterium tuberculosis H37Rv
cguggucggccacccc

SEQ ID NO: 3276895 - RNA, 14 nt, Mycobacterium tuberculosis H37Rv
cguggucggccucg

SEQ ID NO: 3276896 - RNA, 16 nt, Mycobacterium tuberculosis H37Rv
cguggucggccucgag

SEQ ID NO: 3276897 - RNA, 18 nt, Mycobacterium tuberculosis H37Rv
cguggucucggucagccc

SEQ ID NO: 3276898 - RNA, 16 nt, Mycobacterium tuberculosis H37Rv
cguggugaagucggug

SEQ ID NO: 3276899 - RNA, 19 nt, Mycobacterium tuberculosis H37Rv
cguggugcuagcgccgcca

SEQ ID NO: 3276900 - RNA, 17 nt, Mycobacterium tuberculosis H37Rv
cguggugcugaccgcgc

SEQ ID NO: 3276901 - RNA, 19 nt, Mycobacterium tuberculosis H37Rv
cgugguggacgaccgcgcg

SEQ ID NO: 3276902 - RNA, 22 nt, Mycobacterium tuberculosis H37Rv
cgugguggacgaccgcgcggca

SEQ ID NO: 3276903 - RNA, 17 nt, Mycobacterium tuberculosis H37Rv
cgugguggcguaucggg

SEQ ID NO: 3276904 - RNA, 19 nt, Mycobacterium tuberculosis H37Rv
cguggugggcgcagaguca

SEQ ID NO: 3276905 - RNA, 17 nt, Mycobacterium tuberculosis H37Rv
cgugguggucgggcgca

SEQ ID NO: 3276906 - RNA, 13 nt, Mycobacterium tuberculosis H37Rv
cgugguucccggc

SEQ ID NO: 3276907 - RNA, 12 nt, Mycobacterium tuberculosis H37Rv
cgugguuccggc

SEQ ID NO: 3276908 - RNA, 23 nt, Mycobacterium tuberculosis H37Rv
cgugguucggcggcgccccgguu

SEQ ID NO: 3276909 - RNA, 19 nt, Mycobacterium tuberculosis H37Rv
cgugguugccgaagccgga

SEQ ID NO: 3276910 - RNA, 16 nt, Mycobacterium tuberculosis H37Rv
cgugguuguaccagcc

SEQ ID NO: 3276911 - RNA, 17 nt, Mycobacterium tuberculosis H37Rv
cgugguuuugucgacgu

SEQ ID NO: 3276912 - RNA, 23 nt, Mycobacterium tuberculosis H37Rv
cgugguuuugucgacguucggug

SEQ ID NO: 3276913 - RNA, 15 nt, Mycobacterium tuberculosis H37Rv
cguguaaccccaggc

SEQ ID NO: 3276914 - RNA, 17 nt, Mycobacterium tuberculosis H37Rv
cguguacauugccgacc

SEQ ID NO: 3276915 - RNA, 20 nt, Mycobacterium tuberculosis H37Rv
cguguacauugccgacccgu

SEQ ID NO: 3276916 - RNA, 15 nt, Mycobacterium tuberculosis H37Rv
cguguacgucgauca

SEQ ID NO: 3276917 - RNA, 17 nt, Mycobacterium tuberculosis H37Rv
cguguacgucgaucagg

SEQ ID NO: 3276918 - RNA, 11 nt, Mycobacterium tuberculosis H37Rv
cguguaggucc

SEQ ID NO: 3276919 - RNA, 22 nt, Mycobacterium tuberculosis H37Rv
cgugucacccaauggagccgcg

SEQ ID NO: 3276920 - RNA, 15 nt, Mycobacterium tuberculosis H37Rv
cgugucacgcgacca

SEQ ID NO: 3276921 - RNA, 14 nt, Mycobacterium tuberculosis H37Rv
cguguccagcaugc

SEQ ID NO: 3276922 - RNA, 19 nt, Mycobacterium tuberculosis H37Rv
cgugucccaagccugccga

SEQ ID NO: 3276923 - RNA, 23 nt, Mycobacterium tuberculosis H37Rv
cguguccccccagauccgcagcg

SEQ ID NO: 3276924 - RNA, 23 nt, Mycobacterium tuberculosis H37Rv
cguguccgccggauagcaccggc

SEQ ID NO: 3276925 - RNA, 21 nt, Mycobacterium tuberculosis H37Rv
cguguccggggaccucggcga

SEQ ID NO: 3276926 - RNA, 19 nt, Mycobacterium tuberculosis H37Rv
cgugucgacuccgaucggg

SEQ ID NO: 3276927 - RNA, 16 nt, Mycobacterium tuberculosis H37Rv
cgugucgccgccacca

SEQ ID NO: 3276928 - RNA, 13 nt, Mycobacterium tuberculosis H37Rv
cgugucgccgccg

SEQ ID NO: 3276929 - RNA, 16 nt, Mycobacterium tuberculosis H37Rv
cgugucgccgccguug

SEQ ID NO: 3276930 - RNA, 23 nt, Mycobacterium tuberculosis H37Rv
cgugucgcgucgcaggauuccca

SEQ ID NO: 3276931 - RNA, 19 nt, Mycobacterium tuberculosis H37Rv
cgugucgcugcggcgcugg

SEQ ID NO: 3276932 - RNA, 23 nt, Mycobacterium tuberculosis H37Rv
cgugucggacaaggacugaccgu

SEQ ID NO: 3276933 - RNA, 19 nt, Mycobacterium tuberculosis H37Rv
cgugucggcggugccgacg

SEQ ID NO: 3276934 - RNA, 16 nt, Mycobacterium tuberculosis H37Rv
cgugucggguccaacc

SEQ ID NO: 3276935 - RNA, 18 nt, Mycobacterium tuberculosis H37Rv
cguucgucggcugcggcg

SEQ ID NO: 3276936 - RNA, 18 nt, Mycobacterium tuberculosis H37Rv
cguucgucguaguccagg

SEQ ID NO: 3276937 - RNA, 20 nt, Mycobacterium tuberculosis H37Rv
cguucugacggcuugcguga

SEQ ID NO: 3276938 - RNA, 16 nt, Mycobacterium tuberculosis H37Rv
cguucugcaccagcuc

SEQ ID NO: 3276939 - RNA, 22 nt, Mycobacterium tuberculosis H37Rv
cguucugcccaggcaaaccgau

SEQ ID NO: 3276940 - RNA, 20 nt, Mycobacterium tuberculosis H37Rv
cguucugucccggcgcgcca

SEQ ID NO: 3276941 - RNA, 16 nt, Mycobacterium tuberculosis H37Rv
cguucuucagccaggg

SEQ ID NO: 3276942 - RNA, 17 nt, Mycobacterium tuberculosis H37Rv
cguucuugcggguuuuc

SEQ ID NO: 3276943 - RNA, 18 nt, Mycobacterium tuberculosis H37Rv
cguugaacggcaccagcg

SEQ ID NO: 3276944 - RNA, 13 nt, Mycobacterium tuberculosis H37Rv
cguugaacucgag

SEQ ID NO: 3276945 - RNA, 23 nt, Mycobacterium tuberculosis H37Rv
cguugaacucgaguugcucgaca

SEQ ID NO: 3276946 - RNA, 19 nt, Mycobacterium tuberculosis H37Rv
cguugaagacggccaccgg

SEQ ID NO: 3276947 - RNA, 23 nt, Mycobacterium tuberculosis H37Rv
cguugaccagaaccuggagccgu

SEQ ID NO: 3276948 - RNA, 13 nt, Mycobacterium tuberculosis H37Rv
cguugacccggcg

SEQ ID NO: 3276949 - RNA, 22 nt, Mycobacterium tuberculosis H37Rv
cguugaccgcgugagcagacgc

SEQ ID NO: 3276950 - RNA, 18 nt, Mycobacterium tuberculosis H37Rv
cguugacggcuucggcag

SEQ ID NO: 3276951 - RNA, 18 nt, Mycobacterium tuberculosis H37Rv
cguugacguccaacagcg

SEQ ID NO: 3276952 - RNA, 18 nt, Mycobacterium tuberculosis H37Rv
cguugacgucgagcagcg

SEQ ID NO: 3276953 - RNA, 14 nt, Mycobacterium tuberculosis H37Rv
cguugaggccggug

SEQ ID NO: 3276954 - RNA, 20 nt, Mycobacterium tuberculosis H37Rv
cguugagguucuucugcgcc

SEQ ID NO: 3276955 - RNA, 14 nt, Mycobacterium tuberculosis H37Rv
cguugagugggagc

SEQ ID NO: 3276956 - RNA, 16 nt, Mycobacterium tuberculosis H37Rv
cguugauacgcgucga

SEQ ID NO: 3276957 - RNA, 20 nt, Mycobacterium tuberculosis H37Rv
cguugaucgacaucaccacc

SEQ ID NO: 3276958 - RNA, 14 nt, Mycobacterium tuberculosis H37Rv
cguugaucgccggg

SEQ ID NO: 3276959 - RNA, 17 nt, Mycobacterium tuberculosis H37Rv
cguugaugaccaggucg

SEQ ID NO: 3276960 - RNA, 22 nt, Mycobacterium tuberculosis H37Rv
cguugaugaccaggucggucag

SEQ ID NO: 3276961 - RNA, 16 nt, Mycobacterium tuberculosis H37Rv
cguugaugaccgccgc

SEQ ID NO: 3276962 - RNA, 22 nt, Mycobacterium tuberculosis H37Rv
cguugaugacguugcagccggc

SEQ ID NO: 3276963 - RNA, 15 nt, Mycobacterium tuberculosis H37Rv
cguugcacagcagcg

SEQ ID NO: 3276964 - RNA, 21 nt, Mycobacterium tuberculosis H37Rv
cguugcagaccaccagugagg

SEQ ID NO: 3276965 - RNA, 15 nt, Mycobacterium tuberculosis H37Rv
cguugcagccggcau

SEQ ID NO: 3276966 - RNA, 16 nt, Mycobacterium tuberculosis H37Rv
cguugcagcucgaucc

SEQ ID NO: 3276967 - RNA, 21 nt, Mycobacterium tuberculosis H37Rv
cguugcaggaaaguggccgac

SEQ ID NO: 3276968 - RNA, 20 nt, Mycobacterium tuberculosis H37Rv
cguugcaggugaacaacagc

SEQ ID NO: 3276969 - RNA, 12 nt, Mycobacterium tuberculosis H37Rv
cguugccaccgg

SEQ ID NO: 3276970 - RNA, 20 nt, Mycobacterium tuberculosis H37Rv
cguugcccccauugccgccg

SEQ ID NO: 3276971 - RNA, 21 nt, Mycobacterium tuberculosis H37Rv
cguugcccccguugccgcccg

SEQ ID NO: 3276972 - RNA, 16 nt, Mycobacterium tuberculosis H37Rv
cguugcccuccuucuc

SEQ ID NO: 3276973 - RNA, 15 nt, Mycobacterium tuberculosis H37Rv
cguugcccucggcgg

SEQ ID NO: 3276974 - RNA, 13 nt, Mycobacterium tuberculosis H37Rv
cguugccgaacgu

SEQ ID NO: 3276975 - RNA, 22 nt, Mycobacterium tuberculosis H37Rv
cguugccgaacgucgcggccag

SEQ ID NO: 3276976 - RNA, 16 nt, Mycobacterium tuberculosis H37Rv
cguugccgaccgucac

SEQ ID NO: 3276977 - RNA, 20 nt, Mycobacterium tuberculosis H37Rv
cguugccgaucagcccggcc

SEQ ID NO: 3276978 - RNA, 22 nt, Mycobacterium tuberculosis H37Rv
cguugccgaucgcuccggcccu

SEQ ID NO: 3276979 - RNA, 14 nt, Mycobacterium tuberculosis H37Rv
cguugccgaucugc

SEQ ID NO: 3276980 - RNA, 18 nt, Mycobacterium tuberculosis H37Rv
cguugccgauggugaugg

SEQ ID NO: 3276981 - RNA, 16 nt, Mycobacterium tuberculosis H37Rv
cguugccgcagacguc

SEQ ID NO: 3276982 - RNA, 23 nt, Mycobacterium tuberculosis H37Rv
cguugccgccacgggcggccacc

SEQ ID NO: 3276983 - RNA, 21 nt, Mycobacterium tuberculosis H37Rv
cguugccgccagcgccaccgu

SEQ ID NO: 3276984 - RNA, 18 nt, Mycobacterium tuberculosis H37Rv
cguugccgccaucaccgc

SEQ ID NO: 3276985 - RNA, 23 nt, Mycobacterium tuberculosis H37Rv
cguugccgccaucaccgccguua

SEQ ID NO: 3276986 - RNA, 13 nt, Mycobacterium tuberculosis H37Rv
cguugccgcccgu

SEQ ID NO: 3276987 - RNA, 20 nt, Mycobacterium tuberculosis H37Rv
cguugccgccgaagccgacg

SEQ ID NO: 3276988 - RNA, 20 nt, Mycobacterium tuberculosis H37Rv
cguugccgccggcgccgccg

SEQ ID NO: 3276989 - RNA, 23 nt, Mycobacterium tuberculosis H37Rv
cguugccgccggcgccgccguua

SEQ ID NO: 3276990 - RNA, 16 nt, Mycobacterium tuberculosis H37Rv
cguugccgccgucccc

SEQ ID NO: 3276991 - RNA, 14 nt, Mycobacterium tuberculosis H37Rv
cguugccgccguua

SEQ ID NO: 3276992 - RNA, 20 nt, Mycobacterium tuberculosis H37Rv
cguugccgccguugccgccg

SEQ ID NO: 3276993 - RNA, 20 nt, Mycobacterium tuberculosis H37Rv
cguugccgcggucggcgacg

SEQ ID NO: 3276994 - RNA, 15 nt, Mycobacterium tuberculosis H37Rv
cguugccggcgacca

SEQ ID NO: 3276995 - RNA, 14 nt, Mycobacterium tuberculosis H37Rv
cguugccggcguug

SEQ ID NO: 3276996 - RNA, 20 nt, Mycobacterium tuberculosis H37Rv
cguugccggcguugccgccg

SEQ ID NO: 3276997 - RNA, 14 nt, Mycobacterium tuberculosis H37Rv
cguugccgggguug

SEQ ID NO: 3276998 - RNA, 16 nt, Mycobacterium tuberculosis H37Rv
cguugccggugccgcc

SEQ ID NO: 3276999 - RNA, 16 nt, Mycobacterium tuberculosis H37Rv
cguugccguuggugcc

SEQ ID NO: 3277000 - RNA, 19 nt, Mycobacterium tuberculosis H37Rv
cguugccguuggugccgcc

SEQ ID NO: 3277001 - RNA, 19 nt, Mycobacterium tuberculosis H37Rv
cguugcgccucuuccuggc

SEQ ID NO: 3277002 - RNA, 21 nt, Mycobacterium tuberculosis H37Rv
cguugcgccucuuccuggcgu

SEQ ID NO: 3277003 - RNA, 17 nt, Mycobacterium tuberculosis H37Rv
cguugcggacggcguug

SEQ ID NO: 3277004 - RNA, 22 nt, Mycobacterium tuberculosis H37Rv
cguugcguagcaggucgacggc

SEQ ID NO: 3277005 - RNA, 15 nt, Mycobacterium tuberculosis H37Rv
cguugcguaucgacc

SEQ ID NO: 3277006 - RNA, 19 nt, Mycobacterium tuberculosis H37Rv
cguugcguuggcgccacca

SEQ ID NO: 3277007 - RNA, 19 nt, Mycobacterium tuberculosis H37Rv
cguugcuauucgccagcgc

SEQ ID NO: 3277008 - RNA, 17 nt, Mycobacterium tuberculosis H37Rv
cguugcucccacggcac

SEQ ID NO: 3277009 - RNA, 19 nt, Mycobacterium tuberculosis H37Rv
cguugcucggucucgucgc

SEQ ID NO: 3277010 - RNA, 16 nt, Mycobacterium tuberculosis H37Rv
cguugcugauggugcc

SEQ ID NO: 3277011 - RNA, 17 nt, Mycobacterium tuberculosis H37Rv
cguugcugccggcguag

SEQ ID NO: 3277012 - RNA, 15 nt, Mycobacterium tuberculosis H37Rv
cguugcugcgcagcg

SEQ ID NO: 3277013 - RNA, 21 nt, Mycobacterium tuberculosis H37Rv
cguugcuggcggccagcaucg

SEQ ID NO: 3277014 - RNA, 16 nt, Mycobacterium tuberculosis H37Rv
cguugcuggcugggug

SEQ ID NO: 3277015 - RNA, 18 nt, Mycobacterium tuberculosis H37Rv
cguuggaaaagucgggca

SEQ ID NO: 3277016 - RNA, 21 nt, Mycobacterium tuberculosis H37Rv
cguuggaaaagucgggcacug

SEQ ID NO: 3277017 - RNA, 16 nt, Mycobacterium tuberculosis H37Rv
cguuggagccgccacc

SEQ ID NO: 3277018 - RNA, 24 nt, Mycobacterium tuberculosis H37Rv
cguuggagccgccaccgaggccgc

SEQ ID NO: 3277019 - RNA, 21 nt, Mycobacterium tuberculosis H37Rv
cguuggaugaagucgucggca

SEQ ID NO: 3277020 - RNA, 11 nt, Mycobacterium tuberculosis H37Rv
cguuggcagcc

SEQ ID NO: 3277021 - RNA, 23 nt, Mycobacterium tuberculosis H37Rv
cguuggccgagcagggccggcac

SEQ ID NO: 3277022 - RNA, 14 nt, Mycobacterium tuberculosis H37Rv
cguuggcgaacagc

SEQ ID NO: 3277023 - RNA, 14 nt, Mycobacterium tuberculosis H37Rv
cguuggcgaccacc

SEQ ID NO: 3277024 - RNA, 15 nt, Mycobacterium tuberculosis H37Rv
cguuggcgaccaccg

SEQ ID NO: 3277025 - RNA, 16 nt, Mycobacterium tuberculosis H37Rv
cguuggcgaccaccgc

SEQ ID NO: 3277026 - RNA, 18 nt, Mycobacterium tuberculosis H37Rv
cguuggcgaucucgacgg

SEQ ID NO: 3277027 - RNA, 19 nt, Mycobacterium tuberculosis H37Rv
cguuggcgaucucgacggc

SEQ ID NO: 3277028 - RNA, 17 nt, Mycobacterium tuberculosis H37Rv
cguuggcgugcaccgca

SEQ ID NO: 3277029 - RNA, 12 nt, Mycobacterium tuberculosis H37Rv
cguuggcucgug

SEQ ID NO: 3277030 - RNA, 22 nt, Mycobacterium tuberculosis H37Rv
cguuggcuggugcaggugacga

SEQ ID NO: 3277031 - RNA, 16 nt, Mycobacterium tuberculosis H37Rv
cuacgccccacugccg

SEQ ID NO: 3277032 - RNA, 17 nt, Mycobacterium tuberculosis H37Rv
cuacgccccacugccgu

SEQ ID NO: 3277033 - RNA, 15 nt, Mycobacterium tuberculosis H37Rv
cuacgcgcgcucgcu

SEQ ID NO: 3277034 - RNA, 23 nt, Mycobacterium tuberculosis H37Rv
cuacgcggccgaggucacccggu

SEQ ID NO: 3277035 - RNA, 16 nt, Mycobacterium tuberculosis H37Rv
cuacggccuggccacc

SEQ ID NO: 3277036 - RNA, 12 nt, Mycobacterium tuberculosis H37Rv
cuacgggccgcg

SEQ ID NO: 3277037 - RNA, 21 nt, Mycobacterium tuberculosis H37Rv
cuacgucggcucgucgcucga

SEQ ID NO: 3277038 - RNA, 14 nt, Mycobacterium tuberculosis H37Rv
cuacgugcugcggg

SEQ ID NO: 3277039 - RNA, 16 nt, Mycobacterium tuberculosis H37Rv
cuacuaggcccagcac

SEQ ID NO: 3277040 - RNA, 15 nt, Mycobacterium tuberculosis H37Rv
cuacuccggucccgc

SEQ ID NO: 3277041 - RNA, 16 nt, Mycobacterium tuberculosis H37Rv
cuacucgaaacccaug

SEQ ID NO: 3277042 - RNA, 21 nt, Mycobacterium tuberculosis H37Rv
cuacucgugaccgucgggccc

SEQ ID NO: 3277043 - RNA, 18 nt, Mycobacterium tuberculosis H37Rv
cuacugauagacccuggg

SEQ ID NO: 3277044 - RNA, 16 nt, Mycobacterium tuberculosis H37Rv
cuagacgccgccgcug

SEQ ID NO: 3277045 - RNA, 20 nt, Mycobacterium tuberculosis H37Rv
cuagauauggaccgccgccg

SEQ ID NO: 3277046 - RNA, 16 nt, Mycobacterium tuberculosis H37Rv
cuagcaaagccagcgc

SEQ ID NO: 3277047 - RNA, 12 nt, Mycobacterium tuberculosis H37Rv
cuagcagcagcc

SEQ ID NO: 3277048 - RNA, 21 nt, Mycobacterium tuberculosis H37Rv
cuagcagcagcccgacagugg

SEQ ID NO: 3277049 - RNA, 18 nt, Mycobacterium tuberculosis H37Rv
cuagcagggugccggcgc

SEQ ID NO: 3277050 - RNA, 21 nt, Mycobacterium tuberculosis H37Rv
cuagcagggugccggcgccgc

SEQ ID NO: 3277051 - RNA, 22 nt, Mycobacterium tuberculosis H37Rv
cuagccaccaggcggucagguc

SEQ ID NO: 3277052 - RNA, 22 nt, Mycobacterium tuberculosis H37Rv
cuagccagggaucagccgugcg

SEQ ID NO: 3277053 - RNA, 21 nt, Mycobacterium tuberculosis H37Rv
cuagccccugaaggccagcca

SEQ ID NO: 3277054 - RNA, 22 nt, Mycobacterium tuberculosis H37Rv
cuagccccugaaggccagccaa

SEQ ID NO: 3277055 - RNA, 15 nt, Mycobacterium tuberculosis H37Rv
cuagcccgccauccg

SEQ ID NO: 3277056 - RNA, 14 nt, Mycobacterium tuberculosis H37Rv
cuagcccggcagca

SEQ ID NO: 3277057 - RNA, 19 nt, Mycobacterium tuberculosis H37Rv
cuagcccguuguccagaac

SEQ ID NO: 3277058 - RNA, 17 nt, Mycobacterium tuberculosis H37Rv
cuagcccucagcuagcg

SEQ ID NO: 3277059 - RNA, 19 nt, Mycobacterium tuberculosis H37Rv
cuagccgacagcucaucga

SEQ ID NO: 3277060 - RNA, 17 nt, Mycobacterium tuberculosis H37Rv
cuagccgauccagcagg

SEQ ID NO: 3277061 - RNA, 19 nt, Mycobacterium tuberculosis H37Rv
cuagccgcggcaccgccga

SEQ ID NO: 3277062 - RNA, 22 nt, Mycobacterium tuberculosis H37Rv
cuagccgcggcaccgccgagca

SEQ ID NO: 3277063 - RNA, 23 nt, Mycobacterium tuberculosis H37Rv
cuagccggguguuggggaucgca

SEQ ID NO: 3277064 - RNA, 13 nt, Mycobacterium tuberculosis H37Rv
cuagccguucggc

SEQ ID NO: 3277065 - RNA, 20 nt, Mycobacterium tuberculosis H37Rv
cuagcgccaaauccggcuug

SEQ ID NO: 3277066 - RNA, 17 nt, Mycobacterium tuberculosis H37Rv
cuagcgccccuggcacc

SEQ ID NO: 3277067 - RNA, 19 nt, Mycobacterium tuberculosis H37Rv
cuagcgccccuggcaccuc

SEQ ID NO: 3277068 - RNA, 16 nt, Mycobacterium tuberculosis H37Rv
cuagcgcccgaacccc

SEQ ID NO: 3277069 - RNA, 20 nt, Mycobacterium tuberculosis H37Rv
cuagcgccucgccggccacc

SEQ ID NO: 3277070 - RNA, 23 nt, Mycobacterium tuberculosis H37Rv
cuagcgccucgccggccacccgc

SEQ ID NO: 3277071 - RNA, 15 nt, Mycobacterium tuberculosis H37Rv
cuagcgcggcgacga

SEQ ID NO: 3277072 - RNA, 20 nt, Mycobacterium tuberculosis H37Rv
cuagcgcuugcgaccccggc

SEQ ID NO: 3277073 - RNA, 22 nt, Mycobacterium tuberculosis H37Rv
cuagcgguauuugaugagcaac

SEQ ID NO: 3277074 - RNA, 21 nt, Mycobacterium tuberculosis H37Rv
cuagcgguggaaaaagcccga

SEQ ID NO: 3277075 - RNA, 16 nt, Mycobacterium tuberculosis H37Rv
cuagcugcuagcccgg

SEQ ID NO: 3277076 - RNA, 16 nt, Mycobacterium tuberculosis H37Rv
cuagcugcugaugcgg

SEQ ID NO: 3277077 - RNA, 13 nt, Mycobacterium tuberculosis H37Rv
cuaggaacgccac

SEQ ID NO: 3277078 - RNA, 14 nt, Mycobacterium tuberculosis H37Rv
cuaggaccaccagc

SEQ ID NO: 3277079 - RNA, 15 nt, Mycobacterium tuberculosis H37Rv
cuaggaccaccagcg

SEQ ID NO: 3277080 - RNA, 22 nt, Mycobacterium tuberculosis H37Rv
cuaggaccaccagcgcuccagc

SEQ ID NO: 3277081 - RNA, 20 nt, Mycobacterium tuberculosis H37Rv
cuaggaccgcgguggccaga

SEQ ID NO: 3277082 - RNA, 17 nt, Mycobacterium tuberculosis H37Rv
cuaggacgccgcccucu

SEQ ID NO: 3277083 - RNA, 19 nt, Mycobacterium tuberculosis H37Rv
cuaggacggcgcgagccgc

SEQ ID NO: 3277084 - RNA, 22 nt, Mycobacterium tuberculosis H37Rv
cuaggacggcugccgucagccg

SEQ ID NO: 3277085 - RNA, 20 nt, Mycobacterium tuberculosis H37Rv
cuaggaucggauggcggcca

SEQ ID NO: 3277086 - RNA, 21 nt, Mycobacterium tuberculosis H37Rv
cuaggaucggauggcggccac

SEQ ID NO: 3277087 - RNA, 20 nt, Mycobacterium tuberculosis H37Rv
cuaggcaccagcggaucgca

SEQ ID NO: 3277088 - RNA, 14 nt, Mycobacterium tuberculosis H37Rv
cuaggccaaacccc

SEQ ID NO: 3277089 - RNA, 12 nt, Mycobacterium tuberculosis H37Rv
cuaggccaagcc

SEQ ID NO: 3277090 - RNA, 13 nt, Mycobacterium tuberculosis H37Rv
cuaggccagcacg

SEQ ID NO: 3277091 - RNA, 18 nt, Mycobacterium tuberculosis H37Rv
cuaggccagcacggcgac

SEQ ID NO: 3277092 - RNA, 14 nt, Mycobacterium tuberculosis H37Rv
cuaggccggccgga

SEQ ID NO: 3277093 - RNA, 14 nt, Mycobacterium tuberculosis H37Rv
cuaggccucagaac

SEQ ID NO: 3277094 - RNA, 16 nt, Mycobacterium tuberculosis H37Rv
cuaggccucagaaccg

SEQ ID NO: 3277095 - RNA, 15 nt, Mycobacterium tuberculosis H37Rv
cuaggcgcuccuuca

SEQ ID NO: 3277096 - RNA, 15 nt, Mycobacterium tuberculosis H37Rv
cuagggcagcagccc

SEQ ID NO: 3277097 - RNA, 23 nt, Mycobacterium tuberculosis H37Rv
cuagggcagcagcccgggcagcc

SEQ ID NO: 3277098 - RNA, 14 nt, Mycobacterium tuberculosis H37Rv
cuagggucaccgac

SEQ ID NO: 3277099 - RNA, 16 nt, Mycobacterium tuberculosis H37Rv
cuagggugagcccggg

SEQ ID NO: 3277100 - RNA, 17 nt, Mycobacterium tuberculosis H37Rv
cuagguccgaucgugug

SEQ ID NO: 3277101 - RNA, 18 nt, Mycobacterium tuberculosis H37Rv
cuaggucgacgccgacca

SEQ ID NO: 3277102 - RNA, 18 nt, Mycobacterium tuberculosis H37Rv
cuaggucgcgcugaaggu

SEQ ID NO: 3277103 - RNA, 16 nt, Mycobacterium tuberculosis H37Rv
cuaggugacgccgcca

SEQ ID NO: 3277104 - RNA, 23 nt, Mycobacterium tuberculosis H37Rv
cuaggugugcgacgacggcgccg

SEQ ID NO: 3277105 - RNA, 19 nt, Mycobacterium tuberculosis H37Rv
cuagguucgaguccuggua

SEQ ID NO: 3277106 - RNA, 21 nt, Mycobacterium tuberculosis H37Rv
cuagguucgcccagcccgaca

SEQ ID NO: 3277107 - RNA, 13 nt, Mycobacterium tuberculosis H37Rv
cuagucaccuuga

SEQ ID NO: 3277108 - RNA, 17 nt, Mycobacterium tuberculosis H37Rv
cuaguccggcacugcgg

SEQ ID NO: 3277109 - RNA, 17 nt, Mycobacterium tuberculosis H37Rv
cuagucguagacggcga

SEQ ID NO: 3277110 - RNA, 19 nt, Mycobacterium tuberculosis H37Rv
cuagugacugguauuuccc

SEQ ID NO: 3277111 - RNA, 22 nt, Mycobacterium tuberculosis H37Rv
cuagugcgggccgugacccuca

SEQ ID NO: 3277112 - RNA, 15 nt, Mycobacterium tuberculosis H37Rv
cuagugugaccguca

SEQ ID NO: 3277113 - RNA, 22 nt, Mycobacterium tuberculosis H37Rv
cuaguucgagcugccaggcccg

SEQ ID NO: 3277114 - RNA, 22 nt, Mycobacterium tuberculosis H37Rv
cuaguugcaacggguacacccg

SEQ ID NO: 3277115 - RNA, 23 nt, Mycobacterium tuberculosis H37Rv
cuauaucccgccccgggccacca

SEQ ID NO: 3277116 - RNA, 21 nt, Mycobacterium tuberculosis H37Rv
cuaucccaggggcaccgagcu

SEQ ID NO: 3277117 - RNA, 22 nt, Mycobacterium tuberculosis H37Rv
cuauccuugguuagccgcggcc

SEQ ID NO: 3277118 - RNA, 23 nt, Mycobacterium tuberculosis H37Rv
cuauccuugguuagccgcggccc

SEQ ID NO: 3277119 - RNA, 16 nt, Mycobacterium tuberculosis H37Rv
cuaucgcagaacggac

SEQ ID NO: 3277120 - RNA, 17 nt, Mycobacterium tuberculosis H37Rv
cuaucgcagaacggacc

SEQ ID NO: 3277121 - RNA, 22 nt, Mycobacterium tuberculosis H37Rv
cuaucgcuagccggcucaucgc

SEQ ID NO: 3277122 - RNA, 18 nt, Mycobacterium tuberculosis H37Rv
cuaucuggcggccggacu

SEQ ID NO: 3277123 - RNA, 16 nt, Mycobacterium tuberculosis H37Rv
cuaugccaacgacagg

SEQ ID NO: 3277124 - RNA, 22 nt, Mycobacterium tuberculosis H37Rv
cuaugccaacgacaggcgccca

SEQ ID NO: 3277125 - RNA, 16 nt, Mycobacterium tuberculosis H37Rv
cuaugccccggagcca

SEQ ID NO: 3277126 - RNA, 14 nt, Mycobacterium tuberculosis H37Rv
cucaucaccucucc

SEQ ID NO: 3277127 - RNA, 22 nt, Mycobacterium tuberculosis H37Rv
cucauccaccgauggcgcgcuc

SEQ ID NO: 3277128 - RNA, 22 nt, Mycobacterium tuberculosis H37Rv
cucaucccgacccuucgggcug

SEQ ID NO: 3277129 - RNA, 23 nt, Mycobacterium tuberculosis H37Rv
cucaucccgagaucaccuuggca

SEQ ID NO: 3277130 - RNA, 16 nt, Mycobacterium tuberculosis H37Rv
cucauccgccgggcca

SEQ ID NO: 3277131 - RNA, 20 nt, Mycobacterium tuberculosis H37Rv
cucaucgauuggcucgagca

SEQ ID NO: 3277132 - RNA, 17 nt, Mycobacterium tuberculosis H37Rv
cucaucgcgcacgcccu

SEQ ID NO: 3277133 - RNA, 15 nt, Mycobacterium tuberculosis H37Rv
cucaucgcgcccgcc

SEQ ID NO: 3277134 - RNA, 21 nt, Mycobacterium tuberculosis H37Rv
cucaucggacagcgccuggcc

SEQ ID NO: 3277135 - RNA, 18 nt, Mycobacterium tuberculosis H37Rv
cucaucggcaaacuccug

SEQ ID NO: 3277136 - RNA, 21 nt, Mycobacterium tuberculosis H37Rv
cucaucggccgcggucggcca

SEQ ID NO: 3277137 - RNA, 17 nt, Mycobacterium tuberculosis H37Rv
cucaucggcgugcuugc

SEQ ID NO: 3277138 - RNA, 14 nt, Mycobacterium tuberculosis H37Rv
cucaucuguaaccu

SEQ ID NO: 3277139 - RNA, 19 nt, Mycobacterium tuberculosis H37Rv
cucaucuguaaccuccucg

SEQ ID NO: 3277140 - RNA, 14 nt, Mycobacterium tuberculosis H37Rv
cucaucuucgguca

SEQ ID NO: 3277141 - RNA, 21 nt, Mycobacterium tuberculosis H37Rv
cucaucuuugacaccggucgg

SEQ ID NO: 3277142 - RNA, 17 nt, Mycobacterium tuberculosis H37Rv
cucaugcaucugcuucu

SEQ ID NO: 3277143 - RNA, 15 nt, Mycobacterium tuberculosis H37Rv
cucaugcccgggaug

SEQ ID NO: 3277144 - RNA, 14 nt, Mycobacterium tuberculosis H37Rv
cucaugccgagcga

SEQ ID NO: 3277145 - RNA, 18 nt, Mycobacterium tuberculosis H37Rv
cucaugcuaggccaccgg

SEQ ID NO: 3277146 - RNA, 13 nt, Mycobacterium tuberculosis H37Rv
cucaugcuggaag

SEQ ID NO: 3277147 - RNA, 20 nt, Mycobacterium tuberculosis H37Rv
cucaugggcgccaucccgcc

SEQ ID NO: 3277148 - RNA, 14 nt, Mycobacterium tuberculosis H37Rv
cucauuccccggaa

SEQ ID NO: 3277149 - RNA, 17 nt, Mycobacterium tuberculosis H37Rv
cucauucgugcccgggc

SEQ ID NO: 3277150 - RNA, 16 nt, Mycobacterium tuberculosis H37Rv
cuccaaaccggagucg

SEQ ID NO: 3277151 - RNA, 20 nt, Mycobacterium tuberculosis H37Rv
cuccaaaccggagucgucgg

SEQ ID NO: 3277152 - RNA, 14 nt, Mycobacterium tuberculosis H37Rv
cuccaacaacucca

SEQ ID NO: 3277153 - RNA, 20 nt, Mycobacterium tuberculosis H37Rv
cuccaacaacuccagcaggu

SEQ ID NO: 3277154 - RNA, 20 nt, Mycobacterium tuberculosis H37Rv
cuccaacagguaagccacau

SEQ ID NO: 3277155 - RNA, 13 nt, Mycobacterium tuberculosis H37Rv
cuccaagcaauuc

SEQ ID NO: 3277156 - RNA, 21 nt, Mycobacterium tuberculosis H37Rv
cuccaagccgggugggagcag

SEQ ID NO: 3277157 - RNA, 13 nt, Mycobacterium tuberculosis H37Rv
cuccaaguagcac

SEQ ID NO: 3277158 - RNA, 16 nt, Mycobacterium tuberculosis H37Rv
cuccaauugcgcugaa

SEQ ID NO: 3277159 - RNA, 14 nt, Mycobacterium tuberculosis H37Rv
cuccacagcggcca

SEQ ID NO: 3277160 - RNA, 19 nt, Mycobacterium tuberculosis H37Rv
cuccaccaacucgacgugc

SEQ ID NO: 3277161 - RNA, 22 nt, Mycobacterium tuberculosis H37Rv
cuccaccagugccccgccgagc

SEQ ID NO: 3277162 - RNA, 15 nt, Mycobacterium tuberculosis H37Rv
cuccaccccacccag

SEQ ID NO: 3277163 - RNA, 18 nt, Mycobacterium tuberculosis H37Rv
cuccacccccacgcugca

SEQ ID NO: 3277164 - RNA, 20 nt, Mycobacterium tuberculosis H37Rv
cuccaccgaaaaguccgccg

SEQ ID NO: 3277165 - RNA, 13 nt, Mycobacterium tuberculosis H37Rv
cuccaccgcgccg

SEQ ID NO: 3277166 - RNA, 16 nt, Mycobacterium tuberculosis H37Rv
cuccaccgggcccgcc

SEQ ID NO: 3277167 - RNA, 13 nt, Mycobacterium tuberculosis H37Rv
cuccaccgucgcc

SEQ ID NO: 3277168 - RNA, 15 nt, Mycobacterium tuberculosis H37Rv
cuccaccgucgccgc

SEQ ID NO: 3277169 - RNA, 11 nt, Mycobacterium tuberculosis H37Rv
cuccaccuucu

SEQ ID NO: 3277170 - RNA, 13 nt, Mycobacterium tuberculosis H37Rv
cuccaccuucugg

SEQ ID NO: 3277171 - RNA, 23 nt, Mycobacterium tuberculosis H37Rv
cuccaccuucugguccagcaccg

SEQ ID NO: 3277172 - RNA, 20 nt, Mycobacterium tuberculosis H37Rv
cuccacgaucggcccagccc

SEQ ID NO: 3277173 - RNA, 15 nt, Mycobacterium tuberculosis H37Rv
cuccacgcccuggcg

SEQ ID NO: 3277174 - RNA, 14 nt, Mycobacterium tuberculosis H37Rv
cuccacgccguuga

SEQ ID NO: 3277175 - RNA, 13 nt, Mycobacterium tuberculosis H37Rv
cuccacguccggc

SEQ ID NO: 3277176 - RNA, 15 nt, Mycobacterium tuberculosis H37Rv
cuccacugaccaggu

SEQ ID NO: 3277177 - RNA, 16 nt, Mycobacterium tuberculosis H37Rv
cuccacuuggggcgcc

SEQ ID NO: 3277178 - RNA, 23 nt, Mycobacterium tuberculosis H37Rv
cuccacuuggggcgccagggucg

SEQ ID NO: 3277179 - RNA, 22 nt, Mycobacterium tuberculosis H37Rv
cuccacuuuuccgccggccagg

SEQ ID NO: 3277180 - RNA, 14 nt, Mycobacterium tuberculosis H37Rv
cuccagacguucca

SEQ ID NO: 3277181 - RNA, 22 nt, Mycobacterium tuberculosis H37Rv
cuccagacguuccaucacggac

SEQ ID NO: 3277182 - RNA, 23 nt, Mycobacterium tuberculosis H37Rv
cuccagagacagcgccaugcccu

SEQ ID NO: 3277183 - RNA, 17 nt, Mycobacterium tuberculosis H37Rv
cuccagauacaggaaca

SEQ ID NO: 3277184 - RNA, 16 nt, Mycobacterium tuberculosis H37Rv
cuccagauccacgccg

SEQ ID NO: 3277185 - RNA, 18 nt, Mycobacterium tuberculosis H37Rv
cuccagcaaggccagcac

SEQ ID NO: 3277186 - RNA, 14 nt, Mycobacterium tuberculosis H37Rv
cuccagcaccagca

SEQ ID NO: 3277187 - RNA, 21 nt, Mycobacterium tuberculosis H37Rv
cuccagcaccagcacggcaac

SEQ ID NO: 3277188 - RNA, 17 nt, Mycobacterium tuberculosis H37Rv
cuccagcacccggucga

SEQ ID NO: 3277189 - RNA, 13 nt, Mycobacterium tuberculosis H37Rv
cuccagcagcccg

SEQ ID NO: 3277190 - RNA, 17 nt, Mycobacterium tuberculosis H37Rv
cuccagcagcccggugg

SEQ ID NO: 3277191 - RNA, 15 nt, Mycobacterium tuberculosis H37Rv
cuccagcagcgacgg

SEQ ID NO: 3277192 - RNA, 16 nt, Mycobacterium tuberculosis H37Rv
cuccagcagcgacggu

SEQ ID NO: 3277193 - RNA, 15 nt, Mycobacterium tuberculosis H37Rv
cuccagcagcucgcc

SEQ ID NO: 3277194 - RNA, 20 nt, Mycobacterium tuberculosis H37Rv
cuccagcagcucgccggcac

SEQ ID NO: 3277195 - RNA, 21 nt, Mycobacterium tuberculosis H37Rv
cuccagcaggucgccugcccc

SEQ ID NO: 3277196 - RNA, 17 nt, Mycobacterium tuberculosis H37Rv
cuccagcgcaccgguga

SEQ ID NO: 3277197 - RNA, 15 nt, Mycobacterium tuberculosis H37Rv
cuccagcgcacuacu

SEQ ID NO: 3277198 - RNA, 21 nt, Mycobacterium tuberculosis H37Rv
cuccagcgcacuacucgaaca

SEQ ID NO: 3277199 - RNA, 15 nt, Mycobacterium tuberculosis H37Rv
cuccagcgcccgguc

SEQ ID NO: 3277200 - RNA, 18 nt, Mycobacterium tuberculosis H37Rv
cuccagcgccgcggugac

SEQ ID NO: 3277201 - RNA, 18 nt, Mycobacterium tuberculosis H37Rv
cuccagcgcgcgccgcag

SEQ ID NO: 3277202 - RNA, 16 nt, Mycobacterium tuberculosis H37Rv
cuccagcugggugacc

SEQ ID NO: 3277203 - RNA, 21 nt, Mycobacterium tuberculosis H37Rv
cuccaggaucucuucucggcu

SEQ ID NO: 3277204 - RNA, 14 nt, Mycobacterium tuberculosis H37Rv
cuccaggcgccacc

SEQ ID NO: 3277205 - RNA, 12 nt, Mycobacterium tuberculosis H37Rv
cuccagggcccu

SEQ ID NO: 3277206 - RNA, 15 nt, Mycobacterium tuberculosis H37Rv
cuccagggcccugcu

SEQ ID NO: 3277207 - RNA, 15 nt, Mycobacterium tuberculosis H37Rv
cuccaggguccggac

SEQ ID NO: 3277208 - RNA, 21 nt, Mycobacterium tuberculosis H37Rv
cuccagguagucgcgguaggc

SEQ ID NO: 3277209 - RNA, 15 nt, Mycobacterium tuberculosis H37Rv
cuccagguuccaggu

SEQ ID NO: 3277210 - RNA, 15 nt, Mycobacterium tuberculosis H37Rv
cuccaguagccggug

SEQ ID NO: 3277211 - RNA, 17 nt, Mycobacterium tuberculosis H37Rv
cuccaguagccggugcc

SEQ ID NO: 3277212 - RNA, 21 nt, Mycobacterium tuberculosis H37Rv
cuccaguagccggugccggcg

SEQ ID NO: 3277213 - RNA, 15 nt, Mycobacterium tuberculosis H37Rv
cuccagugcggccuu

SEQ ID NO: 3277214 - RNA, 14 nt, Mycobacterium tuberculosis H37Rv
cuccaguggcgcca

SEQ ID NO: 3277215 - RNA, 20 nt, Mycobacterium tuberculosis H37Rv
cuccaguggcgccagggccu

SEQ ID NO: 3277216 - RNA, 14 nt, Mycobacterium tuberculosis H37Rv
cuccaguucgccgu

SEQ ID NO: 3277217 - RNA, 13 nt, Mycobacterium tuberculosis H37Rv
cuccaucaacugc

SEQ ID NO: 3277218 - RNA, 15 nt, Mycobacterium tuberculosis H37Rv
cuccaucaccacacc

SEQ ID NO: 3277219 - RNA, 23 nt, Mycobacterium tuberculosis H37Rv
cuccaucgcgacaucgguggcgg

SEQ ID NO: 3277220 - RNA, 18 nt, Mycobacterium tuberculosis H37Rv
cuccaucgucugguggca

SEQ ID NO: 3277221 - RNA, 20 nt, Mycobacterium tuberculosis H37Rv
cuccaugacaaaccugcaug

SEQ ID NO: 3277222 - RNA, 17 nt, Mycobacterium tuberculosis H37Rv
cuccaugauccagccau

SEQ ID NO: 3277223 - RNA, 20 nt, Mycobacterium tuberculosis H37Rv
cuccggcggcagcggcgccg

SEQ ID NO: 3277224 - RNA, 17 nt, Mycobacterium tuberculosis H37Rv
cuccggcgucggcggcc

SEQ ID NO: 3277225 - RNA, 16 nt, Mycobacterium tuberculosis H37Rv
cuccggcucgacaaca

SEQ ID NO: 3277226 - RNA, 18 nt, Mycobacterium tuberculosis H37Rv
cuccggcuucggcaacca

SEQ ID NO: 3277227 - RNA, 14 nt, Mycobacterium tuberculosis H37Rv
cuccgggaccaggc

SEQ ID NO: 3277228 - RNA, 14 nt, Mycobacterium tuberculosis H37Rv
cuccgggacgguga

SEQ ID NO: 3277229 - RNA, 19 nt, Mycobacterium tuberculosis H37Rv
cuccgggaugaagcucgac

SEQ ID NO: 3277230 - RNA, 19 nt, Mycobacterium tuberculosis H37Rv
cuccgggcgcaccaagacg

SEQ ID NO: 3277231 - RNA, 15 nt, Mycobacterium tuberculosis H37Rv
cuccgggcgcucggu

SEQ ID NO: 3277232 - RNA, 14 nt, Mycobacterium tuberculosis H37Rv
cuccgggucgacga

SEQ ID NO: 3277233 - RNA, 20 nt, Mycobacterium tuberculosis H37Rv
cuccgggucgaugucggggc

SEQ ID NO: 3277234 - RNA, 22 nt, Mycobacterium tuberculosis H37Rv
cuccggguggcggcggcggagc

SEQ ID NO: 3277235 - RNA, 23 nt, Mycobacterium tuberculosis H37Rv
cuccggucaacacccgcccgggc

SEQ ID NO: 3277236 - RNA, 21 nt, Mycobacterium tuberculosis H37Rv
cuccgguggccaacaccgcca

SEQ ID NO: 3277237 - RNA, 17 nt, Mycobacterium tuberculosis H37Rv
cuccggugugaucggcg

SEQ ID NO: 3277238 - RNA, 17 nt, Mycobacterium tuberculosis H37Rv
cuccguaacgccaagcu

SEQ ID NO: 3277239 - RNA, 19 nt, Mycobacterium tuberculosis H37Rv
cuccgucggccaggccacg

SEQ ID NO: 3277240 - RNA, 15 nt, Mycobacterium tuberculosis H37Rv
cuccgugaucgaggc

SEQ ID NO: 3277241 - RNA, 12 nt, Mycobacterium tuberculosis H37Rv
cuccgugccgag

SEQ ID NO: 3277242 - RNA, 18 nt, Mycobacterium tuberculosis H37Rv
cuccgugggcagcgcgcc

SEQ ID NO: 3277243 - RNA, 19 nt, Mycobacterium tuberculosis H37Rv
cuccguggugcuagcgccg

SEQ ID NO: 3277244 - RNA, 14 nt, Mycobacterium tuberculosis H37Rv
cuccguugagguag

SEQ ID NO: 3277245 - RNA, 20 nt, Mycobacterium tuberculosis H37Rv
cuccguugcccccauugccg

SEQ ID NO: 3277246 - RNA, 15 nt, Mycobacterium tuberculosis H37Rv
cuccguuuggcugcc

SEQ ID NO: 3277247 - RNA, 15 nt, Mycobacterium tuberculosis H37Rv
cuccucagccaccgc

SEQ ID NO: 3277248 - RNA, 23 nt, Mycobacterium tuberculosis H37Rv
cuccucagccaccgcggucagcu

SEQ ID NO: 3277249 - RNA, 20 nt, Mycobacterium tuberculosis H37Rv
cuccucauagagcggcacca

SEQ ID NO: 3277250 - RNA, 16 nt, Mycobacterium tuberculosis H37Rv
cuccuccaccagugcc

SEQ ID NO: 3277251 - RNA, 19 nt, Mycobacterium tuberculosis H37Rv
cuccuccaccagugccccg

SEQ ID NO: 3277252 - RNA, 14 nt, Mycobacterium tuberculosis H37Rv
cuccuccagagaca

SEQ ID NO: 3277253 - RNA, 20 nt, Mycobacterium tuberculosis H37Rv
cuccuccagagacagcgcca

SEQ ID NO: 3277254 - RNA, 15 nt, Mycobacterium tuberculosis H37Rv
cuccuccccgaccgc

SEQ ID NO: 3277255 - RNA, 16 nt, Mycobacterium tuberculosis H37Rv
cuccuccccggcccgc

SEQ ID NO: 3277256 - RNA, 14 nt, Mycobacterium tuberculosis H37Rv
cuccuccugugcga

SEQ ID NO: 3277257 - RNA, 22 nt, Mycobacterium tuberculosis H37Rv
cuccucgaaggcuucgcuggcu

SEQ ID NO: 3277258 - RNA, 13 nt, Mycobacterium tuberculosis H37Rv
cuccucgaauucg

SEQ ID NO: 3277259 - RNA, 17 nt, Mycobacterium tuberculosis H37Rv
cuccucgaccgcggccu

SEQ ID NO: 3277260 - RNA, 14 nt, Mycobacterium tuberculosis H37Rv
cuccucgaccgugg

SEQ ID NO: 3277261 - RNA, 22 nt, Mycobacterium tuberculosis H37Rv
cuccucgaccguggcggccucc

SEQ ID NO: 3277262 - RNA, 17 nt, Mycobacterium tuberculosis H37Rv
cuccucgacgucggcga

SEQ ID NO: 3277263 - RNA, 21 nt, Mycobacterium tuberculosis H37Rv
cuccucgauagcggcgccuga

SEQ ID NO: 3277264 - RNA, 11 nt, Mycobacterium tuberculosis H37Rv
cuccucgauga

SEQ ID NO: 3277265 - RNA, 23 nt, Mycobacterium tuberculosis H37Rv
cuccucgaugaggcgcagcgcca

SEQ ID NO: 3277266 - RNA, 20 nt, Mycobacterium tuberculosis H37Rv
cuccucgaugcccuuggcga

SEQ ID NO: 3277267 - RNA, 15 nt, Mycobacterium tuberculosis H37Rv
cuccucgcgggcggc

SEQ ID NO: 3277268 - RNA, 15 nt, Mycobacterium tuberculosis H37Rv
cuccucggcaggccg

SEQ ID NO: 3277269 - RNA, 16 nt, Mycobacterium tuberculosis H37Rv
cuccucggcaggccga

SEQ ID NO: 3277270 - RNA, 20 nt, Mycobacterium tuberculosis H37Rv
cuccucggcguggcaguaca

SEQ ID NO: 3277271 - RNA, 14 nt, Mycobacterium tuberculosis H37Rv
cuccucgguguaga

SEQ ID NO: 3277272 - RNA, 14 nt, Mycobacterium tuberculosis H37Rv
cuccucgucgacgu

SEQ ID NO: 3277273 - RNA, 20 nt, Mycobacterium tuberculosis H37Rv
cuccucgucgcucccgguug

SEQ ID NO: 3277274 - RNA, 23 nt, Mycobacterium tuberculosis H37Rv
cuccucgugcacgcacagcccga

SEQ ID NO: 3277275 - RNA, 23 nt, Mycobacterium tuberculosis H37Rv
cuccucgugcaggaccagcaccg

SEQ ID NO: 3277276 - RNA, 13 nt, Mycobacterium tuberculosis H37Rv
cuccugaguugcg

SEQ ID NO: 3277277 - RNA, 15 nt, Mycobacterium tuberculosis H37Rv
cuccugaguugcggu

SEQ ID NO: 3277278 - RNA, 16 nt, Mycobacterium tuberculosis H37Rv
cuccugcacacaggac

SEQ ID NO: 3277279 - RNA, 18 nt, Mycobacterium tuberculosis H37Rv
cuccugcacacaggacuu

SEQ ID NO: 3277280 - RNA, 16 nt, Mycobacterium tuberculosis H37Rv
cuccugcagcccgggc

SEQ ID NO: 3277281 - RNA, 23 nt, Mycobacterium tuberculosis H37Rv
cuccugcagcccgggcagcacca

SEQ ID NO: 3277282 - RNA, 15 nt, Mycobacterium tuberculosis H37Rv
cuccugcggcaccgc

SEQ ID NO: 3277283 - RNA, 21 nt, Mycobacterium tuberculosis H37Rv
cuccugcggcaccgcugagga

SEQ ID NO: 3277284 - RNA, 11 nt, Mycobacterium tuberculosis H37Rv
cuccugcucgu

SEQ ID NO: 3277285 - RNA, 19 nt, Mycobacterium tuberculosis H37Rv
cuccugcucgucgagccga

SEQ ID NO: 3277286 - RNA, 18 nt, Mycobacterium tuberculosis H37Rv
cuccugcuggcccugcuc

SEQ ID NO: 3277287 - RNA, 23 nt, Mycobacterium tuberculosis H37Rv
cuccuggaaaggacggccggccg

SEQ ID NO: 3277288 - RNA, 23 nt, Mycobacterium tuberculosis H37Rv
cuccuggcaaccgaauugaacug

SEQ ID NO: 3277289 - RNA, 20 nt, Mycobacterium tuberculosis H37Rv
cuccuggcggguggcgauga

SEQ ID NO: 3277290 - RNA, 18 nt, Mycobacterium tuberculosis H37Rv
cuccuggguuugccgaug

SEQ ID NO: 3277291 - RNA, 14 nt, Mycobacterium tuberculosis H37Rv
cuccuggucaaccg

SEQ ID NO: 3277292 - RNA, 21 nt, Mycobacterium tuberculosis H37Rv
cuccugguugaccucggugaa

SEQ ID NO: 3277293 - RNA, 19 nt, Mycobacterium tuberculosis H37Rv
cuccuguaacugcuccugg

SEQ ID NO: 3277294 - RNA, 17 nt, Mycobacterium tuberculosis H37Rv
cuccugugcgaugguca

SEQ ID NO: 3277295 - RNA, 18 nt, Mycobacterium tuberculosis H37Rv
cuccuguggggauuccgc

SEQ ID NO: 3277296 - RNA, 22 nt, Mycobacterium tuberculosis H37Rv
cuccuuaucgucgacgccgauc

SEQ ID NO: 3277297 - RNA, 22 nt, Mycobacterium tuberculosis H37Rv
cuccuugagcaaugacccgcgg

SEQ ID NO: 3277298 - RNA, 14 nt, Mycobacterium tuberculosis H37Rv
cuccuugagccggg

SEQ ID NO: 3277299 - RNA, 15 nt, Mycobacterium tuberculosis H37Rv
cuccuugagcuucuc

SEQ ID NO: 3277300 - RNA, 13 nt, Mycobacterium tuberculosis H37Rv
cuccuugagguca

SEQ ID NO: 3277301 - RNA, 16 nt, Mycobacterium tuberculosis H37Rv
cuccuuggcccagcgg

SEQ ID NO: 3277302 - RNA, 19 nt, Mycobacterium tuberculosis H37Rv
cucgaaaccguggccaucg

SEQ ID NO: 3277303 - RNA, 17 nt, Mycobacterium tuberculosis H37Rv
cucgaacagcucgauca

SEQ ID NO: 3277304 - RNA, 19 nt, Mycobacterium tuberculosis H37Rv
cucgaacagguuggccccg

SEQ ID NO: 3277305 - RNA, 12 nt, Mycobacterium tuberculosis H37Rv
cucgaacgcuga

SEQ ID NO: 3277306 - RNA, 19 nt, Mycobacterium tuberculosis H37Rv
cucgaacucggcggccagc

SEQ ID NO: 3277307 - RNA, 14 nt, Mycobacterium tuberculosis H37Rv
cucgaaggccgcca

SEQ ID NO: 3277308 - RNA, 15 nt, Mycobacterium tuberculosis H37Rv
cucgaaggcguucga

SEQ ID NO: 3277309 - RNA, 15 nt, Mycobacterium tuberculosis H37Rv
cucgaaguuggcuuu

SEQ ID NO: 3277310 - RNA, 14 nt, Mycobacterium tuberculosis H37Rv
cucgaauacaccuu

SEQ ID NO: 3277311 - RNA, 20 nt, Mycobacterium tuberculosis H37Rv
cucgaaucgucacggacccu

SEQ ID NO: 3277312 - RNA, 16 nt, Mycobacterium tuberculosis H37Rv
cucgaauucgcgcucu

SEQ ID NO: 3277313 - RNA, 18 nt, Mycobacterium tuberculosis H37Rv
cucgacaaagcggcugcc

SEQ ID NO: 3277314 - RNA, 12 nt, Mycobacterium tuberculosis H37Rv
cucgacaaccgc

SEQ ID NO: 3277315 - RNA, 22 nt, Mycobacterium tuberculosis H37Rv
cucgacacccagccgcagcccg

SEQ ID NO: 3277316 - RNA, 14 nt, Mycobacterium tuberculosis H37Rv
cucgacacugcagu

SEQ ID NO: 3277317 - RNA, 16 nt, Mycobacterium tuberculosis H37Rv
cucgacagcggcaauc

SEQ ID NO: 3277318 - RNA, 15 nt, Mycobacterium tuberculosis H37Rv
cucgacagugcugcc

SEQ ID NO: 3277319 - RNA, 23 nt, Mycobacterium tuberculosis H37Rv
cucgcccgccgccaccagcugcg

SEQ ID NO: 3277320 - RNA, 18 nt, Mycobacterium tuberculosis H37Rv
cucgcccugacgucacgu

SEQ ID NO: 3277321 - RNA, 19 nt, Mycobacterium tuberculosis H37Rv
cucgccgaaaucggccagc

SEQ ID NO: 3277322 - RNA, 20 nt, Mycobacterium tuberculosis H37Rv
cucgccgaaaucggccagcu

SEQ ID NO: 3277323 - RNA, 13 nt, Mycobacterium tuberculosis H37Rv
cucgccgaccagc

SEQ ID NO: 3277324 - RNA, 23 nt, Mycobacterium tuberculosis H37Rv
cucgccgaccagcuugaccgacc

SEQ ID NO: 3277325 - RNA, 16 nt, Mycobacterium tuberculosis H37Rv
cucgccgaccuuggcg

SEQ ID NO: 3277326 - RNA, 16 nt, Mycobacterium tuberculosis H37Rv
cucgccgacggcaagg

SEQ ID NO: 3277327 - RNA, 18 nt, Mycobacterium tuberculosis H37Rv
cucgccgagcagacacag

SEQ ID NO: 3277328 - RNA, 21 nt, Mycobacterium tuberculosis H37Rv
cucgccgaggccuaccaggcg

SEQ ID NO: 3277329 - RNA, 16 nt, Mycobacterium tuberculosis H37Rv
cucgccgcacgccggc

SEQ ID NO: 3277330 - RNA, 12 nt, Mycobacterium tuberculosis H37Rv
cucgccgccgcu

SEQ ID NO: 3277331 - RNA, 13 nt, Mycobacterium tuberculosis H37Rv
cucgccgcgcacc

SEQ ID NO: 3277332 - RNA, 17 nt, Mycobacterium tuberculosis H37Rv
cucgccgcgcaccgacc

SEQ ID NO: 3277333 - RNA, 16 nt, Mycobacterium tuberculosis H37Rv
cucgccggcacgcagc

SEQ ID NO: 3277334 - RNA, 15 nt, Mycobacterium tuberculosis H37Rv
cucgccggccgccag

SEQ ID NO: 3277335 - RNA, 15 nt, Mycobacterium tuberculosis H37Rv
cucgccggccgucag

SEQ ID NO: 3277336 - RNA, 16 nt, Mycobacterium tuberculosis H37Rv
cucgccggcgaagacc

SEQ ID NO: 3277337 - RNA, 20 nt, Mycobacterium tuberculosis H37Rv
cucgccggcggacgcccggc

SEQ ID NO: 3277338 - RNA, 14 nt, Mycobacterium tuberculosis H37Rv
cucgccgggcagcu

SEQ ID NO: 3277339 - RNA, 23 nt, Mycobacterium tuberculosis H37Rv
cucgccgguaggcggccagcgcg

SEQ ID NO: 3277340 - RNA, 15 nt, Mycobacterium tuberculosis H37Rv
cucgccggucagcgu

SEQ ID NO: 3277341 - RNA, 14 nt, Mycobacterium tuberculosis H37Rv
cucgccggugacgg

SEQ ID NO: 3277342 - RNA, 19 nt, Mycobacterium tuberculosis H37Rv
cucgccggugcgcgcugac

SEQ ID NO: 3277343 - RNA, 17 nt, Mycobacterium tuberculosis H37Rv
cucgccguaagcaccag

SEQ ID NO: 3277344 - RNA, 21 nt, Mycobacterium tuberculosis H37Rv
cucgccguacaucagcgcgaa

SEQ ID NO: 3277345 - RNA, 21 nt, Mycobacterium tuberculosis H37Rv
cucgccgucauagcaggccuc

SEQ ID NO: 3277346 - RNA, 16 nt, Mycobacterium tuberculosis H37Rv
cucgccgugaccaggu

SEQ ID NO: 3277347 - RNA, 15 nt, Mycobacterium tuberculosis H37Rv
cucgccguugauguc

SEQ ID NO: 3277348 - RNA, 16 nt, Mycobacterium tuberculosis H37Rv
cucgccugagcgcucg

SEQ ID NO: 3277349 - RNA, 16 nt, Mycobacterium tuberculosis H37Rv
cucgccugcacccggc

SEQ ID NO: 3277350 - RNA, 19 nt, Mycobacterium tuberculosis H37Rv
cucgccugcacgcccggcg

SEQ ID NO: 3277351 - RNA, 16 nt, Mycobacterium tuberculosis H37Rv
cucgccugugggugcu

SEQ ID NO: 3277352 - RNA, 14 nt, Mycobacterium tuberculosis H37Rv
cucgccuucgccgc

SEQ ID NO: 3277353 - RNA, 15 nt, Mycobacterium tuberculosis H37Rv
cucgcgaaaccgccg

SEQ ID NO: 3277354 - RNA, 19 nt, Mycobacterium tuberculosis H37Rv
cucgcgaaagagagcuaag

SEQ ID NO: 3277355 - RNA, 21 nt, Mycobacterium tuberculosis H37Rv
cucgcgaagccgguucgccca

SEQ ID NO: 3277356 - RNA, 22 nt, Mycobacterium tuberculosis H37Rv
cucgcgaagccgguucgcccag

SEQ ID NO: 3277357 - RNA, 15 nt, Mycobacterium tuberculosis H37Rv
cucgcgacaucaccg

SEQ ID NO: 3277358 - RNA, 16 nt, Mycobacterium tuberculosis H37Rv
cucgcgacaucaccga

SEQ ID NO: 3277359 - RNA, 23 nt, Mycobacterium tuberculosis H37Rv
cucgcgaggcucgcguggccgcc

SEQ ID NO: 3277360 - RNA, 23 nt, Mycobacterium tuberculosis H37Rv
cucgcgcaagcggacccgaccgu

SEQ ID NO: 3277361 - RNA, 15 nt, Mycobacterium tuberculosis H37Rv
cucgcgcaccgucau

SEQ ID NO: 3277362 - RNA, 20 nt, Mycobacterium tuberculosis H37Rv
cucgcgcaccugaucgguca

SEQ ID NO: 3277363 - RNA, 21 nt, Mycobacterium tuberculosis H37Rv
cucgcgccaggucggugacga

SEQ ID NO: 3277364 - RNA, 13 nt, Mycobacterium tuberculosis H37Rv
cucgcgccgguga

SEQ ID NO: 3277365 - RNA, 15 nt, Mycobacterium tuberculosis H37Rv
cucgcgcgcugggcg

SEQ ID NO: 3277366 - RNA, 14 nt, Mycobacterium tuberculosis H37Rv
cucgcgcucgaugg

SEQ ID NO: 3277367 - RNA, 14 nt, Mycobacterium tuberculosis H37Rv
cucgcgcuugcgcc

SEQ ID NO: 3277368 - RNA, 20 nt, Mycobacterium tuberculosis H37Rv
cucgcggaccucggcgaccu

SEQ ID NO: 3277369 - RNA, 16 nt, Mycobacterium tuberculosis H37Rv
cucgcggccggcgucg

SEQ ID NO: 3277370 - RNA, 18 nt, Mycobacterium tuberculosis H37Rv
cucgcggcgcggccgcag

SEQ ID NO: 3277371 - RNA, 21 nt, Mycobacterium tuberculosis H37Rv
cucgcgggccaaagccgucag

SEQ ID NO: 3277372 - RNA, 14 nt, Mycobacterium tuberculosis H37Rv
cucgcgggcgaucg

SEQ ID NO: 3277373 - RNA, 16 nt, Mycobacterium tuberculosis H37Rv
cucgcgggcggcgugg

SEQ ID NO: 3277374 - RNA, 22 nt, Mycobacterium tuberculosis H37Rv
cucgcgggugcuggucaacagc

SEQ ID NO: 3277375 - RNA, 19 nt, Mycobacterium tuberculosis H37Rv
cucgcggguugccucggcg

SEQ ID NO: 3277376 - RNA, 16 nt, Mycobacterium tuberculosis H37Rv
cucgcgguagcgccgu

SEQ ID NO: 3277377 - RNA, 16 nt, Mycobacterium tuberculosis H37Rv
cucgcggugggcuucc

SEQ ID NO: 3277378 - RNA, 17 nt, Mycobacterium tuberculosis H37Rv
cucgcguagggccagcg

SEQ ID NO: 3277379 - RNA, 15 nt, Mycobacterium tuberculosis H37Rv
cucgcuaacucccca

SEQ ID NO: 3277380 - RNA, 16 nt, Mycobacterium tuberculosis H37Rv
cucgcuaauugcggcc

SEQ ID NO: 3277381 - RNA, 15 nt, Mycobacterium tuberculosis H37Rv
cucgcucacgccguc

SEQ ID NO: 3277382 - RNA, 14 nt, Mycobacterium tuberculosis H37Rv
cucgcuccgaccgg

SEQ ID NO: 3277383 - RNA, 16 nt, Mycobacterium tuberculosis H37Rv
cucgcucugcgcggcu

SEQ ID NO: 3277384 - RNA, 14 nt, Mycobacterium tuberculosis H37Rv
cucgcugaccuugu

SEQ ID NO: 3277385 - RNA, 20 nt, Mycobacterium tuberculosis H37Rv
cucgcugaucaggucuucga

SEQ ID NO: 3277386 - RNA, 15 nt, Mycobacterium tuberculosis H37Rv
cucgcugcaccagcu

SEQ ID NO: 3277387 - RNA, 13 nt, Mycobacterium tuberculosis H37Rv
cucgcugcagcag

SEQ ID NO: 3277388 - RNA, 14 nt, Mycobacterium tuberculosis H37Rv
cucgcugcagcagg

SEQ ID NO: 3277389 - RNA, 20 nt, Mycobacterium tuberculosis H37Rv
cucgcugggaaaucccgacc

SEQ ID NO: 3277390 - RNA, 17 nt, Mycobacterium tuberculosis H37Rv
cucgcugggcucauggc

SEQ ID NO: 3277391 - RNA, 15 nt, Mycobacterium tuberculosis H37Rv
cucgcuguucgggac

SEQ ID NO: 3277392 - RNA, 16 nt, Mycobacterium tuberculosis H37Rv
cucgcuguugaagccg

SEQ ID NO: 3277393 - RNA, 18 nt, Mycobacterium tuberculosis H37Rv
cucgcuguugaagccgcc

SEQ ID NO: 3277394 - RNA, 16 nt, Mycobacterium tuberculosis H37Rv
cucgcuguuggccggu

SEQ ID NO: 3277395 - RNA, 15 nt, Mycobacterium tuberculosis H37Rv
cucggacacgcugua

SEQ ID NO: 3277396 - RNA, 20 nt, Mycobacterium tuberculosis H37Rv
cucggaccagacccacgaug

SEQ ID NO: 3277397 - RNA, 20 nt, Mycobacterium tuberculosis H37Rv
cucggagagguagggcucca

SEQ ID NO: 3277398 - RNA, 18 nt, Mycobacterium tuberculosis H37Rv
cucggagggggaccucuu

SEQ ID NO: 3277399 - RNA, 17 nt, Mycobacterium tuberculosis H37Rv
cucggaucggcucgcca

SEQ ID NO: 3277400 - RNA, 18 nt, Mycobacterium tuberculosis H37Rv
cucggaucggcucgccac

SEQ ID NO: 3277401 - RNA, 15 nt, Mycobacterium tuberculosis H37Rv
cucggcaaccaccuc

SEQ ID NO: 3277402 - RNA, 23 nt, Mycobacterium tuberculosis H37Rv
cucggcaaccaccucgugggcca

SEQ ID NO: 3277403 - RNA, 16 nt, Mycobacterium tuberculosis H37Rv
cucggcaagucgacgc

SEQ ID NO: 3277404 - RNA, 22 nt, Mycobacterium tuberculosis H37Rv
cucggcaagucgacgccgcagc

SEQ ID NO: 3277405 - RNA, 20 nt, Mycobacterium tuberculosis H37Rv
cucggcacccggcagagcac

SEQ ID NO: 3277406 - RNA, 15 nt, Mycobacterium tuberculosis H37Rv
cucggcagccggcuu

SEQ ID NO: 3277407 - RNA, 15 nt, Mycobacterium tuberculosis H37Rv
cucggcaggccgacc

SEQ ID NO: 3277408 - RNA, 16 nt, Mycobacterium tuberculosis H37Rv
cucggcauccaggcug

SEQ ID NO: 3277409 - RNA, 17 nt, Mycobacterium tuberculosis H37Rv
cucggcauccaggcugu

SEQ ID NO: 3277410 - RNA, 19 nt, Mycobacterium tuberculosis H37Rv
cucggcaugcagccccacu

SEQ ID NO: 3277411 - RNA, 12 nt, Mycobacterium tuberculosis H37Rv
cucggccaccag

SEQ ID NO: 3277412 - RNA, 13 nt, Mycobacterium tuberculosis H37Rv
cucggccaccagc

SEQ ID NO: 3277413 - RNA, 18 nt, Mycobacterium tuberculosis H37Rv
cucggccaccagcgcccg

SEQ ID NO: 3277414 - RNA, 22 nt, Mycobacterium tuberculosis H37Rv
cucggccaccagcgcccggccc

SEQ ID NO: 3277415 - RNA, 23 nt, Mycobacterium tuberculosis H37Rv
cucggguacaucgaggccacgcc

SEQ ID NO: 3277416 - RNA, 17 nt, Mycobacterium tuberculosis H37Rv
cucggguaccggcggca

SEQ ID NO: 3277417 - RNA, 16 nt, Mycobacterium tuberculosis H37Rv
cucgggugcgcccggc

SEQ ID NO: 3277418 - RNA, 16 nt, Mycobacterium tuberculosis H37Rv
cucggguugcagcagc

SEQ ID NO: 3277419 - RNA, 15 nt, Mycobacterium tuberculosis H37Rv
cucgguaggccggca

SEQ ID NO: 3277420 - RNA, 16 nt, Mycobacterium tuberculosis H37Rv
cucgguaggccggcaa

SEQ ID NO: 3277421 - RNA, 16 nt, Mycobacterium tuberculosis H37Rv
cucggucagccccaug

SEQ ID NO: 3277422 - RNA, 17 nt, Mycobacterium tuberculosis H37Rv
cucggucagcgucaggu

SEQ ID NO: 3277423 - RNA, 18 nt, Mycobacterium tuberculosis H37Rv
cucggucagcgucaggug

SEQ ID NO: 3277424 - RNA, 23 nt, Mycobacterium tuberculosis H37Rv
cucggucaggcggcuggcccgca

SEQ ID NO: 3277425 - RNA, 21 nt, Mycobacterium tuberculosis H37Rv
cucgguccaauuccagcucac

SEQ ID NO: 3277426 - RNA, 17 nt, Mycobacterium tuberculosis H37Rv
cucgguccacgggccgg

SEQ ID NO: 3277427 - RNA, 13 nt, Mycobacterium tuberculosis H37Rv
cucggucccgccg

SEQ ID NO: 3277428 - RNA, 14 nt, Mycobacterium tuberculosis H37Rv
cucggucgccaccg

SEQ ID NO: 3277429 - RNA, 13 nt, Mycobacterium tuberculosis H37Rv
cucggucucgucg

SEQ ID NO: 3277430 - RNA, 17 nt, Mycobacterium tuberculosis H37Rv
cucggugaacgccgccc

SEQ ID NO: 3277431 - RNA, 19 nt, Mycobacterium tuberculosis H37Rv
cucggugaaguggcgcacc

SEQ ID NO: 3277432 - RNA, 21 nt, Mycobacterium tuberculosis H37Rv
cucggugacaagcggcccgcu

SEQ ID NO: 3277433 - RNA, 22 nt, Mycobacterium tuberculosis H37Rv
cucggugaccaggccggcccgc

SEQ ID NO: 3277434 - RNA, 22 nt, Mycobacterium tuberculosis H37Rv
cucggugacgucgccgggcggc

SEQ ID NO: 3277435 - RNA, 15 nt, Mycobacterium tuberculosis H37Rv
cucggugaucucgcg

SEQ ID NO: 3277436 - RNA, 16 nt, Mycobacterium tuberculosis H37Rv
cucggugaucucgcgc

SEQ ID NO: 3277437 - RNA, 21 nt, Mycobacterium tuberculosis H37Rv
cucggugaucucgcgcuccca

SEQ ID NO: 3277438 - RNA, 14 nt, Mycobacterium tuberculosis H37Rv
cucggugcagcagc

SEQ ID NO: 3277439 - RNA, 19 nt, Mycobacterium tuberculosis H37Rv
cucggugcagcagcgcgcg

SEQ ID NO: 3277440 - RNA, 16 nt, Mycobacterium tuberculosis H37Rv
cucggugccacugccg

SEQ ID NO: 3277441 - RNA, 13 nt, Mycobacterium tuberculosis H37Rv
cucggugccgccc

SEQ ID NO: 3277442 - RNA, 19 nt, Mycobacterium tuberculosis H37Rv
cucggugccugucagaagg

SEQ ID NO: 3277443 - RNA, 15 nt, Mycobacterium tuberculosis H37Rv
cucggugcgccagau

SEQ ID NO: 3277444 - RNA, 19 nt, Mycobacterium tuberculosis H37Rv
cucggugcugcgccgauac

SEQ ID NO: 3277445 - RNA, 14 nt, Mycobacterium tuberculosis H37Rv
cucgguggacggca

SEQ ID NO: 3277446 - RNA, 16 nt, Mycobacterium tuberculosis H37Rv
cucgguggccuucugg

SEQ ID NO: 3277447 - RNA, 14 nt, Mycobacterium tuberculosis H37Rv
cucgguggcggacg

SEQ ID NO: 3277448 - RNA, 22 nt, Mycobacterium tuberculosis H37Rv
cucgguggugaccaaguagucg

SEQ ID NO: 3277449 - RNA, 13 nt, Mycobacterium tuberculosis H37Rv
cucgguucgcccc

SEQ ID NO: 3277450 - RNA, 23 nt, Mycobacterium tuberculosis H37Rv
cucgguucggagucacgcagccg

SEQ ID NO: 3277451 - RNA, 17 nt, Mycobacterium tuberculosis H37Rv
cucgguugguccucggc

SEQ ID NO: 3277452 - RNA, 18 nt, Mycobacterium tuberculosis H37Rv
cucgguuugcguccuggu

SEQ ID NO: 3277453 - RNA, 19 nt, Mycobacterium tuberculosis H37Rv
cucgguuugcguccuggug

SEQ ID NO: 3277454 - RNA, 22 nt, Mycobacterium tuberculosis H37Rv
cucgguuugggaauccgcaucu

SEQ ID NO: 3277455 - RNA, 15 nt, Mycobacterium tuberculosis H37Rv
cucguaacgcggcac

SEQ ID NO: 3277456 - RNA, 18 nt, Mycobacterium tuberculosis H37Rv
cucguagaaucggcucag

SEQ ID NO: 3277457 - RNA, 17 nt, Mycobacterium tuberculosis H37Rv
cucguagacuugcugcu

SEQ ID NO: 3277458 - RNA, 16 nt, Mycobacterium tuberculosis H37Rv
cucguagagcaccgca

SEQ ID NO: 3277459 - RNA, 16 nt, Mycobacterium tuberculosis H37Rv
cucguaggugaagagc

SEQ ID NO: 3277460 - RNA, 15 nt, Mycobacterium tuberculosis H37Rv
cucguaggugccgaa

SEQ ID NO: 3277461 - RNA, 20 nt, Mycobacterium tuberculosis H37Rv
cucguccaagccggccacgc

SEQ ID NO: 3277462 - RNA, 22 nt, Mycobacterium tuberculosis H37Rv
cucguccaagccggccacgcau

SEQ ID NO: 3277463 - RNA, 21 nt, Mycobacterium tuberculosis H37Rv
cucguccaccacaccugcggc

SEQ ID NO: 3277464 - RNA, 14 nt, Mycobacterium tuberculosis H37Rv
cucguccagcaacc

SEQ ID NO: 3277465 - RNA, 16 nt, Mycobacterium tuberculosis H37Rv
cucguccagcagugcg

SEQ ID NO: 3277466 - RNA, 17 nt, Mycobacterium tuberculosis H37Rv
cucguccaggucggccg

SEQ ID NO: 3277467 - RNA, 18 nt, Mycobacterium tuberculosis H37Rv
cucguccaggucggccgc

SEQ ID NO: 3277468 - RNA, 16 nt, Mycobacterium tuberculosis H37Rv
cucguccggugcgauc

SEQ ID NO: 3277469 - RNA, 23 nt, Mycobacterium tuberculosis H37Rv
cucguccugacgguacagcucca

SEQ ID NO: 3277470 - RNA, 19 nt, Mycobacterium tuberculosis H37Rv
cucgucgaaguagccgacg

SEQ ID NO: 3277471 - RNA, 22 nt, Mycobacterium tuberculosis H37Rv
cucgucgagagguucgccgucg

SEQ ID NO: 3277472 - RNA, 16 nt, Mycobacterium tuberculosis H37Rv
cucgucgagccgaccg

SEQ ID NO: 3277473 - RNA, 18 nt, Mycobacterium tuberculosis H37Rv
cucgucgagccgaccgcg

SEQ ID NO: 3277474 - RNA, 23 nt, Mycobacterium tuberculosis H37Rv
cucgucgagcgcgucggucaccg

SEQ ID NO: 3277475 - RNA, 18 nt, Mycobacterium tuberculosis H37Rv
cucgucgaggcugaccgu

SEQ ID NO: 3277476 - RNA, 17 nt, Mycobacterium tuberculosis H37Rv
cucgucgaucucgaucg

SEQ ID NO: 3277477 - RNA, 22 nt, Mycobacterium tuberculosis H37Rv
cucgucgaugucguuggccacc

SEQ ID NO: 3277478 - RNA, 19 nt, Mycobacterium tuberculosis H37Rv
cucgucgcaucaccagggu

SEQ ID NO: 3277479 - RNA, 21 nt, Mycobacterium tuberculosis H37Rv
cucgucgccgguggcacccgc

SEQ ID NO: 3277480 - RNA, 12 nt, Mycobacterium tuberculosis H37Rv
cucgucgccugc

SEQ ID NO: 3277481 - RNA, 17 nt, Mycobacterium tuberculosis H37Rv
cucgucgcgggccaccg

SEQ ID NO: 3277482 - RNA, 18 nt, Mycobacterium tuberculosis H37Rv
cucgucgcgggccaccgc

SEQ ID NO: 3277483 - RNA, 15 nt, Mycobacterium tuberculosis H37Rv
cucgucgcugcccau

SEQ ID NO: 3277484 - RNA, 14 nt, Mycobacterium tuberculosis H37Rv
cucgucggccagug

SEQ ID NO: 3277485 - RNA, 16 nt, Mycobacterium tuberculosis H37Rv
cucgucggccagugcg

SEQ ID NO: 3277486 - RNA, 24 nt, Mycobacterium tuberculosis H37Rv
cucgucggccagugcgcgcgucac

SEQ ID NO: 3277487 - RNA, 21 nt, Mycobacterium tuberculosis H37Rv
cucgucggccgacaccgccac

SEQ ID NO: 3277488 - RNA, 23 nt, Mycobacterium tuberculosis H37Rv
cucgucggcgaagguguccucca

SEQ ID NO: 3277489 - RNA, 19 nt, Mycobacterium tuberculosis H37Rv
cucgucggcgacggccagc

SEQ ID NO: 3277490 - RNA, 16 nt, Mycobacterium tuberculosis H37Rv
cucgucggcgccggcg

SEQ ID NO: 3277491 - RNA, 21 nt, Mycobacterium tuberculosis H37Rv
cucgucggcgccggcggccgc

SEQ ID NO: 3277492 - RNA, 20 nt, Mycobacterium tuberculosis H37Rv
cucgucgggcagauucuuca

SEQ ID NO: 3277493 - RNA, 14 nt, Mycobacterium tuberculosis H37Rv
cucgucggucaccg

SEQ ID NO: 3277494 - RNA, 15 nt, Mycobacterium tuberculosis H37Rv
cucgucggucaccga

SEQ ID NO: 3277495 - RNA, 15 nt, Mycobacterium tuberculosis H37Rv
cucgucggugucggu

SEQ ID NO: 3277496 - RNA, 23 nt, Mycobacterium tuberculosis H37Rv
cucgucggugugccagugcugca

SEQ ID NO: 3277497 - RNA, 16 nt, Mycobacterium tuberculosis H37Rv
cucgucguccggccac

SEQ ID NO: 3277498 - RNA, 16 nt, Mycobacterium tuberculosis H37Rv
cucgucgucgauccag

SEQ ID NO: 3277499 - RNA, 18 nt, Mycobacterium tuberculosis H37Rv
cucgucgucgauccagcc

SEQ ID NO: 3277500 - RNA, 23 nt, Mycobacterium tuberculosis H37Rv
cucgucgugagacugggcgcugg

SEQ ID NO: 3277501 - RNA, 21 nt, Mycobacterium tuberculosis H37Rv
cucgucgugagucacccggcc

SEQ ID NO: 3277502 - RNA, 18 nt, Mycobacterium tuberculosis H37Rv
cucgugacagcggcgauc

SEQ ID NO: 3277503 - RNA, 13 nt, Mycobacterium tuberculosis H37Rv
cucgugcacgcac

SEQ ID NO: 3277504 - RNA, 13 nt, Mycobacterium tuberculosis H37Rv
cucgugcagcacu

SEQ ID NO: 3277505 - RNA, 16 nt, Mycobacterium tuberculosis H37Rv
cucgugcaggaccagc

SEQ ID NO: 3277506 - RNA, 14 nt, Mycobacterium tuberculosis H37Rv
cucgugcgcaucgu

SEQ ID NO: 3277507 - RNA, 18 nt, Mycobacterium tuberculosis H37Rv
cucgugcggcgcucccgc

SEQ ID NO: 3277508 - RNA, 19 nt, Mycobacterium tuberculosis H37Rv
cucgugcgugggcgcggcg

SEQ ID NO: 3277509 - RNA, 15 nt, Mycobacterium tuberculosis H37Rv
cucguggaucugccu

SEQ ID NO: 3277510 - RNA, 17 nt, Mycobacterium tuberculosis H37Rv
cucguggaucugccucu

SEQ ID NO: 3277511 - RNA, 18 nt, Mycobacterium tuberculosis H37Rv
cugaccgguucccgggca

SEQ ID NO: 3277512 - RNA, 20 nt, Mycobacterium tuberculosis H37Rv
cugaccgguucccgggcagc

SEQ ID NO: 3277513 - RNA, 21 nt, Mycobacterium tuberculosis H37Rv
cugaccgguucccgggcagcc

SEQ ID NO: 3277514 - RNA, 21 nt, Mycobacterium tuberculosis H37Rv
cugaccgucugcgacccgggc

SEQ ID NO: 3277515 - RNA, 14 nt, Mycobacterium tuberculosis H37Rv
cugaccgugcugaa

SEQ ID NO: 3277516 - RNA, 22 nt, Mycobacterium tuberculosis H37Rv
cugaccucgucaaucaccaccg

SEQ ID NO: 3277517 - RNA, 22 nt, Mycobacterium tuberculosis H37Rv
cugacgaaucgccuaccggccu

SEQ ID NO: 3277518 - RNA, 17 nt, Mycobacterium tuberculosis H37Rv
cugacgaccggcuaccg

SEQ ID NO: 3277519 - RNA, 22 nt, Mycobacterium tuberculosis H37Rv
cugacgacgagggccagcagcc

SEQ ID NO: 3277520 - RNA, 13 nt, Mycobacterium tuberculosis H37Rv
cugacgacugggc

SEQ ID NO: 3277521 - RNA, 15 nt, Mycobacterium tuberculosis H37Rv
cugacgacugggcgc

SEQ ID NO: 3277522 - RNA, 22 nt, Mycobacterium tuberculosis H37Rv
cugacgagcagcuagcccggca

SEQ ID NO: 3277523 - RNA, 13 nt, Mycobacterium tuberculosis H37Rv
cugacgaguugau

SEQ ID NO: 3277524 - RNA, 14 nt, Mycobacterium tuberculosis H37Rv
cugacgauggccag

SEQ ID NO: 3277525 - RNA, 15 nt, Mycobacterium tuberculosis H37Rv
cugacgccauucauc

SEQ ID NO: 3277526 - RNA, 17 nt, Mycobacterium tuberculosis H37Rv
cugacgcccucauaggc

SEQ ID NO: 3277527 - RNA, 16 nt, Mycobacterium tuberculosis H37Rv
cugacgccgagcuggu

SEQ ID NO: 3277528 - RNA, 22 nt, Mycobacterium tuberculosis H37Rv
cugacgcgucagcggcgagcag

SEQ ID NO: 3277529 - RNA, 12 nt, Mycobacterium tuberculosis H37Rv
cugacgcugcag

SEQ ID NO: 3277530 - RNA, 15 nt, Mycobacterium tuberculosis H37Rv
cugacggcaaacgac

SEQ ID NO: 3277531 - RNA, 15 nt, Mycobacterium tuberculosis H37Rv
cugacggcgcaacac

SEQ ID NO: 3277532 - RNA, 13 nt, Mycobacterium tuberculosis H37Rv
cugacgggccgcu

SEQ ID NO: 3277533 - RNA, 23 nt, Mycobacterium tuberculosis H37Rv
cugacgguuugcggagcaagagc

SEQ ID NO: 3277534 - RNA, 17 nt, Mycobacterium tuberculosis H37Rv
cugacgucacguucggc

SEQ ID NO: 3277535 - RNA, 20 nt, Mycobacterium tuberculosis H37Rv
cugacgucacguucggcgca

SEQ ID NO: 3277536 - RNA, 21 nt, Mycobacterium tuberculosis H37Rv
cugacgucacguucggcgcaa

SEQ ID NO: 3277537 - RNA, 21 nt, Mycobacterium tuberculosis H37Rv
cugacgucgaacucccacugc

SEQ ID NO: 3277538 - RNA, 14 nt, Mycobacterium tuberculosis H37Rv
cugacuaccgucau

SEQ ID NO: 3277539 - RNA, 22 nt, Mycobacterium tuberculosis H37Rv
cugacuagggucaccgacacgg

SEQ ID NO: 3277540 - RNA, 18 nt, Mycobacterium tuberculosis H37Rv
cugacuccugcggcaccg

SEQ ID NO: 3277541 - RNA, 20 nt, Mycobacterium tuberculosis H37Rv
cugacuccugcggcaccgcu

SEQ ID NO: 3277542 - RNA, 16 nt, Mycobacterium tuberculosis H37Rv
cugagaccucagccgg

SEQ ID NO: 3277543 - RNA, 15 nt, Mycobacterium tuberculosis H37Rv
cugagacucgucgau

SEQ ID NO: 3277544 - RNA, 14 nt, Mycobacterium tuberculosis H37Rv
cugagacugccgcc

SEQ ID NO: 3277545 - RNA, 17 nt, Mycobacterium tuberculosis H37Rv
cugagagaguaucgacc

SEQ ID NO: 3277546 - RNA, 21 nt, Mycobacterium tuberculosis H37Rv
cugagaucgcuucccggaagc

SEQ ID NO: 3277547 - RNA, 13 nt, Mycobacterium tuberculosis H37Rv
cugagaugaugcg

SEQ ID NO: 3277548 - RNA, 16 nt, Mycobacterium tuberculosis H37Rv
cugagaugaugcguga

SEQ ID NO: 3277549 - RNA, 14 nt, Mycobacterium tuberculosis H37Rv
cugagaugggccac

SEQ ID NO: 3277550 - RNA, 16 nt, Mycobacterium tuberculosis H37Rv
cugagaugggccaccc

SEQ ID NO: 3277551 - RNA, 20 nt, Mycobacterium tuberculosis H37Rv
cugagccccccgagcccgcc

SEQ ID NO: 3277552 - RNA, 14 nt, Mycobacterium tuberculosis H37Rv
cugagcgacugcag

SEQ ID NO: 3277553 - RNA, 16 nt, Mycobacterium tuberculosis H37Rv
cugagcgagcucccgg

SEQ ID NO: 3277554 - RNA, 16 nt, Mycobacterium tuberculosis H37Rv
cugagcgccaggccgc

SEQ ID NO: 3277555 - RNA, 18 nt, Mycobacterium tuberculosis H37Rv
cugagcgccaggccgcac

SEQ ID NO: 3277556 - RNA, 23 nt, Mycobacterium tuberculosis H37Rv
cugagcgccaggccgcacagcac

SEQ ID NO: 3277557 - RNA, 16 nt, Mycobacterium tuberculosis H37Rv
cugagcggccaucggg

SEQ ID NO: 3277558 - RNA, 14 nt, Mycobacterium tuberculosis H37Rv
cugagcgggcgggc

SEQ ID NO: 3277559 - RNA, 18 nt, Mycobacterium tuberculosis H37Rv
cugagcguccgacaacga

SEQ ID NO: 3277560 - RNA, 14 nt, Mycobacterium tuberculosis H37Rv
cugagcgucgucgc

SEQ ID NO: 3277561 - RNA, 12 nt, Mycobacterium tuberculosis H37Rv
cugagcugccga

SEQ ID NO: 3277562 - RNA, 15 nt, Mycobacterium tuberculosis H37Rv
cugagcugccgagcg

SEQ ID NO: 3277563 - RNA, 22 nt, Mycobacterium tuberculosis H37Rv
cugagcugcucgccggccaacu

SEQ ID NO: 3277564 - RNA, 16 nt, Mycobacterium tuberculosis H37Rv
cugaggaaagucaccg

SEQ ID NO: 3277565 - RNA, 17 nt, Mycobacterium tuberculosis H37Rv
cugaggaacgccggcau

SEQ ID NO: 3277566 - RNA, 17 nt, Mycobacterium tuberculosis H37Rv
cugaggaagcggcggca

SEQ ID NO: 3277567 - RNA, 12 nt, Mycobacterium tuberculosis H37Rv
cugaggcaccuc

SEQ ID NO: 3277568 - RNA, 23 nt, Mycobacterium tuberculosis H37Rv
cugagggcggaaaaucggcuggc

SEQ ID NO: 3277569 - RNA, 14 nt, Mycobacterium tuberculosis H37Rv
cugaggugcugcca

SEQ ID NO: 3277570 - RNA, 15 nt, Mycobacterium tuberculosis H37Rv
cugaggugcugccaa

SEQ ID NO: 3277571 - RNA, 18 nt, Mycobacterium tuberculosis H37Rv
cugaguccccaggugggc

SEQ ID NO: 3277572 - RNA, 16 nt, Mycobacterium tuberculosis H37Rv
cugaguggcgaguggc

SEQ ID NO: 3277573 - RNA, 18 nt, Mycobacterium tuberculosis H37Rv
cugaguugcgggcuuuga

SEQ ID NO: 3277574 - RNA, 20 nt, Mycobacterium tuberculosis H37Rv
cugauagcggucggucacca

SEQ ID NO: 3277575 - RNA, 13 nt, Mycobacterium tuberculosis H37Rv
cugauagggcugu

SEQ ID NO: 3277576 - RNA, 17 nt, Mycobacterium tuberculosis H37Rv
cugauauccggaaccgg

SEQ ID NO: 3277577 - RNA, 13 nt, Mycobacterium tuberculosis H37Rv
cugaucaggccac

SEQ ID NO: 3277578 - RNA, 16 nt, Mycobacterium tuberculosis H37Rv
cugaucaggccacacu

SEQ ID NO: 3277579 - RNA, 20 nt, Mycobacterium tuberculosis H37Rv
cugaucaggccacacuugca

SEQ ID NO: 3277580 - RNA, 19 nt, Mycobacterium tuberculosis H37Rv
cugaucaggccgaugacga

SEQ ID NO: 3277581 - RNA, 21 nt, Mycobacterium tuberculosis H37Rv
cugauccacgauaucgaugcg

SEQ ID NO: 3277582 - RNA, 17 nt, Mycobacterium tuberculosis H37Rv
cugaucccggccaggcc

SEQ ID NO: 3277583 - RNA, 18 nt, Mycobacterium tuberculosis H37Rv
cugaucccggccaggccg

SEQ ID NO: 3277584 - RNA, 23 nt, Mycobacterium tuberculosis H37Rv
cugauccggguggcgucaccgcc

SEQ ID NO: 3277585 - RNA, 15 nt, Mycobacterium tuberculosis H37Rv
cugaucgccacccgg

SEQ ID NO: 3277586 - RNA, 16 nt, Mycobacterium tuberculosis H37Rv
cugaucgccacccggu

SEQ ID NO: 3277587 - RNA, 15 nt, Mycobacterium tuberculosis H37Rv
cugaucuaccagugg

SEQ ID NO: 3277588 - RNA, 14 nt, Mycobacterium tuberculosis H37Rv
cugaucugcguugc

SEQ ID NO: 3277589 - RNA, 19 nt, Mycobacterium tuberculosis H37Rv
cugaucuuccccucggccg

SEQ ID NO: 3277590 - RNA, 21 nt, Mycobacterium tuberculosis H37Rv
cugaugaaccacggcaggcag

SEQ ID NO: 3277591 - RNA, 22 nt, Mycobacterium tuberculosis H37Rv
cugaugaagaugauuucgccga

SEQ ID NO: 3277592 - RNA, 16 nt, Mycobacterium tuberculosis H37Rv
cugaugagcucaccgg

SEQ ID NO: 3277593 - RNA, 17 nt, Mycobacterium tuberculosis H37Rv
cugauggcgcugcaccg

SEQ ID NO: 3277594 - RNA, 19 nt, Mycobacterium tuberculosis H37Rv
cugaugugaguccagccgg

SEQ ID NO: 3277595 - RNA, 17 nt, Mycobacterium tuberculosis H37Rv
cugauuccacugggccu

SEQ ID NO: 3277596 - RNA, 13 nt, Mycobacterium tuberculosis H37Rv
cugauugaagccc

SEQ ID NO: 3277597 - RNA, 19 nt, Mycobacterium tuberculosis H37Rv
cugauugagguagaccugg

SEQ ID NO: 3277598 - RNA, 21 nt, Mycobacterium tuberculosis H37Rv
cugauuucuuuaaaccccugg

SEQ ID NO: 3277599 - RNA, 22 nt, Mycobacterium tuberculosis H37Rv
cugcaacacgcgaugcacgccc

SEQ ID NO: 3277600 - RNA, 13 nt, Mycobacterium tuberculosis H37Rv
cugcaaccgccgg

SEQ ID NO: 3277601 - RNA, 23 nt, Mycobacterium tuberculosis H37Rv
cugcaacgauugaacucugguga

SEQ ID NO: 3277602 - RNA, 20 nt, Mycobacterium tuberculosis H37Rv
cugcaagcuaagcgccugau

SEQ ID NO: 3277603 - RNA, 15 nt, Mycobacterium tuberculosis H37Rv
cugcaaugccucgac

SEQ ID NO: 3277604 - RNA, 21 nt, Mycobacterium tuberculosis H37Rv
cugcacaacguggugucucgg

SEQ ID NO: 3277605 - RNA, 17 nt, Mycobacterium tuberculosis H37Rv
cugcacacugccgcgcu

SEQ ID NO: 3277606 - RNA, 13 nt, Mycobacterium tuberculosis H37Rv
cugcacagcaggc

SEQ ID NO: 3277607 - RNA, 17 nt, Mycobacterium tuberculosis H37Rv
cugcccagcagaccaag

SEQ ID NO: 3277608 - RNA, 22 nt, Mycobacterium tuberculosis H37Rv
cugcccaguguccggcgacgcg

SEQ ID NO: 3277609 - RNA, 16 nt, Mycobacterium tuberculosis H37Rv
cugcccaugcggcagg

SEQ ID NO: 3277610 - RNA, 13 nt, Mycobacterium tuberculosis H37Rv
cugccccagcaca

SEQ ID NO: 3277611 - RNA, 17 nt, Mycobacterium tuberculosis H37Rv
cugcccccggcgcggcg

SEQ ID NO: 3277612 - RNA, 23 nt, Mycobacterium tuberculosis H37Rv
cugcccccggcgcggcggaccgu

SEQ ID NO: 3277613 - RNA, 16 nt, Mycobacterium tuberculosis H37Rv
cugccccgcaucgccc

SEQ ID NO: 3277614 - RNA, 23 nt, Mycobacterium tuberculosis H37Rv
cugccccgcaucgcccaagccgu

SEQ ID NO: 3277615 - RNA, 14 nt, Mycobacterium tuberculosis H37Rv
cugccccgccaccu

SEQ ID NO: 3277616 - RNA, 12 nt, Mycobacterium tuberculosis H37Rv
cugccccuccgg

SEQ ID NO: 3277617 - RNA, 16 nt, Mycobacterium tuberculosis H37Rv
cugcccgacgaccauu

SEQ ID NO: 3277618 - RNA, 23 nt, Mycobacterium tuberculosis H37Rv
cugcccgagaucgcgugcgacga

SEQ ID NO: 3277619 - RNA, 21 nt, Mycobacterium tuberculosis H37Rv
cugcccgaugaucugugccgc

SEQ ID NO: 3277620 - RNA, 18 nt, Mycobacterium tuberculosis H37Rv
cugcccgauguuacggcc

SEQ ID NO: 3277621 - RNA, 13 nt, Mycobacterium tuberculosis H37Rv
cugcccgccagcg

SEQ ID NO: 3277622 - RNA, 15 nt, Mycobacterium tuberculosis H37Rv
cugcccgccagcgcc

SEQ ID NO: 3277623 - RNA, 18 nt, Mycobacterium tuberculosis H37Rv
cugcccgccagcgccgcc

SEQ ID NO: 3277624 - RNA, 19 nt, Mycobacterium tuberculosis H37Rv
cugcccgccgacgccagau

SEQ ID NO: 3277625 - RNA, 21 nt, Mycobacterium tuberculosis H37Rv
cugcccgcgcggccaaucagc

SEQ ID NO: 3277626 - RNA, 18 nt, Mycobacterium tuberculosis H37Rv
cugcccgcggugugcacg

SEQ ID NO: 3277627 - RNA, 17 nt, Mycobacterium tuberculosis H37Rv
cugcccggcccgcucag

SEQ ID NO: 3277628 - RNA, 19 nt, Mycobacterium tuberculosis H37Rv
cugcccggcccgcucagcc

SEQ ID NO: 3277629 - RNA, 17 nt, Mycobacterium tuberculosis H37Rv
cugcccgggcugccgcc

SEQ ID NO: 3277630 - RNA, 17 nt, Mycobacterium tuberculosis H37Rv
cugcccggggugcugac

SEQ ID NO: 3277631 - RNA, 21 nt, Mycobacterium tuberculosis H37Rv
cugcccuccgugggcagcgcg

SEQ ID NO: 3277632 - RNA, 22 nt, Mycobacterium tuberculosis H37Rv
cugcccuccgugggcagcgcgc

SEQ ID NO: 3277633 - RNA, 22 nt, Mycobacterium tuberculosis H37Rv
cugcccuuguugaaguaaugga

SEQ ID NO: 3277634 - RNA, 16 nt, Mycobacterium tuberculosis H37Rv
cugccgaaacgccgac

SEQ ID NO: 3277635 - RNA, 17 nt, Mycobacterium tuberculosis H37Rv
cugccgaaacgccgacc

SEQ ID NO: 3277636 - RNA, 20 nt, Mycobacterium tuberculosis H37Rv
cugccgaacaguucggcgag

SEQ ID NO: 3277637 - RNA, 16 nt, Mycobacterium tuberculosis H37Rv
cugccgaagcggccac

SEQ ID NO: 3277638 - RNA, 17 nt, Mycobacterium tuberculosis H37Rv
cugccgaagcggccacc

SEQ ID NO: 3277639 - RNA, 23 nt, Mycobacterium tuberculosis H37Rv
cugccgacaguuuaccgugccgc

SEQ ID NO: 3277640 - RNA, 15 nt, Mycobacterium tuberculosis H37Rv
cugccgaccagcgcg

SEQ ID NO: 3277641 - RNA, 17 nt, Mycobacterium tuberculosis H37Rv
cugccgaccagcgcgcu

SEQ ID NO: 3277642 - RNA, 14 nt, Mycobacterium tuberculosis H37Rv
cugccgagcagacg

SEQ ID NO: 3277643 - RNA, 21 nt, Mycobacterium tuberculosis H37Rv
cugccgaucgggcucacucgc

SEQ ID NO: 3277644 - RNA, 23 nt, Mycobacterium tuberculosis H37Rv
cugccgauguguggaacauccgc

SEQ ID NO: 3277645 - RNA, 22 nt, Mycobacterium tuberculosis H37Rv
cugccgcacacgcgugcacgau

SEQ ID NO: 3277646 - RNA, 14 nt, Mycobacterium tuberculosis H37Rv
cugccgcacccggu

SEQ ID NO: 3277647 - RNA, 22 nt, Mycobacterium tuberculosis H37Rv
cugccgcacccggucgagcguu

SEQ ID NO: 3277648 - RNA, 15 nt, Mycobacterium tuberculosis H37Rv
cugccgcaccggugc

SEQ ID NO: 3277649 - RNA, 21 nt, Mycobacterium tuberculosis H37Rv
cugccgcccuugccgcccgcu

SEQ ID NO: 3277650 - RNA, 14 nt, Mycobacterium tuberculosis H37Rv
cugccgccggcccc

SEQ ID NO: 3277651 - RNA, 14 nt, Mycobacterium tuberculosis H37Rv
cugccgcgccgacg

SEQ ID NO: 3277652 - RNA, 15 nt, Mycobacterium tuberculosis H37Rv
cugccgcgcgcccgc

SEQ ID NO: 3277653 - RNA, 14 nt, Mycobacterium tuberculosis H37Rv
cugccgcgcgcugc

SEQ ID NO: 3277654 - RNA, 14 nt, Mycobacterium tuberculosis H37Rv
cugccgcgcggcga

SEQ ID NO: 3277655 - RNA, 14 nt, Mycobacterium tuberculosis H37Rv
cugccgcgcucgcg

SEQ ID NO: 3277656 - RNA, 18 nt, Mycobacterium tuberculosis H37Rv
cugccgcgcucgcgcacc

SEQ ID NO: 3277657 - RNA, 14 nt, Mycobacterium tuberculosis H37Rv
cugccgcggcaccg

SEQ ID NO: 3277658 - RNA, 20 nt, Mycobacterium tuberculosis H37Rv
cugccgcguagaacccaggc

SEQ ID NO: 3277659 - RNA, 22 nt, Mycobacterium tuberculosis H37Rv
cugccgcguagaacccaggccg

SEQ ID NO: 3277660 - RNA, 19 nt, Mycobacterium tuberculosis H37Rv
cugccgcucgccgguaggc

SEQ ID NO: 3277661 - RNA, 17 nt, Mycobacterium tuberculosis H37Rv
cugccgcugccgaagcg

SEQ ID NO: 3277662 - RNA, 12 nt, Mycobacterium tuberculosis H37Rv
cugccgcugguc

SEQ ID NO: 3277663 - RNA, 20 nt, Mycobacterium tuberculosis H37Rv
cugccggaccaccgggccga

SEQ ID NO: 3277664 - RNA, 18 nt, Mycobacterium tuberculosis H37Rv
cugccggcaacagcucgc

SEQ ID NO: 3277665 - RNA, 19 nt, Mycobacterium tuberculosis H37Rv
cugccggcaacagcucgcc

SEQ ID NO: 3277666 - RNA, 17 nt, Mycobacterium tuberculosis H37Rv
cugccggcacgcaugcc

SEQ ID NO: 3277667 - RNA, 14 nt, Mycobacterium tuberculosis H37Rv
cugccggcagcguc

SEQ ID NO: 3277668 - RNA, 17 nt, Mycobacterium tuberculosis H37Rv
cugccggcagcguccga

SEQ ID NO: 3277669 - RNA, 14 nt, Mycobacterium tuberculosis H37Rv
cugccggcccacca

SEQ ID NO: 3277670 - RNA, 15 nt, Mycobacterium tuberculosis H37Rv
cugccggccggcggg

SEQ ID NO: 3277671 - RNA, 14 nt, Mycobacterium tuberculosis H37Rv
cugccggcgccgcc

SEQ ID NO: 3277672 - RNA, 15 nt, Mycobacterium tuberculosis H37Rv
cugccggcgccgcca

SEQ ID NO: 3277673 - RNA, 15 nt, Mycobacterium tuberculosis H37Rv
cugccgggcgcgcgu

SEQ ID NO: 3277674 - RNA, 24 nt, Mycobacterium tuberculosis H37Rv
cugccggguggguaauacaggccg

SEQ ID NO: 3277675 - RNA, 17 nt, Mycobacterium tuberculosis H37Rv
cugccgguagcacagca

SEQ ID NO: 3277676 - RNA, 16 nt, Mycobacterium tuberculosis H37Rv
cugccggucgaugucg

SEQ ID NO: 3277677 - RNA, 14 nt, Mycobacterium tuberculosis H37Rv
cugccggugggcgu

SEQ ID NO: 3277678 - RNA, 21 nt, Mycobacterium tuberculosis H37Rv
cugccggugucucccuugccg

SEQ ID NO: 3277679 - RNA, 20 nt, Mycobacterium tuberculosis H37Rv
cugccggugugcggcguacu

SEQ ID NO: 3277680 - RNA, 19 nt, Mycobacterium tuberculosis H37Rv
cugccgguuuccgucugac

SEQ ID NO: 3277681 - RNA, 23 nt, Mycobacterium tuberculosis H37Rv
cugccguauccaggcgugcaucg

SEQ ID NO: 3277682 - RNA, 15 nt, Mycobacterium tuberculosis H37Rv
cugccgucuccuggu

SEQ ID NO: 3277683 - RNA, 12 nt, Mycobacterium tuberculosis H37Rv
cugccgucucgu

SEQ ID NO: 3277684 - RNA, 15 nt, Mycobacterium tuberculosis H37Rv
cugccgucucgucgg

SEQ ID NO: 3277685 - RNA, 17 nt, Mycobacterium tuberculosis H37Rv
cugccguggcggcagcg

SEQ ID NO: 3277686 - RNA, 16 nt, Mycobacterium tuberculosis H37Rv
cugccguucggggcgc

SEQ ID NO: 3277687 - RNA, 16 nt, Mycobacterium tuberculosis H37Rv
cugccguugggcaccg

SEQ ID NO: 3277688 - RNA, 12 nt, Mycobacterium tuberculosis H37Rv
cugccucaccgc

SEQ ID NO: 3277689 - RNA, 22 nt, Mycobacterium tuberculosis H37Rv
cugccucgccugcacgcccggc

SEQ ID NO: 3277690 - RNA, 22 nt, Mycobacterium tuberculosis H37Rv
cugccucggcgagccgcucgcu

SEQ ID NO: 3277691 - RNA, 19 nt, Mycobacterium tuberculosis H37Rv
cugccucggggccuaucaa

SEQ ID NO: 3277692 - RNA, 17 nt, Mycobacterium tuberculosis H37Rv
cugccucuugcucggcg

SEQ ID NO: 3277693 - RNA, 18 nt, Mycobacterium tuberculosis H37Rv
cugccuggccgggaccgc

SEQ ID NO: 3277694 - RNA, 15 nt, Mycobacterium tuberculosis H37Rv
cugccuuacacgccu

SEQ ID NO: 3277695 - RNA, 15 nt, Mycobacterium tuberculosis H37Rv
cugccuuaccaaccg

SEQ ID NO: 3277696 - RNA, 16 nt, Mycobacterium tuberculosis H37Rv
cugccuuaccaaccgg

SEQ ID NO: 3277697 - RNA, 11 nt, Mycobacterium tuberculosis H37Rv
cugccuucuuu

SEQ ID NO: 3277698 - RNA, 15 nt, Mycobacterium tuberculosis H37Rv
cugccuuggccggcu

SEQ ID NO: 3277699 - RNA, 13 nt, Mycobacterium tuberculosis H37Rv
cugcgaaacgcca

SEQ ID NO: 3277700 - RNA, 20 nt, Mycobacterium tuberculosis H37Rv
cugcgaagccgagcaucaga

SEQ ID NO: 3277701 - RNA, 16 nt, Mycobacterium tuberculosis H37Rv
cugcgaagucgcaugg

SEQ ID NO: 3277702 - RNA, 19 nt, Mycobacterium tuberculosis H37Rv
cugcgaaucuccgcgcggu

SEQ ID NO: 3277703 - RNA, 20 nt, Mycobacterium tuberculosis H37Rv
cugcggauacagccgccgcc

SEQ ID NO: 3277704 - RNA, 19 nt, Mycobacterium tuberculosis H37Rv
cugcggauacuguucugcu

SEQ ID NO: 3277705 - RNA, 22 nt, Mycobacterium tuberculosis H37Rv
cugcggauccaccacgcuggcc

SEQ ID NO: 3277706 - RNA, 21 nt, Mycobacterium tuberculosis H37Rv
cugcggaucggacaacacggc

SEQ ID NO: 3277707 - RNA, 18 nt, Mycobacterium tuberculosis H37Rv
cugcggaucguggcgccc

SEQ ID NO: 3277708 - RNA, 13 nt, Mycobacterium tuberculosis H37Rv
cugcggcaccacc

SEQ ID NO: 3277709 - RNA, 11 nt, Mycobacterium tuberculosis H37Rv
cugcggcaccg

SEQ ID NO: 3277710 - RNA, 14 nt, Mycobacterium tuberculosis H37Rv
cugcggcagcgcgg

SEQ ID NO: 3277711 - RNA, 13 nt, Mycobacterium tuberculosis H37Rv
cugcggcagcgga

SEQ ID NO: 3277712 - RNA, 23 nt, Mycobacterium tuberculosis H37Rv
cugcggccaauggugggcgagcu

SEQ ID NO: 3277713 - RNA, 13 nt, Mycobacterium tuberculosis H37Rv
cugcggccacggu

SEQ ID NO: 3277714 - RNA, 14 nt, Mycobacterium tuberculosis H37Rv
cugcggccagucag

SEQ ID NO: 3277715 - RNA, 17 nt, Mycobacterium tuberculosis H37Rv
cugcggcccacaccagc

SEQ ID NO: 3277716 - RNA, 23 nt, Mycobacterium tuberculosis H37Rv
cugcggcccacaccagcgcagca

SEQ ID NO: 3277717 - RNA, 17 nt, Mycobacterium tuberculosis H37Rv
cugcggcccgacccggc

SEQ ID NO: 3277718 - RNA, 16 nt, Mycobacterium tuberculosis H37Rv
cugcggccgauacaga

SEQ ID NO: 3277719 - RNA, 18 nt, Mycobacterium tuberculosis H37Rv
cugcggccugcucgacca

SEQ ID NO: 3277720 - RNA, 14 nt, Mycobacterium tuberculosis H37Rv
cugcggcgaucugg

SEQ ID NO: 3277721 - RNA, 20 nt, Mycobacterium tuberculosis H37Rv
cugcggcgcccggucgagcc

SEQ ID NO: 3277722 - RNA, 21 nt, Mycobacterium tuberculosis H37Rv
cugcggcgcccggucgagcca

SEQ ID NO: 3277723 - RNA, 19 nt, Mycobacterium tuberculosis H37Rv
cugcggcggccauucgguc

SEQ ID NO: 3277724 - RNA, 21 nt, Mycobacterium tuberculosis H37Rv
cugcggcggcuuuggccgccg

SEQ ID NO: 3277725 - RNA, 13 nt, Mycobacterium tuberculosis H37Rv
cugcggcuccggc

SEQ ID NO: 3277726 - RNA, 12 nt, Mycobacterium tuberculosis H37Rv
cugcggcugcuu

SEQ ID NO: 3277727 - RNA, 12 nt, Mycobacterium tuberculosis H37Rv
cugcggcuuuca

SEQ ID NO: 3277728 - RNA, 14 nt, Mycobacterium tuberculosis H37Rv
cugcgggacgucgu

SEQ ID NO: 3277729 - RNA, 18 nt, Mycobacterium tuberculosis H37Rv
cugcgggcccggcggcca

SEQ ID NO: 3277730 - RNA, 12 nt, Mycobacterium tuberculosis H37Rv
cugcgggccggc

SEQ ID NO: 3277731 - RNA, 19 nt, Mycobacterium tuberculosis H37Rv
cugcgggcgggucugggug

SEQ ID NO: 3277732 - RNA, 14 nt, Mycobacterium tuberculosis H37Rv
cugcggggagcugu

SEQ ID NO: 3277733 - RNA, 21 nt, Mycobacterium tuberculosis H37Rv
cugcggggcgauccccagcac

SEQ ID NO: 3277734 - RNA, 20 nt, Mycobacterium tuberculosis H37Rv
cugcggggguacgucaccgg

SEQ ID NO: 3277735 - RNA, 23 nt, Mycobacterium tuberculosis H37Rv
cugcggguagccgucgaucccgg

SEQ ID NO: 3277736 - RNA, 16 nt, Mycobacterium tuberculosis H37Rv
cugcgggucagcgccg

SEQ ID NO: 3277737 - RNA, 22 nt, Mycobacterium tuberculosis H37Rv
cugcgggucgugccccggcgcg

SEQ ID NO: 3277738 - RNA, 17 nt, Mycobacterium tuberculosis H37Rv
cugcgggucucgccgac

SEQ ID NO: 3277739 - RNA, 20 nt, Mycobacterium tuberculosis H37Rv
cugcggguucacuuccgggc

SEQ ID NO: 3277740 - RNA, 18 nt, Mycobacterium tuberculosis H37Rv
cugcgguaaucgccaccg

SEQ ID NO: 3277741 - RNA, 18 nt, Mycobacterium tuberculosis H37Rv
cugcgguacugagccgcg

SEQ ID NO: 3277742 - RNA, 19 nt, Mycobacterium tuberculosis H37Rv
cugcggucgaacaucaucg

SEQ ID NO: 3277743 - RNA, 15 nt, Mycobacterium tuberculosis H37Rv
cugcggucgcggagc

SEQ ID NO: 3277744 - RNA, 17 nt, Mycobacterium tuberculosis H37Rv
cugcggugccacgguga

SEQ ID NO: 3277745 - RNA, 20 nt, Mycobacterium tuberculosis H37Rv
cugcguaguugauggccccg

SEQ ID NO: 3277746 - RNA, 14 nt, Mycobacterium tuberculosis H37Rv
cugcguccaccgga

SEQ ID NO: 3277747 - RNA, 23 nt, Mycobacterium tuberculosis H37Rv
cugcgucccggaaaaagucaccu

SEQ ID NO: 3277748 - RNA, 17 nt, Mycobacterium tuberculosis H37Rv
cugcgucggcccgcggu

SEQ ID NO: 3277749 - RNA, 17 nt, Mycobacterium tuberculosis H37Rv
cugcgucggcggcuucc

SEQ ID NO: 3277750 - RNA, 14 nt, Mycobacterium tuberculosis H37Rv
cugcgucgucugca

SEQ ID NO: 3277751 - RNA, 16 nt, Mycobacterium tuberculosis H37Rv
cugcgucugcucacca

SEQ ID NO: 3277752 - RNA, 21 nt, Mycobacterium tuberculosis H37Rv
cugcgucugcucgccagccgg

SEQ ID NO: 3277753 - RNA, 16 nt, Mycobacterium tuberculosis H37Rv
cugcgucugcucgccg

SEQ ID NO: 3277754 - RNA, 15 nt, Mycobacterium tuberculosis H37Rv
cugcgucugcucgcg

SEQ ID NO: 3277755 - RNA, 16 nt, Mycobacterium tuberculosis H37Rv
cugcgucugcucgcga

SEQ ID NO: 3277756 - RNA, 19 nt, Mycobacterium tuberculosis H37Rv
cugcgucugcucgcgcagg

SEQ ID NO: 3277757 - RNA, 19 nt, Mycobacterium tuberculosis H37Rv
cugcgucugcucgcgggua

SEQ ID NO: 3277758 - RNA, 21 nt, Mycobacterium tuberculosis H37Rv
cugcgucugcucggcgcggug

SEQ ID NO: 3277759 - RNA, 17 nt, Mycobacterium tuberculosis H37Rv
cugcgugcagaucacgg

SEQ ID NO: 3277760 - RNA, 13 nt, Mycobacterium tuberculosis H37Rv
cugcgugggccug

SEQ ID NO: 3277761 - RNA, 13 nt, Mycobacterium tuberculosis H37Rv
cugcguucgccgg

SEQ ID NO: 3277762 - RNA, 14 nt, Mycobacterium tuberculosis H37Rv
cugcguugacguca

SEQ ID NO: 3277763 - RNA, 22 nt, Mycobacterium tuberculosis H37Rv
cugcguuggaauguccggcagc

SEQ ID NO: 3277764 - RNA, 23 nt, Mycobacterium tuberculosis H37Rv
cugcguuggaauguccggcagcg

SEQ ID NO: 3277765 - RNA, 14 nt, Mycobacterium tuberculosis H37Rv
cugcguugggaucc

SEQ ID NO: 3277766 - RNA, 21 nt, Mycobacterium tuberculosis H37Rv
cugcguugggaucccagcgca

SEQ ID NO: 3277767 - RNA, 14 nt, Mycobacterium tuberculosis H37Rv
cugcucacgcgggu

SEQ ID NO: 3277768 - RNA, 15 nt, Mycobacterium tuberculosis H37Rv
cugcucagccguucg

SEQ ID NO: 3277769 - RNA, 17 nt, Mycobacterium tuberculosis H37Rv
cugcucagcgcggcccc

SEQ ID NO: 3277770 - RNA, 12 nt, Mycobacterium tuberculosis H37Rv
cugcucauccac

SEQ ID NO: 3277771 - RNA, 16 nt, Mycobacterium tuberculosis H37Rv
cugcucauccaccucg

SEQ ID NO: 3277772 - RNA, 18 nt, Mycobacterium tuberculosis H37Rv
cugcucccgaaaagcgcc

SEQ ID NO: 3277773 - RNA, 20 nt, Mycobacterium tuberculosis H37Rv
cugcucccgaaaagcgccuc

SEQ ID NO: 3277774 - RNA, 19 nt, Mycobacterium tuberculosis H37Rv
cugcuccgcugucaccccu

SEQ ID NO: 3277775 - RNA, 21 nt, Mycobacterium tuberculosis H37Rv
cugcuccucauagagcggcac

SEQ ID NO: 3277776 - RNA, 14 nt, Mycobacterium tuberculosis H37Rv
cugcuccucggcca

SEQ ID NO: 3277777 - RNA, 20 nt, Mycobacterium tuberculosis H37Rv
cugcuccucggucagcgggg

SEQ ID NO: 3277778 - RNA, 13 nt, Mycobacterium tuberculosis H37Rv
cugcuccuggaag

SEQ ID NO: 3277779 - RNA, 22 nt, Mycobacterium tuberculosis H37Rv
cugcucgaaaucgcacagcgca

SEQ ID NO: 3277780 - RNA, 17 nt, Mycobacterium tuberculosis H37Rv
cugcucgaacgcugagg

SEQ ID NO: 3277781 - RNA, 17 nt, Mycobacterium tuberculosis H37Rv
cugcucgauacggcccu

SEQ ID NO: 3277782 - RNA, 23 nt, Mycobacterium tuberculosis H37Rv
cugcucgaucaucgggagccgca

SEQ ID NO: 3277783 - RNA, 14 nt, Mycobacterium tuberculosis H37Rv
cugcucgcacagca

SEQ ID NO: 3277784 - RNA, 17 nt, Mycobacterium tuberculosis H37Rv
cugcucgcacagcacca

SEQ ID NO: 3277785 - RNA, 16 nt, Mycobacterium tuberculosis H37Rv
cugcucgccaggcaag

SEQ ID NO: 3277786 - RNA, 15 nt, Mycobacterium tuberculosis H37Rv
cugcucgccaggccu

SEQ ID NO: 3277787 - RNA, 16 nt, Mycobacterium tuberculosis H37Rv
cugcucgccaggccua

SEQ ID NO: 3277788 - RNA, 18 nt, Mycobacterium tuberculosis H37Rv
cugcucgcccuauacgca

SEQ ID NO: 3277789 - RNA, 23 nt, Mycobacterium tuberculosis H37Rv
cugcucgccggacggagguccua

SEQ ID NO: 3277790 - RNA, 14 nt, Mycobacterium tuberculosis H37Rv
cugcucgccggcca

SEQ ID NO: 3277791 - RNA, 15 nt, Mycobacterium tuberculosis H37Rv
cugcucgccggccaa

SEQ ID NO: 3277792 - RNA, 24 nt, Mycobacterium tuberculosis H37Rv
cugcucgccggccaacugggccga

SEQ ID NO: 3277793 - RNA, 21 nt, Mycobacterium tuberculosis H37Rv
cugcucgcgcaaggcgccgca

SEQ ID NO: 3277794 - RNA, 14 nt, Mycobacterium tuberculosis H37Rv
cugcucgcgccgcu

SEQ ID NO: 3277795 - RNA, 23 nt, Mycobacterium tuberculosis H37Rv
cugcucgcgguaguuaacccagg

SEQ ID NO: 3277796 - RNA, 16 nt, Mycobacterium tuberculosis H37Rv
cugcucggagagcagc

SEQ ID NO: 3277797 - RNA, 16 nt, Mycobacterium tuberculosis H37Rv
cugcucggauccggcc

SEQ ID NO: 3277798 - RNA, 12 nt, Mycobacterium tuberculosis H37Rv
cugcucggcgca

SEQ ID NO: 3277799 - RNA, 17 nt, Mycobacterium tuberculosis H37Rv
cuggcaccucccgggcg

SEQ ID NO: 3277800 - RNA, 18 nt, Mycobacterium tuberculosis H37Rv
cuggcaccucccgggcga

SEQ ID NO: 3277801 - RNA, 21 nt, Mycobacterium tuberculosis H37Rv
cuggcaccucccgggcgagcc

SEQ ID NO: 3277802 - RNA, 16 nt, Mycobacterium tuberculosis H37Rv
cuggcacgcagagcca

SEQ ID NO: 3277803 - RNA, 17 nt, Mycobacterium tuberculosis H37Rv
cuggcagaccaacgcuc

SEQ ID NO: 3277804 - RNA, 16 nt, Mycobacterium tuberculosis H37Rv
cuggcagcggccuccg

SEQ ID NO: 3277805 - RNA, 18 nt, Mycobacterium tuberculosis H37Rv
cuggcagcggccuccggg

SEQ ID NO: 3277806 - RNA, 19 nt, Mycobacterium tuberculosis H37Rv
cuggcaggccgggcaccaa

SEQ ID NO: 3277807 - RNA, 19 nt, Mycobacterium tuberculosis H37Rv
cuggcaggcuuagcuuccg

SEQ ID NO: 3277808 - RNA, 21 nt, Mycobacterium tuberculosis H37Rv
cuggcagugugggggucaggg

SEQ ID NO: 3277809 - RNA, 17 nt, Mycobacterium tuberculosis H37Rv
cuggcauaucccuugcc

SEQ ID NO: 3277810 - RNA, 15 nt, Mycobacterium tuberculosis H37Rv
cuggcaucccgggca

SEQ ID NO: 3277811 - RNA, 14 nt, Mycobacterium tuberculosis H37Rv
cuggcaugccggcg

SEQ ID NO: 3277812 - RNA, 15 nt, Mycobacterium tuberculosis H37Rv
cuggccaccgcaucg

SEQ ID NO: 3277813 - RNA, 21 nt, Mycobacterium tuberculosis H37Rv
cuggccacgauccgcgguagc

SEQ ID NO: 3277814 - RNA, 21 nt, Mycobacterium tuberculosis H37Rv
cuggccacggcuuugcggcgc

SEQ ID NO: 3277815 - RNA, 12 nt, Mycobacterium tuberculosis H37Rv
cuggccagcaca

SEQ ID NO: 3277816 - RNA, 21 nt, Mycobacterium tuberculosis H37Rv
cuggccagcacaccgucgacg

SEQ ID NO: 3277817 - RNA, 14 nt, Mycobacterium tuberculosis H37Rv
cuggccagcgcgcu

SEQ ID NO: 3277818 - RNA, 17 nt, Mycobacterium tuberculosis H37Rv
cuggccagguggccgca

SEQ ID NO: 3277819 - RNA, 19 nt, Mycobacterium tuberculosis H37Rv
cuggccagguugccgucgg

SEQ ID NO: 3277820 - RNA, 19 nt, Mycobacterium tuberculosis H37Rv
cuggccaucgagggcaucg

SEQ ID NO: 3277821 - RNA, 22 nt, Mycobacterium tuberculosis H37Rv
cuggccaugcggaaagccccuc

SEQ ID NO: 3277822 - RNA, 20 nt, Mycobacterium tuberculosis H37Rv
cuggccaugguggcgccgac

SEQ ID NO: 3277823 - RNA, 19 nt, Mycobacterium tuberculosis H37Rv
cuggcccccacaccacgcu

SEQ ID NO: 3277824 - RNA, 22 nt, Mycobacterium tuberculosis H37Rv
cuggcccccgguaccgcccgca

SEQ ID NO: 3277825 - RNA, 17 nt, Mycobacterium tuberculosis H37Rv
cuggccccgccagcggc

SEQ ID NO: 3277826 - RNA, 18 nt, Mycobacterium tuberculosis H37Rv
cuggccccgccagcggca

SEQ ID NO: 3277827 - RNA, 20 nt, Mycobacterium tuberculosis H37Rv
cuggccccgccagcggcagc

SEQ ID NO: 3277828 - RNA, 21 nt, Mycobacterium tuberculosis H37Rv
cuggccccgguggugcugccg

SEQ ID NO: 3277829 - RNA, 23 nt, Mycobacterium tuberculosis H37Rv
cuggccccgguggugcugccgau

SEQ ID NO: 3277830 - RNA, 23 nt, Mycobacterium tuberculosis H37Rv
cuggcccgccacgaugucgucga

SEQ ID NO: 3277831 - RNA, 23 nt, Mycobacterium tuberculosis H37Rv
cuggcccgcgacaucgggaaugu

SEQ ID NO: 3277832 - RNA, 15 nt, Mycobacterium tuberculosis H37Rv
cuggcccugcuccuc

SEQ ID NO: 3277833 - RNA, 17 nt, Mycobacterium tuberculosis H37Rv
cuggccgaacgacgggu

SEQ ID NO: 3277834 - RNA, 23 nt, Mycobacterium tuberculosis H37Rv
cuggccgaacgacggguccgggc

SEQ ID NO: 3277835 - RNA, 14 nt, Mycobacterium tuberculosis H37Rv
cuggccgaagcccg

SEQ ID NO: 3277836 - RNA, 21 nt, Mycobacterium tuberculosis H37Rv
cuggccgaauaacagcaggca

SEQ ID NO: 3277837 - RNA, 23 nt, Mycobacterium tuberculosis H37Rv
cuggccgaauaacagcaggcauu

SEQ ID NO: 3277838 - RNA, 21 nt, Mycobacterium tuberculosis H37Rv
cuggccgauguaguccggcca

SEQ ID NO: 3277839 - RNA, 13 nt, Mycobacterium tuberculosis H37Rv
cuggccgccagau

SEQ ID NO: 3277840 - RNA, 22 nt, Mycobacterium tuberculosis H37Rv
cuggccgcccagaccgccgacg

SEQ ID NO: 3277841 - RNA, 13 nt, Mycobacterium tuberculosis H37Rv
cuggccgcccggc

SEQ ID NO: 3277842 - RNA, 15 nt, Mycobacterium tuberculosis H37Rv
cuggccgcccggcga

SEQ ID NO: 3277843 - RNA, 22 nt, Mycobacterium tuberculosis H37Rv
cuggccgcccggcgagcagggc

SEQ ID NO: 3277844 - RNA, 13 nt, Mycobacterium tuberculosis H37Rv
cuggccgccggcg

SEQ ID NO: 3277845 - RNA, 17 nt, Mycobacterium tuberculosis H37Rv
cuggccgccuccgcggc

SEQ ID NO: 3277846 - RNA, 16 nt, Mycobacterium tuberculosis H37Rv
cuggccgcgccucggu

SEQ ID NO: 3277847 - RNA, 22 nt, Mycobacterium tuberculosis H37Rv
cuggccgcgccucggucugcuc

SEQ ID NO: 3277848 - RNA, 16 nt, Mycobacterium tuberculosis H37Rv
cuggccgggaccgccc

SEQ ID NO: 3277849 - RNA, 21 nt, Mycobacterium tuberculosis H37Rv
cuggccggguuccagcggcac

SEQ ID NO: 3277850 - RNA, 18 nt, Mycobacterium tuberculosis H37Rv
cuggccggugcgcaggua

SEQ ID NO: 3277851 - RNA, 20 nt, Mycobacterium tuberculosis H37Rv
cuggccggugcgcagguacg

SEQ ID NO: 3277852 - RNA, 22 nt, Mycobacterium tuberculosis H37Rv
cuggccggugguagcggacagc

SEQ ID NO: 3277853 - RNA, 16 nt, Mycobacterium tuberculosis H37Rv
cuggccgucgcuggug

SEQ ID NO: 3277854 - RNA, 15 nt, Mycobacterium tuberculosis H37Rv
cuggccguuucggcg

SEQ ID NO: 3277855 - RNA, 16 nt, Mycobacterium tuberculosis H37Rv
cuggccguuucggcgc

SEQ ID NO: 3277856 - RNA, 13 nt, Mycobacterium tuberculosis H37Rv
cuggccuccagcu

SEQ ID NO: 3277857 - RNA, 18 nt, Mycobacterium tuberculosis H37Rv
cuggccucggggaucgca

SEQ ID NO: 3277858 - RNA, 17 nt, Mycobacterium tuberculosis H37Rv
cuggccugcccagcacc

SEQ ID NO: 3277859 - RNA, 13 nt, Mycobacterium tuberculosis H37Rv
cuggccugcccca

SEQ ID NO: 3277860 - RNA, 16 nt, Mycobacterium tuberculosis H37Rv
cuggccuuggcagucc

SEQ ID NO: 3277861 - RNA, 13 nt, Mycobacterium tuberculosis H37Rv
cuggccuuggcga

SEQ ID NO: 3277862 - RNA, 14 nt, Mycobacterium tuberculosis H37Rv
cuggcgaacaguga

SEQ ID NO: 3277863 - RNA, 23 nt, Mycobacterium tuberculosis H37Rv
cuggcgaacucgaggucgagcgc

SEQ ID NO: 3277864 - RNA, 21 nt, Mycobacterium tuberculosis H37Rv
cuggcgaacucgcgcaggaag

SEQ ID NO: 3277865 - RNA, 18 nt, Mycobacterium tuberculosis H37Rv
cuggcgaaggacaacagc

SEQ ID NO: 3277866 - RNA, 22 nt, Mycobacterium tuberculosis H37Rv
cuggcgaaggacaacagccgcu

SEQ ID NO: 3277867 - RNA, 22 nt, Mycobacterium tuberculosis H37Rv
cuggcgaaugcgggccuccugc

SEQ ID NO: 3277868 - RNA, 23 nt, Mycobacterium tuberculosis H37Rv
cuggcgaaugucgcucaaacccg

SEQ ID NO: 3277869 - RNA, 16 nt, Mycobacterium tuberculosis H37Rv
cuggcgacgacgacac

SEQ ID NO: 3277870 - RNA, 19 nt, Mycobacterium tuberculosis H37Rv
cuggcgacgacgacaccgc

SEQ ID NO: 3277871 - RNA, 15 nt, Mycobacterium tuberculosis H37Rv
cuggcgacgcgacac

SEQ ID NO: 3277872 - RNA, 22 nt, Mycobacterium tuberculosis H37Rv
cuggcgacggugcgcuggaugu

SEQ ID NO: 3277873 - RNA, 18 nt, Mycobacterium tuberculosis H37Rv
cuggcgacguauuucgcc

SEQ ID NO: 3277874 - RNA, 23 nt, Mycobacterium tuberculosis H37Rv
cuggcgacucgugucugccucgg

SEQ ID NO: 3277875 - RNA, 18 nt, Mycobacterium tuberculosis H37Rv
cuggcgagggcuaccggc

SEQ ID NO: 3277876 - RNA, 20 nt, Mycobacterium tuberculosis H37Rv
cuggcgauaaccgacgauca

SEQ ID NO: 3277877 - RNA, 17 nt, Mycobacterium tuberculosis H37Rv
cuggcgauacagcgaca

SEQ ID NO: 3277878 - RNA, 21 nt, Mycobacterium tuberculosis H37Rv
cuggcgaucucuaccagccgc

SEQ ID NO: 3277879 - RNA, 12 nt, Mycobacterium tuberculosis H37Rv
cuggcgcagccu

SEQ ID NO: 3277880 - RNA, 21 nt, Mycobacterium tuberculosis H37Rv
cuggcgcagccugccgaugac

SEQ ID NO: 3277881 - RNA, 13 nt, Mycobacterium tuberculosis H37Rv
cuggcgcccagcc

SEQ ID NO: 3277882 - RNA, 17 nt, Mycobacterium tuberculosis H37Rv
cuggcgcccccgccauu

SEQ ID NO: 3277883 - RNA, 21 nt, Mycobacterium tuberculosis H37Rv
cuggcgccgccggugccaccg

SEQ ID NO: 3277884 - RNA, 17 nt, Mycobacterium tuberculosis H37Rv
cuggcgccggugccgcc

SEQ ID NO: 3277885 - RNA, 14 nt, Mycobacterium tuberculosis H37Rv
cuggcgccguuagc

SEQ ID NO: 3277886 - RNA, 20 nt, Mycobacterium tuberculosis H37Rv
cuggcgcucauaggccggcg

SEQ ID NO: 3277887 - RNA, 15 nt, Mycobacterium tuberculosis H37Rv
cuggcgcugaucgcc

SEQ ID NO: 3277888 - RNA, 19 nt, Mycobacterium tuberculosis H37Rv
cuggcgcugaucgccucgg

SEQ ID NO: 3277889 - RNA, 18 nt, Mycobacterium tuberculosis H37Rv
cuggcgcuuugggcugcc

SEQ ID NO: 3277890 - RNA, 21 nt, Mycobacterium tuberculosis H37Rv
cuggcggcagcgguuuuaggc

SEQ ID NO: 3277891 - RNA, 20 nt, Mycobacterium tuberculosis H37Rv
cuggcggccagcaucgggug

SEQ ID NO: 3277892 - RNA, 13 nt, Mycobacterium tuberculosis H37Rv
cuggcggcccggg

SEQ ID NO: 3277893 - RNA, 14 nt, Mycobacterium tuberculosis H37Rv
cuggcggcgcagcg

SEQ ID NO: 3277894 - RNA, 22 nt, Mycobacterium tuberculosis H37Rv
cugguaggagaucaccucggug

SEQ ID NO: 3277895 - RNA, 14 nt, Mycobacterium tuberculosis H37Rv
cugguaggcgcuac

SEQ ID NO: 3277896 - RNA, 18 nt, Mycobacterium tuberculosis H37Rv
cugguaggcgcuaccugu

SEQ ID NO: 3277897 - RNA, 23 nt, Mycobacterium tuberculosis H37Rv
cugguagucgcccguggcgguga

SEQ ID NO: 3277898 - RNA, 19 nt, Mycobacterium tuberculosis H37Rv
cugguaugccgcccgcagc

SEQ ID NO: 3277899 - RNA, 16 nt, Mycobacterium tuberculosis H37Rv
cugguauuuguccggc

SEQ ID NO: 3277900 - RNA, 18 nt, Mycobacterium tuberculosis H37Rv
cuggucacccguaucggg

SEQ ID NO: 3277901 - RNA, 17 nt, Mycobacterium tuberculosis H37Rv
cuggucagccgcggcgg

SEQ ID NO: 3277902 - RNA, 13 nt, Mycobacterium tuberculosis H37Rv
cuggucaugcgga

SEQ ID NO: 3277903 - RNA, 19 nt, Mycobacterium tuberculosis H37Rv
cugguccaaucgcgacagu

SEQ ID NO: 3277904 - RNA, 22 nt, Mycobacterium tuberculosis H37Rv
cugguccaaucgcgacagugcg

SEQ ID NO: 3277905 - RNA, 11 nt, Mycobacterium tuberculosis H37Rv
cugguccagca

SEQ ID NO: 3277906 - RNA, 13 nt, Mycobacterium tuberculosis H37Rv
cugguccagcacc

SEQ ID NO: 3277907 - RNA, 19 nt, Mycobacterium tuberculosis H37Rv
cugguccaggcccuggcca

SEQ ID NO: 3277908 - RNA, 22 nt, Mycobacterium tuberculosis H37Rv
cugguccaggcccuggccagcc

SEQ ID NO: 3277909 - RNA, 19 nt, Mycobacterium tuberculosis H37Rv
cugguccaggcggugacgu

SEQ ID NO: 3277910 - RNA, 16 nt, Mycobacterium tuberculosis H37Rv
cuggucccacaccucc

SEQ ID NO: 3277911 - RNA, 18 nt, Mycobacterium tuberculosis H37Rv
cuggucccacaccuccuc

SEQ ID NO: 3277912 - RNA, 13 nt, Mycobacterium tuberculosis H37Rv
cuggucgaaacgg

SEQ ID NO: 3277913 - RNA, 21 nt, Mycobacterium tuberculosis H37Rv
cuggucgacgcgucucuggcu

SEQ ID NO: 3277914 - RNA, 13 nt, Mycobacterium tuberculosis H37Rv
cuggucgagcacg

SEQ ID NO: 3277915 - RNA, 19 nt, Mycobacterium tuberculosis H37Rv
cuggucgagcacgcugcug

SEQ ID NO: 3277916 - RNA, 14 nt, Mycobacterium tuberculosis H37Rv
cuggucgauggccu

SEQ ID NO: 3277917 - RNA, 19 nt, Mycobacterium tuberculosis H37Rv
cuggucgccaacgccagca

SEQ ID NO: 3277918 - RNA, 21 nt, Mycobacterium tuberculosis H37Rv
cuggucgccaacgccagcacc

SEQ ID NO: 3277919 - RNA, 18 nt, Mycobacterium tuberculosis H37Rv
cuggucgccgcggcagcg

SEQ ID NO: 3277920 - RNA, 17 nt, Mycobacterium tuberculosis H37Rv
cuggucgccguacagcg

SEQ ID NO: 3277921 - RNA, 15 nt, Mycobacterium tuberculosis H37Rv
cuggucgcugcugcg

SEQ ID NO: 3277922 - RNA, 15 nt, Mycobacterium tuberculosis H37Rv
cuggucgcuggugca

SEQ ID NO: 3277923 - RNA, 14 nt, Mycobacterium tuberculosis H37Rv
cuggucggccaggu

SEQ ID NO: 3277924 - RNA, 13 nt, Mycobacterium tuberculosis H37Rv
cuggucggccgca

SEQ ID NO: 3277925 - RNA, 13 nt, Mycobacterium tuberculosis H37Rv
cuggucggcuucg

SEQ ID NO: 3277926 - RNA, 13 nt, Mycobacterium tuberculosis H37Rv
cuggucggugggc

SEQ ID NO: 3277927 - RNA, 14 nt, Mycobacterium tuberculosis H37Rv
cuggucgugggcca

SEQ ID NO: 3277928 - RNA, 22 nt, Mycobacterium tuberculosis H37Rv
cuggucucccagaggucgagcg

SEQ ID NO: 3277929 - RNA, 22 nt, Mycobacterium tuberculosis H37Rv
cuggugacgaaagcgcccagga

SEQ ID NO: 3277930 - RNA, 20 nt, Mycobacterium tuberculosis H37Rv
cuggugaucugguccggcaa

SEQ ID NO: 3277931 - RNA, 13 nt, Mycobacterium tuberculosis H37Rv
cuggugauggcca

SEQ ID NO: 3277932 - RNA, 14 nt, Mycobacterium tuberculosis H37Rv
cuggugauucgcag

SEQ ID NO: 3277933 - RNA, 20 nt, Mycobacterium tuberculosis H37Rv
cuggugcagaauucggcgcg

SEQ ID NO: 3277934 - RNA, 22 nt, Mycobacterium tuberculosis H37Rv
cuggugcagaauucggcgcgac

SEQ ID NO: 3277935 - RNA, 22 nt, Mycobacterium tuberculosis H37Rv
cuggugccaacugcgccguucg

SEQ ID NO: 3277936 - RNA, 17 nt, Mycobacterium tuberculosis H37Rv
cuggugcgccacgccac

SEQ ID NO: 3277937 - RNA, 14 nt, Mycobacterium tuberculosis H37Rv
cuggugcgcccgac

SEQ ID NO: 3277938 - RNA, 15 nt, Mycobacterium tuberculosis H37Rv
cuggugcgggacgcc

SEQ ID NO: 3277939 - RNA, 21 nt, Mycobacterium tuberculosis H37Rv
cuggugcguagcccacccggg

SEQ ID NO: 3277940 - RNA, 22 nt, Mycobacterium tuberculosis H37Rv
cuggugcguagcccacccgggu

SEQ ID NO: 3277941 - RNA, 21 nt, Mycobacterium tuberculosis H37Rv
cuggugcuacuggugugacga

SEQ ID NO: 3277942 - RNA, 14 nt, Mycobacterium tuberculosis H37Rv
cugguggaccuccg

SEQ ID NO: 3277943 - RNA, 17 nt, Mycobacterium tuberculosis H37Rv
cugguggcagaaaccgg

SEQ ID NO: 3277944 - RNA, 15 nt, Mycobacterium tuberculosis H37Rv
cugguggcagacaug

SEQ ID NO: 3277945 - RNA, 21 nt, Mycobacterium tuberculosis H37Rv
cugguggcggcacuggccccg

SEQ ID NO: 3277946 - RNA, 13 nt, Mycobacterium tuberculosis H37Rv
cuggugggccauc

SEQ ID NO: 3277947 - RNA, 19 nt, Mycobacterium tuberculosis H37Rv
cuggugggggagcggccgc

SEQ ID NO: 3277948 - RNA, 20 nt, Mycobacterium tuberculosis H37Rv
cuggugggggagcggccgcc

SEQ ID NO: 3277949 - RNA, 14 nt, Mycobacterium tuberculosis H37Rv
cugguggucggcga

SEQ ID NO: 3277950 - RNA, 22 nt, Mycobacterium tuberculosis H37Rv
cugguguaccagacgaacgacc

SEQ ID NO: 3277951 - RNA, 18 nt, Mycobacterium tuberculosis H37Rv
cugguguccagccaggcg

SEQ ID NO: 3277952 - RNA, 22 nt, Mycobacterium tuberculosis H37Rv
cuggugucggcucgagucgcag

SEQ ID NO: 3277953 - RNA, 16 nt, Mycobacterium tuberculosis H37Rv
cuggugucgggcguca

SEQ ID NO: 3277954 - RNA, 17 nt, Mycobacterium tuberculosis H37Rv
cuggugugacgaucccc

SEQ ID NO: 3277955 - RNA, 13 nt, Mycobacterium tuberculosis H37Rv
cuggugugucccg

SEQ ID NO: 3277956 - RNA, 19 nt, Mycobacterium tuberculosis H37Rv
cugguguugaucgucgggu

SEQ ID NO: 3277957 - RNA, 15 nt, Mycobacterium tuberculosis H37Rv
cugguguugaugagc

SEQ ID NO: 3277958 - RNA, 17 nt, Mycobacterium tuberculosis H37Rv
cugguguuguacuggcu

SEQ ID NO: 3277959 - RNA, 24 nt, Mycobacterium tuberculosis H37Rv
cugguguuucaggcagcggcgaca

SEQ ID NO: 3277960 - RNA, 20 nt, Mycobacterium tuberculosis H37Rv
cugguucagccauucuaggu

SEQ ID NO: 3277961 - RNA, 22 nt, Mycobacterium tuberculosis H37Rv
cugguucguuaggucacuccau

SEQ ID NO: 3277962 - RNA, 16 nt, Mycobacterium tuberculosis H37Rv
cugguugaccucggug

SEQ ID NO: 3277963 - RNA, 17 nt, Mycobacterium tuberculosis H37Rv
cugguugaccucgguga

SEQ ID NO: 3277964 - RNA, 17 nt, Mycobacterium tuberculosis H37Rv
cugguugcgccacugcg

SEQ ID NO: 3277965 - RNA, 18 nt, Mycobacterium tuberculosis H37Rv
cugguugcgccacugcgu

SEQ ID NO: 3277966 - RNA, 20 nt, Mycobacterium tuberculosis H37Rv
cugguugcgcucauccgguu

SEQ ID NO: 3277967 - RNA, 13 nt, Mycobacterium tuberculosis H37Rv
cugguuggcuucu

SEQ ID NO: 3277968 - RNA, 15 nt, Mycobacterium tuberculosis H37Rv
cugguugggccagcu

SEQ ID NO: 3277969 - RNA, 20 nt, Mycobacterium tuberculosis H37Rv
cugguugucgaucucggcca

SEQ ID NO: 3277970 - RNA, 15 nt, Mycobacterium tuberculosis H37Rv
cugguuucggccgca

SEQ ID NO: 3277971 - RNA, 21 nt, Mycobacterium tuberculosis H37Rv
cuguaaaaaugcuucgccaac

SEQ ID NO: 3277972 - RNA, 13 nt, Mycobacterium tuberculosis H37Rv
cuguaacacccgg

SEQ ID NO: 3277973 - RNA, 19 nt, Mycobacterium tuberculosis H37Rv
cuguaacacccggccgccg

SEQ ID NO: 3277974 - RNA, 17 nt, Mycobacterium tuberculosis H37Rv
cuguaacugcuccuggu

SEQ ID NO: 3277975 - RNA, 21 nt, Mycobacterium tuberculosis H37Rv
cuguaagacagcuaucccagg

SEQ ID NO: 3277976 - RNA, 18 nt, Mycobacterium tuberculosis H37Rv
cuguacaccgacacgccg

SEQ ID NO: 3277977 - RNA, 17 nt, Mycobacterium tuberculosis H37Rv
cuguacccgaccagcac

SEQ ID NO: 3277978 - RNA, 16 nt, Mycobacterium tuberculosis H37Rv
cuguaccgggcgacac

SEQ ID NO: 3277979 - RNA, 19 nt, Mycobacterium tuberculosis H37Rv
cuguagagggugucgcccu

SEQ ID NO: 3277980 - RNA, 22 nt, Mycobacterium tuberculosis H37Rv
cuguaggccagcccggcgugca

SEQ ID NO: 3277981 - RNA, 14 nt, Mycobacterium tuberculosis H37Rv
cuguagggcuucca

SEQ ID NO: 3277982 - RNA, 19 nt, Mycobacterium tuberculosis H37Rv
cuguagucccucaucaccu

SEQ ID NO: 3277983 - RNA, 18 nt, Mycobacterium tuberculosis H37Rv
cuguaguucgaugacuga

SEQ ID NO: 3277984 - RNA, 17 nt, Mycobacterium tuberculosis H37Rv
cugucaagcgggcuggc

SEQ ID NO: 3277985 - RNA, 16 nt, Mycobacterium tuberculosis H37Rv
cugucaccccugggcg

SEQ ID NO: 3277986 - RNA, 22 nt, Mycobacterium tuberculosis H37Rv
cugucagaaggaucagcgcacu

SEQ ID NO: 3277987 - RNA, 16 nt, Mycobacterium tuberculosis H37Rv
cugucauugcugccca

SEQ ID NO: 3277988 - RNA, 14 nt, Mycobacterium tuberculosis H37Rv
cuguccaccgaugc

SEQ ID NO: 3277989 - RNA, 18 nt, Mycobacterium tuberculosis H37Rv
cuguccacguccagcccg

SEQ ID NO: 3277990 - RNA, 21 nt, Mycobacterium tuberculosis H37Rv
cuucaacuuacgcgacgccgu

SEQ ID NO: 3277991 - RNA, 22 nt, Mycobacterium tuberculosis H37Rv
cuucaacuuacgcgacgccguc

SEQ ID NO: 3277992 - RNA, 12 nt, Mycobacterium tuberculosis H37Rv
cuucaaugcugg

SEQ ID NO: 3277993 - RNA, 17 nt, Mycobacterium tuberculosis H37Rv
cuucacccaaccccgcc

SEQ ID NO: 3277994 - RNA, 22 nt, Mycobacterium tuberculosis H37Rv
cuucaccgggugacccgccaac

SEQ ID NO: 3277995 - RNA, 17 nt, Mycobacterium tuberculosis H37Rv
cuucaccucgucgacaa

SEQ ID NO: 3277996 - RNA, 13 nt, Mycobacterium tuberculosis H37Rv
cuucaccuggugu

SEQ ID NO: 3277997 - RNA, 21 nt, Mycobacterium tuberculosis H37Rv
cuucacgcuggccuccagcuu

SEQ ID NO: 3277998 - RNA, 17 nt, Mycobacterium tuberculosis H37Rv
cuucacgggccguccag

SEQ ID NO: 3277999 - RNA, 18 nt, Mycobacterium tuberculosis H37Rv
cuucacggucgacgauga

SEQ ID NO: 3278000 - RNA, 15 nt, Mycobacterium tuberculosis H37Rv
cuucacugcgaccgu

SEQ ID NO: 3278001 - RNA, 24 nt, Mycobacterium tuberculosis H37Rv
cuucagcacgguguacgcccgcuc

SEQ ID NO: 3278002 - RNA, 14 nt, Mycobacterium tuberculosis H37Rv
cuucagcagcggcg

SEQ ID NO: 3278003 - RNA, 18 nt, Mycobacterium tuberculosis H37Rv
cuucagcaugguggacga

SEQ ID NO: 3278004 - RNA, 19 nt, Mycobacterium tuberculosis H37Rv
cuucagccaguccagcgcg

SEQ ID NO: 3278005 - RNA, 19 nt, Mycobacterium tuberculosis H37Rv
cuucagcggccgguacacg

SEQ ID NO: 3278006 - RNA, 22 nt, Mycobacterium tuberculosis H37Rv
cuucaggcaccggaugaugugg

SEQ ID NO: 3278007 - RNA, 15 nt, Mycobacterium tuberculosis H37Rv
cuucaggccgcgcau

SEQ ID NO: 3278008 - RNA, 15 nt, Mycobacterium tuberculosis H37Rv
cuucaggcgccacug

SEQ ID NO: 3278009 - RNA, 14 nt, Mycobacterium tuberculosis H37Rv
cuucagguagcggc

SEQ ID NO: 3278010 - RNA, 15 nt, Mycobacterium tuberculosis H37Rv
cuucaguccggcccc

SEQ ID NO: 3278011 - RNA, 14 nt, Mycobacterium tuberculosis H37Rv
cuucaucggcgaua

SEQ ID NO: 3278012 - RNA, 15 nt, Mycobacterium tuberculosis H37Rv
cuucaugaacagccg

SEQ ID NO: 3278013 - RNA, 20 nt, Mycobacterium tuberculosis H37Rv
cuucauucgugggaaccacc

SEQ ID NO: 3278014 - RNA, 13 nt, Mycobacterium tuberculosis H37Rv
cuuccaaacccgg

SEQ ID NO: 3278015 - RNA, 14 nt, Mycobacterium tuberculosis H37Rv
cuuccaacaggccg

SEQ ID NO: 3278016 - RNA, 21 nt, Mycobacterium tuberculosis H37Rv
cuuccaauugauaggccccga

SEQ ID NO: 3278017 - RNA, 22 nt, Mycobacterium tuberculosis H37Rv
cuuccacggcguggucggcaaa

SEQ ID NO: 3278018 - RNA, 21 nt, Mycobacterium tuberculosis H37Rv
cuuccacugacgucucaucaa

SEQ ID NO: 3278019 - RNA, 17 nt, Mycobacterium tuberculosis H37Rv
cuuccagccacagcccg

SEQ ID NO: 3278020 - RNA, 22 nt, Mycobacterium tuberculosis H37Rv
cuuccagccacagcccggcggc

SEQ ID NO: 3278021 - RNA, 23 nt, Mycobacterium tuberculosis H37Rv
cuuccagccggagucaccgaaau

SEQ ID NO: 3278022 - RNA, 15 nt, Mycobacterium tuberculosis H37Rv
cuuccaggagcgccg

SEQ ID NO: 3278023 - RNA, 16 nt, Mycobacterium tuberculosis H37Rv
cuuccaggagcgccgu

SEQ ID NO: 3278024 - RNA, 14 nt, Mycobacterium tuberculosis H37Rv
cuuccauuuucgcc

SEQ ID NO: 3278025 - RNA, 23 nt, Mycobacterium tuberculosis H37Rv
cuucccagccgacgccuuccagc

SEQ ID NO: 3278026 - RNA, 19 nt, Mycobacterium tuberculosis H37Rv
cuucccaguaaguccucga

SEQ ID NO: 3278027 - RNA, 15 nt, Mycobacterium tuberculosis H37Rv
cuucccccgguccgg

SEQ ID NO: 3278028 - RNA, 17 nt, Mycobacterium tuberculosis H37Rv
cuucccgcgcgagccgc

SEQ ID NO: 3278029 - RNA, 16 nt, Mycobacterium tuberculosis H37Rv
cuucccggaagcgccg

SEQ ID NO: 3278030 - RNA, 14 nt, Mycobacterium tuberculosis H37Rv
cuucccgucgacga

SEQ ID NO: 3278031 - RNA, 16 nt, Mycobacterium tuberculosis H37Rv
cuuccggauucggacu

SEQ ID NO: 3278032 - RNA, 23 nt, Mycobacterium tuberculosis H37Rv
cuuccggauucggacucgccgac

SEQ ID NO: 3278033 - RNA, 15 nt, Mycobacterium tuberculosis H37Rv
cuuccggcguggccc

SEQ ID NO: 3278034 - RNA, 19 nt, Mycobacterium tuberculosis H37Rv
cuuccgggcagcugggcag

SEQ ID NO: 3278035 - RNA, 19 nt, Mycobacterium tuberculosis H37Rv
cuuccggggugacaucgcg

SEQ ID NO: 3278036 - RNA, 16 nt, Mycobacterium tuberculosis H37Rv
cuuccgguucaucggc

SEQ ID NO: 3278037 - RNA, 19 nt, Mycobacterium tuberculosis H37Rv
cuuccgguucaucggcaug

SEQ ID NO: 3278038 - RNA, 14 nt, Mycobacterium tuberculosis H37Rv
cuuccucgccggaa

SEQ ID NO: 3278039 - RNA, 13 nt, Mycobacterium tuberculosis H37Rv
cuuccucggccac

SEQ ID NO: 3278040 - RNA, 15 nt, Mycobacterium tuberculosis H37Rv
cuuccucggccaccc

SEQ ID NO: 3278041 - RNA, 14 nt, Mycobacterium tuberculosis H37Rv
cuuccugaggguuu

SEQ ID NO: 3278042 - RNA, 23 nt, Mycobacterium tuberculosis H37Rv
cuuccuggguugugccgcccugg

SEQ ID NO: 3278043 - RNA, 15 nt, Mycobacterium tuberculosis H37Rv
cuuccuggucgacgc

SEQ ID NO: 3278044 - RNA, 23 nt, Mycobacterium tuberculosis H37Rv
cuuccuggucgacgcgucucugg

SEQ ID NO: 3278045 - RNA, 15 nt, Mycobacterium tuberculosis H37Rv
cuucgacagcgcgca

SEQ ID NO: 3278046 - RNA, 13 nt, Mycobacterium tuberculosis H37Rv
cuucgacagcggc

SEQ ID NO: 3278047 - RNA, 14 nt, Mycobacterium tuberculosis H37Rv
cuucgaccucaccc

SEQ ID NO: 3278048 - RNA, 21 nt, Mycobacterium tuberculosis H37Rv
cuucgacgcuuccuggguugg

SEQ ID NO: 3278049 - RNA, 16 nt, Mycobacterium tuberculosis H37Rv
cuucgagccggcggcc

SEQ ID NO: 3278050 - RNA, 14 nt, Mycobacterium tuberculosis H37Rv
cuucgauaccgacc

SEQ ID NO: 3278051 - RNA, 15 nt, Mycobacterium tuberculosis H37Rv
cuucgauaccgaccg

SEQ ID NO: 3278052 - RNA, 20 nt, Mycobacterium tuberculosis H37Rv
cuucgaucagcggcaguucc

SEQ ID NO: 3278053 - RNA, 20 nt, Mycobacterium tuberculosis H37Rv
cuucgauugcgcugcaccgg

SEQ ID NO: 3278054 - RNA, 16 nt, Mycobacterium tuberculosis H37Rv
cuucgcaagucaucca

SEQ ID NO: 3278055 - RNA, 22 nt, Mycobacterium tuberculosis H37Rv
cuucgcaguugagggugugagg

SEQ ID NO: 3278056 - RNA, 18 nt, Mycobacterium tuberculosis H37Rv
cuucgccaacugcggcag

SEQ ID NO: 3278057 - RNA, 14 nt, Mycobacterium tuberculosis H37Rv
cuucgccacaccau

SEQ ID NO: 3278058 - RNA, 18 nt, Mycobacterium tuberculosis H37Rv
cuucgccagcgccacugg

SEQ ID NO: 3278059 - RNA, 15 nt, Mycobacterium tuberculosis H37Rv
cuucgcccgggccgc

SEQ ID NO: 3278060 - RNA, 16 nt, Mycobacterium tuberculosis H37Rv
cuucgcccgggccgcg

SEQ ID NO: 3278061 - RNA, 17 nt, Mycobacterium tuberculosis H37Rv
cuucgcccuugccgcag

SEQ ID NO: 3278062 - RNA, 13 nt, Mycobacterium tuberculosis H37Rv
cuucgccgaagcg

SEQ ID NO: 3278063 - RNA, 16 nt, Mycobacterium tuberculosis H37Rv
cuucgccgaagcgccg

SEQ ID NO: 3278064 - RNA, 22 nt, Mycobacterium tuberculosis H37Rv
cuucgccgaagcgccgcuuggc

SEQ ID NO: 3278065 - RNA, 18 nt, Mycobacterium tuberculosis H37Rv
cuucgccgaguugaccgc

SEQ ID NO: 3278066 - RNA, 17 nt, Mycobacterium tuberculosis H37Rv
cuucgccggaccccgag

SEQ ID NO: 3278067 - RNA, 23 nt, Mycobacterium tuberculosis H37Rv
cuucgccggcgccagcagaucuc

SEQ ID NO: 3278068 - RNA, 16 nt, Mycobacterium tuberculosis H37Rv
cuucgcgaagaacgac

SEQ ID NO: 3278069 - RNA, 13 nt, Mycobacterium tuberculosis H37Rv
cuucgcgcgcugg

SEQ ID NO: 3278070 - RNA, 21 nt, Mycobacterium tuberculosis H37Rv
cuucgcgcuguacugccccag

SEQ ID NO: 3278071 - RNA, 19 nt, Mycobacterium tuberculosis H37Rv
cuucgcggauguccaggag

SEQ ID NO: 3278072 - RNA, 22 nt, Mycobacterium tuberculosis H37Rv
cuucgcgucggcgaacagacgc

SEQ ID NO: 3278073 - RNA, 19 nt, Mycobacterium tuberculosis H37Rv
cuucgcguuggcccgccug

SEQ ID NO: 3278074 - RNA, 21 nt, Mycobacterium tuberculosis H37Rv
cuucgcguuggcccgccugac

SEQ ID NO: 3278075 - RNA, 18 nt, Mycobacterium tuberculosis H37Rv
cuucgcuaccuucuuggc

SEQ ID NO: 3278076 - RNA, 22 nt, Mycobacterium tuberculosis H37Rv
cuucgcuauggcggcuucgacg

SEQ ID NO: 3278077 - RNA, 20 nt, Mycobacterium tuberculosis H37Rv
cuucgcugguauagcucacg

SEQ ID NO: 3278078 - RNA, 12 nt, Mycobacterium tuberculosis H37Rv
cuucggaccggc

SEQ ID NO: 3278079 - RNA, 18 nt, Mycobacterium tuberculosis H37Rv
cuucggacuggggcacgc

SEQ ID NO: 3278080 - RNA, 15 nt, Mycobacterium tuberculosis H37Rv
cuucggccagaucac

SEQ ID NO: 3278081 - RNA, 16 nt, Mycobacterium tuberculosis H37Rv
cuucggccagaucacg

SEQ ID NO: 3278082 - RNA, 16 nt, Mycobacterium tuberculosis H37Rv
cuucggccgaccgggc

SEQ ID NO: 3278083 - RNA, 12 nt, Mycobacterium tuberculosis H37Rv
cuucggccggcg

SEQ ID NO: 3278084 - RNA, 17 nt, Mycobacterium tuberculosis H37Rv
cuucggcgacaggccga

SEQ ID NO: 3278085 - RNA, 19 nt, Mycobacterium tuberculosis H37Rv
cuucggcgaucgucucggu

SEQ ID NO: 3278086 - RNA, 19 nt, Mycobacterium tuberculosis H37Rv
cuugccgucuucgccgcca

SEQ ID NO: 3278087 - RNA, 16 nt, Mycobacterium tuberculosis H37Rv
cuugccguugggaacc

SEQ ID NO: 3278088 - RNA, 16 nt, Mycobacterium tuberculosis H37Rv
cuugccuccggcgccg

SEQ ID NO: 3278089 - RNA, 17 nt, Mycobacterium tuberculosis H37Rv
cuugccugcgccgaguu

SEQ ID NO: 3278090 - RNA, 18 nt, Mycobacterium tuberculosis H37Rv
cuugccuuccgacccaac

SEQ ID NO: 3278091 - RNA, 21 nt, Mycobacterium tuberculosis H37Rv
cuugcgaaacgaauccgccau

SEQ ID NO: 3278092 - RNA, 19 nt, Mycobacterium tuberculosis H37Rv
cuugcgaccccggcugcgc

SEQ ID NO: 3278093 - RNA, 16 nt, Mycobacterium tuberculosis H37Rv
cuugcgaucgccgcua

SEQ ID NO: 3278094 - RNA, 15 nt, Mycobacterium tuberculosis H37Rv
cuugcgauugcgcac

SEQ ID NO: 3278095 - RNA, 16 nt, Mycobacterium tuberculosis H37Rv
cuugcgcagcaccggu

SEQ ID NO: 3278096 - RNA, 14 nt, Mycobacterium tuberculosis H37Rv
cuugcgcagcagcg

SEQ ID NO: 3278097 - RNA, 21 nt, Mycobacterium tuberculosis H37Rv
cuugcgcagccgcagccgguu

SEQ ID NO: 3278098 - RNA, 18 nt, Mycobacterium tuberculosis H37Rv
cuugcgcaucgccgacag

SEQ ID NO: 3278099 - RNA, 14 nt, Mycobacterium tuberculosis H37Rv
cuugcgccgcagcg

SEQ ID NO: 3278100 - RNA, 19 nt, Mycobacterium tuberculosis H37Rv
cuugcgccgcccaugccuc

SEQ ID NO: 3278101 - RNA, 20 nt, Mycobacterium tuberculosis H37Rv
cuugcgccggaugacaccga

SEQ ID NO: 3278102 - RNA, 11 nt, Mycobacterium tuberculosis H37Rv
cuugcgcggcu

SEQ ID NO: 3278103 - RNA, 16 nt, Mycobacterium tuberculosis H37Rv
cuugcgcggcuugggc

SEQ ID NO: 3278104 - RNA, 18 nt, Mycobacterium tuberculosis H37Rv
cuugcggaagaagugcuc

SEQ ID NO: 3278105 - RNA, 14 nt, Mycobacterium tuberculosis H37Rv
cuugcggaccuggc

SEQ ID NO: 3278106 - RNA, 13 nt, Mycobacterium tuberculosis H37Rv
cuugcggcaccca

SEQ ID NO: 3278107 - RNA, 14 nt, Mycobacterium tuberculosis H37Rv
cuugcggcagacca

SEQ ID NO: 3278108 - RNA, 22 nt, Mycobacterium tuberculosis H37Rv
cuugcggccgcugaucaacaga

SEQ ID NO: 3278109 - RNA, 14 nt, Mycobacterium tuberculosis H37Rv
cuugcggcugccca

SEQ ID NO: 3278110 - RNA, 18 nt, Mycobacterium tuberculosis H37Rv
cuugcggcugcccacccc

SEQ ID NO: 3278111 - RNA, 18 nt, Mycobacterium tuberculosis H37Rv
cuugcgggcagccgcccg

SEQ ID NO: 3278112 - RNA, 16 nt, Mycobacterium tuberculosis H37Rv
cuugcgggcucucggc

SEQ ID NO: 3278113 - RNA, 17 nt, Mycobacterium tuberculosis H37Rv
cuugcgggcucucggcg

SEQ ID NO: 3278114 - RNA, 19 nt, Mycobacterium tuberculosis H37Rv
cuugcgguccaggccggca

SEQ ID NO: 3278115 - RNA, 21 nt, Mycobacterium tuberculosis H37Rv
cuugcgugaugguugcucgag

SEQ ID NO: 3278116 - RNA, 17 nt, Mycobacterium tuberculosis H37Rv
cuugcgugcccguuggu

SEQ ID NO: 3278117 - RNA, 17 nt, Mycobacterium tuberculosis H37Rv
cuugcguguaccagccc

SEQ ID NO: 3278118 - RNA, 21 nt, Mycobacterium tuberculosis H37Rv
cuugcuaacgcaucuuggugc

SEQ ID NO: 3278119 - RNA, 20 nt, Mycobacterium tuberculosis H37Rv
cuugcucagcucgaccccgg

SEQ ID NO: 3278120 - RNA, 14 nt, Mycobacterium tuberculosis H37Rv
cuugcuccacaucg

SEQ ID NO: 3278121 - RNA, 23 nt, Mycobacterium tuberculosis H37Rv
cuugcucgacgaucugcagcacu

SEQ ID NO: 3278122 - RNA, 16 nt, Mycobacterium tuberculosis H37Rv
cuugcucggcgugcuc

SEQ ID NO: 3278123 - RNA, 16 nt, Mycobacterium tuberculosis H37Rv
cuugcucguccagguc

SEQ ID NO: 3278124 - RNA, 16 nt, Mycobacterium tuberculosis H37Rv
cuugcucucgcagcau

SEQ ID NO: 3278125 - RNA, 22 nt, Mycobacterium tuberculosis H37Rv
cuugcugcacgcucugcgccac

SEQ ID NO: 3278126 - RNA, 19 nt, Mycobacterium tuberculosis H37Rv
cuugcugcuccuucucgcg

SEQ ID NO: 3278127 - RNA, 20 nt, Mycobacterium tuberculosis H37Rv
cuuggaaggcgcgcgcccgg

SEQ ID NO: 3278128 - RNA, 12 nt, Mycobacterium tuberculosis H37Rv
cuuggacagcag

SEQ ID NO: 3278129 - RNA, 14 nt, Mycobacterium tuberculosis H37Rv
cuuggacagcagca

SEQ ID NO: 3278130 - RNA, 22 nt, Mycobacterium tuberculosis H37Rv
cuuggaccagcguggggccgcc

SEQ ID NO: 3278131 - RNA, 16 nt, Mycobacterium tuberculosis H37Rv
cuuggacccugcgccg

SEQ ID NO: 3278132 - RNA, 15 nt, Mycobacterium tuberculosis H37Rv
cuuggacucggcggg

SEQ ID NO: 3278133 - RNA, 22 nt, Mycobacterium tuberculosis H37Rv
cuuggagaagguuucccgcuua

SEQ ID NO: 3278134 - RNA, 16 nt, Mycobacterium tuberculosis H37Rv
cuuggagaugucggug

SEQ ID NO: 3278135 - RNA, 14 nt, Mycobacterium tuberculosis H37Rv
cuuggaucgguugg

SEQ ID NO: 3278136 - RNA, 20 nt, Mycobacterium tuberculosis H37Rv
cuuggcaaucaucucccgac

SEQ ID NO: 3278137 - RNA, 18 nt, Mycobacterium tuberculosis H37Rv
cuuggcaggugccuucuu

SEQ ID NO: 3278138 - RNA, 17 nt, Mycobacterium tuberculosis H37Rv
cuuggccaccaucgccg

SEQ ID NO: 3278139 - RNA, 14 nt, Mycobacterium tuberculosis H37Rv
cuuggccagcagcc

SEQ ID NO: 3278140 - RNA, 16 nt, Mycobacterium tuberculosis H37Rv
cuuggccagcagcgcg

SEQ ID NO: 3278141 - RNA, 16 nt, Mycobacterium tuberculosis H37Rv
cuuggccagccacucc

SEQ ID NO: 3278142 - RNA, 19 nt, Mycobacterium tuberculosis H37Rv
cuuggccaggaagucccgg

SEQ ID NO: 3278143 - RNA, 16 nt, Mycobacterium tuberculosis H37Rv
cuuggccaucacggcg

SEQ ID NO: 3278144 - RNA, 20 nt, Mycobacterium tuberculosis H37Rv
cuuggccaugcuggucagcg

SEQ ID NO: 3278145 - RNA, 18 nt, Mycobacterium tuberculosis H37Rv
cuuggccgccccggccgc

SEQ ID NO: 3278146 - RNA, 15 nt, Mycobacterium tuberculosis H37Rv
cuuggccgccgccac

SEQ ID NO: 3278147 - RNA, 12 nt, Mycobacterium tuberculosis H37Rv
cuuggccgcgca

SEQ ID NO: 3278148 - RNA, 14 nt, Mycobacterium tuberculosis H37Rv
cuuggccgcugccu

SEQ ID NO: 3278149 - RNA, 22 nt, Mycobacterium tuberculosis H37Rv
cuuggccugcgcuucguccagc

SEQ ID NO: 3278150 - RNA, 19 nt, Mycobacterium tuberculosis H37Rv
cuuggccuucugaagucua

SEQ ID NO: 3278151 - RNA, 19 nt, Mycobacterium tuberculosis H37Rv
cuuggcgacaugcagcgcc

SEQ ID NO: 3278152 - RNA, 14 nt, Mycobacterium tuberculosis H37Rv
cuuggcgaccaugc

SEQ ID NO: 3278153 - RNA, 21 nt, Mycobacterium tuberculosis H37Rv
cuuggcgaccuugacccgcaa

SEQ ID NO: 3278154 - RNA, 16 nt, Mycobacterium tuberculosis H37Rv
cuuggcgacgucgcgg

SEQ ID NO: 3278155 - RNA, 14 nt, Mycobacterium tuberculosis H37Rv
cuuggcgacgucgg

SEQ ID NO: 3278156 - RNA, 17 nt, Mycobacterium tuberculosis H37Rv
cuuggcgauccaggcca

SEQ ID NO: 3278157 - RNA, 20 nt, Mycobacterium tuberculosis H37Rv
cuuggcgaucucaccuggag

SEQ ID NO: 3278158 - RNA, 19 nt, Mycobacterium tuberculosis H37Rv
cuuggcgccgaugccggcc

SEQ ID NO: 3278159 - RNA, 12 nt, Mycobacterium tuberculosis H37Rv
cuuggcggccuu

SEQ ID NO: 3278160 - RNA, 17 nt, Mycobacterium tuberculosis H37Rv
cuuggcgggagccuugg

SEQ ID NO: 3278161 - RNA, 15 nt, Mycobacterium tuberculosis H37Rv
cuuggcgggaucgag

SEQ ID NO: 3278162 - RNA, 12 nt, Mycobacterium tuberculosis H37Rv
cuuggcgggcgc

SEQ ID NO: 3278163 - RNA, 19 nt, Mycobacterium tuberculosis H37Rv
cuuggcguauccuugcgac

SEQ ID NO: 3278164 - RNA, 23 nt, Mycobacterium tuberculosis H37Rv
cuuggcgucgacaucggugacgg

SEQ ID NO: 3278165 - RNA, 21 nt, Mycobacterium tuberculosis H37Rv
cuuggcgucgaucagggcccc

SEQ ID NO: 3278166 - RNA, 24 nt, Mycobacterium tuberculosis H37Rv
cuuggcgugaccuaccuccucggc

SEQ ID NO: 3278167 - RNA, 17 nt, Mycobacterium tuberculosis H37Rv
cuuggcuaacaccgcag

SEQ ID NO: 3278168 - RNA, 23 nt, Mycobacterium tuberculosis H37Rv
cuuggcuucgacgcuuccugggu

SEQ ID NO: 3278169 - RNA, 19 nt, Mycobacterium tuberculosis H37Rv
cuugggauugcgggccugc

SEQ ID NO: 3278170 - RNA, 13 nt, Mycobacterium tuberculosis H37Rv
cuugggcaccacc

SEQ ID NO: 3278171 - RNA, 23 nt, Mycobacterium tuberculosis H37Rv
cuugggcagauauugccugccac

SEQ ID NO: 3278172 - RNA, 15 nt, Mycobacterium tuberculosis H37Rv
cuugggccaggccca

SEQ ID NO: 3278173 - RNA, 17 nt, Mycobacterium tuberculosis H37Rv
cuugggccaggcccagc

SEQ ID NO: 3278174 - RNA, 21 nt, Mycobacterium tuberculosis H37Rv
cuugggcgacgcggcgccgcc

SEQ ID NO: 3278175 - RNA, 19 nt, Mycobacterium tuberculosis H37Rv
cuugggcucgaaaacaugu

SEQ ID NO: 3278176 - RNA, 14 nt, Mycobacterium tuberculosis H37Rv
cuugggcuugcgcc

SEQ ID NO: 3278177 - RNA, 22 nt, Mycobacterium tuberculosis H37Rv
cuuggggcguuucggcgggcgc

SEQ ID NO: 3278178 - RNA, 17 nt, Mycobacterium tuberculosis H37Rv
cuugggucggucacgac

SEQ ID NO: 3278179 - RNA, 21 nt, Mycobacterium tuberculosis H37Rv
cuuggguuccguggauggacc

SEQ ID NO: 3278180 - RNA, 17 nt, Mycobacterium tuberculosis H37Rv
cuugguagccggccgcu

SEQ ID NO: 3278181 - RNA, 22 nt, Mycobacterium tuberculosis H37Rv
cuuggucaaaaagcucggcccu

SEQ ID NO: 3278182 - RNA, 16 nt, Mycobacterium tuberculosis H37Rv
cuuuugauugaccaac

SEQ ID NO: 3278183 - RNA, 14 nt, Mycobacterium tuberculosis H37Rv
cuuuugcgucugcu

SEQ ID NO: 3278184 - RNA, 19 nt, Mycobacterium tuberculosis H37Rv
cuuuugcgucuucucggcg

SEQ ID NO: 3278185 - RNA, 22 nt, Mycobacterium tuberculosis H37Rv
cuuuuucccggcggcgcgcccg

SEQ ID NO: 3278186 - RNA, 15 nt, Mycobacterium tuberculosis H37Rv
cuuuuugcgucuguu

SEQ ID NO: 3278187 - RNA, 15 nt, Mycobacterium tuberculosis H37Rv
gaaaaaccucgacgc

SEQ ID NO: 3278188 - RNA, 14 nt, Mycobacterium tuberculosis H37Rv
gaaaaagaccgaca

SEQ ID NO: 3278189 - RNA, 13 nt, Mycobacterium tuberculosis H37Rv
gaaaaagcccgac

SEQ ID NO: 3278190 - RNA, 14 nt, Mycobacterium tuberculosis H37Rv
gaaaaagcccgaca

SEQ ID NO: 3278191 - RNA, 23 nt, Mycobacterium tuberculosis H37Rv
gaaaacaacccgaacacgcugga

SEQ ID NO: 3278192 - RNA, 14 nt, Mycobacterium tuberculosis H37Rv
gaaaaccgcaccgu

SEQ ID NO: 3278193 - RNA, 20 nt, Mycobacterium tuberculosis H37Rv
gaaaaccucggacugcagcg

SEQ ID NO: 3278194 - RNA, 14 nt, Mycobacterium tuberculosis H37Rv
gaaaacgcccggca

SEQ ID NO: 3278195 - RNA, 19 nt, Mycobacterium tuberculosis H37Rv
gaaaacgggguggcacgca

SEQ ID NO: 3278196 - RNA, 14 nt, Mycobacterium tuberculosis H37Rv
gaaaagaacccggg

SEQ ID NO: 3278197 - RNA, 21 nt, Mycobacterium tuberculosis H37Rv
gaaaagccacggcugcccaug

SEQ ID NO: 3278198 - RNA, 18 nt, Mycobacterium tuberculosis H37Rv
gaaaagcccggaaucgcg

SEQ ID NO: 3278199 - RNA, 23 nt, Mycobacterium tuberculosis H37Rv
gaaaaguuggcuugcgcgcaggu

SEQ ID NO: 3278200 - RNA, 21 nt, Mycobacterium tuberculosis H37Rv
gaaaaucgggucacacuccca

SEQ ID NO: 3278201 - RNA, 17 nt, Mycobacterium tuberculosis H37Rv
gaaaaugauagcggcgc

SEQ ID NO: 3278202 - RNA, 15 nt, Mycobacterium tuberculosis H37Rv
gaaaaugccgcccag

SEQ ID NO: 3278203 - RNA, 19 nt, Mycobacterium tuberculosis H37Rv
gaaaaugccgcucucggcg

SEQ ID NO: 3278204 - RNA, 22 nt, Mycobacterium tuberculosis H37Rv
gaaacaacgucgccgcggcggc

SEQ ID NO: 3278205 - RNA, 22 nt, Mycobacterium tuberculosis H37Rv
gaaacaagcaagcguguuguuu

SEQ ID NO: 3278206 - RNA, 15 nt, Mycobacterium tuberculosis H37Rv
gaaacaccggccagc

SEQ ID NO: 3278207 - RNA, 14 nt, Mycobacterium tuberculosis H37Rv
gaaacaccgucugg

SEQ ID NO: 3278208 - RNA, 15 nt, Mycobacterium tuberculosis H37Rv
gaaacagcauggcga

SEQ ID NO: 3278209 - RNA, 16 nt, Mycobacterium tuberculosis H37Rv
gaaacagccgcagcgg

SEQ ID NO: 3278210 - RNA, 17 nt, Mycobacterium tuberculosis H37Rv
gaaacagccgcagcggc

SEQ ID NO: 3278211 - RNA, 20 nt, Mycobacterium tuberculosis H37Rv
gaaacaggacgugucgguac

SEQ ID NO: 3278212 - RNA, 21 nt, Mycobacterium tuberculosis H37Rv
gaaacaggacgugucgguacu

SEQ ID NO: 3278213 - RNA, 23 nt, Mycobacterium tuberculosis H37Rv
gaaacaucucggcgcagccggug

SEQ ID NO: 3278214 - RNA, 14 nt, Mycobacterium tuberculosis H37Rv
gaaaccacagcgcc

SEQ ID NO: 3278215 - RNA, 15 nt, Mycobacterium tuberculosis H37Rv
gaaaccaucgccagc

SEQ ID NO: 3278216 - RNA, 16 nt, Mycobacterium tuberculosis H37Rv
gaaaccaucgccagcc

SEQ ID NO: 3278217 - RNA, 23 nt, Mycobacterium tuberculosis H37Rv
gaaaccaugccgccgaagccgcg

SEQ ID NO: 3278218 - RNA, 17 nt, Mycobacterium tuberculosis H37Rv
gaaacccaugcaugcgu

SEQ ID NO: 3278219 - RNA, 15 nt, Mycobacterium tuberculosis H37Rv
gaaacccgccgcgau

SEQ ID NO: 3278220 - RNA, 20 nt, Mycobacterium tuberculosis H37Rv
gaaacccugcacccgacccg

SEQ ID NO: 3278221 - RNA, 18 nt, Mycobacterium tuberculosis H37Rv
gaaaccgaguugucgcgc

SEQ ID NO: 3278222 - RNA, 20 nt, Mycobacterium tuberculosis H37Rv
gaaaccgaguugucgcgcua

SEQ ID NO: 3278223 - RNA, 11 nt, Mycobacterium tuberculosis H37Rv
gaaaccgccgu

SEQ ID NO: 3278224 - RNA, 19 nt, Mycobacterium tuberculosis H37Rv
gaaaccggccagccgacgc

SEQ ID NO: 3278225 - RNA, 15 nt, Mycobacterium tuberculosis H37Rv
gaaaccggucagcac

SEQ ID NO: 3278226 - RNA, 20 nt, Mycobacterium tuberculosis H37Rv
gaaaccggugguagcgacga

SEQ ID NO: 3278227 - RNA, 15 nt, Mycobacterium tuberculosis H37Rv
gaaacgaauccgcca

SEQ ID NO: 3278228 - RNA, 12 nt, Mycobacterium tuberculosis H37Rv
gaaacgauggcc

SEQ ID NO: 3278229 - RNA, 14 nt, Mycobacterium tuberculosis H37Rv
gaaacgccauacgu

SEQ ID NO: 3278230 - RNA, 19 nt, Mycobacterium tuberculosis H37Rv
gaaacgcccgggcggcguc

SEQ ID NO: 3278231 - RNA, 14 nt, Mycobacterium tuberculosis H37Rv
gaaacgccgaccgc

SEQ ID NO: 3278232 - RNA, 14 nt, Mycobacterium tuberculosis H37Rv
gaaacgccgucgcc

SEQ ID NO: 3278233 - RNA, 21 nt, Mycobacterium tuberculosis H37Rv
gaaacgcgaugguggccgcca

SEQ ID NO: 3278234 - RNA, 16 nt, Mycobacterium tuberculosis H37Rv
gaaacggaccuccucg

SEQ ID NO: 3278235 - RNA, 21 nt, Mycobacterium tuberculosis H37Rv
gaaacggaccuccucgcccau

SEQ ID NO: 3278236 - RNA, 14 nt, Mycobacterium tuberculosis H37Rv
gaaacggccgggca

SEQ ID NO: 3278237 - RNA, 18 nt, Mycobacterium tuberculosis H37Rv
gaaacgguacgccgccgc

SEQ ID NO: 3278238 - RNA, 18 nt, Mycobacterium tuberculosis H37Rv
gaaacggugucucgccca

SEQ ID NO: 3278239 - RNA, 17 nt, Mycobacterium tuberculosis H37Rv
gaaacguaugacgccca

SEQ ID NO: 3278240 - RNA, 22 nt, Mycobacterium tuberculosis H37Rv
gaaacgucugccacgucggcga

SEQ ID NO: 3278241 - RNA, 18 nt, Mycobacterium tuberculosis H37Rv
gaaacuacucccccgcga

SEQ ID NO: 3278242 - RNA, 19 nt, Mycobacterium tuberculosis H37Rv
gaaacucaagccacgucgu

SEQ ID NO: 3278243 - RNA, 16 nt, Mycobacterium tuberculosis H37Rv
gaaacucaccagcacc

SEQ ID NO: 3278244 - RNA, 17 nt, Mycobacterium tuberculosis H37Rv
gaaacucaccagcaccc

SEQ ID NO: 3278245 - RNA, 17 nt, Mycobacterium tuberculosis H37Rv
gaaacugaugucgccga

SEQ ID NO: 3278246 - RNA, 17 nt, Mycobacterium tuberculosis H37Rv
gaaagcaccgaugcuga

SEQ ID NO: 3278247 - RNA, 23 nt, Mycobacterium tuberculosis H37Rv
gaaagccuaguccuggcucggca

SEQ ID NO: 3278248 - RNA, 17 nt, Mycobacterium tuberculosis H37Rv
gaaagcguaaggccgga

SEQ ID NO: 3278249 - RNA, 20 nt, Mycobacterium tuberculosis H37Rv
gaaagcguaaggccggaguc

SEQ ID NO: 3278250 - RNA, 17 nt, Mycobacterium tuberculosis H37Rv
gaaagcgucgagcugau

SEQ ID NO: 3278251 - RNA, 21 nt, Mycobacterium tuberculosis H37Rv
gaaaggucucuucggagauac

SEQ ID NO: 3278252 - RNA, 17 nt, Mycobacterium tuberculosis H37Rv
gaaagucuccggaacca

SEQ ID NO: 3278253 - RNA, 22 nt, Mycobacterium tuberculosis H37Rv
gaaauacagauauuugucggcg

SEQ ID NO: 3278254 - RNA, 18 nt, Mycobacterium tuberculosis H37Rv
gaaauacccagcgcagca

SEQ ID NO: 3278255 - RNA, 20 nt, Mycobacterium tuberculosis H37Rv
gaaauacccagcgcagcagc

SEQ ID NO: 3278256 - RNA, 20 nt, Mycobacterium tuberculosis H37Rv
gaaauagcccaagccgaucg

SEQ ID NO: 3278257 - RNA, 15 nt, Mycobacterium tuberculosis H37Rv
gaaauagcgagcguu

SEQ ID NO: 3278258 - RNA, 23 nt, Mycobacterium tuberculosis H37Rv
gaaauagucuucuuucgccuccg

SEQ ID NO: 3278259 - RNA, 22 nt, Mycobacterium tuberculosis H37Rv
gaaauaucucggugacgaugaa

SEQ ID NO: 3278260 - RNA, 16 nt, Mycobacterium tuberculosis H37Rv
gaaaucaccucaccag

SEQ ID NO: 3278261 - RNA, 21 nt, Mycobacterium tuberculosis H37Rv
gaaauccagauaauccuggua

SEQ ID NO: 3278262 - RNA, 18 nt, Mycobacterium tuberculosis H37Rv
gaaauccccugcgcugca

SEQ ID NO: 3278263 - RNA, 21 nt, Mycobacterium tuberculosis H37Rv
gaaauccccugcgcugcagcu

SEQ ID NO: 3278264 - RNA, 14 nt, Mycobacterium tuberculosis H37Rv
gaaauccgcgaucg

SEQ ID NO: 3278265 - RNA, 16 nt, Mycobacterium tuberculosis H37Rv
gaaauccuccuccgca

SEQ ID NO: 3278266 - RNA, 18 nt, Mycobacterium tuberculosis H37Rv
gaaaucgcccugacccgg

SEQ ID NO: 3278267 - RNA, 20 nt, Mycobacterium tuberculosis H37Rv
gaaaucgcccugacccggag

SEQ ID NO: 3278268 - RNA, 18 nt, Mycobacterium tuberculosis H37Rv
gaaaucggccagcuuccc

SEQ ID NO: 3278269 - RNA, 22 nt, Mycobacterium tuberculosis H37Rv
gaaaucgucggguaccagcacc

SEQ ID NO: 3278270 - RNA, 14 nt, Mycobacterium tuberculosis H37Rv
gaaaugaagugcac

SEQ ID NO: 3278271 - RNA, 14 nt, Mycobacterium tuberculosis H37Rv
gaaaugacggcuga

SEQ ID NO: 3278272 - RNA, 16 nt, Mycobacterium tuberculosis H37Rv
gaaaugaggucuuugc

SEQ ID NO: 3278273 - RNA, 15 nt, Mycobacterium tuberculosis H37Rv
gaaaugccggugccg

SEQ ID NO: 3278274 - RNA, 16 nt, Mycobacterium tuberculosis H37Rv
gaaaugguucgcacac

SEQ ID NO: 3278275 - RNA, 16 nt, Mycobacterium tuberculosis H37Rv
gaaauucucgcccuga

SEQ ID NO: 3278276 - RNA, 14 nt, Mycobacterium tuberculosis H37Rv
gaaauugagccggc

SEQ ID NO: 3278277 - RNA, 23 nt, Mycobacterium tuberculosis H37Rv
gaacaacagcggcaacgccuccg

SEQ ID NO: 3278278 - RNA, 19 nt, Mycobacterium tuberculosis H37Rv
gaacccagcacugggauga

SEQ ID NO: 3278279 - RNA, 12 nt, Mycobacterium tuberculosis H37Rv
gaacccaggcac

SEQ ID NO: 3278280 - RNA, 23 nt, Mycobacterium tuberculosis H37Rv
gaaccccagcuuggcgucgaugc

SEQ ID NO: 3278281 - RNA, 15 nt, Mycobacterium tuberculosis H37Rv
gaacccccagcugca

SEQ ID NO: 3278282 - RNA, 17 nt, Mycobacterium tuberculosis H37Rv
gaacccccagcugcagg

SEQ ID NO: 3278283 - RNA, 18 nt, Mycobacterium tuberculosis H37Rv
gaacccccagcugcaggg

SEQ ID NO: 3278284 - RNA, 16 nt, Mycobacterium tuberculosis H37Rv
gaaccccgagcugcca

SEQ ID NO: 3278285 - RNA, 19 nt, Mycobacterium tuberculosis H37Rv
gaaccccgcgcggugcccu

SEQ ID NO: 3278286 - RNA, 21 nt, Mycobacterium tuberculosis H37Rv
gaacccgauaacaaggccgcc

SEQ ID NO: 3278287 - RNA, 23 nt, Mycobacterium tuberculosis H37Rv
gaacccgauaacaaggccgccgc

SEQ ID NO: 3278288 - RNA, 19 nt, Mycobacterium tuberculosis H37Rv
gaacccgaucgucgagccg

SEQ ID NO: 3278289 - RNA, 20 nt, Mycobacterium tuberculosis H37Rv
gaacccgcgagguugaccac

SEQ ID NO: 3278290 - RNA, 14 nt, Mycobacterium tuberculosis H37Rv
gaacccgcuuucgg

SEQ ID NO: 3278291 - RNA, 15 nt, Mycobacterium tuberculosis H37Rv
gaacccgguguugag

SEQ ID NO: 3278292 - RNA, 17 nt, Mycobacterium tuberculosis H37Rv
gaacccucagccgcgcc

SEQ ID NO: 3278293 - RNA, 19 nt, Mycobacterium tuberculosis H37Rv
gaaccgaagccucggcaug

SEQ ID NO: 3278294 - RNA, 21 nt, Mycobacterium tuberculosis H37Rv
gaaccgacgcguccggugcac

SEQ ID NO: 3278295 - RNA, 13 nt, Mycobacterium tuberculosis H37Rv
gaaccgacggcca

SEQ ID NO: 3278296 - RNA, 19 nt, Mycobacterium tuberculosis H37Rv
gaaccgauaccucgccauc

SEQ ID NO: 3278297 - RNA, 15 nt, Mycobacterium tuberculosis H37Rv
gaaccgaucaucaua

SEQ ID NO: 3278298 - RNA, 21 nt, Mycobacterium tuberculosis H37Rv
gaaccgaucaucauauccgcc

SEQ ID NO: 3278299 - RNA, 17 nt, Mycobacterium tuberculosis H37Rv
gaaccgccggcaccgcc

SEQ ID NO: 3278300 - RNA, 19 nt, Mycobacterium tuberculosis H37Rv
gaaccgccggcugcgccag

SEQ ID NO: 3278301 - RNA, 13 nt, Mycobacterium tuberculosis H37Rv
gaaccgcgcggcg

SEQ ID NO: 3278302 - RNA, 19 nt, Mycobacterium tuberculosis H37Rv
gaaccgcguuaugccaggc

SEQ ID NO: 3278303 - RNA, 20 nt, Mycobacterium tuberculosis H37Rv
gaaccgcguuaugccaggcg

SEQ ID NO: 3278304 - RNA, 16 nt, Mycobacterium tuberculosis H37Rv
gaaccgcucagcgcag

SEQ ID NO: 3278305 - RNA, 18 nt, Mycobacterium tuberculosis H37Rv
gaaccgcucagcgcagca

SEQ ID NO: 3278306 - RNA, 18 nt, Mycobacterium tuberculosis H37Rv
gaaccgcucgucacgugu

SEQ ID NO: 3278307 - RNA, 14 nt, Mycobacterium tuberculosis H37Rv
gaaccgcugcgggu

SEQ ID NO: 3278308 - RNA, 22 nt, Mycobacterium tuberculosis H37Rv
gaaccgcugcuccucgcgguag

SEQ ID NO: 3278309 - RNA, 13 nt, Mycobacterium tuberculosis H37Rv
gaaccgcugggac

SEQ ID NO: 3278310 - RNA, 14 nt, Mycobacterium tuberculosis H37Rv
gaaccggacagcgu

SEQ ID NO: 3278311 - RNA, 14 nt, Mycobacterium tuberculosis H37Rv
gaaccggaccuggg

SEQ ID NO: 3278312 - RNA, 14 nt, Mycobacterium tuberculosis H37Rv
gaaccggcaccagc

SEQ ID NO: 3278313 - RNA, 19 nt, Mycobacterium tuberculosis H37Rv
gaaccggccgacgaacagc

SEQ ID NO: 3278314 - RNA, 16 nt, Mycobacterium tuberculosis H37Rv
gaaccggccgcgacga

SEQ ID NO: 3278315 - RNA, 22 nt, Mycobacterium tuberculosis H37Rv
gaaccggccgcgacgacacgcc

SEQ ID NO: 3278316 - RNA, 18 nt, Mycobacterium tuberculosis H37Rv
gaaccggcgugcagcacu

SEQ ID NO: 3278317 - RNA, 20 nt, Mycobacterium tuberculosis H37Rv
gaaccggcugggcgccacca

SEQ ID NO: 3278318 - RNA, 15 nt, Mycobacterium tuberculosis H37Rv
gaaccgggcaaauca

SEQ ID NO: 3278319 - RNA, 16 nt, Mycobacterium tuberculosis H37Rv
gaaccgggcaaaucaa

SEQ ID NO: 3278320 - RNA, 20 nt, Mycobacterium tuberculosis H37Rv
gaaccgggcaaaucaagcac

SEQ ID NO: 3278321 - RNA, 22 nt, Mycobacterium tuberculosis H37Rv
gaaccgggcaaaucaagcacag

SEQ ID NO: 3278322 - RNA, 17 nt, Mycobacterium tuberculosis H37Rv
gaaccgguacaaccccc

SEQ ID NO: 3278323 - RNA, 16 nt, Mycobacterium tuberculosis H37Rv
gaaccggucagccgga

SEQ ID NO: 3278324 - RNA, 22 nt, Mycobacterium tuberculosis H37Rv
gaaccggucagccggaccacca

SEQ ID NO: 3278325 - RNA, 15 nt, Mycobacterium tuberculosis H37Rv
gaaccggucgauccc

SEQ ID NO: 3278326 - RNA, 17 nt, Mycobacterium tuberculosis H37Rv
gaaccggucgaucccca

SEQ ID NO: 3278327 - RNA, 16 nt, Mycobacterium tuberculosis H37Rv
gaaccguacgccagau

SEQ ID NO: 3278328 - RNA, 18 nt, Mycobacterium tuberculosis H37Rv
gaaccgucucgcccccuc

SEQ ID NO: 3278329 - RNA, 17 nt, Mycobacterium tuberculosis H37Rv
gaaccguucgacccagc

SEQ ID NO: 3278330 - RNA, 18 nt, Mycobacterium tuberculosis H37Rv
gaaccguucgacccagcg

SEQ ID NO: 3278331 - RNA, 20 nt, Mycobacterium tuberculosis H37Rv
gaaccguucgcucagggugu

SEQ ID NO: 3278332 - RNA, 21 nt, Mycobacterium tuberculosis H37Rv
gaaccguucggcgacagcgcg

SEQ ID NO: 3278333 - RNA, 23 nt, Mycobacterium tuberculosis H37Rv
gaaccuccucggguucgucaguc

SEQ ID NO: 3278334 - RNA, 24 nt, Mycobacterium tuberculosis H37Rv
gaaccuccucggguucgucaguca

SEQ ID NO: 3278335 - RNA, 17 nt, Mycobacterium tuberculosis H37Rv
gaaccucgaccgucacc

SEQ ID NO: 3278336 - RNA, 15 nt, Mycobacterium tuberculosis H37Rv
gaaccucggcggugu

SEQ ID NO: 3278337 - RNA, 20 nt, Mycobacterium tuberculosis H37Rv
gaaccucggcggugucgacc

SEQ ID NO: 3278338 - RNA, 15 nt, Mycobacterium tuberculosis H37Rv
gaaccugauccgcua

SEQ ID NO: 3278339 - RNA, 11 nt, Mycobacterium tuberculosis H37Rv
gaaccugcuga

SEQ ID NO: 3278340 - RNA, 17 nt, Mycobacterium tuberculosis H37Rv
gaaccuggcgacgcgac

SEQ ID NO: 3278341 - RNA, 18 nt, Mycobacterium tuberculosis H37Rv
gaaccuggcgacgcgaca

SEQ ID NO: 3278342 - RNA, 24 nt, Mycobacterium tuberculosis H37Rv
gaacgaaaugcacgccgggcacug

SEQ ID NO: 3278343 - RNA, 23 nt, Mycobacterium tuberculosis H37Rv
gaacgacagcagaaucucggguc

SEQ ID NO: 3278344 - RNA, 14 nt, Mycobacterium tuberculosis H37Rv
gaacgacauccggc

SEQ ID NO: 3278345 - RNA, 12 nt, Mycobacterium tuberculosis H37Rv
gaacgacgccac

SEQ ID NO: 3278346 - RNA, 14 nt, Mycobacterium tuberculosis H37Rv
gaacgaucgaugac

SEQ ID NO: 3278347 - RNA, 19 nt, Mycobacterium tuberculosis H37Rv
gaacgaucggaccaccagg

SEQ ID NO: 3278348 - RNA, 15 nt, Mycobacterium tuberculosis H37Rv
gaacgaugccgccgg

SEQ ID NO: 3278349 - RNA, 18 nt, Mycobacterium tuberculosis H37Rv
gaacgauguccgcgcgaa

SEQ ID NO: 3278350 - RNA, 13 nt, Mycobacterium tuberculosis H37Rv
gaacgcaccgaaa

SEQ ID NO: 3278351 - RNA, 14 nt, Mycobacterium tuberculosis H37Rv
gaacgcaccgaaac

SEQ ID NO: 3278352 - RNA, 19 nt, Mycobacterium tuberculosis H37Rv
gaacgcaccgaaacgccga

SEQ ID NO: 3278353 - RNA, 14 nt, Mycobacterium tuberculosis H37Rv
gaacgcagccagcg

SEQ ID NO: 3278354 - RNA, 14 nt, Mycobacterium tuberculosis H37Rv
gaacgcaucggucc

SEQ ID NO: 3278355 - RNA, 21 nt, Mycobacterium tuberculosis H37Rv
gaacgccaccaccuccgcguc

SEQ ID NO: 3278356 - RNA, 14 nt, Mycobacterium tuberculosis H37Rv
gaacgccaccccca

SEQ ID NO: 3278357 - RNA, 13 nt, Mycobacterium tuberculosis H37Rv
gaacgccagaccg

SEQ ID NO: 3278358 - RNA, 23 nt, Mycobacterium tuberculosis H37Rv
gaacgccagaccgacugcgggcc

SEQ ID NO: 3278359 - RNA, 16 nt, Mycobacterium tuberculosis H37Rv
gaacgccagaccgccg

SEQ ID NO: 3278360 - RNA, 13 nt, Mycobacterium tuberculosis H37Rv
gaacgccagcagc

SEQ ID NO: 3278361 - RNA, 15 nt, Mycobacterium tuberculosis H37Rv
gaacgccagcagcgc

SEQ ID NO: 3278362 - RNA, 14 nt, Mycobacterium tuberculosis H37Rv
gaacgccaggucau

SEQ ID NO: 3278363 - RNA, 15 nt, Mycobacterium tuberculosis H37Rv
gaacgcccgcaggac

SEQ ID NO: 3278364 - RNA, 18 nt, Mycobacterium tuberculosis H37Rv
gaacgcccgcaggacgcu

SEQ ID NO: 3278365 - RNA, 20 nt, Mycobacterium tuberculosis H37Rv
gaacgcccgcuucagcacgg

SEQ ID NO: 3278366 - RNA, 22 nt, Mycobacterium tuberculosis H37Rv
gaacgccgaacaccgccgcguc

SEQ ID NO: 3278367 - RNA, 15 nt, Mycobacterium tuberculosis H37Rv
gaacgccgccccgau

SEQ ID NO: 3278368 - RNA, 14 nt, Mycobacterium tuberculosis H37Rv
gaacgccucaccga

SEQ ID NO: 3278369 - RNA, 20 nt, Mycobacterium tuberculosis H37Rv
gaacgccucgccggccgcca

SEQ ID NO: 3278370 - RNA, 21 nt, Mycobacterium tuberculosis H37Rv
gaacgccugcucgucggccac

SEQ ID NO: 3278371 - RNA, 23 nt, Mycobacterium tuberculosis H37Rv
gaacgcgagcaacaccagggccu

SEQ ID NO: 3278372 - RNA, 14 nt, Mycobacterium tuberculosis H37Rv
gaacgcgagcgcua

SEQ ID NO: 3278373 - RNA, 15 nt, Mycobacterium tuberculosis H37Rv
gaacgcgauccgggu

SEQ ID NO: 3278374 - RNA, 18 nt, Mycobacterium tuberculosis H37Rv
gaacugggcgcccgcggu

SEQ ID NO: 3278375 - RNA, 14 nt, Mycobacterium tuberculosis H37Rv
gaacugguagcccg

SEQ ID NO: 3278376 - RNA, 16 nt, Mycobacterium tuberculosis H37Rv
gaacugguuucgcacc

SEQ ID NO: 3278377 - RNA, 21 nt, Mycobacterium tuberculosis H37Rv
gaacugugcuauggccgcacc

SEQ ID NO: 3278378 - RNA, 12 nt, Mycobacterium tuberculosis H37Rv
gaacuucuccac

SEQ ID NO: 3278379 - RNA, 23 nt, Mycobacterium tuberculosis H37Rv
gaacuugcggaccuggcggcggu

SEQ ID NO: 3278380 - RNA, 11 nt, Mycobacterium tuberculosis H37Rv
gaacuuggccg

SEQ ID NO: 3278381 - RNA, 19 nt, Mycobacterium tuberculosis H37Rv
gaacuuguugaccuccucc

SEQ ID NO: 3278382 - RNA, 15 nt, Mycobacterium tuberculosis H37Rv
gaagaaaacgaaccc

SEQ ID NO: 3278383 - RNA, 12 nt, Mycobacterium tuberculosis H37Rv
gaagaaaccgca

SEQ ID NO: 3278384 - RNA, 18 nt, Mycobacterium tuberculosis H37Rv
gaagaaagcgaccgucgg

SEQ ID NO: 3278385 - RNA, 17 nt, Mycobacterium tuberculosis H37Rv
gaagaacaucaccucga

SEQ ID NO: 3278386 - RNA, 16 nt, Mycobacterium tuberculosis H37Rv
gaagaacgcgucguag

SEQ ID NO: 3278387 - RNA, 16 nt, Mycobacterium tuberculosis H37Rv
gaagaacuggcugcug

SEQ ID NO: 3278388 - RNA, 18 nt, Mycobacterium tuberculosis H37Rv
gaagaacugggcaaugac

SEQ ID NO: 3278389 - RNA, 18 nt, Mycobacterium tuberculosis H37Rv
gaagaagaacucggcguc

SEQ ID NO: 3278390 - RNA, 13 nt, Mycobacterium tuberculosis H37Rv
gaagaagcccagg

SEQ ID NO: 3278391 - RNA, 14 nt, Mycobacterium tuberculosis H37Rv
gaagacaccaggcc

SEQ ID NO: 3278392 - RNA, 17 nt, Mycobacterium tuberculosis H37Rv
gaagacaccaggcccgg

SEQ ID NO: 3278393 - RNA, 16 nt, Mycobacterium tuberculosis H37Rv
gaagaccaccgcccac

SEQ ID NO: 3278394 - RNA, 23 nt, Mycobacterium tuberculosis H37Rv
gaagaccaccgcccacagcaacg

SEQ ID NO: 3278395 - RNA, 12 nt, Mycobacterium tuberculosis H37Rv
gaagacccguga

SEQ ID NO: 3278396 - RNA, 17 nt, Mycobacterium tuberculosis H37Rv
gaagaccucgucgcguc

SEQ ID NO: 3278397 - RNA, 13 nt, Mycobacterium tuberculosis H37Rv
gaagagcaccgcg

SEQ ID NO: 3278398 - RNA, 14 nt, Mycobacterium tuberculosis H37Rv
gaagagcaggccca

SEQ ID NO: 3278399 - RNA, 13 nt, Mycobacterium tuberculosis H37Rv
gaagagcuccguc

SEQ ID NO: 3278400 - RNA, 16 nt, Mycobacterium tuberculosis H37Rv
gaagagggcgccgcgc

SEQ ID NO: 3278401 - RNA, 18 nt, Mycobacterium tuberculosis H37Rv
gaagagggcgccgcgcgc

SEQ ID NO: 3278402 - RNA, 15 nt, Mycobacterium tuberculosis H37Rv
gaagaucaccucccg

SEQ ID NO: 3278403 - RNA, 22 nt, Mycobacterium tuberculosis H37Rv
gaagaucaccucccgcggcacc

SEQ ID NO: 3278404 - RNA, 19 nt, Mycobacterium tuberculosis H37Rv
gaagaucgcgugccacagc

SEQ ID NO: 3278405 - RNA, 20 nt, Mycobacterium tuberculosis H37Rv
gaagaucgcgugccacagca

SEQ ID NO: 3278406 - RNA, 14 nt, Mycobacterium tuberculosis H37Rv
gaagaucgcugcga

SEQ ID NO: 3278407 - RNA, 15 nt, Mycobacterium tuberculosis H37Rv
gaagaucgcugcgaa

SEQ ID NO: 3278408 - RNA, 22 nt, Mycobacterium tuberculosis H37Rv
gaagaucggcgcuagccaggga

SEQ ID NO: 3278409 - RNA, 15 nt, Mycobacterium tuberculosis H37Rv
gaagaucuccuccug

SEQ ID NO: 3278410 - RNA, 20 nt, Mycobacterium tuberculosis H37Rv
gaagaucuccuccugugcga

SEQ ID NO: 3278411 - RNA, 13 nt, Mycobacterium tuberculosis H37Rv
gaagaucucggcc

SEQ ID NO: 3278412 - RNA, 17 nt, Mycobacterium tuberculosis H37Rv
gaagaugauuucgccga

SEQ ID NO: 3278413 - RNA, 20 nt, Mycobacterium tuberculosis H37Rv
gaagaugauuucgccgagcg

SEQ ID NO: 3278414 - RNA, 23 nt, Mycobacterium tuberculosis H37Rv
gaagaugcccuucgucggcauga

SEQ ID NO: 3278415 - RNA, 13 nt, Mycobacterium tuberculosis H37Rv
gaagaugccugcu

SEQ ID NO: 3278416 - RNA, 22 nt, Mycobacterium tuberculosis H37Rv
gaagaugccugcuagcagcagc

SEQ ID NO: 3278417 - RNA, 19 nt, Mycobacterium tuberculosis H37Rv
gaagaugccuggaaucgcg

SEQ ID NO: 3278418 - RNA, 17 nt, Mycobacterium tuberculosis H37Rv
gaagauggcaccgcccc

SEQ ID NO: 3278419 - RNA, 18 nt, Mycobacterium tuberculosis H37Rv
gaagauuuucucggugcu

SEQ ID NO: 3278420 - RNA, 19 nt, Mycobacterium tuberculosis H37Rv
gaagcacacuguucccaca

SEQ ID NO: 3278421 - RNA, 16 nt, Mycobacterium tuberculosis H37Rv
gaagcacgucgucgcg

SEQ ID NO: 3278422 - RNA, 22 nt, Mycobacterium tuberculosis H37Rv
gaagcaggugauguucagcgcc

SEQ ID NO: 3278423 - RNA, 23 nt, Mycobacterium tuberculosis H37Rv
gaagcaucgcguuguaggcuucc

SEQ ID NO: 3278424 - RNA, 16 nt, Mycobacterium tuberculosis H37Rv
gaagccaagcgacucg

SEQ ID NO: 3278425 - RNA, 20 nt, Mycobacterium tuberculosis H37Rv
gaagccaagcgacucgccgg

SEQ ID NO: 3278426 - RNA, 13 nt, Mycobacterium tuberculosis H37Rv
gaagccaccaggu

SEQ ID NO: 3278427 - RNA, 17 nt, Mycobacterium tuberculosis H37Rv
gaagccagcgcagcacc

SEQ ID NO: 3278428 - RNA, 20 nt, Mycobacterium tuberculosis H37Rv
gaagccaggauugccgccgu

SEQ ID NO: 3278429 - RNA, 20 nt, Mycobacterium tuberculosis H37Rv
gaagcccacgaucgcgucgg

SEQ ID NO: 3278430 - RNA, 22 nt, Mycobacterium tuberculosis H37Rv
gaagcccccgacguugcuggcu

SEQ ID NO: 3278431 - RNA, 20 nt, Mycobacterium tuberculosis H37Rv
gaagccccgguggcagggaa

SEQ ID NO: 3278432 - RNA, 15 nt, Mycobacterium tuberculosis H37Rv
gaagccccucaccuc

SEQ ID NO: 3278433 - RNA, 14 nt, Mycobacterium tuberculosis H37Rv
gaagcccgacuggu

SEQ ID NO: 3278434 - RNA, 13 nt, Mycobacterium tuberculosis H37Rv
gaagcccgacugu

SEQ ID NO: 3278435 - RNA, 17 nt, Mycobacterium tuberculosis H37Rv
gaagcccggggcgcucg

SEQ ID NO: 3278436 - RNA, 17 nt, Mycobacterium tuberculosis H37Rv
gaagcccuuguagcaca

SEQ ID NO: 3278437 - RNA, 19 nt, Mycobacterium tuberculosis H37Rv
gaagccgacgaccagcaga

SEQ ID NO: 3278438 - RNA, 20 nt, Mycobacterium tuberculosis H37Rv
gaagccgacgauccacggcg

SEQ ID NO: 3278439 - RNA, 12 nt, Mycobacterium tuberculosis H37Rv
gaagccgacguu

SEQ ID NO: 3278440 - RNA, 13 nt, Mycobacterium tuberculosis H37Rv
gaagccgagcauc

SEQ ID NO: 3278441 - RNA, 23 nt, Mycobacterium tuberculosis H37Rv
gaagccgauguccgacgccaccg

SEQ ID NO: 3278442 - RNA, 14 nt, Mycobacterium tuberculosis H37Rv
gaagccgcaccgcu

SEQ ID NO: 3278443 - RNA, 22 nt, Mycobacterium tuberculosis H37Rv
gaagccgcaccgcuguugcauc

SEQ ID NO: 3278444 - RNA, 17 nt, Mycobacterium tuberculosis H37Rv
gaagccgcaucuggcug

SEQ ID NO: 3278445 - RNA, 18 nt, Mycobacterium tuberculosis H37Rv
gaagccgcaucuggcugu

SEQ ID NO: 3278446 - RNA, 17 nt, Mycobacterium tuberculosis H37Rv
gaagccgcgcaucuguc

SEQ ID NO: 3278447 - RNA, 12 nt, Mycobacterium tuberculosis H37Rv
gaagccgcgcug

SEQ ID NO: 3278448 - RNA, 18 nt, Mycobacterium tuberculosis H37Rv
gaagccgcugaucgccga

SEQ ID NO: 3278449 - RNA, 22 nt, Mycobacterium tuberculosis H37Rv
gaagccgcugaucgccgacaau

SEQ ID NO: 3278450 - RNA, 14 nt, Mycobacterium tuberculosis H37Rv
gaagccggcgccgg

SEQ ID NO: 3278451 - RNA, 17 nt, Mycobacterium tuberculosis H37Rv
gaagccggcgccggcuu

SEQ ID NO: 3278452 - RNA, 22 nt, Mycobacterium tuberculosis H37Rv
gaagccgguguugauguugccg

SEQ ID NO: 3278453 - RNA, 18 nt, Mycobacterium tuberculosis H37Rv
gaagccgguucgcccagc

SEQ ID NO: 3278454 - RNA, 20 nt, Mycobacterium tuberculosis H37Rv
gaagccguugacuugugcca

SEQ ID NO: 3278455 - RNA, 18 nt, Mycobacterium tuberculosis H37Rv
gaagccguuugcgcuggc

SEQ ID NO: 3278456 - RNA, 19 nt, Mycobacterium tuberculosis H37Rv
gaagccuugcagcgccccc

SEQ ID NO: 3278457 - RNA, 18 nt, Mycobacterium tuberculosis H37Rv
gaagcgaacacccgguca

SEQ ID NO: 3278458 - RNA, 16 nt, Mycobacterium tuberculosis H37Rv
gaagcgaagccagauc

SEQ ID NO: 3278459 - RNA, 17 nt, Mycobacterium tuberculosis H37Rv
gaagcgaccgucgucac

SEQ ID NO: 3278460 - RNA, 13 nt, Mycobacterium tuberculosis H37Rv
gaagcgcucggca

SEQ ID NO: 3278461 - RNA, 14 nt, Mycobacterium tuberculosis H37Rv
gaagcggaucuggc

SEQ ID NO: 3278462 - RNA, 13 nt, Mycobacterium tuberculosis H37Rv
gaagcggcugcug

SEQ ID NO: 3278463 - RNA, 19 nt, Mycobacterium tuberculosis H37Rv
gaagcgggaaggcucacca

SEQ ID NO: 3278464 - RNA, 21 nt, Mycobacterium tuberculosis H37Rv
gaagcgggacugcagcgcggu

SEQ ID NO: 3278465 - RNA, 22 nt, Mycobacterium tuberculosis H37Rv
gaagcgggauugccgagaacac

SEQ ID NO: 3278466 - RNA, 20 nt, Mycobacterium tuberculosis H37Rv
gaagcgggcuugagcgccga

SEQ ID NO: 3278467 - RNA, 21 nt, Mycobacterium tuberculosis H37Rv
gaagcgggcuugagcgccgau

SEQ ID NO: 3278468 - RNA, 22 nt, Mycobacterium tuberculosis H37Rv
gaagcgguggccucccacggcg

SEQ ID NO: 3278469 - RNA, 20 nt, Mycobacterium tuberculosis H37Rv
gaagcgucgcuucggcaccg

SEQ ID NO: 3278470 - RNA, 23 nt, Mycobacterium tuberculosis H37Rv
gaauccggucgaugaccucguca

SEQ ID NO: 3278471 - RNA, 17 nt, Mycobacterium tuberculosis H37Rv
gaauccucucgaucaga

SEQ ID NO: 3278472 - RNA, 16 nt, Mycobacterium tuberculosis H37Rv
gaaucgaccgccgcua

SEQ ID NO: 3278473 - RNA, 14 nt, Mycobacterium tuberculosis H37Rv
gaaucgcacaaacc

SEQ ID NO: 3278474 - RNA, 17 nt, Mycobacterium tuberculosis H37Rv
gaaucgcacgacgcgac

SEQ ID NO: 3278475 - RNA, 22 nt, Mycobacterium tuberculosis H37Rv
gaaucgcacgcgaaaugccugc

SEQ ID NO: 3278476 - RNA, 17 nt, Mycobacterium tuberculosis H37Rv
gaaucgcggagccagga

SEQ ID NO: 3278477 - RNA, 18 nt, Mycobacterium tuberculosis H37Rv
gaaucgcggagccaggac

SEQ ID NO: 3278478 - RNA, 13 nt, Mycobacterium tuberculosis H37Rv
gaaucgcucgcgc

SEQ ID NO: 3278479 - RNA, 14 nt, Mycobacterium tuberculosis H37Rv
gaaucggaccgacc

SEQ ID NO: 3278480 - RNA, 19 nt, Mycobacterium tuberculosis H37Rv
gaaucggcaccgugcgggg

SEQ ID NO: 3278481 - RNA, 16 nt, Mycobacterium tuberculosis H37Rv
gaaucggcaguugaac

SEQ ID NO: 3278482 - RNA, 19 nt, Mycobacterium tuberculosis H37Rv
gaaucggcggaugaugcaa

SEQ ID NO: 3278483 - RNA, 13 nt, Mycobacterium tuberculosis H37Rv
gaaucggcggcgg

SEQ ID NO: 3278484 - RNA, 13 nt, Mycobacterium tuberculosis H37Rv
gaaucgggauagc

SEQ ID NO: 3278485 - RNA, 14 nt, Mycobacterium tuberculosis H37Rv
gaaucgggucagca

SEQ ID NO: 3278486 - RNA, 14 nt, Mycobacterium tuberculosis H37Rv
gaaucgucugacga

SEQ ID NO: 3278487 - RNA, 13 nt, Mycobacterium tuberculosis H37Rv
gaaucuccgcgcg

SEQ ID NO: 3278488 - RNA, 15 nt, Mycobacterium tuberculosis H37Rv
gaaucucgcccccag

SEQ ID NO: 3278489 - RNA, 14 nt, Mycobacterium tuberculosis H37Rv
gaaucugacgacgc

SEQ ID NO: 3278490 - RNA, 17 nt, Mycobacterium tuberculosis H37Rv
gaaucugccggccggcg

SEQ ID NO: 3278491 - RNA, 23 nt, Mycobacterium tuberculosis H37Rv
gaaucuucugagacugccgccgc

SEQ ID NO: 3278492 - RNA, 20 nt, Mycobacterium tuberculosis H37Rv
gaaugaccuugcccugcgug

SEQ ID NO: 3278493 - RNA, 13 nt, Mycobacterium tuberculosis H37Rv
gaaugacgaucca

SEQ ID NO: 3278494 - RNA, 18 nt, Mycobacterium tuberculosis H37Rv
gaaugacgauccagccca

SEQ ID NO: 3278495 - RNA, 22 nt, Mycobacterium tuberculosis H37Rv
gaaugcauuggcggugcgcacc

SEQ ID NO: 3278496 - RNA, 18 nt, Mycobacterium tuberculosis H37Rv
gaaugcccgggcccgucg

SEQ ID NO: 3278497 - RNA, 17 nt, Mycobacterium tuberculosis H37Rv
gaaugccgcggggauca

SEQ ID NO: 3278498 - RNA, 13 nt, Mycobacterium tuberculosis H37Rv
gaaugcgacaucc

SEQ ID NO: 3278499 - RNA, 14 nt, Mycobacterium tuberculosis H37Rv
gaaugcgccgucgg

SEQ ID NO: 3278500 - RNA, 21 nt, Mycobacterium tuberculosis H37Rv
gaaugcgccgucggugggugc

SEQ ID NO: 3278501 - RNA, 14 nt, Mycobacterium tuberculosis H37Rv
gaaugcgggccucc

SEQ ID NO: 3278502 - RNA, 21 nt, Mycobacterium tuberculosis H37Rv
gaaugcggugaguccgcugag

SEQ ID NO: 3278503 - RNA, 16 nt, Mycobacterium tuberculosis H37Rv
gaaugcugggcccgcc

SEQ ID NO: 3278504 - RNA, 20 nt, Mycobacterium tuberculosis H37Rv
gaaugcugggcccgccagcc

SEQ ID NO: 3278505 - RNA, 16 nt, Mycobacterium tuberculosis H37Rv
gaaugcuugcgcagca

SEQ ID NO: 3278506 - RNA, 14 nt, Mycobacterium tuberculosis H37Rv
gaauggcagcacga

SEQ ID NO: 3278507 - RNA, 19 nt, Mycobacterium tuberculosis H37Rv
gaauggcccuugcucgucc

SEQ ID NO: 3278508 - RNA, 23 nt, Mycobacterium tuberculosis H37Rv
gaauggcccuugcucguccaggu

SEQ ID NO: 3278509 - RNA, 18 nt, Mycobacterium tuberculosis H37Rv
gaauggcucacgcuccgc

SEQ ID NO: 3278510 - RNA, 13 nt, Mycobacterium tuberculosis H37Rv
gaauggugaccgg

SEQ ID NO: 3278511 - RNA, 16 nt, Mycobacterium tuberculosis H37Rv
gaauguagccgacuuc

SEQ ID NO: 3278512 - RNA, 22 nt, Mycobacterium tuberculosis H37Rv
gaaugucccgguguccagccac

SEQ ID NO: 3278513 - RNA, 22 nt, Mycobacterium tuberculosis H37Rv
gaaugucgaugacgaacggacc

SEQ ID NO: 3278514 - RNA, 23 nt, Mycobacterium tuberculosis H37Rv
gaaugucgcgcuguuguggaaca

SEQ ID NO: 3278515 - RNA, 18 nt, Mycobacterium tuberculosis H37Rv
gaaugucuccaguagccg

SEQ ID NO: 3278516 - RNA, 16 nt, Mycobacterium tuberculosis H37Rv
gaaugucuuuggucgc

SEQ ID NO: 3278517 - RNA, 17 nt, Mycobacterium tuberculosis H37Rv
gaauguugccgccgcgg

SEQ ID NO: 3278518 - RNA, 20 nt, Mycobacterium tuberculosis H37Rv
gaauguugccgccgcggcgc

SEQ ID NO: 3278519 - RNA, 20 nt, Mycobacterium tuberculosis H37Rv
gaauuaguuucguccccaga

SEQ ID NO: 3278520 - RNA, 23 nt, Mycobacterium tuberculosis H37Rv
gaauuaguuucguccccagaccg

SEQ ID NO: 3278521 - RNA, 19 nt, Mycobacterium tuberculosis H37Rv
gaauucauccgggcucgca

SEQ ID NO: 3278522 - RNA, 19 nt, Mycobacterium tuberculosis H37Rv
gaauucccaugcugcgcaa

SEQ ID NO: 3278523 - RNA, 22 nt, Mycobacterium tuberculosis H37Rv
gaauuccggcggagcgggccag

SEQ ID NO: 3278524 - RNA, 19 nt, Mycobacterium tuberculosis H37Rv
gaauucgccauagcgggcg

SEQ ID NO: 3278525 - RNA, 23 nt, Mycobacterium tuberculosis H37Rv
gaauucggcgucguggcuuccgg

SEQ ID NO: 3278526 - RNA, 18 nt, Mycobacterium tuberculosis H37Rv
gaauugccaagcgcgcga

SEQ ID NO: 3278527 - RNA, 22 nt, Mycobacterium tuberculosis H37Rv
gaauuuggugaagccguagacg

SEQ ID NO: 3278528 - RNA, 16 nt, Mycobacterium tuberculosis H37Rv
gaauuuggugaaguga

SEQ ID NO: 3278529 - RNA, 16 nt, Mycobacterium tuberculosis H37Rv
gacaaaaucagcagcc

SEQ ID NO: 3278530 - RNA, 18 nt, Mycobacterium tuberculosis H37Rv
gacaaaaucagcagcccc

SEQ ID NO: 3278531 - RNA, 13 nt, Mycobacterium tuberculosis H37Rv
gacaaaccacaga

SEQ ID NO: 3278532 - RNA, 15 nt, Mycobacterium tuberculosis H37Rv
gacaaaccgggcggc

SEQ ID NO: 3278533 - RNA, 18 nt, Mycobacterium tuberculosis H37Rv
gacaaaccgggcggccaa

SEQ ID NO: 3278534 - RNA, 18 nt, Mycobacterium tuberculosis H37Rv
gacaaacggcgacccagc

SEQ ID NO: 3278535 - RNA, 23 nt, Mycobacterium tuberculosis H37Rv
gacaaacggcgacccagcgguau

SEQ ID NO: 3278536 - RNA, 15 nt, Mycobacterium tuberculosis H37Rv
gacaaagaagugguc

SEQ ID NO: 3278537 - RNA, 16 nt, Mycobacterium tuberculosis H37Rv
gacaaagauugccggu

SEQ ID NO: 3278538 - RNA, 20 nt, Mycobacterium tuberculosis H37Rv
gacaaagccgaacgacagca

SEQ ID NO: 3278539 - RNA, 14 nt, Mycobacterium tuberculosis H37Rv
gacaaagcggcugc

SEQ ID NO: 3278540 - RNA, 22 nt, Mycobacterium tuberculosis H37Rv
gacaaaucgaugaccgucgcac

SEQ ID NO: 3278541 - RNA, 13 nt, Mycobacterium tuberculosis H37Rv
gacaacaccacgg

SEQ ID NO: 3278542 - RNA, 22 nt, Mycobacterium tuberculosis H37Rv
gacaacacgccgucgaccggcg

SEQ ID NO: 3278543 - RNA, 14 nt, Mycobacterium tuberculosis H37Rv
gacaacacggcgaa

SEQ ID NO: 3278544 - RNA, 13 nt, Mycobacterium tuberculosis H37Rv
gacaacagcuugg

SEQ ID NO: 3278545 - RNA, 14 nt, Mycobacterium tuberculosis H37Rv
gacaacagcuugga

SEQ ID NO: 3278546 - RNA, 21 nt, Mycobacterium tuberculosis H37Rv
gacaacaggccgucgaugauc

SEQ ID NO: 3278547 - RNA, 21 nt, Mycobacterium tuberculosis H37Rv
gacaacaucgaaucagcucgc

SEQ ID NO: 3278548 - RNA, 21 nt, Mycobacterium tuberculosis H37Rv
gacaacccggcgucgacgauu

SEQ ID NO: 3278549 - RNA, 15 nt, Mycobacterium tuberculosis H37Rv
gacaaccgagcugac

SEQ ID NO: 3278550 - RNA, 15 nt, Mycobacterium tuberculosis H37Rv
gacaaccuggggcca

SEQ ID NO: 3278551 - RNA, 22 nt, Mycobacterium tuberculosis H37Rv
gacaacgacugcguuccgaucg

SEQ ID NO: 3278552 - RNA, 22 nt, Mycobacterium tuberculosis H37Rv
gacaacgaugucacccucccgc

SEQ ID NO: 3278553 - RNA, 22 nt, Mycobacterium tuberculosis H37Rv
gacaacgggccuucagcucacc

SEQ ID NO: 3278554 - RNA, 23 nt, Mycobacterium tuberculosis H37Rv
gacaacggguugucguugcuggu

SEQ ID NO: 3278555 - RNA, 23 nt, Mycobacterium tuberculosis H37Rv
gacaacuaucgucgugucgccgc

SEQ ID NO: 3278556 - RNA, 16 nt, Mycobacterium tuberculosis H37Rv
gacaacugcccgauga

SEQ ID NO: 3278557 - RNA, 20 nt, Mycobacterium tuberculosis H37Rv
gacaacugguggcccggggc

SEQ ID NO: 3278558 - RNA, 16 nt, Mycobacterium tuberculosis H37Rv
gacaaggacugaccgu

SEQ ID NO: 3278559 - RNA, 21 nt, Mycobacterium tuberculosis H37Rv
gacaaggguucaggucggggu

SEQ ID NO: 3278560 - RNA, 18 nt, Mycobacterium tuberculosis H37Rv
gacaagucggcaccggug

SEQ ID NO: 3278561 - RNA, 17 nt, Mycobacterium tuberculosis H37Rv
gacaagucggcgcuggc

SEQ ID NO: 3278562 - RNA, 15 nt, Mycobacterium tuberculosis H37Rv
gacaagugcccggcc

SEQ ID NO: 3278563 - RNA, 16 nt, Mycobacterium tuberculosis H37Rv
gacaaguggugcccuu

SEQ ID NO: 3278564 - RNA, 14 nt, Mycobacterium tuberculosis H37Rv
gacaauacgugcga

SEQ ID NO: 3278565 - RNA, 19 nt, Mycobacterium tuberculosis H37Rv
gacaaucguccacccgagc

SEQ ID NO: 3278566 - RNA, 18 nt, Mycobacterium tuberculosis H37Rv
gacagcgcgagaucagcc

SEQ ID NO: 3278567 - RNA, 12 nt, Mycobacterium tuberculosis H37Rv
gacagcgcggcg

SEQ ID NO: 3278568 - RNA, 19 nt, Mycobacterium tuberculosis H37Rv
gacagcgcgggacacgucg

SEQ ID NO: 3278569 - RNA, 13 nt, Mycobacterium tuberculosis H37Rv
gacagcgcugggc

SEQ ID NO: 3278570 - RNA, 22 nt, Mycobacterium tuberculosis H37Rv
gacagcggcaaucgggucugga

SEQ ID NO: 3278571 - RNA, 23 nt, Mycobacterium tuberculosis H37Rv
gacagcggcgacaugaucugcca

SEQ ID NO: 3278572 - RNA, 15 nt, Mycobacterium tuberculosis H37Rv
gacagcgggagcagc

SEQ ID NO: 3278573 - RNA, 17 nt, Mycobacterium tuberculosis H37Rv
gacagcgggagcagcac

SEQ ID NO: 3278574 - RNA, 22 nt, Mycobacterium tuberculosis H37Rv
gacagcguaucucccaacggca

SEQ ID NO: 3278575 - RNA, 17 nt, Mycobacterium tuberculosis H37Rv
gacagcgucucggaggc

SEQ ID NO: 3278576 - RNA, 16 nt, Mycobacterium tuberculosis H37Rv
gacagcgugccgaaca

SEQ ID NO: 3278577 - RNA, 20 nt, Mycobacterium tuberculosis H37Rv
gacagcgugccgaacaggga

SEQ ID NO: 3278578 - RNA, 22 nt, Mycobacterium tuberculosis H37Rv
gacagcucacgcugaagccgcu

SEQ ID NO: 3278579 - RNA, 12 nt, Mycobacterium tuberculosis H37Rv
gacagcucgcgg

SEQ ID NO: 3278580 - RNA, 18 nt, Mycobacterium tuberculosis H37Rv
gacagcugcacacagagg

SEQ ID NO: 3278581 - RNA, 23 nt, Mycobacterium tuberculosis H37Rv
gacagcugcacacagaggucggu

SEQ ID NO: 3278582 - RNA, 14 nt, Mycobacterium tuberculosis H37Rv
gacagcugccugac

SEQ ID NO: 3278583 - RNA, 17 nt, Mycobacterium tuberculosis H37Rv
gacagcugguugugcug

SEQ ID NO: 3278584 - RNA, 19 nt, Mycobacterium tuberculosis H37Rv
gacagcugguugugcuggg

SEQ ID NO: 3278585 - RNA, 15 nt, Mycobacterium tuberculosis H37Rv
gacaggaccgguggg

SEQ ID NO: 3278586 - RNA, 14 nt, Mycobacterium tuberculosis H37Rv
gacaggacgucggc

SEQ ID NO: 3278587 - RNA, 17 nt, Mycobacterium tuberculosis H37Rv
gacaggagacgguacgc

SEQ ID NO: 3278588 - RNA, 19 nt, Mycobacterium tuberculosis H37Rv
gacaggccaccgcagacgc

SEQ ID NO: 3278589 - RNA, 13 nt, Mycobacterium tuberculosis H37Rv
gacaggccgagca

SEQ ID NO: 3278590 - RNA, 16 nt, Mycobacterium tuberculosis H37Rv
gacaggcggcggccug

SEQ ID NO: 3278591 - RNA, 13 nt, Mycobacterium tuberculosis H37Rv
gacagggccgcuc

SEQ ID NO: 3278592 - RNA, 22 nt, Mycobacterium tuberculosis H37Rv
gacagggcggcaaccucaugca

SEQ ID NO: 3278593 - RNA, 21 nt, Mycobacterium tuberculosis H37Rv
gacagggugcgcuugcggccg

SEQ ID NO: 3278594 - RNA, 22 nt, Mycobacterium tuberculosis H37Rv
gacagggugggggcaucagggu

SEQ ID NO: 3278595 - RNA, 22 nt, Mycobacterium tuberculosis H37Rv
gacagguagucgccggucaggc

SEQ ID NO: 3278596 - RNA, 13 nt, Mycobacterium tuberculosis H37Rv
gacaggucggcau

SEQ ID NO: 3278597 - RNA, 22 nt, Mycobacterium tuberculosis H37Rv
gacaggugccagaccagggcag

SEQ ID NO: 3278598 - RNA, 21 nt, Mycobacterium tuberculosis H37Rv
gacagucaacagggccaggac

SEQ ID NO: 3278599 - RNA, 14 nt, Mycobacterium tuberculosis H37Rv
gacagugcugccuu

SEQ ID NO: 3278600 - RNA, 21 nt, Mycobacterium tuberculosis H37Rv
gacagugugaagaccaccgcc

SEQ ID NO: 3278601 - RNA, 14 nt, Mycobacterium tuberculosis H37Rv
gacaguucccggcc

SEQ ID NO: 3278602 - RNA, 19 nt, Mycobacterium tuberculosis H37Rv
gacaguuggcagcgcuggc

SEQ ID NO: 3278603 - RNA, 20 nt, Mycobacterium tuberculosis H37Rv
gacaguuggcagcgcuggcu

SEQ ID NO: 3278604 - RNA, 23 nt, Mycobacterium tuberculosis H37Rv
gacaguuuuuccgugccgaccac

SEQ ID NO: 3278605 - RNA, 18 nt, Mycobacterium tuberculosis H37Rv
gacauacccgaucaaugc

SEQ ID NO: 3278606 - RNA, 18 nt, Mycobacterium tuberculosis H37Rv
gacauacgagcagugacc

SEQ ID NO: 3278607 - RNA, 19 nt, Mycobacterium tuberculosis H37Rv
gacauaggccaccuccgag

SEQ ID NO: 3278608 - RNA, 13 nt, Mycobacterium tuberculosis H37Rv
gacaucaccaccg

SEQ ID NO: 3278609 - RNA, 18 nt, Mycobacterium tuberculosis H37Rv
gacaucaccaccgaccug

SEQ ID NO: 3278610 - RNA, 15 nt, Mycobacterium tuberculosis H37Rv
gacaucaccaccgcc

SEQ ID NO: 3278611 - RNA, 11 nt, Mycobacterium tuberculosis H37Rv
gacaucaccgg

SEQ ID NO: 3278612 - RNA, 12 nt, Mycobacterium tuberculosis H37Rv
gacauccagauc

SEQ ID NO: 3278613 - RNA, 16 nt, Mycobacterium tuberculosis H37Rv
gacaucgggccgccga

SEQ ID NO: 3278614 - RNA, 15 nt, Mycobacterium tuberculosis H37Rv
gacaucgggcggcac

SEQ ID NO: 3278615 - RNA, 18 nt, Mycobacterium tuberculosis H37Rv
gacaucgggcggcaccgc

SEQ ID NO: 3278616 - RNA, 21 nt, Mycobacterium tuberculosis H37Rv
gacaucggucagcauggggua

SEQ ID NO: 3278617 - RNA, 21 nt, Mycobacterium tuberculosis H37Rv
gacaucggucagcgggcacgc

SEQ ID NO: 3278618 - RNA, 16 nt, Mycobacterium tuberculosis H37Rv
gacaucgguggcggcc

SEQ ID NO: 3278619 - RNA, 14 nt, Mycobacterium tuberculosis H37Rv
gacaucguaggccg

SEQ ID NO: 3278620 - RNA, 15 nt, Mycobacterium tuberculosis H37Rv
gacaucgucgccagg

SEQ ID NO: 3278621 - RNA, 16 nt, Mycobacterium tuberculosis H37Rv
gacaucgucgccaggg

SEQ ID NO: 3278622 - RNA, 17 nt, Mycobacterium tuberculosis H37Rv
gacaucguugacccggc

SEQ ID NO: 3278623 - RNA, 13 nt, Mycobacterium tuberculosis H37Rv
gacaucugcccac

SEQ ID NO: 3278624 - RNA, 15 nt, Mycobacterium tuberculosis H37Rv
gacaugaaccggucg

SEQ ID NO: 3278625 - RNA, 19 nt, Mycobacterium tuberculosis H37Rv
gacaugacagccccgccgc

SEQ ID NO: 3278626 - RNA, 14 nt, Mycobacterium tuberculosis H37Rv
gacaugagcgccac

SEQ ID NO: 3278627 - RNA, 20 nt, Mycobacterium tuberculosis H37Rv
gacaugagcgccacgccgag

SEQ ID NO: 3278628 - RNA, 19 nt, Mycobacterium tuberculosis H37Rv
gacaugcaggaauggguga

SEQ ID NO: 3278629 - RNA, 21 nt, Mycobacterium tuberculosis H37Rv
gacaugcaggugaugagugcg

SEQ ID NO: 3278630 - RNA, 18 nt, Mycobacterium tuberculosis H37Rv
gacaugcgcaccaugggu

SEQ ID NO: 3278631 - RNA, 16 nt, Mycobacterium tuberculosis H37Rv
gacaugcgggcagcac

SEQ ID NO: 3278632 - RNA, 16 nt, Mycobacterium tuberculosis H37Rv
gacaugguccgaccag

SEQ ID NO: 3278633 - RNA, 21 nt, Mycobacterium tuberculosis H37Rv
gacauucccgaguugcccucu

SEQ ID NO: 3278634 - RNA, 16 nt, Mycobacterium tuberculosis H37Rv
gacauucguccgggca

SEQ ID NO: 3278635 - RNA, 14 nt, Mycobacterium tuberculosis H37Rv
gacauuggugcuga

SEQ ID NO: 3278636 - RNA, 13 nt, Mycobacterium tuberculosis H37Rv
gaccaacacgucg

SEQ ID NO: 3278637 - RNA, 14 nt, Mycobacterium tuberculosis H37Rv
gaccaacacgucga

SEQ ID NO: 3278638 - RNA, 23 nt, Mycobacterium tuberculosis H37Rv
gaccaacauguugucgucgccgc

SEQ ID NO: 3278639 - RNA, 14 nt, Mycobacterium tuberculosis H37Rv
gaccaacgccaacg

SEQ ID NO: 3278640 - RNA, 16 nt, Mycobacterium tuberculosis H37Rv
gaccaacgcgcaggcc

SEQ ID NO: 3278641 - RNA, 23 nt, Mycobacterium tuberculosis H37Rv
gaccaacugugguggaacuccgg

SEQ ID NO: 3278642 - RNA, 15 nt, Mycobacterium tuberculosis H37Rv
gaccaagguguccag

SEQ ID NO: 3278643 - RNA, 17 nt, Mycobacterium tuberculosis H37Rv
gaccaaugcguugacgu

SEQ ID NO: 3278644 - RNA, 21 nt, Mycobacterium tuberculosis H37Rv
gaccaauucgcaaucggcguu

SEQ ID NO: 3278645 - RNA, 15 nt, Mycobacterium tuberculosis H37Rv
gaccacaacgccucg

SEQ ID NO: 3278646 - RNA, 17 nt, Mycobacterium tuberculosis H37Rv
gaccacaacgccucgcc

SEQ ID NO: 3278647 - RNA, 22 nt, Mycobacterium tuberculosis H37Rv
gaccacagccgcgccgaccuca

SEQ ID NO: 3278648 - RNA, 21 nt, Mycobacterium tuberculosis H37Rv
gaccacagcggagacgaucgc

SEQ ID NO: 3278649 - RNA, 14 nt, Mycobacterium tuberculosis H37Rv
gaccaccacgauga

SEQ ID NO: 3278650 - RNA, 12 nt, Mycobacterium tuberculosis H37Rv
gaccaccagcau

SEQ ID NO: 3278651 - RNA, 17 nt, Mycobacterium tuberculosis H37Rv
gaccaccagcaucgugg

SEQ ID NO: 3278652 - RNA, 22 nt, Mycobacterium tuberculosis H37Rv
gaccaccagcgccgacccguac

SEQ ID NO: 3278653 - RNA, 13 nt, Mycobacterium tuberculosis H37Rv
gaccaccagugag

SEQ ID NO: 3278654 - RNA, 13 nt, Mycobacterium tuberculosis H37Rv
gaccacccggcgc

SEQ ID NO: 3278655 - RNA, 16 nt, Mycobacterium tuberculosis H37Rv
gaccacccggcgcgaa

SEQ ID NO: 3278656 - RNA, 19 nt, Mycobacterium tuberculosis H37Rv
gaccaccgaaauacccagc

SEQ ID NO: 3278657 - RNA, 22 nt, Mycobacterium tuberculosis H37Rv
gaccaccgccgacaggccggcc

SEQ ID NO: 3278658 - RNA, 22 nt, Mycobacterium tuberculosis H37Rv
gaccaccgcgaaagcaccgagc

SEQ ID NO: 3278659 - RNA, 20 nt, Mycobacterium tuberculosis H37Rv
gaccaccgcggcaugugaca

SEQ ID NO: 3278660 - RNA, 15 nt, Mycobacterium tuberculosis H37Rv
gaccaccgcgucggg

SEQ ID NO: 3278661 - RNA, 20 nt, Mycobacterium tuberculosis H37Rv
gaccaccgcgucgggccgca

SEQ ID NO: 3278662 - RNA, 22 nt, Mycobacterium tuberculosis H37Rv
gacccagccagcagcggcgagc

SEQ ID NO: 3278663 - RNA, 14 nt, Mycobacterium tuberculosis H37Rv
gacccagccagcug

SEQ ID NO: 3278664 - RNA, 19 nt, Mycobacterium tuberculosis H37Rv
gacccagcgcgcgguggcc

SEQ ID NO: 3278665 - RNA, 15 nt, Mycobacterium tuberculosis H37Rv
gacccagcgcggcaa

SEQ ID NO: 3278666 - RNA, 16 nt, Mycobacterium tuberculosis H37Rv
gacccagcgcggcaac

SEQ ID NO: 3278667 - RNA, 15 nt, Mycobacterium tuberculosis H37Rv
gacccagcggcgguc

SEQ ID NO: 3278668 - RNA, 18 nt, Mycobacterium tuberculosis H37Rv
gacccagcggcggucuuu

SEQ ID NO: 3278669 - RNA, 18 nt, Mycobacterium tuberculosis H37Rv
gacccagcucgucgacgu

SEQ ID NO: 3278670 - RNA, 22 nt, Mycobacterium tuberculosis H37Rv
gacccagcucgucgacgucgua

SEQ ID NO: 3278671 - RNA, 21 nt, Mycobacterium tuberculosis H37Rv
gacccaguccgguagcagcgc

SEQ ID NO: 3278672 - RNA, 12 nt, Mycobacterium tuberculosis H37Rv
gacccauacgaa

SEQ ID NO: 3278673 - RNA, 14 nt, Mycobacterium tuberculosis H37Rv
gaccccacacgccg

SEQ ID NO: 3278674 - RNA, 22 nt, Mycobacterium tuberculosis H37Rv
gaccccacacgccgaacgugca

SEQ ID NO: 3278675 - RNA, 19 nt, Mycobacterium tuberculosis H37Rv
gacccccgagauccguccg

SEQ ID NO: 3278676 - RNA, 17 nt, Mycobacterium tuberculosis H37Rv
gacccccgcaucggcgc

SEQ ID NO: 3278677 - RNA, 15 nt, Mycobacterium tuberculosis H37Rv
gacccccugacggca

SEQ ID NO: 3278678 - RNA, 14 nt, Mycobacterium tuberculosis H37Rv
gacccccugccaca

SEQ ID NO: 3278679 - RNA, 19 nt, Mycobacterium tuberculosis H37Rv
gaccccgaacauccgccgc

SEQ ID NO: 3278680 - RNA, 22 nt, Mycobacterium tuberculosis H37Rv
gaccccgaagaugaccucggcg

SEQ ID NO: 3278681 - RNA, 17 nt, Mycobacterium tuberculosis H37Rv
gaccccgacggcaaugc

SEQ ID NO: 3278682 - RNA, 16 nt, Mycobacterium tuberculosis H37Rv
gaccccgccagccgga

SEQ ID NO: 3278683 - RNA, 23 nt, Mycobacterium tuberculosis H37Rv
gaccccgcgccgacacguugcag

SEQ ID NO: 3278684 - RNA, 17 nt, Mycobacterium tuberculosis H37Rv
gaccccgcugcgacguu

SEQ ID NO: 3278685 - RNA, 22 nt, Mycobacterium tuberculosis H37Rv
gaccccgcuuuuucccggcggc

SEQ ID NO: 3278686 - RNA, 23 nt, Mycobacterium tuberculosis H37Rv
gaccccgcuuuuucccggcggcg

SEQ ID NO: 3278687 - RNA, 15 nt, Mycobacterium tuberculosis H37Rv
gaccccggcagcgcc

SEQ ID NO: 3278688 - RNA, 21 nt, Mycobacterium tuberculosis H37Rv
gaccccggcagcgcccuugga

SEQ ID NO: 3278689 - RNA, 15 nt, Mycobacterium tuberculosis H37Rv
gaccccggcugcgcu

SEQ ID NO: 3278690 - RNA, 16 nt, Mycobacterium tuberculosis H37Rv
gaccccgucagcgggc

SEQ ID NO: 3278691 - RNA, 23 nt, Mycobacterium tuberculosis H37Rv
gaccccgucagcgggcagcaggc

SEQ ID NO: 3278692 - RNA, 17 nt, Mycobacterium tuberculosis H37Rv
gaccccuggccgccggc

SEQ ID NO: 3278693 - RNA, 19 nt, Mycobacterium tuberculosis H37Rv
gacccgaagccgaccgggu

SEQ ID NO: 3278694 - RNA, 22 nt, Mycobacterium tuberculosis H37Rv
gacccgacaugguccgaccagc

SEQ ID NO: 3278695 - RNA, 15 nt, Mycobacterium tuberculosis H37Rv
gacccgaccgucguc

SEQ ID NO: 3278696 - RNA, 16 nt, Mycobacterium tuberculosis H37Rv
gacccgaccgucgucg

SEQ ID NO: 3278697 - RNA, 22 nt, Mycobacterium tuberculosis H37Rv
gacccgacgcuggucggcggcu

SEQ ID NO: 3278698 - RNA, 14 nt, Mycobacterium tuberculosis H37Rv
gacccgacguagcc

SEQ ID NO: 3278699 - RNA, 15 nt, Mycobacterium tuberculosis H37Rv
gacccgagaucaccg

SEQ ID NO: 3278700 - RNA, 16 nt, Mycobacterium tuberculosis H37Rv
gacccgagaucaccgg

SEQ ID NO: 3278701 - RNA, 19 nt, Mycobacterium tuberculosis H37Rv
gacccgagcgcucgaucac

SEQ ID NO: 3278702 - RNA, 15 nt, Mycobacterium tuberculosis H37Rv
gacccgaugacccac

SEQ ID NO: 3278703 - RNA, 12 nt, Mycobacterium tuberculosis H37Rv
gacccgaugcgu

SEQ ID NO: 3278704 - RNA, 20 nt, Mycobacterium tuberculosis H37Rv
gacccgcaauuccggugauc

SEQ ID NO: 3278705 - RNA, 13 nt, Mycobacterium tuberculosis H37Rv
gacccgccgcgcc

SEQ ID NO: 3278706 - RNA, 17 nt, Mycobacterium tuberculosis H37Rv
gacccgcgcgucgccca

SEQ ID NO: 3278707 - RNA, 21 nt, Mycobacterium tuberculosis H37Rv
gacccgcgcgucgcccagugc

SEQ ID NO: 3278708 - RNA, 19 nt, Mycobacterium tuberculosis H37Rv
gacccgcuauucggcggca

SEQ ID NO: 3278709 - RNA, 14 nt, Mycobacterium tuberculosis H37Rv
gacccgcucgcggc

SEQ ID NO: 3278710 - RNA, 15 nt, Mycobacterium tuberculosis H37Rv
gacccgcugccaccc

SEQ ID NO: 3278711 - RNA, 14 nt, Mycobacterium tuberculosis H37Rv
gacccgcugggccg

SEQ ID NO: 3278712 - RNA, 20 nt, Mycobacterium tuberculosis H37Rv
gacccgcugggccgcaucgg

SEQ ID NO: 3278713 - RNA, 21 nt, Mycobacterium tuberculosis H37Rv
gacccgcuggucgaugccuuc

SEQ ID NO: 3278714 - RNA, 22 nt, Mycobacterium tuberculosis H37Rv
gacccgcuggucgaugccuucg

SEQ ID NO: 3278715 - RNA, 16 nt, Mycobacterium tuberculosis H37Rv
gacccgcuucgcccgg

SEQ ID NO: 3278716 - RNA, 16 nt, Mycobacterium tuberculosis H37Rv
gacccggaaucccgag

SEQ ID NO: 3278717 - RNA, 18 nt, Mycobacterium tuberculosis H37Rv
gacccggaaucccgaguc

SEQ ID NO: 3278718 - RNA, 18 nt, Mycobacterium tuberculosis H37Rv
gacccggaccugggcgac

SEQ ID NO: 3278719 - RNA, 14 nt, Mycobacterium tuberculosis H37Rv
gacccggaugucgu

SEQ ID NO: 3278720 - RNA, 20 nt, Mycobacterium tuberculosis H37Rv
gacccggcagcccggcggcc

SEQ ID NO: 3278721 - RNA, 17 nt, Mycobacterium tuberculosis H37Rv
gacccggccaagggugc

SEQ ID NO: 3278722 - RNA, 16 nt, Mycobacterium tuberculosis H37Rv
gacccggcccagcgcc

SEQ ID NO: 3278723 - RNA, 22 nt, Mycobacterium tuberculosis H37Rv
gacccggcgccgaaaacaaccc

SEQ ID NO: 3278724 - RNA, 16 nt, Mycobacterium tuberculosis H37Rv
gacccggcggugccgu

SEQ ID NO: 3278725 - RNA, 21 nt, Mycobacterium tuberculosis H37Rv
gacccgggaaggaaccgggca

SEQ ID NO: 3278726 - RNA, 16 nt, Mycobacterium tuberculosis H37Rv
gacccgggccaguucg

SEQ ID NO: 3278727 - RNA, 21 nt, Mycobacterium tuberculosis H37Rv
gacccgggccgcggcggccag

SEQ ID NO: 3278728 - RNA, 12 nt, Mycobacterium tuberculosis H37Rv
gacccgggccgg

SEQ ID NO: 3278729 - RNA, 21 nt, Mycobacterium tuberculosis H37Rv
gacccgggcgagcgcggccug

SEQ ID NO: 3278730 - RNA, 16 nt, Mycobacterium tuberculosis H37Rv
gacccgggcggcguug

SEQ ID NO: 3278731 - RNA, 15 nt, Mycobacterium tuberculosis H37Rv
gacccggggccguug

SEQ ID NO: 3278732 - RNA, 14 nt, Mycobacterium tuberculosis H37Rv
gacccgggucggca

SEQ ID NO: 3278733 - RNA, 15 nt, Mycobacterium tuberculosis H37Rv
gacccgggucggcac

SEQ ID NO: 3278734 - RNA, 17 nt, Mycobacterium tuberculosis H37Rv
gacccgggucggcacga

SEQ ID NO: 3278735 - RNA, 18 nt, Mycobacterium tuberculosis H37Rv
gacccgggucggcacgac

SEQ ID NO: 3278736 - RNA, 13 nt, Mycobacterium tuberculosis H37Rv
gacccgggugguc

SEQ ID NO: 3278737 - RNA, 14 nt, Mycobacterium tuberculosis H37Rv
gacccggguggucg

SEQ ID NO: 3278738 - RNA, 15 nt, Mycobacterium tuberculosis H37Rv
gacccggguggucga

SEQ ID NO: 3278739 - RNA, 14 nt, Mycobacterium tuberculosis H37Rv
gacccggucgacgg

SEQ ID NO: 3278740 - RNA, 13 nt, Mycobacterium tuberculosis H37Rv
gacccgucgagcg

SEQ ID NO: 3278741 - RNA, 14 nt, Mycobacterium tuberculosis H37Rv
gacccgucgagcgu

SEQ ID NO: 3278742 - RNA, 14 nt, Mycobacterium tuberculosis H37Rv
gacccgugagcgga

SEQ ID NO: 3278743 - RNA, 17 nt, Mycobacterium tuberculosis H37Rv
gacccgugcacgaucgc

SEQ ID NO: 3278744 - RNA, 14 nt, Mycobacterium tuberculosis H37Rv
gacccgugcggcca

SEQ ID NO: 3278745 - RNA, 15 nt, Mycobacterium tuberculosis H37Rv
gacccguuccacgcc

SEQ ID NO: 3278746 - RNA, 23 nt, Mycobacterium tuberculosis H37Rv
gacccguuccacgccggcaucgu

SEQ ID NO: 3278747 - RNA, 17 nt, Mycobacterium tuberculosis H37Rv
gacccucagcaccgcug

SEQ ID NO: 3278748 - RNA, 18 nt, Mycobacterium tuberculosis H37Rv
gacccuccagcacgccgu

SEQ ID NO: 3278749 - RNA, 14 nt, Mycobacterium tuberculosis H37Rv
gacccuccgcaucg

SEQ ID NO: 3278750 - RNA, 18 nt, Mycobacterium tuberculosis H37Rv
gacccuccgcaucgcggc

SEQ ID NO: 3278751 - RNA, 21 nt, Mycobacterium tuberculosis H37Rv
gacccuccgcaucgcggcgac

SEQ ID NO: 3278752 - RNA, 21 nt, Mycobacterium tuberculosis H37Rv
gacccugaugaucguccagcc

SEQ ID NO: 3278753 - RNA, 16 nt, Mycobacterium tuberculosis H37Rv
gacccugcccagcacc

SEQ ID NO: 3278754 - RNA, 19 nt, Mycobacterium tuberculosis H37Rv
gacccugcccagcaccccc

SEQ ID NO: 3278755 - RNA, 16 nt, Mycobacterium tuberculosis H37Rv
gacccugcgccgccac

SEQ ID NO: 3278756 - RNA, 20 nt, Mycobacterium tuberculosis H37Rv
gacccugggguugcaucaug

SEQ ID NO: 3278757 - RNA, 22 nt, Mycobacterium tuberculosis H37Rv
gacccugggguugcaucaugcc

SEQ ID NO: 3278758 - RNA, 23 nt, Mycobacterium tuberculosis H37Rv
gaccgcggcugucacgccugcca

SEQ ID NO: 3278759 - RNA, 21 nt, Mycobacterium tuberculosis H37Rv
gaccgcgggcuccccgcacau

SEQ ID NO: 3278760 - RNA, 20 nt, Mycobacterium tuberculosis H37Rv
gaccgcgggucgugccagca

SEQ ID NO: 3278761 - RNA, 22 nt, Mycobacterium tuberculosis H37Rv
gaccgcgggucgugccagcagc

SEQ ID NO: 3278762 - RNA, 17 nt, Mycobacterium tuberculosis H37Rv
gaccgcggucauggcga

SEQ ID NO: 3278763 - RNA, 19 nt, Mycobacterium tuberculosis H37Rv
gaccgcggucuucuucacc

SEQ ID NO: 3278764 - RNA, 20 nt, Mycobacterium tuberculosis H37Rv
gaccgcggucuucuucaccg

SEQ ID NO: 3278765 - RNA, 21 nt, Mycobacterium tuberculosis H37Rv
gaccgcggugacucggccucc

SEQ ID NO: 3278766 - RNA, 16 nt, Mycobacterium tuberculosis H37Rv
gaccgcgguggccaga

SEQ ID NO: 3278767 - RNA, 18 nt, Mycobacterium tuberculosis H37Rv
gaccgcguagagcagcag

SEQ ID NO: 3278768 - RNA, 19 nt, Mycobacterium tuberculosis H37Rv
gaccgcguagagcagcaga

SEQ ID NO: 3278769 - RNA, 16 nt, Mycobacterium tuberculosis H37Rv
gaccgcgucggcguuc

SEQ ID NO: 3278770 - RNA, 16 nt, Mycobacterium tuberculosis H37Rv
gaccgcgugcaccgag

SEQ ID NO: 3278771 - RNA, 22 nt, Mycobacterium tuberculosis H37Rv
gaccgcguuuugcaggcccgag

SEQ ID NO: 3278772 - RNA, 23 nt, Mycobacterium tuberculosis H37Rv
gaccgcguuuugcaggcccgagu

SEQ ID NO: 3278773 - RNA, 16 nt, Mycobacterium tuberculosis H37Rv
gaccgcuaccagcugg

SEQ ID NO: 3278774 - RNA, 17 nt, Mycobacterium tuberculosis H37Rv
gaccgcuaccagcuggg

SEQ ID NO: 3278775 - RNA, 21 nt, Mycobacterium tuberculosis H37Rv
gaccgcuaccagcugggcgac

SEQ ID NO: 3278776 - RNA, 21 nt, Mycobacterium tuberculosis H37Rv
gaccgcuacccgcgcgaccug

SEQ ID NO: 3278777 - RNA, 23 nt, Mycobacterium tuberculosis H37Rv
gaccgcucgucgccgguggcacc

SEQ ID NO: 3278778 - RNA, 16 nt, Mycobacterium tuberculosis H37Rv
gaccgcucugcggcca

SEQ ID NO: 3278779 - RNA, 15 nt, Mycobacterium tuberculosis H37Rv
gaccgcugccugccg

SEQ ID NO: 3278780 - RNA, 22 nt, Mycobacterium tuberculosis H37Rv
gaccgcuggugugucccggggu

SEQ ID NO: 3278781 - RNA, 22 nt, Mycobacterium tuberculosis H37Rv
gaccgcugguucucgcuguuga

SEQ ID NO: 3278782 - RNA, 19 nt, Mycobacterium tuberculosis H37Rv
gaccgcuucgacgucguug

SEQ ID NO: 3278783 - RNA, 21 nt, Mycobacterium tuberculosis H37Rv
gaccgcuugcccgcgcagcac

SEQ ID NO: 3278784 - RNA, 21 nt, Mycobacterium tuberculosis H37Rv
gaccggaacguuccugcacag

SEQ ID NO: 3278785 - RNA, 18 nt, Mycobacterium tuberculosis H37Rv
gaccggaguucagugcgc

SEQ ID NO: 3278786 - RNA, 23 nt, Mycobacterium tuberculosis H37Rv
gaccggaguucagugcgcgugcc

SEQ ID NO: 3278787 - RNA, 17 nt, Mycobacterium tuberculosis H37Rv
gaccggaucugacggcg

SEQ ID NO: 3278788 - RNA, 17 nt, Mycobacterium tuberculosis H37Rv
gaccggcaacgcggccu

SEQ ID NO: 3278789 - RNA, 18 nt, Mycobacterium tuberculosis H37Rv
gaccggcaacgcggccuu

SEQ ID NO: 3278790 - RNA, 14 nt, Mycobacterium tuberculosis H37Rv
gaccggcaauuccg

SEQ ID NO: 3278791 - RNA, 20 nt, Mycobacterium tuberculosis H37Rv
gaccggcaauuccguuaggc

SEQ ID NO: 3278792 - RNA, 12 nt, Mycobacterium tuberculosis H37Rv
gaccggcaucga

SEQ ID NO: 3278793 - RNA, 16 nt, Mycobacterium tuberculosis H37Rv
gaccggccacgaccuc

SEQ ID NO: 3278794 - RNA, 22 nt, Mycobacterium tuberculosis H37Rv
gaccggcccccggucgagcucg

SEQ ID NO: 3278795 - RNA, 15 nt, Mycobacterium tuberculosis H37Rv
gaccggccgacguga

SEQ ID NO: 3278796 - RNA, 15 nt, Mycobacterium tuberculosis H37Rv
gaccggccggccgcg

SEQ ID NO: 3278797 - RNA, 16 nt, Mycobacterium tuberculosis H37Rv
gaccggccugcgacga

SEQ ID NO: 3278798 - RNA, 18 nt, Mycobacterium tuberculosis H37Rv
gaccggccuggcucgucc

SEQ ID NO: 3278799 - RNA, 21 nt, Mycobacterium tuberculosis H37Rv
gaccggcggcuacggcugccc

SEQ ID NO: 3278800 - RNA, 15 nt, Mycobacterium tuberculosis H37Rv
gaccggcgucggcug

SEQ ID NO: 3278801 - RNA, 19 nt, Mycobacterium tuberculosis H37Rv
gaccggcuaccggcguguc

SEQ ID NO: 3278802 - RNA, 12 nt, Mycobacterium tuberculosis H37Rv
gaccggcuccgg

SEQ ID NO: 3278803 - RNA, 16 nt, Mycobacterium tuberculosis H37Rv
gaccggcucgaucucg

SEQ ID NO: 3278804 - RNA, 15 nt, Mycobacterium tuberculosis H37Rv
gaccggcucgucggg

SEQ ID NO: 3278805 - RNA, 21 nt, Mycobacterium tuberculosis H37Rv
gaccggcuugcccuccgggua

SEQ ID NO: 3278806 - RNA, 17 nt, Mycobacterium tuberculosis H37Rv
gaccgggaacagggugg

SEQ ID NO: 3278807 - RNA, 20 nt, Mycobacterium tuberculosis H37Rv
gaccgggaacaggguggugg

SEQ ID NO: 3278808 - RNA, 17 nt, Mycobacterium tuberculosis H37Rv
gaccgggaucgucaggc

SEQ ID NO: 3278809 - RNA, 20 nt, Mycobacterium tuberculosis H37Rv
gaccgggccaagacggcggg

SEQ ID NO: 3278810 - RNA, 19 nt, Mycobacterium tuberculosis H37Rv
gaccgggccgcacggucag

SEQ ID NO: 3278811 - RNA, 16 nt, Mycobacterium tuberculosis H37Rv
gaccgggcucuggcca

SEQ ID NO: 3278812 - RNA, 16 nt, Mycobacterium tuberculosis H37Rv
gaccgggcuggccagc

SEQ ID NO: 3278813 - RNA, 19 nt, Mycobacterium tuberculosis H37Rv
gaccgggcuggccagcgcg

SEQ ID NO: 3278814 - RNA, 15 nt, Mycobacterium tuberculosis H37Rv
gaccgggucgaugac

SEQ ID NO: 3278815 - RNA, 14 nt, Mycobacterium tuberculosis H37Rv
gaccgggucgccga

SEQ ID NO: 3278816 - RNA, 15 nt, Mycobacterium tuberculosis H37Rv
gaccgggucgccgau

SEQ ID NO: 3278817 - RNA, 15 nt, Mycobacterium tuberculosis H37Rv
gaccgggucguagcc

SEQ ID NO: 3278818 - RNA, 14 nt, Mycobacterium tuberculosis H37Rv
gaccgggugggucg

SEQ ID NO: 3278819 - RNA, 22 nt, Mycobacterium tuberculosis H37Rv
gaccgguaauccguugccguug

SEQ ID NO: 3278820 - RNA, 16 nt, Mycobacterium tuberculosis H37Rv
gaccggucacccgugc

SEQ ID NO: 3278821 - RNA, 19 nt, Mycobacterium tuberculosis H37Rv
gaccgguccagccaacggg

SEQ ID NO: 3278822 - RNA, 18 nt, Mycobacterium tuberculosis H37Rv
gaccggucuggcgaugac

SEQ ID NO: 3278823 - RNA, 15 nt, Mycobacterium tuberculosis H37Rv
gaccggugccagcag

SEQ ID NO: 3278824 - RNA, 17 nt, Mycobacterium tuberculosis H37Rv
gaccggugccugcaacg

SEQ ID NO: 3278825 - RNA, 23 nt, Mycobacterium tuberculosis H37Rv
gaccggugcugucgacgucggca

SEQ ID NO: 3278826 - RNA, 21 nt, Mycobacterium tuberculosis H37Rv
gaccgguggccaucgcgcgga

SEQ ID NO: 3278827 - RNA, 19 nt, Mycobacterium tuberculosis H37Rv
gaccgguguuccgcccagc

SEQ ID NO: 3278828 - RNA, 20 nt, Mycobacterium tuberculosis H37Rv
gaccgguuucuucggccagc

SEQ ID NO: 3278829 - RNA, 17 nt, Mycobacterium tuberculosis H37Rv
gaccguauugaccagcg

SEQ ID NO: 3278830 - RNA, 21 nt, Mycobacterium tuberculosis H37Rv
gaccguauugaccagcggggu

SEQ ID NO: 3278831 - RNA, 17 nt, Mycobacterium tuberculosis H37Rv
gaccguauuucguccac

SEQ ID NO: 3278832 - RNA, 22 nt, Mycobacterium tuberculosis H37Rv
gaccgucacugaugggccgguu

SEQ ID NO: 3278833 - RNA, 17 nt, Mycobacterium tuberculosis H37Rv
gaccguccagcaacagc

SEQ ID NO: 3278834 - RNA, 14 nt, Mycobacterium tuberculosis H37Rv
gaccguccgacggc

SEQ ID NO: 3278835 - RNA, 19 nt, Mycobacterium tuberculosis H37Rv
gaccgucgauuucgacgac

SEQ ID NO: 3278836 - RNA, 20 nt, Mycobacterium tuberculosis H37Rv
gaccgucgauuucgacgacc

SEQ ID NO: 3278837 - RNA, 22 nt, Mycobacterium tuberculosis H37Rv
gaccgucgauuucgacgaccac

SEQ ID NO: 3278838 - RNA, 12 nt, Mycobacterium tuberculosis H37Rv
gaccgucgcacc

SEQ ID NO: 3278839 - RNA, 20 nt, Mycobacterium tuberculosis H37Rv
gaccgucggcuccaggucca

SEQ ID NO: 3278840 - RNA, 23 nt, Mycobacterium tuberculosis H37Rv
gaccgucgggacggccaacaggg

SEQ ID NO: 3278841 - RNA, 17 nt, Mycobacterium tuberculosis H37Rv
gaccgucgucaccgcga

SEQ ID NO: 3278842 - RNA, 18 nt, Mycobacterium tuberculosis H37Rv
gaccgucugcgacccggg

SEQ ID NO: 3278843 - RNA, 22 nt, Mycobacterium tuberculosis H37Rv
gaccgucuggaguucgucaccg

SEQ ID NO: 3278844 - RNA, 23 nt, Mycobacterium tuberculosis H37Rv
gaccgucuuuggugccgagcagc

SEQ ID NO: 3278845 - RNA, 21 nt, Mycobacterium tuberculosis H37Rv
gaccgugacguagggcagcgc

SEQ ID NO: 3278846 - RNA, 19 nt, Mycobacterium tuberculosis H37Rv
gaccgugccgucggcgugc

SEQ ID NO: 3278847 - RNA, 19 nt, Mycobacterium tuberculosis H37Rv
gaccgugcgucgauggcgu

SEQ ID NO: 3278848 - RNA, 18 nt, Mycobacterium tuberculosis H37Rv
gaccguggauaacgacug

SEQ ID NO: 3278849 - RNA, 19 nt, Mycobacterium tuberculosis H37Rv
gaccguggauaacgacuga

SEQ ID NO: 3278850 - RNA, 11 nt, Mycobacterium tuberculosis H37Rv
gaccguggcgc

SEQ ID NO: 3278851 - RNA, 21 nt, Mycobacterium tuberculosis H37Rv
gaccguggcgccggucgccgg

SEQ ID NO: 3278852 - RNA, 23 nt, Mycobacterium tuberculosis H37Rv
gaccguggcggggaaaccggcca

SEQ ID NO: 3278853 - RNA, 16 nt, Mycobacterium tuberculosis H37Rv
gacgaccgcgcggcac

SEQ ID NO: 3278854 - RNA, 20 nt, Mycobacterium tuberculosis H37Rv
gacgaccggcuaccggcgug

SEQ ID NO: 3278855 - RNA, 22 nt, Mycobacterium tuberculosis H37Rv
gacgaccgucacaagucgacac

SEQ ID NO: 3278856 - RNA, 19 nt, Mycobacterium tuberculosis H37Rv
gacgacgaaccgguugccg

SEQ ID NO: 3278857 - RNA, 19 nt, Mycobacterium tuberculosis H37Rv
gacgacgagggccagcagc

SEQ ID NO: 3278858 - RNA, 13 nt, Mycobacterium tuberculosis H37Rv
gacgacgaggucg

SEQ ID NO: 3278859 - RNA, 15 nt, Mycobacterium tuberculosis H37Rv
gacgacgaucaagcc

SEQ ID NO: 3278860 - RNA, 11 nt, Mycobacterium tuberculosis H37Rv
gacgacgccaa

SEQ ID NO: 3278861 - RNA, 14 nt, Mycobacterium tuberculosis H37Rv
gacgacgcccucac

SEQ ID NO: 3278862 - RNA, 18 nt, Mycobacterium tuberculosis H37Rv
gacgacggcgacggcgcc

SEQ ID NO: 3278863 - RNA, 20 nt, Mycobacterium tuberculosis H37Rv
gacgacgggguuguggucga

SEQ ID NO: 3278864 - RNA, 19 nt, Mycobacterium tuberculosis H37Rv
gacgacggguuggcgucgc

SEQ ID NO: 3278865 - RNA, 19 nt, Mycobacterium tuberculosis H37Rv
gacgacguccucgacgauc

SEQ ID NO: 3278866 - RNA, 21 nt, Mycobacterium tuberculosis H37Rv
gacgacgucggccgcaucgcc

SEQ ID NO: 3278867 - RNA, 18 nt, Mycobacterium tuberculosis H37Rv
gacgacuggaaggcgggc

SEQ ID NO: 3278868 - RNA, 20 nt, Mycobacterium tuberculosis H37Rv
gacgacuggaaggcgggcag

SEQ ID NO: 3278869 - RNA, 19 nt, Mycobacterium tuberculosis H37Rv
gacgacuucgaaucaggcu

SEQ ID NO: 3278870 - RNA, 18 nt, Mycobacterium tuberculosis H37Rv
gacgagaucugcgauggg

SEQ ID NO: 3278871 - RNA, 16 nt, Mycobacterium tuberculosis H37Rv
gacgagcacgccgacc

SEQ ID NO: 3278872 - RNA, 22 nt, Mycobacterium tuberculosis H37Rv
gacgagccacggcuucgccgcg

SEQ ID NO: 3278873 - RNA, 17 nt, Mycobacterium tuberculosis H37Rv
gacgagccagaggugga

SEQ ID NO: 3278874 - RNA, 17 nt, Mycobacterium tuberculosis H37Rv
gacgagcccaccgucgc

SEQ ID NO: 3278875 - RNA, 17 nt, Mycobacterium tuberculosis H37Rv
gacgagccgagccucgc

SEQ ID NO: 3278876 - RNA, 14 nt, Mycobacterium tuberculosis H37Rv
gacgagcgauacgu

SEQ ID NO: 3278877 - RNA, 14 nt, Mycobacterium tuberculosis H37Rv
gacgagcggcuuca

SEQ ID NO: 3278878 - RNA, 20 nt, Mycobacterium tuberculosis H37Rv
gacgagcgucagauccggcc

SEQ ID NO: 3278879 - RNA, 22 nt, Mycobacterium tuberculosis H37Rv
gacgaggucauaucgacgggcc

SEQ ID NO: 3278880 - RNA, 23 nt, Mycobacterium tuberculosis H37Rv
gacgagucgccgcgggcagcgaa

SEQ ID NO: 3278881 - RNA, 24 nt, Mycobacterium tuberculosis H37Rv
gacgagugguccggcggccgguag

SEQ ID NO: 3278882 - RNA, 20 nt, Mycobacterium tuberculosis H37Rv
gacgaguuccucgugggucc

SEQ ID NO: 3278883 - RNA, 15 nt, Mycobacterium tuberculosis H37Rv
gacgaguucgcugac

SEQ ID NO: 3278884 - RNA, 16 nt, Mycobacterium tuberculosis H37Rv
gacgaguucgcugacc

SEQ ID NO: 3278885 - RNA, 18 nt, Mycobacterium tuberculosis H37Rv
gacgauagcggcccgauc

SEQ ID NO: 3278886 - RNA, 16 nt, Mycobacterium tuberculosis H37Rv
gacgaucaagccuucg

SEQ ID NO: 3278887 - RNA, 16 nt, Mycobacterium tuberculosis H37Rv
gacgaucaccccgcca

SEQ ID NO: 3278888 - RNA, 16 nt, Mycobacterium tuberculosis H37Rv
gacgaucagcacgucg

SEQ ID NO: 3278889 - RNA, 14 nt, Mycobacterium tuberculosis H37Rv
gacgaucagcgagu

SEQ ID NO: 3278890 - RNA, 18 nt, Mycobacterium tuberculosis H37Rv
gacgaucaggucgccgag

SEQ ID NO: 3278891 - RNA, 17 nt, Mycobacterium tuberculosis H37Rv
gacgaucaucucgucgu

SEQ ID NO: 3278892 - RNA, 21 nt, Mycobacterium tuberculosis H37Rv
gacgauccagggucaccucgu

SEQ ID NO: 3278893 - RNA, 21 nt, Mycobacterium tuberculosis H37Rv
gacgauccccauugcgcccca

SEQ ID NO: 3278894 - RNA, 14 nt, Mycobacterium tuberculosis H37Rv
gacgaucgacagcc

SEQ ID NO: 3278895 - RNA, 14 nt, Mycobacterium tuberculosis H37Rv
gacgaucggcggcg

SEQ ID NO: 3278896 - RNA, 21 nt, Mycobacterium tuberculosis H37Rv
gacgaucggcggcgcgccgau

SEQ ID NO: 3278897 - RNA, 18 nt, Mycobacterium tuberculosis H37Rv
gacgaucucgccggcgaa

SEQ ID NO: 3278898 - RNA, 19 nt, Mycobacterium tuberculosis H37Rv
gacgaucucgccggcgaag

SEQ ID NO: 3278899 - RNA, 14 nt, Mycobacterium tuberculosis H37Rv
gacgaucucggcgg

SEQ ID NO: 3278900 - RNA, 19 nt, Mycobacterium tuberculosis H37Rv
gacgaugaaccgggcagca

SEQ ID NO: 3278901 - RNA, 17 nt, Mycobacterium tuberculosis H37Rv
gacgaugacgcgcgaaa

SEQ ID NO: 3278902 - RNA, 18 nt, Mycobacterium tuberculosis H37Rv
gacgaugauguuggccgg

SEQ ID NO: 3278903 - RNA, 22 nt, Mycobacterium tuberculosis H37Rv
gacgaugcccuccucgaccgcg

SEQ ID NO: 3278904 - RNA, 20 nt, Mycobacterium tuberculosis H37Rv
gacgaugccggcccgcaggc

SEQ ID NO: 3278905 - RNA, 18 nt, Mycobacterium tuberculosis H37Rv
gacgaugccucggcggcc

SEQ ID NO: 3278906 - RNA, 21 nt, Mycobacterium tuberculosis H37Rv
gacgaugccucggcggccucg

SEQ ID NO: 3278907 - RNA, 20 nt, Mycobacterium tuberculosis H37Rv
gacgaugcggucaacgcuga

SEQ ID NO: 3278908 - RNA, 23 nt, Mycobacterium tuberculosis H37Rv
gacgaugcggucaacgcugacgu

SEQ ID NO: 3278909 - RNA, 22 nt, Mycobacterium tuberculosis H37Rv
gacgauggcaacggcaucccgg

SEQ ID NO: 3278910 - RNA, 20 nt, Mycobacterium tuberculosis H37Rv
gacgauggccgccgcgagga

SEQ ID NO: 3278911 - RNA, 17 nt, Mycobacterium tuberculosis H37Rv
gacgauguccuggaagc

SEQ ID NO: 3278912 - RNA, 14 nt, Mycobacterium tuberculosis H37Rv
gacgauucaccaau

SEQ ID NO: 3278913 - RNA, 17 nt, Mycobacterium tuberculosis H37Rv
gacgauuccgcccacau

SEQ ID NO: 3278914 - RNA, 21 nt, Mycobacterium tuberculosis H37Rv
gacgauuccgcgcgggaaacg

SEQ ID NO: 3278915 - RNA, 15 nt, Mycobacterium tuberculosis H37Rv
gacgauucggcggcc

SEQ ID NO: 3278916 - RNA, 14 nt, Mycobacterium tuberculosis H37Rv
gacgauugccacca

SEQ ID NO: 3278917 - RNA, 18 nt, Mycobacterium tuberculosis H37Rv
gacgcaaaauccccucgc

SEQ ID NO: 3278918 - RNA, 16 nt, Mycobacterium tuberculosis H37Rv
gacgcaccuaugguca

SEQ ID NO: 3278919 - RNA, 20 nt, Mycobacterium tuberculosis H37Rv
gacgcaccuauggucaaccg

SEQ ID NO: 3278920 - RNA, 24 nt, Mycobacterium tuberculosis H37Rv
gacgcacgacugugcgccgcagcc

SEQ ID NO: 3278921 - RNA, 14 nt, Mycobacterium tuberculosis H37Rv
gacgcacgauccgc

SEQ ID NO: 3278922 - RNA, 13 nt, Mycobacterium tuberculosis H37Rv
gacgcagaagccc

SEQ ID NO: 3278923 - RNA, 18 nt, Mycobacterium tuberculosis H37Rv
gacgcagaaucgcacaaa

SEQ ID NO: 3278924 - RNA, 17 nt, Mycobacterium tuberculosis H37Rv
gacgcagaccguccagc

SEQ ID NO: 3278925 - RNA, 21 nt, Mycobacterium tuberculosis H37Rv
gacgcagcuugcccgacggcg

SEQ ID NO: 3278926 - RNA, 16 nt, Mycobacterium tuberculosis H37Rv
gacgcaggaucacacu

SEQ ID NO: 3278927 - RNA, 21 nt, Mycobacterium tuberculosis H37Rv
gacgcaggaucacacuggccu

SEQ ID NO: 3278928 - RNA, 19 nt, Mycobacterium tuberculosis H37Rv
gacgcauaagcccccgaca

SEQ ID NO: 3278929 - RNA, 21 nt, Mycobacterium tuberculosis H37Rv
gacgcauaagcccccgacacg

SEQ ID NO: 3278930 - RNA, 19 nt, Mycobacterium tuberculosis H37Rv
gacgcaugcgugacccgac

SEQ ID NO: 3278931 - RNA, 16 nt, Mycobacterium tuberculosis H37Rv
gacgccaaaucggcca

SEQ ID NO: 3278932 - RNA, 17 nt, Mycobacterium tuberculosis H37Rv
gacgccaacgccagcgg

SEQ ID NO: 3278933 - RNA, 18 nt, Mycobacterium tuberculosis H37Rv
gacgccaacgccagcggg

SEQ ID NO: 3278934 - RNA, 16 nt, Mycobacterium tuberculosis H37Rv
gacgccaccgccacca

SEQ ID NO: 3278935 - RNA, 21 nt, Mycobacterium tuberculosis H37Rv
gacgccaccgccaccacccag

SEQ ID NO: 3278936 - RNA, 20 nt, Mycobacterium tuberculosis H37Rv
gacgccaccugacgugcggc

SEQ ID NO: 3278937 - RNA, 17 nt, Mycobacterium tuberculosis H37Rv
gacgccacgaccgccga

SEQ ID NO: 3278938 - RNA, 15 nt, Mycobacterium tuberculosis H37Rv
gacgccacugccagc

SEQ ID NO: 3278939 - RNA, 12 nt, Mycobacterium tuberculosis H37Rv
gacgccagaacg

SEQ ID NO: 3278940 - RNA, 20 nt, Mycobacterium tuberculosis H37Rv
gacgccagcugcccgacguu

SEQ ID NO: 3278941 - RNA, 23 nt, Mycobacterium tuberculosis H37Rv
gacgccaguugcguuguccacca

SEQ ID NO: 3278942 - RNA, 19 nt, Mycobacterium tuberculosis H37Rv
gacgccaucugcuggcugg

SEQ ID NO: 3278943 - RNA, 20 nt, Mycobacterium tuberculosis H37Rv
gacgccaucugcuggcuggg

SEQ ID NO: 3278944 - RNA, 21 nt, Mycobacterium tuberculosis H37Rv
gacgccaucugcuggcuggga

SEQ ID NO: 3278945 - RNA, 15 nt, Mycobacterium tuberculosis H37Rv
gacgccaugcccgca

SEQ ID NO: 3278946 - RNA, 22 nt, Mycobacterium tuberculosis H37Rv
gacgccauucaucggcaucgac

SEQ ID NO: 3278947 - RNA, 14 nt, Mycobacterium tuberculosis H37Rv
gacgcccaccgaca

SEQ ID NO: 3278948 - RNA, 17 nt, Mycobacterium tuberculosis H37Rv
gacggcagugcugcaga

SEQ ID NO: 3278949 - RNA, 22 nt, Mycobacterium tuberculosis H37Rv
gacggcauagcagccagcgucc

SEQ ID NO: 3278950 - RNA, 18 nt, Mycobacterium tuberculosis H37Rv
gacggcauuucagcgcgc

SEQ ID NO: 3278951 - RNA, 14 nt, Mycobacterium tuberculosis H37Rv
gacggccacaugga

SEQ ID NO: 3278952 - RNA, 13 nt, Mycobacterium tuberculosis H37Rv
gacggccagccca

SEQ ID NO: 3278953 - RNA, 15 nt, Mycobacterium tuberculosis H37Rv
gacggccagcccagc

SEQ ID NO: 3278954 - RNA, 13 nt, Mycobacterium tuberculosis H37Rv
gacggccagcgcg

SEQ ID NO: 3278955 - RNA, 22 nt, Mycobacterium tuberculosis H37Rv
gacggccaguugguagccgccc

SEQ ID NO: 3278956 - RNA, 17 nt, Mycobacterium tuberculosis H37Rv
gacggccaucgccagcc

SEQ ID NO: 3278957 - RNA, 15 nt, Mycobacterium tuberculosis H37Rv
gacggccggcaagca

SEQ ID NO: 3278958 - RNA, 11 nt, Mycobacterium tuberculosis H37Rv
gacggccggcc

SEQ ID NO: 3278959 - RNA, 22 nt, Mycobacterium tuberculosis H37Rv
gacggccguggaaagccggcgu

SEQ ID NO: 3278960 - RNA, 16 nt, Mycobacterium tuberculosis H37Rv
gacggccucgucgaug

SEQ ID NO: 3278961 - RNA, 21 nt, Mycobacterium tuberculosis H37Rv
gacggccuggggcagccgggc

SEQ ID NO: 3278962 - RNA, 17 nt, Mycobacterium tuberculosis H37Rv
gacggcgaaaaucccgc

SEQ ID NO: 3278963 - RNA, 22 nt, Mycobacterium tuberculosis H37Rv
gacggcgaaaaucccgcucccc

SEQ ID NO: 3278964 - RNA, 20 nt, Mycobacterium tuberculosis H37Rv
gacggcgaaaucgacagcag

SEQ ID NO: 3278965 - RNA, 23 nt, Mycobacterium tuberculosis H37Rv
gacggcgaaaucgacagcagcgc

SEQ ID NO: 3278966 - RNA, 15 nt, Mycobacterium tuberculosis H37Rv
gacggcgaacccgcc

SEQ ID NO: 3278967 - RNA, 17 nt, Mycobacterium tuberculosis H37Rv
gacggcgaacccgccga

SEQ ID NO: 3278968 - RNA, 18 nt, Mycobacterium tuberculosis H37Rv
gacggcgaacccgccgau

SEQ ID NO: 3278969 - RNA, 21 nt, Mycobacterium tuberculosis H37Rv
gacggcgaaucgguggucgau

SEQ ID NO: 3278970 - RNA, 21 nt, Mycobacterium tuberculosis H37Rv
gacggcgacgaugucgacucg

SEQ ID NO: 3278971 - RNA, 12 nt, Mycobacterium tuberculosis H37Rv
gacggcgagggc

SEQ ID NO: 3278972 - RNA, 17 nt, Mycobacterium tuberculosis H37Rv
gacggcgauauaggacg

SEQ ID NO: 3278973 - RNA, 15 nt, Mycobacterium tuberculosis H37Rv
gacggcgauggcgcg

SEQ ID NO: 3278974 - RNA, 13 nt, Mycobacterium tuberculosis H37Rv
gacggcgccaggc

SEQ ID NO: 3278975 - RNA, 14 nt, Mycobacterium tuberculosis H37Rv
gacggcgccaggca

SEQ ID NO: 3278976 - RNA, 22 nt, Mycobacterium tuberculosis H37Rv
gacggcgccauuggcgucccgc

SEQ ID NO: 3278977 - RNA, 15 nt, Mycobacterium tuberculosis H37Rv
gacggcgcccauagc

SEQ ID NO: 3278978 - RNA, 17 nt, Mycobacterium tuberculosis H37Rv
gacggcgcccgcccgag

SEQ ID NO: 3278979 - RNA, 23 nt, Mycobacterium tuberculosis H37Rv
gacggcgcccgcccgagccgcug

SEQ ID NO: 3278980 - RNA, 23 nt, Mycobacterium tuberculosis H37Rv
gacggcgccgcucacggggcgug

SEQ ID NO: 3278981 - RNA, 16 nt, Mycobacterium tuberculosis H37Rv
gacggcgccgucgaaa

SEQ ID NO: 3278982 - RNA, 14 nt, Mycobacterium tuberculosis H37Rv
gacggcgcucggcg

SEQ ID NO: 3278983 - RNA, 16 nt, Mycobacterium tuberculosis H37Rv
gacggcgcucggcgag

SEQ ID NO: 3278984 - RNA, 17 nt, Mycobacterium tuberculosis H37Rv
gacggcgcucggcgagc

SEQ ID NO: 3278985 - RNA, 16 nt, Mycobacterium tuberculosis H37Rv
gacggcgcuguggcgg

SEQ ID NO: 3278986 - RNA, 14 nt, Mycobacterium tuberculosis H37Rv
gacggcggcaucgg

SEQ ID NO: 3278987 - RNA, 15 nt, Mycobacterium tuberculosis H37Rv
gacggcggccaaggu

SEQ ID NO: 3278988 - RNA, 14 nt, Mycobacterium tuberculosis H37Rv
gacggcggccuucg

SEQ ID NO: 3278989 - RNA, 12 nt, Mycobacterium tuberculosis H37Rv
gacggcggucag

SEQ ID NO: 3278990 - RNA, 18 nt, Mycobacterium tuberculosis H37Rv
gacggcguagacguccgc

SEQ ID NO: 3278991 - RNA, 12 nt, Mycobacterium tuberculosis H37Rv
gacggcgucggg

SEQ ID NO: 3278992 - RNA, 18 nt, Mycobacterium tuberculosis H37Rv
gacggcgucugcgguggc

SEQ ID NO: 3278993 - RNA, 19 nt, Mycobacterium tuberculosis H37Rv
gacggcguugagcaggugc

SEQ ID NO: 3278994 - RNA, 14 nt, Mycobacterium tuberculosis H37Rv
gacggcuaccaccg

SEQ ID NO: 3278995 - RNA, 23 nt, Mycobacterium tuberculosis H37Rv
gacggcuccuccgguaucggcga

SEQ ID NO: 3278996 - RNA, 17 nt, Mycobacterium tuberculosis H37Rv
gacggcucuaccggucc

SEQ ID NO: 3278997 - RNA, 17 nt, Mycobacterium tuberculosis H37Rv
gacggcugccgucagcc

SEQ ID NO: 3278998 - RNA, 18 nt, Mycobacterium tuberculosis H37Rv
gacggcugccgucagccg

SEQ ID NO: 3278999 - RNA, 16 nt, Mycobacterium tuberculosis H37Rv
gacggcuucggcagcc

SEQ ID NO: 3279000 - RNA, 21 nt, Mycobacterium tuberculosis H37Rv
gacggcuucggcagccgcaua

SEQ ID NO: 3279001 - RNA, 14 nt, Mycobacterium tuberculosis H37Rv
gacgggagcgacgu

SEQ ID NO: 3279002 - RNA, 17 nt, Mycobacterium tuberculosis H37Rv
gacgggauagccguucg

SEQ ID NO: 3279003 - RNA, 21 nt, Mycobacterium tuberculosis H37Rv
gacgggcacccgagccgcaca

SEQ ID NO: 3279004 - RNA, 15 nt, Mycobacterium tuberculosis H37Rv
gacgggcacgcggcg

SEQ ID NO: 3279005 - RNA, 16 nt, Mycobacterium tuberculosis H37Rv
gacgggcacgcggcga

SEQ ID NO: 3279006 - RNA, 22 nt, Mycobacterium tuberculosis H37Rv
gacgggccacgaugcgcacacc

SEQ ID NO: 3279007 - RNA, 17 nt, Mycobacterium tuberculosis H37Rv
gacgggccgucgccguc

SEQ ID NO: 3279008 - RNA, 15 nt, Mycobacterium tuberculosis H37Rv
gacggggcaaaggag

SEQ ID NO: 3279009 - RNA, 20 nt, Mycobacterium tuberculosis H37Rv
gacggggcaaaggagccguu

SEQ ID NO: 3279010 - RNA, 16 nt, Mycobacterium tuberculosis H37Rv
gacggggcugaccgcc

SEQ ID NO: 3279011 - RNA, 16 nt, Mycobacterium tuberculosis H37Rv
gacgggggcuguccac

SEQ ID NO: 3279012 - RNA, 17 nt, Mycobacterium tuberculosis H37Rv
gacgggguacugcggcu

SEQ ID NO: 3279013 - RNA, 19 nt, Mycobacterium tuberculosis H37Rv
gacggggucgcccggggcg

SEQ ID NO: 3279014 - RNA, 22 nt, Mycobacterium tuberculosis H37Rv
gacggggucgcgaugcucaaug

SEQ ID NO: 3279015 - RNA, 16 nt, Mycobacterium tuberculosis H37Rv
gacgggguugaccgcc

SEQ ID NO: 3279016 - RNA, 14 nt, Mycobacterium tuberculosis H37Rv
gacgggucgccgcc

SEQ ID NO: 3279017 - RNA, 21 nt, Mycobacterium tuberculosis H37Rv
gacgggucggcagaauguucu

SEQ ID NO: 3279018 - RNA, 18 nt, Mycobacterium tuberculosis H37Rv
gacgggucggcgccgagc

SEQ ID NO: 3279019 - RNA, 19 nt, Mycobacterium tuberculosis H37Rv
gacgggucguucuccgcgc

SEQ ID NO: 3279020 - RNA, 19 nt, Mycobacterium tuberculosis H37Rv
gacggucaaaugaauggug

SEQ ID NO: 3279021 - RNA, 20 nt, Mycobacterium tuberculosis H37Rv
gacggucaaggugcgccgcc

SEQ ID NO: 3279022 - RNA, 15 nt, Mycobacterium tuberculosis H37Rv
gacgguccacgacgu

SEQ ID NO: 3279023 - RNA, 21 nt, Mycobacterium tuberculosis H37Rv
gacgguccacgacgucgagcg

SEQ ID NO: 3279024 - RNA, 13 nt, Mycobacterium tuberculosis H37Rv
gacgguccggucg

SEQ ID NO: 3279025 - RNA, 21 nt, Mycobacterium tuberculosis H37Rv
gacgguccguucgaugccagu

SEQ ID NO: 3279026 - RNA, 12 nt, Mycobacterium tuberculosis H37Rv
gacggucgccgu

SEQ ID NO: 3279027 - RNA, 17 nt, Mycobacterium tuberculosis H37Rv
gacggucgcucggcaug

SEQ ID NO: 3279028 - RNA, 14 nt, Mycobacterium tuberculosis H37Rv
gacggucgucgauc

SEQ ID NO: 3279029 - RNA, 17 nt, Mycobacterium tuberculosis H37Rv
gacggucuggcccgcga

SEQ ID NO: 3279030 - RNA, 22 nt, Mycobacterium tuberculosis H37Rv
gacggucuggcccgcgacaucg

SEQ ID NO: 3279031 - RNA, 17 nt, Mycobacterium tuberculosis H37Rv
gacggugaccgggaguc

SEQ ID NO: 3279032 - RNA, 21 nt, Mycobacterium tuberculosis H37Rv
gacggugagggcgucgucgag

SEQ ID NO: 3279033 - RNA, 14 nt, Mycobacterium tuberculosis H37Rv
gacggugauggggg

SEQ ID NO: 3279034 - RNA, 20 nt, Mycobacterium tuberculosis H37Rv
gacggugcaggaccagaacu

SEQ ID NO: 3279035 - RNA, 18 nt, Mycobacterium tuberculosis H37Rv
gacggugccgaccgcguu

SEQ ID NO: 3279036 - RNA, 17 nt, Mycobacterium tuberculosis H37Rv
gacggugccgguuuucg

SEQ ID NO: 3279037 - RNA, 15 nt, Mycobacterium tuberculosis H37Rv
gacggugcgcuggau

SEQ ID NO: 3279038 - RNA, 14 nt, Mycobacterium tuberculosis H37Rv
gacggugcggucag

SEQ ID NO: 3279039 - RNA, 18 nt, Mycobacterium tuberculosis H37Rv
gacgguggggucgccguc

SEQ ID NO: 3279040 - RNA, 22 nt, Mycobacterium tuberculosis H37Rv
gacgguggggucgccgucgaac

SEQ ID NO: 3279041 - RNA, 14 nt, Mycobacterium tuberculosis H37Rv
gacggugguccuga

SEQ ID NO: 3279042 - RNA, 11 nt, Mycobacterium tuberculosis H37Rv
gacggugguga

SEQ ID NO: 3279043 - RNA, 22 nt, Mycobacterium tuberculosis H37Rv
gacgguggugaccgcgggcgcc

SEQ ID NO: 3279044 - RNA, 23 nt, Mycobacterium tuberculosis H37Rv
gacucacgaggcacaaucaccgc

SEQ ID NO: 3279045 - RNA, 15 nt, Mycobacterium tuberculosis H37Rv
gacucacgcagcgcc

SEQ ID NO: 3279046 - RNA, 18 nt, Mycobacterium tuberculosis H37Rv
gacucaucaccgauggca

SEQ ID NO: 3279047 - RNA, 17 nt, Mycobacterium tuberculosis H37Rv
gacucaucccgagauca

SEQ ID NO: 3279048 - RNA, 13 nt, Mycobacterium tuberculosis H37Rv
gacucaucggccg

SEQ ID NO: 3279049 - RNA, 21 nt, Mycobacterium tuberculosis H37Rv
gacuccaccccacccagcgac

SEQ ID NO: 3279050 - RNA, 19 nt, Mycobacterium tuberculosis H37Rv
gacuccagcaccagcacgg

SEQ ID NO: 3279051 - RNA, 16 nt, Mycobacterium tuberculosis H37Rv
gacuccggcaagcaca

SEQ ID NO: 3279052 - RNA, 23 nt, Mycobacterium tuberculosis H37Rv
gacuccggcaagcacaccgccag

SEQ ID NO: 3279053 - RNA, 22 nt, Mycobacterium tuberculosis H37Rv
gacuccggcuggaagcggcgac

SEQ ID NO: 3279054 - RNA, 16 nt, Mycobacterium tuberculosis H37Rv
gacuccguaccggguu

SEQ ID NO: 3279055 - RNA, 12 nt, Mycobacterium tuberculosis H37Rv
gacuccugcggc

SEQ ID NO: 3279056 - RNA, 16 nt, Mycobacterium tuberculosis H37Rv
gacuccugcggcaccg

SEQ ID NO: 3279057 - RNA, 18 nt, Mycobacterium tuberculosis H37Rv
gacuccugcggcaccgcu

SEQ ID NO: 3279058 - RNA, 13 nt, Mycobacterium tuberculosis H37Rv
gacuccugggcca

SEQ ID NO: 3279059 - RNA, 13 nt, Mycobacterium tuberculosis H37Rv
gacucgacaauuc

SEQ ID NO: 3279060 - RNA, 23 nt, Mycobacterium tuberculosis H37Rv
gacucgacguaagugugcccugc

SEQ ID NO: 3279061 - RNA, 14 nt, Mycobacterium tuberculosis H37Rv
gacucgagagcgau

SEQ ID NO: 3279062 - RNA, 16 nt, Mycobacterium tuberculosis H37Rv
gacucgaucaccauga

SEQ ID NO: 3279063 - RNA, 20 nt, Mycobacterium tuberculosis H37Rv
gacucgccacauuucaccac

SEQ ID NO: 3279064 - RNA, 13 nt, Mycobacterium tuberculosis H37Rv
gacucgccaccgc

SEQ ID NO: 3279065 - RNA, 19 nt, Mycobacterium tuberculosis H37Rv
gacucggaauucggcgucg

SEQ ID NO: 3279066 - RNA, 17 nt, Mycobacterium tuberculosis H37Rv
gacucggcaccgcggcc

SEQ ID NO: 3279067 - RNA, 19 nt, Mycobacterium tuberculosis H37Rv
gacucggcggaagaccgga

SEQ ID NO: 3279068 - RNA, 18 nt, Mycobacterium tuberculosis H37Rv
gacucgucgcaucaccag

SEQ ID NO: 3279069 - RNA, 20 nt, Mycobacterium tuberculosis H37Rv
gacucgucgcaucaccaggg

SEQ ID NO: 3279070 - RNA, 22 nt, Mycobacterium tuberculosis H37Rv
gacucgugucugccucggggcc

SEQ ID NO: 3279071 - RNA, 17 nt, Mycobacterium tuberculosis H37Rv
gacucugccacccagca

SEQ ID NO: 3279072 - RNA, 16 nt, Mycobacterium tuberculosis H37Rv
gacucugccgauguca

SEQ ID NO: 3279073 - RNA, 20 nt, Mycobacterium tuberculosis H37Rv
gacucugcguccaccacgca

SEQ ID NO: 3279074 - RNA, 18 nt, Mycobacterium tuberculosis H37Rv
gacucugcgucugcucac

SEQ ID NO: 3279075 - RNA, 22 nt, Mycobacterium tuberculosis H37Rv
gacucugcgucugcucaccagc

SEQ ID NO: 3279076 - RNA, 17 nt, Mycobacterium tuberculosis H37Rv
gacucugguccggucuu

SEQ ID NO: 3279077 - RNA, 14 nt, Mycobacterium tuberculosis H37Rv
gacugaacaccaaa

SEQ ID NO: 3279078 - RNA, 16 nt, Mycobacterium tuberculosis H37Rv
gacugaacgucaccgu

SEQ ID NO: 3279079 - RNA, 19 nt, Mycobacterium tuberculosis H37Rv
gacugaaucgaccggaacu

SEQ ID NO: 3279080 - RNA, 20 nt, Mycobacterium tuberculosis H37Rv
gacugaccgucugcgacccg

SEQ ID NO: 3279081 - RNA, 20 nt, Mycobacterium tuberculosis H37Rv
gacugaucaagugccagcgu

SEQ ID NO: 3279082 - RNA, 17 nt, Mycobacterium tuberculosis H37Rv
gacugaucugugggugg

SEQ ID NO: 3279083 - RNA, 18 nt, Mycobacterium tuberculosis H37Rv
gacugcaacucuucccau

SEQ ID NO: 3279084 - RNA, 20 nt, Mycobacterium tuberculosis H37Rv
gacugcagaaacagccgcag

SEQ ID NO: 3279085 - RNA, 21 nt, Mycobacterium tuberculosis H37Rv
gacugcagaaacagccgcagc

SEQ ID NO: 3279086 - RNA, 22 nt, Mycobacterium tuberculosis H37Rv
gacugcagaaacagccgcagcg

SEQ ID NO: 3279087 - RNA, 16 nt, Mycobacterium tuberculosis H37Rv
gacugcagcccugcgc

SEQ ID NO: 3279088 - RNA, 17 nt, Mycobacterium tuberculosis H37Rv
gacugcagcccugcgca

SEQ ID NO: 3279089 - RNA, 18 nt, Mycobacterium tuberculosis H37Rv
gacugcagcccugcgcag

SEQ ID NO: 3279090 - RNA, 13 nt, Mycobacterium tuberculosis H37Rv
gacugcagcggcg

SEQ ID NO: 3279091 - RNA, 16 nt, Mycobacterium tuberculosis H37Rv
gacugcagcggcgcau

SEQ ID NO: 3279092 - RNA, 15 nt, Mycobacterium tuberculosis H37Rv
gacugcccgauggcu

SEQ ID NO: 3279093 - RNA, 13 nt, Mycobacterium tuberculosis H37Rv
gacugcgccgccg

SEQ ID NO: 3279094 - RNA, 14 nt, Mycobacterium tuberculosis H37Rv
gacugcgccgccgg

SEQ ID NO: 3279095 - RNA, 13 nt, Mycobacterium tuberculosis H37Rv
gacugcgcggcuu

SEQ ID NO: 3279096 - RNA, 13 nt, Mycobacterium tuberculosis H37Rv
gacugcggaagcc

SEQ ID NO: 3279097 - RNA, 21 nt, Mycobacterium tuberculosis H37Rv
gacugcggauaggugccgcgg

SEQ ID NO: 3279098 - RNA, 15 nt, Mycobacterium tuberculosis H37Rv
gacugcggcccgacc

SEQ ID NO: 3279099 - RNA, 14 nt, Mycobacterium tuberculosis H37Rv
gacugcgggccagc

SEQ ID NO: 3279100 - RNA, 17 nt, Mycobacterium tuberculosis H37Rv
gacugcgggccagcgca

SEQ ID NO: 3279101 - RNA, 15 nt, Mycobacterium tuberculosis H37Rv
gacugcgggccgcuc

SEQ ID NO: 3279102 - RNA, 14 nt, Mycobacterium tuberculosis H37Rv
gacugcggucugga

SEQ ID NO: 3279103 - RNA, 16 nt, Mycobacterium tuberculosis H37Rv
gacugcgucggcggcu

SEQ ID NO: 3279104 - RNA, 17 nt, Mycobacterium tuberculosis H37Rv
gacugcgucggcggcuu

SEQ ID NO: 3279105 - RNA, 14 nt, Mycobacterium tuberculosis H37Rv
gacugcuggggguc

SEQ ID NO: 3279106 - RNA, 20 nt, Mycobacterium tuberculosis H37Rv
gacuggaccgcggugacccg

SEQ ID NO: 3279107 - RNA, 15 nt, Mycobacterium tuberculosis H37Rv
gacuggcaccgccag

SEQ ID NO: 3279108 - RNA, 14 nt, Mycobacterium tuberculosis H37Rv
gacuggcaggccgg

SEQ ID NO: 3279109 - RNA, 16 nt, Mycobacterium tuberculosis H37Rv
gacuggcaggccggcg

SEQ ID NO: 3279110 - RNA, 17 nt, Mycobacterium tuberculosis H37Rv
gacuggccgcccggcga

SEQ ID NO: 3279111 - RNA, 17 nt, Mycobacterium tuberculosis H37Rv
gacugggcaaacccgga

SEQ ID NO: 3279112 - RNA, 18 nt, Mycobacterium tuberculosis H37Rv
gacuggggcgccaccacc

SEQ ID NO: 3279113 - RNA, 21 nt, Mycobacterium tuberculosis H37Rv
gacuggguggugcucaccucc

SEQ ID NO: 3279114 - RNA, 16 nt, Mycobacterium tuberculosis H37Rv
gacuggucacugcccu

SEQ ID NO: 3279115 - RNA, 10 nt, Mycobacterium tuberculosis H37Rv
gacuguccca

SEQ ID NO: 3279116 - RNA, 16 nt, Mycobacterium tuberculosis H37Rv
gacugucccaccaggu

SEQ ID NO: 3279117 - RNA, 17 nt, Mycobacterium tuberculosis H37Rv
gacugucccaccaggua

SEQ ID NO: 3279118 - RNA, 18 nt, Mycobacterium tuberculosis H37Rv
gacugugaaucugacgac

SEQ ID NO: 3279119 - RNA, 20 nt, Mycobacterium tuberculosis H37Rv
gacugugaaucugacgacgc

SEQ ID NO: 3279120 - RNA, 15 nt, Mycobacterium tuberculosis H37Rv
gacugugcgccgcag

SEQ ID NO: 3279121 - RNA, 12 nt, Mycobacterium tuberculosis H37Rv
gacuguggcgcc

SEQ ID NO: 3279122 - RNA, 15 nt, Mycobacterium tuberculosis H37Rv
gacuucacucguuga

SEQ ID NO: 3279123 - RNA, 14 nt, Mycobacterium tuberculosis H37Rv
gacuucagcaggcc

SEQ ID NO: 3279124 - RNA, 18 nt, Mycobacterium tuberculosis H37Rv
gacuucagcaggcccagc

SEQ ID NO: 3279125 - RNA, 21 nt, Mycobacterium tuberculosis H37Rv
gacuucagcaggcccagcgga

SEQ ID NO: 3279126 - RNA, 13 nt, Mycobacterium tuberculosis H37Rv
gacuucagcggcc

SEQ ID NO: 3279127 - RNA, 21 nt, Mycobacterium tuberculosis H37Rv
gacuucccgcgcgagccgcuc

SEQ ID NO: 3279128 - RNA, 18 nt, Mycobacterium tuberculosis H37Rv
gacuucgauggugugccc

SEQ ID NO: 3279129 - RNA, 21 nt, Mycobacterium tuberculosis H37Rv
gacuucgauggugugcccgca

SEQ ID NO: 3279130 - RNA, 19 nt, Mycobacterium tuberculosis H37Rv
gacuucgcugcggugggcc

SEQ ID NO: 3279131 - RNA, 19 nt, Mycobacterium tuberculosis H37Rv
gacuucgguguagcccagc

SEQ ID NO: 3279132 - RNA, 17 nt, Mycobacterium tuberculosis H37Rv
gacuucguggccuugac

SEQ ID NO: 3279133 - RNA, 17 nt, Mycobacterium tuberculosis H37Rv
gacuugccgaccccgga

SEQ ID NO: 3279134 - RNA, 15 nt, Mycobacterium tuberculosis H37Rv
gacuuggcaucgcga

SEQ ID NO: 3279135 - RNA, 14 nt, Mycobacterium tuberculosis H37Rv
gacuuggccagcag

SEQ ID NO: 3279136 - RNA, 17 nt, Mycobacterium tuberculosis H37Rv
gacuuggccagcagccg

SEQ ID NO: 3279137 - RNA, 20 nt, Mycobacterium tuberculosis H37Rv
gacuuggccagcagccgcga

SEQ ID NO: 3279138 - RNA, 17 nt, Mycobacterium tuberculosis H37Rv
gacuuggccaugcuggu

SEQ ID NO: 3279139 - RNA, 18 nt, Mycobacterium tuberculosis H37Rv
gacuuggggcguuucggc

SEQ ID NO: 3279140 - RNA, 17 nt, Mycobacterium tuberculosis H37Rv
gacuugguugccgccuu

SEQ ID NO: 3279141 - RNA, 17 nt, Mycobacterium tuberculosis H37Rv
gagcaccgacaccggcc

SEQ ID NO: 3279142 - RNA, 14 nt, Mycobacterium tuberculosis H37Rv
gagcaccgaccagg

SEQ ID NO: 3279143 - RNA, 22 nt, Mycobacterium tuberculosis H37Rv
gagcaccuccagauacaggaac

SEQ ID NO: 3279144 - RNA, 24 nt, Mycobacterium tuberculosis H37Rv
gagcaccucggccucgucgugcac

SEQ ID NO: 3279145 - RNA, 20 nt, Mycobacterium tuberculosis H37Rv
gagcaccucuaccguggcac

SEQ ID NO: 3279146 - RNA, 14 nt, Mycobacterium tuberculosis H37Rv
gagcacgagcggcu

SEQ ID NO: 3279147 - RNA, 17 nt, Mycobacterium tuberculosis H37Rv
gagcacggcgcggcgga

SEQ ID NO: 3279148 - RNA, 21 nt, Mycobacterium tuberculosis H37Rv
gagcacggcgcggcggagugc

SEQ ID NO: 3279149 - RNA, 20 nt, Mycobacterium tuberculosis H37Rv
gagcacgggcucgcugcacc

SEQ ID NO: 3279150 - RNA, 20 nt, Mycobacterium tuberculosis H37Rv
gagcacggguagcguccagg

SEQ ID NO: 3279151 - RNA, 18 nt, Mycobacterium tuberculosis H37Rv
gagcacgucaacagccag

SEQ ID NO: 3279152 - RNA, 14 nt, Mycobacterium tuberculosis H37Rv
gagcacuccggagc

SEQ ID NO: 3279153 - RNA, 22 nt, Mycobacterium tuberculosis H37Rv
gagcagaaacaacgucgccgcg

SEQ ID NO: 3279154 - RNA, 18 nt, Mycobacterium tuberculosis H37Rv
gagcagacacagaaucgc

SEQ ID NO: 3279155 - RNA, 16 nt, Mycobacterium tuberculosis H37Rv
gagcagacccaguccg

SEQ ID NO: 3279156 - RNA, 21 nt, Mycobacterium tuberculosis H37Rv
gagcagacgcuaaagcccccg

SEQ ID NO: 3279157 - RNA, 14 nt, Mycobacterium tuberculosis H37Rv
gagcagacugcccu

SEQ ID NO: 3279158 - RNA, 16 nt, Mycobacterium tuberculosis H37Rv
gagcagacugcccucg

SEQ ID NO: 3279159 - RNA, 17 nt, Mycobacterium tuberculosis H37Rv
gagcagagaacuccgcc

SEQ ID NO: 3279160 - RNA, 14 nt, Mycobacterium tuberculosis H37Rv
gagcagaucgcggg

SEQ ID NO: 3279161 - RNA, 20 nt, Mycobacterium tuberculosis H37Rv
gagcagaucuuccgagcacu

SEQ ID NO: 3279162 - RNA, 15 nt, Mycobacterium tuberculosis H37Rv
gagcagcaagccgcc

SEQ ID NO: 3279163 - RNA, 17 nt, Mycobacterium tuberculosis H37Rv
gagcagcaagccgccgg

SEQ ID NO: 3279164 - RNA, 13 nt, Mycobacterium tuberculosis H37Rv
gagcagcacagca

SEQ ID NO: 3279165 - RNA, 19 nt, Mycobacterium tuberculosis H37Rv
gagcagcaccacccgcacc

SEQ ID NO: 3279166 - RNA, 22 nt, Mycobacterium tuberculosis H37Rv
gagcagcaccacccgcaccuca

SEQ ID NO: 3279167 - RNA, 14 nt, Mycobacterium tuberculosis H37Rv
gagcagcacgucga

SEQ ID NO: 3279168 - RNA, 16 nt, Mycobacterium tuberculosis H37Rv
gagcagcagcgggcug

SEQ ID NO: 3279169 - RNA, 22 nt, Mycobacterium tuberculosis H37Rv
gagcagcagguacaucaccacg

SEQ ID NO: 3279170 - RNA, 12 nt, Mycobacterium tuberculosis H37Rv
gagcagccagcc

SEQ ID NO: 3279171 - RNA, 23 nt, Mycobacterium tuberculosis H37Rv
gagcagccgaaccggcaccagcg

SEQ ID NO: 3279172 - RNA, 13 nt, Mycobacterium tuberculosis H37Rv
gagcagccgcgac

SEQ ID NO: 3279173 - RNA, 14 nt, Mycobacterium tuberculosis H37Rv
gagcagccggccaa

SEQ ID NO: 3279174 - RNA, 20 nt, Mycobacterium tuberculosis H37Rv
gagcagcgccacccgcguca

SEQ ID NO: 3279175 - RNA, 13 nt, Mycobacterium tuberculosis H37Rv
gagcagcgcggcc

SEQ ID NO: 3279176 - RNA, 16 nt, Mycobacterium tuberculosis H37Rv
gagcagcgcggccaga

SEQ ID NO: 3279177 - RNA, 18 nt, Mycobacterium tuberculosis H37Rv
gagcagcgcggccagagc

SEQ ID NO: 3279178 - RNA, 18 nt, Mycobacterium tuberculosis H37Rv
gagcagcucacuggugac

SEQ ID NO: 3279179 - RNA, 18 nt, Mycobacterium tuberculosis H37Rv
gagcaggcgcaccaggcg

SEQ ID NO: 3279180 - RNA, 14 nt, Mycobacterium tuberculosis H37Rv
gagcagggccggca

SEQ ID NO: 3279181 - RNA, 14 nt, Mycobacterium tuberculosis H37Rv
gagcagggcggcga

SEQ ID NO: 3279182 - RNA, 18 nt, Mycobacterium tuberculosis H37Rv
gagcagggcgucgaccgc

SEQ ID NO: 3279183 - RNA, 19 nt, Mycobacterium tuberculosis H37Rv
gagcagggugaccaggauc

SEQ ID NO: 3279184 - RNA, 12 nt, Mycobacterium tuberculosis H37Rv
gagcaggucucg

SEQ ID NO: 3279185 - RNA, 17 nt, Mycobacterium tuberculosis H37Rv
gagcagucgcaaaagcc

SEQ ID NO: 3279186 - RNA, 18 nt, Mycobacterium tuberculosis H37Rv
gagcaguuccagcucgcg

SEQ ID NO: 3279187 - RNA, 14 nt, Mycobacterium tuberculosis H37Rv
gagcauaccgccgc

SEQ ID NO: 3279188 - RNA, 14 nt, Mycobacterium tuberculosis H37Rv
gagcaugauguccu

SEQ ID NO: 3279189 - RNA, 16 nt, Mycobacterium tuberculosis H37Rv
gagcaugauguccucc

SEQ ID NO: 3279190 - RNA, 14 nt, Mycobacterium tuberculosis H37Rv
gagcaugcccagcg

SEQ ID NO: 3279191 - RNA, 17 nt, Mycobacterium tuberculosis H37Rv
gagcaugcccagcgaau

SEQ ID NO: 3279192 - RNA, 15 nt, Mycobacterium tuberculosis H37Rv
gagcaugccgcccgc

SEQ ID NO: 3279193 - RNA, 17 nt, Mycobacterium tuberculosis H37Rv
gagcaugcuggaccucg

SEQ ID NO: 3279194 - RNA, 17 nt, Mycobacterium tuberculosis H37Rv
gagccaacgcgcagagc

SEQ ID NO: 3279195 - RNA, 15 nt, Mycobacterium tuberculosis H37Rv
gagccaacgcgcgac

SEQ ID NO: 3279196 - RNA, 14 nt, Mycobacterium tuberculosis H37Rv
gagccaacuccacc

SEQ ID NO: 3279197 - RNA, 13 nt, Mycobacterium tuberculosis H37Rv
gagccaccaacac

SEQ ID NO: 3279198 - RNA, 21 nt, Mycobacterium tuberculosis H37Rv
gagccaccggcgucgacgucg

SEQ ID NO: 3279199 - RNA, 18 nt, Mycobacterium tuberculosis H37Rv
gagccacggcuucgccgc

SEQ ID NO: 3279200 - RNA, 15 nt, Mycobacterium tuberculosis H37Rv
gagccacucggcccg

SEQ ID NO: 3279201 - RNA, 18 nt, Mycobacterium tuberculosis H37Rv
gagccacucggcccggca

SEQ ID NO: 3279202 - RNA, 16 nt, Mycobacterium tuberculosis H37Rv
gagccagaaugcaagc

SEQ ID NO: 3279203 - RNA, 18 nt, Mycobacterium tuberculosis H37Rv
gagccagcacccgcagcc

SEQ ID NO: 3279204 - RNA, 15 nt, Mycobacterium tuberculosis H37Rv
gagccaggacgacgc

SEQ ID NO: 3279205 - RNA, 16 nt, Mycobacterium tuberculosis H37Rv
gagccauacgcgcuga

SEQ ID NO: 3279206 - RNA, 16 nt, Mycobacterium tuberculosis H37Rv
gagccaucgucgagcg

SEQ ID NO: 3279207 - RNA, 16 nt, Mycobacterium tuberculosis H37Rv
gagccauguccuugga

SEQ ID NO: 3279208 - RNA, 19 nt, Mycobacterium tuberculosis H37Rv
gagcccagccgggcacccu

SEQ ID NO: 3279209 - RNA, 12 nt, Mycobacterium tuberculosis H37Rv
gagcccagcgcc

SEQ ID NO: 3279210 - RNA, 13 nt, Mycobacterium tuberculosis H37Rv
gagcccagcgccu

SEQ ID NO: 3279211 - RNA, 17 nt, Mycobacterium tuberculosis H37Rv
gagccccccgagcccgc

SEQ ID NO: 3279212 - RNA, 18 nt, Mycobacterium tuberculosis H37Rv
gagccccgaccagcagac

SEQ ID NO: 3279213 - RNA, 22 nt, Mycobacterium tuberculosis H37Rv
gagccccugucaacgccgcggu

SEQ ID NO: 3279214 - RNA, 16 nt, Mycobacterium tuberculosis H37Rv
gagcccgaaggcggcu

SEQ ID NO: 3279215 - RNA, 20 nt, Mycobacterium tuberculosis H37Rv
gagcccgagcucaccgcaca

SEQ ID NO: 3279216 - RNA, 15 nt, Mycobacterium tuberculosis H37Rv
gagcccgccacagcc

SEQ ID NO: 3279217 - RNA, 18 nt, Mycobacterium tuberculosis H37Rv
gagcccgccacagcccca

SEQ ID NO: 3279218 - RNA, 14 nt, Mycobacterium tuberculosis H37Rv
gagcccgccgcgac

SEQ ID NO: 3279219 - RNA, 18 nt, Mycobacterium tuberculosis H37Rv
gagcccggcgaucagcag

SEQ ID NO: 3279220 - RNA, 19 nt, Mycobacterium tuberculosis H37Rv
gagcccggcgaucagcagc

SEQ ID NO: 3279221 - RNA, 23 nt, Mycobacterium tuberculosis H37Rv
gagcccggcgaucagcagcgcca

SEQ ID NO: 3279222 - RNA, 14 nt, Mycobacterium tuberculosis H37Rv
gagcccggcggccc

SEQ ID NO: 3279223 - RNA, 17 nt, Mycobacterium tuberculosis H37Rv
gagcccggcggcccgau

SEQ ID NO: 3279224 - RNA, 19 nt, Mycobacterium tuberculosis H37Rv
gagcccggugcuaccggcu

SEQ ID NO: 3279225 - RNA, 13 nt, Mycobacterium tuberculosis H37Rv
gagcccgucagcu

SEQ ID NO: 3279226 - RNA, 19 nt, Mycobacterium tuberculosis H37Rv
gagcccgucagcuccccgu

SEQ ID NO: 3279227 - RNA, 14 nt, Mycobacterium tuberculosis H37Rv
gagcccguccaggc

SEQ ID NO: 3279228 - RNA, 17 nt, Mycobacterium tuberculosis H37Rv
gagcccgucgaguaggu

SEQ ID NO: 3279229 - RNA, 13 nt, Mycobacterium tuberculosis H37Rv
gagcccgucgauc

SEQ ID NO: 3279230 - RNA, 15 nt, Mycobacterium tuberculosis H37Rv
gagcccuccagggcc

SEQ ID NO: 3279231 - RNA, 16 nt, Mycobacterium tuberculosis H37Rv
gagccgacaacgacgu

SEQ ID NO: 3279232 - RNA, 22 nt, Mycobacterium tuberculosis H37Rv
gagccgacuuugagucguugga

SEQ ID NO: 3279233 - RNA, 23 nt, Mycobacterium tuberculosis H37Rv
gagccgaggaauacucucgcgac

SEQ ID NO: 3279234 - RNA, 18 nt, Mycobacterium tuberculosis H37Rv
gagccgauauaccagggc

SEQ ID NO: 3279235 - RNA, 14 nt, Mycobacterium tuberculosis H37Rv
gagccgaucacgcu

SEQ ID NO: 3279236 - RNA, 16 nt, Mycobacterium tuberculosis H37Rv
gagccgauccaggagu

SEQ ID NO: 3279237 - RNA, 18 nt, Mycobacterium tuberculosis H37Rv
gagccgauccaggaguga

SEQ ID NO: 3279238 - RNA, 15 nt, Mycobacterium tuberculosis H37Rv
gagcggagccgccga

SEQ ID NO: 3279239 - RNA, 20 nt, Mycobacterium tuberculosis H37Rv
gagcggauagcggcaaagcc

SEQ ID NO: 3279240 - RNA, 22 nt, Mycobacterium tuberculosis H37Rv
gagcggauccgugucgcagauc

SEQ ID NO: 3279241 - RNA, 12 nt, Mycobacterium tuberculosis H37Rv
gagcggcagcca

SEQ ID NO: 3279242 - RNA, 22 nt, Mycobacterium tuberculosis H37Rv
gagcggccaggucggucauccg

SEQ ID NO: 3279243 - RNA, 12 nt, Mycobacterium tuberculosis H37Rv
gagcggccggca

SEQ ID NO: 3279244 - RNA, 17 nt, Mycobacterium tuberculosis H37Rv
gagcggccggcaugcug

SEQ ID NO: 3279245 - RNA, 20 nt, Mycobacterium tuberculosis H37Rv
gagcggccuccagcacccgg

SEQ ID NO: 3279246 - RNA, 12 nt, Mycobacterium tuberculosis H37Rv
gagcggccucgg

SEQ ID NO: 3279247 - RNA, 16 nt, Mycobacterium tuberculosis H37Rv
gagcggccucgggacu

SEQ ID NO: 3279248 - RNA, 14 nt, Mycobacterium tuberculosis H37Rv
gagcggcgcggggg

SEQ ID NO: 3279249 - RNA, 16 nt, Mycobacterium tuberculosis H37Rv
gagcggcgcgggggug

SEQ ID NO: 3279250 - RNA, 14 nt, Mycobacterium tuberculosis H37Rv
gagcggcggcacug

SEQ ID NO: 3279251 - RNA, 15 nt, Mycobacterium tuberculosis H37Rv
gagcggcggcacugg

SEQ ID NO: 3279252 - RNA, 22 nt, Mycobacterium tuberculosis H37Rv
gagcggcuugguguauucgcgg

SEQ ID NO: 3279253 - RNA, 19 nt, Mycobacterium tuberculosis H37Rv
gagcgggaucgggcccucc

SEQ ID NO: 3279254 - RNA, 21 nt, Mycobacterium tuberculosis H37Rv
gagcgggauucuggcgcagcu

SEQ ID NO: 3279255 - RNA, 20 nt, Mycobacterium tuberculosis H37Rv
gagcgggcaagucgcccagc

SEQ ID NO: 3279256 - RNA, 16 nt, Mycobacterium tuberculosis H37Rv
gagcgggccagcaccc

SEQ ID NO: 3279257 - RNA, 22 nt, Mycobacterium tuberculosis H37Rv
gagcgggcgggccugcgcgauc

SEQ ID NO: 3279258 - RNA, 17 nt, Mycobacterium tuberculosis H37Rv
gagcgguaccccccagc

SEQ ID NO: 3279259 - RNA, 16 nt, Mycobacterium tuberculosis H37Rv
gagcgguacggacagc

SEQ ID NO: 3279260 - RNA, 22 nt, Mycobacterium tuberculosis H37Rv
gagcgguaggcguugaucgccg

SEQ ID NO: 3279261 - RNA, 23 nt, Mycobacterium tuberculosis H37Rv
gagcggucagcgucgaucgugcg

SEQ ID NO: 3279262 - RNA, 12 nt, Mycobacterium tuberculosis H37Rv
gagcggugccga

SEQ ID NO: 3279263 - RNA, 22 nt, Mycobacterium tuberculosis H37Rv
gagcgguugaucgcguagcugg

SEQ ID NO: 3279264 - RNA, 19 nt, Mycobacterium tuberculosis H37Rv
gagcgguugccauccguca

SEQ ID NO: 3279265 - RNA, 15 nt, Mycobacterium tuberculosis H37Rv
gagcgguugccuucu

SEQ ID NO: 3279266 - RNA, 17 nt, Mycobacterium tuberculosis H37Rv
gagcguaacgguaaccg

SEQ ID NO: 3279267 - RNA, 18 nt, Mycobacterium tuberculosis H37Rv
gagcguaguaggcagccu

SEQ ID NO: 3279268 - RNA, 20 nt, Mycobacterium tuberculosis H37Rv
gagcgugaaccuggcgacgc

SEQ ID NO: 3279269 - RNA, 19 nt, Mycobacterium tuberculosis H37Rv
gagcgugaagucacggcgg

SEQ ID NO: 3279270 - RNA, 17 nt, Mycobacterium tuberculosis H37Rv
gagcgugcccgucucgu

SEQ ID NO: 3279271 - RNA, 12 nt, Mycobacterium tuberculosis H37Rv
gagcgugccgca

SEQ ID NO: 3279272 - RNA, 15 nt, Mycobacterium tuberculosis H37Rv
gagcgugccgcagcg

SEQ ID NO: 3279273 - RNA, 23 nt, Mycobacterium tuberculosis H37Rv
gagcguggccaauccggcggcga

SEQ ID NO: 3279274 - RNA, 23 nt, Mycobacterium tuberculosis H37Rv
gagcgugucgagcgccgcaguga

SEQ ID NO: 3279275 - RNA, 19 nt, Mycobacterium tuberculosis H37Rv
gagcguucuucagccaggg

SEQ ID NO: 3279276 - RNA, 15 nt, Mycobacterium tuberculosis H37Rv
gagcguuggcuucuu

SEQ ID NO: 3279277 - RNA, 20 nt, Mycobacterium tuberculosis H37Rv
gagcguuuuggugcggaccu

SEQ ID NO: 3279278 - RNA, 16 nt, Mycobacterium tuberculosis H37Rv
gagcuacucacgguga

SEQ ID NO: 3279279 - RNA, 20 nt, Mycobacterium tuberculosis H37Rv
gagcuagacccgucaccgcc

SEQ ID NO: 3279280 - RNA, 14 nt, Mycobacterium tuberculosis H37Rv
gagcuagccguucg

SEQ ID NO: 3279281 - RNA, 23 nt, Mycobacterium tuberculosis H37Rv
gagcuagccguucggcugccgcg

SEQ ID NO: 3279282 - RNA, 14 nt, Mycobacterium tuberculosis H37Rv
gagcuaugcuggca

SEQ ID NO: 3279283 - RNA, 17 nt, Mycobacterium tuberculosis H37Rv
gagcucaccgcacaccu

SEQ ID NO: 3279284 - RNA, 14 nt, Mycobacterium tuberculosis H37Rv
gagcuccgcggcga

SEQ ID NO: 3279285 - RNA, 14 nt, Mycobacterium tuberculosis H37Rv
gagcuccgucgcgg

SEQ ID NO: 3279286 - RNA, 16 nt, Mycobacterium tuberculosis H37Rv
gagcuccgucgcggcc

SEQ ID NO: 3279287 - RNA, 15 nt, Mycobacterium tuberculosis H37Rv
gagcucgaagcccgg

SEQ ID NO: 3279288 - RNA, 22 nt, Mycobacterium tuberculosis H37Rv
gagcucgaaguuggcuuucggu

SEQ ID NO: 3279289 - RNA, 19 nt, Mycobacterium tuberculosis H37Rv
gagcucgaugucagcggcc

SEQ ID NO: 3279290 - RNA, 17 nt, Mycobacterium tuberculosis H37Rv
gagcucggcgcccagcu

SEQ ID NO: 3279291 - RNA, 14 nt, Mycobacterium tuberculosis H37Rv
gagcucggcugcuc

SEQ ID NO: 3279292 - RNA, 17 nt, Mycobacterium tuberculosis H37Rv
gagcucggcugcucgac

SEQ ID NO: 3279293 - RNA, 16 nt, Mycobacterium tuberculosis H37Rv
gagcucggucaccacg

SEQ ID NO: 3279294 - RNA, 20 nt, Mycobacterium tuberculosis H37Rv
gagcucggucaccacggcgg

SEQ ID NO: 3279295 - RNA, 22 nt, Mycobacterium tuberculosis H37Rv
gagcucguugcuggcggccagc

SEQ ID NO: 3279296 - RNA, 17 nt, Mycobacterium tuberculosis H37Rv
gagcucuugcgggcagc

SEQ ID NO: 3279297 - RNA, 16 nt, Mycobacterium tuberculosis H37Rv
gagcugaccugguucc

SEQ ID NO: 3279298 - RNA, 17 nt, Mycobacterium tuberculosis H37Rv
gagcugacgauggccag

SEQ ID NO: 3279299 - RNA, 20 nt, Mycobacterium tuberculosis H37Rv
gagcugacgauggccaggcc

SEQ ID NO: 3279300 - RNA, 14 nt, Mycobacterium tuberculosis H37Rv
gagcugauccaagu

SEQ ID NO: 3279301 - RNA, 15 nt, Mycobacterium tuberculosis H37Rv
gagcugauccgggug

SEQ ID NO: 3279302 - RNA, 15 nt, Mycobacterium tuberculosis H37Rv
gagcugcacgccgau

SEQ ID NO: 3279303 - RNA, 17 nt, Mycobacterium tuberculosis H37Rv
gagcugcgccagaaucc

SEQ ID NO: 3279304 - RNA, 13 nt, Mycobacterium tuberculosis H37Rv
gagcugcggcggc

SEQ ID NO: 3279305 - RNA, 11 nt, Mycobacterium tuberculosis H37Rv
gagcugcucgc

SEQ ID NO: 3279306 - RNA, 13 nt, Mycobacterium tuberculosis H37Rv
gagcugcucgccg

SEQ ID NO: 3279307 - RNA, 14 nt, Mycobacterium tuberculosis H37Rv
gagcugcucgccgg

SEQ ID NO: 3279308 - RNA, 16 nt, Mycobacterium tuberculosis H37Rv
gagcugcuggcgcgcc

SEQ ID NO: 3279309 - RNA, 13 nt, Mycobacterium tuberculosis H37Rv
gagcuggaaucga

SEQ ID NO: 3279310 - RNA, 11 nt, Mycobacterium tuberculosis H37Rv
gagcuggcgac

SEQ ID NO: 3279311 - RNA, 15 nt, Mycobacterium tuberculosis H37Rv
gagcuggcgaccugg

SEQ ID NO: 3279312 - RNA, 13 nt, Mycobacterium tuberculosis H37Rv
gagcuggugcaga

SEQ ID NO: 3279313 - RNA, 23 nt, Mycobacterium tuberculosis H37Rv
gagcuggugcagaauucggcgcg

SEQ ID NO: 3279314 - RNA, 17 nt, Mycobacterium tuberculosis H37Rv
gagcugguugacggcga

SEQ ID NO: 3279315 - RNA, 15 nt, Mycobacterium tuberculosis H37Rv
gagcuguaggucagc

SEQ ID NO: 3279316 - RNA, 16 nt, Mycobacterium tuberculosis H37Rv
gagcuguaggucagcg

SEQ ID NO: 3279317 - RNA, 20 nt, Mycobacterium tuberculosis H37Rv
gagcugucgcaacgcaucga

SEQ ID NO: 3279318 - RNA, 23 nt, Mycobacterium tuberculosis H37Rv
gagcugucgcaacgcaucgaugc

SEQ ID NO: 3279319 - RNA, 14 nt, Mycobacterium tuberculosis H37Rv
gagcugugcgcaga

SEQ ID NO: 3279320 - RNA, 14 nt, Mycobacterium tuberculosis H37Rv
gagcuguggcgggc

SEQ ID NO: 3279321 - RNA, 15 nt, Mycobacterium tuberculosis H37Rv
gagcuguggcgggcu

SEQ ID NO: 3279322 - RNA, 17 nt, Mycobacterium tuberculosis H37Rv
gagcuucaucccggagc

SEQ ID NO: 3279323 - RNA, 17 nt, Mycobacterium tuberculosis H37Rv
gagcuuggccagcagca

SEQ ID NO: 3279324 - RNA, 15 nt, Mycobacterium tuberculosis H37Rv
gagcuuggcccagcg

SEQ ID NO: 3279325 - RNA, 22 nt, Mycobacterium tuberculosis H37Rv
gagcuugggccggugcagcacg

SEQ ID NO: 3279326 - RNA, 13 nt, Mycobacterium tuberculosis H37Rv
gagcuuggucgcc

SEQ ID NO: 3279327 - RNA, 15 nt, Mycobacterium tuberculosis H37Rv
gagcuuggucgccau

SEQ ID NO: 3279328 - RNA, 21 nt, Mycobacterium tuberculosis H37Rv
gaggaaccccggucgggguuu

SEQ ID NO: 3279329 - RNA, 19 nt, Mycobacterium tuberculosis H37Rv
gaggaacucggacccaccc

SEQ ID NO: 3279330 - RNA, 10 nt, Mycobacterium tuberculosis H37Rv
gaggaagccc

SEQ ID NO: 3279331 - RNA, 22 nt, Mycobacterium tuberculosis H37Rv
gaggaagccguuggcgacguug

SEQ ID NO: 3279332 - RNA, 19 nt, Mycobacterium tuberculosis H37Rv
gaggaaucguucggggugg

SEQ ID NO: 3279333 - RNA, 20 nt, Mycobacterium tuberculosis H37Rv
gaggaccaccuggucgcguc

SEQ ID NO: 3279334 - RNA, 23 nt, Mycobacterium tuberculosis H37Rv
gaggaccucgucaccggucagcg

SEQ ID NO: 3279335 - RNA, 19 nt, Mycobacterium tuberculosis H37Rv
gagguccuugaggauccgc

SEQ ID NO: 3279336 - RNA, 20 nt, Mycobacterium tuberculosis H37Rv
gagguccuugaugcgcccca

SEQ ID NO: 3279337 - RNA, 22 nt, Mycobacterium tuberculosis H37Rv
gaggucgaaccgccggcugcgc

SEQ ID NO: 3279338 - RNA, 22 nt, Mycobacterium tuberculosis H37Rv
gaggucgagcgccuuugcccga

SEQ ID NO: 3279339 - RNA, 14 nt, Mycobacterium tuberculosis H37Rv
gaggucgaucaggg

SEQ ID NO: 3279340 - RNA, 22 nt, Mycobacterium tuberculosis H37Rv
gaggucgaucaggggcccaccc

SEQ ID NO: 3279341 - RNA, 19 nt, Mycobacterium tuberculosis H37Rv
gaggucgcggucuuugagc

SEQ ID NO: 3279342 - RNA, 16 nt, Mycobacterium tuberculosis H37Rv
gaggucggccagcagc

SEQ ID NO: 3279343 - RNA, 14 nt, Mycobacterium tuberculosis H37Rv
gaggucggcggcgc

SEQ ID NO: 3279344 - RNA, 15 nt, Mycobacterium tuberculosis H37Rv
gaggucgggcggcga

SEQ ID NO: 3279345 - RNA, 21 nt, Mycobacterium tuberculosis H37Rv
gaggucugguagagguugucg

SEQ ID NO: 3279346 - RNA, 20 nt, Mycobacterium tuberculosis H37Rv
gaggucuuugcucucggucu

SEQ ID NO: 3279347 - RNA, 15 nt, Mycobacterium tuberculosis H37Rv
gaggugagcugcggg

SEQ ID NO: 3279348 - RNA, 19 nt, Mycobacterium tuberculosis H37Rv
gaggugccgcgcagcugcc

SEQ ID NO: 3279349 - RNA, 21 nt, Mycobacterium tuberculosis H37Rv
gaggugcucggaucggcucgc

SEQ ID NO: 3279350 - RNA, 19 nt, Mycobacterium tuberculosis H37Rv
gagguggccgcgcaggggc

SEQ ID NO: 3279351 - RNA, 12 nt, Mycobacterium tuberculosis H37Rv
gagguggcgggc

SEQ ID NO: 3279352 - RNA, 14 nt, Mycobacterium tuberculosis H37Rv
gagguggggcagga

SEQ ID NO: 3279353 - RNA, 16 nt, Mycobacterium tuberculosis H37Rv
gagguggggcaggauc

SEQ ID NO: 3279354 - RNA, 15 nt, Mycobacterium tuberculosis H37Rv
gaggugggguggugg

SEQ ID NO: 3279355 - RNA, 16 nt, Mycobacterium tuberculosis H37Rv
gagguggggugguggu

SEQ ID NO: 3279356 - RNA, 20 nt, Mycobacterium tuberculosis H37Rv
gaggugguucacggggacca

SEQ ID NO: 3279357 - RNA, 22 nt, Mycobacterium tuberculosis H37Rv
gaggugguucacggggaccaga

SEQ ID NO: 3279358 - RNA, 15 nt, Mycobacterium tuberculosis H37Rv
gagguguagcccucc

SEQ ID NO: 3279359 - RNA, 14 nt, Mycobacterium tuberculosis H37Rv
gagguucugccgcg

SEQ ID NO: 3279360 - RNA, 16 nt, Mycobacterium tuberculosis H37Rv
gagguuggagcgccag

SEQ ID NO: 3279361 - RNA, 13 nt, Mycobacterium tuberculosis H37Rv
gagguuggcggcc

SEQ ID NO: 3279362 - RNA, 15 nt, Mycobacterium tuberculosis H37Rv
gagguugggaacagc

SEQ ID NO: 3279363 - RNA, 17 nt, Mycobacterium tuberculosis H37Rv
gaguaacacguggguga

SEQ ID NO: 3279364 - RNA, 19 nt, Mycobacterium tuberculosis H37Rv
gaguaagcgaacagcggca

SEQ ID NO: 3279365 - RNA, 14 nt, Mycobacterium tuberculosis H37Rv
gaguaaucgaccga

SEQ ID NO: 3279366 - RNA, 18 nt, Mycobacterium tuberculosis H37Rv
gaguacaacagcgucugg

SEQ ID NO: 3279367 - RNA, 13 nt, Mycobacterium tuberculosis H37Rv
gaguacaggcgca

SEQ ID NO: 3279368 - RNA, 18 nt, Mycobacterium tuberculosis H37Rv
gaguaccggccagccgcg

SEQ ID NO: 3279369 - RNA, 16 nt, Mycobacterium tuberculosis H37Rv
gaguacggcgaugcgg

SEQ ID NO: 3279370 - RNA, 16 nt, Mycobacterium tuberculosis H37Rv
gaguagaagauggcac

SEQ ID NO: 3279371 - RNA, 17 nt, Mycobacterium tuberculosis H37Rv
gaguagaagauggcacc

SEQ ID NO: 3279372 - RNA, 12 nt, Mycobacterium tuberculosis H37Rv
gaguagcccgcg

SEQ ID NO: 3279373 - RNA, 19 nt, Mycobacterium tuberculosis H37Rv
gaguauuuuucgaccagcc

SEQ ID NO: 3279374 - RNA, 18 nt, Mycobacterium tuberculosis H37Rv
gagucagaguugccgggu

SEQ ID NO: 3279375 - RNA, 18 nt, Mycobacterium tuberculosis H37Rv
gagucaucuggcgcgcca

SEQ ID NO: 3279376 - RNA, 17 nt, Mycobacterium tuberculosis H37Rv
gaguccagccggcgcgc

SEQ ID NO: 3279377 - RNA, 14 nt, Mycobacterium tuberculosis H37Rv
gaguccaggccggc

SEQ ID NO: 3279378 - RNA, 21 nt, Mycobacterium tuberculosis H37Rv
gaguccccaggugggcagcag

SEQ ID NO: 3279379 - RNA, 19 nt, Mycobacterium tuberculosis H37Rv
gaguccgcugagcgggcaa

SEQ ID NO: 3279380 - RNA, 19 nt, Mycobacterium tuberculosis H37Rv
gaguccgcugcuucuccga

SEQ ID NO: 3279381 - RNA, 23 nt, Mycobacterium tuberculosis H37Rv
gaguccggcucauccgacgggau

SEQ ID NO: 3279382 - RNA, 21 nt, Mycobacterium tuberculosis H37Rv
gaguccgguagcugugguggu

SEQ ID NO: 3279383 - RNA, 22 nt, Mycobacterium tuberculosis H37Rv
gaguccgucggggacauccgcu

SEQ ID NO: 3279384 - RNA, 17 nt, Mycobacterium tuberculosis H37Rv
gagucgaacaucaccgg

SEQ ID NO: 3279385 - RNA, 13 nt, Mycobacterium tuberculosis H37Rv
gagucgacaagcc

SEQ ID NO: 3279386 - RNA, 21 nt, Mycobacterium tuberculosis H37Rv
gagucgacaagccgucggcga

SEQ ID NO: 3279387 - RNA, 12 nt, Mycobacterium tuberculosis H37Rv
gagucgagcaca

SEQ ID NO: 3279388 - RNA, 24 nt, Mycobacterium tuberculosis H37Rv
gagucgaugaccccgguggucugg

SEQ ID NO: 3279389 - RNA, 22 nt, Mycobacterium tuberculosis H37Rv
gagucgauugccaccgagauca

SEQ ID NO: 3279390 - RNA, 14 nt, Mycobacterium tuberculosis H37Rv
gagucgcacguggg

SEQ ID NO: 3279391 - RNA, 15 nt, Mycobacterium tuberculosis H37Rv
gagucgcacgugggc

SEQ ID NO: 3279392 - RNA, 14 nt, Mycobacterium tuberculosis H37Rv
gagucgcacugcgc

SEQ ID NO: 3279393 - RNA, 13 nt, Mycobacterium tuberculosis H37Rv
gagucgcagcacg

SEQ ID NO: 3279394 - RNA, 17 nt, Mycobacterium tuberculosis H37Rv
gagucggcugguccucc

SEQ ID NO: 3279395 - RNA, 16 nt, Mycobacterium tuberculosis H37Rv
gagucggggggccgga

SEQ ID NO: 3279396 - RNA, 18 nt, Mycobacterium tuberculosis H37Rv
gagucggggggccggacu

SEQ ID NO: 3279397 - RNA, 19 nt, Mycobacterium tuberculosis H37Rv
gagucggugaaaugacggc

SEQ ID NO: 3279398 - RNA, 19 nt, Mycobacterium tuberculosis H37Rv
gagucguuggacggcaccg

SEQ ID NO: 3279399 - RNA, 22 nt, Mycobacterium tuberculosis H37Rv
gagucucgucggguaccacgcu

SEQ ID NO: 3279400 - RNA, 22 nt, Mycobacterium tuberculosis H37Rv
gagucugcgcagaaauguauug

SEQ ID NO: 3279401 - RNA, 21 nt, Mycobacterium tuberculosis H37Rv
gagucuucggcgacaggccga

SEQ ID NO: 3279402 - RNA, 15 nt, Mycobacterium tuberculosis H37Rv
gagugaacucguccu

SEQ ID NO: 3279403 - RNA, 19 nt, Mycobacterium tuberculosis H37Rv
gagugaccacgcugcuggu

SEQ ID NO: 3279404 - RNA, 21 nt, Mycobacterium tuberculosis H37Rv
gagugaccacgcugcugguga

SEQ ID NO: 3279405 - RNA, 19 nt, Mycobacterium tuberculosis H37Rv
gagugcacgcuugaaagcg

SEQ ID NO: 3279406 - RNA, 13 nt, Mycobacterium tuberculosis H37Rv
gagugccaguccg

SEQ ID NO: 3279407 - RNA, 16 nt, Mycobacterium tuberculosis H37Rv
gagugccggcgugcgc

SEQ ID NO: 3279408 - RNA, 16 nt, Mycobacterium tuberculosis H37Rv
gagugcgaaccacgcc

SEQ ID NO: 3279409 - RNA, 16 nt, Mycobacterium tuberculosis H37Rv
gagugcggacuucgcc

SEQ ID NO: 3279410 - RNA, 22 nt, Mycobacterium tuberculosis H37Rv
gagugcggacuucgccgcccgc

SEQ ID NO: 3279411 - RNA, 17 nt, Mycobacterium tuberculosis H37Rv
gagugcggcacgaucgc

SEQ ID NO: 3279412 - RNA, 22 nt, Mycobacterium tuberculosis H37Rv
gagugcgucucgguggcugcgc

SEQ ID NO: 3279413 - RNA, 21 nt, Mycobacterium tuberculosis H37Rv
gaguggacgugucaucacggu

SEQ ID NO: 3279414 - RNA, 13 nt, Mycobacterium tuberculosis H37Rv
gaguggaugcgcc

SEQ ID NO: 3279415 - RNA, 16 nt, Mycobacterium tuberculosis H37Rv
gaguggaugcgccgca

SEQ ID NO: 3279416 - RNA, 14 nt, Mycobacterium tuberculosis H37Rv
gaguggccucgucc

SEQ ID NO: 3279417 - RNA, 22 nt, Mycobacterium tuberculosis H37Rv
gagugguacggcucggcgcuga

SEQ ID NO: 3279418 - RNA, 21 nt, Mycobacterium tuberculosis H37Rv
gaguggucccguucgcccgcc

SEQ ID NO: 3279419 - RNA, 15 nt, Mycobacterium tuberculosis H37Rv
gagugucagcgccac

SEQ ID NO: 3279420 - RNA, 22 nt, Mycobacterium tuberculosis H37Rv
gagugugaaucgcacgacgcga

SEQ ID NO: 3279421 - RNA, 16 nt, Mycobacterium tuberculosis H37Rv
gagugugacggcggcc

SEQ ID NO: 3279422 - RNA, 11 nt, Mycobacterium tuberculosis H37Rv
gaguucccgaa

SEQ ID NO: 3279423 - RNA, 12 nt, Mycobacterium tuberculosis H37Rv
gaguuccggucg

SEQ ID NO: 3279424 - RNA, 19 nt, Mycobacterium tuberculosis H37Rv
gaguucgaccggcgggacg

SEQ ID NO: 3279425 - RNA, 22 nt, Mycobacterium tuberculosis H37Rv
gaguucgaccggcgggacgucg

SEQ ID NO: 3279426 - RNA, 16 nt, Mycobacterium tuberculosis H37Rv
gaguucgcaaugccug

SEQ ID NO: 3279427 - RNA, 16 nt, Mycobacterium tuberculosis H37Rv
gaguucgcgcagcacc

SEQ ID NO: 3279428 - RNA, 22 nt, Mycobacterium tuberculosis H37Rv
gaguucggcccgcaaacagucg

SEQ ID NO: 3279429 - RNA, 14 nt, Mycobacterium tuberculosis H37Rv
gaguucggccgcgg

SEQ ID NO: 3279430 - RNA, 17 nt, Mycobacterium tuberculosis H37Rv
gaguucgggcugcggca

SEQ ID NO: 3279431 - RNA, 18 nt, Mycobacterium tuberculosis H37Rv
gaucacacuggccugcuc

SEQ ID NO: 3279432 - RNA, 20 nt, Mycobacterium tuberculosis H37Rv
gaucacauaggucacaaacg

SEQ ID NO: 3279433 - RNA, 17 nt, Mycobacterium tuberculosis H37Rv
gaucaccaccggcagau

SEQ ID NO: 3279434 - RNA, 15 nt, Mycobacterium tuberculosis H37Rv
gaucaccaugaucag

SEQ ID NO: 3279435 - RNA, 14 nt, Mycobacterium tuberculosis H37Rv
gaucacccacucga

SEQ ID NO: 3279436 - RNA, 17 nt, Mycobacterium tuberculosis H37Rv
gaucacccacucgacgu

SEQ ID NO: 3279437 - RNA, 22 nt, Mycobacterium tuberculosis H37Rv
gaucacccacucgacgucgucg

SEQ ID NO: 3279438 - RNA, 14 nt, Mycobacterium tuberculosis H37Rv
gaucacccgcagcc

SEQ ID NO: 3279439 - RNA, 20 nt, Mycobacterium tuberculosis H37Rv
gaucacccgcaucggcacgc

SEQ ID NO: 3279440 - RNA, 20 nt, Mycobacterium tuberculosis H37Rv
gaucaccgagucgacggcca

SEQ ID NO: 3279441 - RNA, 22 nt, Mycobacterium tuberculosis H37Rv
gaucaccgagucgacggccagu

SEQ ID NO: 3279442 - RNA, 15 nt, Mycobacterium tuberculosis H37Rv
gaucaccgccaccac

SEQ ID NO: 3279443 - RNA, 20 nt, Mycobacterium tuberculosis H37Rv
gaucaccgccaccaccaggg

SEQ ID NO: 3279444 - RNA, 15 nt, Mycobacterium tuberculosis H37Rv
gaucaccgcgccgga

SEQ ID NO: 3279445 - RNA, 16 nt, Mycobacterium tuberculosis H37Rv
gaucaccgcggcgguc

SEQ ID NO: 3279446 - RNA, 13 nt, Mycobacterium tuberculosis H37Rv
gaucaccgucgua

SEQ ID NO: 3279447 - RNA, 23 nt, Mycobacterium tuberculosis H37Rv
gaucaccguugcguuggcgccac

SEQ ID NO: 3279448 - RNA, 18 nt, Mycobacterium tuberculosis H37Rv
gaucaccucccgcggcac

SEQ ID NO: 3279449 - RNA, 20 nt, Mycobacterium tuberculosis H37Rv
gaucaccuuggcaagcacgc

SEQ ID NO: 3279450 - RNA, 23 nt, Mycobacterium tuberculosis H37Rv
gaucaccuuggcaagcacgcgac

SEQ ID NO: 3279451 - RNA, 12 nt, Mycobacterium tuberculosis H37Rv
gaucacgccgac

SEQ ID NO: 3279452 - RNA, 16 nt, Mycobacterium tuberculosis H37Rv
gaucacggccgucgau

SEQ ID NO: 3279453 - RNA, 13 nt, Mycobacterium tuberculosis H37Rv
gaucacggcggcc

SEQ ID NO: 3279454 - RNA, 16 nt, Mycobacterium tuberculosis H37Rv
gaucacgucggcguug

SEQ ID NO: 3279455 - RNA, 16 nt, Mycobacterium tuberculosis H37Rv
gaucagaacgcggccu

SEQ ID NO: 3279456 - RNA, 17 nt, Mycobacterium tuberculosis H37Rv
gaucagaacgcggccuc

SEQ ID NO: 3279457 - RNA, 19 nt, Mycobacterium tuberculosis H37Rv
gaucagcaacucggccacg

SEQ ID NO: 3279458 - RNA, 17 nt, Mycobacterium tuberculosis H37Rv
gaucagcaccgacagcc

SEQ ID NO: 3279459 - RNA, 13 nt, Mycobacterium tuberculosis H37Rv
gaucagcagcaga

SEQ ID NO: 3279460 - RNA, 17 nt, Mycobacterium tuberculosis H37Rv
gaucagcagcgccagca

SEQ ID NO: 3279461 - RNA, 17 nt, Mycobacterium tuberculosis H37Rv
gaucagcaggaucggca

SEQ ID NO: 3279462 - RNA, 20 nt, Mycobacterium tuberculosis H37Rv
gaucagcaggaucggcagca

SEQ ID NO: 3279463 - RNA, 22 nt, Mycobacterium tuberculosis H37Rv
gaucagcaggaucggcagcaga

SEQ ID NO: 3279464 - RNA, 15 nt, Mycobacterium tuberculosis H37Rv
gaucagcccgcgcag

SEQ ID NO: 3279465 - RNA, 20 nt, Mycobacterium tuberculosis H37Rv
gaucagccgggugcgcaccc

SEQ ID NO: 3279466 - RNA, 22 nt, Mycobacterium tuberculosis H37Rv
gaucagcgaggaauuccgcuac

SEQ ID NO: 3279467 - RNA, 18 nt, Mycobacterium tuberculosis H37Rv
gaucagcgaguagccgcu

SEQ ID NO: 3279468 - RNA, 15 nt, Mycobacterium tuberculosis H37Rv
gaucagcgccggauc

SEQ ID NO: 3279469 - RNA, 16 nt, Mycobacterium tuberculosis H37Rv
gaucagcgcggcgccc

SEQ ID NO: 3279470 - RNA, 19 nt, Mycobacterium tuberculosis H37Rv
gaucagcgugaucugcagg

SEQ ID NO: 3279471 - RNA, 20 nt, Mycobacterium tuberculosis H37Rv
gaucagcgugaucugcaggg

SEQ ID NO: 3279472 - RNA, 19 nt, Mycobacterium tuberculosis H37Rv
gaucagcguggcgcccgug

SEQ ID NO: 3279473 - RNA, 17 nt, Mycobacterium tuberculosis H37Rv
gaucagcgugucgccga

SEQ ID NO: 3279474 - RNA, 13 nt, Mycobacterium tuberculosis H37Rv
gaucagcucgcgc

SEQ ID NO: 3279475 - RNA, 21 nt, Mycobacterium tuberculosis H37Rv
gaucaggccgacgucgaccac

SEQ ID NO: 3279476 - RNA, 17 nt, Mycobacterium tuberculosis H37Rv
gaucaggccgaugacga

SEQ ID NO: 3279477 - RNA, 24 nt, Mycobacterium tuberculosis H37Rv
gaucaggcgcucgaaggccgcacu

SEQ ID NO: 3279478 - RNA, 14 nt, Mycobacterium tuberculosis H37Rv
gaucaggcgggcaa

SEQ ID NO: 3279479 - RNA, 21 nt, Mycobacterium tuberculosis H37Rv
gaucaggcgggcaacgcagca

SEQ ID NO: 3279480 - RNA, 23 nt, Mycobacterium tuberculosis H37Rv
gaucaggcgggcaacgcagcacg

SEQ ID NO: 3279481 - RNA, 22 nt, Mycobacterium tuberculosis H37Rv
gaucagggugucgaagagcagg

SEQ ID NO: 3279482 - RNA, 16 nt, Mycobacterium tuberculosis H37Rv
gaucaggucgccgaga

SEQ ID NO: 3279483 - RNA, 16 nt, Mycobacterium tuberculosis H37Rv
gaucaguucgugacgu

SEQ ID NO: 3279484 - RNA, 18 nt, Mycobacterium tuberculosis H37Rv
gaucaguucguggcuggc

SEQ ID NO: 3279485 - RNA, 15 nt, Mycobacterium tuberculosis H37Rv
gaucaucaccggcau

SEQ ID NO: 3279486 - RNA, 17 nt, Mycobacterium tuberculosis H37Rv
gaucaucauauccgccc

SEQ ID NO: 3279487 - RNA, 21 nt, Mycobacterium tuberculosis H37Rv
gaucaucauauccgccccagc

SEQ ID NO: 3279488 - RNA, 17 nt, Mycobacterium tuberculosis H37Rv
gaucaucgggagccgca

SEQ ID NO: 3279489 - RNA, 15 nt, Mycobacterium tuberculosis H37Rv
gaucaucuggcuggu

SEQ ID NO: 3279490 - RNA, 17 nt, Mycobacterium tuberculosis H37Rv
gaucaucuggcugguga

SEQ ID NO: 3279491 - RNA, 15 nt, Mycobacterium tuberculosis H37Rv
gaucaugccggcgaa

SEQ ID NO: 3279492 - RNA, 16 nt, Mycobacterium tuberculosis H37Rv
gaucauggcggcagca

SEQ ID NO: 3279493 - RNA, 21 nt, Mycobacterium tuberculosis H37Rv
gaucauguccaucgcgcggcu

SEQ ID NO: 3279494 - RNA, 15 nt, Mycobacterium tuberculosis H37Rv
gaucauucugcggcc

SEQ ID NO: 3279495 - RNA, 19 nt, Mycobacterium tuberculosis H37Rv
gaucauugcacccaccccg

SEQ ID NO: 3279496 - RNA, 21 nt, Mycobacterium tuberculosis H37Rv
gauccaccaagcucgcaaccg

SEQ ID NO: 3279497 - RNA, 23 nt, Mycobacterium tuberculosis H37Rv
gauccaccacgcuggccucgucg

SEQ ID NO: 3279498 - RNA, 15 nt, Mycobacterium tuberculosis H37Rv
gauccacgccagagc

SEQ ID NO: 3279499 - RNA, 22 nt, Mycobacterium tuberculosis H37Rv
gauccacggcgaugcagccaca

SEQ ID NO: 3279500 - RNA, 18 nt, Mycobacterium tuberculosis H37Rv
gauccagaacaacggcgc

SEQ ID NO: 3279501 - RNA, 21 nt, Mycobacterium tuberculosis H37Rv
gauccagcaacgcgguggacc

SEQ ID NO: 3279502 - RNA, 21 nt, Mycobacterium tuberculosis H37Rv
gauccagcaggccgucgauca

SEQ ID NO: 3279503 - RNA, 20 nt, Mycobacterium tuberculosis H37Rv
gauccagcccaugcgccacg

SEQ ID NO: 3279504 - RNA, 15 nt, Mycobacterium tuberculosis H37Rv
gauccagccgcgucg

SEQ ID NO: 3279505 - RNA, 14 nt, Mycobacterium tuberculosis H37Rv
gauccagcgcaccg

SEQ ID NO: 3279506 - RNA, 20 nt, Mycobacterium tuberculosis H37Rv
gauccaggacuucugcugca

SEQ ID NO: 3279507 - RNA, 15 nt, Mycobacterium tuberculosis H37Rv
gauccaggcccagcc

SEQ ID NO: 3279508 - RNA, 21 nt, Mycobacterium tuberculosis H37Rv
gauccaggccucgcaccggau

SEQ ID NO: 3279509 - RNA, 18 nt, Mycobacterium tuberculosis H37Rv
gauccaggcgucggugac

SEQ ID NO: 3279510 - RNA, 16 nt, Mycobacterium tuberculosis H37Rv
gauccagggagcggcu

SEQ ID NO: 3279511 - RNA, 19 nt, Mycobacterium tuberculosis H37Rv
gauccagggccgacgcgaa

SEQ ID NO: 3279512 - RNA, 23 nt, Mycobacterium tuberculosis H37Rv
gauccagggccuucgggccagga

SEQ ID NO: 3279513 - RNA, 17 nt, Mycobacterium tuberculosis H37Rv
gauccagggucaccucg

SEQ ID NO: 3279514 - RNA, 16 nt, Mycobacterium tuberculosis H37Rv
gaucccaagcgucgca

SEQ ID NO: 3279515 - RNA, 14 nt, Mycobacterium tuberculosis H37Rv
gaucccacccucgg

SEQ ID NO: 3279516 - RNA, 18 nt, Mycobacterium tuberculosis H37Rv
gaucccagcgcagcggac

SEQ ID NO: 3279517 - RNA, 13 nt, Mycobacterium tuberculosis H37Rv
gauccccacgaua

SEQ ID NO: 3279518 - RNA, 13 nt, Mycobacterium tuberculosis H37Rv
gauccccagcucc

SEQ ID NO: 3279519 - RNA, 20 nt, Mycobacterium tuberculosis H37Rv
gauccccguugacccagacc

SEQ ID NO: 3279520 - RNA, 16 nt, Mycobacterium tuberculosis H37Rv
gaucccgaucgcgcug

SEQ ID NO: 3279521 - RNA, 14 nt, Mycobacterium tuberculosis H37Rv
gaucccgaugguca

SEQ ID NO: 3279522 - RNA, 19 nt, Mycobacterium tuberculosis H37Rv
gaucccgccaccgaacagu

SEQ ID NO: 3279523 - RNA, 13 nt, Mycobacterium tuberculosis H37Rv
gaucccgcccaag

SEQ ID NO: 3279524 - RNA, 16 nt, Mycobacterium tuberculosis H37Rv
gaucccggccagcucc

SEQ ID NO: 3279525 - RNA, 15 nt, Mycobacterium tuberculosis H37Rv
gaucccggccaggcc

SEQ ID NO: 3279526 - RNA, 19 nt, Mycobacterium tuberculosis H37Rv
gaucccggccaggccgaca

SEQ ID NO: 3279527 - RNA, 16 nt, Mycobacterium tuberculosis H37Rv
gaucgcguccuccucg

SEQ ID NO: 3279528 - RNA, 17 nt, Mycobacterium tuberculosis H37Rv
gaucgcguccuccucgg

SEQ ID NO: 3279529 - RNA, 20 nt, Mycobacterium tuberculosis H37Rv
gaucgcguuagccaggucga

SEQ ID NO: 3279530 - RNA, 14 nt, Mycobacterium tuberculosis H37Rv
gaucgcuacgucga

SEQ ID NO: 3279531 - RNA, 20 nt, Mycobacterium tuberculosis H37Rv
gaucgcuccgcggcgcagca

SEQ ID NO: 3279532 - RNA, 21 nt, Mycobacterium tuberculosis H37Rv
gaucgcuccgcggcgcagcac

SEQ ID NO: 3279533 - RNA, 15 nt, Mycobacterium tuberculosis H37Rv
gaucgcugccagcgg

SEQ ID NO: 3279534 - RNA, 19 nt, Mycobacterium tuberculosis H37Rv
gaucgcuggccgcgaggua

SEQ ID NO: 3279535 - RNA, 17 nt, Mycobacterium tuberculosis H37Rv
gaucggaaagauccgcu

SEQ ID NO: 3279536 - RNA, 15 nt, Mycobacterium tuberculosis H37Rv
gaucggaacccgaau

SEQ ID NO: 3279537 - RNA, 16 nt, Mycobacterium tuberculosis H37Rv
gaucggaccaccaggg

SEQ ID NO: 3279538 - RNA, 17 nt, Mycobacterium tuberculosis H37Rv
gaucggacccgcgggau

SEQ ID NO: 3279539 - RNA, 13 nt, Mycobacterium tuberculosis H37Rv
gaucggaucggca

SEQ ID NO: 3279540 - RNA, 17 nt, Mycobacterium tuberculosis H37Rv
gaucggauggcggccac

SEQ ID NO: 3279541 - RNA, 19 nt, Mycobacterium tuberculosis H37Rv
gaucggauggugugucggg

SEQ ID NO: 3279542 - RNA, 20 nt, Mycobacterium tuberculosis H37Rv
gaucggauugccuccgggua

SEQ ID NO: 3279543 - RNA, 14 nt, Mycobacterium tuberculosis H37Rv
gaucggcaaaccgu

SEQ ID NO: 3279544 - RNA, 17 nt, Mycobacterium tuberculosis H37Rv
gaucggcaacggcggcg

SEQ ID NO: 3279545 - RNA, 13 nt, Mycobacterium tuberculosis H37Rv
gaucggcacccca

SEQ ID NO: 3279546 - RNA, 11 nt, Mycobacterium tuberculosis H37Rv
gaucggcacua

SEQ ID NO: 3279547 - RNA, 11 nt, Mycobacterium tuberculosis H37Rv
gaucggcacuu

SEQ ID NO: 3279548 - RNA, 15 nt, Mycobacterium tuberculosis H37Rv
gaucggcacuuagcc

SEQ ID NO: 3279549 - RNA, 24 nt, Mycobacterium tuberculosis H37Rv
gaucggcacuuagcccgauggugc

SEQ ID NO: 3279550 - RNA, 21 nt, Mycobacterium tuberculosis H37Rv
gaucggcaggguggccagcag

SEQ ID NO: 3279551 - RNA, 23 nt, Mycobacterium tuberculosis H37Rv
gaucggcaggguggccagcaggc

SEQ ID NO: 3279552 - RNA, 20 nt, Mycobacterium tuberculosis H37Rv
gaucggccacgucccagaga

SEQ ID NO: 3279553 - RNA, 20 nt, Mycobacterium tuberculosis H37Rv
gaucggccauucgggaugcg

SEQ ID NO: 3279554 - RNA, 14 nt, Mycobacterium tuberculosis H37Rv
gaucggccggcggu

SEQ ID NO: 3279555 - RNA, 15 nt, Mycobacterium tuberculosis H37Rv
gaucggcgccgcaua

SEQ ID NO: 3279556 - RNA, 15 nt, Mycobacterium tuberculosis H37Rv
gaucggcgcgccgau

SEQ ID NO: 3279557 - RNA, 16 nt, Mycobacterium tuberculosis H37Rv
gaucggcgcgccgauc

SEQ ID NO: 3279558 - RNA, 21 nt, Mycobacterium tuberculosis H37Rv
gaucggcgcggccguagugca

SEQ ID NO: 3279559 - RNA, 21 nt, Mycobacterium tuberculosis H37Rv
gaucggcggaccgcagcguga

SEQ ID NO: 3279560 - RNA, 18 nt, Mycobacterium tuberculosis H37Rv
gaucggcggccgcgacca

SEQ ID NO: 3279561 - RNA, 19 nt, Mycobacterium tuberculosis H37Rv
gaucggcggcgcgccgauc

SEQ ID NO: 3279562 - RNA, 20 nt, Mycobacterium tuberculosis H37Rv
gaucggcuugggaaacccgg

SEQ ID NO: 3279563 - RNA, 22 nt, Mycobacterium tuberculosis H37Rv
gaucgggccggccgccgcggga

SEQ ID NO: 3279564 - RNA, 22 nt, Mycobacterium tuberculosis H37Rv
gaucgggucguuggcggcgguc

SEQ ID NO: 3279565 - RNA, 16 nt, Mycobacterium tuberculosis H37Rv
gaucggguggcggguc

SEQ ID NO: 3279566 - RNA, 22 nt, Mycobacterium tuberculosis H37Rv
gaucgguaccgacggcaccaug

SEQ ID NO: 3279567 - RNA, 18 nt, Mycobacterium tuberculosis H37Rv
gaucggucggcaccaggu

SEQ ID NO: 3279568 - RNA, 14 nt, Mycobacterium tuberculosis H37Rv
gaucggucggcgug

SEQ ID NO: 3279569 - RNA, 21 nt, Mycobacterium tuberculosis H37Rv
gaucggugaugaacgacaucc

SEQ ID NO: 3279570 - RNA, 19 nt, Mycobacterium tuberculosis H37Rv
gaucggugccagaaugccg

SEQ ID NO: 3279571 - RNA, 17 nt, Mycobacterium tuberculosis H37Rv
gaucggugccagcacuc

SEQ ID NO: 3279572 - RNA, 23 nt, Mycobacterium tuberculosis H37Rv
gaucggugcgggcgccgcuaggu

SEQ ID NO: 3279573 - RNA, 15 nt, Mycobacterium tuberculosis H37Rv
gaucgguggcggcac

SEQ ID NO: 3279574 - RNA, 19 nt, Mycobacterium tuberculosis H37Rv
gaucguaggacucggcgga

SEQ ID NO: 3279575 - RNA, 19 nt, Mycobacterium tuberculosis H37Rv
gaucgucaagccgggcacg

SEQ ID NO: 3279576 - RNA, 23 nt, Mycobacterium tuberculosis H37Rv
gaucgucacaccaguagcaccag

SEQ ID NO: 3279577 - RNA, 14 nt, Mycobacterium tuberculosis H37Rv
gaucguccaaugca

SEQ ID NO: 3279578 - RNA, 16 nt, Mycobacterium tuberculosis H37Rv
gaucguccagcccaga

SEQ ID NO: 3279579 - RNA, 19 nt, Mycobacterium tuberculosis H37Rv
gaucgucgacccaccaugu

SEQ ID NO: 3279580 - RNA, 15 nt, Mycobacterium tuberculosis H37Rv
gaucgucgcgaccuu

SEQ ID NO: 3279581 - RNA, 14 nt, Mycobacterium tuberculosis H37Rv
gaucgucggcaacc

SEQ ID NO: 3279582 - RNA, 13 nt, Mycobacterium tuberculosis H37Rv
gaucgucucggcu

SEQ ID NO: 3279583 - RNA, 15 nt, Mycobacterium tuberculosis H37Rv
gaucgugagacgccg

SEQ ID NO: 3279584 - RNA, 15 nt, Mycobacterium tuberculosis H37Rv
gaucgugccggcgaa

SEQ ID NO: 3279585 - RNA, 15 nt, Mycobacterium tuberculosis H37Rv
gaucgugccgggacc

SEQ ID NO: 3279586 - RNA, 15 nt, Mycobacterium tuberculosis H37Rv
gaucgugcggaaccu

SEQ ID NO: 3279587 - RNA, 23 nt, Mycobacterium tuberculosis H37Rv
gaucgugcuggugguaucggcgu

SEQ ID NO: 3279588 - RNA, 17 nt, Mycobacterium tuberculosis H37Rv
gaucguggcgaccacga

SEQ ID NO: 3279589 - RNA, 12 nt, Mycobacterium tuberculosis H37Rv
gaucguguccac

SEQ ID NO: 3279590 - RNA, 23 nt, Mycobacterium tuberculosis H37Rv
gaucgugugaggccuucgccgac

SEQ ID NO: 3279591 - RNA, 23 nt, Mycobacterium tuberculosis H37Rv
gaucguuuccguagacgggguga

SEQ ID NO: 3279592 - RNA, 19 nt, Mycobacterium tuberculosis H37Rv
gaucucauccuccugcgcc

SEQ ID NO: 3279593 - RNA, 15 nt, Mycobacterium tuberculosis H37Rv
gaucucaucgggcca

SEQ ID NO: 3279594 - RNA, 19 nt, Mycobacterium tuberculosis H37Rv
gaucuccccguccugccag

SEQ ID NO: 3279595 - RNA, 16 nt, Mycobacterium tuberculosis H37Rv
gaucucgaccggcuug

SEQ ID NO: 3279596 - RNA, 22 nt, Mycobacterium tuberculosis H37Rv
gaucucgaccggcuugcccucc

SEQ ID NO: 3279597 - RNA, 21 nt, Mycobacterium tuberculosis H37Rv
gaucucgaccguauugaccag

SEQ ID NO: 3279598 - RNA, 17 nt, Mycobacterium tuberculosis H37Rv
gaucucgacggccucgu

SEQ ID NO: 3279599 - RNA, 19 nt, Mycobacterium tuberculosis H37Rv
gaucucgacggccucgucg

SEQ ID NO: 3279600 - RNA, 15 nt, Mycobacterium tuberculosis H37Rv
gaucucgagcaggcg

SEQ ID NO: 3279601 - RNA, 18 nt, Mycobacterium tuberculosis H37Rv
gaucucgaucgacccggu

SEQ ID NO: 3279602 - RNA, 16 nt, Mycobacterium tuberculosis H37Rv
gaucucgcccaccucc

SEQ ID NO: 3279603 - RNA, 16 nt, Mycobacterium tuberculosis H37Rv
gaucucgcgcucccac

SEQ ID NO: 3279604 - RNA, 19 nt, Mycobacterium tuberculosis H37Rv
gaucucggcgagcaccacc

SEQ ID NO: 3279605 - RNA, 17 nt, Mycobacterium tuberculosis H37Rv
gaucucggcggccgcgu

SEQ ID NO: 3279606 - RNA, 19 nt, Mycobacterium tuberculosis H37Rv
gaucucgucccacugcgcg

SEQ ID NO: 3279607 - RNA, 17 nt, Mycobacterium tuberculosis H37Rv
gaucucgucgcggucga

SEQ ID NO: 3279608 - RNA, 21 nt, Mycobacterium tuberculosis H37Rv
gaucucguggaucugccucuc

SEQ ID NO: 3279609 - RNA, 19 nt, Mycobacterium tuberculosis H37Rv
gaucucuccuggaaaggac

SEQ ID NO: 3279610 - RNA, 22 nt, Mycobacterium tuberculosis H37Rv
gaucucugcggcggucucguca

SEQ ID NO: 3279611 - RNA, 18 nt, Mycobacterium tuberculosis H37Rv
gaucugagggcucggugg

SEQ ID NO: 3279612 - RNA, 19 nt, Mycobacterium tuberculosis H37Rv
gaucugcagcacgcguggu

SEQ ID NO: 3279613 - RNA, 23 nt, Mycobacterium tuberculosis H37Rv
gaucugcagcgcggauucgguua

SEQ ID NO: 3279614 - RNA, 14 nt, Mycobacterium tuberculosis H37Rv
gaucugcccccgcc

SEQ ID NO: 3279615 - RNA, 16 nt, Mycobacterium tuberculosis H37Rv
gaucugcccccgccgg

SEQ ID NO: 3279616 - RNA, 24 nt, Mycobacterium tuberculosis H37Rv
gaucugccgccgcggccacaaccu

SEQ ID NO: 3279617 - RNA, 22 nt, Mycobacterium tuberculosis H37Rv
gaucugcgccaggggcaccaua

SEQ ID NO: 3279618 - RNA, 13 nt, Mycobacterium tuberculosis H37Rv
gaucugcgccauc

SEQ ID NO: 3279619 - RNA, 19 nt, Mycobacterium tuberculosis H37Rv
gaucugcguugcggcaaca

SEQ ID NO: 3279620 - RNA, 21 nt, Mycobacterium tuberculosis H37Rv
gaucugcguuugggucaucga

SEQ ID NO: 3279621 - RNA, 16 nt, Mycobacterium tuberculosis H37Rv
gaucugcucgccgagc

SEQ ID NO: 3279622 - RNA, 13 nt, Mycobacterium tuberculosis H37Rv
gaucugcuggccg

SEQ ID NO: 3279623 - RNA, 17 nt, Mycobacterium tuberculosis H37Rv
gaugccggucggcgucg

SEQ ID NO: 3279624 - RNA, 22 nt, Mycobacterium tuberculosis H37Rv
gaugccgguggggcccucguag

SEQ ID NO: 3279625 - RNA, 18 nt, Mycobacterium tuberculosis H37Rv
gaugccggugugcgccaa

SEQ ID NO: 3279626 - RNA, 15 nt, Mycobacterium tuberculosis H37Rv
gaugccguaggcggc

SEQ ID NO: 3279627 - RNA, 18 nt, Mycobacterium tuberculosis H37Rv
gaugccguaggcggccag

SEQ ID NO: 3279628 - RNA, 20 nt, Mycobacterium tuberculosis H37Rv
gaugccgucuuugucacgca

SEQ ID NO: 3279629 - RNA, 17 nt, Mycobacterium tuberculosis H37Rv
gaugccgugcccggugc

SEQ ID NO: 3279630 - RNA, 20 nt, Mycobacterium tuberculosis H37Rv
gaugccgugcugggccgacg

SEQ ID NO: 3279631 - RNA, 14 nt, Mycobacterium tuberculosis H37Rv
gaugccugccaccc

SEQ ID NO: 3279632 - RNA, 19 nt, Mycobacterium tuberculosis H37Rv
gaugccuucguagcggccg

SEQ ID NO: 3279633 - RNA, 20 nt, Mycobacterium tuberculosis H37Rv
gaugccuugaccgcggucuu

SEQ ID NO: 3279634 - RNA, 14 nt, Mycobacterium tuberculosis H37Rv
gaugcgacccgcag

SEQ ID NO: 3279635 - RNA, 13 nt, Mycobacterium tuberculosis H37Rv
gaugcgacgaacc

SEQ ID NO: 3279636 - RNA, 22 nt, Mycobacterium tuberculosis H37Rv
gaugcgacgaaccucggcggga

SEQ ID NO: 3279637 - RNA, 16 nt, Mycobacterium tuberculosis H37Rv
gaugcgaucgacgauc

SEQ ID NO: 3279638 - RNA, 16 nt, Mycobacterium tuberculosis H37Rv
gaugcgauucugcguc

SEQ ID NO: 3279639 - RNA, 18 nt, Mycobacterium tuberculosis H37Rv
gaugcgcaccagcggcug

SEQ ID NO: 3279640 - RNA, 15 nt, Mycobacterium tuberculosis H37Rv
gaugcgcccggcgug

SEQ ID NO: 3279641 - RNA, 12 nt, Mycobacterium tuberculosis H37Rv
gaugcgccgcac

SEQ ID NO: 3279642 - RNA, 14 nt, Mycobacterium tuberculosis H37Rv
gaugcgcgccggcu

SEQ ID NO: 3279643 - RNA, 17 nt, Mycobacterium tuberculosis H37Rv
gaugcgcgggugguuca

SEQ ID NO: 3279644 - RNA, 12 nt, Mycobacterium tuberculosis H37Rv
gaugcgcggugc

SEQ ID NO: 3279645 - RNA, 22 nt, Mycobacterium tuberculosis H37Rv
gaugcgcugcucacgcagcagu

SEQ ID NO: 3279646 - RNA, 17 nt, Mycobacterium tuberculosis H37Rv
gaugcggaacgccgagc

SEQ ID NO: 3279647 - RNA, 22 nt, Mycobacterium tuberculosis H37Rv
gaugcggccaugaaaaucggca

SEQ ID NO: 3279648 - RNA, 15 nt, Mycobacterium tuberculosis H37Rv
gaugcgggaaaccca

SEQ ID NO: 3279649 - RNA, 11 nt, Mycobacterium tuberculosis H37Rv
gaugcgggcaa

SEQ ID NO: 3279650 - RNA, 18 nt, Mycobacterium tuberculosis H37Rv
gaugcgggccgccaggcg

SEQ ID NO: 3279651 - RNA, 22 nt, Mycobacterium tuberculosis H37Rv
gaugcgggccgccaggcggccg

SEQ ID NO: 3279652 - RNA, 13 nt, Mycobacterium tuberculosis H37Rv
gaugcgggcggca

SEQ ID NO: 3279653 - RNA, 17 nt, Mycobacterium tuberculosis H37Rv
gaugcgguaaguggugu

SEQ ID NO: 3279654 - RNA, 17 nt, Mycobacterium tuberculosis H37Rv
gaugcggucaacgcuga

SEQ ID NO: 3279655 - RNA, 22 nt, Mycobacterium tuberculosis H37Rv
gaugcggucgacgggcucguca

SEQ ID NO: 3279656 - RNA, 22 nt, Mycobacterium tuberculosis H37Rv
gaugcggucgucacggaccgcc

SEQ ID NO: 3279657 - RNA, 12 nt, Mycobacterium tuberculosis H37Rv
gaugcggugcgg

SEQ ID NO: 3279658 - RNA, 18 nt, Mycobacterium tuberculosis H37Rv
gaugcggugcggaucaga

SEQ ID NO: 3279659 - RNA, 20 nt, Mycobacterium tuberculosis H37Rv
gaugcgucacaccacgacgc

SEQ ID NO: 3279660 - RNA, 15 nt, Mycobacterium tuberculosis H37Rv
gaugcgugccgaccc

SEQ ID NO: 3279661 - RNA, 18 nt, Mycobacterium tuberculosis H37Rv
gaugcguuggccccagga

SEQ ID NO: 3279662 - RNA, 18 nt, Mycobacterium tuberculosis H37Rv
gaugcuaugcaguuccuu

SEQ ID NO: 3279663 - RNA, 19 nt, Mycobacterium tuberculosis H37Rv
gaugcucccuauugcugcg

SEQ ID NO: 3279664 - RNA, 23 nt, Mycobacterium tuberculosis H37Rv
gaugcugccagaucggucggcca

SEQ ID NO: 3279665 - RNA, 13 nt, Mycobacterium tuberculosis H37Rv
gaugcugccagcc

SEQ ID NO: 3279666 - RNA, 19 nt, Mycobacterium tuberculosis H37Rv
gaugcugccagccauggcc

SEQ ID NO: 3279667 - RNA, 13 nt, Mycobacterium tuberculosis H37Rv
gaugcugcgggcg

SEQ ID NO: 3279668 - RNA, 10 nt, Mycobacterium tuberculosis H37Rv
gaugcugggc

SEQ ID NO: 3279669 - RNA, 17 nt, Mycobacterium tuberculosis H37Rv
gaugcuggucggcgaug

SEQ ID NO: 3279670 - RNA, 18 nt, Mycobacterium tuberculosis H37Rv
gaugcuggucgugccgcc

SEQ ID NO: 3279671 - RNA, 21 nt, Mycobacterium tuberculosis H37Rv
gaugcugucagacggcgucug

SEQ ID NO: 3279672 - RNA, 13 nt, Mycobacterium tuberculosis H37Rv
gauggacaccacc

SEQ ID NO: 3279673 - RNA, 16 nt, Mycobacterium tuberculosis H37Rv
gauggacaccaccucg

SEQ ID NO: 3279674 - RNA, 14 nt, Mycobacterium tuberculosis H37Rv
gauggacagcugcg

SEQ ID NO: 3279675 - RNA, 15 nt, Mycobacterium tuberculosis H37Rv
gauggacggcagcca

SEQ ID NO: 3279676 - RNA, 13 nt, Mycobacterium tuberculosis H37Rv
gauggacucgaca

SEQ ID NO: 3279677 - RNA, 12 nt, Mycobacterium tuberculosis H37Rv
gauggauuggcg

SEQ ID NO: 3279678 - RNA, 21 nt, Mycobacterium tuberculosis H37Rv
gauggauuggcgucagcagca

SEQ ID NO: 3279679 - RNA, 17 nt, Mycobacterium tuberculosis H37Rv
gauggcaaacgcaccca

SEQ ID NO: 3279680 - RNA, 20 nt, Mycobacterium tuberculosis H37Rv
gauggcaaacgcacccaucg

SEQ ID NO: 3279681 - RNA, 20 nt, Mycobacterium tuberculosis H37Rv
gauggcaagggccgacgucg

SEQ ID NO: 3279682 - RNA, 19 nt, Mycobacterium tuberculosis H37Rv
gauggcaauauccgggagu

SEQ ID NO: 3279683 - RNA, 21 nt, Mycobacterium tuberculosis H37Rv
gauggcaccgcccccgucggc

SEQ ID NO: 3279684 - RNA, 13 nt, Mycobacterium tuberculosis H37Rv
gauggcaggggcg

SEQ ID NO: 3279685 - RNA, 15 nt, Mycobacterium tuberculosis H37Rv
gauggcaggggcgau

SEQ ID NO: 3279686 - RNA, 16 nt, Mycobacterium tuberculosis H37Rv
gauggcauugcgccca

SEQ ID NO: 3279687 - RNA, 18 nt, Mycobacterium tuberculosis H37Rv
gauggccacggacccgaa

SEQ ID NO: 3279688 - RNA, 13 nt, Mycobacterium tuberculosis H37Rv
gauggccagguug

SEQ ID NO: 3279689 - RNA, 23 nt, Mycobacterium tuberculosis H37Rv
gauggccaucagcucgccagggu

SEQ ID NO: 3279690 - RNA, 15 nt, Mycobacterium tuberculosis H37Rv
gauggccaucaucga

SEQ ID NO: 3279691 - RNA, 18 nt, Mycobacterium tuberculosis H37Rv
gauggccccgggcgguga

SEQ ID NO: 3279692 - RNA, 15 nt, Mycobacterium tuberculosis H37Rv
gauggccgacgcugc

SEQ ID NO: 3279693 - RNA, 13 nt, Mycobacterium tuberculosis H37Rv
gauggccgccgac

SEQ ID NO: 3279694 - RNA, 19 nt, Mycobacterium tuberculosis H37Rv
gauggccgcgcccgccucg

SEQ ID NO: 3279695 - RNA, 14 nt, Mycobacterium tuberculosis H37Rv
gauggccgucagcc

SEQ ID NO: 3279696 - RNA, 18 nt, Mycobacterium tuberculosis H37Rv
gauggccguccgaccgau

SEQ ID NO: 3279697 - RNA, 19 nt, Mycobacterium tuberculosis H37Rv
gauggccguccgaccgaua

SEQ ID NO: 3279698 - RNA, 23 nt, Mycobacterium tuberculosis H37Rv
gauggccguccgaccgauaacac

SEQ ID NO: 3279699 - RNA, 23 nt, Mycobacterium tuberculosis H37Rv
gauggccucaacgccagcugcuu

SEQ ID NO: 3279700 - RNA, 19 nt, Mycobacterium tuberculosis H37Rv
gauggcgauagcggcgcuc

SEQ ID NO: 3279701 - RNA, 21 nt, Mycobacterium tuberculosis H37Rv
gauggcgaucaugagcagcac

SEQ ID NO: 3279702 - RNA, 15 nt, Mycobacterium tuberculosis H37Rv
gauggcgauggcagg

SEQ ID NO: 3279703 - RNA, 20 nt, Mycobacterium tuberculosis H37Rv
gauggcgcaccggcgucggc

SEQ ID NO: 3279704 - RNA, 18 nt, Mycobacterium tuberculosis H37Rv
gauggcgcccugcgccac

SEQ ID NO: 3279705 - RNA, 17 nt, Mycobacterium tuberculosis H37Rv
gauggcgcggucgcuga

SEQ ID NO: 3279706 - RNA, 21 nt, Mycobacterium tuberculosis H37Rv
gauggcggaaguucuccucgu

SEQ ID NO: 3279707 - RNA, 14 nt, Mycobacterium tuberculosis H37Rv
gauggcggccacca

SEQ ID NO: 3279708 - RNA, 15 nt, Mycobacterium tuberculosis H37Rv
gauggcggccaccag

SEQ ID NO: 3279709 - RNA, 17 nt, Mycobacterium tuberculosis H37Rv
gauggcggccaccagcg

SEQ ID NO: 3279710 - RNA, 22 nt, Mycobacterium tuberculosis H37Rv
gauggcggcgcguucgucgucg

SEQ ID NO: 3279711 - RNA, 22 nt, Mycobacterium tuberculosis H37Rv
gauggcgucggugaaugccguc

SEQ ID NO: 3279712 - RNA, 20 nt, Mycobacterium tuberculosis H37Rv
gauggcguuugccggccgau

SEQ ID NO: 3279713 - RNA, 21 nt, Mycobacterium tuberculosis H37Rv
gauggcuaccccagggagugc

SEQ ID NO: 3279714 - RNA, 19 nt, Mycobacterium tuberculosis H37Rv
gauggcuggccagcacgcc

SEQ ID NO: 3279715 - RNA, 15 nt, Mycobacterium tuberculosis H37Rv
gaugggagcccggcg

SEQ ID NO: 3279716 - RNA, 21 nt, Mycobacterium tuberculosis H37Rv
gaugggagcccggcggcccga

SEQ ID NO: 3279717 - RNA, 14 nt, Mycobacterium tuberculosis H37Rv
gaugggcagccgcc

SEQ ID NO: 3279718 - RNA, 15 nt, Mycobacterium tuberculosis H37Rv
gaugggcaugguggu

SEQ ID NO: 3279719 - RNA, 16 nt, Mycobacterium tuberculosis H37Rv
gauucguugucgagca

SEQ ID NO: 3279720 - RNA, 17 nt, Mycobacterium tuberculosis H37Rv
gauucugcgucugcucg

SEQ ID NO: 3279721 - RNA, 20 nt, Mycobacterium tuberculosis H37Rv
gauucugcgucugcucgcca

SEQ ID NO: 3279722 - RNA, 20 nt, Mycobacterium tuberculosis H37Rv
gauucugcgucugcucgcgc

SEQ ID NO: 3279723 - RNA, 22 nt, Mycobacterium tuberculosis H37Rv
gauucuggucgaaauugggugc

SEQ ID NO: 3279724 - RNA, 17 nt, Mycobacterium tuberculosis H37Rv
gauugaagcuggccacc

SEQ ID NO: 3279725 - RNA, 21 nt, Mycobacterium tuberculosis H37Rv
gauugaggcuggucugcaggc

SEQ ID NO: 3279726 - RNA, 20 nt, Mycobacterium tuberculosis H37Rv
gauugaguucggcggccagg

SEQ ID NO: 3279727 - RNA, 17 nt, Mycobacterium tuberculosis H37Rv
gauugcccgcgcucgca

SEQ ID NO: 3279728 - RNA, 22 nt, Mycobacterium tuberculosis H37Rv
gauugccgguuuugccgugcca

SEQ ID NO: 3279729 - RNA, 15 nt, Mycobacterium tuberculosis H37Rv
gauugcgaagggcac

SEQ ID NO: 3279730 - RNA, 23 nt, Mycobacterium tuberculosis H37Rv
gauugcgaagggcaccggcgauc

SEQ ID NO: 3279731 - RNA, 20 nt, Mycobacterium tuberculosis H37Rv
gauugcgcgcugagcucgau

SEQ ID NO: 3279732 - RNA, 14 nt, Mycobacterium tuberculosis H37Rv
gauugcgggccugc

SEQ ID NO: 3279733 - RNA, 15 nt, Mycobacterium tuberculosis H37Rv
gauugcgggccugca

SEQ ID NO: 3279734 - RNA, 20 nt, Mycobacterium tuberculosis H37Rv
gauugcuugggugccucgcc

SEQ ID NO: 3279735 - RNA, 20 nt, Mycobacterium tuberculosis H37Rv
gauuggccaaccccauggcc

SEQ ID NO: 3279736 - RNA, 11 nt, Mycobacterium tuberculosis H37Rv
gauuggccccg

SEQ ID NO: 3279737 - RNA, 11 nt, Mycobacterium tuberculosis H37Rv
gauuggcccga

SEQ ID NO: 3279738 - RNA, 14 nt, Mycobacterium tuberculosis H37Rv
gauuggccgcugca

SEQ ID NO: 3279739 - RNA, 21 nt, Mycobacterium tuberculosis H37Rv
gauuggccugccauaggccca

SEQ ID NO: 3279740 - RNA, 17 nt, Mycobacterium tuberculosis H37Rv
gauuggcgucagcagca

SEQ ID NO: 3279741 - RNA, 14 nt, Mycobacterium tuberculosis H37Rv
gauuggcucgagca

SEQ ID NO: 3279742 - RNA, 14 nt, Mycobacterium tuberculosis H37Rv
gauuggcucgccga

SEQ ID NO: 3279743 - RNA, 19 nt, Mycobacterium tuberculosis H37Rv
gauuggugggccagcagca

SEQ ID NO: 3279744 - RNA, 20 nt, Mycobacterium tuberculosis H37Rv
gauugugagcaauggcgcga

SEQ ID NO: 3279745 - RNA, 17 nt, Mycobacterium tuberculosis H37Rv
gauuguggccagcgcuu

SEQ ID NO: 3279746 - RNA, 16 nt, Mycobacterium tuberculosis H37Rv
gauuucgcaguuggcg

SEQ ID NO: 3279747 - RNA, 20 nt, Mycobacterium tuberculosis H37Rv
gauuucgcgucugcucgcca

SEQ ID NO: 3279748 - RNA, 20 nt, Mycobacterium tuberculosis H37Rv
gauuucgggcgccgaccaca

SEQ ID NO: 3279749 - RNA, 19 nt, Mycobacterium tuberculosis H37Rv
gauuucggugacuccggcu

SEQ ID NO: 3279750 - RNA, 22 nt, Mycobacterium tuberculosis H37Rv
gauuucggugacuccggcugga

SEQ ID NO: 3279751 - RNA, 20 nt, Mycobacterium tuberculosis H37Rv
gauuucuuuaaaccccuggc

SEQ ID NO: 3279752 - RNA, 14 nt, Mycobacterium tuberculosis H37Rv
gauuuggagcuuuu

SEQ ID NO: 3279753 - RNA, 15 nt, Mycobacterium tuberculosis H37Rv
gauuugguggcuggu

SEQ ID NO: 3279754 - RNA, 14 nt, Mycobacterium tuberculosis H37Rv
gauuuucucggugc

SEQ ID NO: 3279755 - RNA, 19 nt, Mycobacterium tuberculosis H37Rv
gauuuugcgucugcucacg

SEQ ID NO: 3279756 - RNA, 20 nt, Mycobacterium tuberculosis H37Rv
gauuuugcgucugcucgcca

SEQ ID NO: 3279757 - RNA, 20 nt, Mycobacterium tuberculosis H37Rv
gauuuugcgucugcucgcgc

SEQ ID NO: 3279758 - RNA, 16 nt, Mycobacterium tuberculosis H37Rv
gauuuugugucugcuc

SEQ ID NO: 3279759 - RNA, 17 nt, Mycobacterium tuberculosis H37Rv
gauuuugugucugcucg

SEQ ID NO: 3279760 - RNA, 17 nt, Mycobacterium tuberculosis H37Rv
gcaaaauccccucgaca

SEQ ID NO: 3279761 - RNA, 13 nt, Mycobacterium tuberculosis H37Rv
gcaaaaucgccca

SEQ ID NO: 3279762 - RNA, 18 nt, Mycobacterium tuberculosis H37Rv
gcaaaaucgucagcgccg

SEQ ID NO: 3279763 - RNA, 18 nt, Mycobacterium tuberculosis H37Rv
gcaaacaagaucagaccc

SEQ ID NO: 3279764 - RNA, 20 nt, Mycobacterium tuberculosis H37Rv
gcaaacaagaucagacccag

SEQ ID NO: 3279765 - RNA, 22 nt, Mycobacterium tuberculosis H37Rv
gcaaacagauucggugccagca

SEQ ID NO: 3279766 - RNA, 13 nt, Mycobacterium tuberculosis H37Rv
gcaaaccacccgc

SEQ ID NO: 3279767 - RNA, 20 nt, Mycobacterium tuberculosis H37Rv
gcaaaccagauugccgagcc

SEQ ID NO: 3279768 - RNA, 19 nt, Mycobacterium tuberculosis H37Rv
gcaaaccauugcgccugaa

SEQ ID NO: 3279769 - RNA, 19 nt, Mycobacterium tuberculosis H37Rv
gcaaaccccggaccaucga

SEQ ID NO: 3279770 - RNA, 23 nt, Mycobacterium tuberculosis H37Rv
gcaaaccccggaccaucgacaac

SEQ ID NO: 3279771 - RNA, 15 nt, Mycobacterium tuberculosis H37Rv
gcaaaccgaccguga

SEQ ID NO: 3279772 - RNA, 18 nt, Mycobacterium tuberculosis H37Rv
gcaaaccgaucaauccgc

SEQ ID NO: 3279773 - RNA, 23 nt, Mycobacterium tuberculosis H37Rv
gcaaaccgaucaauccgcccuug

SEQ ID NO: 3279774 - RNA, 17 nt, Mycobacterium tuberculosis H37Rv
gcaaacggaugguucug

SEQ ID NO: 3279775 - RNA, 17 nt, Mycobacterium tuberculosis H37Rv
gcaaacgugaucaggaa

SEQ ID NO: 3279776 - RNA, 15 nt, Mycobacterium tuberculosis H37Rv
gcaaagacgcuggcc

SEQ ID NO: 3279777 - RNA, 22 nt, Mycobacterium tuberculosis H37Rv
gcaaagccagcgcagccaggcu

SEQ ID NO: 3279778 - RNA, 16 nt, Mycobacterium tuberculosis H37Rv
gcaaagcccuccucga

SEQ ID NO: 3279779 - RNA, 15 nt, Mycobacterium tuberculosis H37Rv
gcaaagcgagcaccg

SEQ ID NO: 3279780 - RNA, 18 nt, Mycobacterium tuberculosis H37Rv
gcaaaggccccggugacg

SEQ ID NO: 3279781 - RNA, 16 nt, Mycobacterium tuberculosis H37Rv
gcaaagucggugucac

SEQ ID NO: 3279782 - RNA, 13 nt, Mycobacterium tuberculosis H37Rv
gcaaaucaagcac

SEQ ID NO: 3279783 - RNA, 16 nt, Mycobacterium tuberculosis H37Rv
gcaaaucaagcacagc

SEQ ID NO: 3279784 - RNA, 18 nt, Mycobacterium tuberculosis H37Rv
gcaaaucggugcgauccu

SEQ ID NO: 3279785 - RNA, 19 nt, Mycobacterium tuberculosis H37Rv
gcaacaacgucugcagccu

SEQ ID NO: 3279786 - RNA, 14 nt, Mycobacterium tuberculosis H37Rv
gcaacaacguucgg

SEQ ID NO: 3279787 - RNA, 23 nt, Mycobacterium tuberculosis H37Rv
gcaacacaccgcggaaggccagc

SEQ ID NO: 3279788 - RNA, 22 nt, Mycobacterium tuberculosis H37Rv
gcaacacauuucuuugggcggc

SEQ ID NO: 3279789 - RNA, 21 nt, Mycobacterium tuberculosis H37Rv
gcaacaccaucagcgacaagu

SEQ ID NO: 3279790 - RNA, 15 nt, Mycobacterium tuberculosis H37Rv
gcaacacccgggcga

SEQ ID NO: 3279791 - RNA, 18 nt, Mycobacterium tuberculosis H37Rv
gcaacacccgggcgaccu

SEQ ID NO: 3279792 - RNA, 15 nt, Mycobacterium tuberculosis H37Rv
gcaacaccgcaccgg

SEQ ID NO: 3279793 - RNA, 15 nt, Mycobacterium tuberculosis H37Rv
gcaacaccgccaacu

SEQ ID NO: 3279794 - RNA, 18 nt, Mycobacterium tuberculosis H37Rv
gcaacacgauaucgggcu

SEQ ID NO: 3279795 - RNA, 19 nt, Mycobacterium tuberculosis H37Rv
gcaacacgccggcccggug

SEQ ID NO: 3279796 - RNA, 18 nt, Mycobacterium tuberculosis H37Rv
gcaacagcgagcgguuga

SEQ ID NO: 3279797 - RNA, 13 nt, Mycobacterium tuberculosis H37Rv
gcaacagcgcggu

SEQ ID NO: 3279798 - RNA, 13 nt, Mycobacterium tuberculosis H37Rv
gcaacaucagcag

SEQ ID NO: 3279799 - RNA, 14 nt, Mycobacterium tuberculosis H37Rv
gcaacaucagcagg

SEQ ID NO: 3279800 - RNA, 16 nt, Mycobacterium tuberculosis H37Rv
gcaacaucagcaggac

SEQ ID NO: 3279801 - RNA, 21 nt, Mycobacterium tuberculosis H37Rv
gcaacaucagcaggaccaacg

SEQ ID NO: 3279802 - RNA, 20 nt, Mycobacterium tuberculosis H37Rv
gcaacauccccaugucggug

SEQ ID NO: 3279803 - RNA, 20 nt, Mycobacterium tuberculosis H37Rv
gcaacaucgaauaugacugc

SEQ ID NO: 3279804 - RNA, 23 nt, Mycobacterium tuberculosis H37Rv
gcaacaucgagcgccagccggug

SEQ ID NO: 3279805 - RNA, 16 nt, Mycobacterium tuberculosis H37Rv
gcaacaucggaugacc

SEQ ID NO: 3279806 - RNA, 20 nt, Mycobacterium tuberculosis H37Rv
gcaacaucggaugaccagug

SEQ ID NO: 3279807 - RNA, 16 nt, Mycobacterium tuberculosis H37Rv
gcaacaugucaccugc

SEQ ID NO: 3279808 - RNA, 17 nt, Mycobacterium tuberculosis H37Rv
gcaacauuuucgcccgc

SEQ ID NO: 3279809 - RNA, 18 nt, Mycobacterium tuberculosis H37Rv
gcaacauuuucgcccgcu

SEQ ID NO: 3279810 - RNA, 23 nt, Mycobacterium tuberculosis H37Rv
gcaaccaaagcgacgagcagcaa

SEQ ID NO: 3279811 - RNA, 16 nt, Mycobacterium tuberculosis H37Rv
gcaaccacaucaccgg

SEQ ID NO: 3279812 - RNA, 17 nt, Mycobacterium tuberculosis H37Rv
gcaaccaccggccgcgc

SEQ ID NO: 3279813 - RNA, 15 nt, Mycobacterium tuberculosis H37Rv
gcaaccaccucgugg

SEQ ID NO: 3279814 - RNA, 17 nt, Mycobacterium tuberculosis H37Rv
gcaaccacguccgcaac

SEQ ID NO: 3279815 - RNA, 16 nt, Mycobacterium tuberculosis H37Rv
gcaagccucgugguga

SEQ ID NO: 3279816 - RNA, 16 nt, Mycobacterium tuberculosis H37Rv
gcaagcggacccgacc

SEQ ID NO: 3279817 - RNA, 13 nt, Mycobacterium tuberculosis H37Rv
gcaagcugaccgc

SEQ ID NO: 3279818 - RNA, 14 nt, Mycobacterium tuberculosis H37Rv
gcaagcugaccgcc

SEQ ID NO: 3279819 - RNA, 22 nt, Mycobacterium tuberculosis H37Rv
gcaaggaaaagccuggccguug

SEQ ID NO: 3279820 - RNA, 21 nt, Mycobacterium tuberculosis H37Rv
gcaaggacguggcgcuggacc

SEQ ID NO: 3279821 - RNA, 15 nt, Mycobacterium tuberculosis H37Rv
gcaaggcauccaacg

SEQ ID NO: 3279822 - RNA, 12 nt, Mycobacterium tuberculosis H37Rv
gcaaggcccgca

SEQ ID NO: 3279823 - RNA, 15 nt, Mycobacterium tuberculosis H37Rv
gcaaggcccgcaccg

SEQ ID NO: 3279824 - RNA, 23 nt, Mycobacterium tuberculosis H37Rv
gcaaggccuugcguguaccagcc

SEQ ID NO: 3279825 - RNA, 20 nt, Mycobacterium tuberculosis H37Rv
gcaaggcggaucuucucggu

SEQ ID NO: 3279826 - RNA, 21 nt, Mycobacterium tuberculosis H37Rv
gcaagggccgacgucguuggc

SEQ ID NO: 3279827 - RNA, 14 nt, Mycobacterium tuberculosis H37Rv
gcaaggucaacggg

SEQ ID NO: 3279828 - RNA, 13 nt, Mycobacterium tuberculosis H37Rv
gcaaggucgcugc

SEQ ID NO: 3279829 - RNA, 12 nt, Mycobacterium tuberculosis H37Rv
gcaagguggcau

SEQ ID NO: 3279830 - RNA, 14 nt, Mycobacterium tuberculosis H37Rv
gcaagucaacaccg

SEQ ID NO: 3279831 - RNA, 17 nt, Mycobacterium tuberculosis H37Rv
gcaaguccaccggaucg

SEQ ID NO: 3279832 - RNA, 15 nt, Mycobacterium tuberculosis H37Rv
gcaaguccugcagcu

SEQ ID NO: 3279833 - RNA, 16 nt, Mycobacterium tuberculosis H37Rv
gcaaguccugcagcug

SEQ ID NO: 3279834 - RNA, 19 nt, Mycobacterium tuberculosis H37Rv
gcaagucgacgccgcagcg

SEQ ID NO: 3279835 - RNA, 12 nt, Mycobacterium tuberculosis H37Rv
gcaagucgccga

SEQ ID NO: 3279836 - RNA, 23 nt, Mycobacterium tuberculosis H37Rv
gcaagugcggaacggccaggauc

SEQ ID NO: 3279837 - RNA, 13 nt, Mycobacterium tuberculosis H37Rv
gcaagugcgggcu

SEQ ID NO: 3279838 - RNA, 21 nt, Mycobacterium tuberculosis H37Rv
gcaagugcgggcuguccgggc

SEQ ID NO: 3279839 - RNA, 21 nt, Mycobacterium tuberculosis H37Rv
gcaagugucuccggcaacagc

SEQ ID NO: 3279840 - RNA, 22 nt, Mycobacterium tuberculosis H37Rv
gcaagugucuccggcaacagca

SEQ ID NO: 3279841 - RNA, 17 nt, Mycobacterium tuberculosis H37Rv
gcaagugugagcagacc

SEQ ID NO: 3279842 - RNA, 20 nt, Mycobacterium tuberculosis H37Rv
gcaaguucggccgagugcac

SEQ ID NO: 3279843 - RNA, 18 nt, Mycobacterium tuberculosis H37Rv
gcaaguucgucgggaucg

SEQ ID NO: 3279844 - RNA, 18 nt, Mycobacterium tuberculosis H37Rv
gcaaguugagcagcuugg

SEQ ID NO: 3279845 - RNA, 24 nt, Mycobacterium tuberculosis H37Rv
gcaauaagggagaccgcggccggc

SEQ ID NO: 3279846 - RNA, 22 nt, Mycobacterium tuberculosis H37Rv
gcaauacacguugccgaucccg

SEQ ID NO: 3279847 - RNA, 21 nt, Mycobacterium tuberculosis H37Rv
gcaauaccgccagcgccaccg

SEQ ID NO: 3279848 - RNA, 20 nt, Mycobacterium tuberculosis H37Rv
gcaauacggcggcgccgccc

SEQ ID NO: 3279849 - RNA, 18 nt, Mycobacterium tuberculosis H37Rv
gcaauacguagucgccga

SEQ ID NO: 3279850 - RNA, 17 nt, Mycobacterium tuberculosis H37Rv
gcaauagaccgcagucg

SEQ ID NO: 3279851 - RNA, 20 nt, Mycobacterium tuberculosis H37Rv
gcaauagccggguugccugc

SEQ ID NO: 3279852 - RNA, 18 nt, Mycobacterium tuberculosis H37Rv
gcaauauccggccgagcc

SEQ ID NO: 3279853 - RNA, 20 nt, Mycobacterium tuberculosis H37Rv
gcaauauccggccgagccgu

SEQ ID NO: 3279854 - RNA, 20 nt, Mycobacterium tuberculosis H37Rv
gcaauaucuuuagcgcgugc

SEQ ID NO: 3279855 - RNA, 21 nt, Mycobacterium tuberculosis H37Rv
gcaauaucuuuagcgcgugcu

SEQ ID NO: 3279856 - RNA, 14 nt, Mycobacterium tuberculosis H37Rv
gcaauaugccacag

SEQ ID NO: 3279857 - RNA, 15 nt, Mycobacterium tuberculosis H37Rv
gcaauaugccacaga

SEQ ID NO: 3279858 - RNA, 12 nt, Mycobacterium tuberculosis H37Rv
gcaaucacauca

SEQ ID NO: 3279859 - RNA, 13 nt, Mycobacterium tuberculosis H37Rv
gcaaucacaucaa

SEQ ID NO: 3279860 - RNA, 13 nt, Mycobacterium tuberculosis H37Rv
gcaaucagcuggu

SEQ ID NO: 3279861 - RNA, 16 nt, Mycobacterium tuberculosis H37Rv
gcaaucaggaaccgcu

SEQ ID NO: 3279862 - RNA, 17 nt, Mycobacterium tuberculosis H37Rv
gcaaucaggaaccgcuc

SEQ ID NO: 3279863 - RNA, 19 nt, Mycobacterium tuberculosis H37Rv
gcaaucaucucccgaccgc

SEQ ID NO: 3279864 - RNA, 20 nt, Mycobacterium tuberculosis H37Rv
gcaaucccgccaucugccug

SEQ ID NO: 3279865 - RNA, 23 nt, Mycobacterium tuberculosis H37Rv
gcaaucccgcggucgaucaggcc

SEQ ID NO: 3279866 - RNA, 23 nt, Mycobacterium tuberculosis H37Rv
gcaauccgcaaaacgagcuucca

SEQ ID NO: 3279867 - RNA, 20 nt, Mycobacterium tuberculosis H37Rv
gcaauccggucagcgcggcg

SEQ ID NO: 3279868 - RNA, 15 nt, Mycobacterium tuberculosis H37Rv
gcaaucgaccacgac

SEQ ID NO: 3279869 - RNA, 16 nt, Mycobacterium tuberculosis H37Rv
gcaaucgcgggcgaug

SEQ ID NO: 3279870 - RNA, 16 nt, Mycobacterium tuberculosis H37Rv
gcaaucgugguucggc

SEQ ID NO: 3279871 - RNA, 14 nt, Mycobacterium tuberculosis H37Rv
gcaaucucccgaau

SEQ ID NO: 3279872 - RNA, 23 nt, Mycobacterium tuberculosis H37Rv
gcaaugaccccggcguugccgcc

SEQ ID NO: 3279873 - RNA, 15 nt, Mycobacterium tuberculosis H37Rv
gcaaugacccgcggg

SEQ ID NO: 3279874 - RNA, 15 nt, Mycobacterium tuberculosis H37Rv
gcaaugaccugcagc

SEQ ID NO: 3279875 - RNA, 15 nt, Mycobacterium tuberculosis H37Rv
gcaaugacuugcgac

SEQ ID NO: 3279876 - RNA, 18 nt, Mycobacterium tuberculosis H37Rv
gcaaugacuugcgacccg

SEQ ID NO: 3279877 - RNA, 13 nt, Mycobacterium tuberculosis H37Rv
gcaaugccgacuc

SEQ ID NO: 3279878 - RNA, 23 nt, Mycobacterium tuberculosis H37Rv
gcaaugccgacucaggucggugc

SEQ ID NO: 3279879 - RNA, 14 nt, Mycobacterium tuberculosis H37Rv
gcaaugcgcgcgau

SEQ ID NO: 3279880 - RNA, 21 nt, Mycobacterium tuberculosis H37Rv
gcaaugcguugaccgauacgc

SEQ ID NO: 3279881 - RNA, 12 nt, Mycobacterium tuberculosis H37Rv
gcaauggccagc

SEQ ID NO: 3279882 - RNA, 16 nt, Mycobacterium tuberculosis H37Rv
gcaauggccagcacca

SEQ ID NO: 3279883 - RNA, 14 nt, Mycobacterium tuberculosis H37Rv
gcaauggcggccuu

SEQ ID NO: 3279884 - RNA, 16 nt, Mycobacterium tuberculosis H37Rv
gcaaugguucgugcac

SEQ ID NO: 3279885 - RNA, 23 nt, Mycobacterium tuberculosis H37Rv
gcaaugucggcagggcccccagu

SEQ ID NO: 3279886 - RNA, 16 nt, Mycobacterium tuberculosis H37Rv
gcaauuccgccgagcg

SEQ ID NO: 3279887 - RNA, 20 nt, Mycobacterium tuberculosis H37Rv
gcaauuggcguagcaaccca

SEQ ID NO: 3279888 - RNA, 23 nt, Mycobacterium tuberculosis H37Rv
gcaauuucagccuuguugccgcc

SEQ ID NO: 3279889 - RNA, 15 nt, Mycobacterium tuberculosis H37Rv
gcacaaaaucagcga

SEQ ID NO: 3279890 - RNA, 17 nt, Mycobacterium tuberculosis H37Rv
gcacaaaaucagcgauu

SEQ ID NO: 3279891 - RNA, 17 nt, Mycobacterium tuberculosis H37Rv
gcacaaacauacgccac

SEQ ID NO: 3279892 - RNA, 14 nt, Mycobacterium tuberculosis H37Rv
gcacaaacccaguu

SEQ ID NO: 3279893 - RNA, 20 nt, Mycobacterium tuberculosis H37Rv
gcacaacagaauucgaccgc

SEQ ID NO: 3279894 - RNA, 15 nt, Mycobacterium tuberculosis H37Rv
gcacaacaucgccgc

SEQ ID NO: 3279895 - RNA, 17 nt, Mycobacterium tuberculosis H37Rv
gcacaacaucgccgcag

SEQ ID NO: 3279896 - RNA, 12 nt, Mycobacterium tuberculosis H37Rv
gcacaacccguc

SEQ ID NO: 3279897 - RNA, 13 nt, Mycobacterium tuberculosis H37Rv
gcacaacccgugc

SEQ ID NO: 3279898 - RNA, 13 nt, Mycobacterium tuberculosis H37Rv
gcacaacgcccac

SEQ ID NO: 3279899 - RNA, 16 nt, Mycobacterium tuberculosis H37Rv
gcacaacgcccaccac

SEQ ID NO: 3279900 - RNA, 17 nt, Mycobacterium tuberculosis H37Rv
gcacaacugcgccagca

SEQ ID NO: 3279901 - RNA, 18 nt, Mycobacterium tuberculosis H37Rv
gcacaacugcgccagcaa

SEQ ID NO: 3279902 - RNA, 23 nt, Mycobacterium tuberculosis H37Rv
gcacaacugcgccagcaacagcg

SEQ ID NO: 3279903 - RNA, 18 nt, Mycobacterium tuberculosis H37Rv
gcacaagauccgccacgc

SEQ ID NO: 3279904 - RNA, 20 nt, Mycobacterium tuberculosis H37Rv
gcacaagcuggggaacagca

SEQ ID NO: 3279905 - RNA, 17 nt, Mycobacterium tuberculosis H37Rv
gcacaaguucuucgaca

SEQ ID NO: 3279906 - RNA, 17 nt, Mycobacterium tuberculosis H37Rv
gcacaauacggucagca

SEQ ID NO: 3279907 - RNA, 18 nt, Mycobacterium tuberculosis H37Rv
gcacaauacggucagcag

SEQ ID NO: 3279908 - RNA, 20 nt, Mycobacterium tuberculosis H37Rv
gcacaauacggucagcagac

SEQ ID NO: 3279909 - RNA, 16 nt, Mycobacterium tuberculosis H37Rv
gcacacaccguaccga

SEQ ID NO: 3279910 - RNA, 12 nt, Mycobacterium tuberculosis H37Rv
gcacacagaccg

SEQ ID NO: 3279911 - RNA, 17 nt, Mycobacterium tuberculosis H37Rv
gcaccaccgucucgccg

SEQ ID NO: 3279912 - RNA, 17 nt, Mycobacterium tuberculosis H37Rv
gcaccacgagcagccga

SEQ ID NO: 3279913 - RNA, 18 nt, Mycobacterium tuberculosis H37Rv
gcaccacgagcagccgau

SEQ ID NO: 3279914 - RNA, 21 nt, Mycobacterium tuberculosis H37Rv
gcaccacgccagcccguccgg

SEQ ID NO: 3279915 - RNA, 17 nt, Mycobacterium tuberculosis H37Rv
gcaccacggccagcggg

SEQ ID NO: 3279916 - RNA, 13 nt, Mycobacterium tuberculosis H37Rv
gcaccacggcggc

SEQ ID NO: 3279917 - RNA, 15 nt, Mycobacterium tuberculosis H37Rv
gcaccacggcggcca

SEQ ID NO: 3279918 - RNA, 18 nt, Mycobacterium tuberculosis H37Rv
gcaccacggcggucaacg

SEQ ID NO: 3279919 - RNA, 23 nt, Mycobacterium tuberculosis H37Rv
gcaccacggcggucaacggucuc

SEQ ID NO: 3279920 - RNA, 22 nt, Mycobacterium tuberculosis H37Rv
gcaccagaaaugguucgcacac

SEQ ID NO: 3279921 - RNA, 23 nt, Mycobacterium tuberculosis H37Rv
gcaccagauagaucgugaucgac

SEQ ID NO: 3279922 - RNA, 16 nt, Mycobacterium tuberculosis H37Rv
gcaccagaucagguga

SEQ ID NO: 3279923 - RNA, 21 nt, Mycobacterium tuberculosis H37Rv
gcaccagaucuucgagcgcau

SEQ ID NO: 3279924 - RNA, 13 nt, Mycobacterium tuberculosis H37Rv
gcaccagcaccgu

SEQ ID NO: 3279925 - RNA, 15 nt, Mycobacterium tuberculosis H37Rv
gcaccagcagcacca

SEQ ID NO: 3279926 - RNA, 18 nt, Mycobacterium tuberculosis H37Rv
gcaccagcagccagccca

SEQ ID NO: 3279927 - RNA, 20 nt, Mycobacterium tuberculosis H37Rv
gcaccagccaaaucagccag

SEQ ID NO: 3279928 - RNA, 13 nt, Mycobacterium tuberculosis H37Rv
gcaccagccagcc

SEQ ID NO: 3279929 - RNA, 19 nt, Mycobacterium tuberculosis H37Rv
gcaccagccagccugcugg

SEQ ID NO: 3279930 - RNA, 12 nt, Mycobacterium tuberculosis H37Rv
gcaccagccggu

SEQ ID NO: 3279931 - RNA, 14 nt, Mycobacterium tuberculosis H37Rv
gcaccagccgguga

SEQ ID NO: 3279932 - RNA, 16 nt, Mycobacterium tuberculosis H37Rv
gcaccagccggugagc

SEQ ID NO: 3279933 - RNA, 14 nt, Mycobacterium tuberculosis H37Rv
gcaccagcgaaucc

SEQ ID NO: 3279934 - RNA, 12 nt, Mycobacterium tuberculosis H37Rv
gcaccagcggca

SEQ ID NO: 3279935 - RNA, 22 nt, Mycobacterium tuberculosis H37Rv
gcaccagcggcugaccgggcag

SEQ ID NO: 3279936 - RNA, 23 nt, Mycobacterium tuberculosis H37Rv
gcaccagcucacccggagcaccc

SEQ ID NO: 3279937 - RNA, 14 nt, Mycobacterium tuberculosis H37Rv
gcaccagcugucgg

SEQ ID NO: 3279938 - RNA, 19 nt, Mycobacterium tuberculosis H37Rv
gcaccagcugucgggcagc

SEQ ID NO: 3279939 - RNA, 17 nt, Mycobacterium tuberculosis H37Rv
gcaccaggcggccguaa

SEQ ID NO: 3279940 - RNA, 18 nt, Mycobacterium tuberculosis H37Rv
gcaccagggagccguuca

SEQ ID NO: 3279941 - RNA, 20 nt, Mycobacterium tuberculosis H37Rv
gcaccaggggcgcgucaugg

SEQ ID NO: 3279942 - RNA, 16 nt, Mycobacterium tuberculosis H37Rv
gcaccagguguccccg

SEQ ID NO: 3279943 - RNA, 17 nt, Mycobacterium tuberculosis H37Rv
gcaccagguugcaaccu

SEQ ID NO: 3279944 - RNA, 18 nt, Mycobacterium tuberculosis H37Rv
gcaccaguccagcgggca

SEQ ID NO: 3279945 - RNA, 21 nt, Mycobacterium tuberculosis H37Rv
gcaccaguggcgcccauggcc

SEQ ID NO: 3279946 - RNA, 20 nt, Mycobacterium tuberculosis H37Rv
gcaccaguguggcgaugacc

SEQ ID NO: 3279947 - RNA, 23 nt, Mycobacterium tuberculosis H37Rv
gcaccaguuugugccgccgcggc

SEQ ID NO: 3279948 - RNA, 14 nt, Mycobacterium tuberculosis H37Rv
gcaccauccggucc

SEQ ID NO: 3279949 - RNA, 14 nt, Mycobacterium tuberculosis H37Rv
gcaccaucgcggcc

SEQ ID NO: 3279950 - RNA, 22 nt, Mycobacterium tuberculosis H37Rv
gcaccaucgguaucgagggcag

SEQ ID NO: 3279951 - RNA, 21 nt, Mycobacterium tuberculosis H37Rv
gcaccaugggucuggcaggcc

SEQ ID NO: 3279952 - RNA, 20 nt, Mycobacterium tuberculosis H37Rv
gcacccaaccaggccgcgac

SEQ ID NO: 3279953 - RNA, 14 nt, Mycobacterium tuberculosis H37Rv
gcacccaacccggc

SEQ ID NO: 3279954 - RNA, 18 nt, Mycobacterium tuberculosis H37Rv
gcacccaacuccaucagc

SEQ ID NO: 3279955 - RNA, 17 nt, Mycobacterium tuberculosis H37Rv
gcacccaauccggcgcc

SEQ ID NO: 3279956 - RNA, 19 nt, Mycobacterium tuberculosis H37Rv
gcacccaauccggcgccag

SEQ ID NO: 3279957 - RNA, 23 nt, Mycobacterium tuberculosis H37Rv
gcacccaauccggcgccagcagu

SEQ ID NO: 3279958 - RNA, 15 nt, Mycobacterium tuberculosis H37Rv
gcacccaaugccacc

SEQ ID NO: 3279959 - RNA, 17 nt, Mycobacterium tuberculosis H37Rv
gcacccaaugccaccgc

SEQ ID NO: 3279960 - RNA, 23 nt, Mycobacterium tuberculosis H37Rv
gcacccaaugccaccgcggccgc

SEQ ID NO: 3279961 - RNA, 19 nt, Mycobacterium tuberculosis H37Rv
gcacccaauuucgaccaga

SEQ ID NO: 3279962 - RNA, 22 nt, Mycobacterium tuberculosis H37Rv
gcacccaauuucgaccagaauc

SEQ ID NO: 3279963 - RNA, 15 nt, Mycobacterium tuberculosis H37Rv
gcacccacaucagcc

SEQ ID NO: 3279964 - RNA, 15 nt, Mycobacterium tuberculosis H37Rv
gcacccaccacacca

SEQ ID NO: 3279965 - RNA, 21 nt, Mycobacterium tuberculosis H37Rv
gcacccacccguucggcugcg

SEQ ID NO: 3279966 - RNA, 14 nt, Mycobacterium tuberculosis H37Rv
gcacccacgccggu

SEQ ID NO: 3279967 - RNA, 24 nt, Mycobacterium tuberculosis H37Rv
gcacccacgccgguggcacggccc

SEQ ID NO: 3279968 - RNA, 22 nt, Mycobacterium tuberculosis H37Rv
gcacccacuuuucgguggcggc

SEQ ID NO: 3279969 - RNA, 12 nt, Mycobacterium tuberculosis H37Rv
gcacccagaccg

SEQ ID NO: 3279970 - RNA, 18 nt, Mycobacterium tuberculosis H37Rv
gcacccagacgauggcca

SEQ ID NO: 3279971 - RNA, 21 nt, Mycobacterium tuberculosis H37Rv
gcacccagacgauggccaggu

SEQ ID NO: 3279972 - RNA, 13 nt, Mycobacterium tuberculosis H37Rv
gcacccagccgug

SEQ ID NO: 3279973 - RNA, 13 nt, Mycobacterium tuberculosis H37Rv
gcacccagcggcg

SEQ ID NO: 3279974 - RNA, 22 nt, Mycobacterium tuberculosis H37Rv
gcacccaggugucgcugcugaa

SEQ ID NO: 3279975 - RNA, 22 nt, Mycobacterium tuberculosis H37Rv
gcacccaucccguucagcgacc

SEQ ID NO: 3279976 - RNA, 23 nt, Mycobacterium tuberculosis H37Rv
gcacccaucccguucagcgacca

SEQ ID NO: 3279977 - RNA, 20 nt, Mycobacterium tuberculosis H37Rv
gcaccccauacucggcggcu

SEQ ID NO: 3279978 - RNA, 15 nt, Mycobacterium tuberculosis H37Rv
gcaccccauggccac

SEQ ID NO: 3279979 - RNA, 17 nt, Mycobacterium tuberculosis H37Rv
gcacccccgucgccacc

SEQ ID NO: 3279980 - RNA, 17 nt, Mycobacterium tuberculosis H37Rv
gcaccccgccgggggca

SEQ ID NO: 3279981 - RNA, 19 nt, Mycobacterium tuberculosis H37Rv
gcaccccgccgggggcacc

SEQ ID NO: 3279982 - RNA, 16 nt, Mycobacterium tuberculosis H37Rv
gcaccccggcggcguc

SEQ ID NO: 3279983 - RNA, 20 nt, Mycobacterium tuberculosis H37Rv
gcaccccuuugacgccgagc

SEQ ID NO: 3279984 - RNA, 21 nt, Mycobacterium tuberculosis H37Rv
gcaccccuuugacgccgagca

SEQ ID NO: 3279985 - RNA, 18 nt, Mycobacterium tuberculosis H37Rv
gcacccgaaacaccgucu

SEQ ID NO: 3279986 - RNA, 21 nt, Mycobacterium tuberculosis H37Rv
gcacccgaauuugucggcgaa

SEQ ID NO: 3279987 - RNA, 18 nt, Mycobacterium tuberculosis H37Rv
gcacccgacucgucggcc

SEQ ID NO: 3279988 - RNA, 22 nt, Mycobacterium tuberculosis H37Rv
gcacccgacucgucggccuggu

SEQ ID NO: 3279989 - RNA, 16 nt, Mycobacterium tuberculosis H37Rv
gcacccgagccgcaca

SEQ ID NO: 3279990 - RNA, 19 nt, Mycobacterium tuberculosis H37Rv
gcacccgaguuauagaagc

SEQ ID NO: 3279991 - RNA, 21 nt, Mycobacterium tuberculosis H37Rv
gcacccgaguuauagaagccg

SEQ ID NO: 3279992 - RNA, 21 nt, Mycobacterium tuberculosis H37Rv
gcacccgauaguucuggcccg

SEQ ID NO: 3279993 - RNA, 14 nt, Mycobacterium tuberculosis H37Rv
gcacccgaucgacg

SEQ ID NO: 3279994 - RNA, 13 nt, Mycobacterium tuberculosis H37Rv
gcacccgcacggu

SEQ ID NO: 3279995 - RNA, 12 nt, Mycobacterium tuberculosis H37Rv
gcacccgcagcc

SEQ ID NO: 3279996 - RNA, 14 nt, Mycobacterium tuberculosis H37Rv
gcacccgcagccgc

SEQ ID NO: 3279997 - RNA, 20 nt, Mycobacterium tuberculosis H37Rv
gcacccgccagggcggcauc

SEQ ID NO: 3279998 - RNA, 14 nt, Mycobacterium tuberculosis H37Rv
gcacccgcgccagu

SEQ ID NO: 3279999 - RNA, 13 nt, Mycobacterium tuberculosis H37Rv
gcacccgcggcga

SEQ ID NO: 3280000 - RNA, 23 nt, Mycobacterium tuberculosis H37Rv
gcacccgcgggucguccggcggc

SEQ ID NO: 3280001 - RNA, 23 nt, Mycobacterium tuberculosis H37Rv
gcacccgcgucgagugccgccac

SEQ ID NO: 3280002 - RNA, 19 nt, Mycobacterium tuberculosis H37Rv
gcacccgcuccagcucggc

SEQ ID NO: 3280003 - RNA, 22 nt, Mycobacterium tuberculosis H37Rv
gcacccgcuccauaucgucggg

SEQ ID NO: 3280004 - RNA, 19 nt, Mycobacterium tuberculosis H37Rv
gcacccgcucggccgccgg

SEQ ID NO: 3280005 - RNA, 12 nt, Mycobacterium tuberculosis H37Rv
gcacccgcuggc

SEQ ID NO: 3280006 - RNA, 21 nt, Mycobacterium tuberculosis H37Rv
gcacccggaucuggugggugc

SEQ ID NO: 3280007 - RNA, 14 nt, Mycobacterium tuberculosis H37Rv
gcaccgccggccuu

SEQ ID NO: 3280008 - RNA, 16 nt, Mycobacterium tuberculosis H37Rv
gcaccgccggcgacgg

SEQ ID NO: 3280009 - RNA, 15 nt, Mycobacterium tuberculosis H37Rv
gcaccgccggcgccg

SEQ ID NO: 3280010 - RNA, 18 nt, Mycobacterium tuberculosis H37Rv
gcaccgccggcgccgccg

SEQ ID NO: 3280011 - RNA, 14 nt, Mycobacterium tuberculosis H37Rv
gcaccgccggcucc

SEQ ID NO: 3280012 - RNA, 14 nt, Mycobacterium tuberculosis H37Rv
gcaccgccgguggc

SEQ ID NO: 3280013 - RNA, 23 nt, Mycobacterium tuberculosis H37Rv
gcaccgccgguggcgccggggcc

SEQ ID NO: 3280014 - RNA, 13 nt, Mycobacterium tuberculosis H37Rv
gcaccgccugcgc

SEQ ID NO: 3280015 - RNA, 15 nt, Mycobacterium tuberculosis H37Rv
gcaccgcgacgacga

SEQ ID NO: 3280016 - RNA, 13 nt, Mycobacterium tuberculosis H37Rv
gcaccgcgccgaa

SEQ ID NO: 3280017 - RNA, 14 nt, Mycobacterium tuberculosis H37Rv
gcaccgcgccgcgc

SEQ ID NO: 3280018 - RNA, 17 nt, Mycobacterium tuberculosis H37Rv
gcaccgcgccggcggaa

SEQ ID NO: 3280019 - RNA, 22 nt, Mycobacterium tuberculosis H37Rv
gcaccgcggaccggcgucggcu

SEQ ID NO: 3280020 - RNA, 23 nt, Mycobacterium tuberculosis H37Rv
gcaccgcggauaggccgcgcggc

SEQ ID NO: 3280021 - RNA, 13 nt, Mycobacterium tuberculosis H37Rv
gcaccgcggccag

SEQ ID NO: 3280022 - RNA, 16 nt, Mycobacterium tuberculosis H37Rv
gcaccgcggccagcac

SEQ ID NO: 3280023 - RNA, 17 nt, Mycobacterium tuberculosis H37Rv
gcaccgcggccagcggg

SEQ ID NO: 3280024 - RNA, 23 nt, Mycobacterium tuberculosis H37Rv
gcaccgcggccagcgggaacaca

SEQ ID NO: 3280025 - RNA, 20 nt, Mycobacterium tuberculosis H37Rv
gcaccgcgguacgccggucg

SEQ ID NO: 3280026 - RNA, 19 nt, Mycobacterium tuberculosis H37Rv
gcaccgcgguggggucgac

SEQ ID NO: 3280027 - RNA, 14 nt, Mycobacterium tuberculosis H37Rv
gcaccgcgucguag

SEQ ID NO: 3280028 - RNA, 16 nt, Mycobacterium tuberculosis H37Rv
gcaccgcgucguagcc

SEQ ID NO: 3280029 - RNA, 20 nt, Mycobacterium tuberculosis H37Rv
gcaccgcguugaugaccgcc

SEQ ID NO: 3280030 - RNA, 20 nt, Mycobacterium tuberculosis H37Rv
gcaccgcugaccccggcagc

SEQ ID NO: 3280031 - RNA, 24 nt, Mycobacterium tuberculosis H37Rv
gcaccgcugaccccggcagcgccc

SEQ ID NO: 3280032 - RNA, 17 nt, Mycobacterium tuberculosis H37Rv
gcaccgcugaccgcaac

SEQ ID NO: 3280033 - RNA, 17 nt, Mycobacterium tuberculosis H37Rv
gcaccgcugccgcugcc

SEQ ID NO: 3280034 - RNA, 18 nt, Mycobacterium tuberculosis H37Rv
gcaccgcugccgcugccg

SEQ ID NO: 3280035 - RNA, 17 nt, Mycobacterium tuberculosis H37Rv
gcaccgcugcggccagc

SEQ ID NO: 3280036 - RNA, 21 nt, Mycobacterium tuberculosis H37Rv
gcaccgcugcggccagcgaug

SEQ ID NO: 3280037 - RNA, 14 nt, Mycobacterium tuberculosis H37Rv
gcaccgcuguugca

SEQ ID NO: 3280038 - RNA, 20 nt, Mycobacterium tuberculosis H37Rv
gcaccgcuguugcaucgccg

SEQ ID NO: 3280039 - RNA, 15 nt, Mycobacterium tuberculosis H37Rv
gcaccggaucgacca

SEQ ID NO: 3280040 - RNA, 15 nt, Mycobacterium tuberculosis H37Rv
gcaccggaucggcua

SEQ ID NO: 3280041 - RNA, 14 nt, Mycobacterium tuberculosis H37Rv
gcaccggccgugcc

SEQ ID NO: 3280042 - RNA, 21 nt, Mycobacterium tuberculosis H37Rv
gcaccggccgugccgccgaca

SEQ ID NO: 3280043 - RNA, 21 nt, Mycobacterium tuberculosis H37Rv
gcaccggcgaucguguccacc

SEQ ID NO: 3280044 - RNA, 17 nt, Mycobacterium tuberculosis H37Rv
gcaccggcgcaacucga

SEQ ID NO: 3280045 - RNA, 17 nt, Mycobacterium tuberculosis H37Rv
gcaccggcggcgccgaa

SEQ ID NO: 3280046 - RNA, 23 nt, Mycobacterium tuberculosis H37Rv
gcaccggcggcgccgaaaccgcc

SEQ ID NO: 3280047 - RNA, 22 nt, Mycobacterium tuberculosis H37Rv
gcaccggcggucugcagugcag

SEQ ID NO: 3280048 - RNA, 17 nt, Mycobacterium tuberculosis H37Rv
gcaccggcucgacugcc

SEQ ID NO: 3280049 - RNA, 17 nt, Mycobacterium tuberculosis H37Rv
gcaccggcugcggggcg

SEQ ID NO: 3280050 - RNA, 16 nt, Mycobacterium tuberculosis H37Rv
gcaccggcuugggcca

SEQ ID NO: 3280051 - RNA, 18 nt, Mycobacterium tuberculosis H37Rv
gcaccgggaugugcggcu

SEQ ID NO: 3280052 - RNA, 11 nt, Mycobacterium tuberculosis H37Rv
gcaccggggcu

SEQ ID NO: 3280053 - RNA, 15 nt, Mycobacterium tuberculosis H37Rv
gcaccggggcugccc

SEQ ID NO: 3280054 - RNA, 17 nt, Mycobacterium tuberculosis H37Rv
gcaccgggugcgacggc

SEQ ID NO: 3280055 - RNA, 20 nt, Mycobacterium tuberculosis H37Rv
gcaccggguugagccgccgc

SEQ ID NO: 3280056 - RNA, 23 nt, Mycobacterium tuberculosis H37Rv
gcaccgguauguucggcaaugac

SEQ ID NO: 3280057 - RNA, 21 nt, Mycobacterium tuberculosis H37Rv
gcaccggucgguuaauggguc

SEQ ID NO: 3280058 - RNA, 23 nt, Mycobacterium tuberculosis H37Rv
gcaccggucgguuaaugggucgg

SEQ ID NO: 3280059 - RNA, 17 nt, Mycobacterium tuberculosis H37Rv
gcaccggugauggugac

SEQ ID NO: 3280060 - RNA, 21 nt, Mycobacterium tuberculosis H37Rv
gcaccggugauggugaccagc

SEQ ID NO: 3280061 - RNA, 19 nt, Mycobacterium tuberculosis H37Rv
gcaccggugcccaccaccg

SEQ ID NO: 3280062 - RNA, 12 nt, Mycobacterium tuberculosis H37Rv
gcaccggugcuc

SEQ ID NO: 3280063 - RNA, 20 nt, Mycobacterium tuberculosis H37Rv
gcaccggugcucgucgagca

SEQ ID NO: 3280064 - RNA, 23 nt, Mycobacterium tuberculosis H37Rv
gcaccgguuugacguccagggcc

SEQ ID NO: 3280065 - RNA, 20 nt, Mycobacterium tuberculosis H37Rv
gcaccgguuuucgccggcuc

SEQ ID NO: 3280066 - RNA, 20 nt, Mycobacterium tuberculosis H37Rv
gcaccguagagcaugccgcc

SEQ ID NO: 3280067 - RNA, 17 nt, Mycobacterium tuberculosis H37Rv
gcaccguagccgcugca

SEQ ID NO: 3280068 - RNA, 21 nt, Mycobacterium tuberculosis H37Rv
gcaccguaguaguucagccag

SEQ ID NO: 3280069 - RNA, 14 nt, Mycobacterium tuberculosis H37Rv
gcaccgucccagug

SEQ ID NO: 3280070 - RNA, 15 nt, Mycobacterium tuberculosis H37Rv
gcaccguccucgguc

SEQ ID NO: 3280071 - RNA, 16 nt, Mycobacterium tuberculosis H37Rv
gcaccgucgcggguca

SEQ ID NO: 3280072 - RNA, 17 nt, Mycobacterium tuberculosis H37Rv
gcaccgucggcaccagc

SEQ ID NO: 3280073 - RNA, 21 nt, Mycobacterium tuberculosis H37Rv
gcaccgucggcaccagcagcc

SEQ ID NO: 3280074 - RNA, 18 nt, Mycobacterium tuberculosis H37Rv
gcaccgucgggcccagcc

SEQ ID NO: 3280075 - RNA, 23 nt, Mycobacterium tuberculosis H37Rv
gcaccgucgggcccagccggacc

SEQ ID NO: 3280076 - RNA, 13 nt, Mycobacterium tuberculosis H37Rv
gcaccgucgucac

SEQ ID NO: 3280077 - RNA, 17 nt, Mycobacterium tuberculosis H37Rv
gcaccgugacagcggca

SEQ ID NO: 3280078 - RNA, 18 nt, Mycobacterium tuberculosis H37Rv
gcaccgugacagcggcau

SEQ ID NO: 3280079 - RNA, 20 nt, Mycobacterium tuberculosis H37Rv
gcaccgugaguacucgguca

SEQ ID NO: 3280080 - RNA, 21 nt, Mycobacterium tuberculosis H37Rv
gcaccgugcggggggcagcuc

SEQ ID NO: 3280081 - RNA, 22 nt, Mycobacterium tuberculosis H37Rv
gcaccgugggcccuucacuguu

SEQ ID NO: 3280082 - RNA, 17 nt, Mycobacterium tuberculosis H37Rv
gcaccgugucuacgccg

SEQ ID NO: 3280083 - RNA, 20 nt, Mycobacterium tuberculosis H37Rv
gcaccguuaccgccgucgcc

SEQ ID NO: 3280084 - RNA, 23 nt, Mycobacterium tuberculosis H37Rv
gcaccguuguaugcugcgcgccg

SEQ ID NO: 3280085 - RNA, 21 nt, Mycobacterium tuberculosis H37Rv
gcaccguuuccggcgcuccgc

SEQ ID NO: 3280086 - RNA, 21 nt, Mycobacterium tuberculosis H37Rv
gcaccuccaccgcgccggcgg

SEQ ID NO: 3280087 - RNA, 15 nt, Mycobacterium tuberculosis H37Rv
gcaccuccagcacca

SEQ ID NO: 3280088 - RNA, 18 nt, Mycobacterium tuberculosis H37Rv
gcaccuccagcaccaccg

SEQ ID NO: 3280089 - RNA, 21 nt, Mycobacterium tuberculosis H37Rv
gcaccuccagcaccaccggaa

SEQ ID NO: 3280090 - RNA, 21 nt, Mycobacterium tuberculosis H37Rv
gcaccuccagguagucgcggu

SEQ ID NO: 3280091 - RNA, 14 nt, Mycobacterium tuberculosis H37Rv
gcaccuccgacggc

SEQ ID NO: 3280092 - RNA, 15 nt, Mycobacterium tuberculosis H37Rv
gcaccuccgccggca

SEQ ID NO: 3280093 - RNA, 13 nt, Mycobacterium tuberculosis H37Rv
gcaccuccguaac

SEQ ID NO: 3280094 - RNA, 13 nt, Mycobacterium tuberculosis H37Rv
gcaccucgaccgc

SEQ ID NO: 3280095 - RNA, 19 nt, Mycobacterium tuberculosis H37Rv
gcaccucgacgucgagcac

SEQ ID NO: 3280096 - RNA, 21 nt, Mycobacterium tuberculosis H37Rv
gcaccucgacgucgagcacgu

SEQ ID NO: 3280097 - RNA, 14 nt, Mycobacterium tuberculosis H37Rv
gcaccucgcccugc

SEQ ID NO: 3280098 - RNA, 15 nt, Mycobacterium tuberculosis H37Rv
gcaccucggccagcg

SEQ ID NO: 3280099 - RNA, 15 nt, Mycobacterium tuberculosis H37Rv
gcaccucggccagcu

SEQ ID NO: 3280100 - RNA, 15 nt, Mycobacterium tuberculosis H37Rv
gcaccucguguccgg

SEQ ID NO: 3280101 - RNA, 16 nt, Mycobacterium tuberculosis H37Rv
gcaccugccguuccgg

SEQ ID NO: 3280102 - RNA, 12 nt, Mycobacterium tuberculosis H37Rv
gcaccugggcgc

SEQ ID NO: 3280103 - RNA, 19 nt, Mycobacterium tuberculosis H37Rv
gcacggaugcgauggccga

SEQ ID NO: 3280104 - RNA, 16 nt, Mycobacterium tuberculosis H37Rv
gcacggaugucgccca

SEQ ID NO: 3280105 - RNA, 19 nt, Mycobacterium tuberculosis H37Rv
gcacggcaaccagcgagcc

SEQ ID NO: 3280106 - RNA, 22 nt, Mycobacterium tuberculosis H37Rv
gcacggcacccacccguucggc

SEQ ID NO: 3280107 - RNA, 19 nt, Mycobacterium tuberculosis H37Rv
gcacggcagacacgcugca

SEQ ID NO: 3280108 - RNA, 23 nt, Mycobacterium tuberculosis H37Rv
gcacggccaugaucacaccgcug

SEQ ID NO: 3280109 - RNA, 16 nt, Mycobacterium tuberculosis H37Rv
gcacggccccugccac

SEQ ID NO: 3280110 - RNA, 14 nt, Mycobacterium tuberculosis H37Rv
gcacggccgcagcc

SEQ ID NO: 3280111 - RNA, 13 nt, Mycobacterium tuberculosis H37Rv
gcacggccgggac

SEQ ID NO: 3280112 - RNA, 14 nt, Mycobacterium tuberculosis H37Rv
gcacggccgggacg

SEQ ID NO: 3280113 - RNA, 18 nt, Mycobacterium tuberculosis H37Rv
gcacggccgggacggcga

SEQ ID NO: 3280114 - RNA, 19 nt, Mycobacterium tuberculosis H37Rv
gcacggccgggacggcgau

SEQ ID NO: 3280115 - RNA, 19 nt, Mycobacterium tuberculosis H37Rv
gcacggccgucgacgauca

SEQ ID NO: 3280116 - RNA, 20 nt, Mycobacterium tuberculosis H37Rv
gcacggccgucgacgaucag

SEQ ID NO: 3280117 - RNA, 20 nt, Mycobacterium tuberculosis H37Rv
gcacggcgaaugcauuggcg

SEQ ID NO: 3280118 - RNA, 17 nt, Mycobacterium tuberculosis H37Rv
gcacggcgaggugcucg

SEQ ID NO: 3280119 - RNA, 14 nt, Mycobacterium tuberculosis H37Rv
gcacggcgccgacc

SEQ ID NO: 3280120 - RNA, 23 nt, Mycobacterium tuberculosis H37Rv
gcacggcggccacguccucagcc

SEQ ID NO: 3280121 - RNA, 16 nt, Mycobacterium tuberculosis H37Rv
gcacggcggccagggu

SEQ ID NO: 3280122 - RNA, 17 nt, Mycobacterium tuberculosis H37Rv
gcacggcgucggccacc

SEQ ID NO: 3280123 - RNA, 19 nt, Mycobacterium tuberculosis H37Rv
gcacggcguggaugcccgg

SEQ ID NO: 3280124 - RNA, 22 nt, Mycobacterium tuberculosis H37Rv
gcacggcuuuucgacgcugugg

SEQ ID NO: 3280125 - RNA, 13 nt, Mycobacterium tuberculosis H37Rv
gcacgggaaucgc

SEQ ID NO: 3280126 - RNA, 18 nt, Mycobacterium tuberculosis H37Rv
gcacgggcacgaucgucg

SEQ ID NO: 3280127 - RNA, 19 nt, Mycobacterium tuberculosis H37Rv
gcacgggcgaccugcggac

SEQ ID NO: 3280128 - RNA, 19 nt, Mycobacterium tuberculosis H37Rv
gcacggggaccuuggcgac

SEQ ID NO: 3280129 - RNA, 19 nt, Mycobacterium tuberculosis H37Rv
gcacggguaaucaccgaau

SEQ ID NO: 3280130 - RNA, 14 nt, Mycobacterium tuberculosis H37Rv
gcacgguaucggug

SEQ ID NO: 3280131 - RNA, 15 nt, Mycobacterium tuberculosis H37Rv
gcacggucaacgauc

SEQ ID NO: 3280132 - RNA, 19 nt, Mycobacterium tuberculosis H37Rv
gcacggucgcccgaucggc

SEQ ID NO: 3280133 - RNA, 20 nt, Mycobacterium tuberculosis H37Rv
gcacggucgcccgaucggcg

SEQ ID NO: 3280134 - RNA, 22 nt, Mycobacterium tuberculosis H37Rv
gcacggucgcccgaucggcgga

SEQ ID NO: 3280135 - RNA, 16 nt, Mycobacterium tuberculosis H37Rv
gcacggugaccacgcc

SEQ ID NO: 3280136 - RNA, 15 nt, Mycobacterium tuberculosis H37Rv
gcacggugcccaggg

SEQ ID NO: 3280137 - RNA, 13 nt, Mycobacterium tuberculosis H37Rv
gcacgguggcuuc

SEQ ID NO: 3280138 - RNA, 17 nt, Mycobacterium tuberculosis H37Rv
gcacggugggcgcuggg

SEQ ID NO: 3280139 - RNA, 13 nt, Mycobacterium tuberculosis H37Rv
gcacgguguacgc

SEQ ID NO: 3280140 - RNA, 14 nt, Mycobacterium tuberculosis H37Rv
gcacgguguauccg

SEQ ID NO: 3280141 - RNA, 16 nt, Mycobacterium tuberculosis H37Rv
gcacggugucgcgcga

SEQ ID NO: 3280142 - RNA, 20 nt, Mycobacterium tuberculosis H37Rv
gcacggugugcacggcgaau

SEQ ID NO: 3280143 - RNA, 17 nt, Mycobacterium tuberculosis H37Rv
gcacgguugccgucagg

SEQ ID NO: 3280144 - RNA, 14 nt, Mycobacterium tuberculosis H37Rv
gcacguaacccagu

SEQ ID NO: 3280145 - RNA, 22 nt, Mycobacterium tuberculosis H37Rv
gcacguaacgccgcucauccag

SEQ ID NO: 3280146 - RNA, 16 nt, Mycobacterium tuberculosis H37Rv
gcacguacucggccag

SEQ ID NO: 3280147 - RNA, 19 nt, Mycobacterium tuberculosis H37Rv
gcacguauccacggucgac

SEQ ID NO: 3280148 - RNA, 12 nt, Mycobacterium tuberculosis H37Rv
gcacgucaaccu

SEQ ID NO: 3280149 - RNA, 17 nt, Mycobacterium tuberculosis H37Rv
gcacgucaaccucgcca

SEQ ID NO: 3280150 - RNA, 22 nt, Mycobacterium tuberculosis H37Rv
gcacgucacgcaaccggcggac

SEQ ID NO: 3280151 - RNA, 18 nt, Mycobacterium tuberculosis H37Rv
gcacgucaucggcuggcc

SEQ ID NO: 3280152 - RNA, 19 nt, Mycobacterium tuberculosis H37Rv
gcacguccgcggagcucaa

SEQ ID NO: 3280153 - RNA, 19 nt, Mycobacterium tuberculosis H37Rv
gcacgucgaaaucggugca

SEQ ID NO: 3280154 - RNA, 20 nt, Mycobacterium tuberculosis H37Rv
gcacgucgaaaucggugcac

SEQ ID NO: 3280155 - RNA, 21 nt, Mycobacterium tuberculosis H37Rv
gcacgucgaaaucggugcaca

SEQ ID NO: 3280156 - RNA, 19 nt, Mycobacterium tuberculosis H37Rv
gcacgucgaccucggcaac

SEQ ID NO: 3280157 - RNA, 20 nt, Mycobacterium tuberculosis H37Rv
gcacgucgaccucggcaacc

SEQ ID NO: 3280158 - RNA, 16 nt, Mycobacterium tuberculosis H37Rv
gcacgucgcauugugc

SEQ ID NO: 3280159 - RNA, 22 nt, Mycobacterium tuberculosis H37Rv
gcacgucggcccauaacagcug

SEQ ID NO: 3280160 - RNA, 16 nt, Mycobacterium tuberculosis H37Rv
gcacgucggcugccgc

SEQ ID NO: 3280161 - RNA, 17 nt, Mycobacterium tuberculosis H37Rv
gcacgucggcugccgca

SEQ ID NO: 3280162 - RNA, 19 nt, Mycobacterium tuberculosis H37Rv
gcacgucggcugccgcaaa

SEQ ID NO: 3280163 - RNA, 14 nt, Mycobacterium tuberculosis H37Rv
gcacgucuugcugc

SEQ ID NO: 3280164 - RNA, 15 nt, Mycobacterium tuberculosis H37Rv
gcacguggccacggc

SEQ ID NO: 3280165 - RNA, 18 nt, Mycobacterium tuberculosis H37Rv
gcacguucacgcgcggau

SEQ ID NO: 3280166 - RNA, 20 nt, Mycobacterium tuberculosis H37Rv
gcacguucacgcgcggaucg

SEQ ID NO: 3280167 - RNA, 15 nt, Mycobacterium tuberculosis H37Rv
gcacguugacgucca

SEQ ID NO: 3280168 - RNA, 17 nt, Mycobacterium tuberculosis H37Rv
gcacguugauccgcgca

SEQ ID NO: 3280169 - RNA, 21 nt, Mycobacterium tuberculosis H37Rv
gcacguugauccgcgcaacuu

SEQ ID NO: 3280170 - RNA, 16 nt, Mycobacterium tuberculosis H37Rv
gcacguugucgggcug

SEQ ID NO: 3280171 - RNA, 18 nt, Mycobacterium tuberculosis H37Rv
gcacguugugaucgucag

SEQ ID NO: 3280172 - RNA, 16 nt, Mycobacterium tuberculosis H37Rv
gcacguuuacauagac

SEQ ID NO: 3280173 - RNA, 23 nt, Mycobacterium tuberculosis H37Rv
gcacuaccccacaagcgauggca

SEQ ID NO: 3280174 - RNA, 18 nt, Mycobacterium tuberculosis H37Rv
gcacucagcaggggaucg

SEQ ID NO: 3280175 - RNA, 18 nt, Mycobacterium tuberculosis H37Rv
gcacucaucgaggcgaaa

SEQ ID NO: 3280176 - RNA, 23 nt, Mycobacterium tuberculosis H37Rv
gcacucaugaugccggacgccau

SEQ ID NO: 3280177 - RNA, 16 nt, Mycobacterium tuberculosis H37Rv
gcacuccaccgcuggc

SEQ ID NO: 3280178 - RNA, 16 nt, Mycobacterium tuberculosis H37Rv
gcacuccacgaucggc

SEQ ID NO: 3280179 - RNA, 22 nt, Mycobacterium tuberculosis H37Rv
gcacuccacgaucggcccagcc

SEQ ID NO: 3280180 - RNA, 17 nt, Mycobacterium tuberculosis H37Rv
gcacucccggaguggcc

SEQ ID NO: 3280181 - RNA, 18 nt, Mycobacterium tuberculosis H37Rv
gcacuccggagcccacac

SEQ ID NO: 3280182 - RNA, 12 nt, Mycobacterium tuberculosis H37Rv
gcacucgaccag

SEQ ID NO: 3280183 - RNA, 19 nt, Mycobacterium tuberculosis H37Rv
gcacucgggauucggcagc

SEQ ID NO: 3280184 - RNA, 17 nt, Mycobacterium tuberculosis H37Rv
gcacucggggcugucgg

SEQ ID NO: 3280185 - RNA, 20 nt, Mycobacterium tuberculosis H37Rv
gcacucggggcugucggcga

SEQ ID NO: 3280186 - RNA, 20 nt, Mycobacterium tuberculosis H37Rv
gcacugaugucacccgcccg

SEQ ID NO: 3280187 - RNA, 21 nt, Mycobacterium tuberculosis H37Rv
gcacugaugucacccgcccga

SEQ ID NO: 3280188 - RNA, 17 nt, Mycobacterium tuberculosis H37Rv
gcacugcccagcagacc

SEQ ID NO: 3280189 - RNA, 15 nt, Mycobacterium tuberculosis H37Rv
gcacugccccgcauc

SEQ ID NO: 3280190 - RNA, 17 nt, Mycobacterium tuberculosis H37Rv
gcacugccccgcaucgc

SEQ ID NO: 3280191 - RNA, 16 nt, Mycobacterium tuberculosis H37Rv
gcacugcccggggugc

SEQ ID NO: 3280192 - RNA, 16 nt, Mycobacterium tuberculosis H37Rv
gcacugccgggugggc

SEQ ID NO: 3280193 - RNA, 16 nt, Mycobacterium tuberculosis H37Rv
gcacugcggcagcgaa

SEQ ID NO: 3280194 - RNA, 13 nt, Mycobacterium tuberculosis H37Rv
gcacugcggccag

SEQ ID NO: 3280195 - RNA, 14 nt, Mycobacterium tuberculosis H37Rv
gcacuggcccccac

SEQ ID NO: 3280196 - RNA, 12 nt, Mycobacterium tuberculosis H37Rv
gcacuggccccg

SEQ ID NO: 3280197 - RNA, 13 nt, Mycobacterium tuberculosis H37Rv
gcacuggccccgg

SEQ ID NO: 3280198 - RNA, 15 nt, Mycobacterium tuberculosis H37Rv
gcacugggaugaguu

SEQ ID NO: 3280199 - RNA, 22 nt, Mycobacterium tuberculosis H37Rv
gcagaucgaaaucagcccgcgc

SEQ ID NO: 3280200 - RNA, 18 nt, Mycobacterium tuberculosis H37Rv
gcagaucgauaccgucgu

SEQ ID NO: 3280201 - RNA, 12 nt, Mycobacterium tuberculosis H37Rv
gcagaucgcccc

SEQ ID NO: 3280202 - RNA, 15 nt, Mycobacterium tuberculosis H37Rv
gcagaucggccggau

SEQ ID NO: 3280203 - RNA, 19 nt, Mycobacterium tuberculosis H37Rv
gcagaucguccaccgccga

SEQ ID NO: 3280204 - RNA, 21 nt, Mycobacterium tuberculosis H37Rv
gcagaugaauugccgggcgca

SEQ ID NO: 3280205 - RNA, 15 nt, Mycobacterium tuberculosis H37Rv
gcagaugaugccguu

SEQ ID NO: 3280206 - RNA, 23 nt, Mycobacterium tuberculosis H37Rv
gcagaugcggcugaauucggcga

SEQ ID NO: 3280207 - RNA, 21 nt, Mycobacterium tuberculosis H37Rv
gcagauggcgaggucggugag

SEQ ID NO: 3280208 - RNA, 17 nt, Mycobacterium tuberculosis H37Rv
gcagaugggccuccacc

SEQ ID NO: 3280209 - RNA, 23 nt, Mycobacterium tuberculosis H37Rv
gcagauuccucuucaggcccucg

SEQ ID NO: 3280210 - RNA, 17 nt, Mycobacterium tuberculosis H37Rv
gcagauuugcuccagcg

SEQ ID NO: 3280211 - RNA, 22 nt, Mycobacterium tuberculosis H37Rv
gcagcaaaaacgcugccgccgu

SEQ ID NO: 3280212 - RNA, 12 nt, Mycobacterium tuberculosis H37Rv
gcagcaacaccu

SEQ ID NO: 3280213 - RNA, 21 nt, Mycobacterium tuberculosis H37Rv
gcagcaacgcggugccgggau

SEQ ID NO: 3280214 - RNA, 15 nt, Mycobacterium tuberculosis H37Rv
gcagcaacucgacgu

SEQ ID NO: 3280215 - RNA, 18 nt, Mycobacterium tuberculosis H37Rv
gcagcaacugggcggccu

SEQ ID NO: 3280216 - RNA, 21 nt, Mycobacterium tuberculosis H37Rv
gcagcaacugggcggccuggu

SEQ ID NO: 3280217 - RNA, 17 nt, Mycobacterium tuberculosis H37Rv
gcagcaagccgccggug

SEQ ID NO: 3280218 - RNA, 18 nt, Mycobacterium tuberculosis H37Rv
gcagcaaucagccgccuu

SEQ ID NO: 3280219 - RNA, 21 nt, Mycobacterium tuberculosis H37Rv
gcagcacaggcuggcgauggc

SEQ ID NO: 3280220 - RNA, 22 nt, Mycobacterium tuberculosis H37Rv
gcagcacauacgauuucgacga

SEQ ID NO: 3280221 - RNA, 13 nt, Mycobacterium tuberculosis H37Rv
gcagcaccagcca

SEQ ID NO: 3280222 - RNA, 16 nt, Mycobacterium tuberculosis H37Rv
gcagcaccagcgccuu

SEQ ID NO: 3280223 - RNA, 23 nt, Mycobacterium tuberculosis H37Rv
gcagcacccacaucagccgcacc

SEQ ID NO: 3280224 - RNA, 13 nt, Mycobacterium tuberculosis H37Rv
gcagcacccccuc

SEQ ID NO: 3280225 - RNA, 22 nt, Mycobacterium tuberculosis H37Rv
gcagcacccccucggcuucgga

SEQ ID NO: 3280226 - RNA, 13 nt, Mycobacterium tuberculosis H37Rv
gcagcacccgggc

SEQ ID NO: 3280227 - RNA, 13 nt, Mycobacterium tuberculosis H37Rv
gcagcaccgacgu

SEQ ID NO: 3280228 - RNA, 20 nt, Mycobacterium tuberculosis H37Rv
gcagcaccgacgugauggug

SEQ ID NO: 3280229 - RNA, 13 nt, Mycobacterium tuberculosis H37Rv
gcagcaccgguga

SEQ ID NO: 3280230 - RNA, 16 nt, Mycobacterium tuberculosis H37Rv
gcagcaccggugaccu

SEQ ID NO: 3280231 - RNA, 14 nt, Mycobacterium tuberculosis H37Rv
gcagcaccgucggg

SEQ ID NO: 3280232 - RNA, 21 nt, Mycobacterium tuberculosis H37Rv
gcagcaccgucgggcccagcc

SEQ ID NO: 3280233 - RNA, 16 nt, Mycobacterium tuberculosis H37Rv
gcagcacgaccugguu

SEQ ID NO: 3280234 - RNA, 17 nt, Mycobacterium tuberculosis H37Rv
gcagcacgauccagcug

SEQ ID NO: 3280235 - RNA, 13 nt, Mycobacterium tuberculosis H37Rv
gcagcacgcgugg

SEQ ID NO: 3280236 - RNA, 16 nt, Mycobacterium tuberculosis H37Rv
gcagcacggucugggu

SEQ ID NO: 3280237 - RNA, 14 nt, Mycobacterium tuberculosis H37Rv
gcagcacgucaacc

SEQ ID NO: 3280238 - RNA, 13 nt, Mycobacterium tuberculosis H37Rv
gcagcacguccgc

SEQ ID NO: 3280239 - RNA, 16 nt, Mycobacterium tuberculosis H37Rv
gcagcacguccgcgga

SEQ ID NO: 3280240 - RNA, 23 nt, Mycobacterium tuberculosis H37Rv
gcagcacgucugcguccacguga

SEQ ID NO: 3280241 - RNA, 15 nt, Mycobacterium tuberculosis H37Rv
gcagcacucgguguc

SEQ ID NO: 3280242 - RNA, 17 nt, Mycobacterium tuberculosis H37Rv
gcagcacucuucgauga

SEQ ID NO: 3280243 - RNA, 19 nt, Mycobacterium tuberculosis H37Rv
gcagcacuuccaagccgac

SEQ ID NO: 3280244 - RNA, 21 nt, Mycobacterium tuberculosis H37Rv
gcagcacuuccaagccgaccu

SEQ ID NO: 3280245 - RNA, 22 nt, Mycobacterium tuberculosis H37Rv
gcagcacuuccaagccgaccug

SEQ ID NO: 3280246 - RNA, 18 nt, Mycobacterium tuberculosis H37Rv
gcagcacuuggacccggc

SEQ ID NO: 3280247 - RNA, 21 nt, Mycobacterium tuberculosis H37Rv
gcagcacuuggacccggccgg

SEQ ID NO: 3280248 - RNA, 20 nt, Mycobacterium tuberculosis H37Rv
gcagcagaaacggcgacucg

SEQ ID NO: 3280249 - RNA, 15 nt, Mycobacterium tuberculosis H37Rv
gcagcagacccggug

SEQ ID NO: 3280250 - RNA, 19 nt, Mycobacterium tuberculosis H37Rv
gcagcagacccgguggcgu

SEQ ID NO: 3280251 - RNA, 16 nt, Mycobacterium tuberculosis H37Rv
gcagcagacgacgauc

SEQ ID NO: 3280252 - RNA, 19 nt, Mycobacterium tuberculosis H37Rv
gcagcagauugaugucagg

SEQ ID NO: 3280253 - RNA, 15 nt, Mycobacterium tuberculosis H37Rv
gcagcagcagcuucg

SEQ ID NO: 3280254 - RNA, 14 nt, Mycobacterium tuberculosis H37Rv
gcagcagcccgggc

SEQ ID NO: 3280255 - RNA, 15 nt, Mycobacterium tuberculosis H37Rv
gcagcagcgccgcgu

SEQ ID NO: 3280256 - RNA, 15 nt, Mycobacterium tuberculosis H37Rv
gcagcagcggcggcg

SEQ ID NO: 3280257 - RNA, 13 nt, Mycobacterium tuberculosis H37Rv
gcagcagcgggcu

SEQ ID NO: 3280258 - RNA, 17 nt, Mycobacterium tuberculosis H37Rv
gcagcagcggugcagcc

SEQ ID NO: 3280259 - RNA, 22 nt, Mycobacterium tuberculosis H37Rv
gcagcagcgugaccaccgccga

SEQ ID NO: 3280260 - RNA, 23 nt, Mycobacterium tuberculosis H37Rv
gcagcagcgugaccaccgccgac

SEQ ID NO: 3280261 - RNA, 13 nt, Mycobacterium tuberculosis H37Rv
gcagcagcugguc

SEQ ID NO: 3280262 - RNA, 19 nt, Mycobacterium tuberculosis H37Rv
gcagcagcuucggacuggg

SEQ ID NO: 3280263 - RNA, 12 nt, Mycobacterium tuberculosis H37Rv
gcagcaggacac

SEQ ID NO: 3280264 - RNA, 17 nt, Mycobacterium tuberculosis H37Rv
gcagcaggcgaugcgcc

SEQ ID NO: 3280265 - RNA, 22 nt, Mycobacterium tuberculosis H37Rv
gcagcagggcgcgcaucugcuc

SEQ ID NO: 3280266 - RNA, 20 nt, Mycobacterium tuberculosis H37Rv
gcagcaggggacgaccaugc

SEQ ID NO: 3280267 - RNA, 21 nt, Mycobacterium tuberculosis H37Rv
gcagcaggucgaugcugccag

SEQ ID NO: 3280268 - RNA, 13 nt, Mycobacterium tuberculosis H37Rv
gcagcagugccgu

SEQ ID NO: 3280269 - RNA, 22 nt, Mycobacterium tuberculosis H37Rv
gcagcagugcgaacucaucgug

SEQ ID NO: 3280270 - RNA, 14 nt, Mycobacterium tuberculosis H37Rv
gcagcauauccgcc

SEQ ID NO: 3280271 - RNA, 15 nt, Mycobacterium tuberculosis H37Rv
gcagcaucacguccg

SEQ ID NO: 3280272 - RNA, 15 nt, Mycobacterium tuberculosis H37Rv
gcagcauccggccgu

SEQ ID NO: 3280273 - RNA, 20 nt, Mycobacterium tuberculosis H37Rv
gcagcaucggcacgucguug

SEQ ID NO: 3280274 - RNA, 18 nt, Mycobacterium tuberculosis H37Rv
gcagcaucggcgacagga

SEQ ID NO: 3280275 - RNA, 14 nt, Mycobacterium tuberculosis H37Rv
gcagcaucgucgcc

SEQ ID NO: 3280276 - RNA, 17 nt, Mycobacterium tuberculosis H37Rv
gcagcaucuccgucggc

SEQ ID NO: 3280277 - RNA, 23 nt, Mycobacterium tuberculosis H37Rv
gcagcaucuccgucggccaggcc

SEQ ID NO: 3280278 - RNA, 15 nt, Mycobacterium tuberculosis H37Rv
gcagcauggccaucg

SEQ ID NO: 3280279 - RNA, 16 nt, Mycobacterium tuberculosis H37Rv
gcagcauggcccuggc

SEQ ID NO: 3280280 - RNA, 19 nt, Mycobacterium tuberculosis H37Rv
gcagccaagcgagcggcga

SEQ ID NO: 3280281 - RNA, 16 nt, Mycobacterium tuberculosis H37Rv
gcagccaaugccggau

SEQ ID NO: 3280282 - RNA, 20 nt, Mycobacterium tuberculosis H37Rv
gcagccaccgucaugccgac

SEQ ID NO: 3280283 - RNA, 23 nt, Mycobacterium tuberculosis H37Rv
gcagccagauucauuggccuggc

SEQ ID NO: 3280284 - RNA, 12 nt, Mycobacterium tuberculosis H37Rv
gcagccagcaac

SEQ ID NO: 3280285 - RNA, 15 nt, Mycobacterium tuberculosis H37Rv
gcagccagccaccga

SEQ ID NO: 3280286 - RNA, 18 nt, Mycobacterium tuberculosis H37Rv
gcagccagccaccgaucg

SEQ ID NO: 3280287 - RNA, 21 nt, Mycobacterium tuberculosis H37Rv
gcagccagcguccauggucgc

SEQ ID NO: 3280288 - RNA, 16 nt, Mycobacterium tuberculosis H37Rv
gcagccaggagccgau

SEQ ID NO: 3280289 - RNA, 17 nt, Mycobacterium tuberculosis H37Rv
gcagccagggcgccgaa

SEQ ID NO: 3280290 - RNA, 19 nt, Mycobacterium tuberculosis H37Rv
gcagcccaaagcgccagca

SEQ ID NO: 3280291 - RNA, 18 nt, Mycobacterium tuberculosis H37Rv
gcagccccuccgcgccga

SEQ ID NO: 3280292 - RNA, 23 nt, Mycobacterium tuberculosis H37Rv
gcagccccuccgcgccgaucagc

SEQ ID NO: 3280293 - RNA, 14 nt, Mycobacterium tuberculosis H37Rv
gcagccccucgucg

SEQ ID NO: 3280294 - RNA, 15 nt, Mycobacterium tuberculosis H37Rv
gcagccccugccgau

SEQ ID NO: 3280295 - RNA, 13 nt, Mycobacterium tuberculosis H37Rv
gcagcgcggaugu

SEQ ID NO: 3280296 - RNA, 20 nt, Mycobacterium tuberculosis H37Rv
gcagcgcggaugucggcauc

SEQ ID NO: 3280297 - RNA, 20 nt, Mycobacterium tuberculosis H37Rv
gcagcgcggccacccgcgac

SEQ ID NO: 3280298 - RNA, 22 nt, Mycobacterium tuberculosis H37Rv
gcagcgcggccacccgcgacga

SEQ ID NO: 3280299 - RNA, 17 nt, Mycobacterium tuberculosis H37Rv
gcagcgcggccagagcc

SEQ ID NO: 3280300 - RNA, 22 nt, Mycobacterium tuberculosis H37Rv
gcagcgcggccagagccgcgcg

SEQ ID NO: 3280301 - RNA, 16 nt, Mycobacterium tuberculosis H37Rv
gcagcgcggccgggcg

SEQ ID NO: 3280302 - RNA, 20 nt, Mycobacterium tuberculosis H37Rv
gcagcgcggcuggggccccg

SEQ ID NO: 3280303 - RNA, 13 nt, Mycobacterium tuberculosis H37Rv
gcagcgcgucgcc

SEQ ID NO: 3280304 - RNA, 15 nt, Mycobacterium tuberculosis H37Rv
gcagcgcgucgccga

SEQ ID NO: 3280305 - RNA, 22 nt, Mycobacterium tuberculosis H37Rv
gcagcgcgucgccgaaagccuu

SEQ ID NO: 3280306 - RNA, 16 nt, Mycobacterium tuberculosis H37Rv
gcagcgcugcgaugga

SEQ ID NO: 3280307 - RNA, 12 nt, Mycobacterium tuberculosis H37Rv
gcagcgcuggcu

SEQ ID NO: 3280308 - RNA, 17 nt, Mycobacterium tuberculosis H37Rv
gcagcgcuucggcgguc

SEQ ID NO: 3280309 - RNA, 21 nt, Mycobacterium tuberculosis H37Rv
gcagcgcuucggcggucgccg

SEQ ID NO: 3280310 - RNA, 18 nt, Mycobacterium tuberculosis H37Rv
gcagcggaccgcugccug

SEQ ID NO: 3280311 - RNA, 21 nt, Mycobacterium tuberculosis H37Rv
gcagcggcacgucggcgccga

SEQ ID NO: 3280312 - RNA, 21 nt, Mycobacterium tuberculosis H37Rv
gcagcggcauccacaccgacc

SEQ ID NO: 3280313 - RNA, 12 nt, Mycobacterium tuberculosis H37Rv
gcagcggccagc

SEQ ID NO: 3280314 - RNA, 18 nt, Mycobacterium tuberculosis H37Rv
gcagcggccagcccagcc

SEQ ID NO: 3280315 - RNA, 18 nt, Mycobacterium tuberculosis H37Rv
gcagcggccugaccggcu

SEQ ID NO: 3280316 - RNA, 20 nt, Mycobacterium tuberculosis H37Rv
gcagcggcgcauaggcggcc

SEQ ID NO: 3280317 - RNA, 14 nt, Mycobacterium tuberculosis H37Rv
gcagcggcgccgcc

SEQ ID NO: 3280318 - RNA, 14 nt, Mycobacterium tuberculosis H37Rv
gcagcggcgcgcug

SEQ ID NO: 3280319 - RNA, 13 nt, Mycobacterium tuberculosis H37Rv
gcagcggcgcggu

SEQ ID NO: 3280320 - RNA, 14 nt, Mycobacterium tuberculosis H37Rv
gcagcggcggaagg

SEQ ID NO: 3280321 - RNA, 21 nt, Mycobacterium tuberculosis H37Rv
gcagcggcggaaggacggcag

SEQ ID NO: 3280322 - RNA, 14 nt, Mycobacterium tuberculosis H37Rv
gcagcggcgggcga

SEQ ID NO: 3280323 - RNA, 15 nt, Mycobacterium tuberculosis H37Rv
gcagcggcgucgucg

SEQ ID NO: 3280324 - RNA, 19 nt, Mycobacterium tuberculosis H37Rv
gcagcggcgucgucgucga

SEQ ID NO: 3280325 - RNA, 15 nt, Mycobacterium tuberculosis H37Rv
gcagcgggcgcgcua

SEQ ID NO: 3280326 - RNA, 15 nt, Mycobacterium tuberculosis H37Rv
gcagcgggcgguguc

SEQ ID NO: 3280327 - RNA, 18 nt, Mycobacterium tuberculosis H37Rv
gcagcgggucgccgggcc

SEQ ID NO: 3280328 - RNA, 18 nt, Mycobacterium tuberculosis H37Rv
gcagcggguugcggucac

SEQ ID NO: 3280329 - RNA, 19 nt, Mycobacterium tuberculosis H37Rv
gcagcggguuugccgggcg

SEQ ID NO: 3280330 - RNA, 22 nt, Mycobacterium tuberculosis H37Rv
gcagcgguaagcgcaucgagca

SEQ ID NO: 3280331 - RNA, 19 nt, Mycobacterium tuberculosis H37Rv
gcagcgguccagacaucag

SEQ ID NO: 3280332 - RNA, 16 nt, Mycobacterium tuberculosis H37Rv
gcagcgguccgccgcc

SEQ ID NO: 3280333 - RNA, 18 nt, Mycobacterium tuberculosis H37Rv
gcagcgguccgccgccuu

SEQ ID NO: 3280334 - RNA, 15 nt, Mycobacterium tuberculosis H37Rv
gcagcggugcagccc

SEQ ID NO: 3280335 - RNA, 18 nt, Mycobacterium tuberculosis H37Rv
gcagcggugcagcccgcc

SEQ ID NO: 3280336 - RNA, 16 nt, Mycobacterium tuberculosis H37Rv
gcagcgguggcccgcc

SEQ ID NO: 3280337 - RNA, 22 nt, Mycobacterium tuberculosis H37Rv
gcagcgguggcuugccccgccg

SEQ ID NO: 3280338 - RNA, 21 nt, Mycobacterium tuberculosis H37Rv
gcagcgguugaugcggccgcg

SEQ ID NO: 3280339 - RNA, 15 nt, Mycobacterium tuberculosis H37Rv
gcagcguccagcgcc

SEQ ID NO: 3280340 - RNA, 16 nt, Mycobacterium tuberculosis H37Rv
gcagcguccgaaccac

SEQ ID NO: 3280341 - RNA, 19 nt, Mycobacterium tuberculosis H37Rv
gcagcgucggugccaccac

SEQ ID NO: 3280342 - RNA, 17 nt, Mycobacterium tuberculosis H37Rv
gcagcgucgucgacgac

SEQ ID NO: 3280343 - RNA, 19 nt, Mycobacterium tuberculosis H37Rv
gcagcgucgucuagcggga

SEQ ID NO: 3280344 - RNA, 14 nt, Mycobacterium tuberculosis H37Rv
gcagcgugaccacc

SEQ ID NO: 3280345 - RNA, 15 nt, Mycobacterium tuberculosis H37Rv
gcagcgugaccaccg

SEQ ID NO: 3280346 - RNA, 19 nt, Mycobacterium tuberculosis H37Rv
gcagcgugaucuggccacg

SEQ ID NO: 3280347 - RNA, 20 nt, Mycobacterium tuberculosis H37Rv
gcagcgugcagcggcgggcg

SEQ ID NO: 3280348 - RNA, 15 nt, Mycobacterium tuberculosis H37Rv
gcagcgugggcagcg

SEQ ID NO: 3280349 - RNA, 21 nt, Mycobacterium tuberculosis H37Rv
gcagcgugugcucgugggcga

SEQ ID NO: 3280350 - RNA, 22 nt, Mycobacterium tuberculosis H37Rv
gcagcguugacggucagccgcg

SEQ ID NO: 3280351 - RNA, 14 nt, Mycobacterium tuberculosis H37Rv
gcagcguuggccgc

SEQ ID NO: 3280352 - RNA, 16 nt, Mycobacterium tuberculosis H37Rv
gcagcguuggccgcug

SEQ ID NO: 3280353 - RNA, 15 nt, Mycobacterium tuberculosis H37Rv
gcagcuagcccggca

SEQ ID NO: 3280354 - RNA, 17 nt, Mycobacterium tuberculosis H37Rv
gcagcuagcccggcagc

SEQ ID NO: 3280355 - RNA, 15 nt, Mycobacterium tuberculosis H37Rv
gcagcucaccgacgg

SEQ ID NO: 3280356 - RNA, 13 nt, Mycobacterium tuberculosis H37Rv
gcagcuccccgac

SEQ ID NO: 3280357 - RNA, 16 nt, Mycobacterium tuberculosis H37Rv
gcagcuccccgccgga

SEQ ID NO: 3280358 - RNA, 19 nt, Mycobacterium tuberculosis H37Rv
gcagcucccgccacgucgc

SEQ ID NO: 3280359 - RNA, 22 nt, Mycobacterium tuberculosis H37Rv
gcagcucccgccacgucgccgg

SEQ ID NO: 3280360 - RNA, 14 nt, Mycobacterium tuberculosis H37Rv
gcagcuccguggug

SEQ ID NO: 3280361 - RNA, 14 nt, Mycobacterium tuberculosis H37Rv
gcagcucgaccagg

SEQ ID NO: 3280362 - RNA, 17 nt, Mycobacterium tuberculosis H37Rv
gcagcucgauacccagg

SEQ ID NO: 3280363 - RNA, 19 nt, Mycobacterium tuberculosis H37Rv
gcagcucgauacccaggau

SEQ ID NO: 3280364 - RNA, 21 nt, Mycobacterium tuberculosis H37Rv
gcagcucgcacucguugccga

SEQ ID NO: 3280365 - RNA, 22 nt, Mycobacterium tuberculosis H37Rv
gcagcucgccggcacgcagcca

SEQ ID NO: 3280366 - RNA, 15 nt, Mycobacterium tuberculosis H37Rv
gcagcucgcuguaga

SEQ ID NO: 3280367 - RNA, 16 nt, Mycobacterium tuberculosis H37Rv
gcagcucgggcaggga

SEQ ID NO: 3280368 - RNA, 23 nt, Mycobacterium tuberculosis H37Rv
gcagcucggggcgaugagccugc

SEQ ID NO: 3280369 - RNA, 12 nt, Mycobacterium tuberculosis H37Rv
gcagcucggugg

SEQ ID NO: 3280370 - RNA, 17 nt, Mycobacterium tuberculosis H37Rv
gcagcucgguggcaucg

SEQ ID NO: 3280371 - RNA, 14 nt, Mycobacterium tuberculosis H37Rv
gcagcucguccagc

SEQ ID NO: 3280372 - RNA, 15 nt, Mycobacterium tuberculosis H37Rv
gcagcucguccagcg

SEQ ID NO: 3280373 - RNA, 21 nt, Mycobacterium tuberculosis H37Rv
gcagcugaaaauaggccgggc

SEQ ID NO: 3280374 - RNA, 22 nt, Mycobacterium tuberculosis H37Rv
gcagcugaaaauaggccgggca

SEQ ID NO: 3280375 - RNA, 23 nt, Mycobacterium tuberculosis H37Rv
gcagcugaaaauaggccgggcag

SEQ ID NO: 3280376 - RNA, 15 nt, Mycobacterium tuberculosis H37Rv
gcagcugaaucguuc

SEQ ID NO: 3280377 - RNA, 18 nt, Mycobacterium tuberculosis H37Rv
gcagcugacgucaccacg

SEQ ID NO: 3280378 - RNA, 21 nt, Mycobacterium tuberculosis H37Rv
gcagcugacgucaccacgauc

SEQ ID NO: 3280379 - RNA, 13 nt, Mycobacterium tuberculosis H37Rv
gcagcugcaauag

SEQ ID NO: 3280380 - RNA, 22 nt, Mycobacterium tuberculosis H37Rv
gcagcugcgauauggucaccaa

SEQ ID NO: 3280381 - RNA, 18 nt, Mycobacterium tuberculosis H37Rv
gcagcugcuccaguucgc

SEQ ID NO: 3280382 - RNA, 14 nt, Mycobacterium tuberculosis H37Rv
gcagcuggaccacc

SEQ ID NO: 3280383 - RNA, 14 nt, Mycobacterium tuberculosis H37Rv
gcagcuggcgaaug

SEQ ID NO: 3280384 - RNA, 19 nt, Mycobacterium tuberculosis H37Rv
gcagcuggcgcagccugcc

SEQ ID NO: 3280385 - RNA, 20 nt, Mycobacterium tuberculosis H37Rv
gcagcuggcgcagccugccg

SEQ ID NO: 3280386 - RNA, 18 nt, Mycobacterium tuberculosis H37Rv
gcagcugggcaucaccgc

SEQ ID NO: 3280387 - RNA, 13 nt, Mycobacterium tuberculosis H37Rv
gcagcuggggcgg

SEQ ID NO: 3280388 - RNA, 15 nt, Mycobacterium tuberculosis H37Rv
gcagcugguagguca

SEQ ID NO: 3280389 - RNA, 14 nt, Mycobacterium tuberculosis H37Rv
gcagcuggucggug

SEQ ID NO: 3280390 - RNA, 17 nt, Mycobacterium tuberculosis H37Rv
gcagcugguuugcggug

SEQ ID NO: 3280391 - RNA, 22 nt, Mycobacterium tuberculosis H37Rv
gcaggucgaucugcgccaucac

SEQ ID NO: 3280392 - RNA, 12 nt, Mycobacterium tuberculosis H37Rv
gcaggucgcacc

SEQ ID NO: 3280393 - RNA, 15 nt, Mycobacterium tuberculosis H37Rv
gcaggucgcaccaca

SEQ ID NO: 3280394 - RNA, 19 nt, Mycobacterium tuberculosis H37Rv
gcaggucgccugcccccgc

SEQ ID NO: 3280395 - RNA, 21 nt, Mycobacterium tuberculosis H37Rv
gcaggucgccugcccccgcgc

SEQ ID NO: 3280396 - RNA, 13 nt, Mycobacterium tuberculosis H37Rv
gcaggucgucggc

SEQ ID NO: 3280397 - RNA, 18 nt, Mycobacterium tuberculosis H37Rv
gcaggugaacgccggugc

SEQ ID NO: 3280398 - RNA, 15 nt, Mycobacterium tuberculosis H37Rv
gcaggugacauguug

SEQ ID NO: 3280399 - RNA, 22 nt, Mycobacterium tuberculosis H37Rv
gcaggugacauguugccgcuga

SEQ ID NO: 3280400 - RNA, 19 nt, Mycobacterium tuberculosis H37Rv
gcaggugagccaguuggcc

SEQ ID NO: 3280401 - RNA, 13 nt, Mycobacterium tuberculosis H37Rv
gcaggugccaccu

SEQ ID NO: 3280402 - RNA, 14 nt, Mycobacterium tuberculosis H37Rv
gcaggugcggucaa

SEQ ID NO: 3280403 - RNA, 13 nt, Mycobacterium tuberculosis H37Rv
gcaggugcugggc

SEQ ID NO: 3280404 - RNA, 17 nt, Mycobacterium tuberculosis H37Rv
gcagguggagugcacag

SEQ ID NO: 3280405 - RNA, 17 nt, Mycobacterium tuberculosis H37Rv
gcaggugggcguuggcg

SEQ ID NO: 3280406 - RNA, 13 nt, Mycobacterium tuberculosis H37Rv
gcagguggucgau

SEQ ID NO: 3280407 - RNA, 15 nt, Mycobacterium tuberculosis H37Rv
gcagguggugacacg

SEQ ID NO: 3280408 - RNA, 17 nt, Mycobacterium tuberculosis H37Rv
gcagguguugcacgagc

SEQ ID NO: 3280409 - RNA, 15 nt, Mycobacterium tuberculosis H37Rv
gcagguguuggugcg

SEQ ID NO: 3280410 - RNA, 15 nt, Mycobacterium tuberculosis H37Rv
gcagguuccacgcgu

SEQ ID NO: 3280411 - RNA, 19 nt, Mycobacterium tuberculosis H37Rv
gcagguuggccaccgccca

SEQ ID NO: 3280412 - RNA, 21 nt, Mycobacterium tuberculosis H37Rv
gcagguuguaguccgcgccga

SEQ ID NO: 3280413 - RNA, 18 nt, Mycobacterium tuberculosis H37Rv
gcaguacaccgcccggcc

SEQ ID NO: 3280414 - RNA, 21 nt, Mycobacterium tuberculosis H37Rv
gcaguacuaacaacaccacca

SEQ ID NO: 3280415 - RNA, 21 nt, Mycobacterium tuberculosis H37Rv
gcaguacugguagaggcggcg

SEQ ID NO: 3280416 - RNA, 16 nt, Mycobacterium tuberculosis H37Rv
gcaguacuugguugcg

SEQ ID NO: 3280417 - RNA, 14 nt, Mycobacterium tuberculosis H37Rv
gcaguagcuguggc

SEQ ID NO: 3280418 - RNA, 14 nt, Mycobacterium tuberculosis H37Rv
gcagucaacucccg

SEQ ID NO: 3280419 - RNA, 17 nt, Mycobacterium tuberculosis H37Rv
gcagucaacucccgaac

SEQ ID NO: 3280420 - RNA, 17 nt, Mycobacterium tuberculosis H37Rv
gcagucauguccauagc

SEQ ID NO: 3280421 - RNA, 19 nt, Mycobacterium tuberculosis H37Rv
gcaguccagccgggugccg

SEQ ID NO: 3280422 - RNA, 20 nt, Mycobacterium tuberculosis H37Rv
gcagucccaguucguuggug

SEQ ID NO: 3280423 - RNA, 15 nt, Mycobacterium tuberculosis H37Rv
gcagucccggugggc

SEQ ID NO: 3280424 - RNA, 20 nt, Mycobacterium tuberculosis H37Rv
gcaguccgcacgcggcaaug

SEQ ID NO: 3280425 - RNA, 16 nt, Mycobacterium tuberculosis H37Rv
gcagucgaugagugac

SEQ ID NO: 3280426 - RNA, 19 nt, Mycobacterium tuberculosis H37Rv
gcagucgauuucggcggcg

SEQ ID NO: 3280427 - RNA, 19 nt, Mycobacterium tuberculosis H37Rv
gcagucgcaaaagccccca

SEQ ID NO: 3280428 - RNA, 17 nt, Mycobacterium tuberculosis H37Rv
gcagucgcacggugccg

SEQ ID NO: 3280429 - RNA, 21 nt, Mycobacterium tuberculosis H37Rv
gcagucgcacggugccgccgu

SEQ ID NO: 3280430 - RNA, 12 nt, Mycobacterium tuberculosis H37Rv
gcagucgcccac

SEQ ID NO: 3280431 - RNA, 13 nt, Mycobacterium tuberculosis H37Rv
gcagucgcccacu

SEQ ID NO: 3280432 - RNA, 13 nt, Mycobacterium tuberculosis H37Rv
gcagucgcggcag

SEQ ID NO: 3280433 - RNA, 21 nt, Mycobacterium tuberculosis H37Rv
gcagucgcuaaagcccccgac

SEQ ID NO: 3280434 - RNA, 23 nt, Mycobacterium tuberculosis H37Rv
gcagucuuucccggggcuggggg

SEQ ID NO: 3280435 - RNA, 14 nt, Mycobacterium tuberculosis H37Rv
gcagugaccgcugg

SEQ ID NO: 3280436 - RNA, 13 nt, Mycobacterium tuberculosis H37Rv
gcagugaccucgu

SEQ ID NO: 3280437 - RNA, 22 nt, Mycobacterium tuberculosis H37Rv
gcagugacgccucgacacccag

SEQ ID NO: 3280438 - RNA, 15 nt, Mycobacterium tuberculosis H37Rv
gcagugacguuccgc

SEQ ID NO: 3280439 - RNA, 19 nt, Mycobacterium tuberculosis H37Rv
gcagugacguuccgcucgc

SEQ ID NO: 3280440 - RNA, 21 nt, Mycobacterium tuberculosis H37Rv
gcagugacguuccgcucgccg

SEQ ID NO: 3280441 - RNA, 15 nt, Mycobacterium tuberculosis H37Rv
gcagugacucgauca

SEQ ID NO: 3280442 - RNA, 16 nt, Mycobacterium tuberculosis H37Rv
gcagugccgcacccag

SEQ ID NO: 3280443 - RNA, 17 nt, Mycobacterium tuberculosis H37Rv
gcagugccgcacccaga

SEQ ID NO: 3280444 - RNA, 23 nt, Mycobacterium tuberculosis H37Rv
gcagugccguguccagcaugccc

SEQ ID NO: 3280445 - RNA, 16 nt, Mycobacterium tuberculosis H37Rv
gcagugcgacccgggc

SEQ ID NO: 3280446 - RNA, 20 nt, Mycobacterium tuberculosis H37Rv
gcaguggugucggaaugggc

SEQ ID NO: 3280447 - RNA, 18 nt, Mycobacterium tuberculosis H37Rv
gcaguguggugacguugu

SEQ ID NO: 3280448 - RNA, 21 nt, Mycobacterium tuberculosis H37Rv
gcaguucaucgggcaccaacc

SEQ ID NO: 3280449 - RNA, 16 nt, Mycobacterium tuberculosis H37Rv
gcaguuccagcucgcg

SEQ ID NO: 3280450 - RNA, 23 nt, Mycobacterium tuberculosis H37Rv
gcaguuccuugccgaucgccgag

SEQ ID NO: 3280451 - RNA, 21 nt, Mycobacterium tuberculosis H37Rv
gcaguucgcggccaucgccga

SEQ ID NO: 3280452 - RNA, 13 nt, Mycobacterium tuberculosis H37Rv
gcaguucggcgau

SEQ ID NO: 3280453 - RNA, 15 nt, Mycobacterium tuberculosis H37Rv
gcaguucggucgucu

SEQ ID NO: 3280454 - RNA, 20 nt, Mycobacterium tuberculosis H37Rv
gcaguucucggucccgccgg

SEQ ID NO: 3280455 - RNA, 12 nt, Mycobacterium tuberculosis H37Rv
gcaguugaacuc

SEQ ID NO: 3280456 - RNA, 21 nt, Mycobacterium tuberculosis H37Rv
gcaguugaacucgaccaccgc

SEQ ID NO: 3280457 - RNA, 16 nt, Mycobacterium tuberculosis H37Rv
gcaguuggcaccagcc

SEQ ID NO: 3280458 - RNA, 15 nt, Mycobacterium tuberculosis H37Rv
gcaguuggccaugca

SEQ ID NO: 3280459 - RNA, 15 nt, Mycobacterium tuberculosis H37Rv
gcaguuggccgagcg

SEQ ID NO: 3280460 - RNA, 14 nt, Mycobacterium tuberculosis H37Rv
gcaguuuggcggca

SEQ ID NO: 3280461 - RNA, 18 nt, Mycobacterium tuberculosis H37Rv
gcauacaccgugacguug

SEQ ID NO: 3280462 - RNA, 16 nt, Mycobacterium tuberculosis H37Rv
gcauacagcgcccgga

SEQ ID NO: 3280463 - RNA, 17 nt, Mycobacterium tuberculosis H37Rv
gcauacauccaggcugu

SEQ ID NO: 3280464 - RNA, 13 nt, Mycobacterium tuberculosis H37Rv
gcauacaucgccu

SEQ ID NO: 3280465 - RNA, 19 nt, Mycobacterium tuberculosis H37Rv
gcauaccgaacagcaccuc

SEQ ID NO: 3280466 - RNA, 19 nt, Mycobacterium tuberculosis H37Rv
gcauacgcccacuccagca

SEQ ID NO: 3280467 - RNA, 14 nt, Mycobacterium tuberculosis H37Rv
gcauacgcggcuuu

SEQ ID NO: 3280468 - RNA, 19 nt, Mycobacterium tuberculosis H37Rv
gcauacgcggcuuugacgc

SEQ ID NO: 3280469 - RNA, 13 nt, Mycobacterium tuberculosis H37Rv
gcauacgguugau

SEQ ID NO: 3280470 - RNA, 18 nt, Mycobacterium tuberculosis H37Rv
gcauacgguugaugcauc

SEQ ID NO: 3280471 - RNA, 19 nt, Mycobacterium tuberculosis H37Rv
gcauaggccccgccagcgc

SEQ ID NO: 3280472 - RNA, 13 nt, Mycobacterium tuberculosis H37Rv
gcauaggcgcggu

SEQ ID NO: 3280473 - RNA, 13 nt, Mycobacterium tuberculosis H37Rv
gcauaggcuuccg

SEQ ID NO: 3280474 - RNA, 14 nt, Mycobacterium tuberculosis H37Rv
gcauagugcggcug

SEQ ID NO: 3280475 - RNA, 20 nt, Mycobacterium tuberculosis H37Rv
gcauaucaaccccggugcag

SEQ ID NO: 3280476 - RNA, 16 nt, Mycobacterium tuberculosis H37Rv
gcauauccgcaggccc

SEQ ID NO: 3280477 - RNA, 23 nt, Mycobacterium tuberculosis H37Rv
gcauauugcggcgccgugaucag

SEQ ID NO: 3280478 - RNA, 14 nt, Mycobacterium tuberculosis H37Rv
gcaucaccuggcgu

SEQ ID NO: 3280479 - RNA, 13 nt, Mycobacterium tuberculosis H37Rv
gcaucacgcccac

SEQ ID NO: 3280480 - RNA, 17 nt, Mycobacterium tuberculosis H37Rv
gcaucacgcccacgaua

SEQ ID NO: 3280481 - RNA, 19 nt, Mycobacterium tuberculosis H37Rv
gcaucagauucgcgcuggc

SEQ ID NO: 3280482 - RNA, 20 nt, Mycobacterium tuberculosis H37Rv
gcaucagauucgcgcuggcc

SEQ ID NO: 3280483 - RNA, 15 nt, Mycobacterium tuberculosis H37Rv
gcaucagcgccagcg

SEQ ID NO: 3280484 - RNA, 16 nt, Mycobacterium tuberculosis H37Rv
gcaucagcgccagcga

SEQ ID NO: 3280485 - RNA, 14 nt, Mycobacterium tuberculosis H37Rv
gcaucagcggcgcc

SEQ ID NO: 3280486 - RNA, 12 nt, Mycobacterium tuberculosis H37Rv
gcaucagggucg

SEQ ID NO: 3280487 - RNA, 14 nt, Mycobacterium tuberculosis H37Rv
gcaucaucaagccg

SEQ ID NO: 3280488 - RNA, 15 nt, Mycobacterium tuberculosis H37Rv
gcaugagggcaucga

SEQ ID NO: 3280489 - RNA, 18 nt, Mycobacterium tuberculosis H37Rv
gcaugagucgaaccaggu

SEQ ID NO: 3280490 - RNA, 21 nt, Mycobacterium tuberculosis H37Rv
gcaugauccgcugggccgggg

SEQ ID NO: 3280491 - RNA, 20 nt, Mycobacterium tuberculosis H37Rv
gcaugcaaacggaugguucu

SEQ ID NO: 3280492 - RNA, 18 nt, Mycobacterium tuberculosis H37Rv
gcaugcaaugcuggcggc

SEQ ID NO: 3280493 - RNA, 20 nt, Mycobacterium tuberculosis H37Rv
gcaugcaaugcuggcggcgc

SEQ ID NO: 3280494 - RNA, 19 nt, Mycobacterium tuberculosis H37Rv
gcaugccacacacugccgg

SEQ ID NO: 3280495 - RNA, 22 nt, Mycobacterium tuberculosis H37Rv
gcaugccagccacgaacugauc

SEQ ID NO: 3280496 - RNA, 21 nt, Mycobacterium tuberculosis H37Rv
gcaugcccagcgcacggacca

SEQ ID NO: 3280497 - RNA, 12 nt, Mycobacterium tuberculosis H37Rv
gcaugcccugga

SEQ ID NO: 3280498 - RNA, 17 nt, Mycobacterium tuberculosis H37Rv
gcaugcccuggaccagc

SEQ ID NO: 3280499 - RNA, 19 nt, Mycobacterium tuberculosis H37Rv
gcaugcccuggaccagcgg

SEQ ID NO: 3280500 - RNA, 19 nt, Mycobacterium tuberculosis H37Rv
gcaugccgccaugcgcacc

SEQ ID NO: 3280501 - RNA, 16 nt, Mycobacterium tuberculosis H37Rv
gcaugccgcccgcgcc

SEQ ID NO: 3280502 - RNA, 23 nt, Mycobacterium tuberculosis H37Rv
gcaugccgcccgcuccugcucgu

SEQ ID NO: 3280503 - RNA, 16 nt, Mycobacterium tuberculosis H37Rv
gcaugccggcgaagcc

SEQ ID NO: 3280504 - RNA, 17 nt, Mycobacterium tuberculosis H37Rv
gcaugccggucuucgcg

SEQ ID NO: 3280505 - RNA, 21 nt, Mycobacterium tuberculosis H37Rv
gcaugccggucuucgcgggac

SEQ ID NO: 3280506 - RNA, 19 nt, Mycobacterium tuberculosis H37Rv
gcaugcgacagaugccggg

SEQ ID NO: 3280507 - RNA, 17 nt, Mycobacterium tuberculosis H37Rv
gcaugcgacgucagggu

SEQ ID NO: 3280508 - RNA, 22 nt, Mycobacterium tuberculosis H37Rv
gcaugcgcagaaacgccgagcg

SEQ ID NO: 3280509 - RNA, 15 nt, Mycobacterium tuberculosis H37Rv
gcaugcgccguagcc

SEQ ID NO: 3280510 - RNA, 17 nt, Mycobacterium tuberculosis H37Rv
gcaugcgccguagccga

SEQ ID NO: 3280511 - RNA, 22 nt, Mycobacterium tuberculosis H37Rv
gcaugcguaugcccacgaaccg

SEQ ID NO: 3280512 - RNA, 22 nt, Mycobacterium tuberculosis H37Rv
gcaugcgugccggcagcggugg

SEQ ID NO: 3280513 - RNA, 15 nt, Mycobacterium tuberculosis H37Rv
gcaugcguuggggca

SEQ ID NO: 3280514 - RNA, 12 nt, Mycobacterium tuberculosis H37Rv
gcaugcucacga

SEQ ID NO: 3280515 - RNA, 14 nt, Mycobacterium tuberculosis H37Rv
gcaugcucgaucgc

SEQ ID NO: 3280516 - RNA, 13 nt, Mycobacterium tuberculosis H37Rv
gcaugcuggaccu

SEQ ID NO: 3280517 - RNA, 15 nt, Mycobacterium tuberculosis H37Rv
gcauggacaacagcu

SEQ ID NO: 3280518 - RNA, 12 nt, Mycobacterium tuberculosis H37Rv
gcauggccuggg

SEQ ID NO: 3280519 - RNA, 13 nt, Mycobacterium tuberculosis H37Rv
gcauggccugggu

SEQ ID NO: 3280520 - RNA, 19 nt, Mycobacterium tuberculosis H37Rv
gcauggcgaacacgucggc

SEQ ID NO: 3280521 - RNA, 20 nt, Mycobacterium tuberculosis H37Rv
gcauggcgaacacgucggcc

SEQ ID NO: 3280522 - RNA, 18 nt, Mycobacterium tuberculosis H37Rv
gcauggcggcuggugcgg

SEQ ID NO: 3280523 - RNA, 23 nt, Mycobacterium tuberculosis H37Rv
gcaugggccggcgccgcaccaag

SEQ ID NO: 3280524 - RNA, 20 nt, Mycobacterium tuberculosis H37Rv
gcaugggcggauaguucacc

SEQ ID NO: 3280525 - RNA, 16 nt, Mycobacterium tuberculosis H37Rv
gcauggucaggcggcc

SEQ ID NO: 3280526 - RNA, 15 nt, Mycobacterium tuberculosis H37Rv
gcaugguccacagcc

SEQ ID NO: 3280527 - RNA, 18 nt, Mycobacterium tuberculosis H37Rv
gcaugguccacagccggc

SEQ ID NO: 3280528 - RNA, 23 nt, Mycobacterium tuberculosis H37Rv
gcauggucgacgaacaccccggg

SEQ ID NO: 3280529 - RNA, 20 nt, Mycobacterium tuberculosis H37Rv
gcaugguuagcggugauggg

SEQ ID NO: 3280530 - RNA, 22 nt, Mycobacterium tuberculosis H37Rv
gcauguagaguaucgaauccgu

SEQ ID NO: 3280531 - RNA, 20 nt, Mycobacterium tuberculosis H37Rv
gcaugucgccgaacgccacc

SEQ ID NO: 3280532 - RNA, 17 nt, Mycobacterium tuberculosis H37Rv
gcaugucgggccaggcg

SEQ ID NO: 3280533 - RNA, 18 nt, Mycobacterium tuberculosis H37Rv
gcaugucgggccgcucga

SEQ ID NO: 3280534 - RNA, 20 nt, Mycobacterium tuberculosis H37Rv
gcaugucucgggcgcgggug

SEQ ID NO: 3280535 - RNA, 24 nt, Mycobacterium tuberculosis H37Rv
gcaugugaaagacaacccgcucgg

SEQ ID NO: 3280536 - RNA, 22 nt, Mycobacterium tuberculosis H37Rv
gcaugugacaucgggccgccga

SEQ ID NO: 3280537 - RNA, 19 nt, Mycobacterium tuberculosis H37Rv
gcaugugggaacuggacca

SEQ ID NO: 3280538 - RNA, 20 nt, Mycobacterium tuberculosis H37Rv
gcauguucagcccgaacucg

SEQ ID NO: 3280539 - RNA, 19 nt, Mycobacterium tuberculosis H37Rv
gcauguucuccacgccgau

SEQ ID NO: 3280540 - RNA, 19 nt, Mycobacterium tuberculosis H37Rv
gcauucccgcucgcaggcc

SEQ ID NO: 3280541 - RNA, 24 nt, Mycobacterium tuberculosis H37Rv
gcauuccguaggccacagcccggc

SEQ ID NO: 3280542 - RNA, 20 nt, Mycobacterium tuberculosis H37Rv
gcauucguugaugaugccca

SEQ ID NO: 3280543 - RNA, 12 nt, Mycobacterium tuberculosis H37Rv
gcauugaagaag

SEQ ID NO: 3280544 - RNA, 14 nt, Mycobacterium tuberculosis H37Rv
gcauugaagaagcc

SEQ ID NO: 3280545 - RNA, 20 nt, Mycobacterium tuberculosis H37Rv
gcauugaccaauccacugau

SEQ ID NO: 3280546 - RNA, 22 nt, Mycobacterium tuberculosis H37Rv
gcauugaccaauccacugauca

SEQ ID NO: 3280547 - RNA, 19 nt, Mycobacterium tuberculosis H37Rv
gcauugcccauagccaggu

SEQ ID NO: 3280548 - RNA, 18 nt, Mycobacterium tuberculosis H37Rv
gcauugcuccgguuggcg

SEQ ID NO: 3280549 - RNA, 12 nt, Mycobacterium tuberculosis H37Rv
gcauuggcggcg

SEQ ID NO: 3280550 - RNA, 14 nt, Mycobacterium tuberculosis H37Rv
gcauuggcggcggu

SEQ ID NO: 3280551 - RNA, 15 nt, Mycobacterium tuberculosis H37Rv
gcauuggcggcgguc

SEQ ID NO: 3280552 - RNA, 13 nt, Mycobacterium tuberculosis H37Rv
gcauugucgccgg

SEQ ID NO: 3280553 - RNA, 13 nt, Mycobacterium tuberculosis H37Rv
gcauuucggaucu

SEQ ID NO: 3280554 - RNA, 23 nt, Mycobacterium tuberculosis H37Rv
gcauuucguggcgcgccgcaucg

SEQ ID NO: 3280555 - RNA, 20 nt, Mycobacterium tuberculosis H37Rv
gccaaaaaggaucccgccgc

SEQ ID NO: 3280556 - RNA, 15 nt, Mycobacterium tuberculosis H37Rv
gccaaaacggucgac

SEQ ID NO: 3280557 - RNA, 23 nt, Mycobacterium tuberculosis H37Rv
gccaaaaguacuggcguugccac

SEQ ID NO: 3280558 - RNA, 16 nt, Mycobacterium tuberculosis H37Rv
gccaaaauccgcccac

SEQ ID NO: 3280559 - RNA, 18 nt, Mycobacterium tuberculosis H37Rv
gccaaacuacccgcccac

SEQ ID NO: 3280560 - RNA, 20 nt, Mycobacterium tuberculosis H37Rv
gccaaacuacccgcccacgg

SEQ ID NO: 3280561 - RNA, 21 nt, Mycobacterium tuberculosis H37Rv
gccaaacuacccgcccacggc

SEQ ID NO: 3280562 - RNA, 14 nt, Mycobacterium tuberculosis H37Rv
gccaaagacccggc

SEQ ID NO: 3280563 - RNA, 12 nt, Mycobacterium tuberculosis H37Rv
gccaaagcccac

SEQ ID NO: 3280564 - RNA, 13 nt, Mycobacterium tuberculosis H37Rv
gccaaagcccgac

SEQ ID NO: 3280565 - RNA, 14 nt, Mycobacterium tuberculosis H37Rv
gccaaagcccgaca

SEQ ID NO: 3280566 - RNA, 17 nt, Mycobacterium tuberculosis H37Rv
gccaaagcccgacauga

SEQ ID NO: 3280567 - RNA, 12 nt, Mycobacterium tuberculosis H37Rv
gccaaagcgcgg

SEQ ID NO: 3280568 - RNA, 14 nt, Mycobacterium tuberculosis H37Rv
gccaaauaccguga

SEQ ID NO: 3280569 - RNA, 19 nt, Mycobacterium tuberculosis H37Rv
gccaaaucggccaaaugcc

SEQ ID NO: 3280570 - RNA, 15 nt, Mycobacterium tuberculosis H37Rv
gccaacaacaucagc

SEQ ID NO: 3280571 - RNA, 16 nt, Mycobacterium tuberculosis H37Rv
gccaacaccaaccagu

SEQ ID NO: 3280572 - RNA, 14 nt, Mycobacterium tuberculosis H37Rv
gccaacaccgccag

SEQ ID NO: 3280573 - RNA, 19 nt, Mycobacterium tuberculosis H37Rv
gccaacaccgccagcauga

SEQ ID NO: 3280574 - RNA, 16 nt, Mycobacterium tuberculosis H37Rv
gccaacaccggcgauc

SEQ ID NO: 3280575 - RNA, 22 nt, Mycobacterium tuberculosis H37Rv
gccaacaccggcgaucaccguu

SEQ ID NO: 3280576 - RNA, 14 nt, Mycobacterium tuberculosis H37Rv
gccaacacgcguug

SEQ ID NO: 3280577 - RNA, 12 nt, Mycobacterium tuberculosis H37Rv
gccaacagaugc

SEQ ID NO: 3280578 - RNA, 15 nt, Mycobacterium tuberculosis H37Rv
gccaacagguccacc

SEQ ID NO: 3280579 - RNA, 14 nt, Mycobacterium tuberculosis H37Rv
gccaacagucgcag

SEQ ID NO: 3280580 - RNA, 12 nt, Mycobacterium tuberculosis H37Rv
gccaacaucucc

SEQ ID NO: 3280581 - RNA, 14 nt, Mycobacterium tuberculosis H37Rv
gccaaccaaccggu

SEQ ID NO: 3280582 - RNA, 16 nt, Mycobacterium tuberculosis H37Rv
gccaaccagcccggcc

SEQ ID NO: 3280583 - RNA, 15 nt, Mycobacterium tuberculosis H37Rv
gccaacccaucccga

SEQ ID NO: 3280584 - RNA, 18 nt, Mycobacterium tuberculosis H37Rv
gccaacccaucccgaucc

SEQ ID NO: 3280585 - RNA, 23 nt, Mycobacterium tuberculosis H37Rv
gccaacccgauuuauccggaucg

SEQ ID NO: 3280586 - RNA, 17 nt, Mycobacterium tuberculosis H37Rv
gccaacccggcgggccc

SEQ ID NO: 3280587 - RNA, 18 nt, Mycobacterium tuberculosis H37Rv
gccaacccggcgggcccg

SEQ ID NO: 3280588 - RNA, 23 nt, Mycobacterium tuberculosis H37Rv
gccaacccggcgggcccgccggc

SEQ ID NO: 3280589 - RNA, 20 nt, Mycobacterium tuberculosis H37Rv
gccaacccgucuuaucggcg

SEQ ID NO: 3280590 - RNA, 21 nt, Mycobacterium tuberculosis H37Rv
gccaacccgucuuaucggcgu

SEQ ID NO: 3280591 - RNA, 14 nt, Mycobacterium tuberculosis H37Rv
gccaacccugcggc

SEQ ID NO: 3280592 - RNA, 14 nt, Mycobacterium tuberculosis H37Rv
gccaaccgcgugcg

SEQ ID NO: 3280593 - RNA, 21 nt, Mycobacterium tuberculosis H37Rv
gccaaccgggugugcgucgag

SEQ ID NO: 3280594 - RNA, 23 nt, Mycobacterium tuberculosis H37Rv
gccaaccgguucgucgaacggau

SEQ ID NO: 3280595 - RNA, 20 nt, Mycobacterium tuberculosis H37Rv
gccaaccucugcugagcugc

SEQ ID NO: 3280596 - RNA, 19 nt, Mycobacterium tuberculosis H37Rv
gccaaccugaagccagcgc

SEQ ID NO: 3280597 - RNA, 20 nt, Mycobacterium tuberculosis H37Rv
gccaacgaaccgcucagcgc

SEQ ID NO: 3280598 - RNA, 21 nt, Mycobacterium tuberculosis H37Rv
gccaacgaaccgcucagcgca

SEQ ID NO: 3280599 - RNA, 18 nt, Mycobacterium tuberculosis H37Rv
gccaacgacaggcgccca

SEQ ID NO: 3280600 - RNA, 17 nt, Mycobacterium tuberculosis H37Rv
gccaacgacggccgaca

SEQ ID NO: 3280601 - RNA, 14 nt, Mycobacterium tuberculosis H37Rv
gccaacgagcgcgc

SEQ ID NO: 3280602 - RNA, 20 nt, Mycobacterium tuberculosis H37Rv
gccaacgccaaaacggucga

SEQ ID NO: 3280603 - RNA, 13 nt, Mycobacterium tuberculosis H37Rv
gccaacgccagca

SEQ ID NO: 3280604 - RNA, 14 nt, Mycobacterium tuberculosis H37Rv
gccaacgccagcac

SEQ ID NO: 3280605 - RNA, 19 nt, Mycobacterium tuberculosis H37Rv
gccaacgccagcaccagcg

SEQ ID NO: 3280606 - RNA, 22 nt, Mycobacterium tuberculosis H37Rv
gccaacgcgcagagcguuccgc

SEQ ID NO: 3280607 - RNA, 14 nt, Mycobacterium tuberculosis H37Rv
gccaacgcgcgacc

SEQ ID NO: 3280608 - RNA, 17 nt, Mycobacterium tuberculosis H37Rv
gccaacgcgcgaccgcg

SEQ ID NO: 3280609 - RNA, 15 nt, Mycobacterium tuberculosis H37Rv
gccaacgcgucccgc

SEQ ID NO: 3280610 - RNA, 18 nt, Mycobacterium tuberculosis H37Rv
gccaacgcgucccgccgc

SEQ ID NO: 3280611 - RNA, 22 nt, Mycobacterium tuberculosis H37Rv
gccaacgcgucccgccgcaccg

SEQ ID NO: 3280612 - RNA, 21 nt, Mycobacterium tuberculosis H37Rv
gccaacggaccguuaccggac

SEQ ID NO: 3280613 - RNA, 19 nt, Mycobacterium tuberculosis H37Rv
gccaacggcacccugcggc

SEQ ID NO: 3280614 - RNA, 22 nt, Mycobacterium tuberculosis H37Rv
gccaacggcacccugcggcacc

SEQ ID NO: 3280615 - RNA, 17 nt, Mycobacterium tuberculosis H37Rv
gccaacggcuccgggcg

SEQ ID NO: 3280616 - RNA, 15 nt, Mycobacterium tuberculosis H37Rv
gccaacgggcugccc

SEQ ID NO: 3280617 - RNA, 17 nt, Mycobacterium tuberculosis H37Rv
gccaacgugacgccggc

SEQ ID NO: 3280618 - RNA, 19 nt, Mycobacterium tuberculosis H37Rv
gccaacgugacgccggcca

SEQ ID NO: 3280619 - RNA, 18 nt, Mycobacterium tuberculosis H37Rv
gccaacguugcgccagcg

SEQ ID NO: 3280620 - RNA, 20 nt, Mycobacterium tuberculosis H37Rv
gccaacguugcgccagcggu

SEQ ID NO: 3280621 - RNA, 19 nt, Mycobacterium tuberculosis H37Rv
gccaacucguccaacugaa

SEQ ID NO: 3280622 - RNA, 18 nt, Mycobacterium tuberculosis H37Rv
gccaacucuucagcaagc

SEQ ID NO: 3280623 - RNA, 16 nt, Mycobacterium tuberculosis H37Rv
gccaacugcgccguuc

SEQ ID NO: 3280624 - RNA, 20 nt, Mycobacterium tuberculosis H37Rv
gccaacugggccgagcgcgc

SEQ ID NO: 3280625 - RNA, 21 nt, Mycobacterium tuberculosis H37Rv
gccaacugggccgagcgcgcc

SEQ ID NO: 3280626 - RNA, 16 nt, Mycobacterium tuberculosis H37Rv
gccaacuggucgccaa

SEQ ID NO: 3280627 - RNA, 22 nt, Mycobacterium tuberculosis H37Rv
gccaacuggucgccaacgccag

SEQ ID NO: 3280628 - RNA, 23 nt, Mycobacterium tuberculosis H37Rv
gccaacuggucgccaacgccagc

SEQ ID NO: 3280629 - RNA, 15 nt, Mycobacterium tuberculosis H37Rv
gccaacuugcucagc

SEQ ID NO: 3280630 - RNA, 16 nt, Mycobacterium tuberculosis H37Rv
gccaacuuggcggcca

SEQ ID NO: 3280631 - RNA, 17 nt, Mycobacterium tuberculosis H37Rv
gccaacuuggcggccag

SEQ ID NO: 3280632 - RNA, 23 nt, Mycobacterium tuberculosis H37Rv
gccaagaaagacgcuguccaggu

SEQ ID NO: 3280633 - RNA, 16 nt, Mycobacterium tuberculosis H37Rv
gccaagaccagaagcc

SEQ ID NO: 3280634 - RNA, 14 nt, Mycobacterium tuberculosis H37Rv
gccaagaccgcggc

SEQ ID NO: 3280635 - RNA, 20 nt, Mycobacterium tuberculosis H37Rv
gccaagacggcgggcccggg

SEQ ID NO: 3280636 - RNA, 18 nt, Mycobacterium tuberculosis H37Rv
gccaagcagacgcagaau

SEQ ID NO: 3280637 - RNA, 20 nt, Mycobacterium tuberculosis H37Rv
gccaagcagcugggcaucac

SEQ ID NO: 3280638 - RNA, 16 nt, Mycobacterium tuberculosis H37Rv
gccaagcccaggcgau

SEQ ID NO: 3280639 - RNA, 13 nt, Mycobacterium tuberculosis H37Rv
gccaagccgcggc

SEQ ID NO: 3280640 - RNA, 20 nt, Mycobacterium tuberculosis H37Rv
gccaagccggagcccggcau

SEQ ID NO: 3280641 - RNA, 17 nt, Mycobacterium tuberculosis H37Rv
gccaagccgugccgcac

SEQ ID NO: 3280642 - RNA, 21 nt, Mycobacterium tuberculosis H37Rv
gccaagccgugccgcacagcg

SEQ ID NO: 3280643 - RNA, 18 nt, Mycobacterium tuberculosis H37Rv
gccaagcgacucgccggc

SEQ ID NO: 3280644 - RNA, 21 nt, Mycobacterium tuberculosis H37Rv
gccaagcgacucgccggcgaa

SEQ ID NO: 3280645 - RNA, 14 nt, Mycobacterium tuberculosis H37Rv
gccaagcgagcggc

SEQ ID NO: 3280646 - RNA, 19 nt, Mycobacterium tuberculosis H37Rv
gccaagcgagcggcgaacu

SEQ ID NO: 3280647 - RNA, 15 nt, Mycobacterium tuberculosis H37Rv
gccaagcucggccac

SEQ ID NO: 3280648 - RNA, 16 nt, Mycobacterium tuberculosis H37Rv
gccaagcucggccacc

SEQ ID NO: 3280649 - RNA, 21 nt, Mycobacterium tuberculosis H37Rv
gccaagcucggccaccagcgc

SEQ ID NO: 3280650 - RNA, 23 nt, Mycobacterium tuberculosis H37Rv
gccaagcucggccaccagcgccc

SEQ ID NO: 3280651 - RNA, 19 nt, Mycobacterium tuberculosis H37Rv
gccaagcucggcccagcgc

SEQ ID NO: 3280652 - RNA, 12 nt, Mycobacterium tuberculosis H37Rv
gccaaggccguc

SEQ ID NO: 3280653 - RNA, 13 nt, Mycobacterium tuberculosis H37Rv
gccaaggccgucg

SEQ ID NO: 3280654 - RNA, 15 nt, Mycobacterium tuberculosis H37Rv
gccaaggccgucgac

SEQ ID NO: 3280655 - RNA, 20 nt, Mycobacterium tuberculosis H37Rv
gccaaggccgucgacccagc

SEQ ID NO: 3280656 - RNA, 22 nt, Mycobacterium tuberculosis H37Rv
gccaaggcuuccuccgacgcga

SEQ ID NO: 3280657 - RNA, 14 nt, Mycobacterium tuberculosis H37Rv
gccaaggucgaccc

SEQ ID NO: 3280658 - RNA, 15 nt, Mycobacterium tuberculosis H37Rv
gccaagguugucgcu

SEQ ID NO: 3280659 - RNA, 19 nt, Mycobacterium tuberculosis H37Rv
gccaaguacgcgaccgcga

SEQ ID NO: 3280660 - RNA, 16 nt, Mycobacterium tuberculosis H37Rv
gccaaguacugggcca

SEQ ID NO: 3280661 - RNA, 20 nt, Mycobacterium tuberculosis H37Rv
gccaaguccgcucaccuuug

SEQ ID NO: 3280662 - RNA, 21 nt, Mycobacterium tuberculosis H37Rv
gccaagugagcgaucgggugc

SEQ ID NO: 3280663 - RNA, 18 nt, Mycobacterium tuberculosis H37Rv
gccaaguugcagcgggcc

SEQ ID NO: 3280664 - RNA, 19 nt, Mycobacterium tuberculosis H37Rv
gccaauacgugauguagcu

SEQ ID NO: 3280665 - RNA, 21 nt, Mycobacterium tuberculosis H37Rv
gccaauagcacguugucgggc

SEQ ID NO: 3280666 - RNA, 18 nt, Mycobacterium tuberculosis H37Rv
gccaaucagcccgccgga

SEQ ID NO: 3280667 - RNA, 12 nt, Mycobacterium tuberculosis H37Rv
gccaaucauggu

SEQ ID NO: 3280668 - RNA, 16 nt, Mycobacterium tuberculosis H37Rv
gccaaucgcccagugu

SEQ ID NO: 3280669 - RNA, 20 nt, Mycobacterium tuberculosis H37Rv
gccaaugacuuggccagcag

SEQ ID NO: 3280670 - RNA, 16 nt, Mycobacterium tuberculosis H37Rv
gccaaugauucggcac

SEQ ID NO: 3280671 - RNA, 17 nt, Mycobacterium tuberculosis H37Rv
gccaaugccaccauugc

SEQ ID NO: 3280672 - RNA, 16 nt, Mycobacterium tuberculosis H37Rv
gccaaugcccaggugu

SEQ ID NO: 3280673 - RNA, 15 nt, Mycobacterium tuberculosis H37Rv
gccaaugccguugau

SEQ ID NO: 3280674 - RNA, 15 nt, Mycobacterium tuberculosis H37Rv
gccaauggccugcag

SEQ ID NO: 3280675 - RNA, 17 nt, Mycobacterium tuberculosis H37Rv
gccaauggccugcagcg

SEQ ID NO: 3280676 - RNA, 12 nt, Mycobacterium tuberculosis H37Rv
gccacaaagaag

SEQ ID NO: 3280677 - RNA, 22 nt, Mycobacterium tuberculosis H37Rv
gccacaaaggcgccgggucacg

SEQ ID NO: 3280678 - RNA, 23 nt, Mycobacterium tuberculosis H37Rv
gccacaaccucgucgucaucgag

SEQ ID NO: 3280679 - RNA, 16 nt, Mycobacterium tuberculosis H37Rv
gccaccgaggcguuca

SEQ ID NO: 3280680 - RNA, 23 nt, Mycobacterium tuberculosis H37Rv
gccaccgaguagaacuucgccag

SEQ ID NO: 3280681 - RNA, 18 nt, Mycobacterium tuberculosis H37Rv
gccaccgauaccgucagc

SEQ ID NO: 3280682 - RNA, 20 nt, Mycobacterium tuberculosis H37Rv
gccaccgaucgacugcagcc

SEQ ID NO: 3280683 - RNA, 19 nt, Mycobacterium tuberculosis H37Rv
gccaccgcaacucgccgaa

SEQ ID NO: 3280684 - RNA, 14 nt, Mycobacterium tuberculosis H37Rv
gccaccgcacgcug

SEQ ID NO: 3280685 - RNA, 17 nt, Mycobacterium tuberculosis H37Rv
gccaccgcacgcuggcg

SEQ ID NO: 3280686 - RNA, 15 nt, Mycobacterium tuberculosis H37Rv
gccaccgcacguucg

SEQ ID NO: 3280687 - RNA, 17 nt, Mycobacterium tuberculosis H37Rv
gccaccgcagacgccgu

SEQ ID NO: 3280688 - RNA, 20 nt, Mycobacterium tuberculosis H37Rv
gccaccgcagacgugguagc

SEQ ID NO: 3280689 - RNA, 16 nt, Mycobacterium tuberculosis H37Rv
gccaccgcaucgccga

SEQ ID NO: 3280690 - RNA, 13 nt, Mycobacterium tuberculosis H37Rv
gccaccgccacca

SEQ ID NO: 3280691 - RNA, 18 nt, Mycobacterium tuberculosis H37Rv
gccaccgccaccacccag

SEQ ID NO: 3280692 - RNA, 17 nt, Mycobacterium tuberculosis H37Rv
gccaccgccaccgcggc

SEQ ID NO: 3280693 - RNA, 14 nt, Mycobacterium tuberculosis H37Rv
gccaccgccagcgu

SEQ ID NO: 3280694 - RNA, 17 nt, Mycobacterium tuberculosis H37Rv
gccaccgcccagugcca

SEQ ID NO: 3280695 - RNA, 17 nt, Mycobacterium tuberculosis H37Rv
gccaccgccgaaaaccu

SEQ ID NO: 3280696 - RNA, 13 nt, Mycobacterium tuberculosis H37Rv
gccaccgccgccg

SEQ ID NO: 3280697 - RNA, 21 nt, Mycobacterium tuberculosis H37Rv
gccaccgccgccgccaccggc

SEQ ID NO: 3280698 - RNA, 14 nt, Mycobacterium tuberculosis H37Rv
gccaccgccgccgg

SEQ ID NO: 3280699 - RNA, 13 nt, Mycobacterium tuberculosis H37Rv
gccaccgccgccu

SEQ ID NO: 3280700 - RNA, 15 nt, Mycobacterium tuberculosis H37Rv
gccaccgccgccugc

SEQ ID NO: 3280701 - RNA, 17 nt, Mycobacterium tuberculosis H37Rv
gccaccgccgccugccc

SEQ ID NO: 3280702 - RNA, 15 nt, Mycobacterium tuberculosis H37Rv
gccaccgccgcugcc

SEQ ID NO: 3280703 - RNA, 23 nt, Mycobacterium tuberculosis H37Rv
gccaccgccggcagcaucggcac

SEQ ID NO: 3280704 - RNA, 23 nt, Mycobacterium tuberculosis H37Rv
gccaccgcgacaccccggaaucc

SEQ ID NO: 3280705 - RNA, 16 nt, Mycobacterium tuberculosis H37Rv
gccaccgcgacgagcg

SEQ ID NO: 3280706 - RNA, 18 nt, Mycobacterium tuberculosis H37Rv
gccaccgcgagcagagga

SEQ ID NO: 3280707 - RNA, 21 nt, Mycobacterium tuberculosis H37Rv
gccaccgcggccugacgcugc

SEQ ID NO: 3280708 - RNA, 16 nt, Mycobacterium tuberculosis H37Rv
gccaccgcgggcggca

SEQ ID NO: 3280709 - RNA, 17 nt, Mycobacterium tuberculosis H37Rv
gccaccgcgggcggcau

SEQ ID NO: 3280710 - RNA, 20 nt, Mycobacterium tuberculosis H37Rv
gccaccgcgggcggcaucgc

SEQ ID NO: 3280711 - RNA, 13 nt, Mycobacterium tuberculosis H37Rv
gccaccgcgguca

SEQ ID NO: 3280712 - RNA, 18 nt, Mycobacterium tuberculosis H37Rv
gccaccgcggucagcucg

SEQ ID NO: 3280713 - RNA, 19 nt, Mycobacterium tuberculosis H37Rv
gccaccgcggucagcucgg

SEQ ID NO: 3280714 - RNA, 20 nt, Mycobacterium tuberculosis H37Rv
gccaccgcggucagcucggc

SEQ ID NO: 3280715 - RNA, 16 nt, Mycobacterium tuberculosis H37Rv
gccaccgcugccggca

SEQ ID NO: 3280716 - RNA, 17 nt, Mycobacterium tuberculosis H37Rv
gccaccgcugccggcac

SEQ ID NO: 3280717 - RNA, 19 nt, Mycobacterium tuberculosis H37Rv
gccaccgcugccggcacgc

SEQ ID NO: 3280718 - RNA, 18 nt, Mycobacterium tuberculosis H37Rv
gccaccggaauccgggcc

SEQ ID NO: 3280719 - RNA, 21 nt, Mycobacterium tuberculosis H37Rv
gccaccggcaaucggcggcac

SEQ ID NO: 3280720 - RNA, 20 nt, Mycobacterium tuberculosis H37Rv
gccaccggcaccgccugcgc

SEQ ID NO: 3280721 - RNA, 23 nt, Mycobacterium tuberculosis H37Rv
gccaccggccgcggcgccuagca

SEQ ID NO: 3280722 - RNA, 18 nt, Mycobacterium tuberculosis H37Rv
gccaccggccggcgcagu

SEQ ID NO: 3280723 - RNA, 13 nt, Mycobacterium tuberculosis H37Rv
gccaccggcgacg

SEQ ID NO: 3280724 - RNA, 13 nt, Mycobacterium tuberculosis H37Rv
gccaccggcgcca

SEQ ID NO: 3280725 - RNA, 15 nt, Mycobacterium tuberculosis H37Rv
gccaccggcgccacc

SEQ ID NO: 3280726 - RNA, 23 nt, Mycobacterium tuberculosis H37Rv
gccaccggcgccaccggcgccgc

SEQ ID NO: 3280727 - RNA, 18 nt, Mycobacterium tuberculosis H37Rv
gccaccggcgccgccguc

SEQ ID NO: 3280728 - RNA, 20 nt, Mycobacterium tuberculosis H37Rv
gccaccggcgccgccgucgc

SEQ ID NO: 3280729 - RNA, 21 nt, Mycobacterium tuberculosis H37Rv
gccaccggcgucgacgucggc

SEQ ID NO: 3280730 - RNA, 16 nt, Mycobacterium tuberculosis H37Rv
gccaccggcgucugcc

SEQ ID NO: 3280731 - RNA, 21 nt, Mycobacterium tuberculosis H37Rv
gccaccggcgucugcccgccc

SEQ ID NO: 3280732 - RNA, 17 nt, Mycobacterium tuberculosis H37Rv
gccaccgggacgauucu

SEQ ID NO: 3280733 - RNA, 19 nt, Mycobacterium tuberculosis H37Rv
gccaccgggcgugcggcgg

SEQ ID NO: 3280734 - RNA, 20 nt, Mycobacterium tuberculosis H37Rv
gccaccgguaccgccggcuc

SEQ ID NO: 3280735 - RNA, 18 nt, Mycobacterium tuberculosis H37Rv
gccaccggugagcgcagc

SEQ ID NO: 3280736 - RNA, 20 nt, Mycobacterium tuberculosis H37Rv
gccaccggugagcgcagcuu

SEQ ID NO: 3280737 - RNA, 16 nt, Mycobacterium tuberculosis H37Rv
gccaccggugccggcg

SEQ ID NO: 3280738 - RNA, 23 nt, Mycobacterium tuberculosis H37Rv
gccaccgguuuggagcucaucga

SEQ ID NO: 3280739 - RNA, 16 nt, Mycobacterium tuberculosis H37Rv
gccaccguagccagca

SEQ ID NO: 3280740 - RNA, 14 nt, Mycobacterium tuberculosis H37Rv
gccaccguagccga

SEQ ID NO: 3280741 - RNA, 19 nt, Mycobacterium tuberculosis H37Rv
gccaccgucaccgccguca

SEQ ID NO: 3280742 - RNA, 13 nt, Mycobacterium tuberculosis H37Rv
gccaccgucagcg

SEQ ID NO: 3280743 - RNA, 18 nt, Mycobacterium tuberculosis H37Rv
gccaccgucagcgcgacc

SEQ ID NO: 3280744 - RNA, 14 nt, Mycobacterium tuberculosis H37Rv
gccaccgucaugcc

SEQ ID NO: 3280745 - RNA, 16 nt, Mycobacterium tuberculosis H37Rv
gccaccgucaugccga

SEQ ID NO: 3280746 - RNA, 17 nt, Mycobacterium tuberculosis H37Rv
gccaccgucaugccgac

SEQ ID NO: 3280747 - RNA, 19 nt, Mycobacterium tuberculosis H37Rv
gccaccgucaugccgacga

SEQ ID NO: 3280748 - RNA, 13 nt, Mycobacterium tuberculosis H37Rv
gccaccgucaugg

SEQ ID NO: 3280749 - RNA, 17 nt, Mycobacterium tuberculosis H37Rv
gccaccgucauggcggg

SEQ ID NO: 3280750 - RNA, 13 nt, Mycobacterium tuberculosis H37Rv
gccaccgucgcgg

SEQ ID NO: 3280751 - RNA, 16 nt, Mycobacterium tuberculosis H37Rv
gccaccgucgcugccc

SEQ ID NO: 3280752 - RNA, 20 nt, Mycobacterium tuberculosis H37Rv
gccaccgucgcugcccgcgc

SEQ ID NO: 3280753 - RNA, 16 nt, Mycobacterium tuberculosis H37Rv
gccaccguggccgcag

SEQ ID NO: 3280754 - RNA, 19 nt, Mycobacterium tuberculosis H37Rv
gccaccguggccgcagggc

SEQ ID NO: 3280755 - RNA, 16 nt, Mycobacterium tuberculosis H37Rv
gccaccgugguucggc

SEQ ID NO: 3280756 - RNA, 16 nt, Mycobacterium tuberculosis H37Rv
gccaccgugucacgcg

SEQ ID NO: 3280757 - RNA, 23 nt, Mycobacterium tuberculosis H37Rv
gccaccgugucacgcgaccaccg

SEQ ID NO: 3280758 - RNA, 20 nt, Mycobacterium tuberculosis H37Rv
gccaccguugccgaaccacg

SEQ ID NO: 3280759 - RNA, 20 nt, Mycobacterium tuberculosis H37Rv
gccaccucccacgccgccgu

SEQ ID NO: 3280760 - RNA, 15 nt, Mycobacterium tuberculosis H37Rv
gccaccuccgacggg

SEQ ID NO: 3280761 - RNA, 23 nt, Mycobacterium tuberculosis H37Rv
gccaccucgccggccgucagcac

SEQ ID NO: 3280762 - RNA, 17 nt, Mycobacterium tuberculosis H37Rv
gccaccucggaggugcc

SEQ ID NO: 3280763 - RNA, 22 nt, Mycobacterium tuberculosis H37Rv
gccaccugacaaacggcuuggc

SEQ ID NO: 3280764 - RNA, 22 nt, Mycobacterium tuberculosis H37Rv
gccaccugacgugcggcgcggc

SEQ ID NO: 3280765 - RNA, 21 nt, Mycobacterium tuberculosis H37Rv
gccaccugguuuacccgcaug

SEQ ID NO: 3280766 - RNA, 19 nt, Mycobacterium tuberculosis H37Rv
gccaccugugcgaacagcg

SEQ ID NO: 3280767 - RNA, 18 nt, Mycobacterium tuberculosis H37Rv
gccaccuuagcgcuugcc

SEQ ID NO: 3280768 - RNA, 19 nt, Mycobacterium tuberculosis H37Rv
gccaccuuggacaccacga

SEQ ID NO: 3280769 - RNA, 21 nt, Mycobacterium tuberculosis H37Rv
gccaccuuggcguugaccagc

SEQ ID NO: 3280770 - RNA, 13 nt, Mycobacterium tuberculosis H37Rv
gccacgaacugau

SEQ ID NO: 3280771 - RNA, 13 nt, Mycobacterium tuberculosis H37Rv
gccacgacagguc

SEQ ID NO: 3280772 - RNA, 14 nt, Mycobacterium tuberculosis H37Rv
gccacgaccgccga

SEQ ID NO: 3280773 - RNA, 14 nt, Mycobacterium tuberculosis H37Rv
gccacgaccgcggc

SEQ ID NO: 3280774 - RNA, 22 nt, Mycobacterium tuberculosis H37Rv
gccacgaccucgggaucggcgg

SEQ ID NO: 3280775 - RNA, 20 nt, Mycobacterium tuberculosis H37Rv
gccacuucuucacuggcgaa

SEQ ID NO: 3280776 - RNA, 22 nt, Mycobacterium tuberculosis H37Rv
gccagaaaccccaaacaacccc

SEQ ID NO: 3280777 - RNA, 17 nt, Mycobacterium tuberculosis H37Rv
gccagaaacccggcgac

SEQ ID NO: 3280778 - RNA, 22 nt, Mycobacterium tuberculosis H37Rv
gccagaaacccggcgaccacgg

SEQ ID NO: 3280779 - RNA, 16 nt, Mycobacterium tuberculosis H37Rv
gccagaacggcgucga

SEQ ID NO: 3280780 - RNA, 13 nt, Mycobacterium tuberculosis H37Rv
gccagaaucccgc

SEQ ID NO: 3280781 - RNA, 16 nt, Mycobacterium tuberculosis H37Rv
gccagaaucccgcuuc

SEQ ID NO: 3280782 - RNA, 15 nt, Mycobacterium tuberculosis H37Rv
gccagaaugggcggc

SEQ ID NO: 3280783 - RNA, 16 nt, Mycobacterium tuberculosis H37Rv
gccagaaugggcggca

SEQ ID NO: 3280784 - RNA, 21 nt, Mycobacterium tuberculosis H37Rv
gccagaccagggcagcggcca

SEQ ID NO: 3280785 - RNA, 18 nt, Mycobacterium tuberculosis H37Rv
gccagacccaccaccgca

SEQ ID NO: 3280786 - RNA, 17 nt, Mycobacterium tuberculosis H37Rv
gccagacggugcagcuc

SEQ ID NO: 3280787 - RNA, 12 nt, Mycobacterium tuberculosis H37Rv
gccagagaucga

SEQ ID NO: 3280788 - RNA, 15 nt, Mycobacterium tuberculosis H37Rv
gccagagaucgaggu

SEQ ID NO: 3280789 - RNA, 21 nt, Mycobacterium tuberculosis H37Rv
gccagagccgcccuugccucc

SEQ ID NO: 3280790 - RNA, 13 nt, Mycobacterium tuberculosis H37Rv
gccagagccgcgc

SEQ ID NO: 3280791 - RNA, 15 nt, Mycobacterium tuberculosis H37Rv
gccagagucgcccgc

SEQ ID NO: 3280792 - RNA, 18 nt, Mycobacterium tuberculosis H37Rv
gccagaguuaccaggucg

SEQ ID NO: 3280793 - RNA, 20 nt, Mycobacterium tuberculosis H37Rv
gccagaguuaccaggucgga

SEQ ID NO: 3280794 - RNA, 23 nt, Mycobacterium tuberculosis H37Rv
gccagaguuaccaggucggaacu

SEQ ID NO: 3280795 - RNA, 14 nt, Mycobacterium tuberculosis H37Rv
gccagauaggcacc

SEQ ID NO: 3280796 - RNA, 20 nt, Mycobacterium tuberculosis H37Rv
gccagauagguccgaucaug

SEQ ID NO: 3280797 - RNA, 20 nt, Mycobacterium tuberculosis H37Rv
gccagauagguuccaccggg

SEQ ID NO: 3280798 - RNA, 21 nt, Mycobacterium tuberculosis H37Rv
gccagaucagcaccgacagcc

SEQ ID NO: 3280799 - RNA, 23 nt, Mycobacterium tuberculosis H37Rv
gccagaucagcaccgacagcccg

SEQ ID NO: 3280800 - RNA, 20 nt, Mycobacterium tuberculosis H37Rv
gccagaucgaagcgcagcac

SEQ ID NO: 3280801 - RNA, 15 nt, Mycobacterium tuberculosis H37Rv
gccagaucgcuagga

SEQ ID NO: 3280802 - RNA, 22 nt, Mycobacterium tuberculosis H37Rv
gccagaucgcuaggaccgcggu

SEQ ID NO: 3280803 - RNA, 13 nt, Mycobacterium tuberculosis H37Rv
gccagaucggcgg

SEQ ID NO: 3280804 - RNA, 22 nt, Mycobacterium tuberculosis H37Rv
gccagaucggcggguggcgcca

SEQ ID NO: 3280805 - RNA, 23 nt, Mycobacterium tuberculosis H37Rv
gccagaucggcggguggcgccag

SEQ ID NO: 3280806 - RNA, 16 nt, Mycobacterium tuberculosis H37Rv
gccagaucggucggcc

SEQ ID NO: 3280807 - RNA, 17 nt, Mycobacterium tuberculosis H37Rv
gccagaucggucggcca

SEQ ID NO: 3280808 - RNA, 19 nt, Mycobacterium tuberculosis H37Rv
gccagaucuccccgaccgc

SEQ ID NO: 3280809 - RNA, 16 nt, Mycobacterium tuberculosis H37Rv
gccagaucucgcgcgc

SEQ ID NO: 3280810 - RNA, 21 nt, Mycobacterium tuberculosis H37Rv
gccagaugccucggagaucga

SEQ ID NO: 3280811 - RNA, 15 nt, Mycobacterium tuberculosis H37Rv
gccagaugguggcau

SEQ ID NO: 3280812 - RNA, 14 nt, Mycobacterium tuberculosis H37Rv
gccagauuggcgcu

SEQ ID NO: 3280813 - RNA, 20 nt, Mycobacterium tuberculosis H37Rv
gccagauuugacgacaaacg

SEQ ID NO: 3280814 - RNA, 17 nt, Mycobacterium tuberculosis H37Rv
gccagcaacagcgcggu

SEQ ID NO: 3280815 - RNA, 15 nt, Mycobacterium tuberculosis H37Rv
gccagcaacgucggu

SEQ ID NO: 3280816 - RNA, 21 nt, Mycobacterium tuberculosis H37Rv
gccagcaagacgaugacagac

SEQ ID NO: 3280817 - RNA, 18 nt, Mycobacterium tuberculosis H37Rv
gccagcaaguacgcgucg

SEQ ID NO: 3280818 - RNA, 18 nt, Mycobacterium tuberculosis H37Rv
gccagcaagucugcccga

SEQ ID NO: 3280819 - RNA, 19 nt, Mycobacterium tuberculosis H37Rv
gccagcaagucugcccgac

SEQ ID NO: 3280820 - RNA, 17 nt, Mycobacterium tuberculosis H37Rv
gccagcaaugcccgcac

SEQ ID NO: 3280821 - RNA, 18 nt, Mycobacterium tuberculosis H37Rv
gccagcaaugcccgcacc

SEQ ID NO: 3280822 - RNA, 16 nt, Mycobacterium tuberculosis H37Rv
gccagcacaccgucga

SEQ ID NO: 3280823 - RNA, 18 nt, Mycobacterium tuberculosis H37Rv
gccagcacaccgucgacg

SEQ ID NO: 3280824 - RNA, 19 nt, Mycobacterium tuberculosis H37Rv
gccagcacaccgucgacga

SEQ ID NO: 3280825 - RNA, 15 nt, Mycobacterium tuberculosis H37Rv
gccagcaccacggcc

SEQ ID NO: 3280826 - RNA, 19 nt, Mycobacterium tuberculosis H37Rv
gccagcaccacggccagcg

SEQ ID NO: 3280827 - RNA, 21 nt, Mycobacterium tuberculosis H37Rv
gccagcaccacggccagcggg

SEQ ID NO: 3280828 - RNA, 14 nt, Mycobacterium tuberculosis H37Rv
gccagcaccacguc

SEQ ID NO: 3280829 - RNA, 19 nt, Mycobacterium tuberculosis H37Rv
gccagcaccacgucgacga

SEQ ID NO: 3280830 - RNA, 13 nt, Mycobacterium tuberculosis H37Rv
gccagcaccagcg

SEQ ID NO: 3280831 - RNA, 21 nt, Mycobacterium tuberculosis H37Rv
gccagcaccagcgucgcggcc

SEQ ID NO: 3280832 - RNA, 15 nt, Mycobacterium tuberculosis H37Rv
gccagcaccagcuca

SEQ ID NO: 3280833 - RNA, 17 nt, Mycobacterium tuberculosis H37Rv
gccagcacccgcagccg

SEQ ID NO: 3280834 - RNA, 16 nt, Mycobacterium tuberculosis H37Rv
gccagcaccggcccga

SEQ ID NO: 3280835 - RNA, 21 nt, Mycobacterium tuberculosis H37Rv
gccagcaccuagucgcggccg

SEQ ID NO: 3280836 - RNA, 22 nt, Mycobacterium tuberculosis H37Rv
gccagcaccuagucgcggccgu

SEQ ID NO: 3280837 - RNA, 18 nt, Mycobacterium tuberculosis H37Rv
gccagcaccucgaccgcc

SEQ ID NO: 3280838 - RNA, 18 nt, Mycobacterium tuberculosis H37Rv
gccagcaccucggccagc

SEQ ID NO: 3280839 - RNA, 15 nt, Mycobacterium tuberculosis H37Rv
gccagcacgaccucg

SEQ ID NO: 3280840 - RNA, 21 nt, Mycobacterium tuberculosis H37Rv
gccagcacgcccucgacgcgc

SEQ ID NO: 3280841 - RNA, 22 nt, Mycobacterium tuberculosis H37Rv
gccagcacgcccucgacgcgcu

SEQ ID NO: 3280842 - RNA, 15 nt, Mycobacterium tuberculosis H37Rv
gccagcacgccgccg

SEQ ID NO: 3280843 - RNA, 16 nt, Mycobacterium tuberculosis H37Rv
gccagcacgccgccgg

SEQ ID NO: 3280844 - RNA, 21 nt, Mycobacterium tuberculosis H37Rv
gccagcacgccgccggccgcc

SEQ ID NO: 3280845 - RNA, 15 nt, Mycobacterium tuberculosis H37Rv
gccagcacggcgacg

SEQ ID NO: 3280846 - RNA, 22 nt, Mycobacterium tuberculosis H37Rv
gccagcacgguguugcgcaccc

SEQ ID NO: 3280847 - RNA, 13 nt, Mycobacterium tuberculosis H37Rv
gccagcacuccac

SEQ ID NO: 3280848 - RNA, 19 nt, Mycobacterium tuberculosis H37Rv
gccagcacugccaucgcgg

SEQ ID NO: 3280849 - RNA, 15 nt, Mycobacterium tuberculosis H37Rv
gccagcagagcggca

SEQ ID NO: 3280850 - RNA, 13 nt, Mycobacterium tuberculosis H37Rv
gccagcagauucu

SEQ ID NO: 3280851 - RNA, 16 nt, Mycobacterium tuberculosis H37Rv
gccagcagcaaccgcc

SEQ ID NO: 3280852 - RNA, 16 nt, Mycobacterium tuberculosis H37Rv
gccagcagcaaucagc

SEQ ID NO: 3280853 - RNA, 20 nt, Mycobacterium tuberculosis H37Rv
gccagcagcaaucagccgcc

SEQ ID NO: 3280854 - RNA, 11 nt, Mycobacterium tuberculosis H37Rv
gccagcagcag

SEQ ID NO: 3280855 - RNA, 13 nt, Mycobacterium tuberculosis H37Rv
gccagcagcagcg

SEQ ID NO: 3280856 - RNA, 15 nt, Mycobacterium tuberculosis H37Rv
gccagcagcagcgcc

SEQ ID NO: 3280857 - RNA, 16 nt, Mycobacterium tuberculosis H37Rv
gccagcagcaggccag

SEQ ID NO: 3280858 - RNA, 22 nt, Mycobacterium tuberculosis H37Rv
gccagcagccacccgacaacgc

SEQ ID NO: 3280859 - RNA, 23 nt, Mycobacterium tuberculosis H37Rv
gccagcagccacccgacaacgcu

SEQ ID NO: 3280860 - RNA, 14 nt, Mycobacterium tuberculosis H37Rv
gccagcagccgcga

SEQ ID NO: 3280861 - RNA, 13 nt, Mycobacterium tuberculosis H37Rv
gccagcagcgcga

SEQ ID NO: 3280862 - RNA, 21 nt, Mycobacterium tuberculosis H37Rv
gccagcagcgcgggaucugag

SEQ ID NO: 3280863 - RNA, 16 nt, Mycobacterium tuberculosis H37Rv
gccagcagcggcgagc

SEQ ID NO: 3280864 - RNA, 19 nt, Mycobacterium tuberculosis H37Rv
gccagcagcggcgagccaa

SEQ ID NO: 3280865 - RNA, 17 nt, Mycobacterium tuberculosis H37Rv
gccagcagcugcuccag

SEQ ID NO: 3280866 - RNA, 18 nt, Mycobacterium tuberculosis H37Rv
gccagcagcugcuccagu

SEQ ID NO: 3280867 - RNA, 22 nt, Mycobacterium tuberculosis H37Rv
gccagcaggaacgccgugccgu

SEQ ID NO: 3280868 - RNA, 13 nt, Mycobacterium tuberculosis H37Rv
gccagcaggauga

SEQ ID NO: 3280869 - RNA, 17 nt, Mycobacterium tuberculosis H37Rv
gccagcaggaugaugac

SEQ ID NO: 3280870 - RNA, 13 nt, Mycobacterium tuberculosis H37Rv
gccagcaggccga

SEQ ID NO: 3280871 - RNA, 13 nt, Mycobacterium tuberculosis H37Rv
gccaggucgagca

SEQ ID NO: 3280872 - RNA, 15 nt, Mycobacterium tuberculosis H37Rv
gccaggucgagcacc

SEQ ID NO: 3280873 - RNA, 22 nt, Mycobacterium tuberculosis H37Rv
gccaggucgauaccggcgugca

SEQ ID NO: 3280874 - RNA, 19 nt, Mycobacterium tuberculosis H37Rv
gccaggucggccaccgugg

SEQ ID NO: 3280875 - RNA, 15 nt, Mycobacterium tuberculosis H37Rv
gccaggucggcggac

SEQ ID NO: 3280876 - RNA, 16 nt, Mycobacterium tuberculosis H37Rv
gccaggucggcgggcg

SEQ ID NO: 3280877 - RNA, 18 nt, Mycobacterium tuberculosis H37Rv
gccaggucggcgggcgcg

SEQ ID NO: 3280878 - RNA, 17 nt, Mycobacterium tuberculosis H37Rv
gccaggucggcguugau

SEQ ID NO: 3280879 - RNA, 19 nt, Mycobacterium tuberculosis H37Rv
gccaggucggugggcggcg

SEQ ID NO: 3280880 - RNA, 15 nt, Mycobacterium tuberculosis H37Rv
gccaggucuccuugg

SEQ ID NO: 3280881 - RNA, 16 nt, Mycobacterium tuberculosis H37Rv
gccaggucuccuuggg

SEQ ID NO: 3280882 - RNA, 17 nt, Mycobacterium tuberculosis H37Rv
gccaggugaugccgccg

SEQ ID NO: 3280883 - RNA, 13 nt, Mycobacterium tuberculosis H37Rv
gccaggugcaggc

SEQ ID NO: 3280884 - RNA, 15 nt, Mycobacterium tuberculosis H37Rv
gccaggugcaggcuu

SEQ ID NO: 3280885 - RNA, 19 nt, Mycobacterium tuberculosis H37Rv
gccaggugcccaagcaguc

SEQ ID NO: 3280886 - RNA, 18 nt, Mycobacterium tuberculosis H37Rv
gccagguggccgcaucgc

SEQ ID NO: 3280887 - RNA, 14 nt, Mycobacterium tuberculosis H37Rv
gccagguggcgagc

SEQ ID NO: 3280888 - RNA, 20 nt, Mycobacterium tuberculosis H37Rv
gccagguguucgccggagac

SEQ ID NO: 3280889 - RNA, 17 nt, Mycobacterium tuberculosis H37Rv
gccagguugccgucggc

SEQ ID NO: 3280890 - RNA, 16 nt, Mycobacterium tuberculosis H37Rv
gccagguuuugccgcg

SEQ ID NO: 3280891 - RNA, 17 nt, Mycobacterium tuberculosis H37Rv
gccagguuuugccgcgu

SEQ ID NO: 3280892 - RNA, 14 nt, Mycobacterium tuberculosis H37Rv
gccaguacgucgau

SEQ ID NO: 3280893 - RNA, 14 nt, Mycobacterium tuberculosis H37Rv
gccaguacucggcc

SEQ ID NO: 3280894 - RNA, 18 nt, Mycobacterium tuberculosis H37Rv
gccaguacucggccagcg

SEQ ID NO: 3280895 - RNA, 21 nt, Mycobacterium tuberculosis H37Rv
gccaguagucgccgggcggcc

SEQ ID NO: 3280896 - RNA, 16 nt, Mycobacterium tuberculosis H37Rv
gccaguaugcggugcc

SEQ ID NO: 3280897 - RNA, 19 nt, Mycobacterium tuberculosis H37Rv
gccaguaugcggugcccgc

SEQ ID NO: 3280898 - RNA, 21 nt, Mycobacterium tuberculosis H37Rv
gccaguaugcggugcccgccc

SEQ ID NO: 3280899 - RNA, 15 nt, Mycobacterium tuberculosis H37Rv
gccaguccagcgcgc

SEQ ID NO: 3280900 - RNA, 23 nt, Mycobacterium tuberculosis H37Rv
gccaguccagcgcgccacccagc

SEQ ID NO: 3280901 - RNA, 13 nt, Mycobacterium tuberculosis H37Rv
gccagucccacug

SEQ ID NO: 3280902 - RNA, 21 nt, Mycobacterium tuberculosis H37Rv
gccagucccccgcucgaccag

SEQ ID NO: 3280903 - RNA, 20 nt, Mycobacterium tuberculosis H37Rv
gccaguccgaaagccgccga

SEQ ID NO: 3280904 - RNA, 13 nt, Mycobacterium tuberculosis H37Rv
gccaguccgcagc

SEQ ID NO: 3280905 - RNA, 14 nt, Mycobacterium tuberculosis H37Rv
gccaguccgcagcg

SEQ ID NO: 3280906 - RNA, 20 nt, Mycobacterium tuberculosis H37Rv
gccaguccgcagcguccagc

SEQ ID NO: 3280907 - RNA, 14 nt, Mycobacterium tuberculosis H37Rv
gccaguccgcgcgc

SEQ ID NO: 3280908 - RNA, 15 nt, Mycobacterium tuberculosis H37Rv
gccaguccggggaac

SEQ ID NO: 3280909 - RNA, 14 nt, Mycobacterium tuberculosis H37Rv
gccagucgaucgcg

SEQ ID NO: 3280910 - RNA, 15 nt, Mycobacterium tuberculosis H37Rv
gccagucgaucgcgg

SEQ ID NO: 3280911 - RNA, 14 nt, Mycobacterium tuberculosis H37Rv
gccagucgccgaaa

SEQ ID NO: 3280912 - RNA, 16 nt, Mycobacterium tuberculosis H37Rv
gccagugaacgcgcgu

SEQ ID NO: 3280913 - RNA, 18 nt, Mycobacterium tuberculosis H37Rv
gccagugaacgcgcgugc

SEQ ID NO: 3280914 - RNA, 16 nt, Mycobacterium tuberculosis H37Rv
gccagugaggaucaug

SEQ ID NO: 3280915 - RNA, 13 nt, Mycobacterium tuberculosis H37Rv
gccagugauggcg

SEQ ID NO: 3280916 - RNA, 17 nt, Mycobacterium tuberculosis H37Rv
gccagugauggcgcggu

SEQ ID NO: 3280917 - RNA, 20 nt, Mycobacterium tuberculosis H37Rv
gccagugauggcgcggucgc

SEQ ID NO: 3280918 - RNA, 15 nt, Mycobacterium tuberculosis H37Rv
gccagugccaccugg

SEQ ID NO: 3280919 - RNA, 22 nt, Mycobacterium tuberculosis H37Rv
gccagugccaccugggcgggcu

SEQ ID NO: 3280920 - RNA, 22 nt, Mycobacterium tuberculosis H37Rv
gccagugcccgcacugccgccg

SEQ ID NO: 3280921 - RNA, 22 nt, Mycobacterium tuberculosis H37Rv
gccagugcugcaccgauucggg

SEQ ID NO: 3280922 - RNA, 17 nt, Mycobacterium tuberculosis H37Rv
gccaguggccaccauca

SEQ ID NO: 3280923 - RNA, 23 nt, Mycobacterium tuberculosis H37Rv
gccaguggucgauuucggcgcgu

SEQ ID NO: 3280924 - RNA, 15 nt, Mycobacterium tuberculosis H37Rv
gccagugucagcacg

SEQ ID NO: 3280925 - RNA, 19 nt, Mycobacterium tuberculosis H37Rv
gccagugucccgcgcggau

SEQ ID NO: 3280926 - RNA, 21 nt, Mycobacterium tuberculosis H37Rv
gccaguguugcgcugcggcca

SEQ ID NO: 3280927 - RNA, 15 nt, Mycobacterium tuberculosis H37Rv
gccaguuccggugac

SEQ ID NO: 3280928 - RNA, 14 nt, Mycobacterium tuberculosis H37Rv
gccaguucgcggcu

SEQ ID NO: 3280929 - RNA, 18 nt, Mycobacterium tuberculosis H37Rv
gccaguucggcggccgcc

SEQ ID NO: 3280930 - RNA, 14 nt, Mycobacterium tuberculosis H37Rv
gccaguucggcggg

SEQ ID NO: 3280931 - RNA, 21 nt, Mycobacterium tuberculosis H37Rv
gccaguucggcgggcgcgggu

SEQ ID NO: 3280932 - RNA, 22 nt, Mycobacterium tuberculosis H37Rv
gccaguucggcgucguccgcgc

SEQ ID NO: 3280933 - RNA, 14 nt, Mycobacterium tuberculosis H37Rv
gccaguucgucggc

SEQ ID NO: 3280934 - RNA, 22 nt, Mycobacterium tuberculosis H37Rv
gccaguugaucaggccgaugcg

SEQ ID NO: 3280935 - RNA, 19 nt, Mycobacterium tuberculosis H37Rv
gccaguugcguuguccacc

SEQ ID NO: 3280936 - RNA, 18 nt, Mycobacterium tuberculosis H37Rv
gccaguugguagccgccc

SEQ ID NO: 3280937 - RNA, 20 nt, Mycobacterium tuberculosis H37Rv
gccauaaaugcgcguucgac

SEQ ID NO: 3280938 - RNA, 19 nt, Mycobacterium tuberculosis H37Rv
gccauacagcaccccgccg

SEQ ID NO: 3280939 - RNA, 16 nt, Mycobacterium tuberculosis H37Rv
gccauaccggccgcca

SEQ ID NO: 3280940 - RNA, 22 nt, Mycobacterium tuberculosis H37Rv
gccauaccggccgccaucaucg

SEQ ID NO: 3280941 - RNA, 14 nt, Mycobacterium tuberculosis H37Rv
gccauaccugccgg

SEQ ID NO: 3280942 - RNA, 21 nt, Mycobacterium tuberculosis H37Rv
gccauaccugccggaccaccg

SEQ ID NO: 3280943 - RNA, 14 nt, Mycobacterium tuberculosis H37Rv
gccauacgucgccu

SEQ ID NO: 3280944 - RNA, 16 nt, Mycobacterium tuberculosis H37Rv
gccauagcgggcggua

SEQ ID NO: 3280945 - RNA, 16 nt, Mycobacterium tuberculosis H37Rv
gccauaggcccacggc

SEQ ID NO: 3280946 - RNA, 22 nt, Mycobacterium tuberculosis H37Rv
gccauagugaggccgaccagca

SEQ ID NO: 3280947 - RNA, 19 nt, Mycobacterium tuberculosis H37Rv
gccaucaacaaggggcagc

SEQ ID NO: 3280948 - RNA, 20 nt, Mycobacterium tuberculosis H37Rv
gccaucaacaaggggcagca

SEQ ID NO: 3280949 - RNA, 15 nt, Mycobacterium tuberculosis H37Rv
gccaucaaggccacc

SEQ ID NO: 3280950 - RNA, 18 nt, Mycobacterium tuberculosis H37Rv
gccaucacaucggccucu

SEQ ID NO: 3280951 - RNA, 19 nt, Mycobacterium tuberculosis H37Rv
gccaucacggucagcucgc

SEQ ID NO: 3280952 - RNA, 17 nt, Mycobacterium tuberculosis H37Rv
gccaucagaaccuccuc

SEQ ID NO: 3280953 - RNA, 13 nt, Mycobacterium tuberculosis H37Rv
gccaucagcucgc

SEQ ID NO: 3280954 - RNA, 18 nt, Mycobacterium tuberculosis H37Rv
gccaucaucgcuuggccu

SEQ ID NO: 3280955 - RNA, 15 nt, Mycobacterium tuberculosis H37Rv
gccaucauggcggcc

SEQ ID NO: 3280956 - RNA, 16 nt, Mycobacterium tuberculosis H37Rv
gccaucauggcggccc

SEQ ID NO: 3280957 - RNA, 14 nt, Mycobacterium tuberculosis H37Rv
gccauccaccgcag

SEQ ID NO: 3280958 - RNA, 19 nt, Mycobacterium tuberculosis H37Rv
gccauccccuggccagcag

SEQ ID NO: 3280959 - RNA, 21 nt, Mycobacterium tuberculosis H37Rv
gccauccgccgaaagcaucac

SEQ ID NO: 3280960 - RNA, 18 nt, Mycobacterium tuberculosis H37Rv
gccauccggcggcggcca

SEQ ID NO: 3280961 - RNA, 23 nt, Mycobacterium tuberculosis H37Rv
gccauccggucggucucggcgag

SEQ ID NO: 3280962 - RNA, 17 nt, Mycobacterium tuberculosis H37Rv
gccauccguaucacggu

SEQ ID NO: 3280963 - RNA, 22 nt, Mycobacterium tuberculosis H37Rv
gccauccucgagcugcuggcgc

SEQ ID NO: 3280964 - RNA, 22 nt, Mycobacterium tuberculosis H37Rv
gccauccuuaugcgcggugacc

SEQ ID NO: 3280965 - RNA, 14 nt, Mycobacterium tuberculosis H37Rv
gccaucgagcagca

SEQ ID NO: 3280966 - RNA, 17 nt, Mycobacterium tuberculosis H37Rv
gccaucgaguccaccac

SEQ ID NO: 3280967 - RNA, 23 nt, Mycobacterium tuberculosis H37Rv
gcccacaugaacgaccaccgcug

SEQ ID NO: 3280968 - RNA, 16 nt, Mycobacterium tuberculosis H37Rv
gcccacaugcgcucgc

SEQ ID NO: 3280969 - RNA, 20 nt, Mycobacterium tuberculosis H37Rv
gcccacaugcucagggcagu

SEQ ID NO: 3280970 - RNA, 17 nt, Mycobacterium tuberculosis H37Rv
gcccacauguccagcgu

SEQ ID NO: 3280971 - RNA, 22 nt, Mycobacterium tuberculosis H37Rv
gcccacauguccagcguccugg

SEQ ID NO: 3280972 - RNA, 17 nt, Mycobacterium tuberculosis H37Rv
gcccaccacacagccgc

SEQ ID NO: 3280973 - RNA, 23 nt, Mycobacterium tuberculosis H37Rv
gcccaccaccgacagcacccggc

SEQ ID NO: 3280974 - RNA, 21 nt, Mycobacterium tuberculosis H37Rv
gcccaccacgaacacguucgg

SEQ ID NO: 3280975 - RNA, 21 nt, Mycobacterium tuberculosis H37Rv
gcccaccacgcgacgcggggc

SEQ ID NO: 3280976 - RNA, 12 nt, Mycobacterium tuberculosis H37Rv
gcccaccacugu

SEQ ID NO: 3280977 - RNA, 23 nt, Mycobacterium tuberculosis H37Rv
gcccaccacugugacacccgagg

SEQ ID NO: 3280978 - RNA, 23 nt, Mycobacterium tuberculosis H37Rv
gcccaccagcgcagccgaucguc

SEQ ID NO: 3280979 - RNA, 17 nt, Mycobacterium tuberculosis H37Rv
gcccaccaggcccaucu

SEQ ID NO: 3280980 - RNA, 13 nt, Mycobacterium tuberculosis H37Rv
gcccaccaugauc

SEQ ID NO: 3280981 - RNA, 17 nt, Mycobacterium tuberculosis H37Rv
gcccacccauggccucc

SEQ ID NO: 3280982 - RNA, 16 nt, Mycobacterium tuberculosis H37Rv
gcccacccgggugggc

SEQ ID NO: 3280983 - RNA, 20 nt, Mycobacterium tuberculosis H37Rv
gcccacccgggugggccagu

SEQ ID NO: 3280984 - RNA, 13 nt, Mycobacterium tuberculosis H37Rv
gcccaccgaaacc

SEQ ID NO: 3280985 - RNA, 15 nt, Mycobacterium tuberculosis H37Rv
gcccaccgacccaga

SEQ ID NO: 3280986 - RNA, 12 nt, Mycobacterium tuberculosis H37Rv
gcccaccgcaac

SEQ ID NO: 3280987 - RNA, 14 nt, Mycobacterium tuberculosis H37Rv
gcccaccggccacu

SEQ ID NO: 3280988 - RNA, 15 nt, Mycobacterium tuberculosis H37Rv
gcccaccggcuagcu

SEQ ID NO: 3280989 - RNA, 17 nt, Mycobacterium tuberculosis H37Rv
gcccaccggcuagcugu

SEQ ID NO: 3280990 - RNA, 12 nt, Mycobacterium tuberculosis H37Rv
gcccaccggucg

SEQ ID NO: 3280991 - RNA, 21 nt, Mycobacterium tuberculosis H37Rv
gcccaccggugccgcccgcgc

SEQ ID NO: 3280992 - RNA, 19 nt, Mycobacterium tuberculosis H37Rv
gcccaccgucgcauacgcc

SEQ ID NO: 3280993 - RNA, 15 nt, Mycobacterium tuberculosis H37Rv
gcccaccgucugcug

SEQ ID NO: 3280994 - RNA, 18 nt, Mycobacterium tuberculosis H37Rv
gcccaccuccucgccgga

SEQ ID NO: 3280995 - RNA, 17 nt, Mycobacterium tuberculosis H37Rv
gcccaccuccugguuga

SEQ ID NO: 3280996 - RNA, 19 nt, Mycobacterium tuberculosis H37Rv
gcccaccucgaucgcgccg

SEQ ID NO: 3280997 - RNA, 15 nt, Mycobacterium tuberculosis H37Rv
gcccaccuggggccg

SEQ ID NO: 3280998 - RNA, 20 nt, Mycobacterium tuberculosis H37Rv
gcccacgcacagcaacgccc

SEQ ID NO: 3280999 - RNA, 22 nt, Mycobacterium tuberculosis H37Rv
gcccacgcgcacucgaccagga

SEQ ID NO: 3281000 - RNA, 18 nt, Mycobacterium tuberculosis H37Rv
gcccacgcgccaccgagc

SEQ ID NO: 3281001 - RNA, 13 nt, Mycobacterium tuberculosis H37Rv
gcccacgcugccc

SEQ ID NO: 3281002 - RNA, 16 nt, Mycobacterium tuberculosis H37Rv
gcccacggcaccacca

SEQ ID NO: 3281003 - RNA, 15 nt, Mycobacterium tuberculosis H37Rv
gcccacggcagcgcc

SEQ ID NO: 3281004 - RNA, 16 nt, Mycobacterium tuberculosis H37Rv
gcccacggcgaccacg

SEQ ID NO: 3281005 - RNA, 17 nt, Mycobacterium tuberculosis H37Rv
gcccacggcgaccacgc

SEQ ID NO: 3281006 - RNA, 21 nt, Mycobacterium tuberculosis H37Rv
gcccacggcgaccacgccgcc

SEQ ID NO: 3281007 - RNA, 23 nt, Mycobacterium tuberculosis H37Rv
gcccacggcgaccacgccgccgg

SEQ ID NO: 3281008 - RNA, 18 nt, Mycobacterium tuberculosis H37Rv
gcccacgggccggccgag

SEQ ID NO: 3281009 - RNA, 20 nt, Mycobacterium tuberculosis H37Rv
gcccacgggccggccgagcg

SEQ ID NO: 3281010 - RNA, 14 nt, Mycobacterium tuberculosis H37Rv
gcccacgguguccc

SEQ ID NO: 3281011 - RNA, 16 nt, Mycobacterium tuberculosis H37Rv
gcccacguggggccgg

SEQ ID NO: 3281012 - RNA, 19 nt, Mycobacterium tuberculosis H37Rv
gcccacguugacggcgaac

SEQ ID NO: 3281013 - RNA, 16 nt, Mycobacterium tuberculosis H37Rv
gcccacguuggccagg

SEQ ID NO: 3281014 - RNA, 16 nt, Mycobacterium tuberculosis H37Rv
gcccacguuggccccg

SEQ ID NO: 3281015 - RNA, 19 nt, Mycobacterium tuberculosis H37Rv
gcccacguuggccccgcgg

SEQ ID NO: 3281016 - RNA, 18 nt, Mycobacterium tuberculosis H37Rv
gcccacguuuagggugcc

SEQ ID NO: 3281017 - RNA, 23 nt, Mycobacterium tuberculosis H37Rv
gcccacuagcagggggacccgga

SEQ ID NO: 3281018 - RNA, 16 nt, Mycobacterium tuberculosis H37Rv
gcccacuccagcagcu

SEQ ID NO: 3281019 - RNA, 21 nt, Mycobacterium tuberculosis H37Rv
gcccacuccagcagcucgccg

SEQ ID NO: 3281020 - RNA, 20 nt, Mycobacterium tuberculosis H37Rv
gcccagacaauugcagcgac

SEQ ID NO: 3281021 - RNA, 18 nt, Mycobacterium tuberculosis H37Rv
gcccagauaucguacugg

SEQ ID NO: 3281022 - RNA, 21 nt, Mycobacterium tuberculosis H37Rv
gcccagaucgguugaucggcc

SEQ ID NO: 3281023 - RNA, 13 nt, Mycobacterium tuberculosis H37Rv
gcccagaugucuu

SEQ ID NO: 3281024 - RNA, 20 nt, Mycobacterium tuberculosis H37Rv
gcccagauguuuagcguccg

SEQ ID NO: 3281025 - RNA, 23 nt, Mycobacterium tuberculosis H37Rv
gcccagauguuuagcguccgagc

SEQ ID NO: 3281026 - RNA, 17 nt, Mycobacterium tuberculosis H37Rv
gcccagcaaccgcucgg

SEQ ID NO: 3281027 - RNA, 20 nt, Mycobacterium tuberculosis H37Rv
gcccagcacccucaggcaau

SEQ ID NO: 3281028 - RNA, 15 nt, Mycobacterium tuberculosis H37Rv
gcccagcacgcuggc

SEQ ID NO: 3281029 - RNA, 16 nt, Mycobacterium tuberculosis H37Rv
gcccagcacgcuggcg

SEQ ID NO: 3281030 - RNA, 18 nt, Mycobacterium tuberculosis H37Rv
gcccagcacguaacccag

SEQ ID NO: 3281031 - RNA, 21 nt, Mycobacterium tuberculosis H37Rv
gcccagcacguaacccagucc

SEQ ID NO: 3281032 - RNA, 16 nt, Mycobacterium tuberculosis H37Rv
gcccagcagaccaagu

SEQ ID NO: 3281033 - RNA, 19 nt, Mycobacterium tuberculosis H37Rv
gcccagcagaccaaguccg

SEQ ID NO: 3281034 - RNA, 14 nt, Mycobacterium tuberculosis H37Rv
gcccagcagcaccu

SEQ ID NO: 3281035 - RNA, 20 nt, Mycobacterium tuberculosis H37Rv
gcccagcaggcccuuggcga

SEQ ID NO: 3281036 - RNA, 19 nt, Mycobacterium tuberculosis H37Rv
gcccagcaggucgucggcg

SEQ ID NO: 3281037 - RNA, 14 nt, Mycobacterium tuberculosis H37Rv
gcccagcagguucc

SEQ ID NO: 3281038 - RNA, 19 nt, Mycobacterium tuberculosis H37Rv
gcccagcagguuccacggc

SEQ ID NO: 3281039 - RNA, 21 nt, Mycobacterium tuberculosis H37Rv
gcccagcagguuccacggcca

SEQ ID NO: 3281040 - RNA, 22 nt, Mycobacterium tuberculosis H37Rv
gcccagcagguuccacggccag

SEQ ID NO: 3281041 - RNA, 21 nt, Mycobacterium tuberculosis H37Rv
gcccagccgagcggcggcacu

SEQ ID NO: 3281042 - RNA, 19 nt, Mycobacterium tuberculosis H37Rv
gcccagccgagcguggcgu

SEQ ID NO: 3281043 - RNA, 20 nt, Mycobacterium tuberculosis H37Rv
gcccagccgagcguggcguu

SEQ ID NO: 3281044 - RNA, 14 nt, Mycobacterium tuberculosis H37Rv
gcccagccgcagca

SEQ ID NO: 3281045 - RNA, 15 nt, Mycobacterium tuberculosis H37Rv
gcccagccgccagcc

SEQ ID NO: 3281046 - RNA, 17 nt, Mycobacterium tuberculosis H37Rv
gcccagccgccagcccg

SEQ ID NO: 3281047 - RNA, 15 nt, Mycobacterium tuberculosis H37Rv
gcccagcgacaacac

SEQ ID NO: 3281048 - RNA, 18 nt, Mycobacterium tuberculosis H37Rv
gcccagcgaccaguggug

SEQ ID NO: 3281049 - RNA, 21 nt, Mycobacterium tuberculosis H37Rv
gcccagcgacccggccagcgg

SEQ ID NO: 3281050 - RNA, 18 nt, Mycobacterium tuberculosis H37Rv
gcccagcgaccgcugcag

SEQ ID NO: 3281051 - RNA, 19 nt, Mycobacterium tuberculosis H37Rv
gcccagcgaccgcugcaga

SEQ ID NO: 3281052 - RNA, 17 nt, Mycobacterium tuberculosis H37Rv
gcccagcgaugcgcuca

SEQ ID NO: 3281053 - RNA, 19 nt, Mycobacterium tuberculosis H37Rv
gcccagcgcccccagcagc

SEQ ID NO: 3281054 - RNA, 22 nt, Mycobacterium tuberculosis H37Rv
gcccagcgcccgcgcggccacu

SEQ ID NO: 3281055 - RNA, 16 nt, Mycobacterium tuberculosis H37Rv
gcccagcgccuccagc

SEQ ID NO: 3281056 - RNA, 17 nt, Mycobacterium tuberculosis H37Rv
gcccagcgccuccagca

SEQ ID NO: 3281057 - RNA, 20 nt, Mycobacterium tuberculosis H37Rv
gcccagcgccuccagcacca

SEQ ID NO: 3281058 - RNA, 15 nt, Mycobacterium tuberculosis H37Rv
gcccagcgcgccagc

SEQ ID NO: 3281059 - RNA, 15 nt, Mycobacterium tuberculosis H37Rv
gcccagcgcuagccg

SEQ ID NO: 3281060 - RNA, 15 nt, Mycobacterium tuberculosis H37Rv
gcccagcggccgcga

SEQ ID NO: 3281061 - RNA, 18 nt, Mycobacterium tuberculosis H37Rv
gcccagcgucaucccgau

SEQ ID NO: 3281062 - RNA, 23 nt, Mycobacterium tuberculosis H37Rv
gcccagcgucugugucccgucga

SEQ ID NO: 3281063 - RNA, 15 nt, Mycobacterium tuberculosis H37Rv
gcccccguuaccgcc

SEQ ID NO: 3281064 - RNA, 20 nt, Mycobacterium tuberculosis H37Rv
gcccccguuaccgccgucgc

SEQ ID NO: 3281065 - RNA, 21 nt, Mycobacterium tuberculosis H37Rv
gcccccguuaccgccgucgcc

SEQ ID NO: 3281066 - RNA, 23 nt, Mycobacterium tuberculosis H37Rv
gcccccguuaccgccgucgccga

SEQ ID NO: 3281067 - RNA, 16 nt, Mycobacterium tuberculosis H37Rv
gcccccguugccgccc

SEQ ID NO: 3281068 - RNA, 17 nt, Mycobacterium tuberculosis H37Rv
gcccccuaaaccggcag

SEQ ID NO: 3281069 - RNA, 23 nt, Mycobacterium tuberculosis H37Rv
gcccccuggauggcgcccugcgc

SEQ ID NO: 3281070 - RNA, 20 nt, Mycobacterium tuberculosis H37Rv
gcccccugguacaccaggcc

SEQ ID NO: 3281071 - RNA, 23 nt, Mycobacterium tuberculosis H37Rv
gccccgaaacgauggccgggucg

SEQ ID NO: 3281072 - RNA, 23 nt, Mycobacterium tuberculosis H37Rv
gccccgaagccggugccggcguu

SEQ ID NO: 3281073 - RNA, 22 nt, Mycobacterium tuberculosis H37Rv
gccccgaauguugcgaucugcg

SEQ ID NO: 3281074 - RNA, 17 nt, Mycobacterium tuberculosis H37Rv
gccccgacauacgucgg

SEQ ID NO: 3281075 - RNA, 21 nt, Mycobacterium tuberculosis H37Rv
gccccgacauacgucggggcc

SEQ ID NO: 3281076 - RNA, 22 nt, Mycobacterium tuberculosis H37Rv
gccccgaccagcagaccaagcc

SEQ ID NO: 3281077 - RNA, 16 nt, Mycobacterium tuberculosis H37Rv
gccccgaccgcguaca

SEQ ID NO: 3281078 - RNA, 15 nt, Mycobacterium tuberculosis H37Rv
gccccgacugcgccc

SEQ ID NO: 3281079 - RNA, 18 nt, Mycobacterium tuberculosis H37Rv
gccccgagcugccgucgc

SEQ ID NO: 3281080 - RNA, 16 nt, Mycobacterium tuberculosis H37Rv
gccccgaggaugccga

SEQ ID NO: 3281081 - RNA, 20 nt, Mycobacterium tuberculosis H37Rv
gccccgauaaaaaccacccc

SEQ ID NO: 3281082 - RNA, 17 nt, Mycobacterium tuberculosis H37Rv
gccccgaucaucgacga

SEQ ID NO: 3281083 - RNA, 13 nt, Mycobacterium tuberculosis H37Rv
gccccgcagcugc

SEQ ID NO: 3281084 - RNA, 22 nt, Mycobacterium tuberculosis H37Rv
gccccgcagcugcgucccggaa

SEQ ID NO: 3281085 - RNA, 19 nt, Mycobacterium tuberculosis H37Rv
gccccgcaggggguggugu

SEQ ID NO: 3281086 - RNA, 15 nt, Mycobacterium tuberculosis H37Rv
gccccgcaucgccca

SEQ ID NO: 3281087 - RNA, 19 nt, Mycobacterium tuberculosis H37Rv
gccccgccaccucgccggc

SEQ ID NO: 3281088 - RNA, 13 nt, Mycobacterium tuberculosis H37Rv
gccccgccagcgc

SEQ ID NO: 3281089 - RNA, 14 nt, Mycobacterium tuberculosis H37Rv
gccccgccagcgcc

SEQ ID NO: 3281090 - RNA, 19 nt, Mycobacterium tuberculosis H37Rv
gccccgccagcgccgguca

SEQ ID NO: 3281091 - RNA, 11 nt, Mycobacterium tuberculosis H37Rv
gccccgcccgg

SEQ ID NO: 3281092 - RNA, 13 nt, Mycobacterium tuberculosis H37Rv
gccccgccgagca

SEQ ID NO: 3281093 - RNA, 16 nt, Mycobacterium tuberculosis H37Rv
gccccgccgagcaccg

SEQ ID NO: 3281094 - RNA, 23 nt, Mycobacterium tuberculosis H37Rv
gccccgccgagcggugccggcgu

SEQ ID NO: 3281095 - RNA, 17 nt, Mycobacterium tuberculosis H37Rv
gccccgccgaugccgcc

SEQ ID NO: 3281096 - RNA, 14 nt, Mycobacterium tuberculosis H37Rv
gccccgccgcacgc

SEQ ID NO: 3281097 - RNA, 14 nt, Mycobacterium tuberculosis H37Rv
gccccgccgccaua

SEQ ID NO: 3281098 - RNA, 18 nt, Mycobacterium tuberculosis H37Rv
gccccgccgcgacgggca

SEQ ID NO: 3281099 - RNA, 14 nt, Mycobacterium tuberculosis H37Rv
gccccgccgcuacc

SEQ ID NO: 3281100 - RNA, 16 nt, Mycobacterium tuberculosis H37Rv
gccccgccggccccgc

SEQ ID NO: 3281101 - RNA, 21 nt, Mycobacterium tuberculosis H37Rv
gccccgccggccccgccguca

SEQ ID NO: 3281102 - RNA, 15 nt, Mycobacterium tuberculosis H37Rv
gccccgccggggccg

SEQ ID NO: 3281103 - RNA, 23 nt, Mycobacterium tuberculosis H37Rv
gccccgccggggccgccgucgcc

SEQ ID NO: 3281104 - RNA, 14 nt, Mycobacterium tuberculosis H37Rv
gccccgccgucacc

SEQ ID NO: 3281105 - RNA, 19 nt, Mycobacterium tuberculosis H37Rv
gccccgccgucacccccga

SEQ ID NO: 3281106 - RNA, 21 nt, Mycobacterium tuberculosis H37Rv
gccccgccguuuccgccgccg

SEQ ID NO: 3281107 - RNA, 17 nt, Mycobacterium tuberculosis H37Rv
gccccgccuuggccacc

SEQ ID NO: 3281108 - RNA, 18 nt, Mycobacterium tuberculosis H37Rv
gccccgccuuggccacca

SEQ ID NO: 3281109 - RNA, 15 nt, Mycobacterium tuberculosis H37Rv
gccccgcgcagcguc

SEQ ID NO: 3281110 - RNA, 15 nt, Mycobacterium tuberculosis H37Rv
gccccgcgccggccg

SEQ ID NO: 3281111 - RNA, 17 nt, Mycobacterium tuberculosis H37Rv
gccccgcgccggccgca

SEQ ID NO: 3281112 - RNA, 17 nt, Mycobacterium tuberculosis H37Rv
gccccgcgcguucggcg

SEQ ID NO: 3281113 - RNA, 21 nt, Mycobacterium tuberculosis H37Rv
gccccgcgcguucggcgagca

SEQ ID NO: 3281114 - RNA, 15 nt, Mycobacterium tuberculosis H37Rv
gccccgcggagcgca

SEQ ID NO: 3281115 - RNA, 12 nt, Mycobacterium tuberculosis H37Rv
gccccgcggcca

SEQ ID NO: 3281116 - RNA, 15 nt, Mycobacterium tuberculosis H37Rv
gccccgcggccagca

SEQ ID NO: 3281117 - RNA, 12 nt, Mycobacterium tuberculosis H37Rv
gccccgcggcgc

SEQ ID NO: 3281118 - RNA, 12 nt, Mycobacterium tuberculosis H37Rv
gccccgcucggu

SEQ ID NO: 3281119 - RNA, 23 nt, Mycobacterium tuberculosis H37Rv
gccccgcucgguuugcguccugg

SEQ ID NO: 3281120 - RNA, 15 nt, Mycobacterium tuberculosis H37Rv
gccccgcuggucgac

SEQ ID NO: 3281121 - RNA, 16 nt, Mycobacterium tuberculosis H37Rv
gccccgcuggucgacc

SEQ ID NO: 3281122 - RNA, 18 nt, Mycobacterium tuberculosis H37Rv
gccccggacuccaaagcc

SEQ ID NO: 3281123 - RNA, 22 nt, Mycobacterium tuberculosis H37Rv
gccccggauagcgucuggcgac

SEQ ID NO: 3281124 - RNA, 16 nt, Mycobacterium tuberculosis H37Rv
gccccggcauacucuu

SEQ ID NO: 3281125 - RNA, 21 nt, Mycobacterium tuberculosis H37Rv
gccccggcauugcccgagccc

SEQ ID NO: 3281126 - RNA, 15 nt, Mycobacterium tuberculosis H37Rv
gccccggccaggaca

SEQ ID NO: 3281127 - RNA, 15 nt, Mycobacterium tuberculosis H37Rv
gccccggccgcguca

SEQ ID NO: 3281128 - RNA, 21 nt, Mycobacterium tuberculosis H37Rv
gccccggccuuuacccgggcg

SEQ ID NO: 3281129 - RNA, 18 nt, Mycobacterium tuberculosis H37Rv
gccccggcgacccgguca

SEQ ID NO: 3281130 - RNA, 14 nt, Mycobacterium tuberculosis H37Rv
gccccggcgcggcc

SEQ ID NO: 3281131 - RNA, 17 nt, Mycobacterium tuberculosis H37Rv
gccccggcgcggccagc

SEQ ID NO: 3281132 - RNA, 16 nt, Mycobacterium tuberculosis H37Rv
gccccggcgcguucca

SEQ ID NO: 3281133 - RNA, 12 nt, Mycobacterium tuberculosis H37Rv
gccccggcggcg

SEQ ID NO: 3281134 - RNA, 18 nt, Mycobacterium tuberculosis H37Rv
gccccggcgguaccagag

SEQ ID NO: 3281135 - RNA, 14 nt, Mycobacterium tuberculosis H37Rv
gccccggcucucuu

SEQ ID NO: 3281136 - RNA, 21 nt, Mycobacterium tuberculosis H37Rv
gccccggcucucuucgcgcgc

SEQ ID NO: 3281137 - RNA, 14 nt, Mycobacterium tuberculosis H37Rv
gccccgggccacca

SEQ ID NO: 3281138 - RNA, 19 nt, Mycobacterium tuberculosis H37Rv
gccccgggccaccaguugu

SEQ ID NO: 3281139 - RNA, 18 nt, Mycobacterium tuberculosis H37Rv
gccccgggcggugaggca

SEQ ID NO: 3281140 - RNA, 17 nt, Mycobacterium tuberculosis H37Rv
gccccgggggaagcgcc

SEQ ID NO: 3281141 - RNA, 12 nt, Mycobacterium tuberculosis H37Rv
gccccggggugc

SEQ ID NO: 3281142 - RNA, 14 nt, Mycobacterium tuberculosis H37Rv
gccccggucggcga

SEQ ID NO: 3281143 - RNA, 16 nt, Mycobacterium tuberculosis H37Rv
gccccgguggcaggga

SEQ ID NO: 3281144 - RNA, 20 nt, Mycobacterium tuberculosis H37Rv
gccccguccgauuucccagc

SEQ ID NO: 3281145 - RNA, 16 nt, Mycobacterium tuberculosis H37Rv
gccccgucgccgauca

SEQ ID NO: 3281146 - RNA, 22 nt, Mycobacterium tuberculosis H37Rv
gccccguggaaagugcguccac

SEQ ID NO: 3281147 - RNA, 22 nt, Mycobacterium tuberculosis H37Rv
gccccgugggccucgaucagcg

SEQ ID NO: 3281148 - RNA, 23 nt, Mycobacterium tuberculosis H37Rv
gccccguuggucagcguggacgc

SEQ ID NO: 3281149 - RNA, 20 nt, Mycobacterium tuberculosis H37Rv
gccccguugugucaccggcg

SEQ ID NO: 3281150 - RNA, 17 nt, Mycobacterium tuberculosis H37Rv
gccccguuucggucgac

SEQ ID NO: 3281151 - RNA, 18 nt, Mycobacterium tuberculosis H37Rv
gccccguuucggucgaca

SEQ ID NO: 3281152 - RNA, 16 nt, Mycobacterium tuberculosis H37Rv
gccccuccgcgccgau

SEQ ID NO: 3281153 - RNA, 14 nt, Mycobacterium tuberculosis H37Rv
gccccuccggccgu

SEQ ID NO: 3281154 - RNA, 16 nt, Mycobacterium tuberculosis H37Rv
gccccuccgggcgcac

SEQ ID NO: 3281155 - RNA, 14 nt, Mycobacterium tuberculosis H37Rv
gccccugaaggcca

SEQ ID NO: 3281156 - RNA, 18 nt, Mycobacterium tuberculosis H37Rv
gccccugcacagcaggcu

SEQ ID NO: 3281157 - RNA, 15 nt, Mycobacterium tuberculosis H37Rv
gccccugccgauccc

SEQ ID NO: 3281158 - RNA, 20 nt, Mycobacterium tuberculosis H37Rv
gccccuggcaccucgcccuc

SEQ ID NO: 3281159 - RNA, 21 nt, Mycobacterium tuberculosis H37Rv
gcccgcacguuggcggccagc

SEQ ID NO: 3281160 - RNA, 13 nt, Mycobacterium tuberculosis H37Rv
gcccgcacuugcc

SEQ ID NO: 3281161 - RNA, 17 nt, Mycobacterium tuberculosis H37Rv
gcccgcagcagcaucgg

SEQ ID NO: 3281162 - RNA, 19 nt, Mycobacterium tuberculosis H37Rv
gcccgcagccaaguccgcc

SEQ ID NO: 3281163 - RNA, 20 nt, Mycobacterium tuberculosis H37Rv
gcccgcagcgcuuccagguc

SEQ ID NO: 3281164 - RNA, 18 nt, Mycobacterium tuberculosis H37Rv
gcccgcaggacgcugccg

SEQ ID NO: 3281165 - RNA, 12 nt, Mycobacterium tuberculosis H37Rv
gcccgcagggcc

SEQ ID NO: 3281166 - RNA, 14 nt, Mycobacterium tuberculosis H37Rv
gcccgcauccgcac

SEQ ID NO: 3281167 - RNA, 15 nt, Mycobacterium tuberculosis H37Rv
gcccgcauccgcacc

SEQ ID NO: 3281168 - RNA, 12 nt, Mycobacterium tuberculosis H37Rv
gcccgcaucgca

SEQ ID NO: 3281169 - RNA, 22 nt, Mycobacterium tuberculosis H37Rv
gcccgcaucgccucgagguauu

SEQ ID NO: 3281170 - RNA, 14 nt, Mycobacterium tuberculosis H37Rv
gcccgcaucgcggc

SEQ ID NO: 3281171 - RNA, 15 nt, Mycobacterium tuberculosis H37Rv
gcccgccaauccgcg

SEQ ID NO: 3281172 - RNA, 16 nt, Mycobacterium tuberculosis H37Rv
gcccgccacccuuggc

SEQ ID NO: 3281173 - RNA, 13 nt, Mycobacterium tuberculosis H37Rv
gcccgccaccggc

SEQ ID NO: 3281174 - RNA, 15 nt, Mycobacterium tuberculosis H37Rv
gcccgccaccggcgc

SEQ ID NO: 3281175 - RNA, 18 nt, Mycobacterium tuberculosis H37Rv
gcccgccaccggcgcgac

SEQ ID NO: 3281176 - RNA, 22 nt, Mycobacterium tuberculosis H37Rv
gcccgccacgaugucgucgaug

SEQ ID NO: 3281177 - RNA, 22 nt, Mycobacterium tuberculosis H37Rv
gcccgccacguacuuggacgac

SEQ ID NO: 3281178 - RNA, 22 nt, Mycobacterium tuberculosis H37Rv
gcccgccagaacggcgucgaau

SEQ ID NO: 3281179 - RNA, 17 nt, Mycobacterium tuberculosis H37Rv
gcccgccagcagggcca

SEQ ID NO: 3281180 - RNA, 18 nt, Mycobacterium tuberculosis H37Rv
gcccgccagcagggccag

SEQ ID NO: 3281181 - RNA, 18 nt, Mycobacterium tuberculosis H37Rv
gcccgccagcccagcacg

SEQ ID NO: 3281182 - RNA, 19 nt, Mycobacterium tuberculosis H37Rv
gcccgccagcgauccacca

SEQ ID NO: 3281183 - RNA, 12 nt, Mycobacterium tuberculosis H37Rv
gcccgccagcgc

SEQ ID NO: 3281184 - RNA, 13 nt, Mycobacterium tuberculosis H37Rv
gcccgccaggaac

SEQ ID NO: 3281185 - RNA, 15 nt, Mycobacterium tuberculosis H37Rv
gcccgccaggccguu

SEQ ID NO: 3281186 - RNA, 21 nt, Mycobacterium tuberculosis H37Rv
gcccgccagucccccgcucga

SEQ ID NO: 3281187 - RNA, 18 nt, Mycobacterium tuberculosis H37Rv
gcccgccaucagcccggc

SEQ ID NO: 3281188 - RNA, 19 nt, Mycobacterium tuberculosis H37Rv
gcccgccaucauggcggcc

SEQ ID NO: 3281189 - RNA, 14 nt, Mycobacterium tuberculosis H37Rv
gcccgccauccgcc

SEQ ID NO: 3281190 - RNA, 13 nt, Mycobacterium tuberculosis H37Rv
gcccgcccaccuc

SEQ ID NO: 3281191 - RNA, 14 nt, Mycobacterium tuberculosis H37Rv
gcccgcccaccucg

SEQ ID NO: 3281192 - RNA, 14 nt, Mycobacterium tuberculosis H37Rv
gcccgcccagcccg

SEQ ID NO: 3281193 - RNA, 15 nt, Mycobacterium tuberculosis H37Rv
gcccgcccagcccgg

SEQ ID NO: 3281194 - RNA, 19 nt, Mycobacterium tuberculosis H37Rv
gcccgcccagcccggcguu

SEQ ID NO: 3281195 - RNA, 16 nt, Mycobacterium tuberculosis H37Rv
gcccgccccgcgccuu

SEQ ID NO: 3281196 - RNA, 19 nt, Mycobacterium tuberculosis H37Rv
gcccgcccgucuuccagcc

SEQ ID NO: 3281197 - RNA, 15 nt, Mycobacterium tuberculosis H37Rv
gcccgcccuggcaac

SEQ ID NO: 3281198 - RNA, 18 nt, Mycobacterium tuberculosis H37Rv
gcccgcccuggcaacgac

SEQ ID NO: 3281199 - RNA, 19 nt, Mycobacterium tuberculosis H37Rv
gcccgccgaccugguaugc

SEQ ID NO: 3281200 - RNA, 14 nt, Mycobacterium tuberculosis H37Rv
gcccgccgacgauc

SEQ ID NO: 3281201 - RNA, 14 nt, Mycobacterium tuberculosis H37Rv
gcccgccgaucggg

SEQ ID NO: 3281202 - RNA, 21 nt, Mycobacterium tuberculosis H37Rv
gcccgccgaucgggcuucggc

SEQ ID NO: 3281203 - RNA, 14 nt, Mycobacterium tuberculosis H37Rv
gcccgccgccacca

SEQ ID NO: 3281204 - RNA, 13 nt, Mycobacterium tuberculosis H37Rv
gcccgccgcgacc

SEQ ID NO: 3281205 - RNA, 15 nt, Mycobacterium tuberculosis H37Rv
gcccgccgcgucacc

SEQ ID NO: 3281206 - RNA, 21 nt, Mycobacterium tuberculosis H37Rv
gcccgccggauccgccagacc

SEQ ID NO: 3281207 - RNA, 16 nt, Mycobacterium tuberculosis H37Rv
gcccgccggcagugag

SEQ ID NO: 3281208 - RNA, 18 nt, Mycobacterium tuberculosis H37Rv
gcccgccguccccgccgc

SEQ ID NO: 3281209 - RNA, 20 nt, Mycobacterium tuberculosis H37Rv
gcccgccguccccgccgccg

SEQ ID NO: 3281210 - RNA, 13 nt, Mycobacterium tuberculosis H37Rv
gcccgccguccgg

SEQ ID NO: 3281211 - RNA, 13 nt, Mycobacterium tuberculosis H37Rv
gcccgccgucggc

SEQ ID NO: 3281212 - RNA, 18 nt, Mycobacterium tuberculosis H37Rv
gcccgccgucggcaucga

SEQ ID NO: 3281213 - RNA, 18 nt, Mycobacterium tuberculosis H37Rv
gcccgccgucuuggcccg

SEQ ID NO: 3281214 - RNA, 17 nt, Mycobacterium tuberculosis H37Rv
gcccgccucgcagcgac

SEQ ID NO: 3281215 - RNA, 18 nt, Mycobacterium tuberculosis H37Rv
gcccgccucgcagcgaca

SEQ ID NO: 3281216 - RNA, 24 nt, Mycobacterium tuberculosis H37Rv
gcccgccucugucuucagcugcgg

SEQ ID NO: 3281217 - RNA, 21 nt, Mycobacterium tuberculosis H37Rv
gcccgcgaacgaucccgccga

SEQ ID NO: 3281218 - RNA, 23 nt, Mycobacterium tuberculosis H37Rv
gcccgcgaacgaucccgccgauc

SEQ ID NO: 3281219 - RNA, 22 nt, Mycobacterium tuberculosis H37Rv
gcccgcgaauacgaggacgacg

SEQ ID NO: 3281220 - RNA, 15 nt, Mycobacterium tuberculosis H37Rv
gcccgcgaggacagc

SEQ ID NO: 3281221 - RNA, 20 nt, Mycobacterium tuberculosis H37Rv
gcccgcgaucucggagcgca

SEQ ID NO: 3281222 - RNA, 14 nt, Mycobacterium tuberculosis H37Rv
gcccgcgcagcggu

SEQ ID NO: 3281223 - RNA, 21 nt, Mycobacterium tuberculosis H37Rv
gcccgcgcagcgguccgccgc

SEQ ID NO: 3281224 - RNA, 23 nt, Mycobacterium tuberculosis H37Rv
gcccgcgcagcgguccgccgccu

SEQ ID NO: 3281225 - RNA, 18 nt, Mycobacterium tuberculosis H37Rv
gcccgcgccaccagcacc

SEQ ID NO: 3281226 - RNA, 20 nt, Mycobacterium tuberculosis H37Rv
gcccgcgcccccggugccgu

SEQ ID NO: 3281227 - RNA, 18 nt, Mycobacterium tuberculosis H37Rv
gcccgcgccgccgcuacc

SEQ ID NO: 3281228 - RNA, 22 nt, Mycobacterium tuberculosis H37Rv
gcccgcgccgccgcuacccccg

SEQ ID NO: 3281229 - RNA, 23 nt, Mycobacterium tuberculosis H37Rv
gcccgcgccgccgcuacccccga

SEQ ID NO: 3281230 - RNA, 13 nt, Mycobacterium tuberculosis H37Rv
gcccgcgcggcca

SEQ ID NO: 3281231 - RNA, 12 nt, Mycobacterium tuberculosis H37Rv
gcccgcgcggcg

SEQ ID NO: 3281232 - RNA, 18 nt, Mycobacterium tuberculosis H37Rv
gcccgcgcggcgcauucc

SEQ ID NO: 3281233 - RNA, 13 nt, Mycobacterium tuberculosis H37Rv
gcccgcgcucggc

SEQ ID NO: 3281234 - RNA, 18 nt, Mycobacterium tuberculosis H37Rv
gcccgcggacgugccggu

SEQ ID NO: 3281235 - RNA, 20 nt, Mycobacterium tuberculosis H37Rv
gcccgcggacgugccggucc

SEQ ID NO: 3281236 - RNA, 21 nt, Mycobacterium tuberculosis H37Rv
gcccgcgggcaguggcagccc

SEQ ID NO: 3281237 - RNA, 16 nt, Mycobacterium tuberculosis H37Rv
gcccgcggugaccacc

SEQ ID NO: 3281238 - RNA, 14 nt, Mycobacterium tuberculosis H37Rv
gcccgcggugacgc

SEQ ID NO: 3281239 - RNA, 21 nt, Mycobacterium tuberculosis H37Rv
gcccgcgucgacgagcggcuu

SEQ ID NO: 3281240 - RNA, 19 nt, Mycobacterium tuberculosis H37Rv
gcccgcgugcgcaucccga

SEQ ID NO: 3281241 - RNA, 20 nt, Mycobacterium tuberculosis H37Rv
gcccgcguucagggcacgcu

SEQ ID NO: 3281242 - RNA, 21 nt, Mycobacterium tuberculosis H37Rv
gcccgcguucagggcacgcug

SEQ ID NO: 3281243 - RNA, 13 nt, Mycobacterium tuberculosis H37Rv
gcccgcguucucg

SEQ ID NO: 3281244 - RNA, 18 nt, Mycobacterium tuberculosis H37Rv
gcccgcguugccaaagcc

SEQ ID NO: 3281245 - RNA, 21 nt, Mycobacterium tuberculosis H37Rv
gcccgcguugccaaagcccac

SEQ ID NO: 3281246 - RNA, 19 nt, Mycobacterium tuberculosis H37Rv
gcccgcguuugcgaagccc

SEQ ID NO: 3281247 - RNA, 21 nt, Mycobacterium tuberculosis H37Rv
gcccgcguuugcgaagcccac

SEQ ID NO: 3281248 - RNA, 17 nt, Mycobacterium tuberculosis H37Rv
gcccgcucaacgggccg

SEQ ID NO: 3281249 - RNA, 23 nt, Mycobacterium tuberculosis H37Rv
gcccgcucaacgggccgcaucgu

SEQ ID NO: 3281250 - RNA, 13 nt, Mycobacterium tuberculosis H37Rv
gcccgcucagccg

SEQ ID NO: 3281251 - RNA, 15 nt, Mycobacterium tuberculosis H37Rv
gcccgcucagccguc

SEQ ID NO: 3281252 - RNA, 18 nt, Mycobacterium tuberculosis H37Rv
gcccgcucagccguccgg

SEQ ID NO: 3281253 - RNA, 21 nt, Mycobacterium tuberculosis H37Rv
gcccgcucagccguccgggcg

SEQ ID NO: 3281254 - RNA, 14 nt, Mycobacterium tuberculosis H37Rv
gcccgcucauaccg

SEQ ID NO: 3281255 - RNA, 19 nt, Mycobacterium tuberculosis H37Rv
gcccgggaucgggucaccg

SEQ ID NO: 3281256 - RNA, 12 nt, Mycobacterium tuberculosis H37Rv
gcccgggcaccg

SEQ ID NO: 3281257 - RNA, 13 nt, Mycobacterium tuberculosis H37Rv
gcccgggcagcac

SEQ ID NO: 3281258 - RNA, 18 nt, Mycobacterium tuberculosis H37Rv
gcccgggcagcaccagcg

SEQ ID NO: 3281259 - RNA, 22 nt, Mycobacterium tuberculosis H37Rv
gcccgggcauccuucaccagcu

SEQ ID NO: 3281260 - RNA, 13 nt, Mycobacterium tuberculosis H37Rv
gcccgggccaccg

SEQ ID NO: 3281261 - RNA, 19 nt, Mycobacterium tuberculosis H37Rv
gcccgggccaccggaaucc

SEQ ID NO: 3281262 - RNA, 20 nt, Mycobacterium tuberculosis H37Rv
gcccgggccgaagcgcgcgc

SEQ ID NO: 3281263 - RNA, 20 nt, Mycobacterium tuberculosis H37Rv
gcccgggcggaacgccggca

SEQ ID NO: 3281264 - RNA, 15 nt, Mycobacterium tuberculosis H37Rv
gcccgggcggccagc

SEQ ID NO: 3281265 - RNA, 21 nt, Mycobacterium tuberculosis H37Rv
gcccgggcggcgucggugagc

SEQ ID NO: 3281266 - RNA, 14 nt, Mycobacterium tuberculosis H37Rv
gcccgggcgggagu

SEQ ID NO: 3281267 - RNA, 16 nt, Mycobacterium tuberculosis H37Rv
gcccgggcgggaucca

SEQ ID NO: 3281268 - RNA, 15 nt, Mycobacterium tuberculosis H37Rv
gcccgggcgucaagc

SEQ ID NO: 3281269 - RNA, 16 nt, Mycobacterium tuberculosis H37Rv
gcccgggcgucaagcc

SEQ ID NO: 3281270 - RNA, 20 nt, Mycobacterium tuberculosis H37Rv
gcccggggaaccguccaagc

SEQ ID NO: 3281271 - RNA, 17 nt, Mycobacterium tuberculosis H37Rv
gcccggggcgcacagcu

SEQ ID NO: 3281272 - RNA, 18 nt, Mycobacterium tuberculosis H37Rv
gcccggggcgcacagcug

SEQ ID NO: 3281273 - RNA, 22 nt, Mycobacterium tuberculosis H37Rv
gcccggggcgcucgugauguug

SEQ ID NO: 3281274 - RNA, 20 nt, Mycobacterium tuberculosis H37Rv
gcccgggggguugaucggca

SEQ ID NO: 3281275 - RNA, 14 nt, Mycobacterium tuberculosis H37Rv
gcccgggguccauc

SEQ ID NO: 3281276 - RNA, 17 nt, Mycobacterium tuberculosis H37Rv
gcccgggguccaucggg

SEQ ID NO: 3281277 - RNA, 21 nt, Mycobacterium tuberculosis H37Rv
gcccgggguccaucggggccg

SEQ ID NO: 3281278 - RNA, 19 nt, Mycobacterium tuberculosis H37Rv
gcccgggguguucgucgac

SEQ ID NO: 3281279 - RNA, 19 nt, Mycobacterium tuberculosis H37Rv
gcccgggucuccggcgcac

SEQ ID NO: 3281280 - RNA, 20 nt, Mycobacterium tuberculosis H37Rv
gcccgggugaaacgauggcg

SEQ ID NO: 3281281 - RNA, 18 nt, Mycobacterium tuberculosis H37Rv
gcccgggugagacaaagg

SEQ ID NO: 3281282 - RNA, 15 nt, Mycobacterium tuberculosis H37Rv
gcccggguuggccga

SEQ ID NO: 3281283 - RNA, 18 nt, Mycobacterium tuberculosis H37Rv
gcccggguuggccgaaca

SEQ ID NO: 3281284 - RNA, 21 nt, Mycobacterium tuberculosis H37Rv
gcccggguuggccgaacagcu

SEQ ID NO: 3281285 - RNA, 16 nt, Mycobacterium tuberculosis H37Rv
gcccgguacgccgcgc

SEQ ID NO: 3281286 - RNA, 18 nt, Mycobacterium tuberculosis H37Rv
gcccgguacgccgcgccg

SEQ ID NO: 3281287 - RNA, 19 nt, Mycobacterium tuberculosis H37Rv
gcccgguacgccgcgccga

SEQ ID NO: 3281288 - RNA, 21 nt, Mycobacterium tuberculosis H37Rv
gcccgguaucgucccggcgac

SEQ ID NO: 3281289 - RNA, 12 nt, Mycobacterium tuberculosis H37Rv
gcccgguccagc

SEQ ID NO: 3281290 - RNA, 14 nt, Mycobacterium tuberculosis H37Rv
gcccgguccagccc

SEQ ID NO: 3281291 - RNA, 19 nt, Mycobacterium tuberculosis H37Rv
gcccggucgcucgacgacc

SEQ ID NO: 3281292 - RNA, 21 nt, Mycobacterium tuberculosis H37Rv
gcccggucucgacggcggccg

SEQ ID NO: 3281293 - RNA, 23 nt, Mycobacterium tuberculosis H37Rv
gcccggucucgacggcggccgcg

SEQ ID NO: 3281294 - RNA, 16 nt, Mycobacterium tuberculosis H37Rv
gcccggucuugggcgc

SEQ ID NO: 3281295 - RNA, 23 nt, Mycobacterium tuberculosis H37Rv
gcccggugagcuuagcgcauggg

SEQ ID NO: 3281296 - RNA, 15 nt, Mycobacterium tuberculosis H37Rv
gcccggugauggugc

SEQ ID NO: 3281297 - RNA, 15 nt, Mycobacterium tuberculosis H37Rv
gcccggugcggugca

SEQ ID NO: 3281298 - RNA, 17 nt, Mycobacterium tuberculosis H37Rv
gcccggugcggugcaca

SEQ ID NO: 3281299 - RNA, 14 nt, Mycobacterium tuberculosis H37Rv
gcccggugcuaccg

SEQ ID NO: 3281300 - RNA, 22 nt, Mycobacterium tuberculosis H37Rv
gcccgguguucaucacgccgcc

SEQ ID NO: 3281301 - RNA, 23 nt, Mycobacterium tuberculosis H37Rv
gcccgguguucaucacgccgccg

SEQ ID NO: 3281302 - RNA, 15 nt, Mycobacterium tuberculosis H37Rv
gcccgguucagcgcu

SEQ ID NO: 3281303 - RNA, 22 nt, Mycobacterium tuberculosis H37Rv
gcccgguucgaggaucccgcug

SEQ ID NO: 3281304 - RNA, 21 nt, Mycobacterium tuberculosis H37Rv
gcccgguugggugugcccggg

SEQ ID NO: 3281305 - RNA, 14 nt, Mycobacterium tuberculosis H37Rv
gcccguacacgauc

SEQ ID NO: 3281306 - RNA, 17 nt, Mycobacterium tuberculosis H37Rv
gcccguagacgccgagc

SEQ ID NO: 3281307 - RNA, 18 nt, Mycobacterium tuberculosis H37Rv
gcccguagacgccgagca

SEQ ID NO: 3281308 - RNA, 20 nt, Mycobacterium tuberculosis H37Rv
gcccguagcgucgaucacgu

SEQ ID NO: 3281309 - RNA, 15 nt, Mycobacterium tuberculosis H37Rv
gcccguagcugcgca

SEQ ID NO: 3281310 - RNA, 17 nt, Mycobacterium tuberculosis H37Rv
gcccguagcugcgcagc

SEQ ID NO: 3281311 - RNA, 13 nt, Mycobacterium tuberculosis H37Rv
gcccgucaccgcg

SEQ ID NO: 3281312 - RNA, 20 nt, Mycobacterium tuberculosis H37Rv
gcccgucagcggacaguucg

SEQ ID NO: 3281313 - RNA, 21 nt, Mycobacterium tuberculosis H37Rv
gcccguccaggcgcugcagca

SEQ ID NO: 3281314 - RNA, 14 nt, Mycobacterium tuberculosis H37Rv
gcccgucccgccgg

SEQ ID NO: 3281315 - RNA, 20 nt, Mycobacterium tuberculosis H37Rv
gcccguccggcccccgaggc

SEQ ID NO: 3281316 - RNA, 14 nt, Mycobacterium tuberculosis H37Rv
gcccgucgcggccg

SEQ ID NO: 3281317 - RNA, 20 nt, Mycobacterium tuberculosis H37Rv
gcccgucggacauaccgcga

SEQ ID NO: 3281318 - RNA, 23 nt, Mycobacterium tuberculosis H37Rv
gcccgucggauggaaggcggcca

SEQ ID NO: 3281319 - RNA, 22 nt, Mycobacterium tuberculosis H37Rv
gcccgucguagguggccggcuu

SEQ ID NO: 3281320 - RNA, 16 nt, Mycobacterium tuberculosis H37Rv
gcccgucgucgucgac

SEQ ID NO: 3281321 - RNA, 17 nt, Mycobacterium tuberculosis H37Rv
gcccgucgucgugcacg

SEQ ID NO: 3281322 - RNA, 21 nt, Mycobacterium tuberculosis H37Rv
gcccgucgugcgggggugguc

SEQ ID NO: 3281323 - RNA, 13 nt, Mycobacterium tuberculosis H37Rv
gcccgucuuccag

SEQ ID NO: 3281324 - RNA, 22 nt, Mycobacterium tuberculosis H37Rv
gcccgucuuccagccaggccuu

SEQ ID NO: 3281325 - RNA, 14 nt, Mycobacterium tuberculosis H37Rv
gcccgugaucacca

SEQ ID NO: 3281326 - RNA, 16 nt, Mycobacterium tuberculosis H37Rv
gcccgugaucaccacg

SEQ ID NO: 3281327 - RNA, 15 nt, Mycobacterium tuberculosis H37Rv
gcccgugccacagcu

SEQ ID NO: 3281328 - RNA, 22 nt, Mycobacterium tuberculosis H37Rv
gcccgugccacagcucgccgug

SEQ ID NO: 3281329 - RNA, 23 nt, Mycobacterium tuberculosis H37Rv
gcccguggcggugagccgccagg

SEQ ID NO: 3281330 - RNA, 20 nt, Mycobacterium tuberculosis H37Rv
gcccguggucgaucaugacg

SEQ ID NO: 3281331 - RNA, 15 nt, Mycobacterium tuberculosis H37Rv
gcccguguugaagaa

SEQ ID NO: 3281332 - RNA, 16 nt, Mycobacterium tuberculosis H37Rv
gcccguguugaagaag

SEQ ID NO: 3281333 - RNA, 23 nt, Mycobacterium tuberculosis H37Rv
gcccguguugaagaagcccgagu

SEQ ID NO: 3281334 - RNA, 21 nt, Mycobacterium tuberculosis H37Rv
gcccguucaugcggcggcgcu

SEQ ID NO: 3281335 - RNA, 22 nt, Mycobacterium tuberculosis H37Rv
gcccguucaugcggcggcgcuc

SEQ ID NO: 3281336 - RNA, 23 nt, Mycobacterium tuberculosis H37Rv
gcccguucgaaguucucggugcg

SEQ ID NO: 3281337 - RNA, 16 nt, Mycobacterium tuberculosis H37Rv
gcccguucgaccgugu

SEQ ID NO: 3281338 - RNA, 17 nt, Mycobacterium tuberculosis H37Rv
gcccguucucgcggccg

SEQ ID NO: 3281339 - RNA, 19 nt, Mycobacterium tuberculosis H37Rv
gcccguucucgcggccgau

SEQ ID NO: 3281340 - RNA, 16 nt, Mycobacterium tuberculosis H37Rv
gcccguugaccugcgc

SEQ ID NO: 3281341 - RNA, 15 nt, Mycobacterium tuberculosis H37Rv
gcccguugcagguga

SEQ ID NO: 3281342 - RNA, 20 nt, Mycobacterium tuberculosis H37Rv
gcccguuggcagcacaggcu

SEQ ID NO: 3281343 - RNA, 20 nt, Mycobacterium tuberculosis H37Rv
gcccguuggccaagaaugug

SEQ ID NO: 3281344 - RNA, 21 nt, Mycobacterium tuberculosis H37Rv
gcccguuggccaagaaugugg

SEQ ID NO: 3281345 - RNA, 20 nt, Mycobacterium tuberculosis H37Rv
gcccguuguccagaacggcg

SEQ ID NO: 3281346 - RNA, 19 nt, Mycobacterium tuberculosis H37Rv
gcccguuugccgguucggc

SEQ ID NO: 3281347 - RNA, 20 nt, Mycobacterium tuberculosis H37Rv
gcccguuugccgguucggcg

SEQ ID NO: 3281348 - RNA, 23 nt, Mycobacterium tuberculosis H37Rv
gcccguuugccgguucggcgauc

SEQ ID NO: 3281349 - RNA, 17 nt, Mycobacterium tuberculosis H37Rv
gcccuacgcagcgcggc

SEQ ID NO: 3281350 - RNA, 16 nt, Mycobacterium tuberculosis H37Rv
gcccuuggccagcagg

SEQ ID NO: 3281351 - RNA, 18 nt, Mycobacterium tuberculosis H37Rv
gcccuugggacugcggac

SEQ ID NO: 3281352 - RNA, 14 nt, Mycobacterium tuberculosis H37Rv
gcccuuguagcaca

SEQ ID NO: 3281353 - RNA, 20 nt, Mycobacterium tuberculosis H37Rv
gcccuuguagcacaccgaca

SEQ ID NO: 3281354 - RNA, 20 nt, Mycobacterium tuberculosis H37Rv
gcccuuguggaguacggcga

SEQ ID NO: 3281355 - RNA, 17 nt, Mycobacterium tuberculosis H37Rv
gccgaaaaagaccgaca

SEQ ID NO: 3281356 - RNA, 15 nt, Mycobacterium tuberculosis H37Rv
gccgaaaaugccgcc

SEQ ID NO: 3281357 - RNA, 16 nt, Mycobacterium tuberculosis H37Rv
gccgaaaaugccgccc

SEQ ID NO: 3281358 - RNA, 23 nt, Mycobacterium tuberculosis H37Rv
gccgaaaaugccgcccagcgacc

SEQ ID NO: 3281359 - RNA, 15 nt, Mycobacterium tuberculosis H37Rv
gccgaaacagcaccc

SEQ ID NO: 3281360 - RNA, 15 nt, Mycobacterium tuberculosis H37Rv
gccgaaacauugccc

SEQ ID NO: 3281361 - RNA, 18 nt, Mycobacterium tuberculosis H37Rv
gccgaaacauugcccgug

SEQ ID NO: 3281362 - RNA, 19 nt, Mycobacterium tuberculosis H37Rv
gccgaaacgccgaccgcgc

SEQ ID NO: 3281363 - RNA, 15 nt, Mycobacterium tuberculosis H37Rv
gccgaaacucaccag

SEQ ID NO: 3281364 - RNA, 18 nt, Mycobacterium tuberculosis H37Rv
gccgaaagagccagcggc

SEQ ID NO: 3281365 - RNA, 21 nt, Mycobacterium tuberculosis H37Rv
gccgaaagagccagcggcacu

SEQ ID NO: 3281366 - RNA, 15 nt, Mycobacterium tuberculosis H37Rv
gccgaaagcaucacc

SEQ ID NO: 3281367 - RNA, 15 nt, Mycobacterium tuberculosis H37Rv
gccgaaagccaggcg

SEQ ID NO: 3281368 - RNA, 21 nt, Mycobacterium tuberculosis H37Rv
gccgaaagccaggcggcaagg

SEQ ID NO: 3281369 - RNA, 15 nt, Mycobacterium tuberculosis H37Rv
gccgaaaucggccag

SEQ ID NO: 3281370 - RNA, 17 nt, Mycobacterium tuberculosis H37Rv
gccgaaaucggccagcu

SEQ ID NO: 3281371 - RNA, 21 nt, Mycobacterium tuberculosis H37Rv
gccgaacaaccuucgggcgcg

SEQ ID NO: 3281372 - RNA, 13 nt, Mycobacterium tuberculosis H37Rv
gccgaacacaccg

SEQ ID NO: 3281373 - RNA, 14 nt, Mycobacterium tuberculosis H37Rv
gccgaacaccguca

SEQ ID NO: 3281374 - RNA, 20 nt, Mycobacterium tuberculosis H37Rv
gccgaacaccgucagcgucu

SEQ ID NO: 3281375 - RNA, 16 nt, Mycobacterium tuberculosis H37Rv
gccgaacagcagcccg

SEQ ID NO: 3281376 - RNA, 18 nt, Mycobacterium tuberculosis H37Rv
gccgaacagcagcccgcc

SEQ ID NO: 3281377 - RNA, 16 nt, Mycobacterium tuberculosis H37Rv
gccgaacagcaggccu

SEQ ID NO: 3281378 - RNA, 18 nt, Mycobacterium tuberculosis H37Rv
gccgaacagcaggccucc

SEQ ID NO: 3281379 - RNA, 14 nt, Mycobacterium tuberculosis H37Rv
gccgaacagcgaac

SEQ ID NO: 3281380 - RNA, 18 nt, Mycobacterium tuberculosis H37Rv
gccgaacagcgaaccgcc

SEQ ID NO: 3281381 - RNA, 14 nt, Mycobacterium tuberculosis H37Rv
gccgaacagcgacg

SEQ ID NO: 3281382 - RNA, 17 nt, Mycobacterium tuberculosis H37Rv
gccgaacagggaggucg

SEQ ID NO: 3281383 - RNA, 20 nt, Mycobacterium tuberculosis H37Rv
gccgaacagggaggucgccg

SEQ ID NO: 3281384 - RNA, 19 nt, Mycobacterium tuberculosis H37Rv
gccgaacagugucgauagc

SEQ ID NO: 3281385 - RNA, 14 nt, Mycobacterium tuberculosis H37Rv
gccgaacaguucgg

SEQ ID NO: 3281386 - RNA, 22 nt, Mycobacterium tuberculosis H37Rv
gccgaacaguucggcgagcaca

SEQ ID NO: 3281387 - RNA, 15 nt, Mycobacterium tuberculosis H37Rv
gccgaaccacgcgcc

SEQ ID NO: 3281388 - RNA, 18 nt, Mycobacterium tuberculosis H37Rv
gccgaaccacgcgcccgc

SEQ ID NO: 3281389 - RNA, 14 nt, Mycobacterium tuberculosis H37Rv
gccgaaccagcgau

SEQ ID NO: 3281390 - RNA, 20 nt, Mycobacterium tuberculosis H37Rv
gccgaacccgccgucaccgc

SEQ ID NO: 3281391 - RNA, 16 nt, Mycobacterium tuberculosis H37Rv
gccgaaccggcaccag

SEQ ID NO: 3281392 - RNA, 19 nt, Mycobacterium tuberculosis H37Rv
gccgaaccgguagucgccg

SEQ ID NO: 3281393 - RNA, 15 nt, Mycobacterium tuberculosis H37Rv
gccgaacgacagcag

SEQ ID NO: 3281394 - RNA, 12 nt, Mycobacterium tuberculosis H37Rv
gccgaacgccag

SEQ ID NO: 3281395 - RNA, 19 nt, Mycobacterium tuberculosis H37Rv
gccgaacgggucggcgacc

SEQ ID NO: 3281396 - RNA, 16 nt, Mycobacterium tuberculosis H37Rv
gccgaacgugcaacca

SEQ ID NO: 3281397 - RNA, 20 nt, Mycobacterium tuberculosis H37Rv
gccgaacgugcaaccacggc

SEQ ID NO: 3281398 - RNA, 20 nt, Mycobacterium tuberculosis H37Rv
gccgaacgugcaaccauggc

SEQ ID NO: 3281399 - RNA, 22 nt, Mycobacterium tuberculosis H37Rv
gccgaacgugcaaccauggcgg

SEQ ID NO: 3281400 - RNA, 21 nt, Mycobacterium tuberculosis H37Rv
gccgaagaaccggucgcagug

SEQ ID NO: 3281401 - RNA, 22 nt, Mycobacterium tuberculosis H37Rv
gccgaagaaggugacgaucgac

SEQ ID NO: 3281402 - RNA, 15 nt, Mycobacterium tuberculosis H37Rv
gccgaagaggagaac

SEQ ID NO: 3281403 - RNA, 13 nt, Mycobacterium tuberculosis H37Rv
gccgaagcccggc

SEQ ID NO: 3281404 - RNA, 16 nt, Mycobacterium tuberculosis H37Rv
gccgaagccgacgaac

SEQ ID NO: 3281405 - RNA, 13 nt, Mycobacterium tuberculosis H37Rv
gccgaagccuugc

SEQ ID NO: 3281406 - RNA, 16 nt, Mycobacterium tuberculosis H37Rv
gccgaagcgcccguug

SEQ ID NO: 3281407 - RNA, 14 nt, Mycobacterium tuberculosis H37Rv
gccgaagcggccac

SEQ ID NO: 3281408 - RNA, 15 nt, Mycobacterium tuberculosis H37Rv
gccgaagcggccacc

SEQ ID NO: 3281409 - RNA, 16 nt, Mycobacterium tuberculosis H37Rv
gccgaagcugcccaac

SEQ ID NO: 3281410 - RNA, 18 nt, Mycobacterium tuberculosis H37Rv
gccgaaggcaaagcgagc

SEQ ID NO: 3281411 - RNA, 14 nt, Mycobacterium tuberculosis H37Rv
gccgaaggccuuau

SEQ ID NO: 3281412 - RNA, 18 nt, Mycobacterium tuberculosis H37Rv
gccgaaggggaacgcgcc

SEQ ID NO: 3281413 - RNA, 20 nt, Mycobacterium tuberculosis H37Rv
gccgaaguagacggugguga

SEQ ID NO: 3281414 - RNA, 16 nt, Mycobacterium tuberculosis H37Rv
gccgaaguggagcccc

SEQ ID NO: 3281415 - RNA, 21 nt, Mycobacterium tuberculosis H37Rv
gccgaaguuuuggaagcccga

SEQ ID NO: 3281416 - RNA, 22 nt, Mycobacterium tuberculosis H37Rv
gccgaaguuuuggaagcccgaa

SEQ ID NO: 3281417 - RNA, 17 nt, Mycobacterium tuberculosis H37Rv
gccgaauaacagcaggc

SEQ ID NO: 3281418 - RNA, 18 nt, Mycobacterium tuberculosis H37Rv
gccgaauaacagcaggca

SEQ ID NO: 3281419 - RNA, 23 nt, Mycobacterium tuberculosis H37Rv
gccgaauaacagcaggcauuccc

SEQ ID NO: 3281420 - RNA, 20 nt, Mycobacterium tuberculosis H37Rv
gccgaauaccgguggcagcc

SEQ ID NO: 3281421 - RNA, 13 nt, Mycobacterium tuberculosis H37Rv
gccgaaucgcggg

SEQ ID NO: 3281422 - RNA, 13 nt, Mycobacterium tuberculosis H37Rv
gccgaaucggcag

SEQ ID NO: 3281423 - RNA, 20 nt, Mycobacterium tuberculosis H37Rv
gccgaaucggcaguugaacu

SEQ ID NO: 3281424 - RNA, 14 nt, Mycobacterium tuberculosis H37Rv
gccgaaucuggggu

SEQ ID NO: 3281425 - RNA, 12 nt, Mycobacterium tuberculosis H37Rv
gccgacaacccc

SEQ ID NO: 3281426 - RNA, 16 nt, Mycobacterium tuberculosis H37Rv
gccgacaaccccgcca

SEQ ID NO: 3281427 - RNA, 19 nt, Mycobacterium tuberculosis H37Rv
gccgacaaccccgccagga

SEQ ID NO: 3281428 - RNA, 21 nt, Mycobacterium tuberculosis H37Rv
gccgacaacccggccgggccu

SEQ ID NO: 3281429 - RNA, 18 nt, Mycobacterium tuberculosis H37Rv
gccgacaaucaccaacgc

SEQ ID NO: 3281430 - RNA, 23 nt, Mycobacterium tuberculosis H37Rv
gccgacaaugucggcgaugcguc

SEQ ID NO: 3281431 - RNA, 14 nt, Mycobacterium tuberculosis H37Rv
gccgacaccaccgg

SEQ ID NO: 3281432 - RNA, 15 nt, Mycobacterium tuberculosis H37Rv
gccgacaccaccggc

SEQ ID NO: 3281433 - RNA, 22 nt, Mycobacterium tuberculosis H37Rv
gccgacaccaccggcgccgccg

SEQ ID NO: 3281434 - RNA, 16 nt, Mycobacterium tuberculosis H37Rv
gccgacaccgccacca

SEQ ID NO: 3281435 - RNA, 17 nt, Mycobacterium tuberculosis H37Rv
gccgacaccggcugacc

SEQ ID NO: 3281436 - RNA, 14 nt, Mycobacterium tuberculosis H37Rv
gccgacacgaacgc

SEQ ID NO: 3281437 - RNA, 14 nt, Mycobacterium tuberculosis H37Rv
gccgacacgccgau

SEQ ID NO: 3281438 - RNA, 21 nt, Mycobacterium tuberculosis H37Rv
gccgacacgccgaugccgaac

SEQ ID NO: 3281439 - RNA, 16 nt, Mycobacterium tuberculosis H37Rv
gccgacacguugcagc

SEQ ID NO: 3281440 - RNA, 16 nt, Mycobacterium tuberculosis H37Rv
gccgacagcacgccag

SEQ ID NO: 3281441 - RNA, 14 nt, Mycobacterium tuberculosis H37Rv
gccgacagccaccg

SEQ ID NO: 3281442 - RNA, 18 nt, Mycobacterium tuberculosis H37Rv
gccgacagccgauccgau

SEQ ID NO: 3281443 - RNA, 18 nt, Mycobacterium tuberculosis H37Rv
gccgacagcucaucgauc

SEQ ID NO: 3281444 - RNA, 18 nt, Mycobacterium tuberculosis H37Rv
gccgacaggccggccacc

SEQ ID NO: 3281445 - RNA, 21 nt, Mycobacterium tuberculosis H37Rv
gccgacaucgauguggaugga

SEQ ID NO: 3281446 - RNA, 14 nt, Mycobacterium tuberculosis H37Rv
gccgacgucgccga

SEQ ID NO: 3281447 - RNA, 14 nt, Mycobacterium tuberculosis H37Rv
gccgacgucgccgg

SEQ ID NO: 3281448 - RNA, 15 nt, Mycobacterium tuberculosis H37Rv
gccgacgucguuggc

SEQ ID NO: 3281449 - RNA, 17 nt, Mycobacterium tuberculosis H37Rv
gccgacgugacaacugc

SEQ ID NO: 3281450 - RNA, 20 nt, Mycobacterium tuberculosis H37Rv
gccgacguggaugguggugc

SEQ ID NO: 3281451 - RNA, 22 nt, Mycobacterium tuberculosis H37Rv
gccgacuacgaagacguucgga

SEQ ID NO: 3281452 - RNA, 18 nt, Mycobacterium tuberculosis H37Rv
gccgacuagcugggguca

SEQ ID NO: 3281453 - RNA, 23 nt, Mycobacterium tuberculosis H37Rv
gccgacuagcuggggucaaagca

SEQ ID NO: 3281454 - RNA, 15 nt, Mycobacterium tuberculosis H37Rv
gccgacuaucggccg

SEQ ID NO: 3281455 - RNA, 16 nt, Mycobacterium tuberculosis H37Rv
gccgacuaucggccgc

SEQ ID NO: 3281456 - RNA, 19 nt, Mycobacterium tuberculosis H37Rv
gccgacuaucggccgccgg

SEQ ID NO: 3281457 - RNA, 13 nt, Mycobacterium tuberculosis H37Rv
gccgacucagguc

SEQ ID NO: 3281458 - RNA, 15 nt, Mycobacterium tuberculosis H37Rv
gccgacucaggucgg

SEQ ID NO: 3281459 - RNA, 16 nt, Mycobacterium tuberculosis H37Rv
gccgacucaggucggu

SEQ ID NO: 3281460 - RNA, 17 nt, Mycobacterium tuberculosis H37Rv
gccgacucaucggccgc

SEQ ID NO: 3281461 - RNA, 18 nt, Mycobacterium tuberculosis H37Rv
gccgacuccccgccgggc

SEQ ID NO: 3281462 - RNA, 19 nt, Mycobacterium tuberculosis H37Rv
gccgacucggcaccgcggc

SEQ ID NO: 3281463 - RNA, 20 nt, Mycobacterium tuberculosis H37Rv
gccgacucggcaccgcggcc

SEQ ID NO: 3281464 - RNA, 23 nt, Mycobacterium tuberculosis H37Rv
gccgacugugaaucugacgacgc

SEQ ID NO: 3281465 - RNA, 21 nt, Mycobacterium tuberculosis H37Rv
gccgacuuccgcgucgccggc

SEQ ID NO: 3281466 - RNA, 22 nt, Mycobacterium tuberculosis H37Rv
gccgacuuccgcgucgccggcc

SEQ ID NO: 3281467 - RNA, 17 nt, Mycobacterium tuberculosis H37Rv
gccgacuucgucaacca

SEQ ID NO: 3281468 - RNA, 23 nt, Mycobacterium tuberculosis H37Rv
gccgacuuugagucguuggacgg

SEQ ID NO: 3281469 - RNA, 18 nt, Mycobacterium tuberculosis H37Rv
gccgagaacgauguccgc

SEQ ID NO: 3281470 - RNA, 20 nt, Mycobacterium tuberculosis H37Rv
gccgagaagugggcgguacc

SEQ ID NO: 3281471 - RNA, 20 nt, Mycobacterium tuberculosis H37Rv
gccgagaauuccccagccgc

SEQ ID NO: 3281472 - RNA, 19 nt, Mycobacterium tuberculosis H37Rv
gccgagaccgccgcugccg

SEQ ID NO: 3281473 - RNA, 20 nt, Mycobacterium tuberculosis H37Rv
gccgagaccgccgcugccgc

SEQ ID NO: 3281474 - RNA, 23 nt, Mycobacterium tuberculosis H37Rv
gccgagaccgcguggucggcgaa

SEQ ID NO: 3281475 - RNA, 18 nt, Mycobacterium tuberculosis H37Rv
gccgagagcaccgcucgg

SEQ ID NO: 3281476 - RNA, 13 nt, Mycobacterium tuberculosis H37Rv
gccgagagcagcc

SEQ ID NO: 3281477 - RNA, 16 nt, Mycobacterium tuberculosis H37Rv
gccgagagcagccagc

SEQ ID NO: 3281478 - RNA, 14 nt, Mycobacterium tuberculosis H37Rv
gccgagaucacgcc

SEQ ID NO: 3281479 - RNA, 18 nt, Mycobacterium tuberculosis H37Rv
gccgagaucacgccgggc

SEQ ID NO: 3281480 - RNA, 14 nt, Mycobacterium tuberculosis H37Rv
gccgagauccacgc

SEQ ID NO: 3281481 - RNA, 21 nt, Mycobacterium tuberculosis H37Rv
gccgagauccacgccagagcg

SEQ ID NO: 3281482 - RNA, 12 nt, Mycobacterium tuberculosis H37Rv
gccgagauccgc

SEQ ID NO: 3281483 - RNA, 15 nt, Mycobacterium tuberculosis H37Rv
gccgagaucgacauc

SEQ ID NO: 3281484 - RNA, 21 nt, Mycobacterium tuberculosis H37Rv
gccgagaucgacaucguuggc

SEQ ID NO: 3281485 - RNA, 13 nt, Mycobacterium tuberculosis H37Rv
gccgagcacucgg

SEQ ID NO: 3281486 - RNA, 18 nt, Mycobacterium tuberculosis H37Rv
gccgagcacucggccacg

SEQ ID NO: 3281487 - RNA, 18 nt, Mycobacterium tuberculosis H37Rv
gccgagcagacacagaau

SEQ ID NO: 3281488 - RNA, 16 nt, Mycobacterium tuberculosis H37Rv
gccgagcagacgcaga

SEQ ID NO: 3281489 - RNA, 18 nt, Mycobacterium tuberculosis H37Rv
gccgagcagacgcggaau

SEQ ID NO: 3281490 - RNA, 18 nt, Mycobacterium tuberculosis H37Rv
gccgagcagggccggcac

SEQ ID NO: 3281491 - RNA, 13 nt, Mycobacterium tuberculosis H37Rv
gccgagcaggucg

SEQ ID NO: 3281492 - RNA, 16 nt, Mycobacterium tuberculosis H37Rv
gccgagcaggucggca

SEQ ID NO: 3281493 - RNA, 18 nt, Mycobacterium tuberculosis H37Rv
gccgagcaggucggcaau

SEQ ID NO: 3281494 - RNA, 22 nt, Mycobacterium tuberculosis H37Rv
gccgagcagguuccgcacgauc

SEQ ID NO: 3281495 - RNA, 17 nt, Mycobacterium tuberculosis H37Rv
gccgagccagcacccgc

SEQ ID NO: 3281496 - RNA, 15 nt, Mycobacterium tuberculosis H37Rv
gccgagccagcuccg

SEQ ID NO: 3281497 - RNA, 15 nt, Mycobacterium tuberculosis H37Rv
gccgagcccggugcu

SEQ ID NO: 3281498 - RNA, 22 nt, Mycobacterium tuberculosis H37Rv
gccgagccgauauaccagggca

SEQ ID NO: 3281499 - RNA, 14 nt, Mycobacterium tuberculosis H37Rv
gccgagccgcccgc

SEQ ID NO: 3281500 - RNA, 14 nt, Mycobacterium tuberculosis H37Rv
gccgagccguugcg

SEQ ID NO: 3281501 - RNA, 22 nt, Mycobacterium tuberculosis H37Rv
gccgagccucgcucuccauggc

SEQ ID NO: 3281502 - RNA, 17 nt, Mycobacterium tuberculosis H37Rv
gccgagcgaccguccca

SEQ ID NO: 3281503 - RNA, 22 nt, Mycobacterium tuberculosis H37Rv
gccgagcgcaacucccagcacg

SEQ ID NO: 3281504 - RNA, 12 nt, Mycobacterium tuberculosis H37Rv
gccgagcgcacu

SEQ ID NO: 3281505 - RNA, 13 nt, Mycobacterium tuberculosis H37Rv
gccgagcgcccgc

SEQ ID NO: 3281506 - RNA, 11 nt, Mycobacterium tuberculosis H37Rv
gccgagcgcgc

SEQ ID NO: 3281507 - RNA, 19 nt, Mycobacterium tuberculosis H37Rv
gccgagcggagacuccagc

SEQ ID NO: 3281508 - RNA, 13 nt, Mycobacterium tuberculosis H37Rv
gccgagcggugcc

SEQ ID NO: 3281509 - RNA, 21 nt, Mycobacterium tuberculosis H37Rv
gccgagcgugaaccuggcgac

SEQ ID NO: 3281510 - RNA, 14 nt, Mycobacterium tuberculosis H37Rv
gccgagcgugcgcu

SEQ ID NO: 3281511 - RNA, 20 nt, Mycobacterium tuberculosis H37Rv
gccgagcuagaucacggagc

SEQ ID NO: 3281512 - RNA, 14 nt, Mycobacterium tuberculosis H37Rv
gccgagcuccucca

SEQ ID NO: 3281513 - RNA, 16 nt, Mycobacterium tuberculosis H37Rv
gccgagcuccuccacc

SEQ ID NO: 3281514 - RNA, 13 nt, Mycobacterium tuberculosis H37Rv
gccgagcucggcu

SEQ ID NO: 3281515 - RNA, 20 nt, Mycobacterium tuberculosis H37Rv
gccgagcucggucaccacgg

SEQ ID NO: 3281516 - RNA, 16 nt, Mycobacterium tuberculosis H37Rv
gccgagcucguugacc

SEQ ID NO: 3281517 - RNA, 17 nt, Mycobacterium tuberculosis H37Rv
gccgagcucguugcugg

SEQ ID NO: 3281518 - RNA, 21 nt, Mycobacterium tuberculosis H37Rv
gccgagcuggcaacgccgcgc

SEQ ID NO: 3281519 - RNA, 19 nt, Mycobacterium tuberculosis H37Rv
gccgagcuggcgaccuggu

SEQ ID NO: 3281520 - RNA, 18 nt, Mycobacterium tuberculosis H37Rv
gccgagcuggcgcgcggg

SEQ ID NO: 3281521 - RNA, 12 nt, Mycobacterium tuberculosis H37Rv
gccgagcugguu

SEQ ID NO: 3281522 - RNA, 21 nt, Mycobacterium tuberculosis H37Rv
gccgagcugguugacggcgaa

SEQ ID NO: 3281523 - RNA, 22 nt, Mycobacterium tuberculosis H37Rv
gccgagcugguugacggcgaag

SEQ ID NO: 3281524 - RNA, 21 nt, Mycobacterium tuberculosis H37Rv
gccgagcugguuggcgccgaa

SEQ ID NO: 3281525 - RNA, 13 nt, Mycobacterium tuberculosis H37Rv
gccgagcuugagc

SEQ ID NO: 3281526 - RNA, 23 nt, Mycobacterium tuberculosis H37Rv
gccgagcuugagcgugagcgccg

SEQ ID NO: 3281527 - RNA, 19 nt, Mycobacterium tuberculosis H37Rv
gccgagcuugucgagcagg

SEQ ID NO: 3281528 - RNA, 21 nt, Mycobacterium tuberculosis H37Rv
gccgaggaauacucucgcgac

SEQ ID NO: 3281529 - RNA, 17 nt, Mycobacterium tuberculosis H37Rv
gccgaggaccagaggcg

SEQ ID NO: 3281530 - RNA, 18 nt, Mycobacterium tuberculosis H37Rv
gccgaggaccagaggcgc

SEQ ID NO: 3281531 - RNA, 16 nt, Mycobacterium tuberculosis H37Rv
gccgaggacgccggcg

SEQ ID NO: 3281532 - RNA, 20 nt, Mycobacterium tuberculosis H37Rv
gccgaggacgccggcgccgc

SEQ ID NO: 3281533 - RNA, 22 nt, Mycobacterium tuberculosis H37Rv
gccgaggacgccggcgccgcca

SEQ ID NO: 3281534 - RNA, 20 nt, Mycobacterium tuberculosis H37Rv
gccgaggcagcgucgucgac

SEQ ID NO: 3281535 - RNA, 13 nt, Mycobacterium tuberculosis H37Rv
gccgaggccgccg

SEQ ID NO: 3281536 - RNA, 17 nt, Mycobacterium tuberculosis H37Rv
gccgaggccuaccaggc

SEQ ID NO: 3281537 - RNA, 18 nt, Mycobacterium tuberculosis H37Rv
gccgaggccuaccaggcg

SEQ ID NO: 3281538 - RNA, 20 nt, Mycobacterium tuberculosis H37Rv
gccgaggccuaccaggcgcg

SEQ ID NO: 3281539 - RNA, 19 nt, Mycobacterium tuberculosis H37Rv
gccgaggguagacggggcg

SEQ ID NO: 3281540 - RNA, 19 nt, Mycobacterium tuberculosis H37Rv
gccgagguagauggcgaac

SEQ ID NO: 3281541 - RNA, 15 nt, Mycobacterium tuberculosis H37Rv
gccgaggucgaaccg

SEQ ID NO: 3281542 - RNA, 20 nt, Mycobacterium tuberculosis H37Rv
gccgcacauugguguccacc

SEQ ID NO: 3281543 - RNA, 21 nt, Mycobacterium tuberculosis H37Rv
gccgcacauugguguccacca

SEQ ID NO: 3281544 - RNA, 16 nt, Mycobacterium tuberculosis H37Rv
gccgcaccaagcagcg

SEQ ID NO: 3281545 - RNA, 18 nt, Mycobacterium tuberculosis H37Rv
gccgcaccaagcagcgac

SEQ ID NO: 3281546 - RNA, 18 nt, Mycobacterium tuberculosis H37Rv
gccgcaccagaucgucgg

SEQ ID NO: 3281547 - RNA, 14 nt, Mycobacterium tuberculosis H37Rv
gccgcaccagcauu

SEQ ID NO: 3281548 - RNA, 17 nt, Mycobacterium tuberculosis H37Rv
gccgcaccagcauucuc

SEQ ID NO: 3281549 - RNA, 19 nt, Mycobacterium tuberculosis H37Rv
gccgcacccagaccgccga

SEQ ID NO: 3281550 - RNA, 20 nt, Mycobacterium tuberculosis H37Rv
gccgcacccccuccgcgaug

SEQ ID NO: 3281551 - RNA, 19 nt, Mycobacterium tuberculosis H37Rv
gccgcacccgaaacaccgu

SEQ ID NO: 3281552 - RNA, 16 nt, Mycobacterium tuberculosis H37Rv
gccgcacccgcucccg

SEQ ID NO: 3281553 - RNA, 15 nt, Mycobacterium tuberculosis H37Rv
gccgcacccggucga

SEQ ID NO: 3281554 - RNA, 23 nt, Mycobacterium tuberculosis H37Rv
gccgcaccgcuguugcaucgccg

SEQ ID NO: 3281555 - RNA, 17 nt, Mycobacterium tuberculosis H37Rv
gccgcaccggaucaccg

SEQ ID NO: 3281556 - RNA, 14 nt, Mycobacterium tuberculosis H37Rv
gccgcacgauagcc

SEQ ID NO: 3281557 - RNA, 13 nt, Mycobacterium tuberculosis H37Rv
gccgcacgauggc

SEQ ID NO: 3281558 - RNA, 20 nt, Mycobacterium tuberculosis H37Rv
gccgcacgauggccgucgau

SEQ ID NO: 3281559 - RNA, 21 nt, Mycobacterium tuberculosis H37Rv
gccgcacgauggccgucgauc

SEQ ID NO: 3281560 - RNA, 15 nt, Mycobacterium tuberculosis H37Rv
gccgcacgccgacca

SEQ ID NO: 3281561 - RNA, 22 nt, Mycobacterium tuberculosis H37Rv
gccgcacgccgaccggcccgca

SEQ ID NO: 3281562 - RNA, 17 nt, Mycobacterium tuberculosis H37Rv
gccgcacgccggcaugc

SEQ ID NO: 3281563 - RNA, 17 nt, Mycobacterium tuberculosis H37Rv
gccgcacgccggccagc

SEQ ID NO: 3281564 - RNA, 19 nt, Mycobacterium tuberculosis H37Rv
gccgcacgccuacgaugac

SEQ ID NO: 3281565 - RNA, 15 nt, Mycobacterium tuberculosis H37Rv
gccgcacgcuagccg

SEQ ID NO: 3281566 - RNA, 13 nt, Mycobacterium tuberculosis H37Rv
gccgcacggcgac

SEQ ID NO: 3281567 - RNA, 21 nt, Mycobacterium tuberculosis H37Rv
gccgcacggcgacgccagugu

SEQ ID NO: 3281568 - RNA, 13 nt, Mycobacterium tuberculosis H37Rv
gccgcacgggcga

SEQ ID NO: 3281569 - RNA, 18 nt, Mycobacterium tuberculosis H37Rv
gccgcacgggcgaccugc

SEQ ID NO: 3281570 - RNA, 18 nt, Mycobacterium tuberculosis H37Rv
gccgcacggucagcgcgc

SEQ ID NO: 3281571 - RNA, 12 nt, Mycobacterium tuberculosis H37Rv
gccgcacgucga

SEQ ID NO: 3281572 - RNA, 20 nt, Mycobacterium tuberculosis H37Rv
gccgcacgucgaccucggca

SEQ ID NO: 3281573 - RNA, 19 nt, Mycobacterium tuberculosis H37Rv
gccgcacucacauccuggu

SEQ ID NO: 3281574 - RNA, 20 nt, Mycobacterium tuberculosis H37Rv
gccgcacugggugcgucgac

SEQ ID NO: 3281575 - RNA, 18 nt, Mycobacterium tuberculosis H37Rv
gccgcagaaucccaacuc

SEQ ID NO: 3281576 - RNA, 19 nt, Mycobacterium tuberculosis H37Rv
gccgcagaucaccgccagc

SEQ ID NO: 3281577 - RNA, 22 nt, Mycobacterium tuberculosis H37Rv
gccgcagaucaccgccagcugg

SEQ ID NO: 3281578 - RNA, 14 nt, Mycobacterium tuberculosis H37Rv
gccgcagcaccucg

SEQ ID NO: 3281579 - RNA, 15 nt, Mycobacterium tuberculosis H37Rv
gccgcagcaccucgg

SEQ ID NO: 3281580 - RNA, 20 nt, Mycobacterium tuberculosis H37Rv
gccgcagcaccucgucgauc

SEQ ID NO: 3281581 - RNA, 20 nt, Mycobacterium tuberculosis H37Rv
gccgcagcaggggacgacca

SEQ ID NO: 3281582 - RNA, 21 nt, Mycobacterium tuberculosis H37Rv
gccgcagcaggugcaucgcca

SEQ ID NO: 3281583 - RNA, 14 nt, Mycobacterium tuberculosis H37Rv
gccgcagccagcaa

SEQ ID NO: 3281584 - RNA, 16 nt, Mycobacterium tuberculosis H37Rv
gccgcagccagcggua

SEQ ID NO: 3281585 - RNA, 13 nt, Mycobacterium tuberculosis H37Rv
gccgcagccaggu

SEQ ID NO: 3281586 - RNA, 12 nt, Mycobacterium tuberculosis H37Rv
gccgcagccugc

SEQ ID NO: 3281587 - RNA, 14 nt, Mycobacterium tuberculosis H37Rv
gccgcagccugcaa

SEQ ID NO: 3281588 - RNA, 23 nt, Mycobacterium tuberculosis H37Rv
gccgcagcgaaaacccggucggc

SEQ ID NO: 3281589 - RNA, 12 nt, Mycobacterium tuberculosis H37Rv
gccgcagcggcc

SEQ ID NO: 3281590 - RNA, 14 nt, Mycobacterium tuberculosis H37Rv
gccgcagcggccag

SEQ ID NO: 3281591 - RNA, 15 nt, Mycobacterium tuberculosis H37Rv
gccgcagcggccagc

SEQ ID NO: 3281592 - RNA, 14 nt, Mycobacterium tuberculosis H37Rv
gccgcagcggcggc

SEQ ID NO: 3281593 - RNA, 17 nt, Mycobacterium tuberculosis H37Rv
gccgcagcggcggcaac

SEQ ID NO: 3281594 - RNA, 14 nt, Mycobacterium tuberculosis H37Rv
gccgcagcguccgc

SEQ ID NO: 3281595 - RNA, 22 nt, Mycobacterium tuberculosis H37Rv
gccgcagcuccccgaccgaacc

SEQ ID NO: 3281596 - RNA, 22 nt, Mycobacterium tuberculosis H37Rv
gccgcagcuuuaaucguggcac

SEQ ID NO: 3281597 - RNA, 17 nt, Mycobacterium tuberculosis H37Rv
gccgcagggccgcgcgc

SEQ ID NO: 3281598 - RNA, 20 nt, Mycobacterium tuberculosis H37Rv
gccgcagggccgcgcgcacu

SEQ ID NO: 3281599 - RNA, 13 nt, Mycobacterium tuberculosis H37Rv
gccgcagggccuc

SEQ ID NO: 3281600 - RNA, 20 nt, Mycobacterium tuberculosis H37Rv
gccgcaggugggcguuggcg

SEQ ID NO: 3281601 - RNA, 19 nt, Mycobacterium tuberculosis H37Rv
gccgcagguucaacgcggg

SEQ ID NO: 3281602 - RNA, 13 nt, Mycobacterium tuberculosis H37Rv
gccgcauaccagu

SEQ ID NO: 3281603 - RNA, 19 nt, Mycobacterium tuberculosis H37Rv
gccgcauaggccccgccag

SEQ ID NO: 3281604 - RNA, 20 nt, Mycobacterium tuberculosis H37Rv
gccgcauaggccccgccagc

SEQ ID NO: 3281605 - RNA, 15 nt, Mycobacterium tuberculosis H37Rv
gccgcauccagccgu

SEQ ID NO: 3281606 - RNA, 21 nt, Mycobacterium tuberculosis H37Rv
gccgcauccccgguacgucga

SEQ ID NO: 3281607 - RNA, 22 nt, Mycobacterium tuberculosis H37Rv
gccgcauccccgguacgucgag

SEQ ID NO: 3281608 - RNA, 18 nt, Mycobacterium tuberculosis H37Rv
gccgcaucggcggugaac

SEQ ID NO: 3281609 - RNA, 14 nt, Mycobacterium tuberculosis H37Rv
gccgcaucgucgcc

SEQ ID NO: 3281610 - RNA, 15 nt, Mycobacterium tuberculosis H37Rv
gccgcaucgucgccg

SEQ ID NO: 3281611 - RNA, 18 nt, Mycobacterium tuberculosis H37Rv
gccgcaucgucgccgcgc

SEQ ID NO: 3281612 - RNA, 22 nt, Mycobacterium tuberculosis H37Rv
gccgcaugcgcuccggcgcgac

SEQ ID NO: 3281613 - RNA, 14 nt, Mycobacterium tuberculosis H37Rv
gccgcauuggcgac

SEQ ID NO: 3281614 - RNA, 20 nt, Mycobacterium tuberculosis H37Rv
gccgccaacuucaccacccu

SEQ ID NO: 3281615 - RNA, 14 nt, Mycobacterium tuberculosis H37Rv
gccgccaagcucgg

SEQ ID NO: 3281616 - RNA, 19 nt, Mycobacterium tuberculosis H37Rv
gccgccaagcucggccacc

SEQ ID NO: 3281617 - RNA, 21 nt, Mycobacterium tuberculosis H37Rv
gccgccaccaccgcugccggc

SEQ ID NO: 3281618 - RNA, 15 nt, Mycobacterium tuberculosis H37Rv
gccgccaccaccggc

SEQ ID NO: 3281619 - RNA, 19 nt, Mycobacterium tuberculosis H37Rv
gccgccaccagcgcgagcc

SEQ ID NO: 3281620 - RNA, 21 nt, Mycobacterium tuberculosis H37Rv
gccgccaccagcgcgagcccg

SEQ ID NO: 3281621 - RNA, 23 nt, Mycobacterium tuberculosis H37Rv
gccgccaccagggcacguucggc

SEQ ID NO: 3281622 - RNA, 17 nt, Mycobacterium tuberculosis H37Rv
gccgccacccggcgggc

SEQ ID NO: 3281623 - RNA, 18 nt, Mycobacterium tuberculosis H37Rv
gccgccacccggcgggcg

SEQ ID NO: 3281624 - RNA, 23 nt, Mycobacterium tuberculosis H37Rv
gccgccaccgcgacgagcggccg

SEQ ID NO: 3281625 - RNA, 22 nt, Mycobacterium tuberculosis H37Rv
gccgccaccgcugucgauggac

SEQ ID NO: 3281626 - RNA, 14 nt, Mycobacterium tuberculosis H37Rv
gccgccaccggcga

SEQ ID NO: 3281627 - RNA, 15 nt, Mycobacterium tuberculosis H37Rv
gccgccaccggcgac

SEQ ID NO: 3281628 - RNA, 16 nt, Mycobacterium tuberculosis H37Rv
gccgccaccggcgccg

SEQ ID NO: 3281629 - RNA, 13 nt, Mycobacterium tuberculosis H37Rv
gccgccaccguca

SEQ ID NO: 3281630 - RNA, 17 nt, Mycobacterium tuberculosis H37Rv
gccgccaccgucaccgc

SEQ ID NO: 3281631 - RNA, 20 nt, Mycobacterium tuberculosis H37Rv
gccgccaccgucaccgccgu

SEQ ID NO: 3281632 - RNA, 13 nt, Mycobacterium tuberculosis H37Rv
gccgccaccuugg

SEQ ID NO: 3281633 - RNA, 20 nt, Mycobacterium tuberculosis H37Rv
gccgccacgguacauccaga

SEQ ID NO: 3281634 - RNA, 21 nt, Mycobacterium tuberculosis H37Rv
gccgccacgguacauccagag

SEQ ID NO: 3281635 - RNA, 18 nt, Mycobacterium tuberculosis H37Rv
gccgccagauuggcgcug

SEQ ID NO: 3281636 - RNA, 21 nt, Mycobacterium tuberculosis H37Rv
gccgccagcaccucggccagc

SEQ ID NO: 3281637 - RNA, 12 nt, Mycobacterium tuberculosis H37Rv
gccgccagcauu

SEQ ID NO: 3281638 - RNA, 17 nt, Mycobacterium tuberculosis H37Rv
gccgccgacgccgccgg

SEQ ID NO: 3281639 - RNA, 18 nt, Mycobacterium tuberculosis H37Rv
gccgccgacgccgccggc

SEQ ID NO: 3281640 - RNA, 19 nt, Mycobacterium tuberculosis H37Rv
gccgccgacgccgccggcg

SEQ ID NO: 3281641 - RNA, 22 nt, Mycobacterium tuberculosis H37Rv
gccgccgacggaucgcccugac

SEQ ID NO: 3281642 - RNA, 21 nt, Mycobacterium tuberculosis H37Rv
gccgccgacuuccgcgucgcc

SEQ ID NO: 3281643 - RNA, 15 nt, Mycobacterium tuberculosis H37Rv
gccgccgagacgacc

SEQ ID NO: 3281644 - RNA, 21 nt, Mycobacterium tuberculosis H37Rv
gccgccgagauuggugcagac

SEQ ID NO: 3281645 - RNA, 17 nt, Mycobacterium tuberculosis H37Rv
gccgccgagcuggcgcg

SEQ ID NO: 3281646 - RNA, 18 nt, Mycobacterium tuberculosis H37Rv
gccgccgagcuggcgcgc

SEQ ID NO: 3281647 - RNA, 23 nt, Mycobacterium tuberculosis H37Rv
gccgccgaggacacauugaccag

SEQ ID NO: 3281648 - RNA, 18 nt, Mycobacterium tuberculosis H37Rv
gccgccgauaccgccggc

SEQ ID NO: 3281649 - RNA, 19 nt, Mycobacterium tuberculosis H37Rv
gccgccgauaccgccggcc

SEQ ID NO: 3281650 - RNA, 14 nt, Mycobacterium tuberculosis H37Rv
gccgccgaucugcu

SEQ ID NO: 3281651 - RNA, 18 nt, Mycobacterium tuberculosis H37Rv
gccgccgaucuugagccg

SEQ ID NO: 3281652 - RNA, 19 nt, Mycobacterium tuberculosis H37Rv
gccgccgaucuugagccgg

SEQ ID NO: 3281653 - RNA, 15 nt, Mycobacterium tuberculosis H37Rv
gccgccgaugccacc

SEQ ID NO: 3281654 - RNA, 18 nt, Mycobacterium tuberculosis H37Rv
gccgccgaugccgccggc

SEQ ID NO: 3281655 - RNA, 23 nt, Mycobacterium tuberculosis H37Rv
gccgccgauguagacgguggcgc

SEQ ID NO: 3281656 - RNA, 14 nt, Mycobacterium tuberculosis H37Rv
gccgccgcacacca

SEQ ID NO: 3281657 - RNA, 15 nt, Mycobacterium tuberculosis H37Rv
gccgccgcacaucug

SEQ ID NO: 3281658 - RNA, 12 nt, Mycobacterium tuberculosis H37Rv
gccgccgcagcu

SEQ ID NO: 3281659 - RNA, 19 nt, Mycobacterium tuberculosis H37Rv
gccgccgccaccggcgccg

SEQ ID NO: 3281660 - RNA, 20 nt, Mycobacterium tuberculosis H37Rv
gccgccgccaccggcgccgc

SEQ ID NO: 3281661 - RNA, 17 nt, Mycobacterium tuberculosis H37Rv
gccgccgccaucgccga

SEQ ID NO: 3281662 - RNA, 20 nt, Mycobacterium tuberculosis H37Rv
gccgccgccccggcgcuggu

SEQ ID NO: 3281663 - RNA, 12 nt, Mycobacterium tuberculosis H37Rv
gccgccgcccgu

SEQ ID NO: 3281664 - RNA, 16 nt, Mycobacterium tuberculosis H37Rv
gccgccgccgacgaag

SEQ ID NO: 3281665 - RNA, 13 nt, Mycobacterium tuberculosis H37Rv
gccgccgccgauc

SEQ ID NO: 3281666 - RNA, 15 nt, Mycobacterium tuberculosis H37Rv
gccgccgccgccggc

SEQ ID NO: 3281667 - RNA, 17 nt, Mycobacterium tuberculosis H37Rv
gccgccgccggcgccca

SEQ ID NO: 3281668 - RNA, 16 nt, Mycobacterium tuberculosis H37Rv
gccgccgccggcgccg

SEQ ID NO: 3281669 - RNA, 15 nt, Mycobacterium tuberculosis H37Rv
gccgccgcgacugac

SEQ ID NO: 3281670 - RNA, 16 nt, Mycobacterium tuberculosis H37Rv
gccgccgcgagcgccg

SEQ ID NO: 3281671 - RNA, 17 nt, Mycobacterium tuberculosis H37Rv
gccgccgcgagcgccgg

SEQ ID NO: 3281672 - RNA, 13 nt, Mycobacterium tuberculosis H37Rv
gccgccgcgagga

SEQ ID NO: 3281673 - RNA, 12 nt, Mycobacterium tuberculosis H37Rv
gccgccgcgccg

SEQ ID NO: 3281674 - RNA, 13 nt, Mycobacterium tuberculosis H37Rv
gccgccgcggcca

SEQ ID NO: 3281675 - RNA, 13 nt, Mycobacterium tuberculosis H37Rv
gccgccgcggccg

SEQ ID NO: 3281676 - RNA, 12 nt, Mycobacterium tuberculosis H37Rv
gccgccgcggcg

SEQ ID NO: 3281677 - RNA, 17 nt, Mycobacterium tuberculosis H37Rv
gccgccgcgggcgccgg

SEQ ID NO: 3281678 - RNA, 16 nt, Mycobacterium tuberculosis H37Rv
gccgccgcugccgccc

SEQ ID NO: 3281679 - RNA, 17 nt, Mycobacterium tuberculosis H37Rv
gccgccgcugccgcccu

SEQ ID NO: 3281680 - RNA, 16 nt, Mycobacterium tuberculosis H37Rv
gccgccgcugccgccu

SEQ ID NO: 3281681 - RNA, 13 nt, Mycobacterium tuberculosis H37Rv
gccgccgcuggug

SEQ ID NO: 3281682 - RNA, 19 nt, Mycobacterium tuberculosis H37Rv
gccgccgcuuucgccggcg

SEQ ID NO: 3281683 - RNA, 23 nt, Mycobacterium tuberculosis H37Rv
gccgccgcuuucgccggcgccaa

SEQ ID NO: 3281684 - RNA, 17 nt, Mycobacterium tuberculosis H37Rv
gccgccggaaucgagac

SEQ ID NO: 3281685 - RNA, 14 nt, Mycobacterium tuberculosis H37Rv
gccgccggacccgu

SEQ ID NO: 3281686 - RNA, 17 nt, Mycobacterium tuberculosis H37Rv
gccgccggacccgucga

SEQ ID NO: 3281687 - RNA, 21 nt, Mycobacterium tuberculosis H37Rv
gccgccggacccgucgagcag

SEQ ID NO: 3281688 - RNA, 14 nt, Mycobacterium tuberculosis H37Rv
gccgccggagauga

SEQ ID NO: 3281689 - RNA, 23 nt, Mycobacterium tuberculosis H37Rv
gccgccggaggucgggcggcgac

SEQ ID NO: 3281690 - RNA, 15 nt, Mycobacterium tuberculosis H37Rv
gccgccggaucgcca

SEQ ID NO: 3281691 - RNA, 23 nt, Mycobacterium tuberculosis H37Rv
gccgccggcaacccagugucagc

SEQ ID NO: 3281692 - RNA, 17 nt, Mycobacterium tuberculosis H37Rv
gccgccggcaccaccgu

SEQ ID NO: 3281693 - RNA, 13 nt, Mycobacterium tuberculosis H37Rv
gccgccggcaccg

SEQ ID NO: 3281694 - RNA, 18 nt, Mycobacterium tuberculosis H37Rv
gccgccggcaccgccggc

SEQ ID NO: 3281695 - RNA, 19 nt, Mycobacterium tuberculosis H37Rv
gccgccggcaccgccggca

SEQ ID NO: 3281696 - RNA, 20 nt, Mycobacterium tuberculosis H37Rv
gccgccggcaccgccggcgc

SEQ ID NO: 3281697 - RNA, 16 nt, Mycobacterium tuberculosis H37Rv
gccgccggcaccuccc

SEQ ID NO: 3281698 - RNA, 13 nt, Mycobacterium tuberculosis H37Rv
gccgccggccagc

SEQ ID NO: 3281699 - RNA, 15 nt, Mycobacterium tuberculosis H37Rv
gccgccggccagcgu

SEQ ID NO: 3281700 - RNA, 14 nt, Mycobacterium tuberculosis H37Rv
gccgccggccgcca

SEQ ID NO: 3281701 - RNA, 13 nt, Mycobacterium tuberculosis H37Rv
gccgccggccgcg

SEQ ID NO: 3281702 - RNA, 15 nt, Mycobacterium tuberculosis H37Rv
gccgccggcgccacc

SEQ ID NO: 3281703 - RNA, 17 nt, Mycobacterium tuberculosis H37Rv
gccgccggcgccacccg

SEQ ID NO: 3281704 - RNA, 15 nt, Mycobacterium tuberculosis H37Rv
gccgccggcgccagc

SEQ ID NO: 3281705 - RNA, 17 nt, Mycobacterium tuberculosis H37Rv
gccgccggcgcccaggc

SEQ ID NO: 3281706 - RNA, 18 nt, Mycobacterium tuberculosis H37Rv
gccgccggcgcccaggcc

SEQ ID NO: 3281707 - RNA, 21 nt, Mycobacterium tuberculosis H37Rv
gccgccggcgcccaggccgau

SEQ ID NO: 3281708 - RNA, 17 nt, Mycobacterium tuberculosis H37Rv
gccgccggcgccgccau

SEQ ID NO: 3281709 - RNA, 16 nt, Mycobacterium tuberculosis H37Rv
gccgccggcgccgccc

SEQ ID NO: 3281710 - RNA, 17 nt, Mycobacterium tuberculosis H37Rv
gccgccggcgccgccgu

SEQ ID NO: 3281711 - RNA, 15 nt, Mycobacterium tuberculosis H37Rv
gccgccggcgccgga

SEQ ID NO: 3281712 - RNA, 16 nt, Mycobacterium tuberculosis H37Rv
gccgccggcgccggca

SEQ ID NO: 3281713 - RNA, 13 nt, Mycobacterium tuberculosis H37Rv
gccgccggcgcug

SEQ ID NO: 3281714 - RNA, 19 nt, Mycobacterium tuberculosis H37Rv
gccgccggcggcgguaccg

SEQ ID NO: 3281715 - RNA, 18 nt, Mycobacterium tuberculosis H37Rv
gccgccggcuccgccagc

SEQ ID NO: 3281716 - RNA, 23 nt, Mycobacterium tuberculosis H37Rv
gccgccgggaaauaucucgguga

SEQ ID NO: 3281717 - RNA, 18 nt, Mycobacterium tuberculosis H37Rv
gccgccgggauaacccag

SEQ ID NO: 3281718 - RNA, 22 nt, Mycobacterium tuberculosis H37Rv
gccgccggguccuugcggccgg

SEQ ID NO: 3281719 - RNA, 17 nt, Mycobacterium tuberculosis H37Rv
gccgccgggucgaacgc

SEQ ID NO: 3281720 - RNA, 16 nt, Mycobacterium tuberculosis H37Rv
gccgccgggugcgccg

SEQ ID NO: 3281721 - RNA, 18 nt, Mycobacterium tuberculosis H37Rv
gccgccggguuuauccag

SEQ ID NO: 3281722 - RNA, 14 nt, Mycobacterium tuberculosis H37Rv
gccgccggucaucc

SEQ ID NO: 3281723 - RNA, 20 nt, Mycobacterium tuberculosis H37Rv
gccgccggucaucccaagcg

SEQ ID NO: 3281724 - RNA, 22 nt, Mycobacterium tuberculosis H37Rv
gccgccgguccauggacggcca

SEQ ID NO: 3281725 - RNA, 15 nt, Mycobacterium tuberculosis H37Rv
gccgccgguccccuc

SEQ ID NO: 3281726 - RNA, 20 nt, Mycobacterium tuberculosis H37Rv
gccgccggugccacccuugc

SEQ ID NO: 3281727 - RNA, 16 nt, Mycobacterium tuberculosis H37Rv
gccgccggugccaccg

SEQ ID NO: 3281728 - RNA, 15 nt, Mycobacterium tuberculosis H37Rv
gccgccggugccgau

SEQ ID NO: 3281729 - RNA, 15 nt, Mycobacterium tuberculosis H37Rv
gccgccggugccgcc

SEQ ID NO: 3281730 - RNA, 17 nt, Mycobacterium tuberculosis H37Rv
gccgccggugccgccau

SEQ ID NO: 3281731 - RNA, 16 nt, Mycobacterium tuberculosis H37Rv
gccgccggugccgccg

SEQ ID NO: 3281732 - RNA, 17 nt, Mycobacterium tuberculosis H37Rv
gccgccggugccgccgc

SEQ ID NO: 3281733 - RNA, 14 nt, Mycobacterium tuberculosis H37Rv
gccgccgguggugc

SEQ ID NO: 3281734 - RNA, 23 nt, Mycobacterium tuberculosis H37Rv
gccgccgguggugccggcgccgc

SEQ ID NO: 3281735 - RNA, 23 nt, Mycobacterium tuberculosis H37Rv
gccgcgagacgcaugucgggcca

SEQ ID NO: 3281736 - RNA, 15 nt, Mycobacterium tuberculosis H37Rv
gccgcgagcgccggc

SEQ ID NO: 3281737 - RNA, 15 nt, Mycobacterium tuberculosis H37Rv
gccgcgagcgcgcga

SEQ ID NO: 3281738 - RNA, 17 nt, Mycobacterium tuberculosis H37Rv
gccgcgagcgcgcgacu

SEQ ID NO: 3281739 - RNA, 13 nt, Mycobacterium tuberculosis H37Rv
gccgcgaggaugc

SEQ ID NO: 3281740 - RNA, 17 nt, Mycobacterium tuberculosis H37Rv
gccgcgaggcaccgaca

SEQ ID NO: 3281741 - RNA, 22 nt, Mycobacterium tuberculosis H37Rv
gccgcgagguacccaucgucga

SEQ ID NO: 3281742 - RNA, 18 nt, Mycobacterium tuberculosis H37Rv
gccgcgaguccaggcuga

SEQ ID NO: 3281743 - RNA, 15 nt, Mycobacterium tuberculosis H37Rv
gccgcgauccagcgc

SEQ ID NO: 3281744 - RNA, 22 nt, Mycobacterium tuberculosis H37Rv
gccgcgaucgggcccagcagcg

SEQ ID NO: 3281745 - RNA, 21 nt, Mycobacterium tuberculosis H37Rv
gccgcgaucuccuuggccguu

SEQ ID NO: 3281746 - RNA, 22 nt, Mycobacterium tuberculosis H37Rv
gccgcgaugacgaccgaucggc

SEQ ID NO: 3281747 - RNA, 16 nt, Mycobacterium tuberculosis H37Rv
gccgcgaugacggugc

SEQ ID NO: 3281748 - RNA, 17 nt, Mycobacterium tuberculosis H37Rv
gccgcgaugacggugcc

SEQ ID NO: 3281749 - RNA, 18 nt, Mycobacterium tuberculosis H37Rv
gccgcgaugagcggcgcg

SEQ ID NO: 3281750 - RNA, 16 nt, Mycobacterium tuberculosis H37Rv
gccgcgauggccccug

SEQ ID NO: 3281751 - RNA, 12 nt, Mycobacterium tuberculosis H37Rv
gccgcgauggcg

SEQ ID NO: 3281752 - RNA, 16 nt, Mycobacterium tuberculosis H37Rv
gccgcgauggcggucc

SEQ ID NO: 3281753 - RNA, 16 nt, Mycobacterium tuberculosis H37Rv
gccgcgauggcguagc

SEQ ID NO: 3281754 - RNA, 14 nt, Mycobacterium tuberculosis H37Rv
gccgcgcaccaaca

SEQ ID NO: 3281755 - RNA, 21 nt, Mycobacterium tuberculosis H37Rv
gccgcgcaccaacaccagcgc

SEQ ID NO: 3281756 - RNA, 23 nt, Mycobacterium tuberculosis H37Rv
gccgcgcaccaacaccagcgcgu

SEQ ID NO: 3281757 - RNA, 13 nt, Mycobacterium tuberculosis H37Rv
gccgcgcaccgac

SEQ ID NO: 3281758 - RNA, 19 nt, Mycobacterium tuberculosis H37Rv
gccgcgcaccgcgggaucg

SEQ ID NO: 3281759 - RNA, 13 nt, Mycobacterium tuberculosis H37Rv
gccgcgcagccgg

SEQ ID NO: 3281760 - RNA, 14 nt, Mycobacterium tuberculosis H37Rv
gccgcgcagcgagg

SEQ ID NO: 3281761 - RNA, 12 nt, Mycobacterium tuberculosis H37Rv
gccgcgcagcug

SEQ ID NO: 3281762 - RNA, 16 nt, Mycobacterium tuberculosis H37Rv
gccgcgcagcugccgc

SEQ ID NO: 3281763 - RNA, 17 nt, Mycobacterium tuberculosis H37Rv
gccgcgcaucgcggccg

SEQ ID NO: 3281764 - RNA, 18 nt, Mycobacterium tuberculosis H37Rv
gccgcgcaucugucgcgc

SEQ ID NO: 3281765 - RNA, 12 nt, Mycobacterium tuberculosis H37Rv
gccgcgccagcu

SEQ ID NO: 3281766 - RNA, 19 nt, Mycobacterium tuberculosis H37Rv
gccgcgccccagacgcgca

SEQ ID NO: 3281767 - RNA, 22 nt, Mycobacterium tuberculosis H37Rv
gccgcgcccgagaccggcaccg

SEQ ID NO: 3281768 - RNA, 16 nt, Mycobacterium tuberculosis H37Rv
gccgcgcccgccucga

SEQ ID NO: 3281769 - RNA, 21 nt, Mycobacterium tuberculosis H37Rv
gccgcgcccgccucgaccgcc

SEQ ID NO: 3281770 - RNA, 18 nt, Mycobacterium tuberculosis H37Rv
gccgcgcccggcgcaagc

SEQ ID NO: 3281771 - RNA, 18 nt, Mycobacterium tuberculosis H37Rv
gccgcgcccggcgcuagc

SEQ ID NO: 3281772 - RNA, 21 nt, Mycobacterium tuberculosis H37Rv
gccgcgccgaccucaucggca

SEQ ID NO: 3281773 - RNA, 16 nt, Mycobacterium tuberculosis H37Rv
gccgcgccgacgccgc

SEQ ID NO: 3281774 - RNA, 19 nt, Mycobacterium tuberculosis H37Rv
gccgcgccgacgccgcgga

SEQ ID NO: 3281775 - RNA, 15 nt, Mycobacterium tuberculosis H37Rv
gccgcgccgauucca

SEQ ID NO: 3281776 - RNA, 17 nt, Mycobacterium tuberculosis H37Rv
gccgcgccgcgccgccu

SEQ ID NO: 3281777 - RNA, 15 nt, Mycobacterium tuberculosis H37Rv
gccgcgccgcggccc

SEQ ID NO: 3281778 - RNA, 14 nt, Mycobacterium tuberculosis H37Rv
gccgcgccggcacg

SEQ ID NO: 3281779 - RNA, 13 nt, Mycobacterium tuberculosis H37Rv
gccgcgccguaga

SEQ ID NO: 3281780 - RNA, 22 nt, Mycobacterium tuberculosis H37Rv
gccgcgccguagagccgcucgg

SEQ ID NO: 3281781 - RNA, 15 nt, Mycobacterium tuberculosis H37Rv
gccgcgccgucggcg

SEQ ID NO: 3281782 - RNA, 16 nt, Mycobacterium tuberculosis H37Rv
gccgcgccgucggcga

SEQ ID NO: 3281783 - RNA, 13 nt, Mycobacterium tuberculosis H37Rv
gccgcgcgcccgc

SEQ ID NO: 3281784 - RNA, 14 nt, Mycobacterium tuberculosis H37Rv
gccgcgcgccggcc

SEQ ID NO: 3281785 - RNA, 13 nt, Mycobacterium tuberculosis H37Rv
gccgcgcgcgccg

SEQ ID NO: 3281786 - RNA, 17 nt, Mycobacterium tuberculosis H37Rv
gccgcgcgcucgagcag

SEQ ID NO: 3281787 - RNA, 20 nt, Mycobacterium tuberculosis H37Rv
gccgcgcgcugccgcugcgc

SEQ ID NO: 3281788 - RNA, 22 nt, Mycobacterium tuberculosis H37Rv
gccgcgcgcugccgcugcgcgu

SEQ ID NO: 3281789 - RNA, 16 nt, Mycobacterium tuberculosis H37Rv
gccgcgcggaacaccg

SEQ ID NO: 3281790 - RNA, 12 nt, Mycobacterium tuberculosis H37Rv
gccgcgcggcga

SEQ ID NO: 3281791 - RNA, 17 nt, Mycobacterium tuberculosis H37Rv
gccgcgcgggccgccgc

SEQ ID NO: 3281792 - RNA, 14 nt, Mycobacterium tuberculosis H37Rv
gccgcgcggggugc

SEQ ID NO: 3281793 - RNA, 16 nt, Mycobacterium tuberculosis H37Rv
gccgcgcgggucacga

SEQ ID NO: 3281794 - RNA, 22 nt, Mycobacterium tuberculosis H37Rv
gccgcgcgguacugcgcagcgc

SEQ ID NO: 3281795 - RNA, 13 nt, Mycobacterium tuberculosis H37Rv
gccgcgcgucaag

SEQ ID NO: 3281796 - RNA, 14 nt, Mycobacterium tuberculosis H37Rv
gccgcgcguucggc

SEQ ID NO: 3281797 - RNA, 14 nt, Mycobacterium tuberculosis H37Rv
gccgcgcucgacga

SEQ ID NO: 3281798 - RNA, 16 nt, Mycobacterium tuberculosis H37Rv
gccgcgcucgacgagc

SEQ ID NO: 3281799 - RNA, 19 nt, Mycobacterium tuberculosis H37Rv
gccgcgcucgacgagcacg

SEQ ID NO: 3281800 - RNA, 14 nt, Mycobacterium tuberculosis H37Rv
gccgcgcucgccga

SEQ ID NO: 3281801 - RNA, 13 nt, Mycobacterium tuberculosis H37Rv
gccgcgcugcgac

SEQ ID NO: 3281802 - RNA, 15 nt, Mycobacterium tuberculosis H37Rv
gccgcgcuggucaac

SEQ ID NO: 3281803 - RNA, 15 nt, Mycobacterium tuberculosis H37Rv
gccgcgcuugcgauc

SEQ ID NO: 3281804 - RNA, 21 nt, Mycobacterium tuberculosis H37Rv
gccgcgcuugcgaucggcacu

SEQ ID NO: 3281805 - RNA, 14 nt, Mycobacterium tuberculosis H37Rv
gccgcggaccccga

SEQ ID NO: 3281806 - RNA, 14 nt, Mycobacterium tuberculosis H37Rv
gccgcggaccgcga

SEQ ID NO: 3281807 - RNA, 21 nt, Mycobacterium tuberculosis H37Rv
gccgcggacgcaacucgacgc

SEQ ID NO: 3281808 - RNA, 14 nt, Mycobacterium tuberculosis H37Rv
gccgcggacggcga

SEQ ID NO: 3281809 - RNA, 16 nt, Mycobacterium tuberculosis H37Rv
gccgcggacggcgaac

SEQ ID NO: 3281810 - RNA, 19 nt, Mycobacterium tuberculosis H37Rv
gccgcggacuugcgagccg

SEQ ID NO: 3281811 - RNA, 21 nt, Mycobacterium tuberculosis H37Rv
gccgcggacuugcgagccgua

SEQ ID NO: 3281812 - RNA, 20 nt, Mycobacterium tuberculosis H37Rv
gccgcggagaaggcgcgggc

SEQ ID NO: 3281813 - RNA, 21 nt, Mycobacterium tuberculosis H37Rv
gccgcggagaaggcgcgggcg

SEQ ID NO: 3281814 - RNA, 18 nt, Mycobacterium tuberculosis H37Rv
gccgcggaggcggccagc

SEQ ID NO: 3281815 - RNA, 19 nt, Mycobacterium tuberculosis H37Rv
gccgcggaggcggccagcc

SEQ ID NO: 3281816 - RNA, 20 nt, Mycobacterium tuberculosis H37Rv
gccgcggaggcggccagccu

SEQ ID NO: 3281817 - RNA, 22 nt, Mycobacterium tuberculosis H37Rv
gccgcggaguaggccgcgcccg

SEQ ID NO: 3281818 - RNA, 23 nt, Mycobacterium tuberculosis H37Rv
gccgcggaguaggccgcgcccga

SEQ ID NO: 3281819 - RNA, 16 nt, Mycobacterium tuberculosis H37Rv
gccgcggcacccaggu

SEQ ID NO: 3281820 - RNA, 21 nt, Mycobacterium tuberculosis H37Rv
gccgcggcacccaggugucgc

SEQ ID NO: 3281821 - RNA, 16 nt, Mycobacterium tuberculosis H37Rv
gccgcggcaccgccga

SEQ ID NO: 3281822 - RNA, 19 nt, Mycobacterium tuberculosis H37Rv
gccgcggcaccgccgagca

SEQ ID NO: 3281823 - RNA, 20 nt, Mycobacterium tuberculosis H37Rv
gccgcggcaccgccgagcag

SEQ ID NO: 3281824 - RNA, 23 nt, Mycobacterium tuberculosis H37Rv
gccgcggcaccgccgagcagacg

SEQ ID NO: 3281825 - RNA, 14 nt, Mycobacterium tuberculosis H37Rv
gccgcggcagggcg

SEQ ID NO: 3281826 - RNA, 21 nt, Mycobacterium tuberculosis H37Rv
gccgcggccacaaccucgucg

SEQ ID NO: 3281827 - RNA, 20 nt, Mycobacterium tuberculosis H37Rv
gccgcggccacaucgccagc

SEQ ID NO: 3281828 - RNA, 14 nt, Mycobacterium tuberculosis H37Rv
gccgcggccaccac

SEQ ID NO: 3281829 - RNA, 16 nt, Mycobacterium tuberculosis H37Rv
gccgcggccaccaccg

SEQ ID NO: 3281830 - RNA, 18 nt, Mycobacterium tuberculosis H37Rv
gccgcggccaccgccgcc

SEQ ID NO: 3281831 - RNA, 14 nt, Mycobacterium tuberculosis H37Rv
gccgcucgauggcc

SEQ ID NO: 3281832 - RNA, 21 nt, Mycobacterium tuberculosis H37Rv
gccgcucgcugaaccggaucg

SEQ ID NO: 3281833 - RNA, 15 nt, Mycobacterium tuberculosis H37Rv
gccgcucggcguagc

SEQ ID NO: 3281834 - RNA, 16 nt, Mycobacterium tuberculosis H37Rv
gccgcucggggugguc

SEQ ID NO: 3281835 - RNA, 18 nt, Mycobacterium tuberculosis H37Rv
gccgcucgggguggucgg

SEQ ID NO: 3281836 - RNA, 22 nt, Mycobacterium tuberculosis H37Rv
gccgcucgguaggacaggaucg

SEQ ID NO: 3281837 - RNA, 21 nt, Mycobacterium tuberculosis H37Rv
gccgcucguuacgccgagcac

SEQ ID NO: 3281838 - RNA, 22 nt, Mycobacterium tuberculosis H37Rv
gccgcucguuacgccgagcaca

SEQ ID NO: 3281839 - RNA, 21 nt, Mycobacterium tuberculosis H37Rv
gccgcugaacucaacgggacc

SEQ ID NO: 3281840 - RNA, 23 nt, Mycobacterium tuberculosis H37Rv
gccgcugaagccaggauugccgc

SEQ ID NO: 3281841 - RNA, 16 nt, Mycobacterium tuberculosis H37Rv
gccgcugaauuggcgc

SEQ ID NO: 3281842 - RNA, 22 nt, Mycobacterium tuberculosis H37Rv
gccgcugacgguucggucgggg

SEQ ID NO: 3281843 - RNA, 22 nt, Mycobacterium tuberculosis H37Rv
gccgcugacuccugcggcaccg

SEQ ID NO: 3281844 - RNA, 17 nt, Mycobacterium tuberculosis H37Rv
gccgcugagcccugcgc

SEQ ID NO: 3281845 - RNA, 16 nt, Mycobacterium tuberculosis H37Rv
gccgcugaucgccgac

SEQ ID NO: 3281846 - RNA, 18 nt, Mycobacterium tuberculosis H37Rv
gccgcugaucugccgccg

SEQ ID NO: 3281847 - RNA, 20 nt, Mycobacterium tuberculosis H37Rv
gccgcugauguacccggcga

SEQ ID NO: 3281848 - RNA, 21 nt, Mycobacterium tuberculosis H37Rv
gccgcugauguacccggcgac

SEQ ID NO: 3281849 - RNA, 22 nt, Mycobacterium tuberculosis H37Rv
gccgcugauguacccggcgacg

SEQ ID NO: 3281850 - RNA, 13 nt, Mycobacterium tuberculosis H37Rv
gccgcugccacag

SEQ ID NO: 3281851 - RNA, 14 nt, Mycobacterium tuberculosis H37Rv
gccgcugccagggu

SEQ ID NO: 3281852 - RNA, 18 nt, Mycobacterium tuberculosis H37Rv
gccgcugccaugcgggug

SEQ ID NO: 3281853 - RNA, 20 nt, Mycobacterium tuberculosis H37Rv
gccgcugccgaagcggccac

SEQ ID NO: 3281854 - RNA, 15 nt, Mycobacterium tuberculosis H37Rv
gccgcugccgcccuu

SEQ ID NO: 3281855 - RNA, 13 nt, Mycobacterium tuberculosis H37Rv
gccgcugccgccg

SEQ ID NO: 3281856 - RNA, 17 nt, Mycobacterium tuberculosis H37Rv
gccgcugccgccgagcu

SEQ ID NO: 3281857 - RNA, 14 nt, Mycobacterium tuberculosis H37Rv
gccgcugccgccug

SEQ ID NO: 3281858 - RNA, 13 nt, Mycobacterium tuberculosis H37Rv
gccgcugccuucu

SEQ ID NO: 3281859 - RNA, 13 nt, Mycobacterium tuberculosis H37Rv
gccgcugccuugg

SEQ ID NO: 3281860 - RNA, 16 nt, Mycobacterium tuberculosis H37Rv
gccgcugccuuggcgc

SEQ ID NO: 3281861 - RNA, 20 nt, Mycobacterium tuberculosis H37Rv
gccgcugccuuggcgcggca

SEQ ID NO: 3281862 - RNA, 23 nt, Mycobacterium tuberculosis H37Rv
gccgcugcgacaaaucggcggug

SEQ ID NO: 3281863 - RNA, 16 nt, Mycobacterium tuberculosis H37Rv
gccgcuggagaucacg

SEQ ID NO: 3281864 - RNA, 20 nt, Mycobacterium tuberculosis H37Rv
gccgcuggcaaucccgcggu

SEQ ID NO: 3281865 - RNA, 13 nt, Mycobacterium tuberculosis H37Rv
gccgcuggccagc

SEQ ID NO: 3281866 - RNA, 14 nt, Mycobacterium tuberculosis H37Rv
gccgcuggccagca

SEQ ID NO: 3281867 - RNA, 15 nt, Mycobacterium tuberculosis H37Rv
gccgcuggggcgccc

SEQ ID NO: 3281868 - RNA, 16 nt, Mycobacterium tuberculosis H37Rv
gccgcugggugaccag

SEQ ID NO: 3281869 - RNA, 18 nt, Mycobacterium tuberculosis H37Rv
gccgcugggugaccagga

SEQ ID NO: 3281870 - RNA, 14 nt, Mycobacterium tuberculosis H37Rv
gccgcuggugguga

SEQ ID NO: 3281871 - RNA, 23 nt, Mycobacterium tuberculosis H37Rv
gccgcugucguaccgcucggcgg

SEQ ID NO: 3281872 - RNA, 16 nt, Mycobacterium tuberculosis H37Rv
gccgcugugagcuugg

SEQ ID NO: 3281873 - RNA, 17 nt, Mycobacterium tuberculosis H37Rv
gccgcugugcggucguc

SEQ ID NO: 3281874 - RNA, 18 nt, Mycobacterium tuberculosis H37Rv
gccgcugugcggucguca

SEQ ID NO: 3281875 - RNA, 20 nt, Mycobacterium tuberculosis H37Rv
gccgcugugcggucgucacc

SEQ ID NO: 3281876 - RNA, 18 nt, Mycobacterium tuberculosis H37Rv
gccgcuguugaucgacac

SEQ ID NO: 3281877 - RNA, 21 nt, Mycobacterium tuberculosis H37Rv
gccgcuuggccgcugccuucu

SEQ ID NO: 3281878 - RNA, 16 nt, Mycobacterium tuberculosis H37Rv
gccgcuuggcgcggcc

SEQ ID NO: 3281879 - RNA, 22 nt, Mycobacterium tuberculosis H37Rv
gccgcuugggccugggccgcac

SEQ ID NO: 3281880 - RNA, 22 nt, Mycobacterium tuberculosis H37Rv
gccgcuuucuuggcgggcgccu

SEQ ID NO: 3281881 - RNA, 14 nt, Mycobacterium tuberculosis H37Rv
gccggaacugcgca

SEQ ID NO: 3281882 - RNA, 24 nt, Mycobacterium tuberculosis H37Rv
gccggaagcgccggccgaucggcc

SEQ ID NO: 3281883 - RNA, 23 nt, Mycobacterium tuberculosis H37Rv
gccggaaggugaggucgaucagc

SEQ ID NO: 3281884 - RNA, 20 nt, Mycobacterium tuberculosis H37Rv
gccggaauacaccagcgacg

SEQ ID NO: 3281885 - RNA, 14 nt, Mycobacterium tuberculosis H37Rv
gccggaauacccgc

SEQ ID NO: 3281886 - RNA, 16 nt, Mycobacterium tuberculosis H37Rv
gccggaauacccgcug

SEQ ID NO: 3281887 - RNA, 21 nt, Mycobacterium tuberculosis H37Rv
gccggaauacccggcccauug

SEQ ID NO: 3281888 - RNA, 15 nt, Mycobacterium tuberculosis H37Rv
gccggacaaccuggg

SEQ ID NO: 3281889 - RNA, 16 nt, Mycobacterium tuberculosis H37Rv
gccggacaaccugggg

SEQ ID NO: 3281890 - RNA, 19 nt, Mycobacterium tuberculosis H37Rv
gccggacaaccuggggcca

SEQ ID NO: 3281891 - RNA, 16 nt, Mycobacterium tuberculosis H37Rv
gccggacagaucaacg

SEQ ID NO: 3281892 - RNA, 15 nt, Mycobacterium tuberculosis H37Rv
gccggacagccacgc

SEQ ID NO: 3281893 - RNA, 16 nt, Mycobacterium tuberculosis H37Rv
gccggacccaccguca

SEQ ID NO: 3281894 - RNA, 21 nt, Mycobacterium tuberculosis H37Rv
gccggaccccgagaccaacgc

SEQ ID NO: 3281895 - RNA, 13 nt, Mycobacterium tuberculosis H37Rv
gccggacccgccg

SEQ ID NO: 3281896 - RNA, 17 nt, Mycobacterium tuberculosis H37Rv
gccggacccggugcacg

SEQ ID NO: 3281897 - RNA, 14 nt, Mycobacterium tuberculosis H37Rv
gccggacccgucga

SEQ ID NO: 3281898 - RNA, 21 nt, Mycobacterium tuberculosis H37Rv
gccggacccgucgagcagcau

SEQ ID NO: 3281899 - RNA, 15 nt, Mycobacterium tuberculosis H37Rv
gccggaccgcacuug

SEQ ID NO: 3281900 - RNA, 20 nt, Mycobacterium tuberculosis H37Rv
gccggaccgcgacggcgccg

SEQ ID NO: 3281901 - RNA, 19 nt, Mycobacterium tuberculosis H37Rv
gccggaccguguacuggua

SEQ ID NO: 3281902 - RNA, 17 nt, Mycobacterium tuberculosis H37Rv
gccggacgacaacaggc

SEQ ID NO: 3281903 - RNA, 20 nt, Mycobacterium tuberculosis H37Rv
gccggacgacaacaggccgu

SEQ ID NO: 3281904 - RNA, 23 nt, Mycobacterium tuberculosis H37Rv
gccggacgacaacaggccgucga

SEQ ID NO: 3281905 - RNA, 15 nt, Mycobacterium tuberculosis H37Rv
gccggacgccaugcc

SEQ ID NO: 3281906 - RNA, 20 nt, Mycobacterium tuberculosis H37Rv
gccggacguucuggaucgug

SEQ ID NO: 3281907 - RNA, 21 nt, Mycobacterium tuberculosis H37Rv
gccggacuaccgccggcggcg

SEQ ID NO: 3281908 - RNA, 21 nt, Mycobacterium tuberculosis H37Rv
gccggacugaagccgcgagcg

SEQ ID NO: 3281909 - RNA, 23 nt, Mycobacterium tuberculosis H37Rv
gccggacugaagccgcgagcgcg

SEQ ID NO: 3281910 - RNA, 14 nt, Mycobacterium tuberculosis H37Rv
gccggagacacccg

SEQ ID NO: 3281911 - RNA, 16 nt, Mycobacterium tuberculosis H37Rv
gccggagacacccgcc

SEQ ID NO: 3281912 - RNA, 17 nt, Mycobacterium tuberculosis H37Rv
gccggagacgucgccgc

SEQ ID NO: 3281913 - RNA, 19 nt, Mycobacterium tuberculosis H37Rv
gccggagaguaggaccucg

SEQ ID NO: 3281914 - RNA, 17 nt, Mycobacterium tuberculosis H37Rv
gccggagaucuugcgca

SEQ ID NO: 3281915 - RNA, 21 nt, Mycobacterium tuberculosis H37Rv
gccggagccgccggccccgcc

SEQ ID NO: 3281916 - RNA, 15 nt, Mycobacterium tuberculosis H37Rv
gccggagcgcaccug

SEQ ID NO: 3281917 - RNA, 19 nt, Mycobacterium tuberculosis H37Rv
gccggaggcaagcaaccgg

SEQ ID NO: 3281918 - RNA, 20 nt, Mycobacterium tuberculosis H37Rv
gccggaggucgggcggcgac

SEQ ID NO: 3281919 - RNA, 19 nt, Mycobacterium tuberculosis H37Rv
gccggaguccgucggggac

SEQ ID NO: 3281920 - RNA, 19 nt, Mycobacterium tuberculosis H37Rv
gccggagucggggggccgg

SEQ ID NO: 3281921 - RNA, 17 nt, Mycobacterium tuberculosis H37Rv
gccggaguuccgccauu

SEQ ID NO: 3281922 - RNA, 18 nt, Mycobacterium tuberculosis H37Rv
gccggaguugaagaagcc

SEQ ID NO: 3281923 - RNA, 17 nt, Mycobacterium tuberculosis H37Rv
gccggauacaccggcac

SEQ ID NO: 3281924 - RNA, 15 nt, Mycobacterium tuberculosis H37Rv
gccggauacggcgac

SEQ ID NO: 3281925 - RNA, 15 nt, Mycobacterium tuberculosis H37Rv
gccggauacgucagc

SEQ ID NO: 3281926 - RNA, 15 nt, Mycobacterium tuberculosis H37Rv
gccggauagcgcagc

SEQ ID NO: 3281927 - RNA, 16 nt, Mycobacterium tuberculosis H37Rv
gccggccgccagcgca

SEQ ID NO: 3281928 - RNA, 14 nt, Mycobacterium tuberculosis H37Rv
gccggccgcgaccg

SEQ ID NO: 3281929 - RNA, 17 nt, Mycobacterium tuberculosis H37Rv
gccggccgcgauccagc

SEQ ID NO: 3281930 - RNA, 14 nt, Mycobacterium tuberculosis H37Rv
gccggccgcgcaga

SEQ ID NO: 3281931 - RNA, 12 nt, Mycobacterium tuberculosis H37Rv
gccggccgcggg

SEQ ID NO: 3281932 - RNA, 17 nt, Mycobacterium tuberculosis H37Rv
gccggccgcggggcauc

SEQ ID NO: 3281933 - RNA, 16 nt, Mycobacterium tuberculosis H37Rv
gccggccgcugccacu

SEQ ID NO: 3281934 - RNA, 13 nt, Mycobacterium tuberculosis H37Rv
gccggccggaacg

SEQ ID NO: 3281935 - RNA, 21 nt, Mycobacterium tuberculosis H37Rv
gccggccggcaaugccgcggc

SEQ ID NO: 3281936 - RNA, 13 nt, Mycobacterium tuberculosis H37Rv
gccggccggcggg

SEQ ID NO: 3281937 - RNA, 14 nt, Mycobacterium tuberculosis H37Rv
gccggccggucagg

SEQ ID NO: 3281938 - RNA, 23 nt, Mycobacterium tuberculosis H37Rv
gccggccgucgaucuucuccucg

SEQ ID NO: 3281939 - RNA, 14 nt, Mycobacterium tuberculosis H37Rv
gccggccgucggcc

SEQ ID NO: 3281940 - RNA, 16 nt, Mycobacterium tuberculosis H37Rv
gccggccuagccgaug

SEQ ID NO: 3281941 - RNA, 15 nt, Mycobacterium tuberculosis H37Rv
gccggccucgccgaa

SEQ ID NO: 3281942 - RNA, 22 nt, Mycobacterium tuberculosis H37Rv
gccggccucuggaucacgucga

SEQ ID NO: 3281943 - RNA, 17 nt, Mycobacterium tuberculosis H37Rv
gccggccugcucggcga

SEQ ID NO: 3281944 - RNA, 13 nt, Mycobacterium tuberculosis H37Rv
gccggccuggccg

SEQ ID NO: 3281945 - RNA, 17 nt, Mycobacterium tuberculosis H37Rv
gccggccuugagcaccc

SEQ ID NO: 3281946 - RNA, 18 nt, Mycobacterium tuberculosis H37Rv
gccggcgaacucgcgccg

SEQ ID NO: 3281947 - RNA, 15 nt, Mycobacterium tuberculosis H37Rv
gccggcgaaggccag

SEQ ID NO: 3281948 - RNA, 20 nt, Mycobacterium tuberculosis H37Rv
gccggcgaagugcuccaccu

SEQ ID NO: 3281949 - RNA, 21 nt, Mycobacterium tuberculosis H37Rv
gccggcgaagugcuccaccuc

SEQ ID NO: 3281950 - RNA, 21 nt, Mycobacterium tuberculosis H37Rv
gccggcgaauccgcacagguc

SEQ ID NO: 3281951 - RNA, 13 nt, Mycobacterium tuberculosis H37Rv
gccggcgacaccg

SEQ ID NO: 3281952 - RNA, 19 nt, Mycobacterium tuberculosis H37Rv
gccggcgacaccgcaggug

SEQ ID NO: 3281953 - RNA, 20 nt, Mycobacterium tuberculosis H37Rv
gccggcgacaccgcaggugc

SEQ ID NO: 3281954 - RNA, 15 nt, Mycobacterium tuberculosis H37Rv
gccggcgaccaaggc

SEQ ID NO: 3281955 - RNA, 20 nt, Mycobacterium tuberculosis H37Rv
gccggcgacgcuaccgccgg

SEQ ID NO: 3281956 - RNA, 13 nt, Mycobacterium tuberculosis H37Rv
gccggcgagcucg

SEQ ID NO: 3281957 - RNA, 14 nt, Mycobacterium tuberculosis H37Rv
gccggcgagggcca

SEQ ID NO: 3281958 - RNA, 15 nt, Mycobacterium tuberculosis H37Rv
gccggcgagggccac

SEQ ID NO: 3281959 - RNA, 16 nt, Mycobacterium tuberculosis H37Rv
gccggcgagggugagc

SEQ ID NO: 3281960 - RNA, 13 nt, Mycobacterium tuberculosis H37Rv
gccggcgaggucg

SEQ ID NO: 3281961 - RNA, 14 nt, Mycobacterium tuberculosis H37Rv
gccggcgauuaccg

SEQ ID NO: 3281962 - RNA, 17 nt, Mycobacterium tuberculosis H37Rv
gccggcgccacccgcgc

SEQ ID NO: 3281963 - RNA, 19 nt, Mycobacterium tuberculosis H37Rv
gccggcgccacccgcgccg

SEQ ID NO: 3281964 - RNA, 20 nt, Mycobacterium tuberculosis H37Rv
gccggcgccaccguugccga

SEQ ID NO: 3281965 - RNA, 22 nt, Mycobacterium tuberculosis H37Rv
gccggcgccaccguugccgaac

SEQ ID NO: 3281966 - RNA, 12 nt, Mycobacterium tuberculosis H37Rv
gccggcgccagc

SEQ ID NO: 3281967 - RNA, 17 nt, Mycobacterium tuberculosis H37Rv
gccggcgccagcgccgc

SEQ ID NO: 3281968 - RNA, 20 nt, Mycobacterium tuberculosis H37Rv
gccggcgcccaggccgauca

SEQ ID NO: 3281969 - RNA, 22 nt, Mycobacterium tuberculosis H37Rv
gccggcgcccaggccgaucagc

SEQ ID NO: 3281970 - RNA, 23 nt, Mycobacterium tuberculosis H37Rv
gccggcgcccaggccgaucagcg

SEQ ID NO: 3281971 - RNA, 12 nt, Mycobacterium tuberculosis H37Rv
gccggcgcccgc

SEQ ID NO: 3281972 - RNA, 15 nt, Mycobacterium tuberculosis H37Rv
gccggcgcccgccgc

SEQ ID NO: 3281973 - RNA, 13 nt, Mycobacterium tuberculosis H37Rv
gccggcgccgcac

SEQ ID NO: 3281974 - RNA, 12 nt, Mycobacterium tuberculosis H37Rv
gccggcgccgcc

SEQ ID NO: 3281975 - RNA, 15 nt, Mycobacterium tuberculosis H37Rv
gccggcgccgccagc

SEQ ID NO: 3281976 - RNA, 18 nt, Mycobacterium tuberculosis H37Rv
gccggcgccgccagcacc

SEQ ID NO: 3281977 - RNA, 22 nt, Mycobacterium tuberculosis H37Rv
gccggcgccgccagcaccaccg

SEQ ID NO: 3281978 - RNA, 15 nt, Mycobacterium tuberculosis H37Rv
gccggcgccgccauu

SEQ ID NO: 3281979 - RNA, 19 nt, Mycobacterium tuberculosis H37Rv
gccggcgccgccauugcca

SEQ ID NO: 3281980 - RNA, 22 nt, Mycobacterium tuberculosis H37Rv
gccggcgccgccauugucgcca

SEQ ID NO: 3281981 - RNA, 23 nt, Mycobacterium tuberculosis H37Rv
gccggcgccgccauugucgccaa

SEQ ID NO: 3281982 - RNA, 14 nt, Mycobacterium tuberculosis H37Rv
gccggcgccgcccu

SEQ ID NO: 3281983 - RNA, 16 nt, Mycobacterium tuberculosis H37Rv
gccggcgccgccggca

SEQ ID NO: 3281984 - RNA, 19 nt, Mycobacterium tuberculosis H37Rv
gccggcgccgccggugcca

SEQ ID NO: 3281985 - RNA, 16 nt, Mycobacterium tuberculosis H37Rv
gccggcgccgccgucg

SEQ ID NO: 3281986 - RNA, 17 nt, Mycobacterium tuberculosis H37Rv
gccggcgccgccgugcg

SEQ ID NO: 3281987 - RNA, 17 nt, Mycobacterium tuberculosis H37Rv
gccggcgccggcgcguc

SEQ ID NO: 3281988 - RNA, 14 nt, Mycobacterium tuberculosis H37Rv
gccggcgccggcuu

SEQ ID NO: 3281989 - RNA, 15 nt, Mycobacterium tuberculosis H37Rv
gccggcgccggugcc

SEQ ID NO: 3281990 - RNA, 17 nt, Mycobacterium tuberculosis H37Rv
gccggcgccggugccgc

SEQ ID NO: 3281991 - RNA, 17 nt, Mycobacterium tuberculosis H37Rv
gccggcgccuuggucgc

SEQ ID NO: 3281992 - RNA, 20 nt, Mycobacterium tuberculosis H37Rv
gccggcgccuuggucgccgc

SEQ ID NO: 3281993 - RNA, 16 nt, Mycobacterium tuberculosis H37Rv
gccggcgcgcaccccg

SEQ ID NO: 3281994 - RNA, 17 nt, Mycobacterium tuberculosis H37Rv
gccggcgcgcaccccgg

SEQ ID NO: 3281995 - RNA, 13 nt, Mycobacterium tuberculosis H37Rv
gccggcgcgcccc

SEQ ID NO: 3281996 - RNA, 12 nt, Mycobacterium tuberculosis H37Rv
gccggcgcgccg

SEQ ID NO: 3281997 - RNA, 15 nt, Mycobacterium tuberculosis H37Rv
gccggcgcgccgaug

SEQ ID NO: 3281998 - RNA, 16 nt, Mycobacterium tuberculosis H37Rv
gccggcgcgccgggcg

SEQ ID NO: 3281999 - RNA, 15 nt, Mycobacterium tuberculosis H37Rv
gccggcgcggcggcg

SEQ ID NO: 3282000 - RNA, 17 nt, Mycobacterium tuberculosis H37Rv
gccggcgcugcccgggc

SEQ ID NO: 3282001 - RNA, 23 nt, Mycobacterium tuberculosis H37Rv
gccggcgcuggcgggcgaucucg

SEQ ID NO: 3282002 - RNA, 15 nt, Mycobacterium tuberculosis H37Rv
gccggcggccaccuc

SEQ ID NO: 3282003 - RNA, 14 nt, Mycobacterium tuberculosis H37Rv
gccggcggccgccc

SEQ ID NO: 3282004 - RNA, 18 nt, Mycobacterium tuberculosis H37Rv
gccggcggccgcccagau

SEQ ID NO: 3282005 - RNA, 23 nt, Mycobacterium tuberculosis H37Rv
gccggcggccgcccagaugucuu

SEQ ID NO: 3282006 - RNA, 15 nt, Mycobacterium tuberculosis H37Rv
gccggcggccgcggu

SEQ ID NO: 3282007 - RNA, 13 nt, Mycobacterium tuberculosis H37Rv
gccggcggcgacc

SEQ ID NO: 3282008 - RNA, 21 nt, Mycobacterium tuberculosis H37Rv
gccggcggcggccgcagcggc

SEQ ID NO: 3282009 - RNA, 15 nt, Mycobacterium tuberculosis H37Rv
gccggcggcgguacc

SEQ ID NO: 3282010 - RNA, 14 nt, Mycobacterium tuberculosis H37Rv
gccggcggcggugc

SEQ ID NO: 3282011 - RNA, 15 nt, Mycobacterium tuberculosis H37Rv
gccggcggcgguggu

SEQ ID NO: 3282012 - RNA, 22 nt, Mycobacterium tuberculosis H37Rv
gccggcggcggugguaccggcg

SEQ ID NO: 3282013 - RNA, 18 nt, Mycobacterium tuberculosis H37Rv
gccggcggcuggucucug

SEQ ID NO: 3282014 - RNA, 12 nt, Mycobacterium tuberculosis H37Rv
gccggcggcugu

SEQ ID NO: 3282015 - RNA, 18 nt, Mycobacterium tuberculosis H37Rv
gccggcggcuguggucgc

SEQ ID NO: 3282016 - RNA, 16 nt, Mycobacterium tuberculosis H37Rv
gccggcgggccugccc

SEQ ID NO: 3282017 - RNA, 23 nt, Mycobacterium tuberculosis H37Rv
gccggcgggcgagugucagcaga

SEQ ID NO: 3282018 - RNA, 20 nt, Mycobacterium tuberculosis H37Rv
gccggcgggcguaccuucga

SEQ ID NO: 3282019 - RNA, 20 nt, Mycobacterium tuberculosis H37Rv
gccggcgggcucgcccgcua

SEQ ID NO: 3282020 - RNA, 15 nt, Mycobacterium tuberculosis H37Rv
gccggcgggcucggu

SEQ ID NO: 3282021 - RNA, 17 nt, Mycobacterium tuberculosis H37Rv
gccggcggggugcgccc

SEQ ID NO: 3282022 - RNA, 20 nt, Mycobacterium tuberculosis H37Rv
gccggcgguaagcccagaca

SEQ ID NO: 3282023 - RNA, 20 nt, Mycobacterium tuberculosis H37Rv
gccggcgguagucggccagc

SEQ ID NO: 3282024 - RNA, 17 nt, Mycobacterium tuberculosis H37Rv
gccgggcgucgcuggug

SEQ ID NO: 3282025 - RNA, 23 nt, Mycobacterium tuberculosis H37Rv
gccgggcuccucugguugggagc

SEQ ID NO: 3282026 - RNA, 21 nt, Mycobacterium tuberculosis H37Rv
gccgggcucgcgaucgucacg

SEQ ID NO: 3282027 - RNA, 24 nt, Mycobacterium tuberculosis H37Rv
gccgggcucuaucagacgauucgg

SEQ ID NO: 3282028 - RNA, 22 nt, Mycobacterium tuberculosis H37Rv
gccgggcugcaaaucgucgaug

SEQ ID NO: 3282029 - RNA, 13 nt, Mycobacterium tuberculosis H37Rv
gccgggcuggcga

SEQ ID NO: 3282030 - RNA, 17 nt, Mycobacterium tuberculosis H37Rv
gccgggcuuguagacgc

SEQ ID NO: 3282031 - RNA, 14 nt, Mycobacterium tuberculosis H37Rv
gccggggaccacgg

SEQ ID NO: 3282032 - RNA, 19 nt, Mycobacterium tuberculosis H37Rv
gccggggauaucacgacgc

SEQ ID NO: 3282033 - RNA, 15 nt, Mycobacterium tuberculosis H37Rv
gccggggccccaugc

SEQ ID NO: 3282034 - RNA, 18 nt, Mycobacterium tuberculosis H37Rv
gccggggccgcuggcggu

SEQ ID NO: 3282035 - RNA, 21 nt, Mycobacterium tuberculosis H37Rv
gccggggcgaugucggcuggu

SEQ ID NO: 3282036 - RNA, 17 nt, Mycobacterium tuberculosis H37Rv
gccggggcgcagguugg

SEQ ID NO: 3282037 - RNA, 18 nt, Mycobacterium tuberculosis H37Rv
gccggggcggaaccuguc

SEQ ID NO: 3282038 - RNA, 19 nt, Mycobacterium tuberculosis H37Rv
gccggggcgucgcaacccg

SEQ ID NO: 3282039 - RNA, 13 nt, Mycobacterium tuberculosis H37Rv
gccgggggcaccg

SEQ ID NO: 3282040 - RNA, 14 nt, Mycobacterium tuberculosis H37Rv
gccgggggcgccgc

SEQ ID NO: 3282041 - RNA, 16 nt, Mycobacterium tuberculosis H37Rv
gccgggggcgccgccg

SEQ ID NO: 3282042 - RNA, 20 nt, Mycobacterium tuberculosis H37Rv
gccgggguagacgccccgga

SEQ ID NO: 3282043 - RNA, 22 nt, Mycobacterium tuberculosis H37Rv
gccgggguaggggucgaggucu

SEQ ID NO: 3282044 - RNA, 16 nt, Mycobacterium tuberculosis H37Rv
gccgggguggcgcgcc

SEQ ID NO: 3282045 - RNA, 18 nt, Mycobacterium tuberculosis H37Rv
gccgggguuggucgucgc

SEQ ID NO: 3282046 - RNA, 21 nt, Mycobacterium tuberculosis H37Rv
gccggguauugauugacugcu

SEQ ID NO: 3282047 - RNA, 19 nt, Mycobacterium tuberculosis H37Rv
gccgggucagcccggcgcg

SEQ ID NO: 3282048 - RNA, 22 nt, Mycobacterium tuberculosis H37Rv
gccgggucagcccggcgcgauc

SEQ ID NO: 3282049 - RNA, 16 nt, Mycobacterium tuberculosis H37Rv
gccggguccgccgggc

SEQ ID NO: 3282050 - RNA, 18 nt, Mycobacterium tuberculosis H37Rv
gccggguccuugcggccg

SEQ ID NO: 3282051 - RNA, 23 nt, Mycobacterium tuberculosis H37Rv
gccgggucgaacaggccggccgc

SEQ ID NO: 3282052 - RNA, 20 nt, Mycobacterium tuberculosis H37Rv
gccgggucgucuuccaggag

SEQ ID NO: 3282053 - RNA, 19 nt, Mycobacterium tuberculosis H37Rv
gccgggugaggcgggucgc

SEQ ID NO: 3282054 - RNA, 14 nt, Mycobacterium tuberculosis H37Rv
gccgggugcaggcg

SEQ ID NO: 3282055 - RNA, 21 nt, Mycobacterium tuberculosis H37Rv
gccgggugccacaacccgcuu

SEQ ID NO: 3282056 - RNA, 14 nt, Mycobacterium tuberculosis H37Rv
gccgggugcgagcg

SEQ ID NO: 3282057 - RNA, 21 nt, Mycobacterium tuberculosis H37Rv
gccgggugcgcacccgggugc

SEQ ID NO: 3282058 - RNA, 20 nt, Mycobacterium tuberculosis H37Rv
gccggguggugauugcggaa

SEQ ID NO: 3282059 - RNA, 13 nt, Mycobacterium tuberculosis H37Rv
gccggguguuggg

SEQ ID NO: 3282060 - RNA, 17 nt, Mycobacterium tuberculosis H37Rv
gccggguuaucggcagc

SEQ ID NO: 3282061 - RNA, 14 nt, Mycobacterium tuberculosis H37Rv
gccggguucgccgg

SEQ ID NO: 3282062 - RNA, 14 nt, Mycobacterium tuberculosis H37Rv
gccggguuggccgg

SEQ ID NO: 3282063 - RNA, 16 nt, Mycobacterium tuberculosis H37Rv
gccggguuggucuucg

SEQ ID NO: 3282064 - RNA, 16 nt, Mycobacterium tuberculosis H37Rv
gccggguuugaucagc

SEQ ID NO: 3282065 - RNA, 20 nt, Mycobacterium tuberculosis H37Rv
gccggguuugaucagcucgg

SEQ ID NO: 3282066 - RNA, 16 nt, Mycobacterium tuberculosis H37Rv
gccggguuuggugcag

SEQ ID NO: 3282067 - RNA, 17 nt, Mycobacterium tuberculosis H37Rv
gccgguaacuguccgcc

SEQ ID NO: 3282068 - RNA, 18 nt, Mycobacterium tuberculosis H37Rv
gccgguacacguccagug

SEQ ID NO: 3282069 - RNA, 23 nt, Mycobacterium tuberculosis H37Rv
gccgguacacguccaguggcagc

SEQ ID NO: 3282070 - RNA, 17 nt, Mycobacterium tuberculosis H37Rv
gccgguaccgggacgaa

SEQ ID NO: 3282071 - RNA, 15 nt, Mycobacterium tuberculosis H37Rv
gccgguagaucagcg

SEQ ID NO: 3282072 - RNA, 15 nt, Mycobacterium tuberculosis H37Rv
gccgguagcacagca

SEQ ID NO: 3282073 - RNA, 16 nt, Mycobacterium tuberculosis H37Rv
gccgguagcacagcag

SEQ ID NO: 3282074 - RNA, 17 nt, Mycobacterium tuberculosis H37Rv
gccgguagcacagcagc

SEQ ID NO: 3282075 - RNA, 16 nt, Mycobacterium tuberculosis H37Rv
gccgguagcgcgggug

SEQ ID NO: 3282076 - RNA, 17 nt, Mycobacterium tuberculosis H37Rv
gccgguaggcggccagc

SEQ ID NO: 3282077 - RNA, 18 nt, Mycobacterium tuberculosis H37Rv
gccgguaggcggccagcg

SEQ ID NO: 3282078 - RNA, 23 nt, Mycobacterium tuberculosis H37Rv
gccgguaggcggccagcgcgcgc

SEQ ID NO: 3282079 - RNA, 22 nt, Mycobacterium tuberculosis H37Rv
gccgguaguagcugaccaucgu

SEQ ID NO: 3282080 - RNA, 17 nt, Mycobacterium tuberculosis H37Rv
gccgguauuucggcgac

SEQ ID NO: 3282081 - RNA, 15 nt, Mycobacterium tuberculosis H37Rv
gccggucaccucgcc

SEQ ID NO: 3282082 - RNA, 18 nt, Mycobacterium tuberculosis H37Rv
gccggucaccucgccggc

SEQ ID NO: 3282083 - RNA, 19 nt, Mycobacterium tuberculosis H37Rv
gccggucaccucgccggcg

SEQ ID NO: 3282084 - RNA, 20 nt, Mycobacterium tuberculosis H37Rv
gccggucaccucgccggcgg

SEQ ID NO: 3282085 - RNA, 19 nt, Mycobacterium tuberculosis H37Rv
gccggucacgacguccgau

SEQ ID NO: 3282086 - RNA, 14 nt, Mycobacterium tuberculosis H37Rv
gccggucacgucga

SEQ ID NO: 3282087 - RNA, 22 nt, Mycobacterium tuberculosis H37Rv
gccggucagcaauacggcggcg

SEQ ID NO: 3282088 - RNA, 14 nt, Mycobacterium tuberculosis H37Rv
gccggucaggccgc

SEQ ID NO: 3282089 - RNA, 20 nt, Mycobacterium tuberculosis H37Rv
gccggucagggcuuguacga

SEQ ID NO: 3282090 - RNA, 17 nt, Mycobacterium tuberculosis H37Rv
gccggucaguauggcga

SEQ ID NO: 3282091 - RNA, 20 nt, Mycobacterium tuberculosis H37Rv
gccggucauuucaacguauc

SEQ ID NO: 3282092 - RNA, 14 nt, Mycobacterium tuberculosis H37Rv
gccgguccagaccc

SEQ ID NO: 3282093 - RNA, 19 nt, Mycobacterium tuberculosis H37Rv
gccgguccagacccagcuc

SEQ ID NO: 3282094 - RNA, 13 nt, Mycobacterium tuberculosis H37Rv
gccgguccagcag

SEQ ID NO: 3282095 - RNA, 20 nt, Mycobacterium tuberculosis H37Rv
gccgguccccccguugccgc

SEQ ID NO: 3282096 - RNA, 17 nt, Mycobacterium tuberculosis H37Rv
gccgguccccucggugc

SEQ ID NO: 3282097 - RNA, 18 nt, Mycobacterium tuberculosis H37Rv
gccgguccccucggugcc

SEQ ID NO: 3282098 - RNA, 21 nt, Mycobacterium tuberculosis H37Rv
gccgguccgguacucguccgc

SEQ ID NO: 3282099 - RNA, 14 nt, Mycobacterium tuberculosis H37Rv
gccgguccucgucg

SEQ ID NO: 3282100 - RNA, 19 nt, Mycobacterium tuberculosis H37Rv
gccgguccucgucggcgaa

SEQ ID NO: 3282101 - RNA, 14 nt, Mycobacterium tuberculosis H37Rv
gccggucgagacgc

SEQ ID NO: 3282102 - RNA, 15 nt, Mycobacterium tuberculosis H37Rv
gccggucgagacgcu

SEQ ID NO: 3282103 - RNA, 14 nt, Mycobacterium tuberculosis H37Rv
gccggucgaugacc

SEQ ID NO: 3282104 - RNA, 17 nt, Mycobacterium tuberculosis H37Rv
gccggucgcauggucga

SEQ ID NO: 3282105 - RNA, 14 nt, Mycobacterium tuberculosis H37Rv
gccggucggcgucg

SEQ ID NO: 3282106 - RNA, 14 nt, Mycobacterium tuberculosis H37Rv
gccggucgggcaga

SEQ ID NO: 3282107 - RNA, 19 nt, Mycobacterium tuberculosis H37Rv
gccggucggugagccgugc

SEQ ID NO: 3282108 - RNA, 15 nt, Mycobacterium tuberculosis H37Rv
gccggucgugccggg

SEQ ID NO: 3282109 - RNA, 16 nt, Mycobacterium tuberculosis H37Rv
gccggucuugcaucgc

SEQ ID NO: 3282110 - RNA, 20 nt, Mycobacterium tuberculosis H37Rv
gccggucuugcaucgccgau

SEQ ID NO: 3282111 - RNA, 21 nt, Mycobacterium tuberculosis H37Rv
gccggucuugcaucgccgaug

SEQ ID NO: 3282112 - RNA, 17 nt, Mycobacterium tuberculosis H37Rv
gccggugaacgucacgu

SEQ ID NO: 3282113 - RNA, 15 nt, Mycobacterium tuberculosis H37Rv
gccggugacgacguc

SEQ ID NO: 3282114 - RNA, 17 nt, Mycobacterium tuberculosis H37Rv
gccggugacggggcuga

SEQ ID NO: 3282115 - RNA, 14 nt, Mycobacterium tuberculosis H37Rv
gccggugacucaga

SEQ ID NO: 3282116 - RNA, 14 nt, Mycobacterium tuberculosis H37Rv
gccggugagcgagc

SEQ ID NO: 3282117 - RNA, 17 nt, Mycobacterium tuberculosis H37Rv
gccggugagcgagcgcg

SEQ ID NO: 3282118 - RNA, 17 nt, Mycobacterium tuberculosis H37Rv
gccggugaggaucagcg

SEQ ID NO: 3282119 - RNA, 20 nt, Mycobacterium tuberculosis H37Rv
gccggugauggccgaccagc

SEQ ID NO: 3282120 - RNA, 17 nt, Mycobacterium tuberculosis H37Rv
gccguagcugacggccu

SEQ ID NO: 3282121 - RNA, 19 nt, Mycobacterium tuberculosis H37Rv
gccguaggcggcgacccgc

SEQ ID NO: 3282122 - RNA, 23 nt, Mycobacterium tuberculosis H37Rv
gccguagguugcgccccgacugc

SEQ ID NO: 3282123 - RNA, 17 nt, Mycobacterium tuberculosis H37Rv
gccguaguaguggccgc

SEQ ID NO: 3282124 - RNA, 16 nt, Mycobacterium tuberculosis H37Rv
gccguaguggccggcu

SEQ ID NO: 3282125 - RNA, 18 nt, Mycobacterium tuberculosis H37Rv
gccguaguggccggcuuc

SEQ ID NO: 3282126 - RNA, 17 nt, Mycobacterium tuberculosis H37Rv
gccguagugucggcguc

SEQ ID NO: 3282127 - RNA, 22 nt, Mycobacterium tuberculosis H37Rv
gccguaguugguccaggugacc

SEQ ID NO: 3282128 - RNA, 16 nt, Mycobacterium tuberculosis H37Rv
gccguauccaggcgug

SEQ ID NO: 3282129 - RNA, 18 nt, Mycobacterium tuberculosis H37Rv
gccguaucggacgggaug

SEQ ID NO: 3282130 - RNA, 13 nt, Mycobacterium tuberculosis H37Rv
gccguaucggugu

SEQ ID NO: 3282131 - RNA, 20 nt, Mycobacterium tuberculosis H37Rv
gccguaugccgccaaccgcg

SEQ ID NO: 3282132 - RNA, 21 nt, Mycobacterium tuberculosis H37Rv
gccgucaacgaugguggcgau

SEQ ID NO: 3282133 - RNA, 23 nt, Mycobacterium tuberculosis H37Rv
gccgucaacgccucugcucagcc

SEQ ID NO: 3282134 - RNA, 18 nt, Mycobacterium tuberculosis H37Rv
gccgucaagauugaacga

SEQ ID NO: 3282135 - RNA, 23 nt, Mycobacterium tuberculosis H37Rv
gccgucaagauugaacgaguagc

SEQ ID NO: 3282136 - RNA, 23 nt, Mycobacterium tuberculosis H37Rv
gccgucacccccgauagcgaccg

SEQ ID NO: 3282137 - RNA, 15 nt, Mycobacterium tuberculosis H37Rv
gccgucaccgaucga

SEQ ID NO: 3282138 - RNA, 21 nt, Mycobacterium tuberculosis H37Rv
gccgucaccgccauugccacc

SEQ ID NO: 3282139 - RNA, 19 nt, Mycobacterium tuberculosis H37Rv
gccgucaccgccgaccagg

SEQ ID NO: 3282140 - RNA, 20 nt, Mycobacterium tuberculosis H37Rv
gccgucaccgccgaccaggc

SEQ ID NO: 3282141 - RNA, 21 nt, Mycobacterium tuberculosis H37Rv
gccgucaccgccgaccaggcc

SEQ ID NO: 3282142 - RNA, 21 nt, Mycobacterium tuberculosis H37Rv
gccgucaccgccguugccgau

SEQ ID NO: 3282143 - RNA, 13 nt, Mycobacterium tuberculosis H37Rv
gccgucaccgcga

SEQ ID NO: 3282144 - RNA, 17 nt, Mycobacterium tuberculosis H37Rv
gccgucaccgcgcggcu

SEQ ID NO: 3282145 - RNA, 20 nt, Mycobacterium tuberculosis H37Rv
gccgucacggcaguacccca

SEQ ID NO: 3282146 - RNA, 23 nt, Mycobacterium tuberculosis H37Rv
gccgucagaacaccggccaggcc

SEQ ID NO: 3282147 - RNA, 20 nt, Mycobacterium tuberculosis H37Rv
gccgucagcacaaacccagu

SEQ ID NO: 3282148 - RNA, 15 nt, Mycobacterium tuberculosis H37Rv
gccgucagcaccgcu

SEQ ID NO: 3282149 - RNA, 17 nt, Mycobacterium tuberculosis H37Rv
gccgucagccguucggc

SEQ ID NO: 3282150 - RNA, 14 nt, Mycobacterium tuberculosis H37Rv
gccgucagcggcgg

SEQ ID NO: 3282151 - RNA, 14 nt, Mycobacterium tuberculosis H37Rv
gccgucagcucacc

SEQ ID NO: 3282152 - RNA, 18 nt, Mycobacterium tuberculosis H37Rv
gccgucagggucagcugg

SEQ ID NO: 3282153 - RNA, 22 nt, Mycobacterium tuberculosis H37Rv
gccgucaguuaaagguggucgu

SEQ ID NO: 3282154 - RNA, 17 nt, Mycobacterium tuberculosis H37Rv
gccgucauagcaggccu

SEQ ID NO: 3282155 - RNA, 16 nt, Mycobacterium tuberculosis H37Rv
gccgucaucgugcccg

SEQ ID NO: 3282156 - RNA, 13 nt, Mycobacterium tuberculosis H37Rv
gccgucaugccca

SEQ ID NO: 3282157 - RNA, 14 nt, Mycobacterium tuberculosis H37Rv
gccgucauggcccg

SEQ ID NO: 3282158 - RNA, 23 nt, Mycobacterium tuberculosis H37Rv
gccguccaagaugucguguucgc

SEQ ID NO: 3282159 - RNA, 18 nt, Mycobacterium tuberculosis H37Rv
gccguccaauuccgcaga

SEQ ID NO: 3282160 - RNA, 12 nt, Mycobacterium tuberculosis H37Rv
gccguccaccga

SEQ ID NO: 3282161 - RNA, 22 nt, Mycobacterium tuberculosis H37Rv
gccguccaccgauacccccggc

SEQ ID NO: 3282162 - RNA, 14 nt, Mycobacterium tuberculosis H37Rv
gccguccagcaaua

SEQ ID NO: 3282163 - RNA, 21 nt, Mycobacterium tuberculosis H37Rv
gccguccccgccgucgccacc

SEQ ID NO: 3282164 - RNA, 23 nt, Mycobacterium tuberculosis H37Rv
gccgucccgaaacgccggguucg

SEQ ID NO: 3282165 - RNA, 20 nt, Mycobacterium tuberculosis H37Rv
gccgucccgauacggccggc

SEQ ID NO: 3282166 - RNA, 15 nt, Mycobacterium tuberculosis H37Rv
gccgucccgcgagca

SEQ ID NO: 3282167 - RNA, 16 nt, Mycobacterium tuberculosis H37Rv
gccgucccgcgagcag

SEQ ID NO: 3282168 - RNA, 22 nt, Mycobacterium tuberculosis H37Rv
gccgucccgcgagcagcccggc

SEQ ID NO: 3282169 - RNA, 20 nt, Mycobacterium tuberculosis H37Rv
gccgucccggcucgagcucg

SEQ ID NO: 3282170 - RNA, 17 nt, Mycobacterium tuberculosis H37Rv
gccguccgaccagggau

SEQ ID NO: 3282171 - RNA, 14 nt, Mycobacterium tuberculosis H37Rv
gccguccgcaccgg

SEQ ID NO: 3282172 - RNA, 18 nt, Mycobacterium tuberculosis H37Rv
gccguccgcaccggcggc

SEQ ID NO: 3282173 - RNA, 23 nt, Mycobacterium tuberculosis H37Rv
gccguccgcaccggcggcgccga

SEQ ID NO: 3282174 - RNA, 19 nt, Mycobacterium tuberculosis H37Rv
gccguccggcgcccacauc

SEQ ID NO: 3282175 - RNA, 15 nt, Mycobacterium tuberculosis H37Rv
gccguccggcgccug

SEQ ID NO: 3282176 - RNA, 18 nt, Mycobacterium tuberculosis H37Rv
gccguccggcuuggcggc

SEQ ID NO: 3282177 - RNA, 15 nt, Mycobacterium tuberculosis H37Rv
gccguccgggcggcc

SEQ ID NO: 3282178 - RNA, 16 nt, Mycobacterium tuberculosis H37Rv
gccguccgggcggccu

SEQ ID NO: 3282179 - RNA, 23 nt, Mycobacterium tuberculosis H37Rv
gccguccggguagacauggguga

SEQ ID NO: 3282180 - RNA, 19 nt, Mycobacterium tuberculosis H37Rv
gccguccgguguggcgcug

SEQ ID NO: 3282181 - RNA, 17 nt, Mycobacterium tuberculosis H37Rv
gccguccucccacaggu

SEQ ID NO: 3282182 - RNA, 17 nt, Mycobacterium tuberculosis H37Rv
gccgucgaaauacccgg

SEQ ID NO: 3282183 - RNA, 19 nt, Mycobacterium tuberculosis H37Rv
gccgucgaaccaguccucg

SEQ ID NO: 3282184 - RNA, 20 nt, Mycobacterium tuberculosis H37Rv
gccgucgacaacaaacccgg

SEQ ID NO: 3282185 - RNA, 13 nt, Mycobacterium tuberculosis H37Rv
gccgucgaccacg

SEQ ID NO: 3282186 - RNA, 17 nt, Mycobacterium tuberculosis H37Rv
gccgucgacccagcaug

SEQ ID NO: 3282187 - RNA, 14 nt, Mycobacterium tuberculosis H37Rv
gccgucgaccggcg

SEQ ID NO: 3282188 - RNA, 16 nt, Mycobacterium tuberculosis H37Rv
gccgucgacgaucagc

SEQ ID NO: 3282189 - RNA, 11 nt, Mycobacterium tuberculosis H37Rv
gccgucgacgc

SEQ ID NO: 3282190 - RNA, 15 nt, Mycobacterium tuberculosis H37Rv
gccgucgacgcaugg

SEQ ID NO: 3282191 - RNA, 18 nt, Mycobacterium tuberculosis H37Rv
gccgucgacgcggccggc

SEQ ID NO: 3282192 - RNA, 16 nt, Mycobacterium tuberculosis H37Rv
gccgucgacgucgaug

SEQ ID NO: 3282193 - RNA, 12 nt, Mycobacterium tuberculosis H37Rv
gccgucgagcaa

SEQ ID NO: 3282194 - RNA, 14 nt, Mycobacterium tuberculosis H37Rv
gccgucgagcaacg

SEQ ID NO: 3282195 - RNA, 22 nt, Mycobacterium tuberculosis H37Rv
gccgucgagcaacgugacccgg

SEQ ID NO: 3282196 - RNA, 17 nt, Mycobacterium tuberculosis H37Rv
gccgucgagcacgguga

SEQ ID NO: 3282197 - RNA, 18 nt, Mycobacterium tuberculosis H37Rv
gccgucgagcacggugag

SEQ ID NO: 3282198 - RNA, 22 nt, Mycobacterium tuberculosis H37Rv
gccgucgagcucccacaggacc

SEQ ID NO: 3282199 - RNA, 13 nt, Mycobacterium tuberculosis H37Rv
gccgucgaucccg

SEQ ID NO: 3282200 - RNA, 18 nt, Mycobacterium tuberculosis H37Rv
gccgucgauguggcgcuc

SEQ ID NO: 3282201 - RNA, 18 nt, Mycobacterium tuberculosis H37Rv
gccgucgauguugcccag

SEQ ID NO: 3282202 - RNA, 23 nt, Mycobacterium tuberculosis H37Rv
gccgucgauguugcccagcauga

SEQ ID NO: 3282203 - RNA, 19 nt, Mycobacterium tuberculosis H37Rv
gccgucgauguugccgaga

SEQ ID NO: 3282204 - RNA, 14 nt, Mycobacterium tuberculosis H37Rv
gccgucgcaccaga

SEQ ID NO: 3282205 - RNA, 16 nt, Mycobacterium tuberculosis H37Rv
gccgucgcaccagauc

SEQ ID NO: 3282206 - RNA, 14 nt, Mycobacterium tuberculosis H37Rv
gccgucgcaucagg

SEQ ID NO: 3282207 - RNA, 11 nt, Mycobacterium tuberculosis H37Rv
gccgucgccac

SEQ ID NO: 3282208 - RNA, 22 nt, Mycobacterium tuberculosis H37Rv
gccgucgccaccagagucaaca

SEQ ID NO: 3282209 - RNA, 16 nt, Mycobacterium tuberculosis H37Rv
gccgucgccaccggua

SEQ ID NO: 3282210 - RNA, 23 nt, Mycobacterium tuberculosis H37Rv
gccgucgccacgcccagcgcccg

SEQ ID NO: 3282211 - RNA, 14 nt, Mycobacterium tuberculosis H37Rv
gccgucgcccagcg

SEQ ID NO: 3282212 - RNA, 20 nt, Mycobacterium tuberculosis H37Rv
gccgucgcccagcgugaacu

SEQ ID NO: 3282213 - RNA, 21 nt, Mycobacterium tuberculosis H37Rv
gccgucgccgaucagcugcgc

SEQ ID NO: 3282214 - RNA, 15 nt, Mycobacterium tuberculosis H37Rv
gccgucgccgccggc

SEQ ID NO: 3282215 - RNA, 16 nt, Mycobacterium tuberculosis H37Rv
gccgucgccgccguua

SEQ ID NO: 3282216 - RNA, 15 nt, Mycobacterium tuberculosis H37Rv
gccguggcgucggcg

SEQ ID NO: 3282217 - RNA, 19 nt, Mycobacterium tuberculosis H37Rv
gccgugggugucgguggcc

SEQ ID NO: 3282218 - RNA, 22 nt, Mycobacterium tuberculosis H37Rv
gccguggguguugaugggcagc

SEQ ID NO: 3282219 - RNA, 19 nt, Mycobacterium tuberculosis H37Rv
gccguggucgagggcggcg

SEQ ID NO: 3282220 - RNA, 17 nt, Mycobacterium tuberculosis H37Rv
gccguguacgugcucgu

SEQ ID NO: 3282221 - RNA, 18 nt, Mycobacterium tuberculosis H37Rv
gccguguccagcaugccc

SEQ ID NO: 3282222 - RNA, 17 nt, Mycobacterium tuberculosis H37Rv
gccgugugcucgaagga

SEQ ID NO: 3282223 - RNA, 20 nt, Mycobacterium tuberculosis H37Rv
gccgugugcucgaaggaccg

SEQ ID NO: 3282224 - RNA, 19 nt, Mycobacterium tuberculosis H37Rv
gccgugugcuucgagcacc

SEQ ID NO: 3282225 - RNA, 20 nt, Mycobacterium tuberculosis H37Rv
gccgugugcuucgagcaccg

SEQ ID NO: 3282226 - RNA, 20 nt, Mycobacterium tuberculosis H37Rv
gccgugugugcgauccaggg

SEQ ID NO: 3282227 - RNA, 17 nt, Mycobacterium tuberculosis H37Rv
gccgugugugcggcggu

SEQ ID NO: 3282228 - RNA, 13 nt, Mycobacterium tuberculosis H37Rv
gccguguucgggg

SEQ ID NO: 3282229 - RNA, 21 nt, Mycobacterium tuberculosis H37Rv
gccguguucgggggcggucgc

SEQ ID NO: 3282230 - RNA, 17 nt, Mycobacterium tuberculosis H37Rv
gccguuaccgagcccga

SEQ ID NO: 3282231 - RNA, 21 nt, Mycobacterium tuberculosis H37Rv
gccguuaccgccaaacgcugc

SEQ ID NO: 3282232 - RNA, 16 nt, Mycobacterium tuberculosis H37Rv
gccguuaccgccguug

SEQ ID NO: 3282233 - RNA, 20 nt, Mycobacterium tuberculosis H37Rv
gccguuccggcugcuuuaac

SEQ ID NO: 3282234 - RNA, 16 nt, Mycobacterium tuberculosis H37Rv
gccguuccguaucggg

SEQ ID NO: 3282235 - RNA, 12 nt, Mycobacterium tuberculosis H37Rv
gccguucggcgc

SEQ ID NO: 3282236 - RNA, 15 nt, Mycobacterium tuberculosis H37Rv
gccguucgggaugca

SEQ ID NO: 3282237 - RNA, 17 nt, Mycobacterium tuberculosis H37Rv
gccguucgucgcgggug

SEQ ID NO: 3282238 - RNA, 21 nt, Mycobacterium tuberculosis H37Rv
gccguugacgccguugccgcc

SEQ ID NO: 3282239 - RNA, 18 nt, Mycobacterium tuberculosis H37Rv
gccguugacuugugccac

SEQ ID NO: 3282240 - RNA, 17 nt, Mycobacterium tuberculosis H37Rv
gccguugaucgcaaacc

SEQ ID NO: 3282241 - RNA, 17 nt, Mycobacterium tuberculosis H37Rv
gccguugccaagcagcu

SEQ ID NO: 3282242 - RNA, 13 nt, Mycobacterium tuberculosis H37Rv
gccguugccaccg

SEQ ID NO: 3282243 - RNA, 16 nt, Mycobacterium tuberculosis H37Rv
gccguugccauugccu

SEQ ID NO: 3282244 - RNA, 22 nt, Mycobacterium tuberculosis H37Rv
gccguugccgaucagcccggcc

SEQ ID NO: 3282245 - RNA, 19 nt, Mycobacterium tuberculosis H37Rv
gccguugccgauccccagg

SEQ ID NO: 3282246 - RNA, 15 nt, Mycobacterium tuberculosis H37Rv
gccguugccgccauc

SEQ ID NO: 3282247 - RNA, 20 nt, Mycobacterium tuberculosis H37Rv
gccguugccgccauggccgc

SEQ ID NO: 3282248 - RNA, 15 nt, Mycobacterium tuberculosis H37Rv
gccguugccgccauu

SEQ ID NO: 3282249 - RNA, 14 nt, Mycobacterium tuberculosis H37Rv
gccguugccgccga

SEQ ID NO: 3282250 - RNA, 15 nt, Mycobacterium tuberculosis H37Rv
gccguugccgccggc

SEQ ID NO: 3282251 - RNA, 19 nt, Mycobacterium tuberculosis H37Rv
gccguugccgccggugcca

SEQ ID NO: 3282252 - RNA, 17 nt, Mycobacterium tuberculosis H37Rv
gccguugccgccgucgc

SEQ ID NO: 3282253 - RNA, 20 nt, Mycobacterium tuberculosis H37Rv
gccguugccgccgucgccgc

SEQ ID NO: 3282254 - RNA, 16 nt, Mycobacterium tuberculosis H37Rv
gccguugcgaucgcgu

SEQ ID NO: 3282255 - RNA, 23 nt, Mycobacterium tuberculosis H37Rv
gccguugcgucugcucggcguac

SEQ ID NO: 3282256 - RNA, 21 nt, Mycobacterium tuberculosis H37Rv
gccguugcuauucgccagcgc

SEQ ID NO: 3282257 - RNA, 19 nt, Mycobacterium tuberculosis H37Rv
gccguuggagccgccaccg

SEQ ID NO: 3282258 - RNA, 23 nt, Mycobacterium tuberculosis H37Rv
gccguugggcaccguguagcugc

SEQ ID NO: 3282259 - RNA, 20 nt, Mycobacterium tuberculosis H37Rv
gccguuggugaggccccccg

SEQ ID NO: 3282260 - RNA, 23 nt, Mycobacterium tuberculosis H37Rv
gccguuggugaggccccccgcgc

SEQ ID NO: 3282261 - RNA, 14 nt, Mycobacterium tuberculosis H37Rv
gccguuggugccgc

SEQ ID NO: 3282262 - RNA, 15 nt, Mycobacterium tuberculosis H37Rv
gccguuggugccgcc

SEQ ID NO: 3282263 - RNA, 18 nt, Mycobacterium tuberculosis H37Rv
gccguuguagacggcggc

SEQ ID NO: 3282264 - RNA, 19 nt, Mycobacterium tuberculosis H37Rv
gccguuguagacggcggca

SEQ ID NO: 3282265 - RNA, 20 nt, Mycobacterium tuberculosis H37Rv
gccguuguugaggaugacga

SEQ ID NO: 3282266 - RNA, 16 nt, Mycobacterium tuberculosis H37Rv
gccguuugggccguac

SEQ ID NO: 3282267 - RNA, 17 nt, Mycobacterium tuberculosis H37Rv
gccuaacucgccugcac

SEQ ID NO: 3282268 - RNA, 14 nt, Mycobacterium tuberculosis H37Rv
gccuaccagcaccg

SEQ ID NO: 3282269 - RNA, 14 nt, Mycobacterium tuberculosis H37Rv
gccuaccaggcgcg

SEQ ID NO: 3282270 - RNA, 22 nt, Mycobacterium tuberculosis H37Rv
gccuaccggccuuuccagcacc

SEQ ID NO: 3282271 - RNA, 23 nt, Mycobacterium tuberculosis H37Rv
gccuaccggccuuuccagcaccc

SEQ ID NO: 3282272 - RNA, 13 nt, Mycobacterium tuberculosis H37Rv
gccuagccgcagc

SEQ ID NO: 3282273 - RNA, 20 nt, Mycobacterium tuberculosis H37Rv
gccuagccgcagccccgaca

SEQ ID NO: 3282274 - RNA, 14 nt, Mycobacterium tuberculosis H37Rv
gccuagccgcggca

SEQ ID NO: 3282275 - RNA, 17 nt, Mycobacterium tuberculosis H37Rv
gccuaggccgaggccgc

SEQ ID NO: 3282276 - RNA, 16 nt, Mycobacterium tuberculosis H37Rv
gccuagggcggcggcg

SEQ ID NO: 3282277 - RNA, 20 nt, Mycobacterium tuberculosis H37Rv
gccuaggucgacgccgacca

SEQ ID NO: 3282278 - RNA, 23 nt, Mycobacterium tuberculosis H37Rv
gccuaggucgacgccgaccaccc

SEQ ID NO: 3282279 - RNA, 18 nt, Mycobacterium tuberculosis H37Rv
gccuagguucgcccagcc

SEQ ID NO: 3282280 - RNA, 14 nt, Mycobacterium tuberculosis H37Rv
gccuaguacgccga

SEQ ID NO: 3282281 - RNA, 15 nt, Mycobacterium tuberculosis H37Rv
gccuaguacgccgag

SEQ ID NO: 3282282 - RNA, 21 nt, Mycobacterium tuberculosis H37Rv
gccuaguccggcacugcggcc

SEQ ID NO: 3282283 - RNA, 21 nt, Mycobacterium tuberculosis H37Rv
gccuaucccgaaucucaccca

SEQ ID NO: 3282284 - RNA, 16 nt, Mycobacterium tuberculosis H37Rv
gccuaugcugcccggc

SEQ ID NO: 3282285 - RNA, 18 nt, Mycobacterium tuberculosis H37Rv
gccuaugcugcccggcaa

SEQ ID NO: 3282286 - RNA, 19 nt, Mycobacterium tuberculosis H37Rv
gccuaugcugcccggcaac

SEQ ID NO: 3282287 - RNA, 20 nt, Mycobacterium tuberculosis H37Rv
gccucaaaccggaaacagca

SEQ ID NO: 3282288 - RNA, 14 nt, Mycobacterium tuberculosis H37Rv
gccucaaggcggcc

SEQ ID NO: 3282289 - RNA, 15 nt, Mycobacterium tuberculosis H37Rv
gccucaaugaccacc

SEQ ID NO: 3282290 - RNA, 15 nt, Mycobacterium tuberculosis H37Rv
gccucaccacgucga

SEQ ID NO: 3282291 - RNA, 18 nt, Mycobacterium tuberculosis H37Rv
gccucaccgacgucgcca

SEQ ID NO: 3282292 - RNA, 16 nt, Mycobacterium tuberculosis H37Rv
gccucagaaccggguc

SEQ ID NO: 3282293 - RNA, 13 nt, Mycobacterium tuberculosis H37Rv
gccucagcccggc

SEQ ID NO: 3282294 - RNA, 16 nt, Mycobacterium tuberculosis H37Rv
gccucagcccgucagc

SEQ ID NO: 3282295 - RNA, 15 nt, Mycobacterium tuberculosis H37Rv
gccucauccaccgau

SEQ ID NO: 3282296 - RNA, 22 nt, Mycobacterium tuberculosis H37Rv
gccucauccaccgauggcgcgc

SEQ ID NO: 3282297 - RNA, 19 nt, Mycobacterium tuberculosis H37Rv
gccucaucggacagcgccu

SEQ ID NO: 3282298 - RNA, 17 nt, Mycobacterium tuberculosis H37Rv
gccucaugcuaggccac

SEQ ID NO: 3282299 - RNA, 21 nt, Mycobacterium tuberculosis H37Rv
gccucaugcuaggccaccggc

SEQ ID NO: 3282300 - RNA, 23 nt, Mycobacterium tuberculosis H37Rv
gccucaugcuaggccaccggcga

SEQ ID NO: 3282301 - RNA, 19 nt, Mycobacterium tuberculosis H37Rv
gccuccaaaaucgcggcca

SEQ ID NO: 3282302 - RNA, 21 nt, Mycobacterium tuberculosis H37Rv
gccuccaaaaucgcggccaca

SEQ ID NO: 3282303 - RNA, 22 nt, Mycobacterium tuberculosis H37Rv
gccuccaaaaucgcggccacac

SEQ ID NO: 3282304 - RNA, 18 nt, Mycobacterium tuberculosis H37Rv
gccuccaagcccgccgga

SEQ ID NO: 3282305 - RNA, 20 nt, Mycobacterium tuberculosis H37Rv
gccuccacauacgcggcggc

SEQ ID NO: 3282306 - RNA, 22 nt, Mycobacterium tuberculosis H37Rv
gccuccacauacgcggcggccu

SEQ ID NO: 3282307 - RNA, 12 nt, Mycobacterium tuberculosis H37Rv
gccuccaccagg

SEQ ID NO: 3282308 - RNA, 16 nt, Mycobacterium tuberculosis H37Rv
gccuccaccaggucgu

SEQ ID NO: 3282309 - RNA, 15 nt, Mycobacterium tuberculosis H37Rv
gccuccacccgccac

SEQ ID NO: 3282310 - RNA, 16 nt, Mycobacterium tuberculosis H37Rv
gccuccacccgccacg

SEQ ID NO: 3282311 - RNA, 18 nt, Mycobacterium tuberculosis H37Rv
gccuccaccgcguccagg

SEQ ID NO: 3282312 - RNA, 21 nt, Mycobacterium tuberculosis H37Rv
gccugaaacgauugcugcggc

SEQ ID NO: 3282313 - RNA, 13 nt, Mycobacterium tuberculosis H37Rv
gccugaaccacgc

SEQ ID NO: 3282314 - RNA, 14 nt, Mycobacterium tuberculosis H37Rv
gccugacacgaugc

SEQ ID NO: 3282315 - RNA, 18 nt, Mycobacterium tuberculosis H37Rv
gccugaccgaagucugca

SEQ ID NO: 3282316 - RNA, 21 nt, Mycobacterium tuberculosis H37Rv
gccugacgaaguccaccacga

SEQ ID NO: 3282317 - RNA, 15 nt, Mycobacterium tuberculosis H37Rv
gccugacgcgucagc

SEQ ID NO: 3282318 - RNA, 17 nt, Mycobacterium tuberculosis H37Rv
gccugacucaucaccga

SEQ ID NO: 3282319 - RNA, 13 nt, Mycobacterium tuberculosis H37Rv
gccugagccacca

SEQ ID NO: 3282320 - RNA, 21 nt, Mycobacterium tuberculosis H37Rv
gccugagccaccaacaccgcg

SEQ ID NO: 3282321 - RNA, 15 nt, Mycobacterium tuberculosis H37Rv
gccugagcgccgcgg

SEQ ID NO: 3282322 - RNA, 16 nt, Mycobacterium tuberculosis H37Rv
gccugagcgccgcggc

SEQ ID NO: 3282323 - RNA, 23 nt, Mycobacterium tuberculosis H37Rv
gccugagcggggauguccgcggc

SEQ ID NO: 3282324 - RNA, 20 nt, Mycobacterium tuberculosis H37Rv
gccugagcgucgucgccggc

SEQ ID NO: 3282325 - RNA, 16 nt, Mycobacterium tuberculosis H37Rv
gccugaggugcugcca

SEQ ID NO: 3282326 - RNA, 14 nt, Mycobacterium tuberculosis H37Rv
gccugauaaagccc

SEQ ID NO: 3282327 - RNA, 23 nt, Mycobacterium tuberculosis H37Rv
gccugauaaagcccggcggcaug

SEQ ID NO: 3282328 - RNA, 24 nt, Mycobacterium tuberculosis H37Rv
gccugaugcugccagaucggucgg

SEQ ID NO: 3282329 - RNA, 15 nt, Mycobacterium tuberculosis H37Rv
gccugcaagacaaag

SEQ ID NO: 3282330 - RNA, 22 nt, Mycobacterium tuberculosis H37Rv
gccugcaagacaaagccgucga

SEQ ID NO: 3282331 - RNA, 14 nt, Mycobacterium tuberculosis H37Rv
gccugcacggcgcu

SEQ ID NO: 3282332 - RNA, 23 nt, Mycobacterium tuberculosis H37Rv
gccugcagcgaaacaccggccag

SEQ ID NO: 3282333 - RNA, 17 nt, Mycobacterium tuberculosis H37Rv
gccugcagcgcgacccg

SEQ ID NO: 3282334 - RNA, 12 nt, Mycobacterium tuberculosis H37Rv
gccugcaggccg

SEQ ID NO: 3282335 - RNA, 15 nt, Mycobacterium tuberculosis H37Rv
gccugcaggccgccg

SEQ ID NO: 3282336 - RNA, 23 nt, Mycobacterium tuberculosis H37Rv
gccugcagguugguaauccgggc

SEQ ID NO: 3282337 - RNA, 17 nt, Mycobacterium tuberculosis H37Rv
gccugcaguucggcgua

SEQ ID NO: 3282338 - RNA, 16 nt, Mycobacterium tuberculosis H37Rv
gccugccacccggcca

SEQ ID NO: 3282339 - RNA, 19 nt, Mycobacterium tuberculosis H37Rv
gccugccacccggccaggu

SEQ ID NO: 3282340 - RNA, 16 nt, Mycobacterium tuberculosis H37Rv
gccugccaccggcgcu

SEQ ID NO: 3282341 - RNA, 17 nt, Mycobacterium tuberculosis H37Rv
gccugccaguccugaug

SEQ ID NO: 3282342 - RNA, 19 nt, Mycobacterium tuberculosis H37Rv
gccugccaucacgcgcuca

SEQ ID NO: 3282343 - RNA, 22 nt, Mycobacterium tuberculosis H37Rv
gccugccaucacgcgcucaccg

SEQ ID NO: 3282344 - RNA, 16 nt, Mycobacterium tuberculosis H37Rv
gccugcccaccuucga

SEQ ID NO: 3282345 - RNA, 14 nt, Mycobacterium tuberculosis H37Rv
gccugcccagcacc

SEQ ID NO: 3282346 - RNA, 17 nt, Mycobacterium tuberculosis H37Rv
gccugccccacccgcgg

SEQ ID NO: 3282347 - RNA, 22 nt, Mycobacterium tuberculosis H37Rv
gccugccccacccgcggcgccg

SEQ ID NO: 3282348 - RNA, 13 nt, Mycobacterium tuberculosis H37Rv
gccugccccagau

SEQ ID NO: 3282349 - RNA, 14 nt, Mycobacterium tuberculosis H37Rv
gccugcccccgcgc

SEQ ID NO: 3282350 - RNA, 20 nt, Mycobacterium tuberculosis H37Rv
gccugcccccgcgcgcacgg

SEQ ID NO: 3282351 - RNA, 20 nt, Mycobacterium tuberculosis H37Rv
gccugcccccggcgcggcgg

SEQ ID NO: 3282352 - RNA, 13 nt, Mycobacterium tuberculosis H37Rv
gccugcccgccgu

SEQ ID NO: 3282353 - RNA, 14 nt, Mycobacterium tuberculosis H37Rv
gccugcccgggaug

SEQ ID NO: 3282354 - RNA, 21 nt, Mycobacterium tuberculosis H37Rv
gccugccgaaacgccgaccgc

SEQ ID NO: 3282355 - RNA, 13 nt, Mycobacterium tuberculosis H37Rv
gccugccgcucgc

SEQ ID NO: 3282356 - RNA, 21 nt, Mycobacterium tuberculosis H37Rv
gccugccucgccugcacgccc

SEQ ID NO: 3282357 - RNA, 14 nt, Mycobacterium tuberculosis H37Rv
gccugccucggcga

SEQ ID NO: 3282358 - RNA, 18 nt, Mycobacterium tuberculosis H37Rv
gccugcgaaacgcuggcc

SEQ ID NO: 3282359 - RNA, 15 nt, Mycobacterium tuberculosis H37Rv
gccugcgacagcacg

SEQ ID NO: 3282360 - RNA, 18 nt, Mycobacterium tuberculosis H37Rv
gccugcgacgagcccacc

SEQ ID NO: 3282361 - RNA, 14 nt, Mycobacterium tuberculosis H37Rv
gccugcgcccagcc

SEQ ID NO: 3282362 - RNA, 16 nt, Mycobacterium tuberculosis H37Rv
gccugcgccgacccgc

SEQ ID NO: 3282363 - RNA, 13 nt, Mycobacterium tuberculosis H37Rv
gccugcgccgagu

SEQ ID NO: 3282364 - RNA, 18 nt, Mycobacterium tuberculosis H37Rv
gccugcgccgccagcgcc

SEQ ID NO: 3282365 - RNA, 13 nt, Mycobacterium tuberculosis H37Rv
gccugcgccgcgc

SEQ ID NO: 3282366 - RNA, 19 nt, Mycobacterium tuberculosis H37Rv
gccugcgccggcgcugcca

SEQ ID NO: 3282367 - RNA, 22 nt, Mycobacterium tuberculosis H37Rv
gccugcgccuugaagcggugga

SEQ ID NO: 3282368 - RNA, 17 nt, Mycobacterium tuberculosis H37Rv
gccugcgccuuggucgc

SEQ ID NO: 3282369 - RNA, 15 nt, Mycobacterium tuberculosis H37Rv
gccugcgcgaccgac

SEQ ID NO: 3282370 - RNA, 21 nt, Mycobacterium tuberculosis H37Rv
gccugcgcgaugcgauucugc

SEQ ID NO: 3282371 - RNA, 15 nt, Mycobacterium tuberculosis H37Rv
gccugcggcaccggc

SEQ ID NO: 3282372 - RNA, 13 nt, Mycobacterium tuberculosis H37Rv
gccugcggcagca

SEQ ID NO: 3282373 - RNA, 12 nt, Mycobacterium tuberculosis H37Rv
gccugcggcggu

SEQ ID NO: 3282374 - RNA, 18 nt, Mycobacterium tuberculosis H37Rv
gccugcgggaacgcggcg

SEQ ID NO: 3282375 - RNA, 18 nt, Mycobacterium tuberculosis H37Rv
gccugcgggccggcaucg

SEQ ID NO: 3282376 - RNA, 15 nt, Mycobacterium tuberculosis H37Rv
gccugcguggagcgc

SEQ ID NO: 3282377 - RNA, 15 nt, Mycobacterium tuberculosis H37Rv
gccugcuagcagcag

SEQ ID NO: 3282378 - RNA, 17 nt, Mycobacterium tuberculosis H37Rv
gccugcuccaccgucga

SEQ ID NO: 3282379 - RNA, 16 nt, Mycobacterium tuberculosis H37Rv
gccugcuccucggcca

SEQ ID NO: 3282380 - RNA, 17 nt, Mycobacterium tuberculosis H37Rv
gccugcuccucggccag

SEQ ID NO: 3282381 - RNA, 21 nt, Mycobacterium tuberculosis H37Rv
gccugcuccucggccagcgug

SEQ ID NO: 3282382 - RNA, 17 nt, Mycobacterium tuberculosis H37Rv
gccugcucgcagcgggc

SEQ ID NO: 3282383 - RNA, 15 nt, Mycobacterium tuberculosis H37Rv
gccugcucgucggcc

SEQ ID NO: 3282384 - RNA, 22 nt, Mycobacterium tuberculosis H37Rv
gccugcugcacaucgcauccac

SEQ ID NO: 3282385 - RNA, 20 nt, Mycobacterium tuberculosis H37Rv
gccugcugcggccagggagc

SEQ ID NO: 3282386 - RNA, 20 nt, Mycobacterium tuberculosis H37Rv
gccugcugcugcagcgaugc

SEQ ID NO: 3282387 - RNA, 12 nt, Mycobacterium tuberculosis H37Rv
gccugcuggccg

SEQ ID NO: 3282388 - RNA, 18 nt, Mycobacterium tuberculosis H37Rv
gccugcuggccgcggccu

SEQ ID NO: 3282389 - RNA, 16 nt, Mycobacterium tuberculosis H37Rv
gccugcuucaggaucg

SEQ ID NO: 3282390 - RNA, 13 nt, Mycobacterium tuberculosis H37Rv
gccugcuuggcca

SEQ ID NO: 3282391 - RNA, 18 nt, Mycobacterium tuberculosis H37Rv
gccuggaugccgaucggg

SEQ ID NO: 3282392 - RNA, 14 nt, Mycobacterium tuberculosis H37Rv
gccuggcagggugg

SEQ ID NO: 3282393 - RNA, 14 nt, Mycobacterium tuberculosis H37Rv
gccuggccaccugg

SEQ ID NO: 3282394 - RNA, 14 nt, Mycobacterium tuberculosis H37Rv
gccuggcccgucgg

SEQ ID NO: 3282395 - RNA, 22 nt, Mycobacterium tuberculosis H37Rv
gccuggccggaauacccgcugg

SEQ ID NO: 3282396 - RNA, 15 nt, Mycobacterium tuberculosis H37Rv
gccuggcggcgccgc

SEQ ID NO: 3282397 - RNA, 20 nt, Mycobacterium tuberculosis H37Rv
gccuggcuacgcgcgcccga

SEQ ID NO: 3282398 - RNA, 13 nt, Mycobacterium tuberculosis H37Rv
gccuggcuggcca

SEQ ID NO: 3282399 - RNA, 15 nt, Mycobacterium tuberculosis H37Rv
gccuggcuggccagc

SEQ ID NO: 3282400 - RNA, 16 nt, Mycobacterium tuberculosis H37Rv
gccugggaaacugggu

SEQ ID NO: 3282401 - RNA, 15 nt, Mycobacterium tuberculosis H37Rv
gccugggacggcggc

SEQ ID NO: 3282402 - RNA, 18 nt, Mycobacterium tuberculosis H37Rv
gccugggcacggccgucg

SEQ ID NO: 3282403 - RNA, 19 nt, Mycobacterium tuberculosis H37Rv
gccugggcacggccgucga

SEQ ID NO: 3282404 - RNA, 14 nt, Mycobacterium tuberculosis H37Rv
gccugggccgcaca

SEQ ID NO: 3282405 - RNA, 18 nt, Mycobacterium tuberculosis H37Rv
gccugggugggagcguug

SEQ ID NO: 3282406 - RNA, 22 nt, Mycobacterium tuberculosis H37Rv
gccuggguuggugauugcggcc

SEQ ID NO: 3282407 - RNA, 21 nt, Mycobacterium tuberculosis H37Rv
gccugguacucccgcgaucgc

SEQ ID NO: 3282408 - RNA, 13 nt, Mycobacterium tuberculosis H37Rv
gccuggucgcgca

SEQ ID NO: 3282409 - RNA, 21 nt, Mycobacterium tuberculosis H37Rv
gcgaaaucgacagcagcgcga

SEQ ID NO: 3282410 - RNA, 19 nt, Mycobacterium tuberculosis H37Rv
gcgaaaugcccaucaccag

SEQ ID NO: 3282411 - RNA, 13 nt, Mycobacterium tuberculosis H37Rv
gcgaacaacuugg

SEQ ID NO: 3282412 - RNA, 20 nt, Mycobacterium tuberculosis H37Rv
gcgaacacccgaagccggcg

SEQ ID NO: 3282413 - RNA, 18 nt, Mycobacterium tuberculosis H37Rv
gcgaacacccggucaucg

SEQ ID NO: 3282414 - RNA, 12 nt, Mycobacterium tuberculosis H37Rv
gcgaacacgcga

SEQ ID NO: 3282415 - RNA, 17 nt, Mycobacterium tuberculosis H37Rv
gcgaacacgucggccag

SEQ ID NO: 3282416 - RNA, 21 nt, Mycobacterium tuberculosis H37Rv
gcgaacagcggcacgaucggc

SEQ ID NO: 3282417 - RNA, 15 nt, Mycobacterium tuberculosis H37Rv
gcgaacagcgggggc

SEQ ID NO: 3282418 - RNA, 14 nt, Mycobacterium tuberculosis H37Rv
gcgaacaucaccgu

SEQ ID NO: 3282419 - RNA, 16 nt, Mycobacterium tuberculosis H37Rv
gcgaacaucgccagcg

SEQ ID NO: 3282420 - RNA, 14 nt, Mycobacterium tuberculosis H37Rv
gcgaaccacggcag

SEQ ID NO: 3282421 - RNA, 15 nt, Mycobacterium tuberculosis H37Rv
gcgaacccccgccgc

SEQ ID NO: 3282422 - RNA, 17 nt, Mycobacterium tuberculosis H37Rv
gcgaacccccgccgcgc

SEQ ID NO: 3282423 - RNA, 13 nt, Mycobacterium tuberculosis H37Rv
gcgaacccgccga

SEQ ID NO: 3282424 - RNA, 17 nt, Mycobacterium tuberculosis H37Rv
gcgaacccgccgaugcc

SEQ ID NO: 3282425 - RNA, 14 nt, Mycobacterium tuberculosis H37Rv
gcgaacccuccgca

SEQ ID NO: 3282426 - RNA, 18 nt, Mycobacterium tuberculosis H37Rv
gcgaaccgaagccgucga

SEQ ID NO: 3282427 - RNA, 13 nt, Mycobacterium tuberculosis H37Rv
gcgaaccggccgu

SEQ ID NO: 3282428 - RNA, 16 nt, Mycobacterium tuberculosis H37Rv
gcgaaccggccgucga

SEQ ID NO: 3282429 - RNA, 18 nt, Mycobacterium tuberculosis H37Rv
gcgaaccgucucggcgac

SEQ ID NO: 3282430 - RNA, 22 nt, Mycobacterium tuberculosis H37Rv
gcgaacgaucccgccgaucgaa

SEQ ID NO: 3282431 - RNA, 15 nt, Mycobacterium tuberculosis H37Rv
gcgaacgccacggca

SEQ ID NO: 3282432 - RNA, 12 nt, Mycobacterium tuberculosis H37Rv
gcgaacgccgug

SEQ ID NO: 3282433 - RNA, 24 nt, Mycobacterium tuberculosis H37Rv
gcgaacgccguggugcgcauggcc

SEQ ID NO: 3282434 - RNA, 16 nt, Mycobacterium tuberculosis H37Rv
gcgaacgcguccagcg

SEQ ID NO: 3282435 - RNA, 23 nt, Mycobacterium tuberculosis H37Rv
gcgaacggauucccgcccagcag

SEQ ID NO: 3282436 - RNA, 13 nt, Mycobacterium tuberculosis H37Rv
gcgaacggccagg

SEQ ID NO: 3282437 - RNA, 14 nt, Mycobacterium tuberculosis H37Rv
gcgaacggccagga

SEQ ID NO: 3282438 - RNA, 16 nt, Mycobacterium tuberculosis H37Rv
gcgaacgggucgggac

SEQ ID NO: 3282439 - RNA, 18 nt, Mycobacterium tuberculosis H37Rv
gcgaacgucaaccgggcg

SEQ ID NO: 3282440 - RNA, 16 nt, Mycobacterium tuberculosis H37Rv
gcgaacucaugcccga

SEQ ID NO: 3282441 - RNA, 15 nt, Mycobacterium tuberculosis H37Rv
gcgaacuccagcagc

SEQ ID NO: 3282442 - RNA, 17 nt, Mycobacterium tuberculosis H37Rv
gcgaacuccaucaccac

SEQ ID NO: 3282443 - RNA, 15 nt, Mycobacterium tuberculosis H37Rv
gcgaacucgggcgac

SEQ ID NO: 3282444 - RNA, 19 nt, Mycobacterium tuberculosis H37Rv
gcgaacucuacgguggugc

SEQ ID NO: 3282445 - RNA, 23 nt, Mycobacterium tuberculosis H37Rv
gcgaacugguagcccggaccgcc

SEQ ID NO: 3282446 - RNA, 23 nt, Mycobacterium tuberculosis H37Rv
gcgaacuuaacuacggugcccug

SEQ ID NO: 3282447 - RNA, 17 nt, Mycobacterium tuberculosis H37Rv
gcgaagaacgacgccac

SEQ ID NO: 3282448 - RNA, 15 nt, Mycobacterium tuberculosis H37Rv
gcgaagaagccggca

SEQ ID NO: 3282449 - RNA, 12 nt, Mycobacterium tuberculosis H37Rv
gcgaagacuagc

SEQ ID NO: 3282450 - RNA, 14 nt, Mycobacterium tuberculosis H37Rv
gcgaagagcgcacu

SEQ ID NO: 3282451 - RNA, 17 nt, Mycobacterium tuberculosis H37Rv
gcgaagagcgcacugaa

SEQ ID NO: 3282452 - RNA, 16 nt, Mycobacterium tuberculosis H37Rv
gcgaagcacaccgucc

SEQ ID NO: 3282453 - RNA, 18 nt, Mycobacterium tuberculosis H37Rv
gcgaagcacaccguccgu

SEQ ID NO: 3282454 - RNA, 14 nt, Mycobacterium tuberculosis H37Rv
gcgaagcaucgcgu

SEQ ID NO: 3282455 - RNA, 14 nt, Mycobacterium tuberculosis H37Rv
gcgaagcccgacau

SEQ ID NO: 3282456 - RNA, 13 nt, Mycobacterium tuberculosis H37Rv
gcgaagcccgaga

SEQ ID NO: 3282457 - RNA, 15 nt, Mycobacterium tuberculosis H37Rv
gcgaagccggccggg

SEQ ID NO: 3282458 - RNA, 18 nt, Mycobacterium tuberculosis H37Rv
gcgaagccgggucucggu

SEQ ID NO: 3282459 - RNA, 19 nt, Mycobacterium tuberculosis H37Rv
gcgaagcgucuggucagcc

SEQ ID NO: 3282460 - RNA, 23 nt, Mycobacterium tuberculosis H37Rv
gcgaagcuagcgcccgcgagaga

SEQ ID NO: 3282461 - RNA, 17 nt, Mycobacterium tuberculosis H37Rv
gcgaagcugaccagaca

SEQ ID NO: 3282462 - RNA, 21 nt, Mycobacterium tuberculosis H37Rv
gcgaagcugugcccggcgccc

SEQ ID NO: 3282463 - RNA, 15 nt, Mycobacterium tuberculosis H37Rv
gcgaaggaccagagc

SEQ ID NO: 3282464 - RNA, 13 nt, Mycobacterium tuberculosis H37Rv
gcgaaggccgcgc

SEQ ID NO: 3282465 - RNA, 19 nt, Mycobacterium tuberculosis H37Rv
gcgaagggcaccggcgauc

SEQ ID NO: 3282466 - RNA, 18 nt, Mycobacterium tuberculosis H37Rv
gcgaaguacccggcaaac

SEQ ID NO: 3282467 - RNA, 18 nt, Mycobacterium tuberculosis H37Rv
gcgaagucgacucgccac

SEQ ID NO: 3282468 - RNA, 15 nt, Mycobacterium tuberculosis H37Rv
gcgaagucgcauggc

SEQ ID NO: 3282469 - RNA, 19 nt, Mycobacterium tuberculosis H37Rv
gcgaagucguccagaauga

SEQ ID NO: 3282470 - RNA, 18 nt, Mycobacterium tuberculosis H37Rv
gcgaagucuugaccgcac

SEQ ID NO: 3282471 - RNA, 18 nt, Mycobacterium tuberculosis H37Rv
gcgaaguggaucuggcgc

SEQ ID NO: 3282472 - RNA, 13 nt, Mycobacterium tuberculosis H37Rv
gcgaauagccacc

SEQ ID NO: 3282473 - RNA, 19 nt, Mycobacterium tuberculosis H37Rv
gcgaaucaacaggaccggg

SEQ ID NO: 3282474 - RNA, 12 nt, Mycobacterium tuberculosis H37Rv
gcgaaucacccg

SEQ ID NO: 3282475 - RNA, 23 nt, Mycobacterium tuberculosis H37Rv
gcgaauccagccgcgcgccggcc

SEQ ID NO: 3282476 - RNA, 13 nt, Mycobacterium tuberculosis H37Rv
gcgaaucccguau

SEQ ID NO: 3282477 - RNA, 23 nt, Mycobacterium tuberculosis H37Rv
gcgaaucuuugguagucugcacg

SEQ ID NO: 3282478 - RNA, 22 nt, Mycobacterium tuberculosis H37Rv
gcgaaugaucuugccacuccag

SEQ ID NO: 3282479 - RNA, 20 nt, Mycobacterium tuberculosis H37Rv
gcgaaugcauuggcggugcg

SEQ ID NO: 3282480 - RNA, 15 nt, Mycobacterium tuberculosis H37Rv
gcgaaugcgauugcc

SEQ ID NO: 3282481 - RNA, 17 nt, Mycobacterium tuberculosis H37Rv
gcgaaugcgggccuccu

SEQ ID NO: 3282482 - RNA, 17 nt, Mycobacterium tuberculosis H37Rv
gcgaaugugaucacccg

SEQ ID NO: 3282483 - RNA, 22 nt, Mycobacterium tuberculosis H37Rv
gcgaauucguagggaugcggcc

SEQ ID NO: 3282484 - RNA, 17 nt, Mycobacterium tuberculosis H37Rv
gcgacaaaucggucgac

SEQ ID NO: 3282485 - RNA, 21 nt, Mycobacterium tuberculosis H37Rv
gcgacaaaucggucgacgauc

SEQ ID NO: 3282486 - RNA, 21 nt, Mycobacterium tuberculosis H37Rv
gcgacaacaccacggugccga

SEQ ID NO: 3282487 - RNA, 21 nt, Mycobacterium tuberculosis H37Rv
gcgacaacagcacguacugcu

SEQ ID NO: 3282488 - RNA, 13 nt, Mycobacterium tuberculosis H37Rv
gcgacaacccggc

SEQ ID NO: 3282489 - RNA, 21 nt, Mycobacterium tuberculosis H37Rv
gcgacaagccgagcccgucga

SEQ ID NO: 3282490 - RNA, 18 nt, Mycobacterium tuberculosis H37Rv
gcgacaaggucgucgacu

SEQ ID NO: 3282491 - RNA, 19 nt, Mycobacterium tuberculosis H37Rv
gcgacaauggugcccagga

SEQ ID NO: 3282492 - RNA, 20 nt, Mycobacterium tuberculosis H37Rv
gcgacacaacgggugucggc

SEQ ID NO: 3282493 - RNA, 21 nt, Mycobacterium tuberculosis H37Rv
gcgacacacgccgccgguguc

SEQ ID NO: 3282494 - RNA, 18 nt, Mycobacterium tuberculosis H37Rv
gcgacacauagugcggca

SEQ ID NO: 3282495 - RNA, 15 nt, Mycobacterium tuberculosis H37Rv
gcgacaccacgaauc

SEQ ID NO: 3282496 - RNA, 23 nt, Mycobacterium tuberculosis H37Rv
gcgacacccugggugccggcagc

SEQ ID NO: 3282497 - RNA, 15 nt, Mycobacterium tuberculosis H37Rv
gcgacaccgcaccga

SEQ ID NO: 3282498 - RNA, 21 nt, Mycobacterium tuberculosis H37Rv
gcgacaccggaaacggucagg

SEQ ID NO: 3282499 - RNA, 23 nt, Mycobacterium tuberculosis H37Rv
gcgacaccggaaacggucagggc

SEQ ID NO: 3282500 - RNA, 12 nt, Mycobacterium tuberculosis H37Rv
gcgacacgccag

SEQ ID NO: 3282501 - RNA, 16 nt, Mycobacterium tuberculosis H37Rv
gcgacacgccagccgu

SEQ ID NO: 3282502 - RNA, 18 nt, Mycobacterium tuberculosis H37Rv
gcgacacgccagccgugc

SEQ ID NO: 3282503 - RNA, 19 nt, Mycobacterium tuberculosis H37Rv
gcgacacgccggcgggcug

SEQ ID NO: 3282504 - RNA, 19 nt, Mycobacterium tuberculosis H37Rv
gcgacacguuggcggaugc

SEQ ID NO: 3282505 - RNA, 22 nt, Mycobacterium tuberculosis H37Rv
gcgacgaaccucggcgggaucc

SEQ ID NO: 3282506 - RNA, 20 nt, Mycobacterium tuberculosis H37Rv
gcgacgacccgggucggcac

SEQ ID NO: 3282507 - RNA, 14 nt, Mycobacterium tuberculosis H37Rv
gcgacgaccgucgg

SEQ ID NO: 3282508 - RNA, 20 nt, Mycobacterium tuberculosis H37Rv
gcgacgaccgucggcuccag

SEQ ID NO: 3282509 - RNA, 13 nt, Mycobacterium tuberculosis H37Rv
gcgacgacggccu

SEQ ID NO: 3282510 - RNA, 14 nt, Mycobacterium tuberculosis H37Rv
gcgacgagaucagc

SEQ ID NO: 3282511 - RNA, 18 nt, Mycobacterium tuberculosis H37Rv
gcgacgagaucagccucg

SEQ ID NO: 3282512 - RNA, 14 nt, Mycobacterium tuberculosis H37Rv
gcgacgagcagcaa

SEQ ID NO: 3282513 - RNA, 15 nt, Mycobacterium tuberculosis H37Rv
gcgacgagcccaccg

SEQ ID NO: 3282514 - RNA, 23 nt, Mycobacterium tuberculosis H37Rv
gcgacgagcccaccgucgcauac

SEQ ID NO: 3282515 - RNA, 23 nt, Mycobacterium tuberculosis H37Rv
gcgacgauaucgggagcggcugc

SEQ ID NO: 3282516 - RNA, 13 nt, Mycobacterium tuberculosis H37Rv
gcgacgauccgca

SEQ ID NO: 3282517 - RNA, 18 nt, Mycobacterium tuberculosis H37Rv
gcgacgaucguccaaugc

SEQ ID NO: 3282518 - RNA, 17 nt, Mycobacterium tuberculosis H37Rv
gcgacgaucucggcggc

SEQ ID NO: 3282519 - RNA, 14 nt, Mycobacterium tuberculosis H37Rv
gcgacgaugcaggu

SEQ ID NO: 3282520 - RNA, 16 nt, Mycobacterium tuberculosis H37Rv
gcgacgaugcagguga

SEQ ID NO: 3282521 - RNA, 14 nt, Mycobacterium tuberculosis H37Rv
gcgacgaugccucg

SEQ ID NO: 3282522 - RNA, 19 nt, Mycobacterium tuberculosis H37Rv
gcgacgaugucgagcgcga

SEQ ID NO: 3282523 - RNA, 21 nt, Mycobacterium tuberculosis H37Rv
gcgacgcaaagcagcgcaaug

SEQ ID NO: 3282524 - RNA, 19 nt, Mycobacterium tuberculosis H37Rv
gcgacgcacugccccgcau

SEQ ID NO: 3282525 - RNA, 14 nt, Mycobacterium tuberculosis H37Rv
gcgacgcagaccgu

SEQ ID NO: 3282526 - RNA, 20 nt, Mycobacterium tuberculosis H37Rv
gcgacgcauaaccggcgcgc

SEQ ID NO: 3282527 - RNA, 22 nt, Mycobacterium tuberculosis H37Rv
gcgacgcauaaccggcgcgccc

SEQ ID NO: 3282528 - RNA, 14 nt, Mycobacterium tuberculosis H37Rv
gcgacgccaugguc

SEQ ID NO: 3282529 - RNA, 15 nt, Mycobacterium tuberculosis H37Rv
gcgacgccaugguca

SEQ ID NO: 3282530 - RNA, 18 nt, Mycobacterium tuberculosis H37Rv
gcgacgcccgccuucgau

SEQ ID NO: 3282531 - RNA, 14 nt, Mycobacterium tuberculosis H37Rv
gcgacgccggcccg

SEQ ID NO: 3282532 - RNA, 17 nt, Mycobacterium tuberculosis H37Rv
gcgacgccggccuuggc

SEQ ID NO: 3282533 - RNA, 20 nt, Mycobacterium tuberculosis H37Rv
gcgacgccggccuuggcgau

SEQ ID NO: 3282534 - RNA, 20 nt, Mycobacterium tuberculosis H37Rv
gcgacgcgcgagaacacccg

SEQ ID NO: 3282535 - RNA, 13 nt, Mycobacterium tuberculosis H37Rv
gcgacgcggccag

SEQ ID NO: 3282536 - RNA, 17 nt, Mycobacterium tuberculosis H37Rv
gcgacgcggccagcggc

SEQ ID NO: 3282537 - RNA, 12 nt, Mycobacterium tuberculosis H37Rv
gcgacgcguagc

SEQ ID NO: 3282538 - RNA, 14 nt, Mycobacterium tuberculosis H37Rv
gcgacgcucgcugc

SEQ ID NO: 3282539 - RNA, 15 nt, Mycobacterium tuberculosis H37Rv
gcgacgcucgcugca

SEQ ID NO: 3282540 - RNA, 13 nt, Mycobacterium tuberculosis H37Rv
gcgacgcugacac

SEQ ID NO: 3282541 - RNA, 18 nt, Mycobacterium tuberculosis H37Rv
gcgacggaccaucuccgg

SEQ ID NO: 3282542 - RNA, 23 nt, Mycobacterium tuberculosis H37Rv
gcgacggacucccucgaucacgg

SEQ ID NO: 3282543 - RNA, 12 nt, Mycobacterium tuberculosis H37Rv
gcgacggccaag

SEQ ID NO: 3282544 - RNA, 22 nt, Mycobacterium tuberculosis H37Rv
gcgacggccaagaucggcgccc

SEQ ID NO: 3282545 - RNA, 13 nt, Mycobacterium tuberculosis H37Rv
gcgacggccagcg

SEQ ID NO: 3282546 - RNA, 20 nt, Mycobacterium tuberculosis H37Rv
gcgacggccagcgcgucggg

SEQ ID NO: 3282547 - RNA, 16 nt, Mycobacterium tuberculosis H37Rv
gcgacggcccgauccc

SEQ ID NO: 3282548 - RNA, 22 nt, Mycobacterium tuberculosis H37Rv
gcgacggcccgaucccgaucga

SEQ ID NO: 3282549 - RNA, 16 nt, Mycobacterium tuberculosis H37Rv
gcgacggccggcaagc

SEQ ID NO: 3282550 - RNA, 12 nt, Mycobacterium tuberculosis H37Rv
gcgacggccuug

SEQ ID NO: 3282551 - RNA, 15 nt, Mycobacterium tuberculosis H37Rv
gcgacggcgacguga

SEQ ID NO: 3282552 - RNA, 15 nt, Mycobacterium tuberculosis H37Rv
gcgacggcgcucggc

SEQ ID NO: 3282553 - RNA, 20 nt, Mycobacterium tuberculosis H37Rv
gcgacgggucgggcaaccug

SEQ ID NO: 3282554 - RNA, 19 nt, Mycobacterium tuberculosis H37Rv
gcgacggucgugaucggcg

SEQ ID NO: 3282555 - RNA, 18 nt, Mycobacterium tuberculosis H37Rv
gcgacgguguagcccauc

SEQ ID NO: 3282556 - RNA, 19 nt, Mycobacterium tuberculosis H37Rv
gcgacgguucccagcuucc

SEQ ID NO: 3282557 - RNA, 20 nt, Mycobacterium tuberculosis H37Rv
gcgacgguucccagcuuccg

SEQ ID NO: 3282558 - RNA, 14 nt, Mycobacterium tuberculosis H37Rv
gcgacguaaagggc

SEQ ID NO: 3282559 - RNA, 18 nt, Mycobacterium tuberculosis H37Rv
gcgacguagacgacgucg

SEQ ID NO: 3282560 - RNA, 22 nt, Mycobacterium tuberculosis H37Rv
gcgacguaguggaagccgacca

SEQ ID NO: 3282561 - RNA, 17 nt, Mycobacterium tuberculosis H37Rv
gcgacgucaggguaucc

SEQ ID NO: 3282562 - RNA, 19 nt, Mycobacterium tuberculosis H37Rv
gcgacgucaggguauccac

SEQ ID NO: 3282563 - RNA, 16 nt, Mycobacterium tuberculosis H37Rv
gcgacguccaccagcc

SEQ ID NO: 3282564 - RNA, 18 nt, Mycobacterium tuberculosis H37Rv
gcgacguccaccagccgg

SEQ ID NO: 3282565 - RNA, 20 nt, Mycobacterium tuberculosis H37Rv
gcgacgucgcuagaucccag

SEQ ID NO: 3282566 - RNA, 16 nt, Mycobacterium tuberculosis H37Rv
gcgacgucggcgguga

SEQ ID NO: 3282567 - RNA, 20 nt, Mycobacterium tuberculosis H37Rv
gcgacgucucgcaugcucac

SEQ ID NO: 3282568 - RNA, 23 nt, Mycobacterium tuberculosis H37Rv
gcgacgucucgcaugcucacgau

SEQ ID NO: 3282569 - RNA, 19 nt, Mycobacterium tuberculosis H37Rv
gcgacgucugccaggcgca

SEQ ID NO: 3282570 - RNA, 15 nt, Mycobacterium tuberculosis H37Rv
gcgacguggcgccga

SEQ ID NO: 3282571 - RNA, 18 nt, Mycobacterium tuberculosis H37Rv
gcgacguugaacucgagu

SEQ ID NO: 3282572 - RNA, 17 nt, Mycobacterium tuberculosis H37Rv
gcgacguuggcgggagc

SEQ ID NO: 3282573 - RNA, 23 nt, Mycobacterium tuberculosis H37Rv
gcgacguugguugcguccgccga

SEQ ID NO: 3282574 - RNA, 19 nt, Mycobacterium tuberculosis H37Rv
gcgacuaagggcacuccac

SEQ ID NO: 3282575 - RNA, 16 nt, Mycobacterium tuberculosis H37Rv
gcgacuaccaucgccg

SEQ ID NO: 3282576 - RNA, 21 nt, Mycobacterium tuberculosis H37Rv
gcgacuacggccucgcugggc

SEQ ID NO: 3282577 - RNA, 16 nt, Mycobacterium tuberculosis H37Rv
gcgacuccaccccacc

SEQ ID NO: 3282578 - RNA, 12 nt, Mycobacterium tuberculosis H37Rv
gcgacuccagcg

SEQ ID NO: 3282579 - RNA, 14 nt, Mycobacterium tuberculosis H37Rv
gcgacucgccggcg

SEQ ID NO: 3282580 - RNA, 21 nt, Mycobacterium tuberculosis H37Rv
gcgacucgccggcgaauccgc

SEQ ID NO: 3282581 - RNA, 13 nt, Mycobacterium tuberculosis H37Rv
gcgacucggugcg

SEQ ID NO: 3282582 - RNA, 17 nt, Mycobacterium tuberculosis H37Rv
gcgacucgugucugccu

SEQ ID NO: 3282583 - RNA, 18 nt, Mycobacterium tuberculosis H37Rv
gcgacucugcgucugcuc

SEQ ID NO: 3282584 - RNA, 20 nt, Mycobacterium tuberculosis H37Rv
gcgacucugcgucugcucac

SEQ ID NO: 3282585 - RNA, 22 nt, Mycobacterium tuberculosis H37Rv
gcgacucugcgucugcucacca

SEQ ID NO: 3282586 - RNA, 14 nt, Mycobacterium tuberculosis H37Rv
gcgacugagaucgc

SEQ ID NO: 3282587 - RNA, 13 nt, Mycobacterium tuberculosis H37Rv
gcgacugcgcacc

SEQ ID NO: 3282588 - RNA, 15 nt, Mycobacterium tuberculosis H37Rv
gcgacugcucgccgg

SEQ ID NO: 3282589 - RNA, 21 nt, Mycobacterium tuberculosis H37Rv
gcgacuggaccgauuucgccu

SEQ ID NO: 3282590 - RNA, 15 nt, Mycobacterium tuberculosis H37Rv
gcgacugucuggucg

SEQ ID NO: 3282591 - RNA, 20 nt, Mycobacterium tuberculosis H37Rv
gcgacugugaaucucacgac

SEQ ID NO: 3282592 - RNA, 16 nt, Mycobacterium tuberculosis H37Rv
gcgacuucaucuucga

SEQ ID NO: 3282593 - RNA, 17 nt, Mycobacterium tuberculosis H37Rv
gcgacuuggcaucgcga

SEQ ID NO: 3282594 - RNA, 19 nt, Mycobacterium tuberculosis H37Rv
gcgacuuggcaucgcgagc

SEQ ID NO: 3282595 - RNA, 15 nt, Mycobacterium tuberculosis H37Rv
gcgacuuucugcgcg

SEQ ID NO: 3282596 - RNA, 18 nt, Mycobacterium tuberculosis H37Rv
gcgacuuucugcgcgugg

SEQ ID NO: 3282597 - RNA, 18 nt, Mycobacterium tuberculosis H37Rv
gcgagaacccacgcaugc

SEQ ID NO: 3282598 - RNA, 15 nt, Mycobacterium tuberculosis H37Rv
gcgagaacccgagcg

SEQ ID NO: 3282599 - RNA, 13 nt, Mycobacterium tuberculosis H37Rv
gcgagaagcaggg

SEQ ID NO: 3282600 - RNA, 15 nt, Mycobacterium tuberculosis H37Rv
gcgagaaggugcugc

SEQ ID NO: 3282601 - RNA, 17 nt, Mycobacterium tuberculosis H37Rv
gcgagggcacggcggug

SEQ ID NO: 3282602 - RNA, 21 nt, Mycobacterium tuberculosis H37Rv
gcgagggccaguguugcggac

SEQ ID NO: 3282603 - RNA, 23 nt, Mycobacterium tuberculosis H37Rv
gcgagggcuaccggcgccgcgcg

SEQ ID NO: 3282604 - RNA, 14 nt, Mycobacterium tuberculosis H37Rv
gcgaggggccggcu

SEQ ID NO: 3282605 - RNA, 18 nt, Mycobacterium tuberculosis H37Rv
gcgagguaagcgagucga

SEQ ID NO: 3282606 - RNA, 21 nt, Mycobacterium tuberculosis H37Rv
gcgagguaagcgagucgacga

SEQ ID NO: 3282607 - RNA, 20 nt, Mycobacterium tuberculosis H37Rv
gcgagguauaaacgcggcgc

SEQ ID NO: 3282608 - RNA, 13 nt, Mycobacterium tuberculosis H37Rv
gcgaggucagaga

SEQ ID NO: 3282609 - RNA, 18 nt, Mycobacterium tuberculosis H37Rv
gcgaggugccgggguggc

SEQ ID NO: 3282610 - RNA, 20 nt, Mycobacterium tuberculosis H37Rv
gcgaggugcucggaucggcu

SEQ ID NO: 3282611 - RNA, 21 nt, Mycobacterium tuberculosis H37Rv
gcgagguugaccaccagcgug

SEQ ID NO: 3282612 - RNA, 19 nt, Mycobacterium tuberculosis H37Rv
gcgaguagcugacccgcgg

SEQ ID NO: 3282613 - RNA, 13 nt, Mycobacterium tuberculosis H37Rv
gcgaguccagcgc

SEQ ID NO: 3282614 - RNA, 18 nt, Mycobacterium tuberculosis H37Rv
gcgaguccaggcugaucc

SEQ ID NO: 3282615 - RNA, 14 nt, Mycobacterium tuberculosis H37Rv
gcgagucccggcgg

SEQ ID NO: 3282616 - RNA, 21 nt, Mycobacterium tuberculosis H37Rv
gcgaguccucgagugccgccg

SEQ ID NO: 3282617 - RNA, 14 nt, Mycobacterium tuberculosis H37Rv
gcgagucgacgaac

SEQ ID NO: 3282618 - RNA, 16 nt, Mycobacterium tuberculosis H37Rv
gcgagucggcggggcg

SEQ ID NO: 3282619 - RNA, 13 nt, Mycobacterium tuberculosis H37Rv
gcgagucgggggc

SEQ ID NO: 3282620 - RNA, 15 nt, Mycobacterium tuberculosis H37Rv
gcgagucgucgccaa

SEQ ID NO: 3282621 - RNA, 19 nt, Mycobacterium tuberculosis H37Rv
gcgagugcggcacgaucgc

SEQ ID NO: 3282622 - RNA, 21 nt, Mycobacterium tuberculosis H37Rv
gcgagugucuuagccagcagc

SEQ ID NO: 3282623 - RNA, 18 nt, Mycobacterium tuberculosis H37Rv
gcgaguuaggccgccagc

SEQ ID NO: 3282624 - RNA, 19 nt, Mycobacterium tuberculosis H37Rv
gcgaguuaggccgccagcc

SEQ ID NO: 3282625 - RNA, 21 nt, Mycobacterium tuberculosis H37Rv
gcgaguuaggccgccagccgg

SEQ ID NO: 3282626 - RNA, 22 nt, Mycobacterium tuberculosis H37Rv
gcgaguuggccguggcgaauga

SEQ ID NO: 3282627 - RNA, 18 nt, Mycobacterium tuberculosis H37Rv
gcgaguuucugcucgacc

SEQ ID NO: 3282628 - RNA, 20 nt, Mycobacterium tuberculosis H37Rv
gcgaguuucugcucgaccgu

SEQ ID NO: 3282629 - RNA, 20 nt, Mycobacterium tuberculosis H37Rv
gcgauaacuccgcggcgaac

SEQ ID NO: 3282630 - RNA, 16 nt, Mycobacterium tuberculosis H37Rv
gcgauacagacgggga

SEQ ID NO: 3282631 - RNA, 18 nt, Mycobacterium tuberculosis H37Rv
gcgauacagacggggauc

SEQ ID NO: 3282632 - RNA, 16 nt, Mycobacterium tuberculosis H37Rv
gcgauacagcgacagg

SEQ ID NO: 3282633 - RNA, 14 nt, Mycobacterium tuberculosis H37Rv
gcgauacccaccgu

SEQ ID NO: 3282634 - RNA, 16 nt, Mycobacterium tuberculosis H37Rv
gcgauaccgaggaucu

SEQ ID NO: 3282635 - RNA, 15 nt, Mycobacterium tuberculosis H37Rv
gcgauaggugcucgc

SEQ ID NO: 3282636 - RNA, 18 nt, Mycobacterium tuberculosis H37Rv
gcgauaguugccgaggcg

SEQ ID NO: 3282637 - RNA, 21 nt, Mycobacterium tuberculosis H37Rv
gcgauauccacaauccgcucg

SEQ ID NO: 3282638 - RNA, 22 nt, Mycobacterium tuberculosis H37Rv
gcgauauccacaauccgcucgg

SEQ ID NO: 3282639 - RNA, 13 nt, Mycobacterium tuberculosis H37Rv
gcgauaucgcaca

SEQ ID NO: 3282640 - RNA, 19 nt, Mycobacterium tuberculosis H37Rv
gcgaucaaccgcugucacc

SEQ ID NO: 3282641 - RNA, 20 nt, Mycobacterium tuberculosis H37Rv
gcgaucaaugcgaugcgguc

SEQ ID NO: 3282642 - RNA, 13 nt, Mycobacterium tuberculosis H37Rv
gcgaucaccaccg

SEQ ID NO: 3282643 - RNA, 18 nt, Mycobacterium tuberculosis H37Rv
gcgaucaccaugugcucc

SEQ ID NO: 3282644 - RNA, 18 nt, Mycobacterium tuberculosis H37Rv
gcgaucacccccuggacu

SEQ ID NO: 3282645 - RNA, 22 nt, Mycobacterium tuberculosis H37Rv
gcgaucaccgcgccggagaucg

SEQ ID NO: 3282646 - RNA, 18 nt, Mycobacterium tuberculosis H37Rv
gcgaucaccguuuggucc

SEQ ID NO: 3282647 - RNA, 19 nt, Mycobacterium tuberculosis H37Rv
gcgaucagcagccgccgau

SEQ ID NO: 3282648 - RNA, 21 nt, Mycobacterium tuberculosis H37Rv
gcgaucagcagccgccgauga

SEQ ID NO: 3282649 - RNA, 15 nt, Mycobacterium tuberculosis H37Rv
gcgaucagcgcgcac

SEQ ID NO: 3282650 - RNA, 16 nt, Mycobacterium tuberculosis H37Rv
gcgaucaggcgcucga

SEQ ID NO: 3282651 - RNA, 20 nt, Mycobacterium tuberculosis H37Rv
gcgaucaggcggacgggacg

SEQ ID NO: 3282652 - RNA, 14 nt, Mycobacterium tuberculosis H37Rv
gcgaucaggcugcc

SEQ ID NO: 3282653 - RNA, 16 nt, Mycobacterium tuberculosis H37Rv
gcgaucaggcugccgc

SEQ ID NO: 3282654 - RNA, 16 nt, Mycobacterium tuberculosis H37Rv
gcgaucaucaggugcg

SEQ ID NO: 3282655 - RNA, 22 nt, Mycobacterium tuberculosis H37Rv
gcgaucaucaggugcgccuggc

SEQ ID NO: 3282656 - RNA, 21 nt, Mycobacterium tuberculosis H37Rv
gcgaucaugguggggaccgcg

SEQ ID NO: 3282657 - RNA, 19 nt, Mycobacterium tuberculosis H37Rv
gcgauccacuccggcgauc

SEQ ID NO: 3282658 - RNA, 19 nt, Mycobacterium tuberculosis H37Rv
gcgauccccaacacccggc

SEQ ID NO: 3282659 - RNA, 15 nt, Mycobacterium tuberculosis H37Rv
gcgauccccagcacc

SEQ ID NO: 3282660 - RNA, 18 nt, Mycobacterium tuberculosis H37Rv
gcgauccccagcaccacg

SEQ ID NO: 3282661 - RNA, 14 nt, Mycobacterium tuberculosis H37Rv
gcgauccccgacgu

SEQ ID NO: 3282662 - RNA, 20 nt, Mycobacterium tuberculosis H37Rv
gcgaucccgaucgcgcuggg

SEQ ID NO: 3282663 - RNA, 15 nt, Mycobacterium tuberculosis H37Rv
gcgaucccggcaaca

SEQ ID NO: 3282664 - RNA, 20 nt, Mycobacterium tuberculosis H37Rv
gcgauccgagaccgcgugcu

SEQ ID NO: 3282665 - RNA, 16 nt, Mycobacterium tuberculosis H37Rv
gcgauccggggcuggc

SEQ ID NO: 3282666 - RNA, 16 nt, Mycobacterium tuberculosis H37Rv
gcgauccggucggcca

SEQ ID NO: 3282667 - RNA, 19 nt, Mycobacterium tuberculosis H37Rv
gcgauccggucggccaggc

SEQ ID NO: 3282668 - RNA, 20 nt, Mycobacterium tuberculosis H37Rv
gcgauccggucggccaggcc

SEQ ID NO: 3282669 - RNA, 15 nt, Mycobacterium tuberculosis H37Rv
gcgauccggucgggg

SEQ ID NO: 3282670 - RNA, 14 nt, Mycobacterium tuberculosis H37Rv
gcgauccucgccgg

SEQ ID NO: 3282671 - RNA, 15 nt, Mycobacterium tuberculosis H37Rv
gcgauccugaccagc

SEQ ID NO: 3282672 - RNA, 17 nt, Mycobacterium tuberculosis H37Rv
gcgaucgacgcucggcu

SEQ ID NO: 3282673 - RNA, 18 nt, Mycobacterium tuberculosis H37Rv
gcgaucgauuccgcucgu

SEQ ID NO: 3282674 - RNA, 24 nt, Mycobacterium tuberculosis H37Rv
gcgaucgauuccgcucguucgugc

SEQ ID NO: 3282675 - RNA, 21 nt, Mycobacterium tuberculosis H37Rv
gcgaucgcagugagcagccgg

SEQ ID NO: 3282676 - RNA, 22 nt, Mycobacterium tuberculosis H37Rv
gcgaucgcagugagcagccgga

SEQ ID NO: 3282677 - RNA, 16 nt, Mycobacterium tuberculosis H37Rv
gcgaucgcauccgcgg

SEQ ID NO: 3282678 - RNA, 17 nt, Mycobacterium tuberculosis H37Rv
gcgaucgccgcacagcg

SEQ ID NO: 3282679 - RNA, 18 nt, Mycobacterium tuberculosis H37Rv
gcgaucgccgcgcugguc

SEQ ID NO: 3282680 - RNA, 14 nt, Mycobacterium tuberculosis H37Rv
gcgaucgccggccg

SEQ ID NO: 3282681 - RNA, 22 nt, Mycobacterium tuberculosis H37Rv
gcgaucgccggccgcgugacgu

SEQ ID NO: 3282682 - RNA, 21 nt, Mycobacterium tuberculosis H37Rv
gcgaucgcgacacggccaucc

SEQ ID NO: 3282683 - RNA, 16 nt, Mycobacterium tuberculosis H37Rv
gcgaucgcgagcgagc

SEQ ID NO: 3282684 - RNA, 17 nt, Mycobacterium tuberculosis H37Rv
gcgaucgcguccuccuc

SEQ ID NO: 3282685 - RNA, 20 nt, Mycobacterium tuberculosis H37Rv
gcgaucggcacuuagcccga

SEQ ID NO: 3282686 - RNA, 23 nt, Mycobacterium tuberculosis H37Rv
gcgaucggcacuuagcccgaugg

SEQ ID NO: 3282687 - RNA, 13 nt, Mycobacterium tuberculosis H37Rv
gcgaucggcaugu

SEQ ID NO: 3282688 - RNA, 15 nt, Mycobacterium tuberculosis H37Rv
gcgaucggugaaucg

SEQ ID NO: 3282689 - RNA, 14 nt, Mycobacterium tuberculosis H37Rv
gcgaucgucaagcc

SEQ ID NO: 3282690 - RNA, 17 nt, Mycobacterium tuberculosis H37Rv
gcgaucgucacggaggc

SEQ ID NO: 3282691 - RNA, 20 nt, Mycobacterium tuberculosis H37Rv
gcgaucgucucggugaucuc

SEQ ID NO: 3282692 - RNA, 15 nt, Mycobacterium tuberculosis H37Rv
gcgaucgugccgggc

SEQ ID NO: 3282693 - RNA, 16 nt, Mycobacterium tuberculosis H37Rv
gcgaucgugccgggcc

SEQ ID NO: 3282694 - RNA, 20 nt, Mycobacterium tuberculosis H37Rv
gcgaucgugcggaaaccgcu

SEQ ID NO: 3282695 - RNA, 16 nt, Mycobacterium tuberculosis H37Rv
gcgaucucaccuggag

SEQ ID NO: 3282696 - RNA, 18 nt, Mycobacterium tuberculosis H37Rv
gcgaucucaccuggagcu

SEQ ID NO: 3282697 - RNA, 16 nt, Mycobacterium tuberculosis H37Rv
gcgcacagcgagcaca

SEQ ID NO: 3282698 - RNA, 15 nt, Mycobacterium tuberculosis H37Rv
gcgcacaguucgccg

SEQ ID NO: 3282699 - RNA, 17 nt, Mycobacterium tuberculosis H37Rv
gcgcacaguucgccgga

SEQ ID NO: 3282700 - RNA, 21 nt, Mycobacterium tuberculosis H37Rv
gcgcacaugguuuucaguagg

SEQ ID NO: 3282701 - RNA, 14 nt, Mycobacterium tuberculosis H37Rv
gcgcaccaccgagc

SEQ ID NO: 3282702 - RNA, 18 nt, Mycobacterium tuberculosis H37Rv
gcgcaccaccgcggcggc

SEQ ID NO: 3282703 - RNA, 17 nt, Mycobacterium tuberculosis H37Rv
gcgcaccaggcggccgu

SEQ ID NO: 3282704 - RNA, 19 nt, Mycobacterium tuberculosis H37Rv
gcgcaccaguccagcgggc

SEQ ID NO: 3282705 - RNA, 16 nt, Mycobacterium tuberculosis H37Rv
gcgcaccaucgcggcc

SEQ ID NO: 3282706 - RNA, 16 nt, Mycobacterium tuberculosis H37Rv
gcgcacccagcccagc

SEQ ID NO: 3282707 - RNA, 15 nt, Mycobacterium tuberculosis H37Rv
gcgcacccgcggguc

SEQ ID NO: 3282708 - RNA, 22 nt, Mycobacterium tuberculosis H37Rv
gcgcacccgcgggucguccggc

SEQ ID NO: 3282709 - RNA, 15 nt, Mycobacterium tuberculosis H37Rv
gcgcacccggucggc

SEQ ID NO: 3282710 - RNA, 20 nt, Mycobacterium tuberculosis H37Rv
gcgcacccggucggcggcau

SEQ ID NO: 3282711 - RNA, 18 nt, Mycobacterium tuberculosis H37Rv
gcgcacccguccgccgca

SEQ ID NO: 3282712 - RNA, 18 nt, Mycobacterium tuberculosis H37Rv
gcgcacccugcgugcggc

SEQ ID NO: 3282713 - RNA, 17 nt, Mycobacterium tuberculosis H37Rv
gcgcaccgaccgcaccg

SEQ ID NO: 3282714 - RNA, 22 nt, Mycobacterium tuberculosis H37Rv
gcgcaccgccgauguggucggc

SEQ ID NO: 3282715 - RNA, 20 nt, Mycobacterium tuberculosis H37Rv
gcgcaccggcguucaccugc

SEQ ID NO: 3282716 - RNA, 20 nt, Mycobacterium tuberculosis H37Rv
gcgcaccggcuggcccagcg

SEQ ID NO: 3282717 - RNA, 21 nt, Mycobacterium tuberculosis H37Rv
gcgcaccggguugagccgccg

SEQ ID NO: 3282718 - RNA, 23 nt, Mycobacterium tuberculosis H37Rv
gcgcaccgguauguucggcaaug

SEQ ID NO: 3282719 - RNA, 15 nt, Mycobacterium tuberculosis H37Rv
gcgcaccggucaacg

SEQ ID NO: 3282720 - RNA, 20 nt, Mycobacterium tuberculosis H37Rv
gcgcaccggucaacguggau

SEQ ID NO: 3282721 - RNA, 19 nt, Mycobacterium tuberculosis H37Rv
gcgcaccuccugcgagugc

SEQ ID NO: 3282722 - RNA, 17 nt, Mycobacterium tuberculosis H37Rv
gcgcaccucggcgaagu

SEQ ID NO: 3282723 - RNA, 17 nt, Mycobacterium tuberculosis H37Rv
gcgcaccugggcugccg

SEQ ID NO: 3282724 - RNA, 18 nt, Mycobacterium tuberculosis H37Rv
gcgcaccuugaccgucgc

SEQ ID NO: 3282725 - RNA, 13 nt, Mycobacterium tuberculosis H37Rv
gcgcacgaaaccg

SEQ ID NO: 3282726 - RNA, 21 nt, Mycobacterium tuberculosis H37Rv
gcgcacgaaaccgcagcgcga

SEQ ID NO: 3282727 - RNA, 13 nt, Mycobacterium tuberculosis H37Rv
gcgcacgacagga

SEQ ID NO: 3282728 - RNA, 18 nt, Mycobacterium tuberculosis H37Rv
gcgcacgccaccgggacg

SEQ ID NO: 3282729 - RNA, 14 nt, Mycobacterium tuberculosis H37Rv
gcgcacgcccgcac

SEQ ID NO: 3282730 - RNA, 23 nt, Mycobacterium tuberculosis H37Rv
gcgcacgcucaguuuggccuggu

SEQ ID NO: 3282731 - RNA, 19 nt, Mycobacterium tuberculosis H37Rv
gcgcacggaccaucgccag

SEQ ID NO: 3282732 - RNA, 15 nt, Mycobacterium tuberculosis H37Rv
gcgcacggcgucggc

SEQ ID NO: 3282733 - RNA, 22 nt, Mycobacterium tuberculosis H37Rv
gcgcacggcgucggccaccgcc

SEQ ID NO: 3282734 - RNA, 14 nt, Mycobacterium tuberculosis H37Rv
gcgcacgucgacga

SEQ ID NO: 3282735 - RNA, 21 nt, Mycobacterium tuberculosis H37Rv
gcgcacucccggcucggccag

SEQ ID NO: 3282736 - RNA, 12 nt, Mycobacterium tuberculosis H37Rv
gcgcacucuagc

SEQ ID NO: 3282737 - RNA, 23 nt, Mycobacterium tuberculosis H37Rv
gcgcacucuuuccuuccgcgaug

SEQ ID NO: 3282738 - RNA, 23 nt, Mycobacterium tuberculosis H37Rv
gcgcacugaaauggcgugcucga

SEQ ID NO: 3282739 - RNA, 22 nt, Mycobacterium tuberculosis H37Rv
gcgcagaaagucgcgcgcgaac

SEQ ID NO: 3282740 - RNA, 15 nt, Mycobacterium tuberculosis H37Rv
gcgcagaacgaucgc

SEQ ID NO: 3282741 - RNA, 16 nt, Mycobacterium tuberculosis H37Rv
gcgcagaacgaucgcg

SEQ ID NO: 3282742 - RNA, 14 nt, Mycobacterium tuberculosis H37Rv
gcgcagacucgcca

SEQ ID NO: 3282743 - RNA, 16 nt, Mycobacterium tuberculosis H37Rv
gcgcagacucgccacc

SEQ ID NO: 3282744 - RNA, 22 nt, Mycobacterium tuberculosis H37Rv
gcgcagacucgccaccgcggcg

SEQ ID NO: 3282745 - RNA, 15 nt, Mycobacterium tuberculosis H37Rv
gcgcagauacgcgug

SEQ ID NO: 3282746 - RNA, 17 nt, Mycobacterium tuberculosis H37Rv
gcgcagauagcgcucga

SEQ ID NO: 3282747 - RNA, 15 nt, Mycobacterium tuberculosis H37Rv
gcgcagaucguccac

SEQ ID NO: 3282748 - RNA, 19 nt, Mycobacterium tuberculosis H37Rv
gcgcagaucguccaccgcc

SEQ ID NO: 3282749 - RNA, 21 nt, Mycobacterium tuberculosis H37Rv
gcgcagaucguccaccgccga

SEQ ID NO: 3282750 - RNA, 19 nt, Mycobacterium tuberculosis H37Rv
gcgcagaugagcgcggcga

SEQ ID NO: 3282751 - RNA, 20 nt, Mycobacterium tuberculosis H37Rv
gcgcagaugagcgcggcgac

SEQ ID NO: 3282752 - RNA, 23 nt, Mycobacterium tuberculosis H37Rv
gcgcagauuccucuucaggcccu

SEQ ID NO: 3282753 - RNA, 19 nt, Mycobacterium tuberculosis H37Rv
gcgcagauuugcuccagcg

SEQ ID NO: 3282754 - RNA, 19 nt, Mycobacterium tuberculosis H37Rv
gcgcagcaacugggcggcc

SEQ ID NO: 3282755 - RNA, 21 nt, Mycobacterium tuberculosis H37Rv
gcgcagcaacugggcggccug

SEQ ID NO: 3282756 - RNA, 19 nt, Mycobacterium tuberculosis H37Rv
gcgcagcacauccugcagc

SEQ ID NO: 3282757 - RNA, 13 nt, Mycobacterium tuberculosis H37Rv
gcgcagcaccagg

SEQ ID NO: 3282758 - RNA, 17 nt, Mycobacterium tuberculosis H37Rv
gcgcagcaccagggugg

SEQ ID NO: 3282759 - RNA, 18 nt, Mycobacterium tuberculosis H37Rv
gcgcagcaccaggguggc

SEQ ID NO: 3282760 - RNA, 11 nt, Mycobacterium tuberculosis H37Rv
gcgcagcagcg

SEQ ID NO: 3282761 - RNA, 13 nt, Mycobacterium tuberculosis H37Rv
gcgcagcagcggc

SEQ ID NO: 3282762 - RNA, 22 nt, Mycobacterium tuberculosis H37Rv
gcgcagcaguuggucgcggucc

SEQ ID NO: 3282763 - RNA, 14 nt, Mycobacterium tuberculosis H37Rv
gcgcagcaucggcg

SEQ ID NO: 3282764 - RNA, 15 nt, Mycobacterium tuberculosis H37Rv
gcgcagcaucggcga

SEQ ID NO: 3282765 - RNA, 14 nt, Mycobacterium tuberculosis H37Rv
gcgcagccaggcug

SEQ ID NO: 3282766 - RNA, 14 nt, Mycobacterium tuberculosis H37Rv
gcgcagccgcucga

SEQ ID NO: 3282767 - RNA, 19 nt, Mycobacterium tuberculosis H37Rv
gcgcagccgcucgacggcc

SEQ ID NO: 3282768 - RNA, 21 nt, Mycobacterium tuberculosis H37Rv
gcgcagccgggucuacagcgu

SEQ ID NO: 3282769 - RNA, 15 nt, Mycobacterium tuberculosis H37Rv
gcgcagccugcagcg

SEQ ID NO: 3282770 - RNA, 20 nt, Mycobacterium tuberculosis H37Rv
gcgcagccuucucgcugacc

SEQ ID NO: 3282771 - RNA, 16 nt, Mycobacterium tuberculosis H37Rv
gcgcagcgacgcggug

SEQ ID NO: 3282772 - RNA, 20 nt, Mycobacterium tuberculosis H37Rv
gcgcagcgauucgccuagcg

SEQ ID NO: 3282773 - RNA, 15 nt, Mycobacterium tuberculosis H37Rv
gcgcagcgcaaacau

SEQ ID NO: 3282774 - RNA, 13 nt, Mycobacterium tuberculosis H37Rv
gcgcagcgccagc

SEQ ID NO: 3282775 - RNA, 14 nt, Mycobacterium tuberculosis H37Rv
gcgcagcgccagcg

SEQ ID NO: 3282776 - RNA, 16 nt, Mycobacterium tuberculosis H37Rv
gcgcagcgccggcagc

SEQ ID NO: 3282777 - RNA, 18 nt, Mycobacterium tuberculosis H37Rv
gcgcagcgccggcagcag

SEQ ID NO: 3282778 - RNA, 13 nt, Mycobacterium tuberculosis H37Rv
gcgcagcgccucc

SEQ ID NO: 3282779 - RNA, 12 nt, Mycobacterium tuberculosis H37Rv
gcgcagcgcggc

SEQ ID NO: 3282780 - RNA, 13 nt, Mycobacterium tuberculosis H37Rv
gcgcagcggacgg

SEQ ID NO: 3282781 - RNA, 14 nt, Mycobacterium tuberculosis H37Rv
gcgcagcgugagug

SEQ ID NO: 3282782 - RNA, 19 nt, Mycobacterium tuberculosis H37Rv
gcgcagcuaugucaccugg

SEQ ID NO: 3282783 - RNA, 20 nt, Mycobacterium tuberculosis H37Rv
gcgcagcugacgucaccacg

SEQ ID NO: 3282784 - RNA, 12 nt, Mycobacterium tuberculosis H37Rv
gcgcagcugccg

SEQ ID NO: 3282785 - RNA, 18 nt, Mycobacterium tuberculosis H37Rv
gcgcagcugccgcacccc

SEQ ID NO: 3282786 - RNA, 19 nt, Mycobacterium tuberculosis H37Rv
gcgcagcugcgggucgugc

SEQ ID NO: 3282787 - RNA, 14 nt, Mycobacterium tuberculosis H37Rv
gcgcagcugggugc

SEQ ID NO: 3282788 - RNA, 21 nt, Mycobacterium tuberculosis H37Rv
gcgcaggaagcccacgaucgc

SEQ ID NO: 3282789 - RNA, 22 nt, Mycobacterium tuberculosis H37Rv
gcgcaggaagcccacgaucgcg

SEQ ID NO: 3282790 - RNA, 21 nt, Mycobacterium tuberculosis H37Rv
gcgcaggauguucaaucccuc

SEQ ID NO: 3282791 - RNA, 23 nt, Mycobacterium tuberculosis H37Rv
gcgcaggauucugcugaccauga

SEQ ID NO: 3282792 - RNA, 20 nt, Mycobacterium tuberculosis H37Rv
gcgcaggcuuccagccacag

SEQ ID NO: 3282793 - RNA, 15 nt, Mycobacterium tuberculosis H37Rv
gcgccaguguggugc

SEQ ID NO: 3282794 - RNA, 19 nt, Mycobacterium tuberculosis H37Rv
gcgccaguucggcgggagc

SEQ ID NO: 3282795 - RNA, 21 nt, Mycobacterium tuberculosis H37Rv
gcgccaguucggcgggagcug

SEQ ID NO: 3282796 - RNA, 22 nt, Mycobacterium tuberculosis H37Rv
gcgccaguucggcgggagcugc

SEQ ID NO: 3282797 - RNA, 17 nt, Mycobacterium tuberculosis H37Rv
gcgccaguucggcgggc

SEQ ID NO: 3282798 - RNA, 20 nt, Mycobacterium tuberculosis H37Rv
gcgccaguucggcgggcgcg

SEQ ID NO: 3282799 - RNA, 21 nt, Mycobacterium tuberculosis H37Rv
gcgccauaauauugccgccuc

SEQ ID NO: 3282800 - RNA, 16 nt, Mycobacterium tuberculosis H37Rv
gcgccauagccgcgac

SEQ ID NO: 3282801 - RNA, 19 nt, Mycobacterium tuberculosis H37Rv
gcgccauagccgcgacccg

SEQ ID NO: 3282802 - RNA, 21 nt, Mycobacterium tuberculosis H37Rv
gcgccauauugauuccgaccc

SEQ ID NO: 3282803 - RNA, 18 nt, Mycobacterium tuberculosis H37Rv
gcgccaucgccuccagcc

SEQ ID NO: 3282804 - RNA, 20 nt, Mycobacterium tuberculosis H37Rv
gcgccaucgggucacccccg

SEQ ID NO: 3282805 - RNA, 15 nt, Mycobacterium tuberculosis H37Rv
gcgccaugaagccgg

SEQ ID NO: 3282806 - RNA, 18 nt, Mycobacterium tuberculosis H37Rv
gcgccaugaagccgggcg

SEQ ID NO: 3282807 - RNA, 15 nt, Mycobacterium tuberculosis H37Rv
gcgccaugcgccaac

SEQ ID NO: 3282808 - RNA, 19 nt, Mycobacterium tuberculosis H37Rv
gcgccauggaucccacgag

SEQ ID NO: 3282809 - RNA, 21 nt, Mycobacterium tuberculosis H37Rv
gcgccauggaucccacgaguu

SEQ ID NO: 3282810 - RNA, 15 nt, Mycobacterium tuberculosis H37Rv
gcgccauuccaagac

SEQ ID NO: 3282811 - RNA, 16 nt, Mycobacterium tuberculosis H37Rv
gcgccauucgcccggc

SEQ ID NO: 3282812 - RNA, 22 nt, Mycobacterium tuberculosis H37Rv
gcgccauucgcccggccgcagc

SEQ ID NO: 3282813 - RNA, 20 nt, Mycobacterium tuberculosis H37Rv
gcgccauugcgggaacguca

SEQ ID NO: 3282814 - RNA, 19 nt, Mycobacterium tuberculosis H37Rv
gcgcccaacgcgggugccg

SEQ ID NO: 3282815 - RNA, 18 nt, Mycobacterium tuberculosis H37Rv
gcgcccacagcccgggcg

SEQ ID NO: 3282816 - RNA, 24 nt, Mycobacterium tuberculosis H37Rv
gcgcccacaucgucggcgggcggc

SEQ ID NO: 3282817 - RNA, 22 nt, Mycobacterium tuberculosis H37Rv
gcgcccaccaugaucacaccga

SEQ ID NO: 3282818 - RNA, 14 nt, Mycobacterium tuberculosis H37Rv
gcgcccaccccggc

SEQ ID NO: 3282819 - RNA, 14 nt, Mycobacterium tuberculosis H37Rv
gcgcccaccgaaac

SEQ ID NO: 3282820 - RNA, 17 nt, Mycobacterium tuberculosis H37Rv
gcgcccaccgggcggcg

SEQ ID NO: 3282821 - RNA, 22 nt, Mycobacterium tuberculosis H37Rv
gcgcccacuggugaucuggucc

SEQ ID NO: 3282822 - RNA, 16 nt, Mycobacterium tuberculosis H37Rv
gcgcccagaucgccga

SEQ ID NO: 3282823 - RNA, 20 nt, Mycobacterium tuberculosis H37Rv
gcgcccagcacguaacccag

SEQ ID NO: 3282824 - RNA, 14 nt, Mycobacterium tuberculosis H37Rv
gcgcccagcgaccc

SEQ ID NO: 3282825 - RNA, 13 nt, Mycobacterium tuberculosis H37Rv
gcgcccagcucga

SEQ ID NO: 3282826 - RNA, 23 nt, Mycobacterium tuberculosis H37Rv
gcgcccaggccgaucagcgcggc

SEQ ID NO: 3282827 - RNA, 18 nt, Mycobacterium tuberculosis H37Rv
gcgcccauagcugccggc

SEQ ID NO: 3282828 - RNA, 20 nt, Mycobacterium tuberculosis H37Rv
gcgcccauagcugccggccc

SEQ ID NO: 3282829 - RNA, 13 nt, Mycobacterium tuberculosis H37Rv
gcgccccaccgcg

SEQ ID NO: 3282830 - RNA, 22 nt, Mycobacterium tuberculosis H37Rv
gcgccccaccggcccgggaaau

SEQ ID NO: 3282831 - RNA, 22 nt, Mycobacterium tuberculosis H37Rv
gcgccccaguucgacggcguca

SEQ ID NO: 3282832 - RNA, 22 nt, Mycobacterium tuberculosis H37Rv
gcgccccaugcaacacaccgcg

SEQ ID NO: 3282833 - RNA, 18 nt, Mycobacterium tuberculosis H37Rv
gcgcccccagcagcugcg

SEQ ID NO: 3282834 - RNA, 21 nt, Mycobacterium tuberculosis H37Rv
gcgcccccgacgacggcaccg

SEQ ID NO: 3282835 - RNA, 18 nt, Mycobacterium tuberculosis H37Rv
gcgcccgaaccccgggcg

SEQ ID NO: 3282836 - RNA, 20 nt, Mycobacterium tuberculosis H37Rv
gcgcccgaaccccgggcggc

SEQ ID NO: 3282837 - RNA, 17 nt, Mycobacterium tuberculosis H37Rv
gcgcccgaagccgggcc

SEQ ID NO: 3282838 - RNA, 20 nt, Mycobacterium tuberculosis H37Rv
gcgcccgaagccgggcccca

SEQ ID NO: 3282839 - RNA, 15 nt, Mycobacterium tuberculosis H37Rv
gcgcccgacggaguu

SEQ ID NO: 3282840 - RNA, 18 nt, Mycobacterium tuberculosis H37Rv
gcgcccgacggaguucga

SEQ ID NO: 3282841 - RNA, 14 nt, Mycobacterium tuberculosis H37Rv
gcgcccgcaccacc

SEQ ID NO: 3282842 - RNA, 15 nt, Mycobacterium tuberculosis H37Rv
gcgcccgccaucagc

SEQ ID NO: 3282843 - RNA, 16 nt, Mycobacterium tuberculosis H37Rv
gcgcccgccaucagcc

SEQ ID NO: 3282844 - RNA, 19 nt, Mycobacterium tuberculosis H37Rv
gcgcccgccaucagcccgg

SEQ ID NO: 3282845 - RNA, 15 nt, Mycobacterium tuberculosis H37Rv
gcgcccgccgcggca

SEQ ID NO: 3282846 - RNA, 12 nt, Mycobacterium tuberculosis H37Rv
gcgcccgccggc

SEQ ID NO: 3282847 - RNA, 18 nt, Mycobacterium tuberculosis H37Rv
gcgcccgccggcaaccgg

SEQ ID NO: 3282848 - RNA, 12 nt, Mycobacterium tuberculosis H37Rv
gcgcccgcgaaa

SEQ ID NO: 3282849 - RNA, 13 nt, Mycobacterium tuberculosis H37Rv
gcgcccgcgagag

SEQ ID NO: 3282850 - RNA, 19 nt, Mycobacterium tuberculosis H37Rv
gcgcccgcgguccggcgaa

SEQ ID NO: 3282851 - RNA, 19 nt, Mycobacterium tuberculosis H37Rv
gcgcccgcuaacuggcccg

SEQ ID NO: 3282852 - RNA, 12 nt, Mycobacterium tuberculosis H37Rv
gcgcccgcucgg

SEQ ID NO: 3282853 - RNA, 22 nt, Mycobacterium tuberculosis H37Rv
gcgcccgcucggccgcagccag

SEQ ID NO: 3282854 - RNA, 19 nt, Mycobacterium tuberculosis H37Rv
gcgcccggauguccgccga

SEQ ID NO: 3282855 - RNA, 14 nt, Mycobacterium tuberculosis H37Rv
gcgcccggccaagc

SEQ ID NO: 3282856 - RNA, 20 nt, Mycobacterium tuberculosis H37Rv
gcgcccggcgcuagcgccgc

SEQ ID NO: 3282857 - RNA, 13 nt, Mycobacterium tuberculosis H37Rv
gcgcccggcugau

SEQ ID NO: 3282858 - RNA, 17 nt, Mycobacterium tuberculosis H37Rv
gcgcccguccgcgcgcc

SEQ ID NO: 3282859 - RNA, 14 nt, Mycobacterium tuberculosis H37Rv
gcgcccgucgcugg

SEQ ID NO: 3282860 - RNA, 17 nt, Mycobacterium tuberculosis H37Rv
gcgcccgucuccagcac

SEQ ID NO: 3282861 - RNA, 13 nt, Mycobacterium tuberculosis H37Rv
gcgcccgugccgc

SEQ ID NO: 3282862 - RNA, 15 nt, Mycobacterium tuberculosis H37Rv
gcgcccgugccgccc

SEQ ID NO: 3282863 - RNA, 24 nt, Mycobacterium tuberculosis H37Rv
gcgcccucagccgcggccacauga

SEQ ID NO: 3282864 - RNA, 13 nt, Mycobacterium tuberculosis H37Rv
gcgcccuccucga

SEQ ID NO: 3282865 - RNA, 21 nt, Mycobacterium tuberculosis H37Rv
gcgcccuccucgaugcccuug

SEQ ID NO: 3282866 - RNA, 16 nt, Mycobacterium tuberculosis H37Rv
gcgcccugagccaccc

SEQ ID NO: 3282867 - RNA, 18 nt, Mycobacterium tuberculosis H37Rv
gcgcccugagccaccccg

SEQ ID NO: 3282868 - RNA, 16 nt, Mycobacterium tuberculosis H37Rv
gcgcccugcgccacac

SEQ ID NO: 3282869 - RNA, 16 nt, Mycobacterium tuberculosis H37Rv
gcgcccuggccgcccu

SEQ ID NO: 3282870 - RNA, 23 nt, Mycobacterium tuberculosis H37Rv
gcgcccuggcgugugugcgccuc

SEQ ID NO: 3282871 - RNA, 18 nt, Mycobacterium tuberculosis H37Rv
gcgcccuuaagccggcgc

SEQ ID NO: 3282872 - RNA, 21 nt, Mycobacterium tuberculosis H37Rv
gcgcccuuaagccggcgcggc

SEQ ID NO: 3282873 - RNA, 17 nt, Mycobacterium tuberculosis H37Rv
gcgccgaaaacaacccg

SEQ ID NO: 3282874 - RNA, 22 nt, Mycobacterium tuberculosis H37Rv
gcgccgaaacagcacccagacg

SEQ ID NO: 3282875 - RNA, 23 nt, Mycobacterium tuberculosis H37Rv
gcgccgaaacagcacccagacga

SEQ ID NO: 3282876 - RNA, 17 nt, Mycobacterium tuberculosis H37Rv
gcgccgaaaccacuucc

SEQ ID NO: 3282877 - RNA, 20 nt, Mycobacterium tuberculosis H37Rv
gcgccgaaaccacuuccggc

SEQ ID NO: 3282878 - RNA, 21 nt, Mycobacterium tuberculosis H37Rv
gcgccgaaacucaagccacgu

SEQ ID NO: 3282879 - RNA, 22 nt, Mycobacterium tuberculosis H37Rv
gcgccgaacaccacaccgagca

SEQ ID NO: 3282880 - RNA, 21 nt, Mycobacterium tuberculosis H37Rv
gcgccgaacaccggcuccagc

SEQ ID NO: 3282881 - RNA, 14 nt, Mycobacterium tuberculosis H37Rv
gcgccgaaccagcg

SEQ ID NO: 3282882 - RNA, 18 nt, Mycobacterium tuberculosis H37Rv
gcgccgaacgccagcagc

SEQ ID NO: 3282883 - RNA, 19 nt, Mycobacterium tuberculosis H37Rv
gcgccgaacgcuccaggcc

SEQ ID NO: 3282884 - RNA, 23 nt, Mycobacterium tuberculosis H37Rv
gcgccgaaguagccgaccggcag

SEQ ID NO: 3282885 - RNA, 18 nt, Mycobacterium tuberculosis H37Rv
gcgccgaaucgcgggcug

SEQ ID NO: 3282886 - RNA, 15 nt, Mycobacterium tuberculosis H37Rv
gcgccgaaugccacc

SEQ ID NO: 3282887 - RNA, 22 nt, Mycobacterium tuberculosis H37Rv
gcgccgaaugccaccucgacgc

SEQ ID NO: 3282888 - RNA, 18 nt, Mycobacterium tuberculosis H37Rv
gcgccgccucgggcaccu

SEQ ID NO: 3282889 - RNA, 20 nt, Mycobacterium tuberculosis H37Rv
gcgccgcgacaaaucggucg

SEQ ID NO: 3282890 - RNA, 21 nt, Mycobacterium tuberculosis H37Rv
gcgccgcgacaaaucggucga

SEQ ID NO: 3282891 - RNA, 16 nt, Mycobacterium tuberculosis H37Rv
gcgccgcgcagcgagg

SEQ ID NO: 3282892 - RNA, 13 nt, Mycobacterium tuberculosis H37Rv
gcgccgcgcccac

SEQ ID NO: 3282893 - RNA, 15 nt, Mycobacterium tuberculosis H37Rv
gcgccgcgcccacca

SEQ ID NO: 3282894 - RNA, 17 nt, Mycobacterium tuberculosis H37Rv
gcgccgcgcccaccaug

SEQ ID NO: 3282895 - RNA, 17 nt, Mycobacterium tuberculosis H37Rv
gcgccgcgccgauucca

SEQ ID NO: 3282896 - RNA, 16 nt, Mycobacterium tuberculosis H37Rv
gcgccgcgccgcgccg

SEQ ID NO: 3282897 - RNA, 13 nt, Mycobacterium tuberculosis H37Rv
gcgccgcgcgcgc

SEQ ID NO: 3282898 - RNA, 13 nt, Mycobacterium tuberculosis H37Rv
gcgccgcgcggcu

SEQ ID NO: 3282899 - RNA, 13 nt, Mycobacterium tuberculosis H37Rv
gcgccgcgcucga

SEQ ID NO: 3282900 - RNA, 18 nt, Mycobacterium tuberculosis H37Rv
gcgccgcgcucgacgagc

SEQ ID NO: 3282901 - RNA, 21 nt, Mycobacterium tuberculosis H37Rv
gcgccgcgcuugcgaucggca

SEQ ID NO: 3282902 - RNA, 22 nt, Mycobacterium tuberculosis H37Rv
gcgccgcgcuugcgaucggcac

SEQ ID NO: 3282903 - RNA, 12 nt, Mycobacterium tuberculosis H37Rv
gcgccgcggccc

SEQ ID NO: 3282904 - RNA, 15 nt, Mycobacterium tuberculosis H37Rv
gcgccgcggcccgcu

SEQ ID NO: 3282905 - RNA, 16 nt, Mycobacterium tuberculosis H37Rv
gcgccgcggcccgcuc

SEQ ID NO: 3282906 - RNA, 18 nt, Mycobacterium tuberculosis H37Rv
gcgccgcggcggauggcg

SEQ ID NO: 3282907 - RNA, 23 nt, Mycobacterium tuberculosis H37Rv
gcgccgcggugacgggaucgucg

SEQ ID NO: 3282908 - RNA, 14 nt, Mycobacterium tuberculosis H37Rv
gcgccgcguggcug

SEQ ID NO: 3282909 - RNA, 21 nt, Mycobacterium tuberculosis H37Rv
gcgccgcguggcuggcggcga

SEQ ID NO: 3282910 - RNA, 15 nt, Mycobacterium tuberculosis H37Rv
gcgccgcugaagcca

SEQ ID NO: 3282911 - RNA, 21 nt, Mycobacterium tuberculosis H37Rv
gcgccgcugacuccugcggca

SEQ ID NO: 3282912 - RNA, 19 nt, Mycobacterium tuberculosis H37Rv
gcgccgcugggugaccagg

SEQ ID NO: 3282913 - RNA, 21 nt, Mycobacterium tuberculosis H37Rv
gcgccgcugggugaccaggaa

SEQ ID NO: 3282914 - RNA, 16 nt, Mycobacterium tuberculosis H37Rv
gcgccgcuggucgugg

SEQ ID NO: 3282915 - RNA, 23 nt, Mycobacterium tuberculosis H37Rv
gcgccggacaaaccgggcggcca

SEQ ID NO: 3282916 - RNA, 14 nt, Mycobacterium tuberculosis H37Rv
gcgccggaccagcu

SEQ ID NO: 3282917 - RNA, 16 nt, Mycobacterium tuberculosis H37Rv
gcgccggaccagcucc

SEQ ID NO: 3282918 - RNA, 20 nt, Mycobacterium tuberculosis H37Rv
gcgccggaguuuccccuacc

SEQ ID NO: 3282919 - RNA, 21 nt, Mycobacterium tuberculosis H37Rv
gcgccggauacaccggcaccg

SEQ ID NO: 3282920 - RNA, 18 nt, Mycobacterium tuberculosis H37Rv
gcgccggauccacaccga

SEQ ID NO: 3282921 - RNA, 23 nt, Mycobacterium tuberculosis H37Rv
gcgccggauggguggccagcaac

SEQ ID NO: 3282922 - RNA, 20 nt, Mycobacterium tuberculosis H37Rv
gcgccggcagacccgggcca

SEQ ID NO: 3282923 - RNA, 14 nt, Mycobacterium tuberculosis H37Rv
gcgccggcagcagc

SEQ ID NO: 3282924 - RNA, 19 nt, Mycobacterium tuberculosis H37Rv
gcgccggccaacagguucc

SEQ ID NO: 3282925 - RNA, 18 nt, Mycobacterium tuberculosis H37Rv
gcgccggccacgagucgc

SEQ ID NO: 3282926 - RNA, 20 nt, Mycobacterium tuberculosis H37Rv
gcgccggccaguucggccuu

SEQ ID NO: 3282927 - RNA, 15 nt, Mycobacterium tuberculosis H37Rv
gcgccggccaugccu

SEQ ID NO: 3282928 - RNA, 16 nt, Mycobacterium tuberculosis H37Rv
gcgccggcccgcagcc

SEQ ID NO: 3282929 - RNA, 23 nt, Mycobacterium tuberculosis H37Rv
gcgccggccgcacgccggccagc

SEQ ID NO: 3282930 - RNA, 14 nt, Mycobacterium tuberculosis H37Rv
gcgccggccgcggc

SEQ ID NO: 3282931 - RNA, 13 nt, Mycobacterium tuberculosis H37Rv
gcgccggccgcug

SEQ ID NO: 3282932 - RNA, 17 nt, Mycobacterium tuberculosis H37Rv
gcgccggccgcugccuu

SEQ ID NO: 3282933 - RNA, 14 nt, Mycobacterium tuberculosis H37Rv
gcgccggccgguca

SEQ ID NO: 3282934 - RNA, 13 nt, Mycobacterium tuberculosis H37Rv
gcgccggcgccuc

SEQ ID NO: 3282935 - RNA, 18 nt, Mycobacterium tuberculosis H37Rv
gcgccggcgcgucggcac

SEQ ID NO: 3282936 - RNA, 15 nt, Mycobacterium tuberculosis H37Rv
gcgccggcgcugcug

SEQ ID NO: 3282937 - RNA, 17 nt, Mycobacterium tuberculosis H37Rv
gcgccggcgcugcugcc

SEQ ID NO: 3282938 - RNA, 20 nt, Mycobacterium tuberculosis H37Rv
gcgccggcggaccccucgac

SEQ ID NO: 3282939 - RNA, 12 nt, Mycobacterium tuberculosis H37Rv
gcgccggcggca

SEQ ID NO: 3282940 - RNA, 13 nt, Mycobacterium tuberculosis H37Rv
gcgccggcggcca

SEQ ID NO: 3282941 - RNA, 13 nt, Mycobacterium tuberculosis H37Rv
gcgccggcggccg

SEQ ID NO: 3282942 - RNA, 15 nt, Mycobacterium tuberculosis H37Rv
gcgccggcgucggcg

SEQ ID NO: 3282943 - RNA, 21 nt, Mycobacterium tuberculosis H37Rv
gcgccggcgucggucgucggg

SEQ ID NO: 3282944 - RNA, 14 nt, Mycobacterium tuberculosis H37Rv
gcgccggcgugcau

SEQ ID NO: 3282945 - RNA, 18 nt, Mycobacterium tuberculosis H37Rv
gcgccggcgugcaugagc

SEQ ID NO: 3282946 - RNA, 16 nt, Mycobacterium tuberculosis H37Rv
gcgccggcuagggccc

SEQ ID NO: 3282947 - RNA, 18 nt, Mycobacterium tuberculosis H37Rv
gcgccggcuagggcccug

SEQ ID NO: 3282948 - RNA, 23 nt, Mycobacterium tuberculosis H37Rv
gcgccggcuagggcccuggcggc

SEQ ID NO: 3282949 - RNA, 20 nt, Mycobacterium tuberculosis H37Rv
gcgccggcugccacacaggc

SEQ ID NO: 3282950 - RNA, 15 nt, Mycobacterium tuberculosis H37Rv
gcgccggcuggcggc

SEQ ID NO: 3282951 - RNA, 14 nt, Mycobacterium tuberculosis H37Rv
gcgccgggcucgcg

SEQ ID NO: 3282952 - RNA, 15 nt, Mycobacterium tuberculosis H37Rv
gcgccgggcucgcga

SEQ ID NO: 3282953 - RNA, 15 nt, Mycobacterium tuberculosis H37Rv
gcgccgggcucggcg

SEQ ID NO: 3282954 - RNA, 17 nt, Mycobacterium tuberculosis H37Rv
gcgccggggacacagcg

SEQ ID NO: 3282955 - RNA, 20 nt, Mycobacterium tuberculosis H37Rv
gcgccggggacacagcgucc

SEQ ID NO: 3282956 - RNA, 22 nt, Mycobacterium tuberculosis H37Rv
gcgccggggacacagcguccgu

SEQ ID NO: 3282957 - RNA, 15 nt, Mycobacterium tuberculosis H37Rv
gcgccggggaccacg

SEQ ID NO: 3282958 - RNA, 19 nt, Mycobacterium tuberculosis H37Rv
gcgccggggauaccgguca

SEQ ID NO: 3282959 - RNA, 22 nt, Mycobacterium tuberculosis H37Rv
gcgccggggauaccggucagca

SEQ ID NO: 3282960 - RNA, 16 nt, Mycobacterium tuberculosis H37Rv
gcgccggggccgccga

SEQ ID NO: 3282961 - RNA, 16 nt, Mycobacterium tuberculosis H37Rv
gcgccgggggcgccgc

SEQ ID NO: 3282962 - RNA, 19 nt, Mycobacterium tuberculosis H37Rv
gcgccgggggcgccgccgu

SEQ ID NO: 3282963 - RNA, 17 nt, Mycobacterium tuberculosis H37Rv
gcgccggggggcugcug

SEQ ID NO: 3282964 - RNA, 19 nt, Mycobacterium tuberculosis H37Rv
gcgccggggggcugcugcu

SEQ ID NO: 3282965 - RNA, 20 nt, Mycobacterium tuberculosis H37Rv
gcgccggggggcugcugcuc

SEQ ID NO: 3282966 - RNA, 23 nt, Mycobacterium tuberculosis H37Rv
gcgccggucagcaauacggcggc

SEQ ID NO: 3282967 - RNA, 19 nt, Mycobacterium tuberculosis H37Rv
gcgccgguccucgucggcg

SEQ ID NO: 3282968 - RNA, 20 nt, Mycobacterium tuberculosis H37Rv
gcgccgguccucgucggcga

SEQ ID NO: 3282969 - RNA, 21 nt, Mycobacterium tuberculosis H37Rv
gcgccgguccucgucggcgaa

SEQ ID NO: 3282970 - RNA, 14 nt, Mycobacterium tuberculosis H37Rv
gcgccggucgccug

SEQ ID NO: 3282971 - RNA, 19 nt, Mycobacterium tuberculosis H37Rv
gcgccggucggaucgguga

SEQ ID NO: 3282972 - RNA, 20 nt, Mycobacterium tuberculosis H37Rv
gcgccggucggaucggugau

SEQ ID NO: 3282973 - RNA, 19 nt, Mycobacterium tuberculosis H37Rv
gcgccggugccgccgggug

SEQ ID NO: 3282974 - RNA, 22 nt, Mycobacterium tuberculosis H37Rv
gcgccggugccgccuccgccug

SEQ ID NO: 3282975 - RNA, 16 nt, Mycobacterium tuberculosis H37Rv
gcgccggugccggcca

SEQ ID NO: 3282976 - RNA, 18 nt, Mycobacterium tuberculosis H37Rv
gcgccggugcggcgggcu

SEQ ID NO: 3282977 - RNA, 12 nt, Mycobacterium tuberculosis H37Rv
gcgccggugcug

SEQ ID NO: 3282978 - RNA, 18 nt, Mycobacterium tuberculosis H37Rv
gcgccggugcugcgggaa

SEQ ID NO: 3282979 - RNA, 19 nt, Mycobacterium tuberculosis H37Rv
gcgccgguuacccggaccg

SEQ ID NO: 3282980 - RNA, 22 nt, Mycobacterium tuberculosis H37Rv
gcgccgguuacccggaccgucg

SEQ ID NO: 3282981 - RNA, 23 nt, Mycobacterium tuberculosis H37Rv
gcgccgguuacccggaccgucgu

SEQ ID NO: 3282982 - RNA, 16 nt, Mycobacterium tuberculosis H37Rv
gcgccgguuggccagu

SEQ ID NO: 3282983 - RNA, 20 nt, Mycobacterium tuberculosis H37Rv
gcgccgguuucgaggcgaag

SEQ ID NO: 3282984 - RNA, 12 nt, Mycobacterium tuberculosis H37Rv
gcgcgaacguca

SEQ ID NO: 3282985 - RNA, 18 nt, Mycobacterium tuberculosis H37Rv
gcgcgaacgucaaccggg

SEQ ID NO: 3282986 - RNA, 20 nt, Mycobacterium tuberculosis H37Rv
gcgcgaacgucaaccgggcg

SEQ ID NO: 3282987 - RNA, 22 nt, Mycobacterium tuberculosis H37Rv
gcgcgaacgucaaccgggcggc

SEQ ID NO: 3282988 - RNA, 23 nt, Mycobacterium tuberculosis H37Rv
gcgcgaacgucaaccgggcggcg

SEQ ID NO: 3282989 - RNA, 16 nt, Mycobacterium tuberculosis H37Rv
gcgcgaagccaccagg

SEQ ID NO: 3282990 - RNA, 15 nt, Mycobacterium tuberculosis H37Rv
gcgcgaaggucagcg

SEQ ID NO: 3282991 - RNA, 16 nt, Mycobacterium tuberculosis H37Rv
gcgcgaaggucagcga

SEQ ID NO: 3282992 - RNA, 21 nt, Mycobacterium tuberculosis H37Rv
gcgcgaagucuugaccgcacc

SEQ ID NO: 3282993 - RNA, 22 nt, Mycobacterium tuberculosis H37Rv
gcgcgaauuccucuguacccca

SEQ ID NO: 3282994 - RNA, 15 nt, Mycobacterium tuberculosis H37Rv
gcgcgacaacccggc

SEQ ID NO: 3282995 - RNA, 23 nt, Mycobacterium tuberculosis H37Rv
gcgcgacaacccggcgucgacga

SEQ ID NO: 3282996 - RNA, 18 nt, Mycobacterium tuberculosis H37Rv
gcgcgacagacagcaccg

SEQ ID NO: 3282997 - RNA, 14 nt, Mycobacterium tuberculosis H37Rv
gcgcgaccagaauc

SEQ ID NO: 3282998 - RNA, 17 nt, Mycobacterium tuberculosis H37Rv
gcgcgaccccaggcgcu

SEQ ID NO: 3282999 - RNA, 18 nt, Mycobacterium tuberculosis H37Rv
gcgcgaccgaccagccgu

SEQ ID NO: 3283000 - RNA, 19 nt, Mycobacterium tuberculosis H37Rv
gcgcgaccuccgcgaucac

SEQ ID NO: 3283001 - RNA, 24 nt, Mycobacterium tuberculosis H37Rv
gcgcgaccuccgcgaucaccgacg

SEQ ID NO: 3283002 - RNA, 19 nt, Mycobacterium tuberculosis H37Rv
gcgcgaccucgcuggccgc

SEQ ID NO: 3283003 - RNA, 16 nt, Mycobacterium tuberculosis H37Rv
gcgcgacgagcaugcg

SEQ ID NO: 3283004 - RNA, 13 nt, Mycobacterium tuberculosis H37Rv
gcgcgacggacca

SEQ ID NO: 3283005 - RNA, 13 nt, Mycobacterium tuberculosis H37Rv
gcgcgacggcgcu

SEQ ID NO: 3283006 - RNA, 21 nt, Mycobacterium tuberculosis H37Rv
gcgcgacguagacgacgucgg

SEQ ID NO: 3283007 - RNA, 22 nt, Mycobacterium tuberculosis H37Rv
gcgcgacguagacgacgucggc

SEQ ID NO: 3283008 - RNA, 20 nt, Mycobacterium tuberculosis H37Rv
gcgcgacguaguugccggcu

SEQ ID NO: 3283009 - RNA, 14 nt, Mycobacterium tuberculosis H37Rv
gcgcgacguccacc

SEQ ID NO: 3283010 - RNA, 21 nt, Mycobacterium tuberculosis H37Rv
gcgcgacugauccucgaugac

SEQ ID NO: 3283011 - RNA, 21 nt, Mycobacterium tuberculosis H37Rv
gcgcgacuguacaccgacacg

SEQ ID NO: 3283012 - RNA, 13 nt, Mycobacterium tuberculosis H37Rv
gcgcgagcagacg

SEQ ID NO: 3283013 - RNA, 15 nt, Mycobacterium tuberculosis H37Rv
gcgcgagccgcacga

SEQ ID NO: 3283014 - RNA, 15 nt, Mycobacterium tuberculosis H37Rv
gcgcgagccgcucca

SEQ ID NO: 3283015 - RNA, 22 nt, Mycobacterium tuberculosis H37Rv
gcgcgaggaggcuuacaugccc

SEQ ID NO: 3283016 - RNA, 14 nt, Mycobacterium tuberculosis H37Rv
gcgcgaggggccgg

SEQ ID NO: 3283017 - RNA, 16 nt, Mycobacterium tuberculosis H37Rv
gcgcgaggucggcggc

SEQ ID NO: 3283018 - RNA, 17 nt, Mycobacterium tuberculosis H37Rv
gcgcgaucaacgcguug

SEQ ID NO: 3283019 - RNA, 23 nt, Mycobacterium tuberculosis H37Rv
gcgcgaucaacgcguugcacagc

SEQ ID NO: 3283020 - RNA, 22 nt, Mycobacterium tuberculosis H37Rv
gcgcgaucaccgagucgacggc

SEQ ID NO: 3283021 - RNA, 14 nt, Mycobacterium tuberculosis H37Rv
gcgcgauccccgcg

SEQ ID NO: 3283022 - RNA, 17 nt, Mycobacterium tuberculosis H37Rv
gcgcgauccccgcgcug

SEQ ID NO: 3283023 - RNA, 20 nt, Mycobacterium tuberculosis H37Rv
gcgcgaucgauuccgcucgu

SEQ ID NO: 3283024 - RNA, 14 nt, Mycobacterium tuberculosis H37Rv
gcgcgaucgcgccc

SEQ ID NO: 3283025 - RNA, 17 nt, Mycobacterium tuberculosis H37Rv
gcgcgaucuccuccacc

SEQ ID NO: 3283026 - RNA, 15 nt, Mycobacterium tuberculosis H37Rv
gcgcgaugcccacgc

SEQ ID NO: 3283027 - RNA, 23 nt, Mycobacterium tuberculosis H37Rv
gcgcgauggccuggcccuuguug

SEQ ID NO: 3283028 - RNA, 21 nt, Mycobacterium tuberculosis H37Rv
gcgcgauggcgauagcggcgc

SEQ ID NO: 3283029 - RNA, 16 nt, Mycobacterium tuberculosis H37Rv
gcgcgauggcgcgugg

SEQ ID NO: 3283030 - RNA, 22 nt, Mycobacterium tuberculosis H37Rv
gcgcgaugggagcccggcggcc

SEQ ID NO: 3283031 - RNA, 20 nt, Mycobacterium tuberculosis H37Rv
gcgcgaugucguucgcguca

SEQ ID NO: 3283032 - RNA, 14 nt, Mycobacterium tuberculosis H37Rv
gcgcgcaacccugc

SEQ ID NO: 3283033 - RNA, 15 nt, Mycobacterium tuberculosis H37Rv
gcgcgcaacccugcc

SEQ ID NO: 3283034 - RNA, 19 nt, Mycobacterium tuberculosis H37Rv
gcgcgcaacccugccgcga

SEQ ID NO: 3283035 - RNA, 21 nt, Mycobacterium tuberculosis H37Rv
gcgcgcaacccugccgcgaug

SEQ ID NO: 3283036 - RNA, 19 nt, Mycobacterium tuberculosis H37Rv
gcgcgcaacguacgcacgc

SEQ ID NO: 3283037 - RNA, 21 nt, Mycobacterium tuberculosis H37Rv
gcgcgcaaucgugguucggcg

SEQ ID NO: 3283038 - RNA, 13 nt, Mycobacterium tuberculosis H37Rv
gcgcgcacacggc

SEQ ID NO: 3283039 - RNA, 13 nt, Mycobacterium tuberculosis H37Rv
gcgcgcaccgggu

SEQ ID NO: 3283040 - RNA, 17 nt, Mycobacterium tuberculosis H37Rv
gcgcgcacggcgucggc

SEQ ID NO: 3283041 - RNA, 19 nt, Mycobacterium tuberculosis H37Rv
gcgcgcagaugagcgcggc

SEQ ID NO: 3283042 - RNA, 18 nt, Mycobacterium tuberculosis H37Rv
gcgcgcagccgggcaccg

SEQ ID NO: 3283043 - RNA, 19 nt, Mycobacterium tuberculosis H37Rv
gcgcgcagccgggcaccga

SEQ ID NO: 3283044 - RNA, 14 nt, Mycobacterium tuberculosis H37Rv
gcgcgcagcgacgc

SEQ ID NO: 3283045 - RNA, 12 nt, Mycobacterium tuberculosis H37Rv
gcgcgcagcgau

SEQ ID NO: 3283046 - RNA, 15 nt, Mycobacterium tuberculosis H37Rv
gcgcgcagcugacgu

SEQ ID NO: 3283047 - RNA, 20 nt, Mycobacterium tuberculosis H37Rv
gcgcgcauauccgcaggccc

SEQ ID NO: 3283048 - RNA, 21 nt, Mycobacterium tuberculosis H37Rv
gcgcgccaaacaccccggccu

SEQ ID NO: 3283049 - RNA, 16 nt, Mycobacterium tuberculosis H37Rv
gcgcgccaaucgccca

SEQ ID NO: 3283050 - RNA, 17 nt, Mycobacterium tuberculosis H37Rv
gcgcgccacccagcacc

SEQ ID NO: 3283051 - RNA, 23 nt, Mycobacterium tuberculosis H37Rv
gcgcgccagcuugucgggcaccg

SEQ ID NO: 3283052 - RNA, 21 nt, Mycobacterium tuberculosis H37Rv
gcgcgccauuggcgccgccga

SEQ ID NO: 3283053 - RNA, 20 nt, Mycobacterium tuberculosis H37Rv
gcgcgcccacagcccgggcg

SEQ ID NO: 3283054 - RNA, 16 nt, Mycobacterium tuberculosis H37Rv
gcgcgcccaccgggcg

SEQ ID NO: 3283055 - RNA, 21 nt, Mycobacterium tuberculosis H37Rv
gcgcgcccaccgggcggcggc

SEQ ID NO: 3283056 - RNA, 14 nt, Mycobacterium tuberculosis H37Rv
gcgcgccccaccgc

SEQ ID NO: 3283057 - RNA, 20 nt, Mycobacterium tuberculosis H37Rv
gcgcgcccggaucucggcgu

SEQ ID NO: 3283058 - RNA, 17 nt, Mycobacterium tuberculosis H37Rv
gcgcgccgaaggcggcc

SEQ ID NO: 3283059 - RNA, 16 nt, Mycobacterium tuberculosis H37Rv
gcgcgccgaccagaac

SEQ ID NO: 3283060 - RNA, 14 nt, Mycobacterium tuberculosis H37Rv
gcgcgccgaucacg

SEQ ID NO: 3283061 - RNA, 16 nt, Mycobacterium tuberculosis H37Rv
gcgcgccgaucggcac

SEQ ID NO: 3283062 - RNA, 12 nt, Mycobacterium tuberculosis H37Rv
gcgcgccgcaca

SEQ ID NO: 3283063 - RNA, 14 nt, Mycobacterium tuberculosis H37Rv
gcgcgccgcugggu

SEQ ID NO: 3283064 - RNA, 23 nt, Mycobacterium tuberculosis H37Rv
gcgcgccggauacaccggcaccg

SEQ ID NO: 3283065 - RNA, 12 nt, Mycobacterium tuberculosis H37Rv
gcgcgccggcga

SEQ ID NO: 3283066 - RNA, 13 nt, Mycobacterium tuberculosis H37Rv
gcgcgccggcgac

SEQ ID NO: 3283067 - RNA, 15 nt, Mycobacterium tuberculosis H37Rv
gcgcgccggcgucgg

SEQ ID NO: 3283068 - RNA, 22 nt, Mycobacterium tuberculosis H37Rv
gcgcgccggcuagggcccuggc

SEQ ID NO: 3283069 - RNA, 19 nt, Mycobacterium tuberculosis H37Rv
gcgcgccgguuggccagug

SEQ ID NO: 3283070 - RNA, 22 nt, Mycobacterium tuberculosis H37Rv
gcgcgccguagaccagcaggcc

SEQ ID NO: 3283071 - RNA, 13 nt, Mycobacterium tuberculosis H37Rv
gcgcgccgucggg

SEQ ID NO: 3283072 - RNA, 15 nt, Mycobacterium tuberculosis H37Rv
gcgcgccguucaccc

SEQ ID NO: 3283073 - RNA, 18 nt, Mycobacterium tuberculosis H37Rv
gcgcgccuaugggccugc

SEQ ID NO: 3283074 - RNA, 16 nt, Mycobacterium tuberculosis H37Rv
gcgcgccugugccacc

SEQ ID NO: 3283075 - RNA, 17 nt, Mycobacterium tuberculosis H37Rv
gcgcgccuucacgcugg

SEQ ID NO: 3283076 - RNA, 16 nt, Mycobacterium tuberculosis H37Rv
gcgcgccuuggccagc

SEQ ID NO: 3283077 - RNA, 20 nt, Mycobacterium tuberculosis H37Rv
gcgcgccuuggccagcgcgu

SEQ ID NO: 3283078 - RNA, 19 nt, Mycobacterium tuberculosis H37Rv
gcgcgcgaaccccagccga

SEQ ID NO: 3283079 - RNA, 14 nt, Mycobacterium tuberculosis H37Rv
gcgcgcgacacgag

SEQ ID NO: 3283080 - RNA, 14 nt, Mycobacterium tuberculosis H37Rv
gcgcggggcggcug

SEQ ID NO: 3283081 - RNA, 23 nt, Mycobacterium tuberculosis H37Rv
gcgcggggcggcugcgggcccgg

SEQ ID NO: 3283082 - RNA, 15 nt, Mycobacterium tuberculosis H37Rv
gcgcggggugcgcgc

SEQ ID NO: 3283083 - RNA, 16 nt, Mycobacterium tuberculosis H37Rv
gcgcgggguggcggcg

SEQ ID NO: 3283084 - RNA, 18 nt, Mycobacterium tuberculosis H37Rv
gcgcgggguggcggcgcu

SEQ ID NO: 3283085 - RNA, 16 nt, Mycobacterium tuberculosis H37Rv
gcgcggguccagccac

SEQ ID NO: 3283086 - RNA, 16 nt, Mycobacterium tuberculosis H37Rv
gcgcgggucggcgacc

SEQ ID NO: 3283087 - RNA, 16 nt, Mycobacterium tuberculosis H37Rv
gcgcggguggcgccag

SEQ ID NO: 3283088 - RNA, 23 nt, Mycobacterium tuberculosis H37Rv
gcgcggguggcgccaguucggcg

SEQ ID NO: 3283089 - RNA, 23 nt, Mycobacterium tuberculosis H37Rv
gcgcgggugguucaccucggcga

SEQ ID NO: 3283090 - RNA, 19 nt, Mycobacterium tuberculosis H37Rv
gcgcggguugucggcgacc

SEQ ID NO: 3283091 - RNA, 19 nt, Mycobacterium tuberculosis H37Rv
gcgcgguaccgcucgggcg

SEQ ID NO: 3283092 - RNA, 17 nt, Mycobacterium tuberculosis H37Rv
gcgcgguacugcgcagc

SEQ ID NO: 3283093 - RNA, 12 nt, Mycobacterium tuberculosis H37Rv
gcgcggucaccg

SEQ ID NO: 3283094 - RNA, 17 nt, Mycobacterium tuberculosis H37Rv
gcgcgguccaucccgag

SEQ ID NO: 3283095 - RNA, 22 nt, Mycobacterium tuberculosis H37Rv
gcgcgguccuuguuagccucca

SEQ ID NO: 3283096 - RNA, 14 nt, Mycobacterium tuberculosis H37Rv
gcgcggucgcgcga

SEQ ID NO: 3283097 - RNA, 20 nt, Mycobacterium tuberculosis H37Rv
gcgcggucggagucgagcac

SEQ ID NO: 3283098 - RNA, 14 nt, Mycobacterium tuberculosis H37Rv
gcgcggucucgagu

SEQ ID NO: 3283099 - RNA, 22 nt, Mycobacterium tuberculosis H37Rv
gcgcggucugaccgcgucggcg

SEQ ID NO: 3283100 - RNA, 16 nt, Mycobacterium tuberculosis H37Rv
gcgcggugaccggguu

SEQ ID NO: 3283101 - RNA, 18 nt, Mycobacterium tuberculosis H37Rv
gcgcggugaugguuaccg

SEQ ID NO: 3283102 - RNA, 14 nt, Mycobacterium tuberculosis H37Rv
gcgcggugcccugc

SEQ ID NO: 3283103 - RNA, 23 nt, Mycobacterium tuberculosis H37Rv
gcgcggugccggccguucguggg

SEQ ID NO: 3283104 - RNA, 14 nt, Mycobacterium tuberculosis H37Rv
gcgcggugccggcg

SEQ ID NO: 3283105 - RNA, 15 nt, Mycobacterium tuberculosis H37Rv
gcgcggugcgcguga

SEQ ID NO: 3283106 - RNA, 20 nt, Mycobacterium tuberculosis H37Rv
gcgcgguggccaacucgaca

SEQ ID NO: 3283107 - RNA, 21 nt, Mycobacterium tuberculosis H37Rv
gcgcgguggccaacucgacau

SEQ ID NO: 3283108 - RNA, 12 nt, Mycobacterium tuberculosis H37Rv
gcgcggugguca

SEQ ID NO: 3283109 - RNA, 16 nt, Mycobacterium tuberculosis H37Rv
gcgcgguggucagcac

SEQ ID NO: 3283110 - RNA, 19 nt, Mycobacterium tuberculosis H37Rv
gcgcgguggucagcaccgg

SEQ ID NO: 3283111 - RNA, 15 nt, Mycobacterium tuberculosis H37Rv
gcgcgguggucgcga

SEQ ID NO: 3283112 - RNA, 18 nt, Mycobacterium tuberculosis H37Rv
gcgcgguguagagcgcac

SEQ ID NO: 3283113 - RNA, 22 nt, Mycobacterium tuberculosis H37Rv
gcgcgguguagagcgcaccgcg

SEQ ID NO: 3283114 - RNA, 23 nt, Mycobacterium tuberculosis H37Rv
gcgcgguucgucggcgagcgcgg

SEQ ID NO: 3283115 - RNA, 14 nt, Mycobacterium tuberculosis H37Rv
gcgcgguugcuggu

SEQ ID NO: 3283116 - RNA, 18 nt, Mycobacterium tuberculosis H37Rv
gcgcgguuucggcgucac

SEQ ID NO: 3283117 - RNA, 20 nt, Mycobacterium tuberculosis H37Rv
gcgcgguuucggcgucaccg

SEQ ID NO: 3283118 - RNA, 16 nt, Mycobacterium tuberculosis H37Rv
gcgcgguuuucggcug

SEQ ID NO: 3283119 - RNA, 23 nt, Mycobacterium tuberculosis H37Rv
gcgcguaauccgagcgcggcggc

SEQ ID NO: 3283120 - RNA, 19 nt, Mycobacterium tuberculosis H37Rv
gcgcguacccgaucagcga

SEQ ID NO: 3283121 - RNA, 13 nt, Mycobacterium tuberculosis H37Rv
gcgcguagccaau

SEQ ID NO: 3283122 - RNA, 14 nt, Mycobacterium tuberculosis H37Rv
gcgcguagcucagc

SEQ ID NO: 3283123 - RNA, 21 nt, Mycobacterium tuberculosis H37Rv
gcgcguaguaaugcucgacgu

SEQ ID NO: 3283124 - RNA, 19 nt, Mycobacterium tuberculosis H37Rv
gcgcgucagccgcaccccg

SEQ ID NO: 3283125 - RNA, 14 nt, Mycobacterium tuberculosis H37Rv
gcgcgucaggccag

SEQ ID NO: 3283126 - RNA, 16 nt, Mycobacterium tuberculosis H37Rv
gcgcgucaggccagcg

SEQ ID NO: 3283127 - RNA, 17 nt, Mycobacterium tuberculosis H37Rv
gcgcgucaggccagcgc

SEQ ID NO: 3283128 - RNA, 14 nt, Mycobacterium tuberculosis H37Rv
gcgcguccaaccaa

SEQ ID NO: 3283129 - RNA, 14 nt, Mycobacterium tuberculosis H37Rv
gcgcguccccagcg

SEQ ID NO: 3283130 - RNA, 15 nt, Mycobacterium tuberculosis H37Rv
gcgcguccccagcgc

SEQ ID NO: 3283131 - RNA, 13 nt, Mycobacterium tuberculosis H37Rv
gcgcguccgucgg

SEQ ID NO: 3283132 - RNA, 13 nt, Mycobacterium tuberculosis H37Rv
gcgcgucgagcag

SEQ ID NO: 3283133 - RNA, 15 nt, Mycobacterium tuberculosis H37Rv
gcgcgucgagcgacc

SEQ ID NO: 3283134 - RNA, 22 nt, Mycobacterium tuberculosis H37Rv
gcgcgucgaguuuugcggccag

SEQ ID NO: 3283135 - RNA, 13 nt, Mycobacterium tuberculosis H37Rv
gcgcgucgccgaa

SEQ ID NO: 3283136 - RNA, 16 nt, Mycobacterium tuberculosis H37Rv
gcgcgucgccgucgau

SEQ ID NO: 3283137 - RNA, 18 nt, Mycobacterium tuberculosis H37Rv
gcgcgucgcgaguagcug

SEQ ID NO: 3283138 - RNA, 12 nt, Mycobacterium tuberculosis H37Rv
gcgcgucggcac

SEQ ID NO: 3283139 - RNA, 14 nt, Mycobacterium tuberculosis H37Rv
gcgcgucguccagg

SEQ ID NO: 3283140 - RNA, 14 nt, Mycobacterium tuberculosis H37Rv
gcgcgucgucgcgc

SEQ ID NO: 3283141 - RNA, 21 nt, Mycobacterium tuberculosis H37Rv
gcgcgucgucgcgcugaacgc

SEQ ID NO: 3283142 - RNA, 15 nt, Mycobacterium tuberculosis H37Rv
gcgcgucucgagcgc

SEQ ID NO: 3283143 - RNA, 16 nt, Mycobacterium tuberculosis H37Rv
gcgcgugacgaccagc

SEQ ID NO: 3283144 - RNA, 17 nt, Mycobacterium tuberculosis H37Rv
gcgcgugacgaccagcc

SEQ ID NO: 3283145 - RNA, 20 nt, Mycobacterium tuberculosis H37Rv
gcgcgugcugcagaucggcc

SEQ ID NO: 3283146 - RNA, 15 nt, Mycobacterium tuberculosis H37Rv
gcgcguggucgggaa

SEQ ID NO: 3283147 - RNA, 19 nt, Mycobacterium tuberculosis H37Rv
gcgcgugugcgucgcacga

SEQ ID NO: 3283148 - RNA, 16 nt, Mycobacterium tuberculosis H37Rv
gcgcguucgaccucga

SEQ ID NO: 3283149 - RNA, 18 nt, Mycobacterium tuberculosis H37Rv
gcgcguucggcgagcagc

SEQ ID NO: 3283150 - RNA, 19 nt, Mycobacterium tuberculosis H37Rv
gcgcguucggcgagcagcg

SEQ ID NO: 3283151 - RNA, 14 nt, Mycobacterium tuberculosis H37Rv
gcgcguucggcgcu

SEQ ID NO: 3283152 - RNA, 18 nt, Mycobacterium tuberculosis H37Rv
gcgcguugaagucgccgg

SEQ ID NO: 3283153 - RNA, 23 nt, Mycobacterium tuberculosis H37Rv
gcgcguugaccgaacgcacgucg

SEQ ID NO: 3283154 - RNA, 15 nt, Mycobacterium tuberculosis H37Rv
gcgcguugcggucaa

SEQ ID NO: 3283155 - RNA, 15 nt, Mycobacterium tuberculosis H37Rv
gcgcuaaaccgucgc

SEQ ID NO: 3283156 - RNA, 23 nt, Mycobacterium tuberculosis H37Rv
gcgcuaaggugggcacagcgacc

SEQ ID NO: 3283157 - RNA, 14 nt, Mycobacterium tuberculosis H37Rv
gcgcuacgcggccg

SEQ ID NO: 3283158 - RNA, 16 nt, Mycobacterium tuberculosis H37Rv
gcgcuagccgggcgcg

SEQ ID NO: 3283159 - RNA, 20 nt, Mycobacterium tuberculosis H37Rv
gcgcuagccgggcgcgccgg

SEQ ID NO: 3283160 - RNA, 21 nt, Mycobacterium tuberculosis H37Rv
gcgcuagccgggcgcgccggc

SEQ ID NO: 3283161 - RNA, 14 nt, Mycobacterium tuberculosis H37Rv
gcgcuauaggccgc

SEQ ID NO: 3283162 - RNA, 15 nt, Mycobacterium tuberculosis H37Rv
gcgcuaucaugacca

SEQ ID NO: 3283163 - RNA, 16 nt, Mycobacterium tuberculosis H37Rv
gcgcucaacggcgaaa

SEQ ID NO: 3283164 - RNA, 16 nt, Mycobacterium tuberculosis H37Rv
gcgcucaccgacgcug

SEQ ID NO: 3283165 - RNA, 15 nt, Mycobacterium tuberculosis H37Rv
gcgcucacugcagcg

SEQ ID NO: 3283166 - RNA, 15 nt, Mycobacterium tuberculosis H37Rv
gcgcucagcgcggcc

SEQ ID NO: 3283167 - RNA, 20 nt, Mycobacterium tuberculosis H37Rv
gcgcucaggucaucggcggc

SEQ ID NO: 3283168 - RNA, 22 nt, Mycobacterium tuberculosis H37Rv
gcgcucaggucaucggcggcgg

SEQ ID NO: 3283169 - RNA, 18 nt, Mycobacterium tuberculosis H37Rv
gcgcucaucacccagcgc

SEQ ID NO: 3283170 - RNA, 14 nt, Mycobacterium tuberculosis H37Rv
gcgcucaucgaccg

SEQ ID NO: 3283171 - RNA, 21 nt, Mycobacterium tuberculosis H37Rv
gcgcucauguucucgaccgcg

SEQ ID NO: 3283172 - RNA, 22 nt, Mycobacterium tuberculosis H37Rv
gcgcucauguucucgaccgcgu

SEQ ID NO: 3283173 - RNA, 18 nt, Mycobacterium tuberculosis H37Rv
gcgcuccaacaacuccag

SEQ ID NO: 3283174 - RNA, 23 nt, Mycobacterium tuberculosis H37Rv
gcgcuccaacaacuccagcaggu

SEQ ID NO: 3283175 - RNA, 19 nt, Mycobacterium tuberculosis H37Rv
gcgcuccacugaccagguc

SEQ ID NO: 3283176 - RNA, 21 nt, Mycobacterium tuberculosis H37Rv
gcgcugggcgcgcucaucgac

SEQ ID NO: 3283177 - RNA, 22 nt, Mycobacterium tuberculosis H37Rv
gcgcugggucgugucgccacac

SEQ ID NO: 3283178 - RNA, 20 nt, Mycobacterium tuberculosis H37Rv
gcgcugguaguguucagcuu

SEQ ID NO: 3283179 - RNA, 16 nt, Mycobacterium tuberculosis H37Rv
gcgcuggucgcaaugg

SEQ ID NO: 3283180 - RNA, 20 nt, Mycobacterium tuberculosis H37Rv
gcgcuggucggagaccagcg

SEQ ID NO: 3283181 - RNA, 17 nt, Mycobacterium tuberculosis H37Rv
gcgcuggugcgccacgc

SEQ ID NO: 3283182 - RNA, 13 nt, Mycobacterium tuberculosis H37Rv
gcgcugguggcgg

SEQ ID NO: 3283183 - RNA, 20 nt, Mycobacterium tuberculosis H37Rv
gcgcuguacugccccagcac

SEQ ID NO: 3283184 - RNA, 18 nt, Mycobacterium tuberculosis H37Rv
gcgcuguagucgcgccuc

SEQ ID NO: 3283185 - RNA, 13 nt, Mycobacterium tuberculosis H37Rv
gcgcuguccacga

SEQ ID NO: 3283186 - RNA, 22 nt, Mycobacterium tuberculosis H37Rv
gcgcugucguaccgcggaucgg

SEQ ID NO: 3283187 - RNA, 16 nt, Mycobacterium tuberculosis H37Rv
gcgcuguugccaucga

SEQ ID NO: 3283188 - RNA, 14 nt, Mycobacterium tuberculosis H37Rv
gcgcuguuguuguc

SEQ ID NO: 3283189 - RNA, 20 nt, Mycobacterium tuberculosis H37Rv
gcgcuucacagccaccagcc

SEQ ID NO: 3283190 - RNA, 23 nt, Mycobacterium tuberculosis H37Rv
gcgcuucacagccaccagccggg

SEQ ID NO: 3283191 - RNA, 16 nt, Mycobacterium tuberculosis H37Rv
gcgcuuccaucgccac

SEQ ID NO: 3283192 - RNA, 17 nt, Mycobacterium tuberculosis H37Rv
gcgcuucgucggccggc

SEQ ID NO: 3283193 - RNA, 21 nt, Mycobacterium tuberculosis H37Rv
gcgcuugcgaccccggcugcg

SEQ ID NO: 3283194 - RNA, 16 nt, Mycobacterium tuberculosis H37Rv
gcgcuugcgaucgccg

SEQ ID NO: 3283195 - RNA, 19 nt, Mycobacterium tuberculosis H37Rv
gcgcuuggucgaccgccga

SEQ ID NO: 3283196 - RNA, 19 nt, Mycobacterium tuberculosis H37Rv
gcgcuuguugaccucacgg

SEQ ID NO: 3283197 - RNA, 18 nt, Mycobacterium tuberculosis H37Rv
gcgcuuuccucaccagcc

SEQ ID NO: 3283198 - RNA, 21 nt, Mycobacterium tuberculosis H37Rv
gcggaaaagaacccgggaucg

SEQ ID NO: 3283199 - RNA, 23 nt, Mycobacterium tuberculosis H37Rv
gcggaaacccggccgccgagacg

SEQ ID NO: 3283200 - RNA, 19 nt, Mycobacterium tuberculosis H37Rv
gcggaacaccaccaggcug

SEQ ID NO: 3283201 - RNA, 14 nt, Mycobacterium tuberculosis H37Rv
gcggaacaccagca

SEQ ID NO: 3283202 - RNA, 16 nt, Mycobacterium tuberculosis H37Rv
gcggaacaccagcagg

SEQ ID NO: 3283203 - RNA, 17 nt, Mycobacterium tuberculosis H37Rv
gcggaacaccagcaggc

SEQ ID NO: 3283204 - RNA, 21 nt, Mycobacterium tuberculosis H37Rv
gcggaacaccgacgacaccag

SEQ ID NO: 3283205 - RNA, 16 nt, Mycobacterium tuberculosis H37Rv
gcggaacacgaugcgc

SEQ ID NO: 3283206 - RNA, 19 nt, Mycobacterium tuberculosis H37Rv
gcggaacacgaugcgcggu

SEQ ID NO: 3283207 - RNA, 13 nt, Mycobacterium tuberculosis H37Rv
gcggaacgaugcc

SEQ ID NO: 3283208 - RNA, 17 nt, Mycobacterium tuberculosis H37Rv
gcggaacgccgagcacg

SEQ ID NO: 3283209 - RNA, 18 nt, Mycobacterium tuberculosis H37Rv
gcggaacugggcccccaa

SEQ ID NO: 3283210 - RNA, 14 nt, Mycobacterium tuberculosis H37Rv
gcggaagaccggau

SEQ ID NO: 3283211 - RNA, 14 nt, Mycobacterium tuberculosis H37Rv
gcggaagcggcggc

SEQ ID NO: 3283212 - RNA, 15 nt, Mycobacterium tuberculosis H37Rv
gcggaagcggcggcc

SEQ ID NO: 3283213 - RNA, 22 nt, Mycobacterium tuberculosis H37Rv
gcggaaguagcgcaaugcggcc

SEQ ID NO: 3283214 - RNA, 22 nt, Mycobacterium tuberculosis H37Rv
gcggaagugucgucggaccucg

SEQ ID NO: 3283215 - RNA, 21 nt, Mycobacterium tuberculosis H37Rv
gcggaaucaccgaaugcacga

SEQ ID NO: 3283216 - RNA, 17 nt, Mycobacterium tuberculosis H37Rv
gcggaauccgcggcgau

SEQ ID NO: 3283217 - RNA, 18 nt, Mycobacterium tuberculosis H37Rv
gcggaauccgcggcgauc

SEQ ID NO: 3283218 - RNA, 13 nt, Mycobacterium tuberculosis H37Rv
gcggaaucgcgac

SEQ ID NO: 3283219 - RNA, 16 nt, Mycobacterium tuberculosis H37Rv
gcggaauuagucgccg

SEQ ID NO: 3283220 - RNA, 17 nt, Mycobacterium tuberculosis H37Rv
gcggaauuagucgccgc

SEQ ID NO: 3283221 - RNA, 15 nt, Mycobacterium tuberculosis H37Rv
gcggacaagucggca

SEQ ID NO: 3283222 - RNA, 16 nt, Mycobacterium tuberculosis H37Rv
gcggacaagucggcac

SEQ ID NO: 3283223 - RNA, 14 nt, Mycobacterium tuberculosis H37Rv
gcggacaccgcggc

SEQ ID NO: 3283224 - RNA, 18 nt, Mycobacterium tuberculosis H37Rv
gcggacaccgcggcgauc

SEQ ID NO: 3283225 - RNA, 13 nt, Mycobacterium tuberculosis H37Rv
gcggacaccucgg

SEQ ID NO: 3283226 - RNA, 18 nt, Mycobacterium tuberculosis H37Rv
gcggacaccucgggcgcc

SEQ ID NO: 3283227 - RNA, 19 nt, Mycobacterium tuberculosis H37Rv
gcggacaccuuucuccaca

SEQ ID NO: 3283228 - RNA, 20 nt, Mycobacterium tuberculosis H37Rv
gcggacacgaucgcgucggc

SEQ ID NO: 3283229 - RNA, 23 nt, Mycobacterium tuberculosis H37Rv
gcggacacgaucgcgucggcuac

SEQ ID NO: 3283230 - RNA, 23 nt, Mycobacterium tuberculosis H37Rv
gcggacacugcgaaggaccagag

SEQ ID NO: 3283231 - RNA, 20 nt, Mycobacterium tuberculosis H37Rv
gcggacagcaucacgaucac

SEQ ID NO: 3283232 - RNA, 15 nt, Mycobacterium tuberculosis H37Rv
gcggacagcucgcgg

SEQ ID NO: 3283233 - RNA, 13 nt, Mycobacterium tuberculosis H37Rv
gcggacagguagu

SEQ ID NO: 3283234 - RNA, 13 nt, Mycobacterium tuberculosis H37Rv
gcggacaguuccc

SEQ ID NO: 3283235 - RNA, 18 nt, Mycobacterium tuberculosis H37Rv
gcggacauccgggccgag

SEQ ID NO: 3283236 - RNA, 20 nt, Mycobacterium tuberculosis H37Rv
gcggaccaggccgcgcgcac

SEQ ID NO: 3283237 - RNA, 14 nt, Mycobacterium tuberculosis H37Rv
gcggacccgaccgu

SEQ ID NO: 3283238 - RNA, 17 nt, Mycobacterium tuberculosis H37Rv
gcggacccgaccgucgu

SEQ ID NO: 3283239 - RNA, 18 nt, Mycobacterium tuberculosis H37Rv
gcggacccgcagcugcgg

SEQ ID NO: 3283240 - RNA, 20 nt, Mycobacterium tuberculosis H37Rv
gcggacccgcagcugcggau

SEQ ID NO: 3283241 - RNA, 20 nt, Mycobacterium tuberculosis H37Rv
gcggacccgcgcgucgccca

SEQ ID NO: 3283242 - RNA, 20 nt, Mycobacterium tuberculosis H37Rv
gcggacccuaacucccccgc

SEQ ID NO: 3283243 - RNA, 21 nt, Mycobacterium tuberculosis H37Rv
gcggaccgaugacgaucggcg

SEQ ID NO: 3283244 - RNA, 14 nt, Mycobacterium tuberculosis H37Rv
gcggaccgauuguc

SEQ ID NO: 3283245 - RNA, 15 nt, Mycobacterium tuberculosis H37Rv
gcggaccggcgcgcu

SEQ ID NO: 3283246 - RNA, 16 nt, Mycobacterium tuberculosis H37Rv
gcggaccggcgcgcuc

SEQ ID NO: 3283247 - RNA, 12 nt, Mycobacterium tuberculosis H37Rv
gcggaccguccg

SEQ ID NO: 3283248 - RNA, 15 nt, Mycobacterium tuberculosis H37Rv
gcggaccucggcgac

SEQ ID NO: 3283249 - RNA, 17 nt, Mycobacterium tuberculosis H37Rv
gcggaccucggcgaccu

SEQ ID NO: 3283250 - RNA, 17 nt, Mycobacterium tuberculosis H37Rv
gcggaccugcgccggug

SEQ ID NO: 3283251 - RNA, 16 nt, Mycobacterium tuberculosis H37Rv
gcggaccuggcggcgg

SEQ ID NO: 3283252 - RNA, 17 nt, Mycobacterium tuberculosis H37Rv
gcggaccuggcggcggu

SEQ ID NO: 3283253 - RNA, 21 nt, Mycobacterium tuberculosis H37Rv
gcggacgaacccguuuugggu

SEQ ID NO: 3283254 - RNA, 23 nt, Mycobacterium tuberculosis H37Rv
gcggacggcguuuccuucgacga

SEQ ID NO: 3283255 - RNA, 19 nt, Mycobacterium tuberculosis H37Rv
gcggacgguguacaggucg

SEQ ID NO: 3283256 - RNA, 21 nt, Mycobacterium tuberculosis H37Rv
gcggacgugaccagaucgacg

SEQ ID NO: 3283257 - RNA, 22 nt, Mycobacterium tuberculosis H37Rv
gcggacucagcggcguggucuc

SEQ ID NO: 3283258 - RNA, 17 nt, Mycobacterium tuberculosis H37Rv
gcggacugacgucgaag

SEQ ID NO: 3283259 - RNA, 17 nt, Mycobacterium tuberculosis H37Rv
gcggacuggcauccgcc

SEQ ID NO: 3283260 - RNA, 22 nt, Mycobacterium tuberculosis H37Rv
gcggacuggcauccgccccgcc

SEQ ID NO: 3283261 - RNA, 21 nt, Mycobacterium tuberculosis H37Rv
gcggacuucguuccgugccga

SEQ ID NO: 3283262 - RNA, 20 nt, Mycobacterium tuberculosis H37Rv
gcggacuugcgagccguaga

SEQ ID NO: 3283263 - RNA, 17 nt, Mycobacterium tuberculosis H37Rv
gcggacuuggcggucgg

SEQ ID NO: 3283264 - RNA, 16 nt, Mycobacterium tuberculosis H37Rv
gcggagaaaagcgcgc

SEQ ID NO: 3283265 - RNA, 22 nt, Mycobacterium tuberculosis H37Rv
gcggagaacgcgucgcgcgccu

SEQ ID NO: 3283266 - RNA, 18 nt, Mycobacterium tuberculosis H37Rv
gcggagacgaucgccagg

SEQ ID NO: 3283267 - RNA, 18 nt, Mycobacterium tuberculosis H37Rv
gcggagacggcggccaug

SEQ ID NO: 3283268 - RNA, 17 nt, Mycobacterium tuberculosis H37Rv
gcggagagggcgaccaa

SEQ ID NO: 3283269 - RNA, 17 nt, Mycobacterium tuberculosis H37Rv
gcggagccacucggccc

SEQ ID NO: 3283270 - RNA, 21 nt, Mycobacterium tuberculosis H37Rv
gcggagccaggacgacgccga

SEQ ID NO: 3283271 - RNA, 23 nt, Mycobacterium tuberculosis H37Rv
gcggagccgccgacucggcaccg

SEQ ID NO: 3283272 - RNA, 13 nt, Mycobacterium tuberculosis H37Rv
gcggcagcgcggc

SEQ ID NO: 3283273 - RNA, 15 nt, Mycobacterium tuberculosis H37Rv
gcggcagcggcgauc

SEQ ID NO: 3283274 - RNA, 17 nt, Mycobacterium tuberculosis H37Rv
gcggcagcggcgccgcc

SEQ ID NO: 3283275 - RNA, 16 nt, Mycobacterium tuberculosis H37Rv
gcggcagcggcguagc

SEQ ID NO: 3283276 - RNA, 18 nt, Mycobacterium tuberculosis H37Rv
gcggcagcggugcuggug

SEQ ID NO: 3283277 - RNA, 21 nt, Mycobacterium tuberculosis H37Rv
gcggcagcgguuuuaggcagc

SEQ ID NO: 3283278 - RNA, 15 nt, Mycobacterium tuberculosis H37Rv
gcggcagggccugga

SEQ ID NO: 3283279 - RNA, 19 nt, Mycobacterium tuberculosis H37Rv
gcggcaggugcggcggcau

SEQ ID NO: 3283280 - RNA, 17 nt, Mycobacterium tuberculosis H37Rv
gcggcagguucggcgac

SEQ ID NO: 3283281 - RNA, 23 nt, Mycobacterium tuberculosis H37Rv
gcggcagguugcguugcaggaaa

SEQ ID NO: 3283282 - RNA, 16 nt, Mycobacterium tuberculosis H37Rv
gcggcauccacaccga

SEQ ID NO: 3283283 - RNA, 19 nt, Mycobacterium tuberculosis H37Rv
gcggcauccacaccgaccg

SEQ ID NO: 3283284 - RNA, 17 nt, Mycobacterium tuberculosis H37Rv
gcggcaucccgccacac

SEQ ID NO: 3283285 - RNA, 19 nt, Mycobacterium tuberculosis H37Rv
gcggcauccugcacgaccc

SEQ ID NO: 3283286 - RNA, 14 nt, Mycobacterium tuberculosis H37Rv
gcggcaucgaggcc

SEQ ID NO: 3283287 - RNA, 16 nt, Mycobacterium tuberculosis H37Rv
gcggcaucgaggccag

SEQ ID NO: 3283288 - RNA, 12 nt, Mycobacterium tuberculosis H37Rv
gcggcaucgcgg

SEQ ID NO: 3283289 - RNA, 14 nt, Mycobacterium tuberculosis H37Rv
gcggcaucgcgggc

SEQ ID NO: 3283290 - RNA, 17 nt, Mycobacterium tuberculosis H37Rv
gcggcaucgcgggcggc

SEQ ID NO: 3283291 - RNA, 13 nt, Mycobacterium tuberculosis H37Rv
gcggcaucggcca

SEQ ID NO: 3283292 - RNA, 13 nt, Mycobacterium tuberculosis H37Rv
gcggcaucggugg

SEQ ID NO: 3283293 - RNA, 13 nt, Mycobacterium tuberculosis H37Rv
gcggcaucgucgc

SEQ ID NO: 3283294 - RNA, 22 nt, Mycobacterium tuberculosis H37Rv
gcggcaugaagcaguuggccga

SEQ ID NO: 3283295 - RNA, 21 nt, Mycobacterium tuberculosis H37Rv
gcggcaugcaaugcuggcggc

SEQ ID NO: 3283296 - RNA, 18 nt, Mycobacterium tuberculosis H37Rv
gcggcauguagaguaucg

SEQ ID NO: 3283297 - RNA, 15 nt, Mycobacterium tuberculosis H37Rv
gcggcauucucgagc

SEQ ID NO: 3283298 - RNA, 23 nt, Mycobacterium tuberculosis H37Rv
gcggcauucucgagcacccgcaa

SEQ ID NO: 3283299 - RNA, 22 nt, Mycobacterium tuberculosis H37Rv
gcggcauugguaccggcuucgu

SEQ ID NO: 3283300 - RNA, 18 nt, Mycobacterium tuberculosis H37Rv
gcggccaacagcacccgg

SEQ ID NO: 3283301 - RNA, 22 nt, Mycobacterium tuberculosis H37Rv
gcggccaaccccgaugaggcgc

SEQ ID NO: 3283302 - RNA, 13 nt, Mycobacterium tuberculosis H37Rv
gcggccaacgaac

SEQ ID NO: 3283303 - RNA, 19 nt, Mycobacterium tuberculosis H37Rv
gcggccaacgacgacccgu

SEQ ID NO: 3283304 - RNA, 14 nt, Mycobacterium tuberculosis H37Rv
gcggccaacggacc

SEQ ID NO: 3283305 - RNA, 24 nt, Mycobacterium tuberculosis H37Rv
gcggccaacggcuccgggcgcucg

SEQ ID NO: 3283306 - RNA, 13 nt, Mycobacterium tuberculosis H37Rv
gcggccaaggucg

SEQ ID NO: 3283307 - RNA, 20 nt, Mycobacterium tuberculosis H37Rv
gcggccaaucagcccgccgg

SEQ ID NO: 3283308 - RNA, 17 nt, Mycobacterium tuberculosis H37Rv
gcggccaaugacgucgg

SEQ ID NO: 3283309 - RNA, 18 nt, Mycobacterium tuberculosis H37Rv
gcggccaauggccgcggc

SEQ ID NO: 3283310 - RNA, 16 nt, Mycobacterium tuberculosis H37Rv
gcggccaauggugggc

SEQ ID NO: 3283311 - RNA, 24 nt, Mycobacterium tuberculosis H37Rv
gcggccaauggugggcgagcugcu

SEQ ID NO: 3283312 - RNA, 15 nt, Mycobacterium tuberculosis H37Rv
gcggccacaaccucg

SEQ ID NO: 3283313 - RNA, 23 nt, Mycobacterium tuberculosis H37Rv
gcggccaccaccgagcgcaaccc

SEQ ID NO: 3283314 - RNA, 14 nt, Mycobacterium tuberculosis H37Rv
gcggccaccagauc

SEQ ID NO: 3283315 - RNA, 12 nt, Mycobacterium tuberculosis H37Rv
gcggccaccagc

SEQ ID NO: 3283316 - RNA, 15 nt, Mycobacterium tuberculosis H37Rv
gcggccaccagcgcc

SEQ ID NO: 3283317 - RNA, 14 nt, Mycobacterium tuberculosis H37Rv
gcggccaccgccgc

SEQ ID NO: 3283318 - RNA, 23 nt, Mycobacterium tuberculosis H37Rv
gcggccaccgccgccgccaccgg

SEQ ID NO: 3283319 - RNA, 15 nt, Mycobacterium tuberculosis H37Rv
gcggccaccgucagc

SEQ ID NO: 3283320 - RNA, 15 nt, Mycobacterium tuberculosis H37Rv
gcggccacgccggcg

SEQ ID NO: 3283321 - RNA, 19 nt, Mycobacterium tuberculosis H37Rv
gcggccacgguggcgcaag

SEQ ID NO: 3283322 - RNA, 16 nt, Mycobacterium tuberculosis H37Rv
gcggccacguggucgg

SEQ ID NO: 3283323 - RNA, 21 nt, Mycobacterium tuberculosis H37Rv
gcggccacuuggaugcgaccc

SEQ ID NO: 3283324 - RNA, 14 nt, Mycobacterium tuberculosis H37Rv
gcggccagagccgc

SEQ ID NO: 3283325 - RNA, 20 nt, Mycobacterium tuberculosis H37Rv
gcggccagagccgcgcgccg

SEQ ID NO: 3283326 - RNA, 24 nt, Mycobacterium tuberculosis H37Rv
gcggccagagccgcgcgccgguug

SEQ ID NO: 3283327 - RNA, 12 nt, Mycobacterium tuberculosis H37Rv
gcggccagcagc

SEQ ID NO: 3283328 - RNA, 20 nt, Mycobacterium tuberculosis H37Rv
gcggccagcagcaacgaccc

SEQ ID NO: 3283329 - RNA, 18 nt, Mycobacterium tuberculosis H37Rv
gcggccagcaucgcggug

SEQ ID NO: 3283330 - RNA, 14 nt, Mycobacterium tuberculosis H37Rv
gcggccagcccacu

SEQ ID NO: 3283331 - RNA, 18 nt, Mycobacterium tuberculosis H37Rv
gcggccagcccagccggg

SEQ ID NO: 3283332 - RNA, 19 nt, Mycobacterium tuberculosis H37Rv
gcggccagcgcaccgccga

SEQ ID NO: 3283333 - RNA, 19 nt, Mycobacterium tuberculosis H37Rv
gcggccagcuccagcgccg

SEQ ID NO: 3283334 - RNA, 20 nt, Mycobacterium tuberculosis H37Rv
gcggccagcuccagcgccgc

SEQ ID NO: 3283335 - RNA, 22 nt, Mycobacterium tuberculosis H37Rv
gcggccagcuccagcgccgcgg

SEQ ID NO: 3283336 - RNA, 21 nt, Mycobacterium tuberculosis H37Rv
gcggccaggaugccugccacc

SEQ ID NO: 3283337 - RNA, 15 nt, Mycobacterium tuberculosis H37Rv
gcggccaggcgcgac

SEQ ID NO: 3283338 - RNA, 16 nt, Mycobacterium tuberculosis H37Rv
gcggccagggagcggc

SEQ ID NO: 3283339 - RNA, 13 nt, Mycobacterium tuberculosis H37Rv
gcggccaggucgc

SEQ ID NO: 3283340 - RNA, 15 nt, Mycobacterium tuberculosis H37Rv
gcggccaggucgguc

SEQ ID NO: 3283341 - RNA, 19 nt, Mycobacterium tuberculosis H37Rv
gcggccaguacgucgauca

SEQ ID NO: 3283342 - RNA, 17 nt, Mycobacterium tuberculosis H37Rv
gcggccauaucgcccac

SEQ ID NO: 3283343 - RNA, 18 nt, Mycobacterium tuberculosis H37Rv
gcggccauaucgcccacc

SEQ ID NO: 3283344 - RNA, 17 nt, Mycobacterium tuberculosis H37Rv
gcggccaucccgcguuc

SEQ ID NO: 3283345 - RNA, 22 nt, Mycobacterium tuberculosis H37Rv
gcggccauccggcggcggccag

SEQ ID NO: 3283346 - RNA, 16 nt, Mycobacterium tuberculosis H37Rv
gcggccaucgccgaca

SEQ ID NO: 3283347 - RNA, 20 nt, Mycobacterium tuberculosis H37Rv
gcggccaucgggauggacac

SEQ ID NO: 3283348 - RNA, 18 nt, Mycobacterium tuberculosis H37Rv
gcggccaugucagcggcc

SEQ ID NO: 3283349 - RNA, 22 nt, Mycobacterium tuberculosis H37Rv
gcggccauguugcccugcaacc

SEQ ID NO: 3283350 - RNA, 20 nt, Mycobacterium tuberculosis H37Rv
gcggccauucuugucggugg

SEQ ID NO: 3283351 - RNA, 17 nt, Mycobacterium tuberculosis H37Rv
gcggcccaaccggucgu

SEQ ID NO: 3283352 - RNA, 19 nt, Mycobacterium tuberculosis H37Rv
gcggcccaaccggucgugg

SEQ ID NO: 3283353 - RNA, 15 nt, Mycobacterium tuberculosis H37Rv
gcggcccacaccagc

SEQ ID NO: 3283354 - RNA, 21 nt, Mycobacterium tuberculosis H37Rv
gcggcccacaccagcgcagca

SEQ ID NO: 3283355 - RNA, 14 nt, Mycobacterium tuberculosis H37Rv
gcggcccacgcgca

SEQ ID NO: 3283356 - RNA, 20 nt, Mycobacterium tuberculosis H37Rv
gcggccccaggggcaccagc

SEQ ID NO: 3283357 - RNA, 15 nt, Mycobacterium tuberculosis H37Rv
gcggccccgccguug

SEQ ID NO: 3283358 - RNA, 16 nt, Mycobacterium tuberculosis H37Rv
gcggccccgcgccacc

SEQ ID NO: 3283359 - RNA, 21 nt, Mycobacterium tuberculosis H37Rv
gcggccccggcauugcccgag

SEQ ID NO: 3283360 - RNA, 23 nt, Mycobacterium tuberculosis H37Rv
gcggccccggcauugcccgagcc

SEQ ID NO: 3283361 - RNA, 16 nt, Mycobacterium tuberculosis H37Rv
gcggccccgucgccga

SEQ ID NO: 3283362 - RNA, 19 nt, Mycobacterium tuberculosis H37Rv
gcggcccgagaagcguugc

SEQ ID NO: 3283363 - RNA, 21 nt, Mycobacterium tuberculosis H37Rv
gcggcccgauagaucgcgugg

SEQ ID NO: 3283364 - RNA, 22 nt, Mycobacterium tuberculosis H37Rv
gcggcccgauagaucgcgugga

SEQ ID NO: 3283365 - RNA, 16 nt, Mycobacterium tuberculosis H37Rv
gcggcccgaucaccag

SEQ ID NO: 3283366 - RNA, 14 nt, Mycobacterium tuberculosis H37Rv
gcggcccgcagccc

SEQ ID NO: 3283367 - RNA, 15 nt, Mycobacterium tuberculosis H37Rv
gcggcccgcagcccg

SEQ ID NO: 3283368 - RNA, 16 nt, Mycobacterium tuberculosis H37Rv
gcggcgaagccgggug

SEQ ID NO: 3283369 - RNA, 20 nt, Mycobacterium tuberculosis H37Rv
gcggcgacauccacaccgcg

SEQ ID NO: 3283370 - RNA, 13 nt, Mycobacterium tuberculosis H37Rv
gcggcgaccaccg

SEQ ID NO: 3283371 - RNA, 17 nt, Mycobacterium tuberculosis H37Rv
gcggcgaccgcauccgg

SEQ ID NO: 3283372 - RNA, 22 nt, Mycobacterium tuberculosis H37Rv
gcggcgaccgcauccggucucg

SEQ ID NO: 3283373 - RNA, 13 nt, Mycobacterium tuberculosis H37Rv
gcggcgaccguca

SEQ ID NO: 3283374 - RNA, 14 nt, Mycobacterium tuberculosis H37Rv
gcggcgacgaccgu

SEQ ID NO: 3283375 - RNA, 15 nt, Mycobacterium tuberculosis H37Rv
gcggcgacgacggcc

SEQ ID NO: 3283376 - RNA, 17 nt, Mycobacterium tuberculosis H37Rv
gcggcgacgacggccug

SEQ ID NO: 3283377 - RNA, 17 nt, Mycobacterium tuberculosis H37Rv
gcggcgacgagcgcagc

SEQ ID NO: 3283378 - RNA, 17 nt, Mycobacterium tuberculosis H37Rv
gcggcgacggccgcucg

SEQ ID NO: 3283379 - RNA, 15 nt, Mycobacterium tuberculosis H37Rv
gcggcgacguggcgc

SEQ ID NO: 3283380 - RNA, 14 nt, Mycobacterium tuberculosis H37Rv
gcggcgacuaccca

SEQ ID NO: 3283381 - RNA, 18 nt, Mycobacterium tuberculosis H37Rv
gcggcgacuacggccucg

SEQ ID NO: 3283382 - RNA, 15 nt, Mycobacterium tuberculosis H37Rv
gcggcgagaaucccg

SEQ ID NO: 3283383 - RNA, 20 nt, Mycobacterium tuberculosis H37Rv
gcggcgagaaucccgggccg

SEQ ID NO: 3283384 - RNA, 14 nt, Mycobacterium tuberculosis H37Rv
gcggcgagcacgcg

SEQ ID NO: 3283385 - RNA, 15 nt, Mycobacterium tuberculosis H37Rv
gcggcgagcagagaa

SEQ ID NO: 3283386 - RNA, 16 nt, Mycobacterium tuberculosis H37Rv
gcggcgaguuggccgu

SEQ ID NO: 3283387 - RNA, 15 nt, Mycobacterium tuberculosis H37Rv
gcggcgaucaccaug

SEQ ID NO: 3283388 - RNA, 16 nt, Mycobacterium tuberculosis H37Rv
gcggcgauccggucgg

SEQ ID NO: 3283389 - RNA, 20 nt, Mycobacterium tuberculosis H37Rv
gcggcgaugauggcgcgauc

SEQ ID NO: 3283390 - RNA, 19 nt, Mycobacterium tuberculosis H37Rv
gcggcgaugguaucgccgc

SEQ ID NO: 3283391 - RNA, 21 nt, Mycobacterium tuberculosis H37Rv
gcggcgcacaacccgucgagc

SEQ ID NO: 3283392 - RNA, 16 nt, Mycobacterium tuberculosis H37Rv
gcggcgcagcacggcg

SEQ ID NO: 3283393 - RNA, 21 nt, Mycobacterium tuberculosis H37Rv
gcggcgcaggucgcgcaguug

SEQ ID NO: 3283394 - RNA, 20 nt, Mycobacterium tuberculosis H37Rv
gcggcgcauuccggcgccag

SEQ ID NO: 3283395 - RNA, 15 nt, Mycobacterium tuberculosis H37Rv
gcggcgccacccgcg

SEQ ID NO: 3283396 - RNA, 19 nt, Mycobacterium tuberculosis H37Rv
gcggcgccaguauggccgc

SEQ ID NO: 3283397 - RNA, 21 nt, Mycobacterium tuberculosis H37Rv
gcggcgccauggaucccacga

SEQ ID NO: 3283398 - RNA, 14 nt, Mycobacterium tuberculosis H37Rv
gcggcgcccaggaa

SEQ ID NO: 3283399 - RNA, 13 nt, Mycobacterium tuberculosis H37Rv
gcggcgcccaucg

SEQ ID NO: 3283400 - RNA, 20 nt, Mycobacterium tuberculosis H37Rv
gcggcgccccgguuggccgu

SEQ ID NO: 3283401 - RNA, 11 nt, Mycobacterium tuberculosis H37Rv
gcggcgcccgg

SEQ ID NO: 3283402 - RNA, 13 nt, Mycobacterium tuberculosis H37Rv
gcggcgcccggcg

SEQ ID NO: 3283403 - RNA, 14 nt, Mycobacterium tuberculosis H37Rv
gcggcgcccggcuu

SEQ ID NO: 3283404 - RNA, 17 nt, Mycobacterium tuberculosis H37Rv
gcggcgcccggucgagc

SEQ ID NO: 3283405 - RNA, 12 nt, Mycobacterium tuberculosis H37Rv
gcggcgccgcaa

SEQ ID NO: 3283406 - RNA, 13 nt, Mycobacterium tuberculosis H37Rv
gcggcgccgcacc

SEQ ID NO: 3283407 - RNA, 13 nt, Mycobacterium tuberculosis H37Rv
gcggcgccgcaga

SEQ ID NO: 3283408 - RNA, 19 nt, Mycobacterium tuberculosis H37Rv
gcggcgccgcagaucaccg

SEQ ID NO: 3283409 - RNA, 12 nt, Mycobacterium tuberculosis H37Rv
gcggcgccgcca

SEQ ID NO: 3283410 - RNA, 18 nt, Mycobacterium tuberculosis H37Rv
gcggcgccgccacgguac

SEQ ID NO: 3283411 - RNA, 13 nt, Mycobacterium tuberculosis H37Rv
gcggcgccgccca

SEQ ID NO: 3283412 - RNA, 15 nt, Mycobacterium tuberculosis H37Rv
gcggcgccggugggc

SEQ ID NO: 3283413 - RNA, 21 nt, Mycobacterium tuberculosis H37Rv
gcggcgccgugaucagcucgc

SEQ ID NO: 3283414 - RNA, 12 nt, Mycobacterium tuberculosis H37Rv
gcggcgccguug

SEQ ID NO: 3283415 - RNA, 21 nt, Mycobacterium tuberculosis H37Rv
gcggcgccugacucaucaccg

SEQ ID NO: 3283416 - RNA, 19 nt, Mycobacterium tuberculosis H37Rv
gcggcgccuuccacggagu

SEQ ID NO: 3283417 - RNA, 18 nt, Mycobacterium tuberculosis H37Rv
gcggcgcgaagucuugac

SEQ ID NO: 3283418 - RNA, 17 nt, Mycobacterium tuberculosis H37Rv
gcggcgcggccgcagcc

SEQ ID NO: 3283419 - RNA, 13 nt, Mycobacterium tuberculosis H37Rv
gcggcgcggcgac

SEQ ID NO: 3283420 - RNA, 18 nt, Mycobacterium tuberculosis H37Rv
gcggcgcggcgggcagcg

SEQ ID NO: 3283421 - RNA, 17 nt, Mycobacterium tuberculosis H37Rv
gcggcgcgggggugggc

SEQ ID NO: 3283422 - RNA, 19 nt, Mycobacterium tuberculosis H37Rv
gcggcgcgggucacgccgu

SEQ ID NO: 3283423 - RNA, 12 nt, Mycobacterium tuberculosis H37Rv
gcggcgcgggug

SEQ ID NO: 3283424 - RNA, 13 nt, Mycobacterium tuberculosis H37Rv
gcggcgcgggugc

SEQ ID NO: 3283425 - RNA, 20 nt, Mycobacterium tuberculosis H37Rv
gcggcgcggucgaagcuggc

SEQ ID NO: 3283426 - RNA, 13 nt, Mycobacterium tuberculosis H37Rv
gcggcgcgguuuc

SEQ ID NO: 3283427 - RNA, 18 nt, Mycobacterium tuberculosis H37Rv
gcggcgcucccgccggca

SEQ ID NO: 3283428 - RNA, 20 nt, Mycobacterium tuberculosis H37Rv
gcggcgcucuugcucaccag

SEQ ID NO: 3283429 - RNA, 12 nt, Mycobacterium tuberculosis H37Rv
gcggcgcugcag

SEQ ID NO: 3283430 - RNA, 14 nt, Mycobacterium tuberculosis H37Rv
gcggcgcuggcguc

SEQ ID NO: 3283431 - RNA, 11 nt, Mycobacterium tuberculosis H37Rv
gcggcgcuggg

SEQ ID NO: 3283432 - RNA, 20 nt, Mycobacterium tuberculosis H37Rv
gcggcgcuggucgcgguggc

SEQ ID NO: 3283433 - RNA, 12 nt, Mycobacterium tuberculosis H37Rv
gcggcgcugguu

SEQ ID NO: 3283434 - RNA, 18 nt, Mycobacterium tuberculosis H37Rv
gcggcggaacaccgacga

SEQ ID NO: 3283435 - RNA, 19 nt, Mycobacterium tuberculosis H37Rv
gcggcggaaggcgucgaac

SEQ ID NO: 3283436 - RNA, 14 nt, Mycobacterium tuberculosis H37Rv
gcggcggacccgcu

SEQ ID NO: 3283437 - RNA, 17 nt, Mycobacterium tuberculosis H37Rv
gcggcggacccgcucgc

SEQ ID NO: 3283438 - RNA, 21 nt, Mycobacterium tuberculosis H37Rv
gcggcggaccguccgacggcg

SEQ ID NO: 3283439 - RNA, 13 nt, Mycobacterium tuberculosis H37Rv
gcggcggauuccg

SEQ ID NO: 3283440 - RNA, 19 nt, Mycobacterium tuberculosis H37Rv
gcggcggauuccggcaucg

SEQ ID NO: 3283441 - RNA, 20 nt, Mycobacterium tuberculosis H37Rv
gcggcggcacuggugcccga

SEQ ID NO: 3283442 - RNA, 23 nt, Mycobacterium tuberculosis H37Rv
gcggcggcagcggcgaucaggcg

SEQ ID NO: 3283443 - RNA, 20 nt, Mycobacterium tuberculosis H37Rv
gcggcggcauagugcgacug

SEQ ID NO: 3283444 - RNA, 14 nt, Mycobacterium tuberculosis H37Rv
gcggcggcaucggu

SEQ ID NO: 3283445 - RNA, 14 nt, Mycobacterium tuberculosis H37Rv
gcggcggccagcgc

SEQ ID NO: 3283446 - RNA, 13 nt, Mycobacterium tuberculosis H37Rv
gcggcggccagga

SEQ ID NO: 3283447 - RNA, 20 nt, Mycobacterium tuberculosis H37Rv
gcggcggcccgcagcccgcc

SEQ ID NO: 3283448 - RNA, 13 nt, Mycobacterium tuberculosis H37Rv
gcggcggccgcag

SEQ ID NO: 3283449 - RNA, 14 nt, Mycobacterium tuberculosis H37Rv
gcggcggccgcagc

SEQ ID NO: 3283450 - RNA, 15 nt, Mycobacterium tuberculosis H37Rv
gcggcggccgcagcg

SEQ ID NO: 3283451 - RNA, 17 nt, Mycobacterium tuberculosis H37Rv
gcggcggccgcagcggc

SEQ ID NO: 3283452 - RNA, 17 nt, Mycobacterium tuberculosis H37Rv
gcggcggccuccaccac

SEQ ID NO: 3283453 - RNA, 18 nt, Mycobacterium tuberculosis H37Rv
gcggcggccugagcgucg

SEQ ID NO: 3283454 - RNA, 15 nt, Mycobacterium tuberculosis H37Rv
gcggcggccuggcac

SEQ ID NO: 3283455 - RNA, 13 nt, Mycobacterium tuberculosis H37Rv
gcggcggccuggg

SEQ ID NO: 3283456 - RNA, 18 nt, Mycobacterium tuberculosis H37Rv
gcggcggccugggccagc

SEQ ID NO: 3283457 - RNA, 15 nt, Mycobacterium tuberculosis H37Rv
gcggcggcgaacucg

SEQ ID NO: 3283458 - RNA, 14 nt, Mycobacterium tuberculosis H37Rv
gcggcggcgcgauc

SEQ ID NO: 3283459 - RNA, 16 nt, Mycobacterium tuberculosis H37Rv
gcggcggcgcgaucga

SEQ ID NO: 3283460 - RNA, 19 nt, Mycobacterium tuberculosis H37Rv
gcggcggcgcgaucgacgc

SEQ ID NO: 3283461 - RNA, 12 nt, Mycobacterium tuberculosis H37Rv
gcggcggcgcug

SEQ ID NO: 3283462 - RNA, 13 nt, Mycobacterium tuberculosis H37Rv
gcggcggcgcugg

SEQ ID NO: 3283463 - RNA, 13 nt, Mycobacterium tuberculosis H37Rv
gcggcggcggagg

SEQ ID NO: 3283464 - RNA, 14 nt, Mycobacterium tuberculosis H37Rv
gcggcggcggcacg

SEQ ID NO: 3283465 - RNA, 13 nt, Mycobacterium tuberculosis H37Rv
gcggcggcggcca

SEQ ID NO: 3283466 - RNA, 22 nt, Mycobacterium tuberculosis H37Rv
gcggcugguguccagccaggcg

SEQ ID NO: 3283467 - RNA, 18 nt, Mycobacterium tuberculosis H37Rv
gcggcugucacgccugcc

SEQ ID NO: 3283468 - RNA, 20 nt, Mycobacterium tuberculosis H37Rv
gcggcugucacgccugccac

SEQ ID NO: 3283469 - RNA, 23 nt, Mycobacterium tuberculosis H37Rv
gcggcugucacgccugccaccgg

SEQ ID NO: 3283470 - RNA, 17 nt, Mycobacterium tuberculosis H37Rv
gcggcugucggccgggu

SEQ ID NO: 3283471 - RNA, 15 nt, Mycobacterium tuberculosis H37Rv
gcggcugugcccgau

SEQ ID NO: 3283472 - RNA, 19 nt, Mycobacterium tuberculosis H37Rv
gcggcugugcccgaucagc

SEQ ID NO: 3283473 - RNA, 16 nt, Mycobacterium tuberculosis H37Rv
gcggcuguugcggcgg

SEQ ID NO: 3283474 - RNA, 19 nt, Mycobacterium tuberculosis H37Rv
gcggcuguugcggcggcgc

SEQ ID NO: 3283475 - RNA, 15 nt, Mycobacterium tuberculosis H37Rv
gcggcuucgacgucg

SEQ ID NO: 3283476 - RNA, 15 nt, Mycobacterium tuberculosis H37Rv
gcggcuucgucgaca

SEQ ID NO: 3283477 - RNA, 22 nt, Mycobacterium tuberculosis H37Rv
gcggcuucgucgacaucgccau

SEQ ID NO: 3283478 - RNA, 22 nt, Mycobacterium tuberculosis H37Rv
gcggcuucguggcggcgcgcgc

SEQ ID NO: 3283479 - RNA, 15 nt, Mycobacterium tuberculosis H37Rv
gcggcuuggaucuca

SEQ ID NO: 3283480 - RNA, 19 nt, Mycobacterium tuberculosis H37Rv
gcggcuuggaucucaucca

SEQ ID NO: 3283481 - RNA, 13 nt, Mycobacterium tuberculosis H37Rv
gcggcuuggccgc

SEQ ID NO: 3283482 - RNA, 19 nt, Mycobacterium tuberculosis H37Rv
gcgggaaaacgggguggca

SEQ ID NO: 3283483 - RNA, 18 nt, Mycobacterium tuberculosis H37Rv
gcgggaaacccaugcaug

SEQ ID NO: 3283484 - RNA, 22 nt, Mycobacterium tuberculosis H37Rv
gcgggaaacccaugcaugcguu

SEQ ID NO: 3283485 - RNA, 16 nt, Mycobacterium tuberculosis H37Rv
gcgggaacacaccgca

SEQ ID NO: 3283486 - RNA, 18 nt, Mycobacterium tuberculosis H37Rv
gcgggaaccccagcuugg

SEQ ID NO: 3283487 - RNA, 23 nt, Mycobacterium tuberculosis H37Rv
gcgggaaccccccauagcaagaa

SEQ ID NO: 3283488 - RNA, 19 nt, Mycobacterium tuberculosis H37Rv
gcgggaacgaucgaugacc

SEQ ID NO: 3283489 - RNA, 14 nt, Mycobacterium tuberculosis H37Rv
gcgggaacgaugcc

SEQ ID NO: 3283490 - RNA, 21 nt, Mycobacterium tuberculosis H37Rv
gcgggaacgaugccgccggcg

SEQ ID NO: 3283491 - RNA, 21 nt, Mycobacterium tuberculosis H37Rv
gcgggaacggugccgaucggg

SEQ ID NO: 3283492 - RNA, 19 nt, Mycobacterium tuberculosis H37Rv
gcgggaaggguggaccggg

SEQ ID NO: 3283493 - RNA, 15 nt, Mycobacterium tuberculosis H37Rv
gcgggaagucccgag

SEQ ID NO: 3283494 - RNA, 17 nt, Mycobacterium tuberculosis H37Rv
gcgggaagugauguggc

SEQ ID NO: 3283495 - RNA, 13 nt, Mycobacterium tuberculosis H37Rv
gcgggaauccggu

SEQ ID NO: 3283496 - RNA, 19 nt, Mycobacterium tuberculosis H37Rv
gcgggacaaaaucagcagc

SEQ ID NO: 3283497 - RNA, 16 nt, Mycobacterium tuberculosis H37Rv
gcgggacaaccgggcg

SEQ ID NO: 3283498 - RNA, 21 nt, Mycobacterium tuberculosis H37Rv
gcgggacaccaccgcccgcac

SEQ ID NO: 3283499 - RNA, 19 nt, Mycobacterium tuberculosis H37Rv
gcgggacagauggcggccg

SEQ ID NO: 3283500 - RNA, 20 nt, Mycobacterium tuberculosis H37Rv
gcgggacagauggcggccga

SEQ ID NO: 3283501 - RNA, 21 nt, Mycobacterium tuberculosis H37Rv
gcgggacagauggcggccgag

SEQ ID NO: 3283502 - RNA, 22 nt, Mycobacterium tuberculosis H37Rv
gcgggacagauggcggccgagg

SEQ ID NO: 3283503 - RNA, 22 nt, Mycobacterium tuberculosis H37Rv
gcgggacaucaccgcagcaccg

SEQ ID NO: 3283504 - RNA, 20 nt, Mycobacterium tuberculosis H37Rv
gcgggacauccagugcggug

SEQ ID NO: 3283505 - RNA, 23 nt, Mycobacterium tuberculosis H37Rv
gcgggacgccgaauacggcugcc

SEQ ID NO: 3283506 - RNA, 12 nt, Mycobacterium tuberculosis H37Rv
gcgggacgucgc

SEQ ID NO: 3283507 - RNA, 19 nt, Mycobacterium tuberculosis H37Rv
gcgggacugcagcgcggug

SEQ ID NO: 3283508 - RNA, 19 nt, Mycobacterium tuberculosis H37Rv
gcgggagguacccccagca

SEQ ID NO: 3283509 - RNA, 20 nt, Mycobacterium tuberculosis H37Rv
gcgggagguacccccagcac

SEQ ID NO: 3283510 - RNA, 21 nt, Mycobacterium tuberculosis H37Rv
gcgggagguacccccagcacc

SEQ ID NO: 3283511 - RNA, 17 nt, Mycobacterium tuberculosis H37Rv
gcgggaguucggggugc

SEQ ID NO: 3283512 - RNA, 22 nt, Mycobacterium tuberculosis H37Rv
gcgggauccucgaaggcguucg

SEQ ID NO: 3283513 - RNA, 15 nt, Mycobacterium tuberculosis H37Rv
gcgggaugcgcgccc

SEQ ID NO: 3283514 - RNA, 17 nt, Mycobacterium tuberculosis H37Rv
gcgggaugcgcgcccga

SEQ ID NO: 3283515 - RNA, 13 nt, Mycobacterium tuberculosis H37Rv
gcgggauucuggc

SEQ ID NO: 3283516 - RNA, 15 nt, Mycobacterium tuberculosis H37Rv
gcgggauugccgaga

SEQ ID NO: 3283517 - RNA, 13 nt, Mycobacterium tuberculosis H37Rv
gcgggauugcgcg

SEQ ID NO: 3283518 - RNA, 15 nt, Mycobacterium tuberculosis H37Rv
gcgggauugcgcgcu

SEQ ID NO: 3283519 - RNA, 18 nt, Mycobacterium tuberculosis H37Rv
gcgggcaaccacaucacc

SEQ ID NO: 3283520 - RNA, 19 nt, Mycobacterium tuberculosis H37Rv
gcgggcaaccacaucaccg

SEQ ID NO: 3283521 - RNA, 15 nt, Mycobacterium tuberculosis H37Rv
gcgggcaacgcagca

SEQ ID NO: 3283522 - RNA, 16 nt, Mycobacterium tuberculosis H37Rv
gcgggcaacugcagca

SEQ ID NO: 3283523 - RNA, 15 nt, Mycobacterium tuberculosis H37Rv
gcgggcaagccggac

SEQ ID NO: 3283524 - RNA, 21 nt, Mycobacterium tuberculosis H37Rv
gcgggcaagccggacagauca

SEQ ID NO: 3283525 - RNA, 21 nt, Mycobacterium tuberculosis H37Rv
gcgggcaagucgcccagccga

SEQ ID NO: 3283526 - RNA, 18 nt, Mycobacterium tuberculosis H37Rv
gcgggcacaccgcaccug

SEQ ID NO: 3283527 - RNA, 18 nt, Mycobacterium tuberculosis H37Rv
gcgggcacgccgccgacg

SEQ ID NO: 3283528 - RNA, 14 nt, Mycobacterium tuberculosis H37Rv
gcgggcacucagca

SEQ ID NO: 3283529 - RNA, 17 nt, Mycobacterium tuberculosis H37Rv
gcgggcacucagcaggg

SEQ ID NO: 3283530 - RNA, 21 nt, Mycobacterium tuberculosis H37Rv
gcgggcacugguggcgauccg

SEQ ID NO: 3283531 - RNA, 11 nt, Mycobacterium tuberculosis H37Rv
gcgggcagcag

SEQ ID NO: 3283532 - RNA, 15 nt, Mycobacterium tuberculosis H37Rv
gcgggcagcaggcga

SEQ ID NO: 3283533 - RNA, 14 nt, Mycobacterium tuberculosis H37Rv
gcgggcagccgccc

SEQ ID NO: 3283534 - RNA, 18 nt, Mycobacterium tuberculosis H37Rv
gcgggcagcguguaaccg

SEQ ID NO: 3283535 - RNA, 19 nt, Mycobacterium tuberculosis H37Rv
gcgggcagcguguaaccga

SEQ ID NO: 3283536 - RNA, 17 nt, Mycobacterium tuberculosis H37Rv
gcgggcagcuguucggc

SEQ ID NO: 3283537 - RNA, 18 nt, Mycobacterium tuberculosis H37Rv
gcgggcaguagcuguggc

SEQ ID NO: 3283538 - RNA, 23 nt, Mycobacterium tuberculosis H37Rv
gcgggcaguagcuguggcccgcg

SEQ ID NO: 3283539 - RNA, 19 nt, Mycobacterium tuberculosis H37Rv
gcgggcauaacccgcaccg

SEQ ID NO: 3283540 - RNA, 12 nt, Mycobacterium tuberculosis H37Rv
gcgggcaucgcg

SEQ ID NO: 3283541 - RNA, 14 nt, Mycobacterium tuberculosis H37Rv
gcgggcaugccggc

SEQ ID NO: 3283542 - RNA, 14 nt, Mycobacterium tuberculosis H37Rv
gcgggccaccaccg

SEQ ID NO: 3283543 - RNA, 21 nt, Mycobacterium tuberculosis H37Rv
gcgggccaccacgcgccgcac

SEQ ID NO: 3283544 - RNA, 15 nt, Mycobacterium tuberculosis H37Rv
gcgggccacgaucgg

SEQ ID NO: 3283545 - RNA, 20 nt, Mycobacterium tuberculosis H37Rv
gcgggccacgaucggcuggu

SEQ ID NO: 3283546 - RNA, 13 nt, Mycobacterium tuberculosis H37Rv
gcgggccagcacc

SEQ ID NO: 3283547 - RNA, 16 nt, Mycobacterium tuberculosis H37Rv
gcgggccagcacccgc

SEQ ID NO: 3283548 - RNA, 20 nt, Mycobacterium tuberculosis H37Rv
gcgggccagcacccgcucca

SEQ ID NO: 3283549 - RNA, 23 nt, Mycobacterium tuberculosis H37Rv
gcgggccccaucgccuggaugcc

SEQ ID NO: 3283550 - RNA, 17 nt, Mycobacterium tuberculosis H37Rv
gcgggcccgcaggucgg

SEQ ID NO: 3283551 - RNA, 18 nt, Mycobacterium tuberculosis H37Rv
gcgggcccgcaggucggc

SEQ ID NO: 3283552 - RNA, 13 nt, Mycobacterium tuberculosis H37Rv
gcgggcccgccgg

SEQ ID NO: 3283553 - RNA, 14 nt, Mycobacterium tuberculosis H37Rv
gcgggcccgccggc

SEQ ID NO: 3283554 - RNA, 15 nt, Mycobacterium tuberculosis H37Rv
gcgggcccgccggcc

SEQ ID NO: 3283555 - RNA, 20 nt, Mycobacterium tuberculosis H37Rv
gcgggcccgccggccccgcc

SEQ ID NO: 3283556 - RNA, 22 nt, Mycobacterium tuberculosis H37Rv
gcgggcccucuaugcgggcagc

SEQ ID NO: 3283557 - RNA, 23 nt, Mycobacterium tuberculosis H37Rv
gcgggcccucuaugcgggcagcg

SEQ ID NO: 3283558 - RNA, 21 nt, Mycobacterium tuberculosis H37Rv
gcgggccgaccagagcuucgc

SEQ ID NO: 3283559 - RNA, 17 nt, Mycobacterium tuberculosis H37Rv
gcgggccgacgcaggug

SEQ ID NO: 3283560 - RNA, 14 nt, Mycobacterium tuberculosis H37Rv
gcgggccgccgcaa

SEQ ID NO: 3283561 - RNA, 11 nt, Mycobacterium tuberculosis H37Rv
gcgggccgcga

SEQ ID NO: 3283562 - RNA, 14 nt, Mycobacterium tuberculosis H37Rv
gcgggucggcggug

SEQ ID NO: 3283563 - RNA, 15 nt, Mycobacterium tuberculosis H37Rv
gcgggucgugccccg

SEQ ID NO: 3283564 - RNA, 20 nt, Mycobacterium tuberculosis H37Rv
gcgggucgugccccggcgcg

SEQ ID NO: 3283565 - RNA, 22 nt, Mycobacterium tuberculosis H37Rv
gcgggucguuaccaggcgugga

SEQ ID NO: 3283566 - RNA, 17 nt, Mycobacterium tuberculosis H37Rv
gcgggucuuggcacaca

SEQ ID NO: 3283567 - RNA, 22 nt, Mycobacterium tuberculosis H37Rv
gcgggugaccaggcggcgcggg

SEQ ID NO: 3283568 - RNA, 11 nt, Mycobacterium tuberculosis H37Rv
gcgggugacuu

SEQ ID NO: 3283569 - RNA, 19 nt, Mycobacterium tuberculosis H37Rv
gcgggugacuucguggccu

SEQ ID NO: 3283570 - RNA, 22 nt, Mycobacterium tuberculosis H37Rv
gcgggugaugacgccgucggcg

SEQ ID NO: 3283571 - RNA, 22 nt, Mycobacterium tuberculosis H37Rv
gcgggugauggaugggucgacc

SEQ ID NO: 3283572 - RNA, 23 nt, Mycobacterium tuberculosis H37Rv
gcgggugauggaugggucgaccg

SEQ ID NO: 3283573 - RNA, 13 nt, Mycobacterium tuberculosis H37Rv
gcgggugccagcc

SEQ ID NO: 3283574 - RNA, 15 nt, Mycobacterium tuberculosis H37Rv
gcgggugcgccggcg

SEQ ID NO: 3283575 - RNA, 12 nt, Mycobacterium tuberculosis H37Rv
gcgggugcgcug

SEQ ID NO: 3283576 - RNA, 22 nt, Mycobacterium tuberculosis H37Rv
gcgggugcuggucaacagcggc

SEQ ID NO: 3283577 - RNA, 23 nt, Mycobacterium tuberculosis H37Rv
gcgggugcuggucaacagcggca

SEQ ID NO: 3283578 - RNA, 20 nt, Mycobacterium tuberculosis H37Rv
gcggguggccaucaccgcgc

SEQ ID NO: 3283579 - RNA, 13 nt, Mycobacterium tuberculosis H37Rv
gcggguggccggg

SEQ ID NO: 3283580 - RNA, 18 nt, Mycobacterium tuberculosis H37Rv
gcggguggcgccaggucg

SEQ ID NO: 3283581 - RNA, 18 nt, Mycobacterium tuberculosis H37Rv
gcggguggcgccaguucg

SEQ ID NO: 3283582 - RNA, 18 nt, Mycobacterium tuberculosis H37Rv
gcggguggcgccggugcg

SEQ ID NO: 3283583 - RNA, 22 nt, Mycobacterium tuberculosis H37Rv
gcggguggugaaguagucggcg

SEQ ID NO: 3283584 - RNA, 12 nt, Mycobacterium tuberculosis H37Rv
gcggguggugcc

SEQ ID NO: 3283585 - RNA, 13 nt, Mycobacterium tuberculosis H37Rv
gcggguggugcca

SEQ ID NO: 3283586 - RNA, 17 nt, Mycobacterium tuberculosis H37Rv
gcggguguggcuacgac

SEQ ID NO: 3283587 - RNA, 20 nt, Mycobacterium tuberculosis H37Rv
gcggguguuccacaccaggc

SEQ ID NO: 3283588 - RNA, 23 nt, Mycobacterium tuberculosis H37Rv
gcggguguuccacaccaggccga

SEQ ID NO: 3283589 - RNA, 17 nt, Mycobacterium tuberculosis H37Rv
gcggguucaacgcgcgc

SEQ ID NO: 3283590 - RNA, 19 nt, Mycobacterium tuberculosis H37Rv
gcggguucaacgcgcgcac

SEQ ID NO: 3283591 - RNA, 20 nt, Mycobacterium tuberculosis H37Rv
gcggguucaacgcgcgcacg

SEQ ID NO: 3283592 - RNA, 21 nt, Mycobacterium tuberculosis H37Rv
gcggguucacugccggccaac

SEQ ID NO: 3283593 - RNA, 15 nt, Mycobacterium tuberculosis H37Rv
gcggguucgacguug

SEQ ID NO: 3283594 - RNA, 18 nt, Mycobacterium tuberculosis H37Rv
gcggguucggacgagguc

SEQ ID NO: 3283595 - RNA, 18 nt, Mycobacterium tuberculosis H37Rv
gcggguugccucggcgag

SEQ ID NO: 3283596 - RNA, 17 nt, Mycobacterium tuberculosis H37Rv
gcggguugcggucaccg

SEQ ID NO: 3283597 - RNA, 18 nt, Mycobacterium tuberculosis H37Rv
gcggguuggguggcaccg

SEQ ID NO: 3283598 - RNA, 19 nt, Mycobacterium tuberculosis H37Rv
gcggguuggguggcaccgg

SEQ ID NO: 3283599 - RNA, 23 nt, Mycobacterium tuberculosis H37Rv
gcggguuggguggcaccggucgg

SEQ ID NO: 3283600 - RNA, 21 nt, Mycobacterium tuberculosis H37Rv
gcgguaaagaucuugucgcgu

SEQ ID NO: 3283601 - RNA, 23 nt, Mycobacterium tuberculosis H37Rv
gcgguaaaugccugcccaccuuc

SEQ ID NO: 3283602 - RNA, 19 nt, Mycobacterium tuberculosis H37Rv
gcgguaaccacgcggauca

SEQ ID NO: 3283603 - RNA, 20 nt, Mycobacterium tuberculosis H37Rv
gcgguaacucuggugugggc

SEQ ID NO: 3283604 - RNA, 15 nt, Mycobacterium tuberculosis H37Rv
gcgguaagggcgggc

SEQ ID NO: 3283605 - RNA, 16 nt, Mycobacterium tuberculosis H37Rv
gcgguaagggcgggcu

SEQ ID NO: 3283606 - RNA, 14 nt, Mycobacterium tuberculosis H37Rv
gcgguaauggcgug

SEQ ID NO: 3283607 - RNA, 21 nt, Mycobacterium tuberculosis H37Rv
gcgguacaucgaccaccucga

SEQ ID NO: 3283608 - RNA, 15 nt, Mycobacterium tuberculosis H37Rv
gcgguaccaucaccg

SEQ ID NO: 3283609 - RNA, 19 nt, Mycobacterium tuberculosis H37Rv
gcgguaccgccgcggucgg

SEQ ID NO: 3283610 - RNA, 16 nt, Mycobacterium tuberculosis H37Rv
gcgguaccgcucgggc

SEQ ID NO: 3283611 - RNA, 17 nt, Mycobacterium tuberculosis H37Rv
gcgguaccgcucgggcg

SEQ ID NO: 3283612 - RNA, 18 nt, Mycobacterium tuberculosis H37Rv
gcgguaccggaaucggcg

SEQ ID NO: 3283613 - RNA, 14 nt, Mycobacterium tuberculosis H37Rv
gcgguaccgguguc

SEQ ID NO: 3283614 - RNA, 18 nt, Mycobacterium tuberculosis H37Rv
gcgguacgccggucggug

SEQ ID NO: 3283615 - RNA, 17 nt, Mycobacterium tuberculosis H37Rv
gcgguacgggucgccgg

SEQ ID NO: 3283616 - RNA, 14 nt, Mycobacterium tuberculosis H37Rv
gcgguacugcgcag

SEQ ID NO: 3283617 - RNA, 16 nt, Mycobacterium tuberculosis H37Rv
gcgguagagcucuggu

SEQ ID NO: 3283618 - RNA, 20 nt, Mycobacterium tuberculosis H37Rv
gcgguagcagccgcugagcg

SEQ ID NO: 3283619 - RNA, 17 nt, Mycobacterium tuberculosis H37Rv
gcgguagccgaccagcg

SEQ ID NO: 3283620 - RNA, 14 nt, Mycobacterium tuberculosis H37Rv
gcgguagccgagcu

SEQ ID NO: 3283621 - RNA, 16 nt, Mycobacterium tuberculosis H37Rv
gcgguagccgagcucg

SEQ ID NO: 3283622 - RNA, 20 nt, Mycobacterium tuberculosis H37Rv
gcgguagcgauuccaggaug

SEQ ID NO: 3283623 - RNA, 19 nt, Mycobacterium tuberculosis H37Rv
gcgguagcggaccugcgag

SEQ ID NO: 3283624 - RNA, 16 nt, Mycobacterium tuberculosis H37Rv
gcgguagcugcccagc

SEQ ID NO: 3283625 - RNA, 17 nt, Mycobacterium tuberculosis H37Rv
gcgguagcugcccagcg

SEQ ID NO: 3283626 - RNA, 22 nt, Mycobacterium tuberculosis H37Rv
gcgguagcuuccgcgacgcucg

SEQ ID NO: 3283627 - RNA, 18 nt, Mycobacterium tuberculosis H37Rv
gcgguaggagcggguggc

SEQ ID NO: 3283628 - RNA, 23 nt, Mycobacterium tuberculosis H37Rv
gcgguaggcguugaucgccgggc

SEQ ID NO: 3283629 - RNA, 22 nt, Mycobacterium tuberculosis H37Rv
gcgguaggcguuggacgcgaac

SEQ ID NO: 3283630 - RNA, 21 nt, Mycobacterium tuberculosis H37Rv
gcgguaggcuugcaaggucgc

SEQ ID NO: 3283631 - RNA, 16 nt, Mycobacterium tuberculosis H37Rv
gcgguagucggccagc

SEQ ID NO: 3283632 - RNA, 21 nt, Mycobacterium tuberculosis H37Rv
gcgguagucggccagcucgcg

SEQ ID NO: 3283633 - RNA, 19 nt, Mycobacterium tuberculosis H37Rv
gcgguaguugucccgccgc

SEQ ID NO: 3283634 - RNA, 22 nt, Mycobacterium tuberculosis H37Rv
gcgguaguugucccgccgcgcg

SEQ ID NO: 3283635 - RNA, 19 nt, Mycobacterium tuberculosis H37Rv
gcgguaucccccagccgcg

SEQ ID NO: 3283636 - RNA, 17 nt, Mycobacterium tuberculosis H37Rv
gcgguaucggucagcca

SEQ ID NO: 3283637 - RNA, 15 nt, Mycobacterium tuberculosis H37Rv
gcgguaucggucgac

SEQ ID NO: 3283638 - RNA, 17 nt, Mycobacterium tuberculosis H37Rv
gcgguauuuugccggau

SEQ ID NO: 3283639 - RNA, 21 nt, Mycobacterium tuberculosis H37Rv
gcgguauuuugccggauucuc

SEQ ID NO: 3283640 - RNA, 22 nt, Mycobacterium tuberculosis H37Rv
gcggucaacgcuagcgucgugu

SEQ ID NO: 3283641 - RNA, 21 nt, Mycobacterium tuberculosis H37Rv
gcggucaacgcugacgugaag

SEQ ID NO: 3283642 - RNA, 22 nt, Mycobacterium tuberculosis H37Rv
gcggucaauguggcgcuucggc

SEQ ID NO: 3283643 - RNA, 17 nt, Mycobacterium tuberculosis H37Rv
gcggucaccgacgcaga

SEQ ID NO: 3283644 - RNA, 17 nt, Mycobacterium tuberculosis H37Rv
gcggucagacgccggcc

SEQ ID NO: 3283645 - RNA, 22 nt, Mycobacterium tuberculosis H37Rv
gcggucagaugcgccgcugguc

SEQ ID NO: 3283646 - RNA, 16 nt, Mycobacterium tuberculosis H37Rv
gcggucagcagcgccg

SEQ ID NO: 3283647 - RNA, 17 nt, Mycobacterium tuberculosis H37Rv
gcggucagcagcgccgu

SEQ ID NO: 3283648 - RNA, 19 nt, Mycobacterium tuberculosis H37Rv
gcggucaucgagcugaccu

SEQ ID NO: 3283649 - RNA, 15 nt, Mycobacterium tuberculosis H37Rv
gcggucaucgccucg

SEQ ID NO: 3283650 - RNA, 18 nt, Mycobacterium tuberculosis H37Rv
gcgguccaacagcgccag

SEQ ID NO: 3283651 - RNA, 21 nt, Mycobacterium tuberculosis H37Rv
gcgguccacaaaccgugcacg

SEQ ID NO: 3283652 - RNA, 20 nt, Mycobacterium tuberculosis H37Rv
gcgguccaccggcccucgcc

SEQ ID NO: 3283653 - RNA, 22 nt, Mycobacterium tuberculosis H37Rv
gcgguccagaaugucgcgggug

SEQ ID NO: 3283654 - RNA, 23 nt, Mycobacterium tuberculosis H37Rv
gcgguccagacaucagugcgccg

SEQ ID NO: 3283655 - RNA, 14 nt, Mycobacterium tuberculosis H37Rv
gcgguccagccacc

SEQ ID NO: 3283656 - RNA, 15 nt, Mycobacterium tuberculosis H37Rv
gcgguccagcgucgc

SEQ ID NO: 3283657 - RNA, 16 nt, Mycobacterium tuberculosis H37Rv
gcgguuagcagccgcu

SEQ ID NO: 3283658 - RNA, 14 nt, Mycobacterium tuberculosis H37Rv
gcgguuaucgccga

SEQ ID NO: 3283659 - RNA, 15 nt, Mycobacterium tuberculosis H37Rv
gcgguuaucgccgag

SEQ ID NO: 3283660 - RNA, 15 nt, Mycobacterium tuberculosis H37Rv
gcgguucaucaccgu

SEQ ID NO: 3283661 - RNA, 19 nt, Mycobacterium tuberculosis H37Rv
gcgguucgaacgcgaucga

SEQ ID NO: 3283662 - RNA, 16 nt, Mycobacterium tuberculosis H37Rv
gcgguucgcauugggg

SEQ ID NO: 3283663 - RNA, 17 nt, Mycobacterium tuberculosis H37Rv
gcgguucgcugcggcgg

SEQ ID NO: 3283664 - RNA, 15 nt, Mycobacterium tuberculosis H37Rv
gcgguucucgagcuc

SEQ ID NO: 3283665 - RNA, 17 nt, Mycobacterium tuberculosis H37Rv
gcgguugccuucuuggc

SEQ ID NO: 3283666 - RNA, 20 nt, Mycobacterium tuberculosis H37Rv
gcgguuggcggcgaugguau

SEQ ID NO: 3283667 - RNA, 13 nt, Mycobacterium tuberculosis H37Rv
gcgguuggugcag

SEQ ID NO: 3283668 - RNA, 13 nt, Mycobacterium tuberculosis H37Rv
gcgguuggugguu

SEQ ID NO: 3283669 - RNA, 22 nt, Mycobacterium tuberculosis H37Rv
gcgguugugcugggugccgcag

SEQ ID NO: 3283670 - RNA, 22 nt, Mycobacterium tuberculosis H37Rv
gcgguuuccgcacgaucgcccg

SEQ ID NO: 3283671 - RNA, 23 nt, Mycobacterium tuberculosis H37Rv
gcgguuuggaucacccgccgcgu

SEQ ID NO: 3283672 - RNA, 18 nt, Mycobacterium tuberculosis H37Rv
gcgguuuucggcugccgc

SEQ ID NO: 3283673 - RNA, 21 nt, Mycobacterium tuberculosis H37Rv
gcguaaaggccuugggcggca

SEQ ID NO: 3283674 - RNA, 23 nt, Mycobacterium tuberculosis H37Rv
gcguaaaggccuugggcggcacu

SEQ ID NO: 3283675 - RNA, 15 nt, Mycobacterium tuberculosis H37Rv
gcguaaugcugcugc

SEQ ID NO: 3283676 - RNA, 16 nt, Mycobacterium tuberculosis H37Rv
gcguacaaaccgucgg

SEQ ID NO: 3283677 - RNA, 17 nt, Mycobacterium tuberculosis H37Rv
gcguacaaaccgucggg

SEQ ID NO: 3283678 - RNA, 13 nt, Mycobacterium tuberculosis H37Rv
gcguacagcaccg

SEQ ID NO: 3283679 - RNA, 17 nt, Mycobacterium tuberculosis H37Rv
gcguacagcgccugggu

SEQ ID NO: 3283680 - RNA, 15 nt, Mycobacterium tuberculosis H37Rv
gcguacaggccggcc

SEQ ID NO: 3283681 - RNA, 18 nt, Mycobacterium tuberculosis H37Rv
gcguaccaguugauuccg

SEQ ID NO: 3283682 - RNA, 18 nt, Mycobacterium tuberculosis H37Rv
gcguacccgaucagcgac

SEQ ID NO: 3283683 - RNA, 19 nt, Mycobacterium tuberculosis H37Rv
gcguacccgaucagcgacg

SEQ ID NO: 3283684 - RNA, 18 nt, Mycobacterium tuberculosis H37Rv
gcguacgacccccgauca

SEQ ID NO: 3283685 - RNA, 14 nt, Mycobacterium tuberculosis H37Rv
gcguacucccccga

SEQ ID NO: 3283686 - RNA, 23 nt, Mycobacterium tuberculosis H37Rv
gcguacucccccgaaccugcggc

SEQ ID NO: 3283687 - RNA, 18 nt, Mycobacterium tuberculosis H37Rv
gcguacucggcauccagg

SEQ ID NO: 3283688 - RNA, 19 nt, Mycobacterium tuberculosis H37Rv
gcguacugguccgcacggu

SEQ ID NO: 3283689 - RNA, 21 nt, Mycobacterium tuberculosis H37Rv
gcguagaagaaguacaucugc

SEQ ID NO: 3283690 - RNA, 19 nt, Mycobacterium tuberculosis H37Rv
gcguagaucaucagcgacu

SEQ ID NO: 3283691 - RNA, 14 nt, Mycobacterium tuberculosis H37Rv
gcguagcagcgaua

SEQ ID NO: 3283692 - RNA, 17 nt, Mycobacterium tuberculosis H37Rv
gcguagcaggucgacgg

SEQ ID NO: 3283693 - RNA, 17 nt, Mycobacterium tuberculosis H37Rv
gcguagcgaccucgccg

SEQ ID NO: 3283694 - RNA, 22 nt, Mycobacterium tuberculosis H37Rv
gcguagcgaccucgccgcggcg

SEQ ID NO: 3283695 - RNA, 22 nt, Mycobacterium tuberculosis H37Rv
gcguagcgggggagcgaacggc

SEQ ID NO: 3283696 - RNA, 17 nt, Mycobacterium tuberculosis H37Rv
gcguagcucgcggggcg

SEQ ID NO: 3283697 - RNA, 16 nt, Mycobacterium tuberculosis H37Rv
gcguagcuggccaggu

SEQ ID NO: 3283698 - RNA, 22 nt, Mycobacterium tuberculosis H37Rv
gcguagcuggccagguugccgu

SEQ ID NO: 3283699 - RNA, 18 nt, Mycobacterium tuberculosis H37Rv
gcguaggccuugcucagc

SEQ ID NO: 3283700 - RNA, 20 nt, Mycobacterium tuberculosis H37Rv
gcguaggccuugcucagccg

SEQ ID NO: 3283701 - RNA, 21 nt, Mycobacterium tuberculosis H37Rv
gcguaggccuugcucagccgg

SEQ ID NO: 3283702 - RNA, 12 nt, Mycobacterium tuberculosis H37Rv
gcguagggccag

SEQ ID NO: 3283703 - RNA, 15 nt, Mycobacterium tuberculosis H37Rv
gcguagggccagcgc

SEQ ID NO: 3283704 - RNA, 21 nt, Mycobacterium tuberculosis H37Rv
gcguagguggccagcgcggcg

SEQ ID NO: 3283705 - RNA, 22 nt, Mycobacterium tuberculosis H37Rv
gcguagguggccagcgcggcga

SEQ ID NO: 3283706 - RNA, 17 nt, Mycobacterium tuberculosis H37Rv
gcguaguccaggccguc

SEQ ID NO: 3283707 - RNA, 21 nt, Mycobacterium tuberculosis H37Rv
gcguagugcggcguggaucag

SEQ ID NO: 3283708 - RNA, 23 nt, Mycobacterium tuberculosis H37Rv
gcguauagcaugccgcggcggaa

SEQ ID NO: 3283709 - RNA, 17 nt, Mycobacterium tuberculosis H37Rv
gcguaucccgugugcgg

SEQ ID NO: 3283710 - RNA, 15 nt, Mycobacterium tuberculosis H37Rv
gcguaucgacccgcg

SEQ ID NO: 3283711 - RNA, 22 nt, Mycobacterium tuberculosis H37Rv
gcguaucgacccgcgcaaccgg

SEQ ID NO: 3283712 - RNA, 17 nt, Mycobacterium tuberculosis H37Rv
gcguaucgggcccccug

SEQ ID NO: 3283713 - RNA, 13 nt, Mycobacterium tuberculosis H37Rv
gcguaucucccaa

SEQ ID NO: 3283714 - RNA, 21 nt, Mycobacterium tuberculosis H37Rv
gcguaucucccaacggcagcg

SEQ ID NO: 3283715 - RNA, 17 nt, Mycobacterium tuberculosis H37Rv
gcguaugcccacgaacc

SEQ ID NO: 3283716 - RNA, 18 nt, Mycobacterium tuberculosis H37Rv
gcguauucggcaucgccg

SEQ ID NO: 3283717 - RNA, 17 nt, Mycobacterium tuberculosis H37Rv
gcguauugcaccgccag

SEQ ID NO: 3283718 - RNA, 19 nt, Mycobacterium tuberculosis H37Rv
gcgucaaacaccuccagga

SEQ ID NO: 3283719 - RNA, 18 nt, Mycobacterium tuberculosis H37Rv
gcgucaaauccagcgagg

SEQ ID NO: 3283720 - RNA, 17 nt, Mycobacterium tuberculosis H37Rv
gcgucaaccacggccgc

SEQ ID NO: 3283721 - RNA, 16 nt, Mycobacterium tuberculosis H37Rv
gcgucaagggcugggu

SEQ ID NO: 3283722 - RNA, 13 nt, Mycobacterium tuberculosis H37Rv
gcgucacaccacg

SEQ ID NO: 3283723 - RNA, 21 nt, Mycobacterium tuberculosis H37Rv
gcgucacaccagcgggcaucg

SEQ ID NO: 3283724 - RNA, 13 nt, Mycobacterium tuberculosis H37Rv
gcgucacauccga

SEQ ID NO: 3283725 - RNA, 20 nt, Mycobacterium tuberculosis H37Rv
gcgucacauccgacagcagc

SEQ ID NO: 3283726 - RNA, 22 nt, Mycobacterium tuberculosis H37Rv
gcgucaccguguugcacgcggg

SEQ ID NO: 3283727 - RNA, 18 nt, Mycobacterium tuberculosis H37Rv
gcgucagauccggccguu

SEQ ID NO: 3283728 - RNA, 20 nt, Mycobacterium tuberculosis H37Rv
gcgucagcgccuuguggcac

SEQ ID NO: 3283729 - RNA, 16 nt, Mycobacterium tuberculosis H37Rv
gcgucaggcacaacgc

SEQ ID NO: 3283730 - RNA, 13 nt, Mycobacterium tuberculosis H37Rv
gcgucaggccagc

SEQ ID NO: 3283731 - RNA, 23 nt, Mycobacterium tuberculosis H37Rv
gcgucaguccucaucgagcgcgc

SEQ ID NO: 3283732 - RNA, 21 nt, Mycobacterium tuberculosis H37Rv
gcgucaucaccgguacugcga

SEQ ID NO: 3283733 - RNA, 17 nt, Mycobacterium tuberculosis H37Rv
gcgucauccgcggcagg

SEQ ID NO: 3283734 - RNA, 17 nt, Mycobacterium tuberculosis H37Rv
gcgucaugaugucgaca

SEQ ID NO: 3283735 - RNA, 20 nt, Mycobacterium tuberculosis H37Rv
gcgucaugaugucgacaucg

SEQ ID NO: 3283736 - RNA, 21 nt, Mycobacterium tuberculosis H37Rv
gcgucaugaugucgacaucga

SEQ ID NO: 3283737 - RNA, 20 nt, Mycobacterium tuberculosis H37Rv
gcguccaacccaggguggcg

SEQ ID NO: 3283738 - RNA, 15 nt, Mycobacterium tuberculosis H37Rv
gcguccaaggcgcug

SEQ ID NO: 3283739 - RNA, 12 nt, Mycobacterium tuberculosis H37Rv
gcguccaccacg

SEQ ID NO: 3283740 - RNA, 21 nt, Mycobacterium tuberculosis H37Rv
gcguccacccacgaucagcag

SEQ ID NO: 3283741 - RNA, 22 nt, Mycobacterium tuberculosis H37Rv
gcguccacccacgaucagcagc

SEQ ID NO: 3283742 - RNA, 19 nt, Mycobacterium tuberculosis H37Rv
gcguccacgcugaccaacg

SEQ ID NO: 3283743 - RNA, 15 nt, Mycobacterium tuberculosis H37Rv
gcguccagcgcggcc

SEQ ID NO: 3283744 - RNA, 18 nt, Mycobacterium tuberculosis H37Rv
gcguccaggccagggcgg

SEQ ID NO: 3283745 - RNA, 22 nt, Mycobacterium tuberculosis H37Rv
gcguccaggccagggcgguggc

SEQ ID NO: 3283746 - RNA, 17 nt, Mycobacterium tuberculosis H37Rv
gcguccaggcgagugaa

SEQ ID NO: 3283747 - RNA, 16 nt, Mycobacterium tuberculosis H37Rv
gcguccaggugcgccg

SEQ ID NO: 3283748 - RNA, 22 nt, Mycobacterium tuberculosis H37Rv
gcguccaggugcgccguggcau

SEQ ID NO: 3283749 - RNA, 18 nt, Mycobacterium tuberculosis H37Rv
gcguccauggucgcgcca

SEQ ID NO: 3283750 - RNA, 19 nt, Mycobacterium tuberculosis H37Rv
gcguccauggucgcgccac

SEQ ID NO: 3283751 - RNA, 22 nt, Mycobacterium tuberculosis H37Rv
gcgucccaaucgggaucgcugc

SEQ ID NO: 3283752 - RNA, 23 nt, Mycobacterium tuberculosis H37Rv
gcgucguugaggaagcccgaugc

SEQ ID NO: 3283753 - RNA, 17 nt, Mycobacterium tuberculosis H37Rv
gcgucguugcucggucu

SEQ ID NO: 3283754 - RNA, 20 nt, Mycobacterium tuberculosis H37Rv
gcgucguugcucggucucgu

SEQ ID NO: 3283755 - RNA, 16 nt, Mycobacterium tuberculosis H37Rv
gcgucguugucgucgc

SEQ ID NO: 3283756 - RNA, 20 nt, Mycobacterium tuberculosis H37Rv
gcgucguugucgucgccggc

SEQ ID NO: 3283757 - RNA, 18 nt, Mycobacterium tuberculosis H37Rv
gcgucuccagcuggguga

SEQ ID NO: 3283758 - RNA, 23 nt, Mycobacterium tuberculosis H37Rv
gcgucucgaucaccucgcgggug

SEQ ID NO: 3283759 - RNA, 20 nt, Mycobacterium tuberculosis H37Rv
gcgucugacaucgucgacga

SEQ ID NO: 3283760 - RNA, 15 nt, Mycobacterium tuberculosis H37Rv
gcgucugagcgagcu

SEQ ID NO: 3283761 - RNA, 20 nt, Mycobacterium tuberculosis H37Rv
gcgucugagcgccggcaucg

SEQ ID NO: 3283762 - RNA, 17 nt, Mycobacterium tuberculosis H37Rv
gcgucugcagcgggcgu

SEQ ID NO: 3283763 - RNA, 18 nt, Mycobacterium tuberculosis H37Rv
gcgucugcccgcccagcc

SEQ ID NO: 3283764 - RNA, 22 nt, Mycobacterium tuberculosis H37Rv
gcgucugcgaucccgaucgcgc

SEQ ID NO: 3283765 - RNA, 16 nt, Mycobacterium tuberculosis H37Rv
gcgucugcgguggccu

SEQ ID NO: 3283766 - RNA, 17 nt, Mycobacterium tuberculosis H37Rv
gcgucugcucaccagcg

SEQ ID NO: 3283767 - RNA, 12 nt, Mycobacterium tuberculosis H37Rv
gcgucugcucgc

SEQ ID NO: 3283768 - RNA, 14 nt, Mycobacterium tuberculosis H37Rv
gcgucugcucgcca

SEQ ID NO: 3283769 - RNA, 17 nt, Mycobacterium tuberculosis H37Rv
gcgucugcucgccagcg

SEQ ID NO: 3283770 - RNA, 16 nt, Mycobacterium tuberculosis H37Rv
gcgucugcucgccagg

SEQ ID NO: 3283771 - RNA, 17 nt, Mycobacterium tuberculosis H37Rv
gcgucugcucgccaggc

SEQ ID NO: 3283772 - RNA, 18 nt, Mycobacterium tuberculosis H37Rv
gcgucugcucgccaggca

SEQ ID NO: 3283773 - RNA, 18 nt, Mycobacterium tuberculosis H37Rv
gcgucugcucgccaggcc

SEQ ID NO: 3283774 - RNA, 20 nt, Mycobacterium tuberculosis H37Rv
gcgucugcucgcgcagccgg

SEQ ID NO: 3283775 - RNA, 16 nt, Mycobacterium tuberculosis H37Rv
gcgucugcucgcgccc

SEQ ID NO: 3283776 - RNA, 22 nt, Mycobacterium tuberculosis H37Rv
gcgucugcucgcgccggugagg

SEQ ID NO: 3283777 - RNA, 14 nt, Mycobacterium tuberculosis H37Rv
gcgucugcucggcg

SEQ ID NO: 3283778 - RNA, 17 nt, Mycobacterium tuberculosis H37Rv
gcgucugcucggcggcc

SEQ ID NO: 3283779 - RNA, 20 nt, Mycobacterium tuberculosis H37Rv
gcgucugcucggcggugccg

SEQ ID NO: 3283780 - RNA, 12 nt, Mycobacterium tuberculosis H37Rv
gcgucuggcgac

SEQ ID NO: 3283781 - RNA, 16 nt, Mycobacterium tuberculosis H37Rv
gcgucuggucagccgc

SEQ ID NO: 3283782 - RNA, 18 nt, Mycobacterium tuberculosis H37Rv
gcgucugugucccgucga

SEQ ID NO: 3283783 - RNA, 21 nt, Mycobacterium tuberculosis H37Rv
gcgucuucagguccaccgcug

SEQ ID NO: 3283784 - RNA, 18 nt, Mycobacterium tuberculosis H37Rv
gcgucuuccucggccacc

SEQ ID NO: 3283785 - RNA, 19 nt, Mycobacterium tuberculosis H37Rv
gcgucuuccucggccaccc

SEQ ID NO: 3283786 - RNA, 20 nt, Mycobacterium tuberculosis H37Rv
gcgucuucggucgcggccuc

SEQ ID NO: 3283787 - RNA, 21 nt, Mycobacterium tuberculosis H37Rv
gcgugaaccuuacgacgccgu

SEQ ID NO: 3283788 - RNA, 15 nt, Mycobacterium tuberculosis H37Rv
gcgugacccgacaug

SEQ ID NO: 3283789 - RNA, 19 nt, Mycobacterium tuberculosis H37Rv
gcgugaccgugccgucggc

SEQ ID NO: 3283790 - RNA, 14 nt, Mycobacterium tuberculosis H37Rv
gcgugacgaccagc

SEQ ID NO: 3283791 - RNA, 15 nt, Mycobacterium tuberculosis H37Rv
gcgugacgaccagcc

SEQ ID NO: 3283792 - RNA, 19 nt, Mycobacterium tuberculosis H37Rv
gcgugacgaccagccccgc

SEQ ID NO: 3283793 - RNA, 16 nt, Mycobacterium tuberculosis H37Rv
gcgugagcagacgcaa

SEQ ID NO: 3283794 - RNA, 21 nt, Mycobacterium tuberculosis H37Rv
gcgugagccaugccgcucggc

SEQ ID NO: 3283795 - RNA, 12 nt, Mycobacterium tuberculosis H37Rv
gcgugagcgccg

SEQ ID NO: 3283796 - RNA, 17 nt, Mycobacterium tuberculosis H37Rv
gcgugagcugcucgagc

SEQ ID NO: 3283797 - RNA, 19 nt, Mycobacterium tuberculosis H37Rv
gcgugauagcccuugccgu

SEQ ID NO: 3283798 - RNA, 12 nt, Mycobacterium tuberculosis H37Rv
gcgugaucccgc

SEQ ID NO: 3283799 - RNA, 15 nt, Mycobacterium tuberculosis H37Rv
gcgugaugguugcuc

SEQ ID NO: 3283800 - RNA, 16 nt, Mycobacterium tuberculosis H37Rv
gcgugcacaggucagc

SEQ ID NO: 3283801 - RNA, 17 nt, Mycobacterium tuberculosis H37Rv
gcgugcacaggucagcg

SEQ ID NO: 3283802 - RNA, 19 nt, Mycobacterium tuberculosis H37Rv
gcgugcacccccaucaccg

SEQ ID NO: 3283803 - RNA, 16 nt, Mycobacterium tuberculosis H37Rv
gcgugcacugaccgcg

SEQ ID NO: 3283804 - RNA, 21 nt, Mycobacterium tuberculosis H37Rv
gcgugcacugaccgcggcugu

SEQ ID NO: 3283805 - RNA, 15 nt, Mycobacterium tuberculosis H37Rv
gcgugcagacccggu

SEQ ID NO: 3283806 - RNA, 15 nt, Mycobacterium tuberculosis H37Rv
gcgugcagcggcggg

SEQ ID NO: 3283807 - RNA, 20 nt, Mycobacterium tuberculosis H37Rv
gcgugcaggcugucaauccg

SEQ ID NO: 3283808 - RNA, 15 nt, Mycobacterium tuberculosis H37Rv
gcgugcauaggccgc

SEQ ID NO: 3283809 - RNA, 17 nt, Mycobacterium tuberculosis H37Rv
gcgugcaucgccugcgc

SEQ ID NO: 3283810 - RNA, 12 nt, Mycobacterium tuberculosis H37Rv
gcgugcaucgcg

SEQ ID NO: 3283811 - RNA, 18 nt, Mycobacterium tuberculosis H37Rv
gcgugcaucgcgauuccg

SEQ ID NO: 3283812 - RNA, 14 nt, Mycobacterium tuberculosis H37Rv
gcgugcaugagccg

SEQ ID NO: 3283813 - RNA, 16 nt, Mycobacterium tuberculosis H37Rv
gcgugccacucgaugc

SEQ ID NO: 3283814 - RNA, 15 nt, Mycobacterium tuberculosis H37Rv
gcgugccagcgcccc

SEQ ID NO: 3283815 - RNA, 14 nt, Mycobacterium tuberculosis H37Rv
gcgugccccagucc

SEQ ID NO: 3283816 - RNA, 14 nt, Mycobacterium tuberculosis H37Rv
gcgugcccgccggc

SEQ ID NO: 3283817 - RNA, 14 nt, Mycobacterium tuberculosis H37Rv
gcgugccgaccagc

SEQ ID NO: 3283818 - RNA, 14 nt, Mycobacterium tuberculosis H37Rv
gcgugccgacccgc

SEQ ID NO: 3283819 - RNA, 15 nt, Mycobacterium tuberculosis H37Rv
gcgugccgccgcaga

SEQ ID NO: 3283820 - RNA, 19 nt, Mycobacterium tuberculosis H37Rv
gcgugccggcagcgguggc

SEQ ID NO: 3283821 - RNA, 23 nt, Mycobacterium tuberculosis H37Rv
gcgugccggggauaucacgacgc

SEQ ID NO: 3283822 - RNA, 21 nt, Mycobacterium tuberculosis H37Rv
gcgugcgauucugcgucugcu

SEQ ID NO: 3283823 - RNA, 13 nt, Mycobacterium tuberculosis H37Rv
gcgugcggcgaag

SEQ ID NO: 3283824 - RNA, 13 nt, Mycobacterium tuberculosis H37Rv
gcgugcggcugcc

SEQ ID NO: 3283825 - RNA, 14 nt, Mycobacterium tuberculosis H37Rv
gcgugcggcugcca

SEQ ID NO: 3283826 - RNA, 15 nt, Mycobacterium tuberculosis H37Rv
gcgugcgggggacgg

SEQ ID NO: 3283827 - RNA, 13 nt, Mycobacterium tuberculosis H37Rv
gcgugcucgacaa

SEQ ID NO: 3283828 - RNA, 13 nt, Mycobacterium tuberculosis H37Rv
gcgugcugcggac

SEQ ID NO: 3283829 - RNA, 15 nt, Mycobacterium tuberculosis H37Rv
gcgugcugugcucac

SEQ ID NO: 3283830 - RNA, 13 nt, Mycobacterium tuberculosis H37Rv
gcgugcuugaccg

SEQ ID NO: 3283831 - RNA, 13 nt, Mycobacterium tuberculosis H37Rv
gcgugcuugagca

SEQ ID NO: 3283832 - RNA, 15 nt, Mycobacterium tuberculosis H37Rv
gcguggaaaccggug

SEQ ID NO: 3283833 - RNA, 22 nt, Mycobacterium tuberculosis H37Rv
gcguggaaaccggugguagcga

SEQ ID NO: 3283834 - RNA, 19 nt, Mycobacterium tuberculosis H37Rv
gcguggaacuugcgcaggu

SEQ ID NO: 3283835 - RNA, 14 nt, Mycobacterium tuberculosis H37Rv
gcguggacgcccgc

SEQ ID NO: 3283836 - RNA, 17 nt, Mycobacterium tuberculosis H37Rv
gcguggacgcccgcccg

SEQ ID NO: 3283837 - RNA, 22 nt, Mycobacterium tuberculosis H37Rv
gcguggacgcccgcccgcacga

SEQ ID NO: 3283838 - RNA, 18 nt, Mycobacterium tuberculosis H37Rv
gcguggaucuuggccagc

SEQ ID NO: 3283839 - RNA, 23 nt, Mycobacterium tuberculosis H37Rv
gcguggcaguacaccggcgugcu

SEQ ID NO: 3283840 - RNA, 24 nt, Mycobacterium tuberculosis H37Rv
gcguggccaacucuucagcaagcc

SEQ ID NO: 3283841 - RNA, 16 nt, Mycobacterium tuberculosis H37Rv
gcguggccaauccggc

SEQ ID NO: 3283842 - RNA, 16 nt, Mycobacterium tuberculosis H37Rv
gcguggcccucggcga

SEQ ID NO: 3283843 - RNA, 17 nt, Mycobacterium tuberculosis H37Rv
gcguggcccucggcgau

SEQ ID NO: 3283844 - RNA, 16 nt, Mycobacterium tuberculosis H37Rv
gcguggcgcaccaccg

SEQ ID NO: 3283845 - RNA, 22 nt, Mycobacterium tuberculosis H37Rv
gcguggcgggcugcagccgaca

SEQ ID NO: 3283846 - RNA, 15 nt, Mycobacterium tuberculosis H37Rv
gcguggcuggcggcg

SEQ ID NO: 3283847 - RNA, 17 nt, Mycobacterium tuberculosis H37Rv
gcguggcuugguggucg

SEQ ID NO: 3283848 - RNA, 23 nt, Mycobacterium tuberculosis H37Rv
gcgugggcagcgcgaucaccgag

SEQ ID NO: 3283849 - RNA, 13 nt, Mycobacterium tuberculosis H37Rv
gcuaauugcggcc

SEQ ID NO: 3283850 - RNA, 23 nt, Mycobacterium tuberculosis H37Rv
gcuacacccguagaccuucgagu

SEQ ID NO: 3283851 - RNA, 17 nt, Mycobacterium tuberculosis H37Rv
gcuacagcuugcguagc

SEQ ID NO: 3283852 - RNA, 14 nt, Mycobacterium tuberculosis H37Rv
gcuacaucggcggc

SEQ ID NO: 3283853 - RNA, 22 nt, Mycobacterium tuberculosis H37Rv
gcuaccaaaaaaggucagcgug

SEQ ID NO: 3283854 - RNA, 20 nt, Mycobacterium tuberculosis H37Rv
gcuacccaccggccggugcc

SEQ ID NO: 3283855 - RNA, 13 nt, Mycobacterium tuberculosis H37Rv
gcuacccauggcc

SEQ ID NO: 3283856 - RNA, 23 nt, Mycobacterium tuberculosis H37Rv
gcuacccauggcccguuggcagc

SEQ ID NO: 3283857 - RNA, 17 nt, Mycobacterium tuberculosis H37Rv
gcuacccauucggcggc

SEQ ID NO: 3283858 - RNA, 17 nt, Mycobacterium tuberculosis H37Rv
gcuaccccagccggcag

SEQ ID NO: 3283859 - RNA, 21 nt, Mycobacterium tuberculosis H37Rv
gcuacccccgauggcgucgcc

SEQ ID NO: 3283860 - RNA, 17 nt, Mycobacterium tuberculosis H37Rv
gcuaccccgcagaaucc

SEQ ID NO: 3283861 - RNA, 13 nt, Mycobacterium tuberculosis H37Rv
gcuacccgcgcga

SEQ ID NO: 3283862 - RNA, 20 nt, Mycobacterium tuberculosis H37Rv
gcuacccggacagggcggcg

SEQ ID NO: 3283863 - RNA, 16 nt, Mycobacterium tuberculosis H37Rv
gcuacccgggccaggc

SEQ ID NO: 3283864 - RNA, 22 nt, Mycobacterium tuberculosis H37Rv
gcuaccgaacaguaggccuccg

SEQ ID NO: 3283865 - RNA, 23 nt, Mycobacterium tuberculosis H37Rv
gcuaccgaacaguaggccuccgc

SEQ ID NO: 3283866 - RNA, 18 nt, Mycobacterium tuberculosis H37Rv
gcuaccgcaggugccacc

SEQ ID NO: 3283867 - RNA, 12 nt, Mycobacterium tuberculosis H37Rv
gcuaccgcccgc

SEQ ID NO: 3283868 - RNA, 17 nt, Mycobacterium tuberculosis H37Rv
gcuaccgcgcucccggc

SEQ ID NO: 3283869 - RNA, 19 nt, Mycobacterium tuberculosis H37Rv
gcuaccgcgcucccggcgu

SEQ ID NO: 3283870 - RNA, 16 nt, Mycobacterium tuberculosis H37Rv
gcuaccggcagcugcu

SEQ ID NO: 3283871 - RNA, 13 nt, Mycobacterium tuberculosis H37Rv
gcuacgccccacu

SEQ ID NO: 3283872 - RNA, 20 nt, Mycobacterium tuberculosis H37Rv
gcuacgcgcgcucgcucacc

SEQ ID NO: 3283873 - RNA, 14 nt, Mycobacterium tuberculosis H37Rv
gcuacgcggccgag

SEQ ID NO: 3283874 - RNA, 17 nt, Mycobacterium tuberculosis H37Rv
gcuacgcggccgagguc

SEQ ID NO: 3283875 - RNA, 18 nt, Mycobacterium tuberculosis H37Rv
gcuacggcgacacgccag

SEQ ID NO: 3283876 - RNA, 20 nt, Mycobacterium tuberculosis H37Rv
gcuacggcgacacgccagcc

SEQ ID NO: 3283877 - RNA, 16 nt, Mycobacterium tuberculosis H37Rv
gcuacgucgaccgacg

SEQ ID NO: 3283878 - RNA, 16 nt, Mycobacterium tuberculosis H37Rv
gcuacguuacgccgag

SEQ ID NO: 3283879 - RNA, 17 nt, Mycobacterium tuberculosis H37Rv
gcuacguuacgccgaga

SEQ ID NO: 3283880 - RNA, 13 nt, Mycobacterium tuberculosis H37Rv
gcuacugcgacca

SEQ ID NO: 3283881 - RNA, 20 nt, Mycobacterium tuberculosis H37Rv
gcuacuggugugacgauccc

SEQ ID NO: 3283882 - RNA, 19 nt, Mycobacterium tuberculosis H37Rv
gcuagaccgcuacccgcgc

SEQ ID NO: 3283883 - RNA, 16 nt, Mycobacterium tuberculosis H37Rv
gcuagagccaguuucu

SEQ ID NO: 3283884 - RNA, 23 nt, Mycobacterium tuberculosis H37Rv
gcuagccccgaucaucgacgauu

SEQ ID NO: 3283885 - RNA, 24 nt, Mycobacterium tuberculosis H37Rv
gcuagccccgaucaucgacgauuc

SEQ ID NO: 3283886 - RNA, 13 nt, Mycobacterium tuberculosis H37Rv
gcuagcccggcag

SEQ ID NO: 3283887 - RNA, 20 nt, Mycobacterium tuberculosis H37Rv
gcuagccgggcgcgccggcc

SEQ ID NO: 3283888 - RNA, 14 nt, Mycobacterium tuberculosis H37Rv
gcuagccguucggc

SEQ ID NO: 3283889 - RNA, 16 nt, Mycobacterium tuberculosis H37Rv
gcuagcgccgcgcuug

SEQ ID NO: 3283890 - RNA, 22 nt, Mycobacterium tuberculosis H37Rv
gcuagcgcuauaggccgcaugc

SEQ ID NO: 3283891 - RNA, 16 nt, Mycobacterium tuberculosis H37Rv
gcuagcggauucagcg

SEQ ID NO: 3283892 - RNA, 22 nt, Mycobacterium tuberculosis H37Rv
gcuagcggauucagcgucgcca

SEQ ID NO: 3283893 - RNA, 22 nt, Mycobacterium tuberculosis H37Rv
gcuagcucaacacuuccgggcg

SEQ ID NO: 3283894 - RNA, 15 nt, Mycobacterium tuberculosis H37Rv
gcuagcuuggcggcc

SEQ ID NO: 3283895 - RNA, 19 nt, Mycobacterium tuberculosis H37Rv
gcuagcuuggcggccagcg

SEQ ID NO: 3283896 - RNA, 23 nt, Mycobacterium tuberculosis H37Rv
gcuaggacggcugccgucagccg

SEQ ID NO: 3283897 - RNA, 18 nt, Mycobacterium tuberculosis H37Rv
gcuaggccaccggcgacc

SEQ ID NO: 3283898 - RNA, 21 nt, Mycobacterium tuberculosis H37Rv
gcuagggcgaugagggcuugu

SEQ ID NO: 3283899 - RNA, 17 nt, Mycobacterium tuberculosis H37Rv
gcuaggucaguucccag

SEQ ID NO: 3283900 - RNA, 21 nt, Mycobacterium tuberculosis H37Rv
gcuaggucaguucccagacca

SEQ ID NO: 3283901 - RNA, 17 nt, Mycobacterium tuberculosis H37Rv
gcuaggugacgccgcca

SEQ ID NO: 3283902 - RNA, 20 nt, Mycobacterium tuberculosis H37Rv
gcuagucggggugggacagg

SEQ ID NO: 3283903 - RNA, 21 nt, Mycobacterium tuberculosis H37Rv
gcuagucgugccgcgucggcc

SEQ ID NO: 3283904 - RNA, 15 nt, Mycobacterium tuberculosis H37Rv
gcuaguucggcgucc

SEQ ID NO: 3283905 - RNA, 19 nt, Mycobacterium tuberculosis H37Rv
gcuaguugggugggugcag

SEQ ID NO: 3283906 - RNA, 22 nt, Mycobacterium tuberculosis H37Rv
gcuauccaggccgucaggcgug

SEQ ID NO: 3283907 - RNA, 16 nt, Mycobacterium tuberculosis H37Rv
gcuaucccaggggcac

SEQ ID NO: 3283908 - RNA, 16 nt, Mycobacterium tuberculosis H37Rv
gcuauccggcggccag

SEQ ID NO: 3283909 - RNA, 12 nt, Mycobacterium tuberculosis H37Rv
gcuaucgcagaa

SEQ ID NO: 3283910 - RNA, 17 nt, Mycobacterium tuberculosis H37Rv
gcuaucgguucagcugc

SEQ ID NO: 3283911 - RNA, 18 nt, Mycobacterium tuberculosis H37Rv
gcuaucgguucagcugcg

SEQ ID NO: 3283912 - RNA, 15 nt, Mycobacterium tuberculosis H37Rv
gcuaugaccugcgaa

SEQ ID NO: 3283913 - RNA, 16 nt, Mycobacterium tuberculosis H37Rv
gcuaugaugccgccgg

SEQ ID NO: 3283914 - RNA, 18 nt, Mycobacterium tuberculosis H37Rv
gcuaugcaggucacuggg

SEQ ID NO: 3283915 - RNA, 18 nt, Mycobacterium tuberculosis H37Rv
gcuaugcuggcagcucgg

SEQ ID NO: 3283916 - RNA, 16 nt, Mycobacterium tuberculosis H37Rv
gcuauugggugcagug

SEQ ID NO: 3283917 - RNA, 21 nt, Mycobacterium tuberculosis H37Rv
gcucaacacgagcgguacgcc

SEQ ID NO: 3283918 - RNA, 23 nt, Mycobacterium tuberculosis H37Rv
gcucaaccagcagacgccguagc

SEQ ID NO: 3283919 - RNA, 22 nt, Mycobacterium tuberculosis H37Rv
gcucaacggaaccgauaccucg

SEQ ID NO: 3283920 - RNA, 21 nt, Mycobacterium tuberculosis H37Rv
gcucaacggcgaaaguccugc

SEQ ID NO: 3283921 - RNA, 18 nt, Mycobacterium tuberculosis H37Rv
gcucaaggcuucggcggc

SEQ ID NO: 3283922 - RNA, 18 nt, Mycobacterium tuberculosis H37Rv
gcucaagguccagcgauc

SEQ ID NO: 3283923 - RNA, 15 nt, Mycobacterium tuberculosis H37Rv
gcucacaagccgugc

SEQ ID NO: 3283924 - RNA, 17 nt, Mycobacterium tuberculosis H37Rv
gcucacauccggucaga

SEQ ID NO: 3283925 - RNA, 19 nt, Mycobacterium tuberculosis H37Rv
gcucaccaaggucggcgau

SEQ ID NO: 3283926 - RNA, 19 nt, Mycobacterium tuberculosis H37Rv
gcucaccaaucugcgggcc

SEQ ID NO: 3283927 - RNA, 22 nt, Mycobacterium tuberculosis H37Rv
gcucaccacgccggucgaggug

SEQ ID NO: 3283928 - RNA, 12 nt, Mycobacterium tuberculosis H37Rv
gcucaccagcgg

SEQ ID NO: 3283929 - RNA, 16 nt, Mycobacterium tuberculosis H37Rv
gcucacccgcccggaa

SEQ ID NO: 3283930 - RNA, 16 nt, Mycobacterium tuberculosis H37Rv
gcucacccggagcacc

SEQ ID NO: 3283931 - RNA, 13 nt, Mycobacterium tuberculosis H37Rv
gcucacccggcgu

SEQ ID NO: 3283932 - RNA, 18 nt, Mycobacterium tuberculosis H37Rv
gcucacccgucgucaagu

SEQ ID NO: 3283933 - RNA, 20 nt, Mycobacterium tuberculosis H37Rv
gcucacccuuggaauugaag

SEQ ID NO: 3283934 - RNA, 17 nt, Mycobacterium tuberculosis H37Rv
gcucaccgaacgcgaug

SEQ ID NO: 3283935 - RNA, 16 nt, Mycobacterium tuberculosis H37Rv
gcucaccgacgcugac

SEQ ID NO: 3283936 - RNA, 16 nt, Mycobacterium tuberculosis H37Rv
gcucaccgcacaccug

SEQ ID NO: 3283937 - RNA, 20 nt, Mycobacterium tuberculosis H37Rv
gcucaccgcgcaucaucgcc

SEQ ID NO: 3283938 - RNA, 13 nt, Mycobacterium tuberculosis H37Rv
gcucaccggcgcc

SEQ ID NO: 3283939 - RNA, 17 nt, Mycobacterium tuberculosis H37Rv
gcucaccggcgcccagc

SEQ ID NO: 3283940 - RNA, 14 nt, Mycobacterium tuberculosis H37Rv
gcucaccggcuggu

SEQ ID NO: 3283941 - RNA, 22 nt, Mycobacterium tuberculosis H37Rv
gcucaccggggccgucggcaau

SEQ ID NO: 3283942 - RNA, 14 nt, Mycobacterium tuberculosis H37Rv
gcucaccggggucg

SEQ ID NO: 3283943 - RNA, 15 nt, Mycobacterium tuberculosis H37Rv
gcucaccucaugauc

SEQ ID NO: 3283944 - RNA, 22 nt, Mycobacterium tuberculosis H37Rv
gcucaccucaugaucucaccac

SEQ ID NO: 3283945 - RNA, 17 nt, Mycobacterium tuberculosis H37Rv
gcucacgacuggcgccc

SEQ ID NO: 3283946 - RNA, 21 nt, Mycobacterium tuberculosis H37Rv
gcucacgacuggcgcccagcc

SEQ ID NO: 3283947 - RNA, 21 nt, Mycobacterium tuberculosis H37Rv
gcucacgcgggucguuaccag

SEQ ID NO: 3283948 - RNA, 17 nt, Mycobacterium tuberculosis H37Rv
gcucacgcugaagccgc

SEQ ID NO: 3283949 - RNA, 21 nt, Mycobacterium tuberculosis H37Rv
gcucacgcugaagccgcugga

SEQ ID NO: 3283950 - RNA, 15 nt, Mycobacterium tuberculosis H37Rv
gcucacggacgcugg

SEQ ID NO: 3283951 - RNA, 14 nt, Mycobacterium tuberculosis H37Rv
gcucacggcccgag

SEQ ID NO: 3283952 - RNA, 18 nt, Mycobacterium tuberculosis H37Rv
gcucacggcccgagccgc

SEQ ID NO: 3283953 - RNA, 22 nt, Mycobacterium tuberculosis H37Rv
gcucacggcccgagccgcgugg

SEQ ID NO: 3283954 - RNA, 19 nt, Mycobacterium tuberculosis H37Rv
gcucacgggcgaucgugcg

SEQ ID NO: 3283955 - RNA, 15 nt, Mycobacterium tuberculosis H37Rv
gcucacgguggccgc

SEQ ID NO: 3283956 - RNA, 21 nt, Mycobacterium tuberculosis H37Rv
gcucacgguggccgcaucgac

SEQ ID NO: 3283957 - RNA, 19 nt, Mycobacterium tuberculosis H37Rv
gcucacguaaccagugacc

SEQ ID NO: 3283958 - RNA, 13 nt, Mycobacterium tuberculosis H37Rv
gcucacuacccgc

SEQ ID NO: 3283959 - RNA, 20 nt, Mycobacterium tuberculosis H37Rv
gcucacuggcgauaucggcc

SEQ ID NO: 3283960 - RNA, 14 nt, Mycobacterium tuberculosis H37Rv
gcucacuggugacc

SEQ ID NO: 3283961 - RNA, 13 nt, Mycobacterium tuberculosis H37Rv
gcucagaccaagg

SEQ ID NO: 3283962 - RNA, 14 nt, Mycobacterium tuberculosis H37Rv
gcucagccguucgc

SEQ ID NO: 3283963 - RNA, 17 nt, Mycobacterium tuberculosis H37Rv
gcucagcgaugcggccc

SEQ ID NO: 3283964 - RNA, 22 nt, Mycobacterium tuberculosis H37Rv
gcucagcgcagcaucgucgcca

SEQ ID NO: 3283965 - RNA, 15 nt, Mycobacterium tuberculosis H37Rv
gcucagcgcgcgccg

SEQ ID NO: 3283966 - RNA, 13 nt, Mycobacterium tuberculosis H37Rv
gcucagcgcggcc

SEQ ID NO: 3283967 - RNA, 17 nt, Mycobacterium tuberculosis H37Rv
gcucagcgcggccccga

SEQ ID NO: 3283968 - RNA, 21 nt, Mycobacterium tuberculosis H37Rv
gcucagcggcgaccgcauccg

SEQ ID NO: 3283969 - RNA, 17 nt, Mycobacterium tuberculosis H37Rv
gcucagcgugcgcuggc

SEQ ID NO: 3283970 - RNA, 16 nt, Mycobacterium tuberculosis H37Rv
gcucagcuccggcgac

SEQ ID NO: 3283971 - RNA, 17 nt, Mycobacterium tuberculosis H37Rv
gcucagcuccggcgacu

SEQ ID NO: 3283972 - RNA, 20 nt, Mycobacterium tuberculosis H37Rv
gcucagcugagaugaggaug

SEQ ID NO: 3283973 - RNA, 15 nt, Mycobacterium tuberculosis H37Rv
gcucagcugcggauu

SEQ ID NO: 3283974 - RNA, 22 nt, Mycobacterium tuberculosis H37Rv
gcucaggaacaaugagaucggg

SEQ ID NO: 3283975 - RNA, 12 nt, Mycobacterium tuberculosis H37Rv
gcucagggcagu

SEQ ID NO: 3283976 - RNA, 20 nt, Mycobacterium tuberculosis H37Rv
gcucaggguguucacguuca

SEQ ID NO: 3283977 - RNA, 22 nt, Mycobacterium tuberculosis H37Rv
gcucaggguguucacguucagc

SEQ ID NO: 3283978 - RNA, 19 nt, Mycobacterium tuberculosis H37Rv
gcucaggucaccggccgcc

SEQ ID NO: 3283979 - RNA, 24 nt, Mycobacterium tuberculosis H37Rv
gcucaggucgcagaccagacugca

SEQ ID NO: 3283980 - RNA, 12 nt, Mycobacterium tuberculosis H37Rv
gcucaggugcuc

SEQ ID NO: 3283981 - RNA, 22 nt, Mycobacterium tuberculosis H37Rv
gcucagguucagcuugaugucu

SEQ ID NO: 3283982 - RNA, 14 nt, Mycobacterium tuberculosis H37Rv
gcucagugaccugu

SEQ ID NO: 3283983 - RNA, 20 nt, Mycobacterium tuberculosis H37Rv
gcucauaccgggaggacacc

SEQ ID NO: 3283984 - RNA, 19 nt, Mycobacterium tuberculosis H37Rv
gcucaucacccagcgccga

SEQ ID NO: 3283985 - RNA, 18 nt, Mycobacterium tuberculosis H37Rv
gcucaucgaagcuucggc

SEQ ID NO: 3283986 - RNA, 14 nt, Mycobacterium tuberculosis H37Rv
gcucaucgaccgcg

SEQ ID NO: 3283987 - RNA, 21 nt, Mycobacterium tuberculosis H37Rv
gcucaucgaccggggcuuggg

SEQ ID NO: 3283988 - RNA, 15 nt, Mycobacterium tuberculosis H37Rv
gcucaucgcggcgaa

SEQ ID NO: 3283989 - RNA, 18 nt, Mycobacterium tuberculosis H37Rv
gcucaucgggcacaucgc

SEQ ID NO: 3283990 - RNA, 21 nt, Mycobacterium tuberculosis H37Rv
gcucaucuguaaccuccucga

SEQ ID NO: 3283991 - RNA, 16 nt, Mycobacterium tuberculosis H37Rv
gcucaugaccgcucgg

SEQ ID NO: 3283992 - RNA, 17 nt, Mycobacterium tuberculosis H37Rv
gcucauggcauuuccug

SEQ ID NO: 3283993 - RNA, 14 nt, Mycobacterium tuberculosis H37Rv
gcucauugccgauu

SEQ ID NO: 3283994 - RNA, 17 nt, Mycobacterium tuberculosis H37Rv
gcuccaaaagccucagc

SEQ ID NO: 3283995 - RNA, 20 nt, Mycobacterium tuberculosis H37Rv
gcuccaaaagccucagccgc

SEQ ID NO: 3283996 - RNA, 18 nt, Mycobacterium tuberculosis H37Rv
gcuccaacaaugccagcu

SEQ ID NO: 3283997 - RNA, 22 nt, Mycobacterium tuberculosis H37Rv
gcuccaacagguaagccacaua

SEQ ID NO: 3283998 - RNA, 20 nt, Mycobacterium tuberculosis H37Rv
gcuccaacgauggaacgggc

SEQ ID NO: 3283999 - RNA, 18 nt, Mycobacterium tuberculosis H37Rv
gcuccaacgcacacaccg

SEQ ID NO: 3284000 - RNA, 13 nt, Mycobacterium tuberculosis H37Rv
gcuccaagcgcgg

SEQ ID NO: 3284001 - RNA, 17 nt, Mycobacterium tuberculosis H37Rv
gcuccaauugcggccgc

SEQ ID NO: 3284002 - RNA, 14 nt, Mycobacterium tuberculosis H37Rv
gcuccaccgggccc

SEQ ID NO: 3284003 - RNA, 22 nt, Mycobacterium tuberculosis H37Rv
gcuccaccgggcccgccguccc

SEQ ID NO: 3284004 - RNA, 14 nt, Mycobacterium tuberculosis H37Rv
gcuccaccgucgca

SEQ ID NO: 3284005 - RNA, 19 nt, Mycobacterium tuberculosis H37Rv
gcuccaccucgguacuugc

SEQ ID NO: 3284006 - RNA, 19 nt, Mycobacterium tuberculosis H37Rv
gcuccacguacgcggcugc

SEQ ID NO: 3284007 - RNA, 21 nt, Mycobacterium tuberculosis H37Rv
gcuccacuuggggcgccaggg

SEQ ID NO: 3284008 - RNA, 12 nt, Mycobacterium tuberculosis H37Rv
gcuccagcagcg

SEQ ID NO: 3284009 - RNA, 15 nt, Mycobacterium tuberculosis H37Rv
gcuccagcgcgcgcc

SEQ ID NO: 3284010 - RNA, 17 nt, Mycobacterium tuberculosis H37Rv
gcuccagcgcgcgccgc

SEQ ID NO: 3284011 - RNA, 22 nt, Mycobacterium tuberculosis H37Rv
gcuccagcugagcggccggcau

SEQ ID NO: 3284012 - RNA, 17 nt, Mycobacterium tuberculosis H37Rv
gcuccaggcgcgccgca

SEQ ID NO: 3284013 - RNA, 22 nt, Mycobacterium tuberculosis H37Rv
gcuccaggucgacauaggccac

SEQ ID NO: 3284014 - RNA, 20 nt, Mycobacterium tuberculosis H37Rv
gcuccaguggcgccagggcc

SEQ ID NO: 3284015 - RNA, 19 nt, Mycobacterium tuberculosis H37Rv
gcuccaugacaaaccugca

SEQ ID NO: 3284016 - RNA, 12 nt, Mycobacterium tuberculosis H37Rv
gcucccacggca

SEQ ID NO: 3284017 - RNA, 18 nt, Mycobacterium tuberculosis H37Rv
gcucccauggcgcgagca

SEQ ID NO: 3284018 - RNA, 21 nt, Mycobacterium tuberculosis H37Rv
gcucccccgccaaccccaaca

SEQ ID NO: 3284019 - RNA, 20 nt, Mycobacterium tuberculosis H37Rv
gcuccccggauuccucguca

SEQ ID NO: 3284020 - RNA, 16 nt, Mycobacterium tuberculosis H37Rv
gcuccccgucggggaa

SEQ ID NO: 3284021 - RNA, 20 nt, Mycobacterium tuberculosis H37Rv
gcucccgccacgucgccggc

SEQ ID NO: 3284022 - RNA, 13 nt, Mycobacterium tuberculosis H37Rv
gcucccgccggca

SEQ ID NO: 3284023 - RNA, 21 nt, Mycobacterium tuberculosis H37Rv
gcucccgccggcagcgucggc

SEQ ID NO: 3284024 - RNA, 18 nt, Mycobacterium tuberculosis H37Rv
gcucccgcggcgccaccc

SEQ ID NO: 3284025 - RNA, 16 nt, Mycobacterium tuberculosis H37Rv
gcucccgggcgcucac

SEQ ID NO: 3284026 - RNA, 18 nt, Mycobacterium tuberculosis H37Rv
gcucccgggcggcggccu

SEQ ID NO: 3284027 - RNA, 16 nt, Mycobacterium tuberculosis H37Rv
gcucccguacgccggc

SEQ ID NO: 3284028 - RNA, 22 nt, Mycobacterium tuberculosis H37Rv
gcucccguacgccggcgguggc

SEQ ID NO: 3284029 - RNA, 23 nt, Mycobacterium tuberculosis H37Rv
gcucccgucucgacaguggcgac

SEQ ID NO: 3284030 - RNA, 14 nt, Mycobacterium tuberculosis H37Rv
gcucccgugcuggc

SEQ ID NO: 3284031 - RNA, 18 nt, Mycobacterium tuberculosis H37Rv
gcucccuacgagcccacg

SEQ ID NO: 3284032 - RNA, 20 nt, Mycobacterium tuberculosis H37Rv
gcucccugggcgucgaccac

SEQ ID NO: 3284033 - RNA, 18 nt, Mycobacterium tuberculosis H37Rv
gcuccgaacauggccagc

SEQ ID NO: 3284034 - RNA, 16 nt, Mycobacterium tuberculosis H37Rv
gcuccgaaguccacgc

SEQ ID NO: 3284035 - RNA, 22 nt, Mycobacterium tuberculosis H37Rv
gcuccgaaguccacgcaccacg

SEQ ID NO: 3284036 - RNA, 15 nt, Mycobacterium tuberculosis H37Rv
gcuccgaccgguggc

SEQ ID NO: 3284037 - RNA, 21 nt, Mycobacterium tuberculosis H37Rv
gcuccgagggcugcguggcgg

SEQ ID NO: 3284038 - RNA, 14 nt, Mycobacterium tuberculosis H37Rv
gcuccgaugccgac

SEQ ID NO: 3284039 - RNA, 15 nt, Mycobacterium tuberculosis H37Rv
gcuccgaugugccga

SEQ ID NO: 3284040 - RNA, 15 nt, Mycobacterium tuberculosis H37Rv
gcuccgauuccgaac

SEQ ID NO: 3284041 - RNA, 16 nt, Mycobacterium tuberculosis H37Rv
gcucgccgaccagcuu

SEQ ID NO: 3284042 - RNA, 18 nt, Mycobacterium tuberculosis H37Rv
gcucgccgauaucugcca

SEQ ID NO: 3284043 - RNA, 19 nt, Mycobacterium tuberculosis H37Rv
gcucgccgauaucugccac

SEQ ID NO: 3284044 - RNA, 12 nt, Mycobacterium tuberculosis H37Rv
gcucgccggcac

SEQ ID NO: 3284045 - RNA, 16 nt, Mycobacterium tuberculosis H37Rv
gcucgccggcaccgac

SEQ ID NO: 3284046 - RNA, 12 nt, Mycobacterium tuberculosis H37Rv
gcucgccggcca

SEQ ID NO: 3284047 - RNA, 14 nt, Mycobacterium tuberculosis H37Rv
gcucgccggccaac

SEQ ID NO: 3284048 - RNA, 13 nt, Mycobacterium tuberculosis H37Rv
gcucgccggcgaa

SEQ ID NO: 3284049 - RNA, 14 nt, Mycobacterium tuberculosis H37Rv
gcucgccgggcagc

SEQ ID NO: 3284050 - RNA, 18 nt, Mycobacterium tuberculosis H37Rv
gcucgccgguaggcggcc

SEQ ID NO: 3284051 - RNA, 19 nt, Mycobacterium tuberculosis H37Rv
gcucgccgguaggcggcca

SEQ ID NO: 3284052 - RNA, 22 nt, Mycobacterium tuberculosis H37Rv
gcucgccgguaggcggccagcg

SEQ ID NO: 3284053 - RNA, 23 nt, Mycobacterium tuberculosis H37Rv
gcucgccgguaggcggccagcgc

SEQ ID NO: 3284054 - RNA, 18 nt, Mycobacterium tuberculosis H37Rv
gcucgccguaagcaccag

SEQ ID NO: 3284055 - RNA, 20 nt, Mycobacterium tuberculosis H37Rv
gcucgccguaagcaccagcc

SEQ ID NO: 3284056 - RNA, 23 nt, Mycobacterium tuberculosis H37Rv
gcucgccguaagcaccagccagc

SEQ ID NO: 3284057 - RNA, 17 nt, Mycobacterium tuberculosis H37Rv
gcucgccgugaccaggu

SEQ ID NO: 3284058 - RNA, 17 nt, Mycobacterium tuberculosis H37Rv
gcucgccguuauccgac

SEQ ID NO: 3284059 - RNA, 21 nt, Mycobacterium tuberculosis H37Rv
gcucgccguuauccgacgaac

SEQ ID NO: 3284060 - RNA, 19 nt, Mycobacterium tuberculosis H37Rv
gcucgccuaucgacucagu

SEQ ID NO: 3284061 - RNA, 21 nt, Mycobacterium tuberculosis H37Rv
gcucgccuaucgacucaguca

SEQ ID NO: 3284062 - RNA, 20 nt, Mycobacterium tuberculosis H37Rv
gcucgcgaaggggcgguuac

SEQ ID NO: 3284063 - RNA, 21 nt, Mycobacterium tuberculosis H37Rv
gcucgcgaggcucgcguggcc

SEQ ID NO: 3284064 - RNA, 14 nt, Mycobacterium tuberculosis H37Rv
gcucgcgaucguca

SEQ ID NO: 3284065 - RNA, 17 nt, Mycobacterium tuberculosis H37Rv
gcucgcgcaaggcgccg

SEQ ID NO: 3284066 - RNA, 16 nt, Mycobacterium tuberculosis H37Rv
gcucgcgcaccgucau

SEQ ID NO: 3284067 - RNA, 15 nt, Mycobacterium tuberculosis H37Rv
gcucgcgcacgucga

SEQ ID NO: 3284068 - RNA, 16 nt, Mycobacterium tuberculosis H37Rv
gcucgcgcacgucgac

SEQ ID NO: 3284069 - RNA, 17 nt, Mycobacterium tuberculosis H37Rv
gcucgcgcacgucgacg

SEQ ID NO: 3284070 - RNA, 20 nt, Mycobacterium tuberculosis H37Rv
gcucgcgccaggucggugac

SEQ ID NO: 3284071 - RNA, 14 nt, Mycobacterium tuberculosis H37Rv
gcucgcgcccgcua

SEQ ID NO: 3284072 - RNA, 20 nt, Mycobacterium tuberculosis H37Rv
gcucgcgcccgcuaacuggc

SEQ ID NO: 3284073 - RNA, 15 nt, Mycobacterium tuberculosis H37Rv
gcucgcgcgcugggc

SEQ ID NO: 3284074 - RNA, 16 nt, Mycobacterium tuberculosis H37Rv
gcucgcgcgcugggcg

SEQ ID NO: 3284075 - RNA, 20 nt, Mycobacterium tuberculosis H37Rv
gcucgcgcucguuagcggcg

SEQ ID NO: 3284076 - RNA, 14 nt, Mycobacterium tuberculosis H37Rv
gcucgcggcgcagg

SEQ ID NO: 3284077 - RNA, 16 nt, Mycobacterium tuberculosis H37Rv
gcucgcggcggcgcug

SEQ ID NO: 3284078 - RNA, 23 nt, Mycobacterium tuberculosis H37Rv
gcucgcggcuucaguccggcccc

SEQ ID NO: 3284079 - RNA, 15 nt, Mycobacterium tuberculosis H37Rv
gcucgcgggccaaag

SEQ ID NO: 3284080 - RNA, 15 nt, Mycobacterium tuberculosis H37Rv
gcucgcggggcgcac

SEQ ID NO: 3284081 - RNA, 24 nt, Mycobacterium tuberculosis H37Rv
gcucgcggggcgcaccgcggaccg

SEQ ID NO: 3284082 - RNA, 21 nt, Mycobacterium tuberculosis H37Rv
gcucgcgguaguuaacccagg

SEQ ID NO: 3284083 - RNA, 13 nt, Mycobacterium tuberculosis H37Rv
gcucgcggugggc

SEQ ID NO: 3284084 - RNA, 17 nt, Mycobacterium tuberculosis H37Rv
gcucgcguggccgccgg

SEQ ID NO: 3284085 - RNA, 19 nt, Mycobacterium tuberculosis H37Rv
gcucgcucaccggcuggug

SEQ ID NO: 3284086 - RNA, 15 nt, Mycobacterium tuberculosis H37Rv
gcucgcucacgccgu

SEQ ID NO: 3284087 - RNA, 13 nt, Mycobacterium tuberculosis H37Rv
gcucgcugaaccg

SEQ ID NO: 3284088 - RNA, 17 nt, Mycobacterium tuberculosis H37Rv
gcucgcugaaccggauc

SEQ ID NO: 3284089 - RNA, 14 nt, Mycobacterium tuberculosis H37Rv
gcucgcugaccuug

SEQ ID NO: 3284090 - RNA, 21 nt, Mycobacterium tuberculosis H37Rv
gcucgcugaucuggggcacca

SEQ ID NO: 3284091 - RNA, 20 nt, Mycobacterium tuberculosis H37Rv
gcucgcugaugcaucccaac

SEQ ID NO: 3284092 - RNA, 14 nt, Mycobacterium tuberculosis H37Rv
gcucgcugcaccag

SEQ ID NO: 3284093 - RNA, 11 nt, Mycobacterium tuberculosis H37Rv
gcucgcugcag

SEQ ID NO: 3284094 - RNA, 15 nt, Mycobacterium tuberculosis H37Rv
gcucgcugcgcgccc

SEQ ID NO: 3284095 - RNA, 21 nt, Mycobacterium tuberculosis H37Rv
gcucgcuguagagggugucgc

SEQ ID NO: 3284096 - RNA, 14 nt, Mycobacterium tuberculosis H37Rv
gcucggauccggcc

SEQ ID NO: 3284097 - RNA, 21 nt, Mycobacterium tuberculosis H37Rv
gcucggcagccggcuugggcg

SEQ ID NO: 3284098 - RNA, 12 nt, Mycobacterium tuberculosis H37Rv
gcucggcaggcc

SEQ ID NO: 3284099 - RNA, 15 nt, Mycobacterium tuberculosis H37Rv
gcucggcaucgagca

SEQ ID NO: 3284100 - RNA, 17 nt, Mycobacterium tuberculosis H37Rv
gcucggccagccagcgg

SEQ ID NO: 3284101 - RNA, 15 nt, Mycobacterium tuberculosis H37Rv
gcucggccauagcgc

SEQ ID NO: 3284102 - RNA, 22 nt, Mycobacterium tuberculosis H37Rv
gcucggccauagcgccgcgccc

SEQ ID NO: 3284103 - RNA, 13 nt, Mycobacterium tuberculosis H37Rv
gcucggcccagcg

SEQ ID NO: 3284104 - RNA, 17 nt, Mycobacterium tuberculosis H37Rv
gcucggccgaggcgguc

SEQ ID NO: 3284105 - RNA, 14 nt, Mycobacterium tuberculosis H37Rv
gcucggccgaugcg

SEQ ID NO: 3284106 - RNA, 14 nt, Mycobacterium tuberculosis H37Rv
gcucggccgcagcc

SEQ ID NO: 3284107 - RNA, 11 nt, Mycobacterium tuberculosis H37Rv
gcucggcgaag

SEQ ID NO: 3284108 - RNA, 20 nt, Mycobacterium tuberculosis H37Rv
gcucggcgagcucagugacc

SEQ ID NO: 3284109 - RNA, 16 nt, Mycobacterium tuberculosis H37Rv
gcucggcgaguucggc

SEQ ID NO: 3284110 - RNA, 10 nt, Mycobacterium tuberculosis H37Rv
gcucggcgau

SEQ ID NO: 3284111 - RNA, 17 nt, Mycobacterium tuberculosis H37Rv
gcucggcgccguuuggc

SEQ ID NO: 3284112 - RNA, 14 nt, Mycobacterium tuberculosis H37Rv
gcucggcgcggugg

SEQ ID NO: 3284113 - RNA, 15 nt, Mycobacterium tuberculosis H37Rv
gcucggcggccagcu

SEQ ID NO: 3284114 - RNA, 15 nt, Mycobacterium tuberculosis H37Rv
gcucggcggcccggc

SEQ ID NO: 3284115 - RNA, 15 nt, Mycobacterium tuberculosis H37Rv
gcucggcgguacaca

SEQ ID NO: 3284116 - RNA, 19 nt, Mycobacterium tuberculosis H37Rv
gcucggcggugccgcggcu

SEQ ID NO: 3284117 - RNA, 15 nt, Mycobacterium tuberculosis H37Rv
gcucggcgucgccgc

SEQ ID NO: 3284118 - RNA, 17 nt, Mycobacterium tuberculosis H37Rv
gcucggcgucgccgcca

SEQ ID NO: 3284119 - RNA, 19 nt, Mycobacterium tuberculosis H37Rv
gcucggcuagguagucgac

SEQ ID NO: 3284120 - RNA, 21 nt, Mycobacterium tuberculosis H37Rv
gcucggcuauggguucgcggu

SEQ ID NO: 3284121 - RNA, 16 nt, Mycobacterium tuberculosis H37Rv
gcucggcugcucgacg

SEQ ID NO: 3284122 - RNA, 17 nt, Mycobacterium tuberculosis H37Rv
gcucggcugcucgacgg

SEQ ID NO: 3284123 - RNA, 18 nt, Mycobacterium tuberculosis H37Rv
gcucgggaacuucgccga

SEQ ID NO: 3284124 - RNA, 15 nt, Mycobacterium tuberculosis H37Rv
gcucgggcccagcgc

SEQ ID NO: 3284125 - RNA, 17 nt, Mycobacterium tuberculosis H37Rv
gcucgggccgcacuuuc

SEQ ID NO: 3284126 - RNA, 21 nt, Mycobacterium tuberculosis H37Rv
gcucgggcgcgaggacgcuga

SEQ ID NO: 3284127 - RNA, 17 nt, Mycobacterium tuberculosis H37Rv
gcucgggggauccggcg

SEQ ID NO: 3284128 - RNA, 15 nt, Mycobacterium tuberculosis H37Rv
gcucgggggccgacc

SEQ ID NO: 3284129 - RNA, 16 nt, Mycobacterium tuberculosis H37Rv
gcucgggucgugcgug

SEQ ID NO: 3284130 - RNA, 23 nt, Mycobacterium tuberculosis H37Rv
gcucgggugguuugcgaacgaau

SEQ ID NO: 3284131 - RNA, 21 nt, Mycobacterium tuberculosis H37Rv
gcucgguaccaaagcugucga

SEQ ID NO: 3284132 - RNA, 19 nt, Mycobacterium tuberculosis H37Rv
gcucgguaggccggcaaga

SEQ ID NO: 3284133 - RNA, 18 nt, Mycobacterium tuberculosis H37Rv
gcucggucaccacggcgg

SEQ ID NO: 3284134 - RNA, 16 nt, Mycobacterium tuberculosis H37Rv
gcucggucagcgucag

SEQ ID NO: 3284135 - RNA, 16 nt, Mycobacterium tuberculosis H37Rv
gcucgguccagccggu

SEQ ID NO: 3284136 - RNA, 21 nt, Mycobacterium tuberculosis H37Rv
gcucgguccuugccguagaag

SEQ ID NO: 3284137 - RNA, 14 nt, Mycobacterium tuberculosis H37Rv
gcucggucuccacc

SEQ ID NO: 3284138 - RNA, 19 nt, Mycobacterium tuberculosis H37Rv
gcugcagacccguucgccg

SEQ ID NO: 3284139 - RNA, 21 nt, Mycobacterium tuberculosis H37Rv
gcugcagcacggcuucgcggu

SEQ ID NO: 3284140 - RNA, 14 nt, Mycobacterium tuberculosis H37Rv
gcugcagcagaccc

SEQ ID NO: 3284141 - RNA, 14 nt, Mycobacterium tuberculosis H37Rv
gcugcagguccagg

SEQ ID NO: 3284142 - RNA, 16 nt, Mycobacterium tuberculosis H37Rv
gcugcagguccagggu

SEQ ID NO: 3284143 - RNA, 18 nt, Mycobacterium tuberculosis H37Rv
gcugcagucuuucccggg

SEQ ID NO: 3284144 - RNA, 16 nt, Mycobacterium tuberculosis H37Rv
gcugcagugacucgau

SEQ ID NO: 3284145 - RNA, 18 nt, Mycobacterium tuberculosis H37Rv
gcugcagugacucgauca

SEQ ID NO: 3284146 - RNA, 19 nt, Mycobacterium tuberculosis H37Rv
gcugcagugacucgaucac

SEQ ID NO: 3284147 - RNA, 21 nt, Mycobacterium tuberculosis H37Rv
gcugcagugacucgaucacca

SEQ ID NO: 3284148 - RNA, 15 nt, Mycobacterium tuberculosis H37Rv
gcugcagugccgcac

SEQ ID NO: 3284149 - RNA, 14 nt, Mycobacterium tuberculosis H37Rv
gcugcauccgcagc

SEQ ID NO: 3284150 - RNA, 23 nt, Mycobacterium tuberculosis H37Rv
gcugccaaacuaacggcagccac

SEQ ID NO: 3284151 - RNA, 22 nt, Mycobacterium tuberculosis H37Rv
gcugccaacgcccguguugaag

SEQ ID NO: 3284152 - RNA, 21 nt, Mycobacterium tuberculosis H37Rv
gcugccacccaucgcacggau

SEQ ID NO: 3284153 - RNA, 10 nt, Mycobacterium tuberculosis H37Rv
gcugccaccg

SEQ ID NO: 3284154 - RNA, 14 nt, Mycobacterium tuberculosis H37Rv
gcugccaccgcggu

SEQ ID NO: 3284155 - RNA, 11 nt, Mycobacterium tuberculosis H37Rv
gcugccaccgg

SEQ ID NO: 3284156 - RNA, 13 nt, Mycobacterium tuberculosis H37Rv
gcugccaccggcc

SEQ ID NO: 3284157 - RNA, 23 nt, Mycobacterium tuberculosis H37Rv
gcugccagaucggucggccaaag

SEQ ID NO: 3284158 - RNA, 16 nt, Mycobacterium tuberculosis H37Rv
gcugccagccgaagcc

SEQ ID NO: 3284159 - RNA, 22 nt, Mycobacterium tuberculosis H37Rv
gcugccaguucuuggcgaccuu

SEQ ID NO: 3284160 - RNA, 18 nt, Mycobacterium tuberculosis H37Rv
gcugccaucccgaucccg

SEQ ID NO: 3284161 - RNA, 22 nt, Mycobacterium tuberculosis H37Rv
gcugccaugcgggugucgggca

SEQ ID NO: 3284162 - RNA, 13 nt, Mycobacterium tuberculosis H37Rv
gcugccauugccg

SEQ ID NO: 3284163 - RNA, 13 nt, Mycobacterium tuberculosis H37Rv
gcugccauugccu

SEQ ID NO: 3284164 - RNA, 22 nt, Mycobacterium tuberculosis H37Rv
gcugccauugccugggcgaccg

SEQ ID NO: 3284165 - RNA, 12 nt, Mycobacterium tuberculosis H37Rv
gcugcccaaaag

SEQ ID NO: 3284166 - RNA, 18 nt, Mycobacterium tuberculosis H37Rv
gcugcccaaaagcgcggc

SEQ ID NO: 3284167 - RNA, 13 nt, Mycobacterium tuberculosis H37Rv
gcugcccaugcgg

SEQ ID NO: 3284168 - RNA, 22 nt, Mycobacterium tuberculosis H37Rv
gcugcccaugguggcgaucugg

SEQ ID NO: 3284169 - RNA, 14 nt, Mycobacterium tuberculosis H37Rv
gcugccccgccacc

SEQ ID NO: 3284170 - RNA, 13 nt, Mycobacterium tuberculosis H37Rv
gcugcccgccagc

SEQ ID NO: 3284171 - RNA, 18 nt, Mycobacterium tuberculosis H37Rv
gcugcccgccagcccaua

SEQ ID NO: 3284172 - RNA, 15 nt, Mycobacterium tuberculosis H37Rv
gcugcccgccagcgc

SEQ ID NO: 3284173 - RNA, 14 nt, Mycobacterium tuberculosis H37Rv
gcugcccgccgccc

SEQ ID NO: 3284174 - RNA, 18 nt, Mycobacterium tuberculosis H37Rv
gcugcccgcgcggccaau

SEQ ID NO: 3284175 - RNA, 14 nt, Mycobacterium tuberculosis H37Rv
gcugcccgcggugu

SEQ ID NO: 3284176 - RNA, 19 nt, Mycobacterium tuberculosis H37Rv
gcugccgaacaguucggcg

SEQ ID NO: 3284177 - RNA, 23 nt, Mycobacterium tuberculosis H37Rv
gcugccgaacaguucggcgagca

SEQ ID NO: 3284178 - RNA, 16 nt, Mycobacterium tuberculosis H37Rv
gcugccgaagcggcca

SEQ ID NO: 3284179 - RNA, 18 nt, Mycobacterium tuberculosis H37Rv
gcugccgaagcggccacc

SEQ ID NO: 3284180 - RNA, 19 nt, Mycobacterium tuberculosis H37Rv
gcugccgaagcggccaccg

SEQ ID NO: 3284181 - RNA, 13 nt, Mycobacterium tuberculosis H37Rv
gcugccgaaguug

SEQ ID NO: 3284182 - RNA, 23 nt, Mycobacterium tuberculosis H37Rv
gcugccgauacagcacauccagc

SEQ ID NO: 3284183 - RNA, 17 nt, Mycobacterium tuberculosis H37Rv
gcugccgauagcgcggc

SEQ ID NO: 3284184 - RNA, 16 nt, Mycobacterium tuberculosis H37Rv
gcugccgcacccccuc

SEQ ID NO: 3284185 - RNA, 18 nt, Mycobacterium tuberculosis H37Rv
gcugccgcaucggcaagg

SEQ ID NO: 3284186 - RNA, 20 nt, Mycobacterium tuberculosis H37Rv
gcugccgcaugcgcuccggc

SEQ ID NO: 3284187 - RNA, 16 nt, Mycobacterium tuberculosis H37Rv
gcugccgccaccgcug

SEQ ID NO: 3284188 - RNA, 17 nt, Mycobacterium tuberculosis H37Rv
gcugccgccguugccgu

SEQ ID NO: 3284189 - RNA, 24 nt, Mycobacterium tuberculosis H37Rv
gcugccgccuuggucgcgucggcu

SEQ ID NO: 3284190 - RNA, 13 nt, Mycobacterium tuberculosis H37Rv
gcugccgcggcug

SEQ ID NO: 3284191 - RNA, 12 nt, Mycobacterium tuberculosis H37Rv
gcugccgcggug

SEQ ID NO: 3284192 - RNA, 19 nt, Mycobacterium tuberculosis H37Rv
gcugccggagacacccgcc

SEQ ID NO: 3284193 - RNA, 19 nt, Mycobacterium tuberculosis H37Rv
gcugccggcaacagcucgc

SEQ ID NO: 3284194 - RNA, 21 nt, Mycobacterium tuberculosis H37Rv
gcugccggcaacagcucgccu

SEQ ID NO: 3284195 - RNA, 23 nt, Mycobacterium tuberculosis H37Rv
gcugccggcacgcaugccgguga

SEQ ID NO: 3284196 - RNA, 14 nt, Mycobacterium tuberculosis H37Rv
gcugccggcagcgu

SEQ ID NO: 3284197 - RNA, 22 nt, Mycobacterium tuberculosis H37Rv
gcugccggccagacggugcagc

SEQ ID NO: 3284198 - RNA, 15 nt, Mycobacterium tuberculosis H37Rv
gcugccggcccacca

SEQ ID NO: 3284199 - RNA, 23 nt, Mycobacterium tuberculosis H37Rv
gcugccgggagggguucacccag

SEQ ID NO: 3284200 - RNA, 21 nt, Mycobacterium tuberculosis H37Rv
gcugccgguagcacagcagca

SEQ ID NO: 3284201 - RNA, 16 nt, Mycobacterium tuberculosis H37Rv
gcugccgucggugccg

SEQ ID NO: 3284202 - RNA, 17 nt, Mycobacterium tuberculosis H37Rv
gcugccguugggcaccg

SEQ ID NO: 3284203 - RNA, 15 nt, Mycobacterium tuberculosis H37Rv
gcugccuccaugacg

SEQ ID NO: 3284204 - RNA, 19 nt, Mycobacterium tuberculosis H37Rv
gcugccuugauugccgcgu

SEQ ID NO: 3284205 - RNA, 17 nt, Mycobacterium tuberculosis H37Rv
gcugccuuggcgcggca

SEQ ID NO: 3284206 - RNA, 18 nt, Mycobacterium tuberculosis H37Rv
gcugcgaaagccacucgc

SEQ ID NO: 3284207 - RNA, 21 nt, Mycobacterium tuberculosis H37Rv
gcugcgagaucgcggcgaccc

SEQ ID NO: 3284208 - RNA, 14 nt, Mycobacterium tuberculosis H37Rv
gcugcgauaugguc

SEQ ID NO: 3284209 - RNA, 17 nt, Mycobacterium tuberculosis H37Rv
gcugcgcaccaaggccg

SEQ ID NO: 3284210 - RNA, 13 nt, Mycobacterium tuberculosis H37Rv
gcugcgcagcggc

SEQ ID NO: 3284211 - RNA, 20 nt, Mycobacterium tuberculosis H37Rv
gcugcgcagcggcauccaca

SEQ ID NO: 3284212 - RNA, 18 nt, Mycobacterium tuberculosis H37Rv
gcugcgccgaacaccaca

SEQ ID NO: 3284213 - RNA, 13 nt, Mycobacterium tuberculosis H37Rv
gcugcgccgggcu

SEQ ID NO: 3284214 - RNA, 16 nt, Mycobacterium tuberculosis H37Rv
gcugcgccgggcucgc

SEQ ID NO: 3284215 - RNA, 14 nt, Mycobacterium tuberculosis H37Rv
gcugcgcgauggcc

SEQ ID NO: 3284216 - RNA, 14 nt, Mycobacterium tuberculosis H37Rv
gcugcgcgcccacc

SEQ ID NO: 3284217 - RNA, 15 nt, Mycobacterium tuberculosis H37Rv
gcugcgcgcucggcc

SEQ ID NO: 3284218 - RNA, 19 nt, Mycobacterium tuberculosis H37Rv
gcugcgcggugccggccgu

SEQ ID NO: 3284219 - RNA, 11 nt, Mycobacterium tuberculosis H37Rv
gcugcgcuggu

SEQ ID NO: 3284220 - RNA, 18 nt, Mycobacterium tuberculosis H37Rv
gcugcggauacagccgcc

SEQ ID NO: 3284221 - RNA, 20 nt, Mycobacterium tuberculosis H37Rv
gcugcggauacagccgccgc

SEQ ID NO: 3284222 - RNA, 17 nt, Mycobacterium tuberculosis H37Rv
gcugcggauccaccacg

SEQ ID NO: 3284223 - RNA, 18 nt, Mycobacterium tuberculosis H37Rv
gcugcggauccaccacgc

SEQ ID NO: 3284224 - RNA, 14 nt, Mycobacterium tuberculosis H37Rv
gcugcggcaccacc

SEQ ID NO: 3284225 - RNA, 14 nt, Mycobacterium tuberculosis H37Rv
gcugcggccagcgc

SEQ ID NO: 3284226 - RNA, 21 nt, Mycobacterium tuberculosis H37Rv
gcugcggccagcgcggcgcgc

SEQ ID NO: 3284227 - RNA, 12 nt, Mycobacterium tuberculosis H37Rv
gcugcggccagg

SEQ ID NO: 3284228 - RNA, 14 nt, Mycobacterium tuberculosis H37Rv
gcugcggccaggga

SEQ ID NO: 3284229 - RNA, 13 nt, Mycobacterium tuberculosis H37Rv
gcugcggcccaca

SEQ ID NO: 3284230 - RNA, 21 nt, Mycobacterium tuberculosis H37Rv
gcugcggcccacaccagcgca

SEQ ID NO: 3284231 - RNA, 20 nt, Mycobacterium tuberculosis H37Rv
gcugcggcgaucuggucgac

SEQ ID NO: 3284232 - RNA, 20 nt, Mycobacterium tuberculosis H37Rv
gcugcggcgcuggccagcag

SEQ ID NO: 3284233 - RNA, 14 nt, Mycobacterium tuberculosis H37Rv
gcugcgggcggucc

SEQ ID NO: 3284234 - RNA, 18 nt, Mycobacterium tuberculosis H37Rv
gcugcggguagccgucga

SEQ ID NO: 3284235 - RNA, 14 nt, Mycobacterium tuberculosis H37Rv
gcuggcgcaaccaa

SEQ ID NO: 3284236 - RNA, 15 nt, Mycobacterium tuberculosis H37Rv
gcuggcgccccaggu

SEQ ID NO: 3284237 - RNA, 21 nt, Mycobacterium tuberculosis H37Rv
gcuggcgccccaggugguuca

SEQ ID NO: 3284238 - RNA, 17 nt, Mycobacterium tuberculosis H37Rv
gcuggcgcccccgacga

SEQ ID NO: 3284239 - RNA, 20 nt, Mycobacterium tuberculosis H37Rv
gcuggcgcccccgacgacgg

SEQ ID NO: 3284240 - RNA, 13 nt, Mycobacterium tuberculosis H37Rv
gcuggcgccgaag

SEQ ID NO: 3284241 - RNA, 18 nt, Mycobacterium tuberculosis H37Rv
gcuggcgccgccggugcc

SEQ ID NO: 3284242 - RNA, 15 nt, Mycobacterium tuberculosis H37Rv
gcuggcgcgcggggu

SEQ ID NO: 3284243 - RNA, 13 nt, Mycobacterium tuberculosis H37Rv
gcuggcggcgacc

SEQ ID NO: 3284244 - RNA, 14 nt, Mycobacterium tuberculosis H37Rv
gcuggcggcgcagc

SEQ ID NO: 3284245 - RNA, 13 nt, Mycobacterium tuberculosis H37Rv
gcuggcgggcgau

SEQ ID NO: 3284246 - RNA, 19 nt, Mycobacterium tuberculosis H37Rv
gcuggcggguuggucccga

SEQ ID NO: 3284247 - RNA, 19 nt, Mycobacterium tuberculosis H37Rv
gcuggcguucccgcucggc

SEQ ID NO: 3284248 - RNA, 23 nt, Mycobacterium tuberculosis H37Rv
gcuggcguugcugaugucgccgg

SEQ ID NO: 3284249 - RNA, 23 nt, Mycobacterium tuberculosis H37Rv
gcuggcguuguugacgaucaccc

SEQ ID NO: 3284250 - RNA, 14 nt, Mycobacterium tuberculosis H37Rv
gcuggcuacccacc

SEQ ID NO: 3284251 - RNA, 15 nt, Mycobacterium tuberculosis H37Rv
gcuggcuacccaccg

SEQ ID NO: 3284252 - RNA, 21 nt, Mycobacterium tuberculosis H37Rv
gcuggcucaccgacaugacgc

SEQ ID NO: 3284253 - RNA, 14 nt, Mycobacterium tuberculosis H37Rv
gcuggcugacaccg

SEQ ID NO: 3284254 - RNA, 21 nt, Mycobacterium tuberculosis H37Rv
gcuggcugaccgaauggccgc

SEQ ID NO: 3284255 - RNA, 16 nt, Mycobacterium tuberculosis H37Rv
gcuggcuguggcgcgc

SEQ ID NO: 3284256 - RNA, 13 nt, Mycobacterium tuberculosis H37Rv
gcuggcuguggcu

SEQ ID NO: 3284257 - RNA, 16 nt, Mycobacterium tuberculosis H37Rv
gcuggcuugggccagc

SEQ ID NO: 3284258 - RNA, 13 nt, Mycobacterium tuberculosis H37Rv
gcugggaaagcau

SEQ ID NO: 3284259 - RNA, 16 nt, Mycobacterium tuberculosis H37Rv
gcugggaaaucccgac

SEQ ID NO: 3284260 - RNA, 20 nt, Mycobacterium tuberculosis H37Rv
gcugggaagcucgguccaau

SEQ ID NO: 3284261 - RNA, 20 nt, Mycobacterium tuberculosis H37Rv
gcugggacgggcgcgucggc

SEQ ID NO: 3284262 - RNA, 19 nt, Mycobacterium tuberculosis H37Rv
gcugggacggucgcucggc

SEQ ID NO: 3284263 - RNA, 21 nt, Mycobacterium tuberculosis H37Rv
gcugggacgucuccaccgcga

SEQ ID NO: 3284264 - RNA, 23 nt, Mycobacterium tuberculosis H37Rv
gcugggacgucuccaccgcgaug

SEQ ID NO: 3284265 - RNA, 15 nt, Mycobacterium tuberculosis H37Rv
gcugggagcggaugu

SEQ ID NO: 3284266 - RNA, 19 nt, Mycobacterium tuberculosis H37Rv
gcugggaggcgcggucgac

SEQ ID NO: 3284267 - RNA, 17 nt, Mycobacterium tuberculosis H37Rv
gcugggcagaccgaucg

SEQ ID NO: 3284268 - RNA, 20 nt, Mycobacterium tuberculosis H37Rv
gcugggcagaccgaucggca

SEQ ID NO: 3284269 - RNA, 19 nt, Mycobacterium tuberculosis H37Rv
gcugggcagccagaucucc

SEQ ID NO: 3284270 - RNA, 15 nt, Mycobacterium tuberculosis H37Rv
gcugggcaucaccga

SEQ ID NO: 3284271 - RNA, 18 nt, Mycobacterium tuberculosis H37Rv
gcugggcaucaccgacgc

SEQ ID NO: 3284272 - RNA, 20 nt, Mycobacterium tuberculosis H37Rv
gcugggcaucaccgccgcgg

SEQ ID NO: 3284273 - RNA, 14 nt, Mycobacterium tuberculosis H37Rv
gcugggcccgccag

SEQ ID NO: 3284274 - RNA, 18 nt, Mycobacterium tuberculosis H37Rv
gcugggcccgccagccca

SEQ ID NO: 3284275 - RNA, 23 nt, Mycobacterium tuberculosis H37Rv
gcugggcccgccagcccagcacg

SEQ ID NO: 3284276 - RNA, 20 nt, Mycobacterium tuberculosis H37Rv
gcugggcccgccgucaccgc

SEQ ID NO: 3284277 - RNA, 15 nt, Mycobacterium tuberculosis H37Rv
gcugggcgccaugcg

SEQ ID NO: 3284278 - RNA, 16 nt, Mycobacterium tuberculosis H37Rv
gcugggcgccgcgcuc

SEQ ID NO: 3284279 - RNA, 21 nt, Mycobacterium tuberculosis H37Rv
gcugggcgccgcgcucgacga

SEQ ID NO: 3284280 - RNA, 13 nt, Mycobacterium tuberculosis H37Rv
gcugggcgcgcuc

SEQ ID NO: 3284281 - RNA, 23 nt, Mycobacterium tuberculosis H37Rv
gcugggcgcgcucaucgaccggg

SEQ ID NO: 3284282 - RNA, 17 nt, Mycobacterium tuberculosis H37Rv
gcugggcuucgagugcg

SEQ ID NO: 3284283 - RNA, 13 nt, Mycobacterium tuberculosis H37Rv
gcuggggccccgc

SEQ ID NO: 3284284 - RNA, 15 nt, Mycobacterium tuberculosis H37Rv
gcuggggccccgcgc

SEQ ID NO: 3284285 - RNA, 19 nt, Mycobacterium tuberculosis H37Rv
gcugggggauaccgcuggg

SEQ ID NO: 3284286 - RNA, 22 nt, Mycobacterium tuberculosis H37Rv
gcugggggccggcagcggcugg

SEQ ID NO: 3284287 - RNA, 15 nt, Mycobacterium tuberculosis H37Rv
gcugggggucaaucg

SEQ ID NO: 3284288 - RNA, 16 nt, Mycobacterium tuberculosis H37Rv
gcuggguaugcaccca

SEQ ID NO: 3284289 - RNA, 20 nt, Mycobacterium tuberculosis H37Rv
gcugggucagguugucggcg

SEQ ID NO: 3284290 - RNA, 23 nt, Mycobacterium tuberculosis H37Rv
gcugggucccgcuggcauauccc

SEQ ID NO: 3284291 - RNA, 15 nt, Mycobacterium tuberculosis H37Rv
gcugggucgccguuu

SEQ ID NO: 3284292 - RNA, 12 nt, Mycobacterium tuberculosis H37Rv
gcugggugacca

SEQ ID NO: 3284293 - RNA, 15 nt, Mycobacterium tuberculosis H37Rv
gcugggugaccagga

SEQ ID NO: 3284294 - RNA, 15 nt, Mycobacterium tuberculosis H37Rv
gcuggguggccccuu

SEQ ID NO: 3284295 - RNA, 18 nt, Mycobacterium tuberculosis H37Rv
gcugguaaccggcggcag

SEQ ID NO: 3284296 - RNA, 15 nt, Mycobacterium tuberculosis H37Rv
gcugguaggucaccg

SEQ ID NO: 3284297 - RNA, 16 nt, Mycobacterium tuberculosis H37Rv
gcugguaggucaccgg

SEQ ID NO: 3284298 - RNA, 21 nt, Mycobacterium tuberculosis H37Rv
gcugguaggucaccggucacc

SEQ ID NO: 3284299 - RNA, 20 nt, Mycobacterium tuberculosis H37Rv
gcugguauagcucacggugg

SEQ ID NO: 3284300 - RNA, 16 nt, Mycobacterium tuberculosis H37Rv
gcugguaucgagcacc

SEQ ID NO: 3284301 - RNA, 19 nt, Mycobacterium tuberculosis H37Rv
gcuggucaacagcggcaag

SEQ ID NO: 3284302 - RNA, 15 nt, Mycobacterium tuberculosis H37Rv
gcuggucagcggcgc

SEQ ID NO: 3284303 - RNA, 18 nt, Mycobacterium tuberculosis H37Rv
gcugguccaggcggugac

SEQ ID NO: 3284304 - RNA, 16 nt, Mycobacterium tuberculosis H37Rv
gcugguccgggugccg

SEQ ID NO: 3284305 - RNA, 23 nt, Mycobacterium tuberculosis H37Rv
gcugguccuccaaggcggucacc

SEQ ID NO: 3284306 - RNA, 22 nt, Mycobacterium tuberculosis H37Rv
gcugguccuccuucgguggugg

SEQ ID NO: 3284307 - RNA, 13 nt, Mycobacterium tuberculosis H37Rv
gcuggucgagcag

SEQ ID NO: 3284308 - RNA, 14 nt, Mycobacterium tuberculosis H37Rv
gcuggucgccgcgg

SEQ ID NO: 3284309 - RNA, 18 nt, Mycobacterium tuberculosis H37Rv
gcuggucgcugcugcgau

SEQ ID NO: 3284310 - RNA, 19 nt, Mycobacterium tuberculosis H37Rv
gcuggucgcugcugcgauc

SEQ ID NO: 3284311 - RNA, 14 nt, Mycobacterium tuberculosis H37Rv
gcuggucggagacc

SEQ ID NO: 3284312 - RNA, 14 nt, Mycobacterium tuberculosis H37Rv
gcuggucggcggcu

SEQ ID NO: 3284313 - RNA, 17 nt, Mycobacterium tuberculosis H37Rv
gcuggucgugccgccgu

SEQ ID NO: 3284314 - RNA, 15 nt, Mycobacterium tuberculosis H37Rv
gcuggucgugggcca

SEQ ID NO: 3284315 - RNA, 19 nt, Mycobacterium tuberculosis H37Rv
gcuggucgugggccaccac

SEQ ID NO: 3284316 - RNA, 23 nt, Mycobacterium tuberculosis H37Rv
gcuggugaucugcugggcaagau

SEQ ID NO: 3284317 - RNA, 17 nt, Mycobacterium tuberculosis H37Rv
gcuggugccaacugcgc

SEQ ID NO: 3284318 - RNA, 20 nt, Mycobacterium tuberculosis H37Rv
gcuggugcgccacgccaccg

SEQ ID NO: 3284319 - RNA, 16 nt, Mycobacterium tuberculosis H37Rv
gcuggugcgcggucug

SEQ ID NO: 3284320 - RNA, 17 nt, Mycobacterium tuberculosis H37Rv
gcuggugggaggggacc

SEQ ID NO: 3284321 - RNA, 15 nt, Mycobacterium tuberculosis H37Rv
gcuggugggccggac

SEQ ID NO: 3284322 - RNA, 19 nt, Mycobacterium tuberculosis H37Rv
gcuggugggggagcggccg

SEQ ID NO: 3284323 - RNA, 18 nt, Mycobacterium tuberculosis H37Rv
gcugguggugcggccggg

SEQ ID NO: 3284324 - RNA, 18 nt, Mycobacterium tuberculosis H37Rv
gcugguguccagccaggc

SEQ ID NO: 3284325 - RNA, 13 nt, Mycobacterium tuberculosis H37Rv
gcuggugugcggg

SEQ ID NO: 3284326 - RNA, 14 nt, Mycobacterium tuberculosis H37Rv
gcuggugugcgggc

SEQ ID NO: 3284327 - RNA, 16 nt, Mycobacterium tuberculosis H37Rv
gcuggugugucccggg

SEQ ID NO: 3284328 - RNA, 17 nt, Mycobacterium tuberculosis H37Rv
gcugguugaacaugucc

SEQ ID NO: 3284329 - RNA, 15 nt, Mycobacterium tuberculosis H37Rv
gcugguugcgccacu

SEQ ID NO: 3284330 - RNA, 18 nt, Mycobacterium tuberculosis H37Rv
gcugguugggggucgggc

SEQ ID NO: 3284331 - RNA, 20 nt, Mycobacterium tuberculosis H37Rv
gcuucggcagaccggcaucg

SEQ ID NO: 3284332 - RNA, 15 nt, Mycobacterium tuberculosis H37Rv
gcuucggccagauca

SEQ ID NO: 3284333 - RNA, 11 nt, Mycobacterium tuberculosis H37Rv
gcuucggcgag

SEQ ID NO: 3284334 - RNA, 19 nt, Mycobacterium tuberculosis H37Rv
gcuucggcggucagcggcu

SEQ ID NO: 3284335 - RNA, 14 nt, Mycobacterium tuberculosis H37Rv
gcuucggcgugcgu

SEQ ID NO: 3284336 - RNA, 16 nt, Mycobacterium tuberculosis H37Rv
gcuucgggcgucaucc

SEQ ID NO: 3284337 - RNA, 19 nt, Mycobacterium tuberculosis H37Rv
gcuucggguccagcggccg

SEQ ID NO: 3284338 - RNA, 13 nt, Mycobacterium tuberculosis H37Rv
gcuucggugaccc

SEQ ID NO: 3284339 - RNA, 16 nt, Mycobacterium tuberculosis H37Rv
gcuucggugacccggg

SEQ ID NO: 3284340 - RNA, 18 nt, Mycobacterium tuberculosis H37Rv
gcuucgucggccagcagc

SEQ ID NO: 3284341 - RNA, 15 nt, Mycobacterium tuberculosis H37Rv
gcuucgucggccggc

SEQ ID NO: 3284342 - RNA, 16 nt, Mycobacterium tuberculosis H37Rv
gcuucgucggccggca

SEQ ID NO: 3284343 - RNA, 15 nt, Mycobacterium tuberculosis H37Rv
gcuucgugcaccaca

SEQ ID NO: 3284344 - RNA, 17 nt, Mycobacterium tuberculosis H37Rv
gcuucguggcggcgcgc

SEQ ID NO: 3284345 - RNA, 16 nt, Mycobacterium tuberculosis H37Rv
gcuucuagcccguugu

SEQ ID NO: 3284346 - RNA, 17 nt, Mycobacterium tuberculosis H37Rv
gcuucucagcaccaugc

SEQ ID NO: 3284347 - RNA, 20 nt, Mycobacterium tuberculosis H37Rv
gcuucucccgccacugcugg

SEQ ID NO: 3284348 - RNA, 15 nt, Mycobacterium tuberculosis H37Rv
gcuucugccugcgca

SEQ ID NO: 3284349 - RNA, 16 nt, Mycobacterium tuberculosis H37Rv
gcuucugcgucugcuc

SEQ ID NO: 3284350 - RNA, 20 nt, Mycobacterium tuberculosis H37Rv
gcuucugcgucugcucgcgg

SEQ ID NO: 3284351 - RNA, 22 nt, Mycobacterium tuberculosis H37Rv
gcuucuucggacagcagccggc

SEQ ID NO: 3284352 - RNA, 19 nt, Mycobacterium tuberculosis H37Rv
gcuugacccacgagagcgc

SEQ ID NO: 3284353 - RNA, 20 nt, Mycobacterium tuberculosis H37Rv
gcuugacccacgagagcgcu

SEQ ID NO: 3284354 - RNA, 21 nt, Mycobacterium tuberculosis H37Rv
gcuugacccuugggcaccacc

SEQ ID NO: 3284355 - RNA, 18 nt, Mycobacterium tuberculosis H37Rv
gcuugaccgccuggaagg

SEQ ID NO: 3284356 - RNA, 12 nt, Mycobacterium tuberculosis H37Rv
gcuugacuccgc

SEQ ID NO: 3284357 - RNA, 16 nt, Mycobacterium tuberculosis H37Rv
gcuugacugcacacca

SEQ ID NO: 3284358 - RNA, 15 nt, Mycobacterium tuberculosis H37Rv
gcuugagcgccgaug

SEQ ID NO: 3284359 - RNA, 22 nt, Mycobacterium tuberculosis H37Rv
gcuugaggucccgugcgcgcgc

SEQ ID NO: 3284360 - RNA, 23 nt, Mycobacterium tuberculosis H37Rv
gcuugaguugguugaugcccuug

SEQ ID NO: 3284361 - RNA, 14 nt, Mycobacterium tuberculosis H37Rv
gcuugaucgccgag

SEQ ID NO: 3284362 - RNA, 15 nt, Mycobacterium tuberculosis H37Rv
gcuugaucgccgagg

SEQ ID NO: 3284363 - RNA, 14 nt, Mycobacterium tuberculosis H37Rv
gcuugcagggccac

SEQ ID NO: 3284364 - RNA, 21 nt, Mycobacterium tuberculosis H37Rv
gcuugcagugaggucaucguc

SEQ ID NO: 3284365 - RNA, 19 nt, Mycobacterium tuberculosis H37Rv
gcuugccccaucguucguu

SEQ ID NO: 3284366 - RNA, 14 nt, Mycobacterium tuberculosis H37Rv
gcuugccccgccgu

SEQ ID NO: 3284367 - RNA, 14 nt, Mycobacterium tuberculosis H37Rv
gcuugccccgccuu

SEQ ID NO: 3284368 - RNA, 18 nt, Mycobacterium tuberculosis H37Rv
gcuugccccgccuuggcc

SEQ ID NO: 3284369 - RNA, 19 nt, Mycobacterium tuberculosis H37Rv
gcuugccccgccuuggcca

SEQ ID NO: 3284370 - RNA, 19 nt, Mycobacterium tuberculosis H37Rv
gcuugcccgaagagcacgu

SEQ ID NO: 3284371 - RNA, 17 nt, Mycobacterium tuberculosis H37Rv
gcuugcccggcucggca

SEQ ID NO: 3284372 - RNA, 16 nt, Mycobacterium tuberculosis H37Rv
gcuugccggggugugc

SEQ ID NO: 3284373 - RNA, 15 nt, Mycobacterium tuberculosis H37Rv
gcuugccgucgcuga

SEQ ID NO: 3284374 - RNA, 18 nt, Mycobacterium tuberculosis H37Rv
gcuugccgucuucgccgc

SEQ ID NO: 3284375 - RNA, 18 nt, Mycobacterium tuberculosis H37Rv
gcuugcgaccccggcugc

SEQ ID NO: 3284376 - RNA, 17 nt, Mycobacterium tuberculosis H37Rv
gcuugcgaucggcacuu

SEQ ID NO: 3284377 - RNA, 15 nt, Mycobacterium tuberculosis H37Rv
gcuugcgcagccgca

SEQ ID NO: 3284378 - RNA, 16 nt, Mycobacterium tuberculosis H37Rv
gcuugcgcagccgcag

SEQ ID NO: 3284379 - RNA, 18 nt, Mycobacterium tuberculosis H37Rv
gcuugcgcagccgcagcc

SEQ ID NO: 3284380 - RNA, 14 nt, Mycobacterium tuberculosis H37Rv
gcuugcgccgcagc

SEQ ID NO: 3284381 - RNA, 22 nt, Mycobacterium tuberculosis H37Rv
gcuugcgccgcccaugccucca

SEQ ID NO: 3284382 - RNA, 21 nt, Mycobacterium tuberculosis H37Rv
gcuugcgccggaugacaccga

SEQ ID NO: 3284383 - RNA, 14 nt, Mycobacterium tuberculosis H37Rv
gcuugcgcggcuug

SEQ ID NO: 3284384 - RNA, 22 nt, Mycobacterium tuberculosis H37Rv
gcuugcgcucguugguucagcu

SEQ ID NO: 3284385 - RNA, 20 nt, Mycobacterium tuberculosis H37Rv
gcuugcggccgaauuccuca

SEQ ID NO: 3284386 - RNA, 14 nt, Mycobacterium tuberculosis H37Rv
gcuugcggccgcgc

SEQ ID NO: 3284387 - RNA, 14 nt, Mycobacterium tuberculosis H37Rv
gcuugcguagcuca

SEQ ID NO: 3284388 - RNA, 16 nt, Mycobacterium tuberculosis H37Rv
gcuuggaccagcgugg

SEQ ID NO: 3284389 - RNA, 21 nt, Mycobacterium tuberculosis H37Rv
gcuuggcaaccuguuccagcg

SEQ ID NO: 3284390 - RNA, 21 nt, Mycobacterium tuberculosis H37Rv
gcuuggcaaucaucucccgac

SEQ ID NO: 3284391 - RNA, 19 nt, Mycobacterium tuberculosis H37Rv
gcuuggccaaaaccaggga

SEQ ID NO: 3284392 - RNA, 19 nt, Mycobacterium tuberculosis H37Rv
gcuuggccagccacuccuc

SEQ ID NO: 3284393 - RNA, 23 nt, Mycobacterium tuberculosis H37Rv
gcuuggccgcgcaggcuuccagc

SEQ ID NO: 3284394 - RNA, 14 nt, Mycobacterium tuberculosis H37Rv
gcuuggccgggagu

SEQ ID NO: 3284395 - RNA, 16 nt, Mycobacterium tuberculosis H37Rv
gcuuggcgagccacgg

SEQ ID NO: 3284396 - RNA, 14 nt, Mycobacterium tuberculosis H37Rv
gcuuggcgccgaug

SEQ ID NO: 3284397 - RNA, 13 nt, Mycobacterium tuberculosis H37Rv
gcuuggcggccag

SEQ ID NO: 3284398 - RNA, 23 nt, Mycobacterium tuberculosis H37Rv
gcuuggcggccagcgugucccaa

SEQ ID NO: 3284399 - RNA, 17 nt, Mycobacterium tuberculosis H37Rv
gcuuggcgggaccguga

SEQ ID NO: 3284400 - RNA, 14 nt, Mycobacterium tuberculosis H37Rv
gcuuggcggggcua

SEQ ID NO: 3284401 - RNA, 23 nt, Mycobacterium tuberculosis H37Rv
gcuuggcggucugcgccaaaauc

SEQ ID NO: 3284402 - RNA, 13 nt, Mycobacterium tuberculosis H37Rv
gcuuggcgugacc

SEQ ID NO: 3284403 - RNA, 18 nt, Mycobacterium tuberculosis H37Rv
gcuuggcuccacaauccu

SEQ ID NO: 3284404 - RNA, 15 nt, Mycobacterium tuberculosis H37Rv
gcuugggccaggccc

SEQ ID NO: 3284405 - RNA, 15 nt, Mycobacterium tuberculosis H37Rv
gcuugggccggugca

SEQ ID NO: 3284406 - RNA, 16 nt, Mycobacterium tuberculosis H37Rv
gcuugggccggugcag

SEQ ID NO: 3284407 - RNA, 13 nt, Mycobacterium tuberculosis H37Rv
gcuugggccuggg

SEQ ID NO: 3284408 - RNA, 23 nt, Mycobacterium tuberculosis H37Rv
gcuugggugccucgccaaccuuu

SEQ ID NO: 3284409 - RNA, 16 nt, Mycobacterium tuberculosis H37Rv
gcuuggucgccgggca

SEQ ID NO: 3284410 - RNA, 19 nt, Mycobacterium tuberculosis H37Rv
gcuuggugcccaaggcaga

SEQ ID NO: 3284411 - RNA, 23 nt, Mycobacterium tuberculosis H37Rv
gcuuggugcccagcguggcuggc

SEQ ID NO: 3284412 - RNA, 16 nt, Mycobacterium tuberculosis H37Rv
gcuugguguauucgcg

SEQ ID NO: 3284413 - RNA, 21 nt, Mycobacterium tuberculosis H37Rv
gcuugguguauucgcggaugc

SEQ ID NO: 3284414 - RNA, 15 nt, Mycobacterium tuberculosis H37Rv
gcuugucgccccaug

SEQ ID NO: 3284415 - RNA, 14 nt, Mycobacterium tuberculosis H37Rv
gcuugucgcggugc

SEQ ID NO: 3284416 - RNA, 13 nt, Mycobacterium tuberculosis H37Rv
gcuugugcccaau

SEQ ID NO: 3284417 - RNA, 14 nt, Mycobacterium tuberculosis H37Rv
gcuuguucaucauc

SEQ ID NO: 3284418 - RNA, 16 nt, Mycobacterium tuberculosis H37Rv
gcuuuaaucguggcac

SEQ ID NO: 3284419 - RNA, 12 nt, Mycobacterium tuberculosis H37Rv
gcuuucagcacc

SEQ ID NO: 3284420 - RNA, 18 nt, Mycobacterium tuberculosis H37Rv
gcuuucagcaccggaucg

SEQ ID NO: 3284421 - RNA, 18 nt, Mycobacterium tuberculosis H37Rv
gcuuuccucaccagccgu

SEQ ID NO: 3284422 - RNA, 14 nt, Mycobacterium tuberculosis H37Rv
gcuuucgaagaacg

SEQ ID NO: 3284423 - RNA, 18 nt, Mycobacterium tuberculosis H37Rv
gcuuucgcgugcggcugc

SEQ ID NO: 3284424 - RNA, 16 nt, Mycobacterium tuberculosis H37Rv
gcuuucuuggcgggcg

SEQ ID NO: 3284425 - RNA, 14 nt, Mycobacterium tuberculosis H37Rv
gcuuugagccgcuc

SEQ ID NO: 3284426 - RNA, 20 nt, Mycobacterium tuberculosis H37Rv
gcuuugagucccgguagacc

SEQ ID NO: 3284427 - RNA, 14 nt, Mycobacterium tuberculosis H37Rv
gcuuugcacugugg

SEQ ID NO: 3284428 - RNA, 19 nt, Mycobacterium tuberculosis H37Rv
ggaaguacuuuuggguucg

SEQ ID NO: 3284429 - RNA, 14 nt, Mycobacterium tuberculosis H37Rv
ggaagucccgccgu

SEQ ID NO: 3284430 - RNA, 22 nt, Mycobacterium tuberculosis H37Rv
ggaagugcaccuggaucagggc

SEQ ID NO: 3284431 - RNA, 17 nt, Mycobacterium tuberculosis H37Rv
ggaaguugcccagguga

SEQ ID NO: 3284432 - RNA, 17 nt, Mycobacterium tuberculosis H37Rv
ggaaguuggcugagcag

SEQ ID NO: 3284433 - RNA, 17 nt, Mycobacterium tuberculosis H37Rv
ggaauacaacagcuggg

SEQ ID NO: 3284434 - RNA, 14 nt, Mycobacterium tuberculosis H37Rv
ggaauacagcuuga

SEQ ID NO: 3284435 - RNA, 18 nt, Mycobacterium tuberculosis H37Rv
ggaauagcaacgcugcag

SEQ ID NO: 3284436 - RNA, 19 nt, Mycobacterium tuberculosis H37Rv
ggaauagcaacgcugcagc

SEQ ID NO: 3284437 - RNA, 21 nt, Mycobacterium tuberculosis H37Rv
ggaaucagugaagacaccagg

SEQ ID NO: 3284438 - RNA, 17 nt, Mycobacterium tuberculosis H37Rv
ggaauccccccugucgc

SEQ ID NO: 3284439 - RNA, 14 nt, Mycobacterium tuberculosis H37Rv
ggaauccgaacucg

SEQ ID NO: 3284440 - RNA, 16 nt, Mycobacterium tuberculosis H37Rv
ggaauccgcggcgauc

SEQ ID NO: 3284441 - RNA, 20 nt, Mycobacterium tuberculosis H37Rv
ggaauccgcggcgaucacca

SEQ ID NO: 3284442 - RNA, 18 nt, Mycobacterium tuberculosis H37Rv
ggaauccggugaugaccg

SEQ ID NO: 3284443 - RNA, 13 nt, Mycobacterium tuberculosis H37Rv
ggaaucgcaccgu

SEQ ID NO: 3284444 - RNA, 16 nt, Mycobacterium tuberculosis H37Rv
ggaaucgcaucggcgg

SEQ ID NO: 3284445 - RNA, 18 nt, Mycobacterium tuberculosis H37Rv
ggaaucgcggagccagga

SEQ ID NO: 3284446 - RNA, 15 nt, Mycobacterium tuberculosis H37Rv
ggaaucgguuucgac

SEQ ID NO: 3284447 - RNA, 20 nt, Mycobacterium tuberculosis H37Rv
ggaaucgguuucgaccugcg

SEQ ID NO: 3284448 - RNA, 13 nt, Mycobacterium tuberculosis H37Rv
ggaaucgucgcgg

SEQ ID NO: 3284449 - RNA, 23 nt, Mycobacterium tuberculosis H37Rv
ggaaucgucggcgcggcugucgu

SEQ ID NO: 3284450 - RNA, 13 nt, Mycobacterium tuberculosis H37Rv
ggaaucgucggcu

SEQ ID NO: 3284451 - RNA, 14 nt, Mycobacterium tuberculosis H37Rv
ggaaucuccggcug

SEQ ID NO: 3284452 - RNA, 16 nt, Mycobacterium tuberculosis H37Rv
ggaaugccgucgccgg

SEQ ID NO: 3284453 - RNA, 22 nt, Mycobacterium tuberculosis H37Rv
ggaauggacaggucgggcagca

SEQ ID NO: 3284454 - RNA, 14 nt, Mycobacterium tuberculosis H37Rv
ggaauggaccagcg

SEQ ID NO: 3284455 - RNA, 17 nt, Mycobacterium tuberculosis H37Rv
ggaauggaccagcgccc

SEQ ID NO: 3284456 - RNA, 18 nt, Mycobacterium tuberculosis H37Rv
ggaaugucagccgguucc

SEQ ID NO: 3284457 - RNA, 22 nt, Mycobacterium tuberculosis H37Rv
ggaauguugcgagugagcucag

SEQ ID NO: 3284458 - RNA, 15 nt, Mycobacterium tuberculosis H37Rv
ggaauuagucgccgc

SEQ ID NO: 3284459 - RNA, 15 nt, Mycobacterium tuberculosis H37Rv
ggaauucagcgacgc

SEQ ID NO: 3284460 - RNA, 23 nt, Mycobacterium tuberculosis H37Rv
ggaauuccgcuaccgcacaggca

SEQ ID NO: 3284461 - RNA, 22 nt, Mycobacterium tuberculosis H37Rv
ggacaaacaucgcacccaccac

SEQ ID NO: 3284462 - RNA, 18 nt, Mycobacterium tuberculosis H37Rv
ggacaaaccgggcggcca

SEQ ID NO: 3284463 - RNA, 21 nt, Mycobacterium tuberculosis H37Rv
ggacaacagcuuggagaucgc

SEQ ID NO: 3284464 - RNA, 16 nt, Mycobacterium tuberculosis H37Rv
ggacaaccccuugccu

SEQ ID NO: 3284465 - RNA, 18 nt, Mycobacterium tuberculosis H37Rv
ggacaaccgggcgggacu

SEQ ID NO: 3284466 - RNA, 23 nt, Mycobacterium tuberculosis H37Rv
ggacaaccgggcgggacucggcg

SEQ ID NO: 3284467 - RNA, 21 nt, Mycobacterium tuberculosis H37Rv
ggacaaccuggggccaccaga

SEQ ID NO: 3284468 - RNA, 15 nt, Mycobacterium tuberculosis H37Rv
ggacaagccgcugau

SEQ ID NO: 3284469 - RNA, 15 nt, Mycobacterium tuberculosis H37Rv
ggacaagcuccucgc

SEQ ID NO: 3284470 - RNA, 17 nt, Mycobacterium tuberculosis H37Rv
ggacaagcuccucgcga

SEQ ID NO: 3284471 - RNA, 17 nt, Mycobacterium tuberculosis H37Rv
ggacaaggucaucggca

SEQ ID NO: 3284472 - RNA, 20 nt, Mycobacterium tuberculosis H37Rv
ggacaaggucaucggcaucc

SEQ ID NO: 3284473 - RNA, 14 nt, Mycobacterium tuberculosis H37Rv
ggacaagucggcac

SEQ ID NO: 3284474 - RNA, 15 nt, Mycobacterium tuberculosis H37Rv
ggacaagucggcacc

SEQ ID NO: 3284475 - RNA, 14 nt, Mycobacterium tuberculosis H37Rv
ggacaagugccggc

SEQ ID NO: 3284476 - RNA, 18 nt, Mycobacterium tuberculosis H37Rv
ggacaauggacaccaacc

SEQ ID NO: 3284477 - RNA, 18 nt, Mycobacterium tuberculosis H37Rv
ggacacauugaccaggug

SEQ ID NO: 3284478 - RNA, 19 nt, Mycobacterium tuberculosis H37Rv
ggacaccaacccacccccc

SEQ ID NO: 3284479 - RNA, 18 nt, Mycobacterium tuberculosis H37Rv
ggacaccguggaucggca

SEQ ID NO: 3284480 - RNA, 19 nt, Mycobacterium tuberculosis H37Rv
ggacaccguggaucggcag

SEQ ID NO: 3284481 - RNA, 23 nt, Mycobacterium tuberculosis H37Rv
ggacaccguggaucggcagcccg

SEQ ID NO: 3284482 - RNA, 21 nt, Mycobacterium tuberculosis H37Rv
ggacaccuaccgagaucaccg

SEQ ID NO: 3284483 - RNA, 15 nt, Mycobacterium tuberculosis H37Rv
ggacaccugcugcac

SEQ ID NO: 3284484 - RNA, 16 nt, Mycobacterium tuberculosis H37Rv
ggacaccugcugcacc

SEQ ID NO: 3284485 - RNA, 21 nt, Mycobacterium tuberculosis H37Rv
ggacaccuguaguucgaugac

SEQ ID NO: 3284486 - RNA, 19 nt, Mycobacterium tuberculosis H37Rv
ggacacgaucgcgucggcu

SEQ ID NO: 3284487 - RNA, 22 nt, Mycobacterium tuberculosis H37Rv
ggacacuccugcacacaggacu

SEQ ID NO: 3284488 - RNA, 15 nt, Mycobacterium tuberculosis H37Rv
ggacagcagcagauc

SEQ ID NO: 3284489 - RNA, 15 nt, Mycobacterium tuberculosis H37Rv
ggacagcagccggau

SEQ ID NO: 3284490 - RNA, 16 nt, Mycobacterium tuberculosis H37Rv
ggacagcaucacgauc

SEQ ID NO: 3284491 - RNA, 19 nt, Mycobacterium tuberculosis H37Rv
ggacagcaucacgaucacg

SEQ ID NO: 3284492 - RNA, 11 nt, Mycobacterium tuberculosis H37Rv
ggacagcgccg

SEQ ID NO: 3284493 - RNA, 15 nt, Mycobacterium tuberculosis H37Rv
ggacagcuguugauu

SEQ ID NO: 3284494 - RNA, 18 nt, Mycobacterium tuberculosis H37Rv
ggacaggcuugacugcac

SEQ ID NO: 3284495 - RNA, 12 nt, Mycobacterium tuberculosis H37Rv
ggacagggugcg

SEQ ID NO: 3284496 - RNA, 16 nt, Mycobacterium tuberculosis H37Rv
ggacagggugcgcuug

SEQ ID NO: 3284497 - RNA, 22 nt, Mycobacterium tuberculosis H37Rv
ggacagggugggggcaucaggg

SEQ ID NO: 3284498 - RNA, 18 nt, Mycobacterium tuberculosis H37Rv
ggacagguaacgcgguuc

SEQ ID NO: 3284499 - RNA, 17 nt, Mycobacterium tuberculosis H37Rv
ggacaggucgggcagca

SEQ ID NO: 3284500 - RNA, 18 nt, Mycobacterium tuberculosis H37Rv
ggacaguuacgcuggcac

SEQ ID NO: 3284501 - RNA, 20 nt, Mycobacterium tuberculosis H37Rv
ggacaguuccccgggcucgg

SEQ ID NO: 3284502 - RNA, 23 nt, Mycobacterium tuberculosis H37Rv
ggacaguuuuuccgugccgacca

SEQ ID NO: 3284503 - RNA, 14 nt, Mycobacterium tuberculosis H37Rv
ggacaucaccggca

SEQ ID NO: 3284504 - RNA, 21 nt, Mycobacterium tuberculosis H37Rv
ggacauccgggccgagcgcac

SEQ ID NO: 3284505 - RNA, 17 nt, Mycobacterium tuberculosis H37Rv
ggacaucggccggcguc

SEQ ID NO: 3284506 - RNA, 15 nt, Mycobacterium tuberculosis H37Rv
ggacaucgggcggca

SEQ ID NO: 3284507 - RNA, 18 nt, Mycobacterium tuberculosis H37Rv
ggacaucgggcggcaccg

SEQ ID NO: 3284508 - RNA, 17 nt, Mycobacterium tuberculosis H37Rv
ggacaugcgggcagcac

SEQ ID NO: 3284509 - RNA, 20 nt, Mycobacterium tuberculosis H37Rv
ggacaugcgggcagcacucu

SEQ ID NO: 3284510 - RNA, 14 nt, Mycobacterium tuberculosis H37Rv
ggaccaacgccaac

SEQ ID NO: 3284511 - RNA, 23 nt, Mycobacterium tuberculosis H37Rv
ggaccaacgccaacgccacggca

SEQ ID NO: 3284512 - RNA, 18 nt, Mycobacterium tuberculosis H37Rv
ggaccacagccgcgccga

SEQ ID NO: 3284513 - RNA, 14 nt, Mycobacterium tuberculosis H37Rv
ggaccaccagcgcu

SEQ ID NO: 3284514 - RNA, 17 nt, Mycobacterium tuberculosis H37Rv
ggaccaccagcgcucca

SEQ ID NO: 3284515 - RNA, 22 nt, Mycobacterium tuberculosis H37Rv
ggaccaccagcgcuccagcacc

SEQ ID NO: 3284516 - RNA, 20 nt, Mycobacterium tuberculosis H37Rv
ggaccaccgcauaacgccag

SEQ ID NO: 3284517 - RNA, 13 nt, Mycobacterium tuberculosis H37Rv
ggaccacgaaccg

SEQ ID NO: 3284518 - RNA, 15 nt, Mycobacterium tuberculosis H37Rv
ggaccacgccgacgu

SEQ ID NO: 3284519 - RNA, 23 nt, Mycobacterium tuberculosis H37Rv
ggaccacuguuggugccgccacc

SEQ ID NO: 3284520 - RNA, 16 nt, Mycobacterium tuberculosis H37Rv
ggaccagagccaacga

SEQ ID NO: 3284521 - RNA, 14 nt, Mycobacterium tuberculosis H37Rv
ggaccagaggcgcu

SEQ ID NO: 3284522 - RNA, 11 nt, Mycobacterium tuberculosis H37Rv
ggaccagcgcc

SEQ ID NO: 3284523 - RNA, 16 nt, Mycobacterium tuberculosis H37Rv
ggaccagcgccccggc

SEQ ID NO: 3284524 - RNA, 12 nt, Mycobacterium tuberculosis H37Rv
ggacgggcggcc

SEQ ID NO: 3284525 - RNA, 19 nt, Mycobacterium tuberculosis H37Rv
ggacgggggcuguccaccg

SEQ ID NO: 3284526 - RNA, 20 nt, Mycobacterium tuberculosis H37Rv
ggacgggguacugcggcucg

SEQ ID NO: 3284527 - RNA, 18 nt, Mycobacterium tuberculosis H37Rv
ggacgggucucgcgagcg

SEQ ID NO: 3284528 - RNA, 14 nt, Mycobacterium tuberculosis H37Rv
ggacggucgccagg

SEQ ID NO: 3284529 - RNA, 16 nt, Mycobacterium tuberculosis H37Rv
ggacggucgcucggca

SEQ ID NO: 3284530 - RNA, 23 nt, Mycobacterium tuberculosis H37Rv
ggacggugaucuugccggccagc

SEQ ID NO: 3284531 - RNA, 16 nt, Mycobacterium tuberculosis H37Rv
ggacggugggucucga

SEQ ID NO: 3284532 - RNA, 19 nt, Mycobacterium tuberculosis H37Rv
ggacggugucagccgucgc

SEQ ID NO: 3284533 - RNA, 21 nt, Mycobacterium tuberculosis H37Rv
ggacgguugguccgccgucga

SEQ ID NO: 3284534 - RNA, 20 nt, Mycobacterium tuberculosis H37Rv
ggacgucaccgucaguucgg

SEQ ID NO: 3284535 - RNA, 14 nt, Mycobacterium tuberculosis H37Rv
ggacgucgccgcag

SEQ ID NO: 3284536 - RNA, 14 nt, Mycobacterium tuberculosis H37Rv
ggacgucggcgaua

SEQ ID NO: 3284537 - RNA, 14 nt, Mycobacterium tuberculosis H37Rv
ggacgugacgucgu

SEQ ID NO: 3284538 - RNA, 22 nt, Mycobacterium tuberculosis H37Rv
ggacgugacgucguggcgcucg

SEQ ID NO: 3284539 - RNA, 22 nt, Mycobacterium tuberculosis H37Rv
ggacgugcccgguguucaucac

SEQ ID NO: 3284540 - RNA, 14 nt, Mycobacterium tuberculosis H37Rv
ggacguggacuuug

SEQ ID NO: 3284541 - RNA, 13 nt, Mycobacterium tuberculosis H37Rv
ggacgugucggug

SEQ ID NO: 3284542 - RNA, 18 nt, Mycobacterium tuberculosis H37Rv
ggacguuucagccgggug

SEQ ID NO: 3284543 - RNA, 18 nt, Mycobacterium tuberculosis H37Rv
ggacuaccgccggcggcg

SEQ ID NO: 3284544 - RNA, 14 nt, Mycobacterium tuberculosis H37Rv
ggacucacgcagcg

SEQ ID NO: 3284545 - RNA, 14 nt, Mycobacterium tuberculosis H37Rv
ggacucaucggcgu

SEQ ID NO: 3284546 - RNA, 17 nt, Mycobacterium tuberculosis H37Rv
ggacucgccgacgucga

SEQ ID NO: 3284547 - RNA, 16 nt, Mycobacterium tuberculosis H37Rv
ggacucgcguccucgg

SEQ ID NO: 3284548 - RNA, 19 nt, Mycobacterium tuberculosis H37Rv
ggacucggaauucggcguc

SEQ ID NO: 3284549 - RNA, 22 nt, Mycobacterium tuberculosis H37Rv
ggacucggcggaagaccggauc

SEQ ID NO: 3284550 - RNA, 21 nt, Mycobacterium tuberculosis H37Rv
ggacucguucauguagcagcg

SEQ ID NO: 3284551 - RNA, 17 nt, Mycobacterium tuberculosis H37Rv
ggacucugccacccagc

SEQ ID NO: 3284552 - RNA, 16 nt, Mycobacterium tuberculosis H37Rv
ggacugaucgucugaa

SEQ ID NO: 3284553 - RNA, 18 nt, Mycobacterium tuberculosis H37Rv
ggacugcagcgccucgac

SEQ ID NO: 3284554 - RNA, 14 nt, Mycobacterium tuberculosis H37Rv
ggacugcagcgcgg

SEQ ID NO: 3284555 - RNA, 20 nt, Mycobacterium tuberculosis H37Rv
ggacugcgaagaguccuuaa

SEQ ID NO: 3284556 - RNA, 14 nt, Mycobacterium tuberculosis H37Rv
ggacugcgccgggu

SEQ ID NO: 3284557 - RNA, 18 nt, Mycobacterium tuberculosis H37Rv
ggacugugggggcgcacc

SEQ ID NO: 3284558 - RNA, 19 nt, Mycobacterium tuberculosis H37Rv
ggacuucagcaggcccagc

SEQ ID NO: 3284559 - RNA, 20 nt, Mycobacterium tuberculosis H37Rv
ggacuucaugaucggacccg

SEQ ID NO: 3284560 - RNA, 23 nt, Mycobacterium tuberculosis H37Rv
ggacuucggugagcagggcggcg

SEQ ID NO: 3284561 - RNA, 22 nt, Mycobacterium tuberculosis H37Rv
ggacuucguuccgugccgagcu

SEQ ID NO: 3284562 - RNA, 16 nt, Mycobacterium tuberculosis H37Rv
ggacuugcgagccgua

SEQ ID NO: 3284563 - RNA, 15 nt, Mycobacterium tuberculosis H37Rv
ggagaacaucccccg

SEQ ID NO: 3284564 - RNA, 17 nt, Mycobacterium tuberculosis H37Rv
ggagaacgcccgcagga

SEQ ID NO: 3284565 - RNA, 23 nt, Mycobacterium tuberculosis H37Rv
ggagaauuaguuucguccccaga

SEQ ID NO: 3284566 - RNA, 21 nt, Mycobacterium tuberculosis H37Rv
ggagaccggccgggugaacca

SEQ ID NO: 3284567 - RNA, 19 nt, Mycobacterium tuberculosis H37Rv
ggagacgaucgccaggccg

SEQ ID NO: 3284568 - RNA, 20 nt, Mycobacterium tuberculosis H37Rv
ggagacgaucgccaggccga

SEQ ID NO: 3284569 - RNA, 16 nt, Mycobacterium tuberculosis H37Rv
ggagacgguacgccag

SEQ ID NO: 3284570 - RNA, 18 nt, Mycobacterium tuberculosis H37Rv
ggagacguuuugcggccc

SEQ ID NO: 3284571 - RNA, 20 nt, Mycobacterium tuberculosis H37Rv
ggagacuccagcaaggccag

SEQ ID NO: 3284572 - RNA, 15 nt, Mycobacterium tuberculosis H37Rv
ggagacucucugauc

SEQ ID NO: 3284573 - RNA, 11 nt, Mycobacterium tuberculosis H37Rv
ggagagccggu

SEQ ID NO: 3284574 - RNA, 20 nt, Mycobacterium tuberculosis H37Rv
ggagagguagggcuccaccg

SEQ ID NO: 3284575 - RNA, 14 nt, Mycobacterium tuberculosis H37Rv
ggagagugguugcg

SEQ ID NO: 3284576 - RNA, 21 nt, Mycobacterium tuberculosis H37Rv
ggagauccaccgguccagggc

SEQ ID NO: 3284577 - RNA, 13 nt, Mycobacterium tuberculosis H37Rv
ggagauccagggc

SEQ ID NO: 3284578 - RNA, 14 nt, Mycobacterium tuberculosis H37Rv
ggagaugccgacga

SEQ ID NO: 3284579 - RNA, 24 nt, Mycobacterium tuberculosis H37Rv
ggagauggcauuggggggcuggca

SEQ ID NO: 3284580 - RNA, 21 nt, Mycobacterium tuberculosis H37Rv
ggagauuggguccagcgagga

SEQ ID NO: 3284581 - RNA, 17 nt, Mycobacterium tuberculosis H37Rv
ggagcaauuccacgauc

SEQ ID NO: 3284582 - RNA, 16 nt, Mycobacterium tuberculosis H37Rv
ggagcaccgaccaggg

SEQ ID NO: 3284583 - RNA, 21 nt, Mycobacterium tuberculosis H37Rv
ggagcaccucgaagugcaggu

SEQ ID NO: 3284584 - RNA, 12 nt, Mycobacterium tuberculosis H37Rv
ggagcagccgaa

SEQ ID NO: 3284585 - RNA, 12 nt, Mycobacterium tuberculosis H37Rv
ggagcagggcuc

SEQ ID NO: 3284586 - RNA, 23 nt, Mycobacterium tuberculosis H37Rv
ggagccacucggcccggcaggac

SEQ ID NO: 3284587 - RNA, 22 nt, Mycobacterium tuberculosis H37Rv
ggagccccugucaacgccgcgg

SEQ ID NO: 3284588 - RNA, 14 nt, Mycobacterium tuberculosis H37Rv
ggagcccgagcuca

SEQ ID NO: 3284589 - RNA, 15 nt, Mycobacterium tuberculosis H37Rv
ggagcccgagcucac

SEQ ID NO: 3284590 - RNA, 16 nt, Mycobacterium tuberculosis H37Rv
ggagcccgagcucacc

SEQ ID NO: 3284591 - RNA, 12 nt, Mycobacterium tuberculosis H37Rv
ggagcccggcau

SEQ ID NO: 3284592 - RNA, 22 nt, Mycobacterium tuberculosis H37Rv
ggagcccggcauuaggccgggg

SEQ ID NO: 3284593 - RNA, 14 nt, Mycobacterium tuberculosis H37Rv
ggagcccggcggcc

SEQ ID NO: 3284594 - RNA, 18 nt, Mycobacterium tuberculosis H37Rv
ggagcccguccaggcccg

SEQ ID NO: 3284595 - RNA, 16 nt, Mycobacterium tuberculosis H37Rv
ggagcccugaccgggg

SEQ ID NO: 3284596 - RNA, 16 nt, Mycobacterium tuberculosis H37Rv
ggagccgaucacgcug

SEQ ID NO: 3284597 - RNA, 14 nt, Mycobacterium tuberculosis H37Rv
ggagccgccaccga

SEQ ID NO: 3284598 - RNA, 22 nt, Mycobacterium tuberculosis H37Rv
ggagccgccaggugcucgucga

SEQ ID NO: 3284599 - RNA, 12 nt, Mycobacterium tuberculosis H37Rv
ggagccgcccaa

SEQ ID NO: 3284600 - RNA, 19 nt, Mycobacterium tuberculosis H37Rv
ggagccgcccaagccgccg

SEQ ID NO: 3284601 - RNA, 18 nt, Mycobacterium tuberculosis H37Rv
ggagccgccgacucggca

SEQ ID NO: 3284602 - RNA, 14 nt, Mycobacterium tuberculosis H37Rv
ggagccgccggacg

SEQ ID NO: 3284603 - RNA, 21 nt, Mycobacterium tuberculosis H37Rv
ggagccgccggacgaacugug

SEQ ID NO: 3284604 - RNA, 18 nt, Mycobacterium tuberculosis H37Rv
ggagccgccggccccgcc

SEQ ID NO: 3284605 - RNA, 20 nt, Mycobacterium tuberculosis H37Rv
ggagccggccaccucggugc

SEQ ID NO: 3284606 - RNA, 13 nt, Mycobacterium tuberculosis H37Rv
ggagccggugacg

SEQ ID NO: 3284607 - RNA, 22 nt, Mycobacterium tuberculosis H37Rv
ggagccgucgcaucaggucggu

SEQ ID NO: 3284608 - RNA, 20 nt, Mycobacterium tuberculosis H37Rv
ggagccgugcggucgcgccc

SEQ ID NO: 3284609 - RNA, 19 nt, Mycobacterium tuberculosis H37Rv
ggagccuccagcgcaccgg

SEQ ID NO: 3284610 - RNA, 14 nt, Mycobacterium tuberculosis H37Rv
ggagcgaacggcgc

SEQ ID NO: 3284611 - RNA, 16 nt, Mycobacterium tuberculosis H37Rv
ggagcgaugcgggcaa

SEQ ID NO: 3284612 - RNA, 21 nt, Mycobacterium tuberculosis H37Rv
ggagcgcaccugaaggcggcg

SEQ ID NO: 3284613 - RNA, 23 nt, Mycobacterium tuberculosis H37Rv
ggagcgcaccugaaggcggcgau

SEQ ID NO: 3284614 - RNA, 18 nt, Mycobacterium tuberculosis H37Rv
ggagcgcaggaccugacg

SEQ ID NO: 3284615 - RNA, 18 nt, Mycobacterium tuberculosis H37Rv
ggagcgccgagcucggcg

SEQ ID NO: 3284616 - RNA, 19 nt, Mycobacterium tuberculosis H37Rv
ggagcgccgagcucggcgc

SEQ ID NO: 3284617 - RNA, 13 nt, Mycobacterium tuberculosis H37Rv
ggagcgccgcagg

SEQ ID NO: 3284618 - RNA, 18 nt, Mycobacterium tuberculosis H37Rv
ggagcgcgaugaccucgg

SEQ ID NO: 3284619 - RNA, 14 nt, Mycobacterium tuberculosis H37Rv
ggagcgcuugguca

SEQ ID NO: 3284620 - RNA, 23 nt, Mycobacterium tuberculosis H37Rv
ggaucgaccaauucgaccgcgcg

SEQ ID NO: 3284621 - RNA, 15 nt, Mycobacterium tuberculosis H37Rv
ggaucgaccaugguc

SEQ ID NO: 3284622 - RNA, 19 nt, Mycobacterium tuberculosis H37Rv
ggaucgaccauggucgauu

SEQ ID NO: 3284623 - RNA, 17 nt, Mycobacterium tuberculosis H37Rv
ggaucgaccgccagcgc

SEQ ID NO: 3284624 - RNA, 23 nt, Mycobacterium tuberculosis H37Rv
ggaucgagcuaguucggcgucca

SEQ ID NO: 3284625 - RNA, 21 nt, Mycobacterium tuberculosis H37Rv
ggaucgcagggaucaccccgg

SEQ ID NO: 3284626 - RNA, 13 nt, Mycobacterium tuberculosis H37Rv
ggaucgccaccgg

SEQ ID NO: 3284627 - RNA, 17 nt, Mycobacterium tuberculosis H37Rv
ggaucgccaccggcgcc

SEQ ID NO: 3284628 - RNA, 24 nt, Mycobacterium tuberculosis H37Rv
ggaucgcccaggcgcgacguacga

SEQ ID NO: 3284629 - RNA, 16 nt, Mycobacterium tuberculosis H37Rv
ggaucgccggggacgc

SEQ ID NO: 3284630 - RNA, 14 nt, Mycobacterium tuberculosis H37Rv
ggaucgccugagcg

SEQ ID NO: 3284631 - RNA, 17 nt, Mycobacterium tuberculosis H37Rv
ggaucgccugagcgccg

SEQ ID NO: 3284632 - RNA, 22 nt, Mycobacterium tuberculosis H37Rv
ggaucgccugagcgccgcggcg

SEQ ID NO: 3284633 - RNA, 21 nt, Mycobacterium tuberculosis H37Rv
ggaucgccuuggcgcccgcga

SEQ ID NO: 3284634 - RNA, 14 nt, Mycobacterium tuberculosis H37Rv
ggaucgcgauggcc

SEQ ID NO: 3284635 - RNA, 19 nt, Mycobacterium tuberculosis H37Rv
ggaucgcgcccugagccac

SEQ ID NO: 3284636 - RNA, 15 nt, Mycobacterium tuberculosis H37Rv
ggaucgcggcggcgu

SEQ ID NO: 3284637 - RNA, 21 nt, Mycobacterium tuberculosis H37Rv
ggaucgcggucagcgggucga

SEQ ID NO: 3284638 - RNA, 16 nt, Mycobacterium tuberculosis H37Rv
ggaucggauggcggcc

SEQ ID NO: 3284639 - RNA, 15 nt, Mycobacterium tuberculosis H37Rv
ggaucggcagcagag

SEQ ID NO: 3284640 - RNA, 13 nt, Mycobacterium tuberculosis H37Rv
ggaucggccggcg

SEQ ID NO: 3284641 - RNA, 19 nt, Mycobacterium tuberculosis H37Rv
ggaucggcggaccgcagcg

SEQ ID NO: 3284642 - RNA, 12 nt, Mycobacterium tuberculosis H37Rv
ggaucggcggau

SEQ ID NO: 3284643 - RNA, 22 nt, Mycobacterium tuberculosis H37Rv
ggaucggcggccgcgaccagcg

SEQ ID NO: 3284644 - RNA, 24 nt, Mycobacterium tuberculosis H37Rv
ggaucggcugcgcgcucggccagc

SEQ ID NO: 3284645 - RNA, 17 nt, Mycobacterium tuberculosis H37Rv
ggaucgggcaccccgac

SEQ ID NO: 3284646 - RNA, 20 nt, Mycobacterium tuberculosis H37Rv
ggaucgggcaccccgaccac

SEQ ID NO: 3284647 - RNA, 13 nt, Mycobacterium tuberculosis H37Rv
ggaucggugguac

SEQ ID NO: 3284648 - RNA, 22 nt, Mycobacterium tuberculosis H37Rv
ggaucggugguacgugcgagcc

SEQ ID NO: 3284649 - RNA, 22 nt, Mycobacterium tuberculosis H37Rv
ggaucgguuucugcggccccga

SEQ ID NO: 3284650 - RNA, 23 nt, Mycobacterium tuberculosis H37Rv
ggaucgucaggcccauggcagcc

SEQ ID NO: 3284651 - RNA, 14 nt, Mycobacterium tuberculosis H37Rv
ggaucgucgcugug

SEQ ID NO: 3284652 - RNA, 15 nt, Mycobacterium tuberculosis H37Rv
ggaucgucgugcacg

SEQ ID NO: 3284653 - RNA, 13 nt, Mycobacterium tuberculosis H37Rv
ggaucgugccggc

SEQ ID NO: 3284654 - RNA, 14 nt, Mycobacterium tuberculosis H37Rv
ggaucgugccggcg

SEQ ID NO: 3284655 - RNA, 23 nt, Mycobacterium tuberculosis H37Rv
ggaucguucgcgugccagcgccc

SEQ ID NO: 3284656 - RNA, 16 nt, Mycobacterium tuberculosis H37Rv
ggaucucauccauguu

SEQ ID NO: 3284657 - RNA, 18 nt, Mycobacterium tuberculosis H37Rv
ggaucucggcguaggcga

SEQ ID NO: 3284658 - RNA, 19 nt, Mycobacterium tuberculosis H37Rv
ggaucucguuggugccuuc

SEQ ID NO: 3284659 - RNA, 22 nt, Mycobacterium tuberculosis H37Rv
ggaucucguuggugccuucacc

SEQ ID NO: 3284660 - RNA, 16 nt, Mycobacterium tuberculosis H37Rv
ggaucucuuucggaug

SEQ ID NO: 3284661 - RNA, 15 nt, Mycobacterium tuberculosis H37Rv
ggaucugacccagca

SEQ ID NO: 3284662 - RNA, 17 nt, Mycobacterium tuberculosis H37Rv
ggaucugcagcacgcgu

SEQ ID NO: 3284663 - RNA, 18 nt, Mycobacterium tuberculosis H37Rv
ggaucugggcucgguccu

SEQ ID NO: 3284664 - RNA, 22 nt, Mycobacterium tuberculosis H37Rv
ggaucuguuccucggugacuuc

SEQ ID NO: 3284665 - RNA, 14 nt, Mycobacterium tuberculosis H37Rv
ggaucuuggccagc

SEQ ID NO: 3284666 - RNA, 15 nt, Mycobacterium tuberculosis H37Rv
ggaucuuggccagca

SEQ ID NO: 3284667 - RNA, 18 nt, Mycobacterium tuberculosis H37Rv
ggaugaagcgaugagggu

SEQ ID NO: 3284668 - RNA, 16 nt, Mycobacterium tuberculosis H37Rv
ggaugaccaccgguuc

SEQ ID NO: 3284669 - RNA, 22 nt, Mycobacterium tuberculosis H37Rv
ggaugaccuucccgucgacgag

SEQ ID NO: 3284670 - RNA, 15 nt, Mycobacterium tuberculosis H37Rv
ggaugacgacgguga

SEQ ID NO: 3284671 - RNA, 20 nt, Mycobacterium tuberculosis H37Rv
ggaugaucugcgcggcccgc

SEQ ID NO: 3284672 - RNA, 14 nt, Mycobacterium tuberculosis H37Rv
ggaugcagcugccc

SEQ ID NO: 3284673 - RNA, 22 nt, Mycobacterium tuberculosis H37Rv
ggaugcaugucaaguucgccag

SEQ ID NO: 3284674 - RNA, 15 nt, Mycobacterium tuberculosis H37Rv
ggaugcccggauccg

SEQ ID NO: 3284675 - RNA, 20 nt, Mycobacterium tuberculosis H37Rv
ggaugcccguagacgccgag

SEQ ID NO: 3284676 - RNA, 19 nt, Mycobacterium tuberculosis H37Rv
ggaugccgaaccgcugcgg

SEQ ID NO: 3284677 - RNA, 15 nt, Mycobacterium tuberculosis H37Rv
ggaugccggaaagca

SEQ ID NO: 3284678 - RNA, 13 nt, Mycobacterium tuberculosis H37Rv
ggaugccggucgg

SEQ ID NO: 3284679 - RNA, 15 nt, Mycobacterium tuberculosis H37Rv
ggaugccggucggcg

SEQ ID NO: 3284680 - RNA, 19 nt, Mycobacterium tuberculosis H37Rv
ggaugccggucggcgucga

SEQ ID NO: 3284681 - RNA, 18 nt, Mycobacterium tuberculosis H37Rv
ggaugccugccucggcga

SEQ ID NO: 3284682 - RNA, 17 nt, Mycobacterium tuberculosis H37Rv
ggaugcgacagcgcugg

SEQ ID NO: 3284683 - RNA, 14 nt, Mycobacterium tuberculosis H37Rv
ggaugcgaggcgua

SEQ ID NO: 3284684 - RNA, 17 nt, Mycobacterium tuberculosis H37Rv
ggaugcgaucgucacgc

SEQ ID NO: 3284685 - RNA, 18 nt, Mycobacterium tuberculosis H37Rv
ggaugcgcuuccaucgcc

SEQ ID NO: 3284686 - RNA, 22 nt, Mycobacterium tuberculosis H37Rv
ggaugcggccggugaugaucgc

SEQ ID NO: 3284687 - RNA, 15 nt, Mycobacterium tuberculosis H37Rv
ggaugcucaggucac

SEQ ID NO: 3284688 - RNA, 14 nt, Mycobacterium tuberculosis H37Rv
ggaugcucgaucca

SEQ ID NO: 3284689 - RNA, 15 nt, Mycobacterium tuberculosis H37Rv
ggaugcucgauccac

SEQ ID NO: 3284690 - RNA, 16 nt, Mycobacterium tuberculosis H37Rv
ggaugcugagcgccag

SEQ ID NO: 3284691 - RNA, 19 nt, Mycobacterium tuberculosis H37Rv
ggaugcugagcgccaggcc

SEQ ID NO: 3284692 - RNA, 17 nt, Mycobacterium tuberculosis H37Rv
ggaugcugucagcagcc

SEQ ID NO: 3284693 - RNA, 13 nt, Mycobacterium tuberculosis H37Rv
ggauggaccacga

SEQ ID NO: 3284694 - RNA, 14 nt, Mycobacterium tuberculosis H37Rv
ggauggacucgaca

SEQ ID NO: 3284695 - RNA, 17 nt, Mycobacterium tuberculosis H37Rv
ggauggcgcccugcgcc

SEQ ID NO: 3284696 - RNA, 20 nt, Mycobacterium tuberculosis H37Rv
ggauggcgucgaccacaggc

SEQ ID NO: 3284697 - RNA, 15 nt, Mycobacterium tuberculosis H37Rv
ggauggcucgccgaa

SEQ ID NO: 3284698 - RNA, 22 nt, Mycobacterium tuberculosis H37Rv
ggaugggaccuugaucgagcag

SEQ ID NO: 3284699 - RNA, 18 nt, Mycobacterium tuberculosis H37Rv
ggauguccgcggccacca

SEQ ID NO: 3284700 - RNA, 22 nt, Mycobacterium tuberculosis H37Rv
ggauguccuugaaccagcgcgu

SEQ ID NO: 3284701 - RNA, 15 nt, Mycobacterium tuberculosis H37Rv
ggaugucgugcgggc

SEQ ID NO: 3284702 - RNA, 17 nt, Mycobacterium tuberculosis H37Rv
ggaugugggcgcucgca

SEQ ID NO: 3284703 - RNA, 15 nt, Mycobacterium tuberculosis H37Rv
ggauguuugcucggc

SEQ ID NO: 3284704 - RNA, 17 nt, Mycobacterium tuberculosis H37Rv
ggauguuugcucggccu

SEQ ID NO: 3284705 - RNA, 16 nt, Mycobacterium tuberculosis H37Rv
ggauucacgcaccggc

SEQ ID NO: 3284706 - RNA, 18 nt, Mycobacterium tuberculosis H37Rv
ggauuccgcacccccguc

SEQ ID NO: 3284707 - RNA, 17 nt, Mycobacterium tuberculosis H37Rv
ggauucggcugccaccg

SEQ ID NO: 3284708 - RNA, 16 nt, Mycobacterium tuberculosis H37Rv
ggauucgggcgccgca

SEQ ID NO: 3284709 - RNA, 12 nt, Mycobacterium tuberculosis H37Rv
ggauucuucagc

SEQ ID NO: 3284710 - RNA, 17 nt, Mycobacterium tuberculosis H37Rv
ggauugcgggccugcac

SEQ ID NO: 3284711 - RNA, 18 nt, Mycobacterium tuberculosis H37Rv
ggauuggugggccagcag

SEQ ID NO: 3284712 - RNA, 21 nt, Mycobacterium tuberculosis H37Rv
ggcaaaacacaccgaacacgg

SEQ ID NO: 3284713 - RNA, 17 nt, Mycobacterium tuberculosis H37Rv
ggcaaacaccagcccgg

SEQ ID NO: 3284714 - RNA, 23 nt, Mycobacterium tuberculosis H37Rv
ggcaaaccgaucaauccgcccuu

SEQ ID NO: 3284715 - RNA, 18 nt, Mycobacterium tuberculosis H37Rv
ggcaaacgacaucauggu

SEQ ID NO: 3284716 - RNA, 16 nt, Mycobacterium tuberculosis H37Rv
ggcacaccgacgccgc

SEQ ID NO: 3284717 - RNA, 22 nt, Mycobacterium tuberculosis H37Rv
ggcacaccgguggcgcccuugg

SEQ ID NO: 3284718 - RNA, 22 nt, Mycobacterium tuberculosis H37Rv
ggcacacggccuugccgaucag

SEQ ID NO: 3284719 - RNA, 16 nt, Mycobacterium tuberculosis H37Rv
ggcacaggcggccagc

SEQ ID NO: 3284720 - RNA, 16 nt, Mycobacterium tuberculosis H37Rv
ggcacaucgcacaacu

SEQ ID NO: 3284721 - RNA, 19 nt, Mycobacterium tuberculosis H37Rv
ggcacauugaucgacggcc

SEQ ID NO: 3284722 - RNA, 21 nt, Mycobacterium tuberculosis H37Rv
ggcacauugaucgacggccag

SEQ ID NO: 3284723 - RNA, 23 nt, Mycobacterium tuberculosis H37Rv
ggcacauugaucgacggccagcc

SEQ ID NO: 3284724 - RNA, 20 nt, Mycobacterium tuberculosis H37Rv
ggcaccaacgagauccagcg

SEQ ID NO: 3284725 - RNA, 14 nt, Mycobacterium tuberculosis H37Rv
ggcaccaacgccac

SEQ ID NO: 3284726 - RNA, 17 nt, Mycobacterium tuberculosis H37Rv
ggcaccaccaagcucgg

SEQ ID NO: 3284727 - RNA, 23 nt, Mycobacterium tuberculosis H37Rv
ggcaccaccaagcucggccagca

SEQ ID NO: 3284728 - RNA, 21 nt, Mycobacterium tuberculosis H37Rv
ggcaccaccacaccggagccg

SEQ ID NO: 3284729 - RNA, 17 nt, Mycobacterium tuberculosis H37Rv
ggcaccaccacgccgac

SEQ ID NO: 3284730 - RNA, 21 nt, Mycobacterium tuberculosis H37Rv
ggcaccacccgauuggccaac

SEQ ID NO: 3284731 - RNA, 16 nt, Mycobacterium tuberculosis H37Rv
ggcaccacccggcgaa

SEQ ID NO: 3284732 - RNA, 14 nt, Mycobacterium tuberculosis H37Rv
ggcaccacgaccga

SEQ ID NO: 3284733 - RNA, 12 nt, Mycobacterium tuberculosis H37Rv
ggcaccacgauc

SEQ ID NO: 3284734 - RNA, 13 nt, Mycobacterium tuberculosis H37Rv
ggcaccacgccag

SEQ ID NO: 3284735 - RNA, 14 nt, Mycobacterium tuberculosis H37Rv
ggcaccacgccagc

SEQ ID NO: 3284736 - RNA, 14 nt, Mycobacterium tuberculosis H37Rv
ggcaccacgcugug

SEQ ID NO: 3284737 - RNA, 15 nt, Mycobacterium tuberculosis H37Rv
ggcaccacgcugugc

SEQ ID NO: 3284738 - RNA, 18 nt, Mycobacterium tuberculosis H37Rv
ggcaccacuacaucgauc

SEQ ID NO: 3284739 - RNA, 20 nt, Mycobacterium tuberculosis H37Rv
ggcaccagcaccgucggggu

SEQ ID NO: 3284740 - RNA, 16 nt, Mycobacterium tuberculosis H37Rv
ggcaccagcagccagc

SEQ ID NO: 3284741 - RNA, 12 nt, Mycobacterium tuberculosis H37Rv
ggcaccagccgg

SEQ ID NO: 3284742 - RNA, 21 nt, Mycobacterium tuberculosis H37Rv
ggcaccagccggugagcgagc

SEQ ID NO: 3284743 - RNA, 13 nt, Mycobacterium tuberculosis H37Rv
ggcaccagcggca

SEQ ID NO: 3284744 - RNA, 19 nt, Mycobacterium tuberculosis H37Rv
ggcaccagcggcaccgcgg

SEQ ID NO: 3284745 - RNA, 11 nt, Mycobacterium tuberculosis H37Rv
ggcaccagguu

SEQ ID NO: 3284746 - RNA, 14 nt, Mycobacterium tuberculosis H37Rv
ggcaccauaucgug

SEQ ID NO: 3284747 - RNA, 18 nt, Mycobacterium tuberculosis H37Rv
ggcaccauguacaggcug

SEQ ID NO: 3284748 - RNA, 23 nt, Mycobacterium tuberculosis H37Rv
ggcacccaucccguucagcgacc

SEQ ID NO: 3284749 - RNA, 19 nt, Mycobacterium tuberculosis H37Rv
ggcaccccacgccugccga

SEQ ID NO: 3284750 - RNA, 17 nt, Mycobacterium tuberculosis H37Rv
ggcaccccacggccagu

SEQ ID NO: 3284751 - RNA, 20 nt, Mycobacterium tuberculosis H37Rv
ggcacccccgucgccaccga

SEQ ID NO: 3284752 - RNA, 15 nt, Mycobacterium tuberculosis H37Rv
ggcaccccggccacu

SEQ ID NO: 3284753 - RNA, 19 nt, Mycobacterium tuberculosis H37Rv
ggcacccgcggcgaaccgu

SEQ ID NO: 3284754 - RNA, 22 nt, Mycobacterium tuberculosis H37Rv
ggcacccgcggcgaaccgucuc

SEQ ID NO: 3284755 - RNA, 14 nt, Mycobacterium tuberculosis H37Rv
ggcacccgcuggcg

SEQ ID NO: 3284756 - RNA, 15 nt, Mycobacterium tuberculosis H37Rv
ggcacccggcagagc

SEQ ID NO: 3284757 - RNA, 19 nt, Mycobacterium tuberculosis H37Rv
ggcacccggggugcccggc

SEQ ID NO: 3284758 - RNA, 20 nt, Mycobacterium tuberculosis H37Rv
ggcacccggggugcccggcc

SEQ ID NO: 3284759 - RNA, 23 nt, Mycobacterium tuberculosis H37Rv
ggcacccggggugcccggccgcc

SEQ ID NO: 3284760 - RNA, 19 nt, Mycobacterium tuberculosis H37Rv
ggcacccggucggccaucc

SEQ ID NO: 3284761 - RNA, 18 nt, Mycobacterium tuberculosis H37Rv
ggcacccgugccgccgau

SEQ ID NO: 3284762 - RNA, 22 nt, Mycobacterium tuberculosis H37Rv
ggcacccgugccgccgaugccg

SEQ ID NO: 3284763 - RNA, 15 nt, Mycobacterium tuberculosis H37Rv
ggcacccuugccgau

SEQ ID NO: 3284764 - RNA, 24 nt, Mycobacterium tuberculosis H37Rv
ggcaccgaaaaacaccagcgaggc

SEQ ID NO: 3284765 - RNA, 17 nt, Mycobacterium tuberculosis H37Rv
ggcaccgacgucggcuu

SEQ ID NO: 3284766 - RNA, 16 nt, Mycobacterium tuberculosis H37Rv
ggcaccgagcugagcg

SEQ ID NO: 3284767 - RNA, 13 nt, Mycobacterium tuberculosis H37Rv
ggcaccgauggcg

SEQ ID NO: 3284768 - RNA, 19 nt, Mycobacterium tuberculosis H37Rv
ggcaccgauggcgcaccgg

SEQ ID NO: 3284769 - RNA, 14 nt, Mycobacterium tuberculosis H37Rv
ggcaccgcagcgga

SEQ ID NO: 3284770 - RNA, 20 nt, Mycobacterium tuberculosis H37Rv
ggcaccgccaaaaacgccag

SEQ ID NO: 3284771 - RNA, 13 nt, Mycobacterium tuberculosis H37Rv
ggcaccgccagcc

SEQ ID NO: 3284772 - RNA, 18 nt, Mycobacterium tuberculosis H37Rv
ggcaccgcccuugccgcc

SEQ ID NO: 3284773 - RNA, 19 nt, Mycobacterium tuberculosis H37Rv
ggcaccgcccuugccgccg

SEQ ID NO: 3284774 - RNA, 19 nt, Mycobacterium tuberculosis H37Rv
ggcaccgccgcccccgccg

SEQ ID NO: 3284775 - RNA, 22 nt, Mycobacterium tuberculosis H37Rv
ggcaccgccgcccccgccggcc

SEQ ID NO: 3284776 - RNA, 15 nt, Mycobacterium tuberculosis H37Rv
ggcaccgccggcgcc

SEQ ID NO: 3284777 - RNA, 21 nt, Mycobacterium tuberculosis H37Rv
ggcaccgccggcgccgccguc

SEQ ID NO: 3284778 - RNA, 23 nt, Mycobacterium tuberculosis H37Rv
ggcaccgccggcgccgccgucgc

SEQ ID NO: 3284779 - RNA, 20 nt, Mycobacterium tuberculosis H37Rv
ggcaccgccgguggcgccgg

SEQ ID NO: 3284780 - RNA, 16 nt, Mycobacterium tuberculosis H37Rv
ggcaccgcgcgcucca

SEQ ID NO: 3284781 - RNA, 15 nt, Mycobacterium tuberculosis H37Rv
ggcaccgcggccagc

SEQ ID NO: 3284782 - RNA, 18 nt, Mycobacterium tuberculosis H37Rv
ggcaccgcggccagcggg

SEQ ID NO: 3284783 - RNA, 16 nt, Mycobacterium tuberculosis H37Rv
ggcaccgcggccgcgg

SEQ ID NO: 3284784 - RNA, 16 nt, Mycobacterium tuberculosis H37Rv
ggcaccggauccggag

SEQ ID NO: 3284785 - RNA, 19 nt, Mycobacterium tuberculosis H37Rv
ggcaccggauccggaggcg

SEQ ID NO: 3284786 - RNA, 12 nt, Mycobacterium tuberculosis H37Rv
ggcaccggccgg

SEQ ID NO: 3284787 - RNA, 21 nt, Mycobacterium tuberculosis H37Rv
ggcaccggccgugccgccgac

SEQ ID NO: 3284788 - RNA, 12 nt, Mycobacterium tuberculosis H37Rv
ggcaccggcgau

SEQ ID NO: 3284789 - RNA, 20 nt, Mycobacterium tuberculosis H37Rv
ggcaccggcggucugcagug

SEQ ID NO: 3284790 - RNA, 20 nt, Mycobacterium tuberculosis H37Rv
ggcaccggugcccaccaccg

SEQ ID NO: 3284791 - RNA, 21 nt, Mycobacterium tuberculosis H37Rv
ggcaccguagagcaugccgcc

SEQ ID NO: 3284792 - RNA, 16 nt, Mycobacterium tuberculosis H37Rv
ggcaccgucggaacug

SEQ ID NO: 3284793 - RNA, 16 nt, Mycobacterium tuberculosis H37Rv
ggcaccgugcgggggg

SEQ ID NO: 3284794 - RNA, 15 nt, Mycobacterium tuberculosis H37Rv
ggcaccgugggcggg

SEQ ID NO: 3284795 - RNA, 12 nt, Mycobacterium tuberculosis H37Rv
ggcaccgugucg

SEQ ID NO: 3284796 - RNA, 18 nt, Mycobacterium tuberculosis H37Rv
ggcaccguuaccgccguc

SEQ ID NO: 3284797 - RNA, 22 nt, Mycobacterium tuberculosis H37Rv
ggcaccguuaccgccgucgcca

SEQ ID NO: 3284798 - RNA, 15 nt, Mycobacterium tuberculosis H37Rv
ggcaccuauagggac

SEQ ID NO: 3284799 - RNA, 13 nt, Mycobacterium tuberculosis H37Rv
ggcaccucggccu

SEQ ID NO: 3284800 - RNA, 20 nt, Mycobacterium tuberculosis H37Rv
ggcaccugguccaaucgcga

SEQ ID NO: 3284801 - RNA, 20 nt, Mycobacterium tuberculosis H37Rv
ggcaccuuguagcgggcaag

SEQ ID NO: 3284802 - RNA, 22 nt, Mycobacterium tuberculosis H37Rv
ggcacgaaucccccggacggca

SEQ ID NO: 3284803 - RNA, 18 nt, Mycobacterium tuberculosis H37Rv
ggcacgacccgggaagga

SEQ ID NO: 3284804 - RNA, 14 nt, Mycobacterium tuberculosis H37Rv
ggcacgacgccggc

SEQ ID NO: 3284805 - RNA, 18 nt, Mycobacterium tuberculosis H37Rv
ggcacgagccaucgucga

SEQ ID NO: 3284806 - RNA, 13 nt, Mycobacterium tuberculosis H37Rv
ggcacgaucgcca

SEQ ID NO: 3284807 - RNA, 14 nt, Mycobacterium tuberculosis H37Rv
ggcacgaucgccaa

SEQ ID NO: 3284808 - RNA, 14 nt, Mycobacterium tuberculosis H37Rv
ggcacgaucgucgc

SEQ ID NO: 3284809 - RNA, 18 nt, Mycobacterium tuberculosis H37Rv
ggcacgcaacaccgccaa

SEQ ID NO: 3284810 - RNA, 18 nt, Mycobacterium tuberculosis H37Rv
ggcacgcccucgucgauc

SEQ ID NO: 3284811 - RNA, 13 nt, Mycobacterium tuberculosis H37Rv
ggcacgccgccga

SEQ ID NO: 3284812 - RNA, 19 nt, Mycobacterium tuberculosis H37Rv
ggcagccgcgccgcggccc

SEQ ID NO: 3284813 - RNA, 16 nt, Mycobacterium tuberculosis H37Rv
ggcagccgggcgucgc

SEQ ID NO: 3284814 - RNA, 19 nt, Mycobacterium tuberculosis H37Rv
ggcagccggguugguaccc

SEQ ID NO: 3284815 - RNA, 16 nt, Mycobacterium tuberculosis H37Rv
ggcagccugcugcaca

SEQ ID NO: 3284816 - RNA, 19 nt, Mycobacterium tuberculosis H37Rv
ggcagcgaccgucguccag

SEQ ID NO: 3284817 - RNA, 15 nt, Mycobacterium tuberculosis H37Rv
ggcagcgacgccggc

SEQ ID NO: 3284818 - RNA, 16 nt, Mycobacterium tuberculosis H37Rv
ggcagcgacgccggcc

SEQ ID NO: 3284819 - RNA, 14 nt, Mycobacterium tuberculosis H37Rv
ggcagcgaggcucg

SEQ ID NO: 3284820 - RNA, 21 nt, Mycobacterium tuberculosis H37Rv
ggcagcgcacccggucggcgg

SEQ ID NO: 3284821 - RNA, 14 nt, Mycobacterium tuberculosis H37Rv
ggcagcgcccccgg

SEQ ID NO: 3284822 - RNA, 23 nt, Mycobacterium tuberculosis H37Rv
ggcagcgccggucggaucgguga

SEQ ID NO: 3284823 - RNA, 21 nt, Mycobacterium tuberculosis H37Rv
ggcagcgcggaugucggcauc

SEQ ID NO: 3284824 - RNA, 12 nt, Mycobacterium tuberculosis H37Rv
ggcagcgcggca

SEQ ID NO: 3284825 - RNA, 12 nt, Mycobacterium tuberculosis H37Rv
ggcagcgcggcc

SEQ ID NO: 3284826 - RNA, 15 nt, Mycobacterium tuberculosis H37Rv
ggcagcgcggccaau

SEQ ID NO: 3284827 - RNA, 15 nt, Mycobacterium tuberculosis H37Rv
ggcagcgcggccacc

SEQ ID NO: 3284828 - RNA, 19 nt, Mycobacterium tuberculosis H37Rv
ggcagcgcucucauagcga

SEQ ID NO: 3284829 - RNA, 21 nt, Mycobacterium tuberculosis H37Rv
ggcagcggaccgcugccugcc

SEQ ID NO: 3284830 - RNA, 17 nt, Mycobacterium tuberculosis H37Rv
ggcagcggcaucggcca

SEQ ID NO: 3284831 - RNA, 12 nt, Mycobacterium tuberculosis H37Rv
ggcagcggcgau

SEQ ID NO: 3284832 - RNA, 13 nt, Mycobacterium tuberculosis H37Rv
ggcagcggcgauc

SEQ ID NO: 3284833 - RNA, 21 nt, Mycobacterium tuberculosis H37Rv
ggcagcggcgaucaggcggac

SEQ ID NO: 3284834 - RNA, 20 nt, Mycobacterium tuberculosis H37Rv
ggcagcggcgcgcugcacgg

SEQ ID NO: 3284835 - RNA, 14 nt, Mycobacterium tuberculosis H37Rv
ggcagcggcgucgu

SEQ ID NO: 3284836 - RNA, 13 nt, Mycobacterium tuberculosis H37Rv
ggcagcgggacug

SEQ ID NO: 3284837 - RNA, 23 nt, Mycobacterium tuberculosis H37Rv
ggcagcggguuugccgggcgcug

SEQ ID NO: 3284838 - RNA, 22 nt, Mycobacterium tuberculosis H37Rv
ggcagcggugcugguggcggca

SEQ ID NO: 3284839 - RNA, 13 nt, Mycobacterium tuberculosis H37Rv
ggcagcgguggcc

SEQ ID NO: 3284840 - RNA, 20 nt, Mycobacterium tuberculosis H37Rv
ggcagcgguggcccgccggc

SEQ ID NO: 3284841 - RNA, 22 nt, Mycobacterium tuberculosis H37Rv
ggcagcgguggcccgccggcaa

SEQ ID NO: 3284842 - RNA, 15 nt, Mycobacterium tuberculosis H37Rv
ggcagcgguggcuug

SEQ ID NO: 3284843 - RNA, 22 nt, Mycobacterium tuberculosis H37Rv
ggcagcgguuuuaggcagccca

SEQ ID NO: 3284844 - RNA, 22 nt, Mycobacterium tuberculosis H37Rv
ggcagcgucacccugucgcgca

SEQ ID NO: 3284845 - RNA, 15 nt, Mycobacterium tuberculosis H37Rv
ggcagcguccacaug

SEQ ID NO: 3284846 - RNA, 17 nt, Mycobacterium tuberculosis H37Rv
ggcagcguugacgguca

SEQ ID NO: 3284847 - RNA, 23 nt, Mycobacterium tuberculosis H37Rv
ggcagcguugacggucagccgcg

SEQ ID NO: 3284848 - RNA, 17 nt, Mycobacterium tuberculosis H37Rv
ggcagcuccgccgccga

SEQ ID NO: 3284849 - RNA, 14 nt, Mycobacterium tuberculosis H37Rv
ggcagcucguccag

SEQ ID NO: 3284850 - RNA, 14 nt, Mycobacterium tuberculosis H37Rv
ggcagcugggcagg

SEQ ID NO: 3284851 - RNA, 21 nt, Mycobacterium tuberculosis H37Rv
ggcagcuggggcccggccgcc

SEQ ID NO: 3284852 - RNA, 20 nt, Mycobacterium tuberculosis H37Rv
ggcagcugguaaccggcggc

SEQ ID NO: 3284853 - RNA, 23 nt, Mycobacterium tuberculosis H37Rv
ggcagcuugcagugccgccggcc

SEQ ID NO: 3284854 - RNA, 19 nt, Mycobacterium tuberculosis H37Rv
ggcagcuugccaaucaccg

SEQ ID NO: 3284855 - RNA, 22 nt, Mycobacterium tuberculosis H37Rv
ggcagcuuggacucaucggcgu

SEQ ID NO: 3284856 - RNA, 19 nt, Mycobacterium tuberculosis H37Rv
ggcaggaaucgggucagca

SEQ ID NO: 3284857 - RNA, 12 nt, Mycobacterium tuberculosis H37Rv
ggcaggacuugg

SEQ ID NO: 3284858 - RNA, 20 nt, Mycobacterium tuberculosis H37Rv
ggcaggagaacacauccgcu

SEQ ID NO: 3284859 - RNA, 12 nt, Mycobacterium tuberculosis H37Rv
ggcaggagcagc

SEQ ID NO: 3284860 - RNA, 13 nt, Mycobacterium tuberculosis H37Rv
ggcaggaucgccu

SEQ ID NO: 3284861 - RNA, 20 nt, Mycobacterium tuberculosis H37Rv
ggcaggaucgccugagcgcc

SEQ ID NO: 3284862 - RNA, 18 nt, Mycobacterium tuberculosis H37Rv
ggcaggccccacuggugc

SEQ ID NO: 3284863 - RNA, 14 nt, Mycobacterium tuberculosis H37Rv
ggcaggcccgacgg

SEQ ID NO: 3284864 - RNA, 21 nt, Mycobacterium tuberculosis H37Rv
ggcaggccgcugggccgaccg

SEQ ID NO: 3284865 - RNA, 18 nt, Mycobacterium tuberculosis H37Rv
ggcaggccggcgucgauc

SEQ ID NO: 3284866 - RNA, 19 nt, Mycobacterium tuberculosis H37Rv
ggcaggccggcgucgauca

SEQ ID NO: 3284867 - RNA, 13 nt, Mycobacterium tuberculosis H37Rv
ggcaggccgggca

SEQ ID NO: 3284868 - RNA, 16 nt, Mycobacterium tuberculosis H37Rv
ggcaggccucggcgcc

SEQ ID NO: 3284869 - RNA, 17 nt, Mycobacterium tuberculosis H37Rv
ggcaggccucggcgccg

SEQ ID NO: 3284870 - RNA, 14 nt, Mycobacterium tuberculosis H37Rv
ggcaggcggccagc

SEQ ID NO: 3284871 - RNA, 15 nt, Mycobacterium tuberculosis H37Rv
ggcaggcggccagcg

SEQ ID NO: 3284872 - RNA, 15 nt, Mycobacterium tuberculosis H37Rv
ggcaggcggccgccg

SEQ ID NO: 3284873 - RNA, 16 nt, Mycobacterium tuberculosis H37Rv
ggcaggcggccgccgg

SEQ ID NO: 3284874 - RNA, 18 nt, Mycobacterium tuberculosis H37Rv
ggcaggcgggggaucggu

SEQ ID NO: 3284875 - RNA, 20 nt, Mycobacterium tuberculosis H37Rv
ggcaggcuaaucagccaggc

SEQ ID NO: 3284876 - RNA, 15 nt, Mycobacterium tuberculosis H37Rv
ggcaggcuggcgagg

SEQ ID NO: 3284877 - RNA, 17 nt, Mycobacterium tuberculosis H37Rv
ggcaggcuggcgagggc

SEQ ID NO: 3284878 - RNA, 17 nt, Mycobacterium tuberculosis H37Rv
ggcagggaccgcaucgg

SEQ ID NO: 3284879 - RNA, 14 nt, Mycobacterium tuberculosis H37Rv
ggcagggcagcccg

SEQ ID NO: 3284880 - RNA, 21 nt, Mycobacterium tuberculosis H37Rv
ggcagggcccccaguucggcg

SEQ ID NO: 3284881 - RNA, 13 nt, Mycobacterium tuberculosis H37Rv
ggcaggguggggc

SEQ ID NO: 3284882 - RNA, 13 nt, Mycobacterium tuberculosis H37Rv
ggcaggucgagcg

SEQ ID NO: 3284883 - RNA, 19 nt, Mycobacterium tuberculosis H37Rv
ggcaggucuucgcugucga

SEQ ID NO: 3284884 - RNA, 15 nt, Mycobacterium tuberculosis H37Rv
ggcaggugaucccga

SEQ ID NO: 3284885 - RNA, 16 nt, Mycobacterium tuberculosis H37Rv
ggcaggugcggcggca

SEQ ID NO: 3284886 - RNA, 22 nt, Mycobacterium tuberculosis H37Rv
ggcagguguuggugcgggguug

SEQ ID NO: 3284887 - RNA, 21 nt, Mycobacterium tuberculosis H37Rv
ggcagguugcguugcaggaaa

SEQ ID NO: 3284888 - RNA, 15 nt, Mycobacterium tuberculosis H37Rv
ggcaguagcuguggc

SEQ ID NO: 3284889 - RNA, 17 nt, Mycobacterium tuberculosis H37Rv
ggcagucaggccuagcg

SEQ ID NO: 3284890 - RNA, 14 nt, Mycobacterium tuberculosis H37Rv
ggcaguccaccgcg

SEQ ID NO: 3284891 - RNA, 19 nt, Mycobacterium tuberculosis H37Rv
ggcaguccaccgcgcggcg

SEQ ID NO: 3284892 - RNA, 18 nt, Mycobacterium tuberculosis H37Rv
ggcaguccagccgggugc

SEQ ID NO: 3284893 - RNA, 13 nt, Mycobacterium tuberculosis H37Rv
ggcaguccaggca

SEQ ID NO: 3284894 - RNA, 14 nt, Mycobacterium tuberculosis H37Rv
ggcagucccagcgc

SEQ ID NO: 3284895 - RNA, 22 nt, Mycobacterium tuberculosis H37Rv
ggcagucgcgguaccaucaccg

SEQ ID NO: 3284896 - RNA, 23 nt, Mycobacterium tuberculosis H37Rv
ggcagucgcgguaccaucaccgc

SEQ ID NO: 3284897 - RNA, 19 nt, Mycobacterium tuberculosis H37Rv
ggcagugaaauugccgccg

SEQ ID NO: 3284898 - RNA, 23 nt, Mycobacterium tuberculosis H37Rv
ggcagugcgaaaaucgcgcgcga

SEQ ID NO: 3284899 - RNA, 14 nt, Mycobacterium tuberculosis H37Rv
ggcagugcgcggcg

SEQ ID NO: 3284900 - RNA, 16 nt, Mycobacterium tuberculosis H37Rv
ggcaguggcagcccgu

SEQ ID NO: 3284901 - RNA, 14 nt, Mycobacterium tuberculosis H37Rv
ggcaguucgcggcc

SEQ ID NO: 3284902 - RNA, 20 nt, Mycobacterium tuberculosis H37Rv
ggcaguugaacucgaccacc

SEQ ID NO: 3284903 - RNA, 18 nt, Mycobacterium tuberculosis H37Rv
ggcaguugacccaugccg

SEQ ID NO: 3284904 - RNA, 18 nt, Mycobacterium tuberculosis H37Rv
ggcaguuguugacagaca

SEQ ID NO: 3284905 - RNA, 14 nt, Mycobacterium tuberculosis H37Rv
ggcaguuuggcggc

SEQ ID NO: 3284906 - RNA, 19 nt, Mycobacterium tuberculosis H37Rv
ggcauaaacaucgguggcg

SEQ ID NO: 3284907 - RNA, 14 nt, Mycobacterium tuberculosis H37Rv
ggcauacaacuggu

SEQ ID NO: 3284908 - RNA, 17 nt, Mycobacterium tuberculosis H37Rv
ggccaacgacggccgac

SEQ ID NO: 3284909 - RNA, 19 nt, Mycobacterium tuberculosis H37Rv
ggccaacgacggccgacaa

SEQ ID NO: 3284910 - RNA, 12 nt, Mycobacterium tuberculosis H37Rv
ggccaacggcgc

SEQ ID NO: 3284911 - RNA, 13 nt, Mycobacterium tuberculosis H37Rv
ggccaacggcucc

SEQ ID NO: 3284912 - RNA, 15 nt, Mycobacterium tuberculosis H37Rv
ggccaacucgacauc

SEQ ID NO: 3284913 - RNA, 20 nt, Mycobacterium tuberculosis H37Rv
ggccaacucuucagcaagcc

SEQ ID NO: 3284914 - RNA, 17 nt, Mycobacterium tuberculosis H37Rv
ggccaacugggccgagc

SEQ ID NO: 3284915 - RNA, 18 nt, Mycobacterium tuberculosis H37Rv
ggccaacugggccgagcg

SEQ ID NO: 3284916 - RNA, 16 nt, Mycobacterium tuberculosis H37Rv
ggccaacuucugcacg

SEQ ID NO: 3284917 - RNA, 19 nt, Mycobacterium tuberculosis H37Rv
ggccaacuugcucagcucg

SEQ ID NO: 3284918 - RNA, 16 nt, Mycobacterium tuberculosis H37Rv
ggccaacuuggcggcc

SEQ ID NO: 3284919 - RNA, 19 nt, Mycobacterium tuberculosis H37Rv
ggccaacuuggcggccagc

SEQ ID NO: 3284920 - RNA, 20 nt, Mycobacterium tuberculosis H37Rv
ggccaacuuggcggccagcc

SEQ ID NO: 3284921 - RNA, 22 nt, Mycobacterium tuberculosis H37Rv
ggccaacuuggcggccagccgc

SEQ ID NO: 3284922 - RNA, 22 nt, Mycobacterium tuberculosis H37Rv
ggccaagaaugugggcgacggc

SEQ ID NO: 3284923 - RNA, 23 nt, Mycobacterium tuberculosis H37Rv
ggccaagaaugugggcgacggcc

SEQ ID NO: 3284924 - RNA, 17 nt, Mycobacterium tuberculosis H37Rv
ggccaagaccgcggccc

SEQ ID NO: 3284925 - RNA, 16 nt, Mycobacterium tuberculosis H37Rv
ggccaagacggcgggc

SEQ ID NO: 3284926 - RNA, 13 nt, Mycobacterium tuberculosis H37Rv
ggccaagauggcg

SEQ ID NO: 3284927 - RNA, 14 nt, Mycobacterium tuberculosis H37Rv
ggccaagccgcggc

SEQ ID NO: 3284928 - RNA, 14 nt, Mycobacterium tuberculosis H37Rv
ggccaagccggagc

SEQ ID NO: 3284929 - RNA, 15 nt, Mycobacterium tuberculosis H37Rv
ggccaagccggcgag

SEQ ID NO: 3284930 - RNA, 16 nt, Mycobacterium tuberculosis H37Rv
ggccaagccggcgagu

SEQ ID NO: 3284931 - RNA, 13 nt, Mycobacterium tuberculosis H37Rv
ggccaagggugcu

SEQ ID NO: 3284932 - RNA, 15 nt, Mycobacterium tuberculosis H37Rv
ggccaaggucgaccc

SEQ ID NO: 3284933 - RNA, 16 nt, Mycobacterium tuberculosis H37Rv
ggccaagguggccacc

SEQ ID NO: 3284934 - RNA, 20 nt, Mycobacterium tuberculosis H37Rv
ggccaauagaagcacgucgu

SEQ ID NO: 3284935 - RNA, 15 nt, Mycobacterium tuberculosis H37Rv
ggccaaucagcccgc

SEQ ID NO: 3284936 - RNA, 15 nt, Mycobacterium tuberculosis H37Rv
ggccaauccggggcc

SEQ ID NO: 3284937 - RNA, 13 nt, Mycobacterium tuberculosis H37Rv
ggccacaccguca

SEQ ID NO: 3284938 - RNA, 14 nt, Mycobacterium tuberculosis H37Rv
ggccacagcccggc

SEQ ID NO: 3284939 - RNA, 23 nt, Mycobacterium tuberculosis H37Rv
ggccacaggaagcgaccgucguc

SEQ ID NO: 3284940 - RNA, 13 nt, Mycobacterium tuberculosis H37Rv
ggccacagugcau

SEQ ID NO: 3284941 - RNA, 14 nt, Mycobacterium tuberculosis H37Rv
ggccacauaccacc

SEQ ID NO: 3284942 - RNA, 12 nt, Mycobacterium tuberculosis H37Rv
ggccacauccag

SEQ ID NO: 3284943 - RNA, 18 nt, Mycobacterium tuberculosis H37Rv
ggccacaucgccagcagc

SEQ ID NO: 3284944 - RNA, 18 nt, Mycobacterium tuberculosis H37Rv
ggccacaugaucgagcag

SEQ ID NO: 3284945 - RNA, 18 nt, Mycobacterium tuberculosis H37Rv
ggccaccaacucggcgac

SEQ ID NO: 3284946 - RNA, 17 nt, Mycobacterium tuberculosis H37Rv
ggccaccaccacggcca

SEQ ID NO: 3284947 - RNA, 18 nt, Mycobacterium tuberculosis H37Rv
ggccaccaccaggcugac

SEQ ID NO: 3284948 - RNA, 21 nt, Mycobacterium tuberculosis H37Rv
ggccaccaccgccgccggcac

SEQ ID NO: 3284949 - RNA, 21 nt, Mycobacterium tuberculosis H37Rv
ggccaccaccgcgccgucguc

SEQ ID NO: 3284950 - RNA, 14 nt, Mycobacterium tuberculosis H37Rv
ggccaccaccucgg

SEQ ID NO: 3284951 - RNA, 17 nt, Mycobacterium tuberculosis H37Rv
ggccaccacgugcgcgu

SEQ ID NO: 3284952 - RNA, 14 nt, Mycobacterium tuberculosis H37Rv
ggccaccagaacca

SEQ ID NO: 3284953 - RNA, 17 nt, Mycobacterium tuberculosis H37Rv
ggccaccagaaccacuu

SEQ ID NO: 3284954 - RNA, 11 nt, Mycobacterium tuberculosis H37Rv
ggccaccagcg

SEQ ID NO: 3284955 - RNA, 18 nt, Mycobacterium tuberculosis H37Rv
ggccaccagcgcccggcc

SEQ ID NO: 3284956 - RNA, 19 nt, Mycobacterium tuberculosis H37Rv
ggccaccaggggaccgcgg

SEQ ID NO: 3284957 - RNA, 12 nt, Mycobacterium tuberculosis H37Rv
ggccaccagucc

SEQ ID NO: 3284958 - RNA, 22 nt, Mycobacterium tuberculosis H37Rv
ggccaccagugcgggguccagc

SEQ ID NO: 3284959 - RNA, 19 nt, Mycobacterium tuberculosis H37Rv
ggccaccaguuguccggcu

SEQ ID NO: 3284960 - RNA, 21 nt, Mycobacterium tuberculosis H37Rv
ggccaccaucaccucgcacga

SEQ ID NO: 3284961 - RNA, 14 nt, Mycobacterium tuberculosis H37Rv
ggccaccaucgccg

SEQ ID NO: 3284962 - RNA, 19 nt, Mycobacterium tuberculosis H37Rv
ggccaccaucgccgccguu

SEQ ID NO: 3284963 - RNA, 21 nt, Mycobacterium tuberculosis H37Rv
ggccaccccgagcucaccaag

SEQ ID NO: 3284964 - RNA, 17 nt, Mycobacterium tuberculosis H37Rv
ggccaccccgucggggu

SEQ ID NO: 3284965 - RNA, 17 nt, Mycobacterium tuberculosis H37Rv
ggccacccgcaggucgc

SEQ ID NO: 3284966 - RNA, 15 nt, Mycobacterium tuberculosis H37Rv
ggccacccgcgcgau

SEQ ID NO: 3284967 - RNA, 15 nt, Mycobacterium tuberculosis H37Rv
ggccacccgguggcg

SEQ ID NO: 3284968 - RNA, 20 nt, Mycobacterium tuberculosis H37Rv
ggccaccgaacgcggccacc

SEQ ID NO: 3284969 - RNA, 19 nt, Mycobacterium tuberculosis H37Rv
ggccaccgaccgcacgauc

SEQ ID NO: 3284970 - RNA, 13 nt, Mycobacterium tuberculosis H37Rv
ggccaccgaggcg

SEQ ID NO: 3284971 - RNA, 17 nt, Mycobacterium tuberculosis H37Rv
ggccaccgcaucgccga

SEQ ID NO: 3284972 - RNA, 18 nt, Mycobacterium tuberculosis H37Rv
ggccaccgccgccgccga

SEQ ID NO: 3284973 - RNA, 18 nt, Mycobacterium tuberculosis H37Rv
ggccaccgccgccugccc

SEQ ID NO: 3284974 - RNA, 16 nt, Mycobacterium tuberculosis H37Rv
ggccaccgcgcaaccc

SEQ ID NO: 3284975 - RNA, 22 nt, Mycobacterium tuberculosis H37Rv
ggccaccggacgaaacgaucgc

SEQ ID NO: 3284976 - RNA, 14 nt, Mycobacterium tuberculosis H37Rv
ggccaccggcgacc

SEQ ID NO: 3284977 - RNA, 16 nt, Mycobacterium tuberculosis H37Rv
ggccaccggcgaccga

SEQ ID NO: 3284978 - RNA, 16 nt, Mycobacterium tuberculosis H37Rv
ggccaccggcggucug

SEQ ID NO: 3284979 - RNA, 13 nt, Mycobacterium tuberculosis H37Rv
ggccaccggcguc

SEQ ID NO: 3284980 - RNA, 21 nt, Mycobacterium tuberculosis H37Rv
ggccaccggcgucugcccgcc

SEQ ID NO: 3284981 - RNA, 20 nt, Mycobacterium tuberculosis H37Rv
ggccaccguaaacagcgcgc

SEQ ID NO: 3284982 - RNA, 17 nt, Mycobacterium tuberculosis H37Rv
ggccaccguagccagca

SEQ ID NO: 3284983 - RNA, 11 nt, Mycobacterium tuberculosis H37Rv
ggccaccguca

SEQ ID NO: 3284984 - RNA, 12 nt, Mycobacterium tuberculosis H37Rv
ggccaccguccc

SEQ ID NO: 3284985 - RNA, 22 nt, Mycobacterium tuberculosis H37Rv
ggccaccgucccugugucgccg

SEQ ID NO: 3284986 - RNA, 18 nt, Mycobacterium tuberculosis H37Rv
ggccaccgucgcggcggc

SEQ ID NO: 3284987 - RNA, 16 nt, Mycobacterium tuberculosis H37Rv
ggccaccuccaaaccg

SEQ ID NO: 3284988 - RNA, 23 nt, Mycobacterium tuberculosis H37Rv
ggccaccucgaaugcauccgcgu

SEQ ID NO: 3284989 - RNA, 16 nt, Mycobacterium tuberculosis H37Rv
ggccaccugcucgucg

SEQ ID NO: 3284990 - RNA, 16 nt, Mycobacterium tuberculosis H37Rv
ggccacgaacccucag

SEQ ID NO: 3284991 - RNA, 14 nt, Mycobacterium tuberculosis H37Rv
ggccacgagucgca

SEQ ID NO: 3284992 - RNA, 17 nt, Mycobacterium tuberculosis H37Rv
ggccacgaugaucccaa

SEQ ID NO: 3284993 - RNA, 16 nt, Mycobacterium tuberculosis H37Rv
ggccacgcaccgggug

SEQ ID NO: 3284994 - RNA, 22 nt, Mycobacterium tuberculosis H37Rv
ggccacgcauuccagcaggcca

SEQ ID NO: 3284995 - RNA, 14 nt, Mycobacterium tuberculosis H37Rv
ggccacgcccaggc

SEQ ID NO: 3284996 - RNA, 23 nt, Mycobacterium tuberculosis H37Rv
ggccacgcuucuuccgcgcgccg

SEQ ID NO: 3284997 - RNA, 20 nt, Mycobacterium tuberculosis H37Rv
ggccacggaaguaucgccgg

SEQ ID NO: 3284998 - RNA, 22 nt, Mycobacterium tuberculosis H37Rv
ggccacggaaguaucgccggcc

SEQ ID NO: 3284999 - RNA, 15 nt, Mycobacterium tuberculosis H37Rv
ggccacggcgucggc

SEQ ID NO: 3285000 - RNA, 20 nt, Mycobacterium tuberculosis H37Rv
ggccacggcgucggccaccc

SEQ ID NO: 3285001 - RNA, 23 nt, Mycobacterium tuberculosis H37Rv
ggccacgggaguacgggagccgg

SEQ ID NO: 3285002 - RNA, 16 nt, Mycobacterium tuberculosis H37Rv
ggccacggggcugccg

SEQ ID NO: 3285003 - RNA, 18 nt, Mycobacterium tuberculosis H37Rv
ggccacgguagaacacgu

SEQ ID NO: 3285004 - RNA, 16 nt, Mycobacterium tuberculosis H37Rv
ggccacggucagccag

SEQ ID NO: 3285005 - RNA, 12 nt, Mycobacterium tuberculosis H37Rv
ggccagcugcgu

SEQ ID NO: 3285006 - RNA, 23 nt, Mycobacterium tuberculosis H37Rv
ggccagcuucccgguagcggcgg

SEQ ID NO: 3285007 - RNA, 15 nt, Mycobacterium tuberculosis H37Rv
ggccagcuugcggag

SEQ ID NO: 3285008 - RNA, 20 nt, Mycobacterium tuberculosis H37Rv
ggccagcuugcggagccgcc

SEQ ID NO: 3285009 - RNA, 22 nt, Mycobacterium tuberculosis H37Rv
ggccagcuugcggagccgccgc

SEQ ID NO: 3285010 - RNA, 17 nt, Mycobacterium tuberculosis H37Rv
ggccaggaagucccggg

SEQ ID NO: 3285011 - RNA, 19 nt, Mycobacterium tuberculosis H37Rv
ggccaggaagucccgggca

SEQ ID NO: 3285012 - RNA, 15 nt, Mycobacterium tuberculosis H37Rv
ggccaggaucaaccg

SEQ ID NO: 3285013 - RNA, 24 nt, Mycobacterium tuberculosis H37Rv
ggccaggaucgcuacgucgaccga

SEQ ID NO: 3285014 - RNA, 20 nt, Mycobacterium tuberculosis H37Rv
ggccaggaugaagacgcggg

SEQ ID NO: 3285015 - RNA, 19 nt, Mycobacterium tuberculosis H37Rv
ggccaggauuucgcaguug

SEQ ID NO: 3285016 - RNA, 14 nt, Mycobacterium tuberculosis H37Rv
ggccaggcccagcu

SEQ ID NO: 3285017 - RNA, 21 nt, Mycobacterium tuberculosis H37Rv
ggccaggccgaugccgaccuu

SEQ ID NO: 3285018 - RNA, 16 nt, Mycobacterium tuberculosis H37Rv
ggccaggccggcggcg

SEQ ID NO: 3285019 - RNA, 22 nt, Mycobacterium tuberculosis H37Rv
ggccaggccguaguggccggcu

SEQ ID NO: 3285020 - RNA, 16 nt, Mycobacterium tuberculosis H37Rv
ggccaggccgucggcg

SEQ ID NO: 3285021 - RNA, 23 nt, Mycobacterium tuberculosis H37Rv
ggccaggcuauggugccggugau

SEQ ID NO: 3285022 - RNA, 14 nt, Mycobacterium tuberculosis H37Rv
ggccaggcugccuc

SEQ ID NO: 3285023 - RNA, 16 nt, Mycobacterium tuberculosis H37Rv
ggccagggagcggcuu

SEQ ID NO: 3285024 - RNA, 16 nt, Mycobacterium tuberculosis H37Rv
ggccagggcgguggcc

SEQ ID NO: 3285025 - RNA, 15 nt, Mycobacterium tuberculosis H37Rv
ggccaggggcgcagc

SEQ ID NO: 3285026 - RNA, 16 nt, Mycobacterium tuberculosis H37Rv
ggccagggucagcucg

SEQ ID NO: 3285027 - RNA, 23 nt, Mycobacterium tuberculosis H37Rv
ggccagggucagcucggugaugu

SEQ ID NO: 3285028 - RNA, 15 nt, Mycobacterium tuberculosis H37Rv
ggccaggucgacacc

SEQ ID NO: 3285029 - RNA, 15 nt, Mycobacterium tuberculosis H37Rv
ggccaggucgagcac

SEQ ID NO: 3285030 - RNA, 19 nt, Mycobacterium tuberculosis H37Rv
ggccagguggccgcaucgc

SEQ ID NO: 3285031 - RNA, 22 nt, Mycobacterium tuberculosis H37Rv
ggccagguuguagacggcaccc

SEQ ID NO: 3285032 - RNA, 14 nt, Mycobacterium tuberculosis H37Rv
ggccaguacgucga

SEQ ID NO: 3285033 - RNA, 16 nt, Mycobacterium tuberculosis H37Rv
ggccaguacgucgauc

SEQ ID NO: 3285034 - RNA, 19 nt, Mycobacterium tuberculosis H37Rv
ggccaguaugcggugcccg

SEQ ID NO: 3285035 - RNA, 24 nt, Mycobacterium tuberculosis H37Rv
ggccagugaaaccaccggccgucc

SEQ ID NO: 3285036 - RNA, 15 nt, Mycobacterium tuberculosis H37Rv
ggccagugaggauca

SEQ ID NO: 3285037 - RNA, 14 nt, Mycobacterium tuberculosis H37Rv
ggccagugccaccu

SEQ ID NO: 3285038 - RNA, 16 nt, Mycobacterium tuberculosis H37Rv
ggccaguucggcggcc

SEQ ID NO: 3285039 - RNA, 18 nt, Mycobacterium tuberculosis H37Rv
ggccaguucggugagccg

SEQ ID NO: 3285040 - RNA, 20 nt, Mycobacterium tuberculosis H37Rv
ggccaguugguagccgcccu

SEQ ID NO: 3285041 - RNA, 15 nt, Mycobacterium tuberculosis H37Rv
ggccauaccgcucgc

SEQ ID NO: 3285042 - RNA, 17 nt, Mycobacterium tuberculosis H37Rv
ggccauaccgcucgccg

SEQ ID NO: 3285043 - RNA, 19 nt, Mycobacterium tuberculosis H37Rv
ggccaucacggcggggauc

SEQ ID NO: 3285044 - RNA, 17 nt, Mycobacterium tuberculosis H37Rv
ggccaucacggucagcu

SEQ ID NO: 3285045 - RNA, 19 nt, Mycobacterium tuberculosis H37Rv
ggccaucagaaccuccucg

SEQ ID NO: 3285046 - RNA, 14 nt, Mycobacterium tuberculosis H37Rv
ggccaucagcucgc

SEQ ID NO: 3285047 - RNA, 20 nt, Mycobacterium tuberculosis H37Rv
ggccaucaucgacggugauc

SEQ ID NO: 3285048 - RNA, 17 nt, Mycobacterium tuberculosis H37Rv
ggccaucccggccucca

SEQ ID NO: 3285049 - RNA, 23 nt, Mycobacterium tuberculosis H37Rv
ggccauccggucgcucgauggau

SEQ ID NO: 3285050 - RNA, 18 nt, Mycobacterium tuberculosis H37Rv
ggccauccguaucacggu

SEQ ID NO: 3285051 - RNA, 19 nt, Mycobacterium tuberculosis H37Rv
ggccaucgaccguccgggu

SEQ ID NO: 3285052 - RNA, 15 nt, Mycobacterium tuberculosis H37Rv
ggccaucgacgacac

SEQ ID NO: 3285053 - RNA, 16 nt, Mycobacterium tuberculosis H37Rv
ggccaucgagggcauc

SEQ ID NO: 3285054 - RNA, 17 nt, Mycobacterium tuberculosis H37Rv
ggccaucgaguccacca

SEQ ID NO: 3285055 - RNA, 17 nt, Mycobacterium tuberculosis H37Rv
ggccaucgcauccccag

SEQ ID NO: 3285056 - RNA, 17 nt, Mycobacterium tuberculosis H37Rv
ggccaucgcccgaugcg

SEQ ID NO: 3285057 - RNA, 16 nt, Mycobacterium tuberculosis H37Rv
ggccaucgcgcggacc

SEQ ID NO: 3285058 - RNA, 21 nt, Mycobacterium tuberculosis H37Rv
ggccaucgcgcggaccagagu

SEQ ID NO: 3285059 - RNA, 18 nt, Mycobacterium tuberculosis H37Rv
ggccaucgggauggacac

SEQ ID NO: 3285060 - RNA, 23 nt, Mycobacterium tuberculosis H37Rv
ggccaucgggauggacaccaccu

SEQ ID NO: 3285061 - RNA, 13 nt, Mycobacterium tuberculosis H37Rv
ggccaucguccag

SEQ ID NO: 3285062 - RNA, 17 nt, Mycobacterium tuberculosis H37Rv
ggccaucguccagcagg

SEQ ID NO: 3285063 - RNA, 20 nt, Mycobacterium tuberculosis H37Rv
ggccaucgucguggugaugu

SEQ ID NO: 3285064 - RNA, 18 nt, Mycobacterium tuberculosis H37Rv
ggccaucgugcggcacuc

SEQ ID NO: 3285065 - RNA, 19 nt, Mycobacterium tuberculosis H37Rv
ggccaucgugcggcacucc

SEQ ID NO: 3285066 - RNA, 21 nt, Mycobacterium tuberculosis H37Rv
ggccaucgugcggcacucccu

SEQ ID NO: 3285067 - RNA, 17 nt, Mycobacterium tuberculosis H37Rv
ggccaucucgucgaugu

SEQ ID NO: 3285068 - RNA, 19 nt, Mycobacterium tuberculosis H37Rv
ggccaucucgucgaugucg

SEQ ID NO: 3285069 - RNA, 15 nt, Mycobacterium tuberculosis H37Rv
ggccaucugauccgg

SEQ ID NO: 3285070 - RNA, 16 nt, Mycobacterium tuberculosis H37Rv
ggccaucugcucgugg

SEQ ID NO: 3285071 - RNA, 17 nt, Mycobacterium tuberculosis H37Rv
ggccaugaaaaucggca

SEQ ID NO: 3285072 - RNA, 14 nt, Mycobacterium tuberculosis H37Rv
ggccaugcucgcca

SEQ ID NO: 3285073 - RNA, 22 nt, Mycobacterium tuberculosis H37Rv
ggccaugguccaagugggccgg

SEQ ID NO: 3285074 - RNA, 16 nt, Mycobacterium tuberculosis H37Rv
ggccaugucagcggcc

SEQ ID NO: 3285075 - RNA, 16 nt, Mycobacterium tuberculosis H37Rv
ggccauguugcccugc

SEQ ID NO: 3285076 - RNA, 17 nt, Mycobacterium tuberculosis H37Rv
ggccauguuggggaugc

SEQ ID NO: 3285077 - RNA, 17 nt, Mycobacterium tuberculosis H37Rv
ggccauucaccgcgcac

SEQ ID NO: 3285078 - RNA, 19 nt, Mycobacterium tuberculosis H37Rv
ggccauucaccgcgcacga

SEQ ID NO: 3285079 - RNA, 21 nt, Mycobacterium tuberculosis H37Rv
ggccauucuuggugaucgcga

SEQ ID NO: 3285080 - RNA, 16 nt, Mycobacterium tuberculosis H37Rv
ggcccaacaccgccag

SEQ ID NO: 3285081 - RNA, 17 nt, Mycobacterium tuberculosis H37Rv
ggcccaacaccgccaga

SEQ ID NO: 3285082 - RNA, 18 nt, Mycobacterium tuberculosis H37Rv
ggcccaaggaacggcguc

SEQ ID NO: 3285083 - RNA, 16 nt, Mycobacterium tuberculosis H37Rv
ggcccaauugcgccga

SEQ ID NO: 3285084 - RNA, 20 nt, Mycobacterium tuberculosis H37Rv
ggcccacacggucgucgcga

SEQ ID NO: 3285085 - RNA, 22 nt, Mycobacterium tuberculosis H37Rv
ggcccacacggucgucgcgagc

SEQ ID NO: 3285086 - RNA, 19 nt, Mycobacterium tuberculosis H37Rv
ggcccacauguccagcguc

SEQ ID NO: 3285087 - RNA, 13 nt, Mycobacterium tuberculosis H37Rv
ggcccaccagcgc

SEQ ID NO: 3285088 - RNA, 19 nt, Mycobacterium tuberculosis H37Rv
ggcccaccagcgcagccga

SEQ ID NO: 3285089 - RNA, 15 nt, Mycobacterium tuberculosis H37Rv
ggcccaccgccguug

SEQ ID NO: 3285090 - RNA, 20 nt, Mycobacterium tuberculosis H37Rv
ggcccaccgccguugggccg

SEQ ID NO: 3285091 - RNA, 22 nt, Mycobacterium tuberculosis H37Rv
ggcccacgcgcacucgaccagg

SEQ ID NO: 3285092 - RNA, 23 nt, Mycobacterium tuberculosis H37Rv
ggcccacgcgcacucgaccagga

SEQ ID NO: 3285093 - RNA, 18 nt, Mycobacterium tuberculosis H37Rv
ggcccacggcagcgccgg

SEQ ID NO: 3285094 - RNA, 22 nt, Mycobacterium tuberculosis H37Rv
ggcccacucacacaaccgacgg

SEQ ID NO: 3285095 - RNA, 19 nt, Mycobacterium tuberculosis H37Rv
ggcccagauaucguacugg

SEQ ID NO: 3285096 - RNA, 23 nt, Mycobacterium tuberculosis H37Rv
ggcccagcaaccgcucggcgaug

SEQ ID NO: 3285097 - RNA, 12 nt, Mycobacterium tuberculosis H37Rv
ggcccagcacgg

SEQ ID NO: 3285098 - RNA, 14 nt, Mycobacterium tuberculosis H37Rv
ggcccagcagcgca

SEQ ID NO: 3285099 - RNA, 20 nt, Mycobacterium tuberculosis H37Rv
ggcccagcaggucgucggcg

SEQ ID NO: 3285100 - RNA, 19 nt, Mycobacterium tuberculosis H37Rv
ggcccagcccuucagcguc

SEQ ID NO: 3285101 - RNA, 14 nt, Mycobacterium tuberculosis H37Rv
ggcccgcucagccg

SEQ ID NO: 3285102 - RNA, 15 nt, Mycobacterium tuberculosis H37Rv
ggcccgcucagccgu

SEQ ID NO: 3285103 - RNA, 19 nt, Mycobacterium tuberculosis H37Rv
ggcccgcuccacggucagg

SEQ ID NO: 3285104 - RNA, 22 nt, Mycobacterium tuberculosis H37Rv
ggcccgcuccacggucaggcgu

SEQ ID NO: 3285105 - RNA, 13 nt, Mycobacterium tuberculosis H37Rv
ggcccgcucccug

SEQ ID NO: 3285106 - RNA, 14 nt, Mycobacterium tuberculosis H37Rv
ggcccgcucccugc

SEQ ID NO: 3285107 - RNA, 17 nt, Mycobacterium tuberculosis H37Rv
ggcccgcucccugcacc

SEQ ID NO: 3285108 - RNA, 19 nt, Mycobacterium tuberculosis H37Rv
ggcccgcucgaucggcagc

SEQ ID NO: 3285109 - RNA, 14 nt, Mycobacterium tuberculosis H37Rv
ggcccggaacaccg

SEQ ID NO: 3285110 - RNA, 23 nt, Mycobacterium tuberculosis H37Rv
ggcccggacaugcgggcagcacu

SEQ ID NO: 3285111 - RNA, 18 nt, Mycobacterium tuberculosis H37Rv
ggcccggacgucggcggc

SEQ ID NO: 3285112 - RNA, 14 nt, Mycobacterium tuberculosis H37Rv
ggcccggcacccgg

SEQ ID NO: 3285113 - RNA, 15 nt, Mycobacterium tuberculosis H37Rv
ggcccggcaccgcgu

SEQ ID NO: 3285114 - RNA, 13 nt, Mycobacterium tuberculosis H37Rv
ggcccggccgcca

SEQ ID NO: 3285115 - RNA, 13 nt, Mycobacterium tuberculosis H37Rv
ggcccggcgcggc

SEQ ID NO: 3285116 - RNA, 14 nt, Mycobacterium tuberculosis H37Rv
ggcccggcucacag

SEQ ID NO: 3285117 - RNA, 20 nt, Mycobacterium tuberculosis H37Rv
ggcccggcucacagcacagc

SEQ ID NO: 3285118 - RNA, 15 nt, Mycobacterium tuberculosis H37Rv
ggcccggcucggugc

SEQ ID NO: 3285119 - RNA, 14 nt, Mycobacterium tuberculosis H37Rv
ggcccgggccaccg

SEQ ID NO: 3285120 - RNA, 15 nt, Mycobacterium tuberculosis H37Rv
ggcccgggccaccgg

SEQ ID NO: 3285121 - RNA, 12 nt, Mycobacterium tuberculosis H37Rv
ggcccgggcccg

SEQ ID NO: 3285122 - RNA, 17 nt, Mycobacterium tuberculosis H37Rv
ggcccgggccgaagcgc

SEQ ID NO: 3285123 - RNA, 17 nt, Mycobacterium tuberculosis H37Rv
ggcccgggcggccagcu

SEQ ID NO: 3285124 - RNA, 18 nt, Mycobacterium tuberculosis H37Rv
ggcccgggcggccagcug

SEQ ID NO: 3285125 - RNA, 20 nt, Mycobacterium tuberculosis H37Rv
ggcccgggcggccagcugca

SEQ ID NO: 3285126 - RNA, 16 nt, Mycobacterium tuberculosis H37Rv
ggcccgggucuccggc

SEQ ID NO: 3285127 - RNA, 22 nt, Mycobacterium tuberculosis H37Rv
ggcccggguugagguaggggca

SEQ ID NO: 3285128 - RNA, 14 nt, Mycobacterium tuberculosis H37Rv
ggcccgguccagcc

SEQ ID NO: 3285129 - RNA, 15 nt, Mycobacterium tuberculosis H37Rv
ggcccgguccagccc

SEQ ID NO: 3285130 - RNA, 18 nt, Mycobacterium tuberculosis H37Rv
ggcccggucuugggcgcg

SEQ ID NO: 3285131 - RNA, 20 nt, Mycobacterium tuberculosis H37Rv
ggcccggugcucaagcgcgu

SEQ ID NO: 3285132 - RNA, 16 nt, Mycobacterium tuberculosis H37Rv
ggcccguagccgagcu

SEQ ID NO: 3285133 - RNA, 19 nt, Mycobacterium tuberculosis H37Rv
ggcccguagcguccgcgcc

SEQ ID NO: 3285134 - RNA, 21 nt, Mycobacterium tuberculosis H37Rv
ggcccguagcugcgcagcgca

SEQ ID NO: 3285135 - RNA, 21 nt, Mycobacterium tuberculosis H37Rv
ggcccgucacaaugcccaggc

SEQ ID NO: 3285136 - RNA, 15 nt, Mycobacterium tuberculosis H37Rv
ggcccguccugcggg

SEQ ID NO: 3285137 - RNA, 16 nt, Mycobacterium tuberculosis H37Rv
ggcccgucggcgugcg

SEQ ID NO: 3285138 - RNA, 16 nt, Mycobacterium tuberculosis H37Rv
ggcccgucgucgucga

SEQ ID NO: 3285139 - RNA, 19 nt, Mycobacterium tuberculosis H37Rv
ggcccgucgucgucgacac

SEQ ID NO: 3285140 - RNA, 17 nt, Mycobacterium tuberculosis H37Rv
ggcccgucgugaccgac

SEQ ID NO: 3285141 - RNA, 22 nt, Mycobacterium tuberculosis H37Rv
ggcccgugccacagcucgccgu

SEQ ID NO: 3285142 - RNA, 15 nt, Mycobacterium tuberculosis H37Rv
ggcccgugugggcgu

SEQ ID NO: 3285143 - RNA, 21 nt, Mycobacterium tuberculosis H37Rv
ggcccguuggcagcacaggcu

SEQ ID NO: 3285144 - RNA, 19 nt, Mycobacterium tuberculosis H37Rv
ggcccuccacugcgagcgc

SEQ ID NO: 3285145 - RNA, 18 nt, Mycobacterium tuberculosis H37Rv
ggcccuccggcgcagcga

SEQ ID NO: 3285146 - RNA, 19 nt, Mycobacterium tuberculosis H37Rv
ggcccuccggcgcagcgac

SEQ ID NO: 3285147 - RNA, 13 nt, Mycobacterium tuberculosis H37Rv
ggcccuccucggu

SEQ ID NO: 3285148 - RNA, 15 nt, Mycobacterium tuberculosis H37Rv
ggcccuccucgguga

SEQ ID NO: 3285149 - RNA, 20 nt, Mycobacterium tuberculosis H37Rv
ggcccucgggacugcgcggc

SEQ ID NO: 3285150 - RNA, 15 nt, Mycobacterium tuberculosis H37Rv
ggcccugagcugccg

SEQ ID NO: 3285151 - RNA, 17 nt, Mycobacterium tuberculosis H37Rv
ggcccugcacagcagcg

SEQ ID NO: 3285152 - RNA, 21 nt, Mycobacterium tuberculosis H37Rv
ggcccugcggccacgguggcg

SEQ ID NO: 3285153 - RNA, 20 nt, Mycobacterium tuberculosis H37Rv
ggcccugcuccucgcgggcg

SEQ ID NO: 3285154 - RNA, 23 nt, Mycobacterium tuberculosis H37Rv
ggcccugcuccucgcgggcggcg

SEQ ID NO: 3285155 - RNA, 15 nt, Mycobacterium tuberculosis H37Rv
ggcccuggccagccc

SEQ ID NO: 3285156 - RNA, 20 nt, Mycobacterium tuberculosis H37Rv
ggcccuggccagcccgagcu

SEQ ID NO: 3285157 - RNA, 16 nt, Mycobacterium tuberculosis H37Rv
ggcccuggcgaccagc

SEQ ID NO: 3285158 - RNA, 21 nt, Mycobacterium tuberculosis H37Rv
ggcccuucaguucgacggugc

SEQ ID NO: 3285159 - RNA, 18 nt, Mycobacterium tuberculosis H37Rv
ggcccuugcucguccagg

SEQ ID NO: 3285160 - RNA, 22 nt, Mycobacterium tuberculosis H37Rv
ggcccuugcucguccaggucgg

SEQ ID NO: 3285161 - RNA, 20 nt, Mycobacterium tuberculosis H37Rv
ggccgaaacuucgcccgggc

SEQ ID NO: 3285162 - RNA, 19 nt, Mycobacterium tuberculosis H37Rv
ggccgaaagagccagcggc

SEQ ID NO: 3285163 - RNA, 21 nt, Mycobacterium tuberculosis H37Rv
ggccgaaagagccagcggcac

SEQ ID NO: 3285164 - RNA, 15 nt, Mycobacterium tuberculosis H37Rv
ggccgaaagccaggc

SEQ ID NO: 3285165 - RNA, 22 nt, Mycobacterium tuberculosis H37Rv
ggccgaaagccaggcggcaagg

SEQ ID NO: 3285166 - RNA, 15 nt, Mycobacterium tuberculosis H37Rv
ggccgaacacaccgg

SEQ ID NO: 3285167 - RNA, 18 nt, Mycobacterium tuberculosis H37Rv
ggccgaacacaccgggcg

SEQ ID NO: 3285168 - RNA, 14 nt, Mycobacterium tuberculosis H37Rv
ggccgaacagccga

SEQ ID NO: 3285169 - RNA, 23 nt, Mycobacterium tuberculosis H37Rv
ggccgaacagcugcccgccagcg

SEQ ID NO: 3285170 - RNA, 13 nt, Mycobacterium tuberculosis H37Rv
ggccgaaccggua

SEQ ID NO: 3285171 - RNA, 20 nt, Mycobacterium tuberculosis H37Rv
ggccgaaccgguagucgccg

SEQ ID NO: 3285172 - RNA, 23 nt, Mycobacterium tuberculosis H37Rv
ggccgaacgacggguccgggcca

SEQ ID NO: 3285173 - RNA, 13 nt, Mycobacterium tuberculosis H37Rv
ggccgaacggguc

SEQ ID NO: 3285174 - RNA, 17 nt, Mycobacterium tuberculosis H37Rv
ggccgaacgggucggcg

SEQ ID NO: 3285175 - RNA, 18 nt, Mycobacterium tuberculosis H37Rv
ggccgaacugccgcgccg

SEQ ID NO: 3285176 - RNA, 21 nt, Mycobacterium tuberculosis H37Rv
ggccgaagcccgaucggcggg

SEQ ID NO: 3285177 - RNA, 18 nt, Mycobacterium tuberculosis H37Rv
ggccgacaaugucggcga

SEQ ID NO: 3285178 - RNA, 14 nt, Mycobacterium tuberculosis H37Rv
ggccgacacgaacg

SEQ ID NO: 3285179 - RNA, 20 nt, Mycobacterium tuberculosis H37Rv
ggccgacacgaacgcugcuc

SEQ ID NO: 3285180 - RNA, 17 nt, Mycobacterium tuberculosis H37Rv
ggccgacagcacgccag

SEQ ID NO: 3285181 - RNA, 20 nt, Mycobacterium tuberculosis H37Rv
ggccgacagcacgccaggca

SEQ ID NO: 3285182 - RNA, 22 nt, Mycobacterium tuberculosis H37Rv
ggccgacagcacgccaggcaug

SEQ ID NO: 3285183 - RNA, 18 nt, Mycobacterium tuberculosis H37Rv
ggccgacagccaccgcga

SEQ ID NO: 3285184 - RNA, 18 nt, Mycobacterium tuberculosis H37Rv
ggccgaccagagcuucgc

SEQ ID NO: 3285185 - RNA, 13 nt, Mycobacterium tuberculosis H37Rv
ggccgaccagcac

SEQ ID NO: 3285186 - RNA, 14 nt, Mycobacterium tuberculosis H37Rv
ggccgaccagccga

SEQ ID NO: 3285187 - RNA, 16 nt, Mycobacterium tuberculosis H37Rv
ggccgaccagccgauc

SEQ ID NO: 3285188 - RNA, 17 nt, Mycobacterium tuberculosis H37Rv
ggccgaccagccgauca

SEQ ID NO: 3285189 - RNA, 21 nt, Mycobacterium tuberculosis H37Rv
ggccgaccgcgacccggccca

SEQ ID NO: 3285190 - RNA, 15 nt, Mycobacterium tuberculosis H37Rv
ggccgaccgcgcaca

SEQ ID NO: 3285191 - RNA, 22 nt, Mycobacterium tuberculosis H37Rv
ggccgaccgggcucuggccagu

SEQ ID NO: 3285192 - RNA, 23 nt, Mycobacterium tuberculosis H37Rv
ggccgaccucguucgucaccacg

SEQ ID NO: 3285193 - RNA, 12 nt, Mycobacterium tuberculosis H37Rv
ggccgacgcugc

SEQ ID NO: 3285194 - RNA, 14 nt, Mycobacterium tuberculosis H37Rv
ggccgacgcugcug

SEQ ID NO: 3285195 - RNA, 23 nt, Mycobacterium tuberculosis H37Rv
ggccgacggcaaaccaguuggcg

SEQ ID NO: 3285196 - RNA, 14 nt, Mycobacterium tuberculosis H37Rv
ggccgacgucgacc

SEQ ID NO: 3285197 - RNA, 22 nt, Mycobacterium tuberculosis H37Rv
ggccgccgcgcaccgcgggauc

SEQ ID NO: 3285198 - RNA, 13 nt, Mycobacterium tuberculosis H37Rv
ggccgccgcgccg

SEQ ID NO: 3285199 - RNA, 13 nt, Mycobacterium tuberculosis H37Rv
ggccgccgcggcc

SEQ ID NO: 3285200 - RNA, 17 nt, Mycobacterium tuberculosis H37Rv
ggccgccgcggcuuguc

SEQ ID NO: 3285201 - RNA, 21 nt, Mycobacterium tuberculosis H37Rv
ggccgccgcugccgccugcag

SEQ ID NO: 3285202 - RNA, 21 nt, Mycobacterium tuberculosis H37Rv
ggccgccggacccgucgagca

SEQ ID NO: 3285203 - RNA, 18 nt, Mycobacterium tuberculosis H37Rv
ggccgccggaucaggauc

SEQ ID NO: 3285204 - RNA, 17 nt, Mycobacterium tuberculosis H37Rv
ggccgccggccagcguc

SEQ ID NO: 3285205 - RNA, 17 nt, Mycobacterium tuberculosis H37Rv
ggccgccggcgcuggcg

SEQ ID NO: 3285206 - RNA, 11 nt, Mycobacterium tuberculosis H37Rv
ggccgccgguc

SEQ ID NO: 3285207 - RNA, 21 nt, Mycobacterium tuberculosis H37Rv
ggccgccguccccgccgucgc

SEQ ID NO: 3285208 - RNA, 15 nt, Mycobacterium tuberculosis H37Rv
ggccgccuccgcggc

SEQ ID NO: 3285209 - RNA, 23 nt, Mycobacterium tuberculosis H37Rv
ggccgccucgcggaugagcucgg

SEQ ID NO: 3285210 - RNA, 19 nt, Mycobacterium tuberculosis H37Rv
ggccgccucguacggaccg

SEQ ID NO: 3285211 - RNA, 22 nt, Mycobacterium tuberculosis H37Rv
ggccgccucguacggaccgucg

SEQ ID NO: 3285212 - RNA, 19 nt, Mycobacterium tuberculosis H37Rv
ggccgccugacccggcgcc

SEQ ID NO: 3285213 - RNA, 20 nt, Mycobacterium tuberculosis H37Rv
ggccgccugacccggcgccg

SEQ ID NO: 3285214 - RNA, 17 nt, Mycobacterium tuberculosis H37Rv
ggccgccuucgccgccg

SEQ ID NO: 3285215 - RNA, 18 nt, Mycobacterium tuberculosis H37Rv
ggccgccuucuccggcgu

SEQ ID NO: 3285216 - RNA, 19 nt, Mycobacterium tuberculosis H37Rv
ggccgccuucuccggcguc

SEQ ID NO: 3285217 - RNA, 23 nt, Mycobacterium tuberculosis H37Rv
ggccgcgacaauggugcccagga

SEQ ID NO: 3285218 - RNA, 14 nt, Mycobacterium tuberculosis H37Rv
ggccgcgaccagcg

SEQ ID NO: 3285219 - RNA, 15 nt, Mycobacterium tuberculosis H37Rv
ggccgcgaccagcgc

SEQ ID NO: 3285220 - RNA, 20 nt, Mycobacterium tuberculosis H37Rv
ggccgcgaccggcguaaccg

SEQ ID NO: 3285221 - RNA, 15 nt, Mycobacterium tuberculosis H37Rv
ggccgcgacgacacg

SEQ ID NO: 3285222 - RNA, 17 nt, Mycobacterium tuberculosis H37Rv
ggccgcgacguugaacu

SEQ ID NO: 3285223 - RNA, 14 nt, Mycobacterium tuberculosis H37Rv
ggccgcgagacgca

SEQ ID NO: 3285224 - RNA, 22 nt, Mycobacterium tuberculosis H37Rv
ggccgcgagacgcaugucgggc

SEQ ID NO: 3285225 - RNA, 15 nt, Mycobacterium tuberculosis H37Rv
ggccgcgagguaccc

SEQ ID NO: 3285226 - RNA, 23 nt, Mycobacterium tuberculosis H37Rv
ggccgcgagguacccaucgucga

SEQ ID NO: 3285227 - RNA, 17 nt, Mycobacterium tuberculosis H37Rv
ggccgcgauccagcgcu

SEQ ID NO: 3285228 - RNA, 22 nt, Mycobacterium tuberculosis H37Rv
ggccgcgauggugcgccgggcg

SEQ ID NO: 3285229 - RNA, 12 nt, Mycobacterium tuberculosis H37Rv
ggccgcgcaggc

SEQ ID NO: 3285230 - RNA, 13 nt, Mycobacterium tuberculosis H37Rv
ggccgcgcaggcu

SEQ ID NO: 3285231 - RNA, 14 nt, Mycobacterium tuberculosis H37Rv
ggccgcgcaugguc

SEQ ID NO: 3285232 - RNA, 15 nt, Mycobacterium tuberculosis H37Rv
ggccgcgccgucggc

SEQ ID NO: 3285233 - RNA, 16 nt, Mycobacterium tuberculosis H37Rv
ggccgcgccucggucu

SEQ ID NO: 3285234 - RNA, 12 nt, Mycobacterium tuberculosis H37Rv
ggccgcgcgcac

SEQ ID NO: 3285235 - RNA, 13 nt, Mycobacterium tuberculosis H37Rv
ggccgcgcgcacc

SEQ ID NO: 3285236 - RNA, 15 nt, Mycobacterium tuberculosis H37Rv
ggccgcgcgcaccgg

SEQ ID NO: 3285237 - RNA, 17 nt, Mycobacterium tuberculosis H37Rv
ggccgcgcgcaccggua

SEQ ID NO: 3285238 - RNA, 17 nt, Mycobacterium tuberculosis H37Rv
ggccgcgcgcaucgcgc

SEQ ID NO: 3285239 - RNA, 14 nt, Mycobacterium tuberculosis H37Rv
ggccgcgcggcgac

SEQ ID NO: 3285240 - RNA, 21 nt, Mycobacterium tuberculosis H37Rv
ggccgcgcggcgacagcuugg

SEQ ID NO: 3285241 - RNA, 16 nt, Mycobacterium tuberculosis H37Rv
ggccgcgcggggugcg

SEQ ID NO: 3285242 - RNA, 24 nt, Mycobacterium tuberculosis H37Rv
ggccgcgcggucguacgcauggcg

SEQ ID NO: 3285243 - RNA, 16 nt, Mycobacterium tuberculosis H37Rv
ggccgcgcugaacgcu

SEQ ID NO: 3285244 - RNA, 19 nt, Mycobacterium tuberculosis H37Rv
ggccgcgcugcagcacggc

SEQ ID NO: 3285245 - RNA, 22 nt, Mycobacterium tuberculosis H37Rv
ggccgcggagaaggcgcgggcg

SEQ ID NO: 3285246 - RNA, 12 nt, Mycobacterium tuberculosis H37Rv
ggccgcggcagc

SEQ ID NO: 3285247 - RNA, 20 nt, Mycobacterium tuberculosis H37Rv
ggccgcggccacaucgccag

SEQ ID NO: 3285248 - RNA, 18 nt, Mycobacterium tuberculosis H37Rv
ggccgcggccucccgcaa

SEQ ID NO: 3285249 - RNA, 13 nt, Mycobacterium tuberculosis H37Rv
ggccgcggccucg

SEQ ID NO: 3285250 - RNA, 13 nt, Mycobacterium tuberculosis H37Rv
ggccgcggcgauc

SEQ ID NO: 3285251 - RNA, 17 nt, Mycobacterium tuberculosis H37Rv
ggccgcggcgcgacggc

SEQ ID NO: 3285252 - RNA, 13 nt, Mycobacterium tuberculosis H37Rv
ggccgcggcggcc

SEQ ID NO: 3285253 - RNA, 16 nt, Mycobacterium tuberculosis H37Rv
ggccgcggcggccagc

SEQ ID NO: 3285254 - RNA, 12 nt, Mycobacterium tuberculosis H37Rv
ggccgcggcggu

SEQ ID NO: 3285255 - RNA, 13 nt, Mycobacterium tuberculosis H37Rv
ggccgcggcgguc

SEQ ID NO: 3285256 - RNA, 12 nt, Mycobacterium tuberculosis H37Rv
ggccgcggcguc

SEQ ID NO: 3285257 - RNA, 13 nt, Mycobacterium tuberculosis H37Rv
ggccgcggcgucg

SEQ ID NO: 3285258 - RNA, 14 nt, Mycobacterium tuberculosis H37Rv
ggccgcggucggcc

SEQ ID NO: 3285259 - RNA, 17 nt, Mycobacterium tuberculosis H37Rv
ggccgcggucggccacc

SEQ ID NO: 3285260 - RNA, 16 nt, Mycobacterium tuberculosis H37Rv
ggccgcggugacggcg

SEQ ID NO: 3285261 - RNA, 15 nt, Mycobacterium tuberculosis H37Rv
ggccgcggugcccgu

SEQ ID NO: 3285262 - RNA, 21 nt, Mycobacterium tuberculosis H37Rv
ggccgcguaaaccggcugacc

SEQ ID NO: 3285263 - RNA, 20 nt, Mycobacterium tuberculosis H37Rv
ggccgcgucacggaccugga

SEQ ID NO: 3285264 - RNA, 15 nt, Mycobacterium tuberculosis H37Rv
ggccgcgucgucgag

SEQ ID NO: 3285265 - RNA, 19 nt, Mycobacterium tuberculosis H37Rv
ggccgcgucucggugcagc

SEQ ID NO: 3285266 - RNA, 20 nt, Mycobacterium tuberculosis H37Rv
ggccgcgucuuggugcgcgu

SEQ ID NO: 3285267 - RNA, 22 nt, Mycobacterium tuberculosis H37Rv
ggccgcgucuuggugcgcguca

SEQ ID NO: 3285268 - RNA, 20 nt, Mycobacterium tuberculosis H37Rv
ggccgcuauggcccgggccg

SEQ ID NO: 3285269 - RNA, 16 nt, Mycobacterium tuberculosis H37Rv
ggccgcuccaccucgg

SEQ ID NO: 3285270 - RNA, 12 nt, Mycobacterium tuberculosis H37Rv
ggccgcucgccu

SEQ ID NO: 3285271 - RNA, 20 nt, Mycobacterium tuberculosis H37Rv
ggccgcucgccucgauggcg

SEQ ID NO: 3285272 - RNA, 17 nt, Mycobacterium tuberculosis H37Rv
ggccgcucuucgacauc

SEQ ID NO: 3285273 - RNA, 22 nt, Mycobacterium tuberculosis H37Rv
ggccgcugccuuggcgcggcac

SEQ ID NO: 3285274 - RNA, 20 nt, Mycobacterium tuberculosis H37Rv
ggccgcugggcccaucgcga

SEQ ID NO: 3285275 - RNA, 13 nt, Mycobacterium tuberculosis H37Rv
ggccgcugggccg

SEQ ID NO: 3285276 - RNA, 23 nt, Mycobacterium tuberculosis H37Rv
ggccgcugucguaccgcucggcg

SEQ ID NO: 3285277 - RNA, 22 nt, Mycobacterium tuberculosis H37Rv
ggccgcugugcggucgucaccg

SEQ ID NO: 3285278 - RNA, 17 nt, Mycobacterium tuberculosis H37Rv
ggccgcuucggcgguca

SEQ ID NO: 3285279 - RNA, 16 nt, Mycobacterium tuberculosis H37Rv
ggccgcuucgggcguc

SEQ ID NO: 3285280 - RNA, 17 nt, Mycobacterium tuberculosis H37Rv
ggccgcuugccccgccu

SEQ ID NO: 3285281 - RNA, 14 nt, Mycobacterium tuberculosis H37Rv
ggccgcuuggcgua

SEQ ID NO: 3285282 - RNA, 18 nt, Mycobacterium tuberculosis H37Rv
ggccgcuuugcgcgguca

SEQ ID NO: 3285283 - RNA, 14 nt, Mycobacterium tuberculosis H37Rv
ggccggaacgcccg

SEQ ID NO: 3285284 - RNA, 16 nt, Mycobacterium tuberculosis H37Rv
ggccggaacgcccggc

SEQ ID NO: 3285285 - RNA, 14 nt, Mycobacterium tuberculosis H37Rv
ggccggacgggugc

SEQ ID NO: 3285286 - RNA, 19 nt, Mycobacterium tuberculosis H37Rv
ggccggacgggugcgggcc

SEQ ID NO: 3285287 - RNA, 14 nt, Mycobacterium tuberculosis H37Rv
ggccggagccgccg

SEQ ID NO: 3285288 - RNA, 16 nt, Mycobacterium tuberculosis H37Rv
ggccggagccgccggc

SEQ ID NO: 3285289 - RNA, 17 nt, Mycobacterium tuberculosis H37Rv
ggccggagccgccggcc

SEQ ID NO: 3285290 - RNA, 13 nt, Mycobacterium tuberculosis H37Rv
ggccggagccggu

SEQ ID NO: 3285291 - RNA, 18 nt, Mycobacterium tuberculosis H37Rv
ggccggagccggugccga

SEQ ID NO: 3285292 - RNA, 18 nt, Mycobacterium tuberculosis H37Rv
ggccggagggguuagguu

SEQ ID NO: 3285293 - RNA, 17 nt, Mycobacterium tuberculosis H37Rv
ggccggaguccgucggg

SEQ ID NO: 3285294 - RNA, 18 nt, Mycobacterium tuberculosis H37Rv
ggccgucgaacgguagca

SEQ ID NO: 3285295 - RNA, 19 nt, Mycobacterium tuberculosis H37Rv
ggccgucgaacgguagcac

SEQ ID NO: 3285296 - RNA, 20 nt, Mycobacterium tuberculosis H37Rv
ggccgucgaagacgaacgug

SEQ ID NO: 3285297 - RNA, 12 nt, Mycobacterium tuberculosis H37Rv
ggccgucgaccc

SEQ ID NO: 3285298 - RNA, 17 nt, Mycobacterium tuberculosis H37Rv
ggccgucgacgaucagc

SEQ ID NO: 3285299 - RNA, 14 nt, Mycobacterium tuberculosis H37Rv
ggccgucgaucaag

SEQ ID NO: 3285300 - RNA, 16 nt, Mycobacterium tuberculosis H37Rv
ggccgucgaucuucuc

SEQ ID NO: 3285301 - RNA, 23 nt, Mycobacterium tuberculosis H37Rv
ggccgucgcgggacaacagcaug

SEQ ID NO: 3285302 - RNA, 15 nt, Mycobacterium tuberculosis H37Rv
ggccgucggccggau

SEQ ID NO: 3285303 - RNA, 14 nt, Mycobacterium tuberculosis H37Rv
ggccgucggcgggc

SEQ ID NO: 3285304 - RNA, 15 nt, Mycobacterium tuberculosis H37Rv
ggccgucggcgucga

SEQ ID NO: 3285305 - RNA, 15 nt, Mycobacterium tuberculosis H37Rv
ggccgucgggugugc

SEQ ID NO: 3285306 - RNA, 16 nt, Mycobacterium tuberculosis H37Rv
ggccgucgucggucac

SEQ ID NO: 3285307 - RNA, 19 nt, Mycobacterium tuberculosis H37Rv
ggccgucgucggucaccga

SEQ ID NO: 3285308 - RNA, 19 nt, Mycobacterium tuberculosis H37Rv
ggccgucguugccggcgac

SEQ ID NO: 3285309 - RNA, 14 nt, Mycobacterium tuberculosis H37Rv
ggccgucucgacac

SEQ ID NO: 3285310 - RNA, 16 nt, Mycobacterium tuberculosis H37Rv
ggccgucucgacacug

SEQ ID NO: 3285311 - RNA, 14 nt, Mycobacterium tuberculosis H37Rv
ggccgucucgccgu

SEQ ID NO: 3285312 - RNA, 16 nt, Mycobacterium tuberculosis H37Rv
ggccgucuucggugau

SEQ ID NO: 3285313 - RNA, 17 nt, Mycobacterium tuberculosis H37Rv
ggccgucuucggugauc

SEQ ID NO: 3285314 - RNA, 14 nt, Mycobacterium tuberculosis H37Rv
ggccgugaacggcg

SEQ ID NO: 3285315 - RNA, 17 nt, Mycobacterium tuberculosis H37Rv
ggccgugaauucgccga

SEQ ID NO: 3285316 - RNA, 18 nt, Mycobacterium tuberculosis H37Rv
ggccgugaauucgccgaa

SEQ ID NO: 3285317 - RNA, 12 nt, Mycobacterium tuberculosis H37Rv
ggccgugaccga

SEQ ID NO: 3285318 - RNA, 15 nt, Mycobacterium tuberculosis H37Rv
ggccgugagcccggc

SEQ ID NO: 3285319 - RNA, 12 nt, Mycobacterium tuberculosis H37Rv
ggccgugccgcc

SEQ ID NO: 3285320 - RNA, 13 nt, Mycobacterium tuberculosis H37Rv
ggccgugccgccg

SEQ ID NO: 3285321 - RNA, 14 nt, Mycobacterium tuberculosis H37Rv
ggccgugccgccga

SEQ ID NO: 3285322 - RNA, 18 nt, Mycobacterium tuberculosis H37Rv
ggccguggaaagccggcg

SEQ ID NO: 3285323 - RNA, 13 nt, Mycobacterium tuberculosis H37Rv
ggccguggcgaau

SEQ ID NO: 3285324 - RNA, 20 nt, Mycobacterium tuberculosis H37Rv
ggccgugggugucgguggcc

SEQ ID NO: 3285325 - RNA, 12 nt, Mycobacterium tuberculosis H37Rv
ggccguggucga

SEQ ID NO: 3285326 - RNA, 17 nt, Mycobacterium tuberculosis H37Rv
ggccguggucgagggcg

SEQ ID NO: 3285327 - RNA, 22 nt, Mycobacterium tuberculosis H37Rv
ggccguggucgagggcggcguc

SEQ ID NO: 3285328 - RNA, 15 nt, Mycobacterium tuberculosis H37Rv
ggccguucaaccgga

SEQ ID NO: 3285329 - RNA, 20 nt, Mycobacterium tuberculosis H37Rv
ggccguuccacaucaaaacg

SEQ ID NO: 3285330 - RNA, 21 nt, Mycobacterium tuberculosis H37Rv
ggccguucgcccuaauccgcu

SEQ ID NO: 3285331 - RNA, 22 nt, Mycobacterium tuberculosis H37Rv
ggccguugacggugucuugcca

SEQ ID NO: 3285332 - RNA, 15 nt, Mycobacterium tuberculosis H37Rv
ggccguugccccguc

SEQ ID NO: 3285333 - RNA, 19 nt, Mycobacterium tuberculosis H37Rv
ggccguugcuauucgccag

SEQ ID NO: 3285334 - RNA, 21 nt, Mycobacterium tuberculosis H37Rv
ggccguugcuauucgccagcg

SEQ ID NO: 3285335 - RNA, 20 nt, Mycobacterium tuberculosis H37Rv
ggccguuggcggcgguggcc

SEQ ID NO: 3285336 - RNA, 19 nt, Mycobacterium tuberculosis H37Rv
ggccguugggccaccggcg

SEQ ID NO: 3285337 - RNA, 23 nt, Mycobacterium tuberculosis H37Rv
ggccguuggugaggccccccgcg

SEQ ID NO: 3285338 - RNA, 16 nt, Mycobacterium tuberculosis H37Rv
ggccguugugcgguug

SEQ ID NO: 3285339 - RNA, 24 nt, Mycobacterium tuberculosis H37Rv
ggccguuucggcgccgucgcccag

SEQ ID NO: 3285340 - RNA, 17 nt, Mycobacterium tuberculosis H37Rv
ggccuaccaggcgcggc

SEQ ID NO: 3285341 - RNA, 17 nt, Mycobacterium tuberculosis H37Rv
ggccuagcaugaggccc

SEQ ID NO: 3285342 - RNA, 16 nt, Mycobacterium tuberculosis H37Rv
ggccuagccgauggcu

SEQ ID NO: 3285343 - RNA, 13 nt, Mycobacterium tuberculosis H37Rv
ggccuagccgcgg

SEQ ID NO: 3285344 - RNA, 15 nt, Mycobacterium tuberculosis H37Rv
ggccuagcgcggcga

SEQ ID NO: 3285345 - RNA, 15 nt, Mycobacterium tuberculosis H37Rv
ggccuaggucgacgc

SEQ ID NO: 3285346 - RNA, 23 nt, Mycobacterium tuberculosis H37Rv
ggccuaucccgaaucucacccac

SEQ ID NO: 3285347 - RNA, 20 nt, Mycobacterium tuberculosis H37Rv
ggccucaaguugguucaccg

SEQ ID NO: 3285348 - RNA, 16 nt, Mycobacterium tuberculosis H37Rv
ggccucacccggucaa

SEQ ID NO: 3285349 - RNA, 17 nt, Mycobacterium tuberculosis H37Rv
ggccucagccaccgggc

SEQ ID NO: 3285350 - RNA, 18 nt, Mycobacterium tuberculosis H37Rv
ggccucagcccggccagc

SEQ ID NO: 3285351 - RNA, 22 nt, Mycobacterium tuberculosis H37Rv
ggccucagcccggccagccgca

SEQ ID NO: 3285352 - RNA, 20 nt, Mycobacterium tuberculosis H37Rv
ggccucagcccgucagccga

SEQ ID NO: 3285353 - RNA, 20 nt, Mycobacterium tuberculosis H37Rv
ggccucaguacagcgcguug

SEQ ID NO: 3285354 - RNA, 18 nt, Mycobacterium tuberculosis H37Rv
ggccucauccaccgaugg

SEQ ID NO: 3285355 - RNA, 17 nt, Mycobacterium tuberculosis H37Rv
ggccuccaccacgucgg

SEQ ID NO: 3285356 - RNA, 18 nt, Mycobacterium tuberculosis H37Rv
ggccuccacccgccacgg

SEQ ID NO: 3285357 - RNA, 23 nt, Mycobacterium tuberculosis H37Rv
ggccucccacucacccagcuugg

SEQ ID NO: 3285358 - RNA, 23 nt, Mycobacterium tuberculosis H37Rv
ggccuccucgucgcucccgguug

SEQ ID NO: 3285359 - RNA, 21 nt, Mycobacterium tuberculosis H37Rv
ggccuccugcuggcccugcuc

SEQ ID NO: 3285360 - RNA, 17 nt, Mycobacterium tuberculosis H37Rv
ggccucgaccucuucgg

SEQ ID NO: 3285361 - RNA, 12 nt, Mycobacterium tuberculosis H37Rv
ggccucgaucag

SEQ ID NO: 3285362 - RNA, 14 nt, Mycobacterium tuberculosis H37Rv
ggccucgaucagcg

SEQ ID NO: 3285363 - RNA, 13 nt, Mycobacterium tuberculosis H37Rv
ggccucgcgagaa

SEQ ID NO: 3285364 - RNA, 13 nt, Mycobacterium tuberculosis H37Rv
ggccucgcugcuc

SEQ ID NO: 3285365 - RNA, 15 nt, Mycobacterium tuberculosis H37Rv
ggccucgcugcucag

SEQ ID NO: 3285366 - RNA, 13 nt, Mycobacterium tuberculosis H37Rv
ggccucggcagca

SEQ ID NO: 3285367 - RNA, 14 nt, Mycobacterium tuberculosis H37Rv
ggccucggccagcg

SEQ ID NO: 3285368 - RNA, 12 nt, Mycobacterium tuberculosis H37Rv
ggccucggcgac

SEQ ID NO: 3285369 - RNA, 13 nt, Mycobacterium tuberculosis H37Rv
ggccucggcgaua

SEQ ID NO: 3285370 - RNA, 20 nt, Mycobacterium tuberculosis H37Rv
ggccucggcgauaccgagga

SEQ ID NO: 3285371 - RNA, 14 nt, Mycobacterium tuberculosis H37Rv
ggccucgggacucc

SEQ ID NO: 3285372 - RNA, 13 nt, Mycobacterium tuberculosis H37Rv
ggccucggggauc

SEQ ID NO: 3285373 - RNA, 21 nt, Mycobacterium tuberculosis H37Rv
ggccucggugagcagcucggu

SEQ ID NO: 3285374 - RNA, 12 nt, Mycobacterium tuberculosis H37Rv
ggccucguccag

SEQ ID NO: 3285375 - RNA, 14 nt, Mycobacterium tuberculosis H37Rv
ggccucguccagcu

SEQ ID NO: 3285376 - RNA, 21 nt, Mycobacterium tuberculosis H37Rv
ggccucgucgauguucgccgc

SEQ ID NO: 3285377 - RNA, 21 nt, Mycobacterium tuberculosis H37Rv
ggccucgucgugcaccucguc

SEQ ID NO: 3285378 - RNA, 17 nt, Mycobacterium tuberculosis H37Rv
ggccucguugaccgggu

SEQ ID NO: 3285379 - RNA, 17 nt, Mycobacterium tuberculosis H37Rv
ggccucugaccagccgg

SEQ ID NO: 3285380 - RNA, 20 nt, Mycobacterium tuberculosis H37Rv
ggccucugaccagccggucu

SEQ ID NO: 3285381 - RNA, 16 nt, Mycobacterium tuberculosis H37Rv
ggccugaaacggcugc

SEQ ID NO: 3285382 - RNA, 19 nt, Mycobacterium tuberculosis H37Rv
ggccugaccggcucgccgg

SEQ ID NO: 3285383 - RNA, 20 nt, Mycobacterium tuberculosis H37Rv
ggccugaccggcucgccggc

SEQ ID NO: 3285384 - RNA, 14 nt, Mycobacterium tuberculosis H37Rv
ggccugagcggcca

SEQ ID NO: 3285385 - RNA, 19 nt, Mycobacterium tuberculosis H37Rv
ggccugagcgucgucgccg

SEQ ID NO: 3285386 - RNA, 21 nt, Mycobacterium tuberculosis H37Rv
ggccugagcgucgucgccggc

SEQ ID NO: 3285387 - RNA, 18 nt, Mycobacterium tuberculosis H37Rv
ggccugagcgugucuggc

SEQ ID NO: 3285388 - RNA, 19 nt, Mycobacterium tuberculosis H37Rv
ggccugauuccacugggcc

SEQ ID NO: 3285389 - RNA, 15 nt, Mycobacterium tuberculosis H37Rv
ggccugcaccacggc

SEQ ID NO: 3285390 - RNA, 19 nt, Mycobacterium tuberculosis H37Rv
ggccugcaccacggcggcc

SEQ ID NO: 3285391 - RNA, 16 nt, Mycobacterium tuberculosis H37Rv
ggcgaccacgccgccg

SEQ ID NO: 3285392 - RNA, 23 nt, Mycobacterium tuberculosis H37Rv
ggcgaccacggcaccgaucaacg

SEQ ID NO: 3285393 - RNA, 19 nt, Mycobacterium tuberculosis H37Rv
ggcgaccacgucggcgaac

SEQ ID NO: 3285394 - RNA, 12 nt, Mycobacterium tuberculosis H37Rv
ggcgaccagaua

SEQ ID NO: 3285395 - RNA, 16 nt, Mycobacterium tuberculosis H37Rv
ggcgaccagccgagcg

SEQ ID NO: 3285396 - RNA, 19 nt, Mycobacterium tuberculosis H37Rv
ggcgaccagcucagcugcg

SEQ ID NO: 3285397 - RNA, 20 nt, Mycobacterium tuberculosis H37Rv
ggcgaccagcucagcugcgg

SEQ ID NO: 3285398 - RNA, 13 nt, Mycobacterium tuberculosis H37Rv
ggcgaccaggagc

SEQ ID NO: 3285399 - RNA, 18 nt, Mycobacterium tuberculosis H37Rv
ggcgaccaggagccucca

SEQ ID NO: 3285400 - RNA, 14 nt, Mycobacterium tuberculosis H37Rv
ggcgaccaggucgg

SEQ ID NO: 3285401 - RNA, 23 nt, Mycobacterium tuberculosis H37Rv
ggcgaccauaagcucguagagca

SEQ ID NO: 3285402 - RNA, 16 nt, Mycobacterium tuberculosis H37Rv
ggcgaccaugcuccua

SEQ ID NO: 3285403 - RNA, 21 nt, Mycobacterium tuberculosis H37Rv
ggcgaccccgaacauccgccg

SEQ ID NO: 3285404 - RNA, 14 nt, Mycobacterium tuberculosis H37Rv
ggcgacccgcuggg

SEQ ID NO: 3285405 - RNA, 20 nt, Mycobacterium tuberculosis H37Rv
ggcgacccgcugggucgacc

SEQ ID NO: 3285406 - RNA, 20 nt, Mycobacterium tuberculosis H37Rv
ggcgacccggguagacaccg

SEQ ID NO: 3285407 - RNA, 23 nt, Mycobacterium tuberculosis H37Rv
ggcgacccggguagacaccgcga

SEQ ID NO: 3285408 - RNA, 20 nt, Mycobacterium tuberculosis H37Rv
ggcgacccggucacucuggc

SEQ ID NO: 3285409 - RNA, 21 nt, Mycobacterium tuberculosis H37Rv
ggcgacccggucacucuggcg

SEQ ID NO: 3285410 - RNA, 18 nt, Mycobacterium tuberculosis H37Rv
ggcgaccgagacggcguc

SEQ ID NO: 3285411 - RNA, 16 nt, Mycobacterium tuberculosis H37Rv
ggcgaccgcauccggu

SEQ ID NO: 3285412 - RNA, 13 nt, Mycobacterium tuberculosis H37Rv
ggcgaccgccugc

SEQ ID NO: 3285413 - RNA, 15 nt, Mycobacterium tuberculosis H37Rv
ggcgaccgcgucguc

SEQ ID NO: 3285414 - RNA, 12 nt, Mycobacterium tuberculosis H37Rv
ggcgaccggcga

SEQ ID NO: 3285415 - RNA, 20 nt, Mycobacterium tuberculosis H37Rv
ggcgaccgucaaccugcugc

SEQ ID NO: 3285416 - RNA, 22 nt, Mycobacterium tuberculosis H37Rv
ggcgaccgucgauuucgacgac

SEQ ID NO: 3285417 - RNA, 21 nt, Mycobacterium tuberculosis H37Rv
ggcgaccuccggaaucgcccg

SEQ ID NO: 3285418 - RNA, 16 nt, Mycobacterium tuberculosis H37Rv
ggcgaccucggcggcg

SEQ ID NO: 3285419 - RNA, 23 nt, Mycobacterium tuberculosis H37Rv
ggcgaccucggguugcagcagca

SEQ ID NO: 3285420 - RNA, 15 nt, Mycobacterium tuberculosis H37Rv
ggcgaccugcggacc

SEQ ID NO: 3285421 - RNA, 14 nt, Mycobacterium tuberculosis H37Rv
ggcgaccugcucgc

SEQ ID NO: 3285422 - RNA, 20 nt, Mycobacterium tuberculosis H37Rv
ggcgaccuugacccgcaagu

SEQ ID NO: 3285423 - RNA, 16 nt, Mycobacterium tuberculosis H37Rv
ggcgacgaaccgccag

SEQ ID NO: 3285424 - RNA, 17 nt, Mycobacterium tuberculosis H37Rv
ggcgacgaaccgccaga

SEQ ID NO: 3285425 - RNA, 19 nt, Mycobacterium tuberculosis H37Rv
ggcgacgaaguccccguag

SEQ ID NO: 3285426 - RNA, 16 nt, Mycobacterium tuberculosis H37Rv
ggcgacgaccgucggc

SEQ ID NO: 3285427 - RNA, 18 nt, Mycobacterium tuberculosis H37Rv
ggcgacgacgacaccgcg

SEQ ID NO: 3285428 - RNA, 21 nt, Mycobacterium tuberculosis H37Rv
ggcgacgaggcaaugcgagca

SEQ ID NO: 3285429 - RNA, 19 nt, Mycobacterium tuberculosis H37Rv
ggcgacgaucucggcggcc

SEQ ID NO: 3285430 - RNA, 17 nt, Mycobacterium tuberculosis H37Rv
ggcgacgaugucgagcg

SEQ ID NO: 3285431 - RNA, 19 nt, Mycobacterium tuberculosis H37Rv
ggcgacgccgucuagcaca

SEQ ID NO: 3285432 - RNA, 14 nt, Mycobacterium tuberculosis H37Rv
ggcgacggccagcg

SEQ ID NO: 3285433 - RNA, 17 nt, Mycobacterium tuberculosis H37Rv
ggcgacggccagcgcgu

SEQ ID NO: 3285434 - RNA, 13 nt, Mycobacterium tuberculosis H37Rv
ggcgacggcgaug

SEQ ID NO: 3285435 - RNA, 17 nt, Mycobacterium tuberculosis H37Rv
ggcgacggcgucacccg

SEQ ID NO: 3285436 - RNA, 16 nt, Mycobacterium tuberculosis H37Rv
ggcgacgggucgggca

SEQ ID NO: 3285437 - RNA, 15 nt, Mycobacterium tuberculosis H37Rv
ggcgacggucgugau

SEQ ID NO: 3285438 - RNA, 20 nt, Mycobacterium tuberculosis H37Rv
ggcgacguagacgguccggu

SEQ ID NO: 3285439 - RNA, 22 nt, Mycobacterium tuberculosis H37Rv
ggcgacguauaccgcacccugg

SEQ ID NO: 3285440 - RNA, 16 nt, Mycobacterium tuberculosis H37Rv
ggcgacguuccgcucg

SEQ ID NO: 3285441 - RNA, 17 nt, Mycobacterium tuberculosis H37Rv
ggcgacguuccgcucga

SEQ ID NO: 3285442 - RNA, 22 nt, Mycobacterium tuberculosis H37Rv
ggcgacuacccagccagccgcg

SEQ ID NO: 3285443 - RNA, 15 nt, Mycobacterium tuberculosis H37Rv
ggcgacuaccggcuc

SEQ ID NO: 3285444 - RNA, 19 nt, Mycobacterium tuberculosis H37Rv
ggcgacucgaggaccugcu

SEQ ID NO: 3285445 - RNA, 21 nt, Mycobacterium tuberculosis H37Rv
ggcgacucgaggaccugcucg

SEQ ID NO: 3285446 - RNA, 22 nt, Mycobacterium tuberculosis H37Rv
ggcgacucgaggaccugcucgg

SEQ ID NO: 3285447 - RNA, 17 nt, Mycobacterium tuberculosis H37Rv
ggcgacucgugucugcc

SEQ ID NO: 3285448 - RNA, 18 nt, Mycobacterium tuberculosis H37Rv
ggcgacugcagcgaagcc

SEQ ID NO: 3285449 - RNA, 22 nt, Mycobacterium tuberculosis H37Rv
ggcgacugucccauacgugucg

SEQ ID NO: 3285450 - RNA, 15 nt, Mycobacterium tuberculosis H37Rv
ggcgacugucugguc

SEQ ID NO: 3285451 - RNA, 15 nt, Mycobacterium tuberculosis H37Rv
ggcgagaacaggauc

SEQ ID NO: 3285452 - RNA, 12 nt, Mycobacterium tuberculosis H37Rv
ggcgagaagcgu

SEQ ID NO: 3285453 - RNA, 16 nt, Mycobacterium tuberculosis H37Rv
ggcgagagcgcggaga

SEQ ID NO: 3285454 - RNA, 17 nt, Mycobacterium tuberculosis H37Rv
ggcgagcaacucgucca

SEQ ID NO: 3285455 - RNA, 18 nt, Mycobacterium tuberculosis H37Rv
ggcgagcaacucguccag

SEQ ID NO: 3285456 - RNA, 19 nt, Mycobacterium tuberculosis H37Rv
ggcgagcaacucguccagc

SEQ ID NO: 3285457 - RNA, 24 nt, Mycobacterium tuberculosis H37Rv
ggcgagcaacucguccagcagugc

SEQ ID NO: 3285458 - RNA, 22 nt, Mycobacterium tuberculosis H37Rv
ggcgagcaccaccccagcggcc

SEQ ID NO: 3285459 - RNA, 23 nt, Mycobacterium tuberculosis H37Rv
ggcgagcacccgcuggucgagca

SEQ ID NO: 3285460 - RNA, 18 nt, Mycobacterium tuberculosis H37Rv
ggcgagcaccgugcccug

SEQ ID NO: 3285461 - RNA, 14 nt, Mycobacterium tuberculosis H37Rv
ggcgagcagcaggu

SEQ ID NO: 3285462 - RNA, 16 nt, Mycobacterium tuberculosis H37Rv
ggcgagccgcucgcug

SEQ ID NO: 3285463 - RNA, 15 nt, Mycobacterium tuberculosis H37Rv
ggcgagccggcgcgc

SEQ ID NO: 3285464 - RNA, 22 nt, Mycobacterium tuberculosis H37Rv
ggcgagccucgcgcgccacggu

SEQ ID NO: 3285465 - RNA, 22 nt, Mycobacterium tuberculosis H37Rv
ggcgagcgccuuucggucacgc

SEQ ID NO: 3285466 - RNA, 12 nt, Mycobacterium tuberculosis H37Rv
ggcgagcgcgcc

SEQ ID NO: 3285467 - RNA, 13 nt, Mycobacterium tuberculosis H37Rv
ggcgagcgcggcc

SEQ ID NO: 3285468 - RNA, 15 nt, Mycobacterium tuberculosis H37Rv
ggcgagcggccucca

SEQ ID NO: 3285469 - RNA, 18 nt, Mycobacterium tuberculosis H37Rv
ggcgagcggccuccagca

SEQ ID NO: 3285470 - RNA, 17 nt, Mycobacterium tuberculosis H37Rv
ggcgagcguuuggacgg

SEQ ID NO: 3285471 - RNA, 22 nt, Mycobacterium tuberculosis H37Rv
ggcgagcucaacacgagcggua

SEQ ID NO: 3285472 - RNA, 22 nt, Mycobacterium tuberculosis H37Rv
ggcgagcucgacgaaugugagc

SEQ ID NO: 3285473 - RNA, 15 nt, Mycobacterium tuberculosis H37Rv
ggcgagcucgucgag

SEQ ID NO: 3285474 - RNA, 16 nt, Mycobacterium tuberculosis H37Rv
ggcgagcucgucgagc

SEQ ID NO: 3285475 - RNA, 17 nt, Mycobacterium tuberculosis H37Rv
ggcgagcucgucgagcg

SEQ ID NO: 3285476 - RNA, 23 nt, Mycobacterium tuberculosis H37Rv
ggcgagcuggcguucccgcucgg

SEQ ID NO: 3285477 - RNA, 16 nt, Mycobacterium tuberculosis H37Rv
ggcgaggacggcggcc

SEQ ID NO: 3285478 - RNA, 19 nt, Mycobacterium tuberculosis H37Rv
ggcgaggacggcggccagg

SEQ ID NO: 3285479 - RNA, 19 nt, Mycobacterium tuberculosis H37Rv
ggcgagggccacggcugcg

SEQ ID NO: 3285480 - RNA, 20 nt, Mycobacterium tuberculosis H37Rv
ggcgagggcuaccggcgccg

SEQ ID NO: 3285481 - RNA, 17 nt, Mycobacterium tuberculosis H37Rv
ggcgagggcugacggga

SEQ ID NO: 3285482 - RNA, 20 nt, Mycobacterium tuberculosis H37Rv
ggcgagggugaagacaccgg

SEQ ID NO: 3285483 - RNA, 24 nt, Mycobacterium tuberculosis H37Rv
ggcgagguauaaacgcggcgcgcu

SEQ ID NO: 3285484 - RNA, 13 nt, Mycobacterium tuberculosis H37Rv
ggcgagucaccgg

SEQ ID NO: 3285485 - RNA, 21 nt, Mycobacterium tuberculosis H37Rv
ggcgagucaccggguccaccg

SEQ ID NO: 3285486 - RNA, 22 nt, Mycobacterium tuberculosis H37Rv
ggcgagucgguugucggggccg

SEQ ID NO: 3285487 - RNA, 13 nt, Mycobacterium tuberculosis H37Rv
ggcgcagcgccag

SEQ ID NO: 3285488 - RNA, 15 nt, Mycobacterium tuberculosis H37Rv
ggcgcagcgccagcg

SEQ ID NO: 3285489 - RNA, 19 nt, Mycobacterium tuberculosis H37Rv
ggcgcagcgugagugcagc

SEQ ID NO: 3285490 - RNA, 13 nt, Mycobacterium tuberculosis H37Rv
ggcgcagcucacc

SEQ ID NO: 3285491 - RNA, 16 nt, Mycobacterium tuberculosis H37Rv
ggcgcagcucaccgac

SEQ ID NO: 3285492 - RNA, 17 nt, Mycobacterium tuberculosis H37Rv
ggcgcagcugccgagcg

SEQ ID NO: 3285493 - RNA, 20 nt, Mycobacterium tuberculosis H37Rv
ggcgcagcugguagcgcacc

SEQ ID NO: 3285494 - RNA, 20 nt, Mycobacterium tuberculosis H37Rv
ggcgcagcugguuugcggug

SEQ ID NO: 3285495 - RNA, 20 nt, Mycobacterium tuberculosis H37Rv
ggcgcagggacugugggggc

SEQ ID NO: 3285496 - RNA, 12 nt, Mycobacterium tuberculosis H37Rv
ggcgcagguaua

SEQ ID NO: 3285497 - RNA, 19 nt, Mycobacterium tuberculosis H37Rv
ggcgcaggucgcgcaguug

SEQ ID NO: 3285498 - RNA, 18 nt, Mycobacterium tuberculosis H37Rv
ggcgcagguucucggugc

SEQ ID NO: 3285499 - RNA, 21 nt, Mycobacterium tuberculosis H37Rv
ggcgcagguuggcaagcacgg

SEQ ID NO: 3285500 - RNA, 15 nt, Mycobacterium tuberculosis H37Rv
ggcgcaguagccgac

SEQ ID NO: 3285501 - RNA, 19 nt, Mycobacterium tuberculosis H37Rv
ggcgcaguuggcaccagcc

SEQ ID NO: 3285502 - RNA, 21 nt, Mycobacterium tuberculosis H37Rv
ggcgcaguuggcaccagccgg

SEQ ID NO: 3285503 - RNA, 16 nt, Mycobacterium tuberculosis H37Rv
ggcgcauaccggcguc

SEQ ID NO: 3285504 - RNA, 17 nt, Mycobacterium tuberculosis H37Rv
ggcgcauaccggcgucg

SEQ ID NO: 3285505 - RNA, 15 nt, Mycobacterium tuberculosis H37Rv
ggcgcauaggcggcc

SEQ ID NO: 3285506 - RNA, 18 nt, Mycobacterium tuberculosis H37Rv
ggcgcauaggcggccauc

SEQ ID NO: 3285507 - RNA, 16 nt, Mycobacterium tuberculosis H37Rv
ggcgcauagggccacc

SEQ ID NO: 3285508 - RNA, 18 nt, Mycobacterium tuberculosis H37Rv
ggcgcauagggccaccgc

SEQ ID NO: 3285509 - RNA, 19 nt, Mycobacterium tuberculosis H37Rv
ggcgcauuccggcgccagg

SEQ ID NO: 3285510 - RNA, 21 nt, Mycobacterium tuberculosis H37Rv
ggcgcauuccggcgccaggau

SEQ ID NO: 3285511 - RNA, 22 nt, Mycobacterium tuberculosis H37Rv
ggcgccacccgcgccgcccgcu

SEQ ID NO: 3285512 - RNA, 23 nt, Mycobacterium tuberculosis H37Rv
ggcgccacccgcgccgcccgcuc

SEQ ID NO: 3285513 - RNA, 21 nt, Mycobacterium tuberculosis H37Rv
ggcgccaccggcgccgcccgc

SEQ ID NO: 3285514 - RNA, 18 nt, Mycobacterium tuberculosis H37Rv
ggcgccaccguugccgaa

SEQ ID NO: 3285515 - RNA, 15 nt, Mycobacterium tuberculosis H37Rv
ggcgccacggcagcg

SEQ ID NO: 3285516 - RNA, 23 nt, Mycobacterium tuberculosis H37Rv
ggcgccacggcagcgcccagauc

SEQ ID NO: 3285517 - RNA, 13 nt, Mycobacterium tuberculosis H37Rv
ggcgccacggugu

SEQ ID NO: 3285518 - RNA, 18 nt, Mycobacterium tuberculosis H37Rv
ggcgccacugaccgcgau

SEQ ID NO: 3285519 - RNA, 23 nt, Mycobacterium tuberculosis H37Rv
ggcgccacugaccgcgaucgccg

SEQ ID NO: 3285520 - RNA, 17 nt, Mycobacterium tuberculosis H37Rv
ggcgccagaucgacgcc

SEQ ID NO: 3285521 - RNA, 14 nt, Mycobacterium tuberculosis H37Rv
ggcgccagcagauc

SEQ ID NO: 3285522 - RNA, 14 nt, Mycobacterium tuberculosis H37Rv
ggcgccagccccgc

SEQ ID NO: 3285523 - RNA, 12 nt, Mycobacterium tuberculosis H37Rv
ggcgccagcgcc

SEQ ID NO: 3285524 - RNA, 13 nt, Mycobacterium tuberculosis H37Rv
ggcgccagggccu

SEQ ID NO: 3285525 - RNA, 19 nt, Mycobacterium tuberculosis H37Rv
ggcgccaggucggcggacg

SEQ ID NO: 3285526 - RNA, 19 nt, Mycobacterium tuberculosis H37Rv
ggcgccagugcggucucga

SEQ ID NO: 3285527 - RNA, 23 nt, Mycobacterium tuberculosis H37Rv
ggcgccaguucggcgggagcugc

SEQ ID NO: 3285528 - RNA, 21 nt, Mycobacterium tuberculosis H37Rv
ggcgccaguucggcgggcgcg

SEQ ID NO: 3285529 - RNA, 19 nt, Mycobacterium tuberculosis H37Rv
ggcgccauggucgcugcgu

SEQ ID NO: 3285530 - RNA, 16 nt, Mycobacterium tuberculosis H37Rv
ggcgccauuugggccc

SEQ ID NO: 3285531 - RNA, 21 nt, Mycobacterium tuberculosis H37Rv
ggcgccauuugggcccauggc

SEQ ID NO: 3285532 - RNA, 14 nt, Mycobacterium tuberculosis H37Rv
ggcgcccagcgaca

SEQ ID NO: 3285533 - RNA, 13 nt, Mycobacterium tuberculosis H37Rv
ggcgcccagcucg

SEQ ID NO: 3285534 - RNA, 14 nt, Mycobacterium tuberculosis H37Rv
ggcgcccagcucgu

SEQ ID NO: 3285535 - RNA, 20 nt, Mycobacterium tuberculosis H37Rv
ggcgcccagcucgucgagcu

SEQ ID NO: 3285536 - RNA, 11 nt, Mycobacterium tuberculosis H37Rv
ggcgcccaggc

SEQ ID NO: 3285537 - RNA, 15 nt, Mycobacterium tuberculosis H37Rv
ggcgcccaggccgau

SEQ ID NO: 3285538 - RNA, 15 nt, Mycobacterium tuberculosis H37Rv
ggcgccccaccggcc

SEQ ID NO: 3285539 - RNA, 14 nt, Mycobacterium tuberculosis H37Rv
ggcgcccccgacga

SEQ ID NO: 3285540 - RNA, 15 nt, Mycobacterium tuberculosis H37Rv
ggcgcccccgacgac

SEQ ID NO: 3285541 - RNA, 17 nt, Mycobacterium tuberculosis H37Rv
ggcgcccccgacgacgg

SEQ ID NO: 3285542 - RNA, 22 nt, Mycobacterium tuberculosis H37Rv
ggcgcccccgacgacggcaccg

SEQ ID NO: 3285543 - RNA, 13 nt, Mycobacterium tuberculosis H37Rv
ggcgcccccgcca

SEQ ID NO: 3285544 - RNA, 14 nt, Mycobacterium tuberculosis H37Rv
ggcgcccccgccau

SEQ ID NO: 3285545 - RNA, 22 nt, Mycobacterium tuberculosis H37Rv
ggcgcccccgccauugccgccg

SEQ ID NO: 3285546 - RNA, 15 nt, Mycobacterium tuberculosis H37Rv
ggcgccccugucgac

SEQ ID NO: 3285547 - RNA, 16 nt, Mycobacterium tuberculosis H37Rv
ggcgcccgaagccggg

SEQ ID NO: 3285548 - RNA, 21 nt, Mycobacterium tuberculosis H37Rv
ggcgcccgaagccgggcccca

SEQ ID NO: 3285549 - RNA, 13 nt, Mycobacterium tuberculosis H37Rv
ggcgcccgcccga

SEQ ID NO: 3285550 - RNA, 20 nt, Mycobacterium tuberculosis H37Rv
ggcgcccgcccgagccgcug

SEQ ID NO: 3285551 - RNA, 12 nt, Mycobacterium tuberculosis H37Rv
ggcgcccgccgc

SEQ ID NO: 3285552 - RNA, 16 nt, Mycobacterium tuberculosis H37Rv
ggcgcccgccggcaac

SEQ ID NO: 3285553 - RNA, 14 nt, Mycobacterium tuberculosis H37Rv
ggcgcccgcggucc

SEQ ID NO: 3285554 - RNA, 13 nt, Mycobacterium tuberculosis H37Rv
ggcgcccgcucgg

SEQ ID NO: 3285555 - RNA, 16 nt, Mycobacterium tuberculosis H37Rv
ggcgcccgcucggccg

SEQ ID NO: 3285556 - RNA, 13 nt, Mycobacterium tuberculosis H37Rv
ggcgcccggccag

SEQ ID NO: 3285557 - RNA, 20 nt, Mycobacterium tuberculosis H37Rv
ggcgcccggccaggucgaca

SEQ ID NO: 3285558 - RNA, 14 nt, Mycobacterium tuberculosis H37Rv
ggcgcccggcggau

SEQ ID NO: 3285559 - RNA, 15 nt, Mycobacterium tuberculosis H37Rv
ggcgcccggcggauc

SEQ ID NO: 3285560 - RNA, 20 nt, Mycobacterium tuberculosis H37Rv
ggcgcccgggaucgggucac

SEQ ID NO: 3285561 - RNA, 15 nt, Mycobacterium tuberculosis H37Rv
ggcgcccgugccgcc

SEQ ID NO: 3285562 - RNA, 18 nt, Mycobacterium tuberculosis H37Rv
ggcgcccgugccgcccgc

SEQ ID NO: 3285563 - RNA, 12 nt, Mycobacterium tuberculosis H37Rv
ggcgcccugcgc

SEQ ID NO: 3285564 - RNA, 20 nt, Mycobacterium tuberculosis H37Rv
ggcgcccuuaagccggcgcg

SEQ ID NO: 3285565 - RNA, 23 nt, Mycobacterium tuberculosis H37Rv
ggcgcccuuaagccggcgcggcg

SEQ ID NO: 3285566 - RNA, 18 nt, Mycobacterium tuberculosis H37Rv
ggcgcccuugccggcgag

SEQ ID NO: 3285567 - RNA, 20 nt, Mycobacterium tuberculosis H37Rv
ggcgccgaaaccgccgggau

SEQ ID NO: 3285568 - RNA, 18 nt, Mycobacterium tuberculosis H37Rv
ggcgccgaacaccggcuc

SEQ ID NO: 3285569 - RNA, 17 nt, Mycobacterium tuberculosis H37Rv
ggcgccgaaccagcgau

SEQ ID NO: 3285570 - RNA, 13 nt, Mycobacterium tuberculosis H37Rv
ggcgccgaaguag

SEQ ID NO: 3285571 - RNA, 19 nt, Mycobacterium tuberculosis H37Rv
ggcgccgaaguagccgacc

SEQ ID NO: 3285572 - RNA, 20 nt, Mycobacterium tuberculosis H37Rv
ggcgccgacaccggcugacc

SEQ ID NO: 3285573 - RNA, 23 nt, Mycobacterium tuberculosis H37Rv
ggcgccgacaccggcugaccgac

SEQ ID NO: 3285574 - RNA, 22 nt, Mycobacterium tuberculosis H37Rv
ggcgccgacgacuccggcaagc

SEQ ID NO: 3285575 - RNA, 18 nt, Mycobacterium tuberculosis H37Rv
ggcgccgauaccggcggc

SEQ ID NO: 3285576 - RNA, 19 nt, Mycobacterium tuberculosis H37Rv
ggcgccgauaccggcggcg

SEQ ID NO: 3285577 - RNA, 13 nt, Mycobacterium tuberculosis H37Rv
ggcgccgaucacg

SEQ ID NO: 3285578 - RNA, 21 nt, Mycobacterium tuberculosis H37Rv
ggcgccgaugaccgcaaccgg

SEQ ID NO: 3285579 - RNA, 19 nt, Mycobacterium tuberculosis H37Rv
ggcgccgaugccggccaag

SEQ ID NO: 3285580 - RNA, 21 nt, Mycobacterium tuberculosis H37Rv
ggcgccgauuuugggaucgug

SEQ ID NO: 3285581 - RNA, 13 nt, Mycobacterium tuberculosis H37Rv
ggcgccgcaaccg

SEQ ID NO: 3285582 - RNA, 21 nt, Mycobacterium tuberculosis H37Rv
ggcgccgcaaucagacggcga

SEQ ID NO: 3285583 - RNA, 15 nt, Mycobacterium tuberculosis H37Rv
ggcgcgcgacgagca

SEQ ID NO: 3285584 - RNA, 14 nt, Mycobacterium tuberculosis H37Rv
ggcgcgcgcgccgg

SEQ ID NO: 3285585 - RNA, 19 nt, Mycobacterium tuberculosis H37Rv
ggcgcgcgcgccggcugcc

SEQ ID NO: 3285586 - RNA, 14 nt, Mycobacterium tuberculosis H37Rv
ggcgcgcggcgagc

SEQ ID NO: 3285587 - RNA, 15 nt, Mycobacterium tuberculosis H37Rv
ggcgcgcggcgagcc

SEQ ID NO: 3285588 - RNA, 13 nt, Mycobacterium tuberculosis H37Rv
ggcgcgcggcgcc

SEQ ID NO: 3285589 - RNA, 14 nt, Mycobacterium tuberculosis H37Rv
ggcgcgcggcgccg

SEQ ID NO: 3285590 - RNA, 15 nt, Mycobacterium tuberculosis H37Rv
ggcgcgcggggccuc

SEQ ID NO: 3285591 - RNA, 21 nt, Mycobacterium tuberculosis H37Rv
ggcgcgcggguugucggcgac

SEQ ID NO: 3285592 - RNA, 14 nt, Mycobacterium tuberculosis H37Rv
ggcgcgcucaucga

SEQ ID NO: 3285593 - RNA, 13 nt, Mycobacterium tuberculosis H37Rv
ggcgcgcucggcc

SEQ ID NO: 3285594 - RNA, 14 nt, Mycobacterium tuberculosis H37Rv
ggcgcgcucggccg

SEQ ID NO: 3285595 - RNA, 19 nt, Mycobacterium tuberculosis H37Rv
ggcgcgcugcacggaaucg

SEQ ID NO: 3285596 - RNA, 16 nt, Mycobacterium tuberculosis H37Rv
ggcgcgcugcccacgg

SEQ ID NO: 3285597 - RNA, 21 nt, Mycobacterium tuberculosis H37Rv
ggcgcggauacgggcagugaa

SEQ ID NO: 3285598 - RNA, 19 nt, Mycobacterium tuberculosis H37Rv
ggcgcggcacccggucggc

SEQ ID NO: 3285599 - RNA, 20 nt, Mycobacterium tuberculosis H37Rv
ggcgcggcacccggucggcc

SEQ ID NO: 3285600 - RNA, 21 nt, Mycobacterium tuberculosis H37Rv
ggcgcggcacccggucggcca

SEQ ID NO: 3285601 - RNA, 23 nt, Mycobacterium tuberculosis H37Rv
ggcgcggcacccggucggccauc

SEQ ID NO: 3285602 - RNA, 15 nt, Mycobacterium tuberculosis H37Rv
ggcgcggcccaccuc

SEQ ID NO: 3285603 - RNA, 15 nt, Mycobacterium tuberculosis H37Rv
ggcgcggccgcagcc

SEQ ID NO: 3285604 - RNA, 18 nt, Mycobacterium tuberculosis H37Rv
ggcgcggccgcagccagc

SEQ ID NO: 3285605 - RNA, 19 nt, Mycobacterium tuberculosis H37Rv
ggcgcggccgcagccagca

SEQ ID NO: 3285606 - RNA, 13 nt, Mycobacterium tuberculosis H37Rv
ggcgcggcgagca

SEQ ID NO: 3285607 - RNA, 22 nt, Mycobacterium tuberculosis H37Rv
ggcgcggcgagcacgcgggcac

SEQ ID NO: 3285608 - RNA, 14 nt, Mycobacterium tuberculosis H37Rv
ggcgcggcggaccg

SEQ ID NO: 3285609 - RNA, 20 nt, Mycobacterium tuberculosis H37Rv
ggcgcggcggaccguccgac

SEQ ID NO: 3285610 - RNA, 12 nt, Mycobacterium tuberculosis H37Rv
ggcgcggcggcg

SEQ ID NO: 3285611 - RNA, 14 nt, Mycobacterium tuberculosis H37Rv
ggcgcggcggcguc

SEQ ID NO: 3285612 - RNA, 22 nt, Mycobacterium tuberculosis H37Rv
ggcgcggcggcgucgagggagc

SEQ ID NO: 3285613 - RNA, 16 nt, Mycobacterium tuberculosis H37Rv
ggcgcgggcaggucgu

SEQ ID NO: 3285614 - RNA, 14 nt, Mycobacterium tuberculosis H37Rv
ggcgcgggccggcg

SEQ ID NO: 3285615 - RNA, 15 nt, Mycobacterium tuberculosis H37Rv
ggcgcgggcgacguc

SEQ ID NO: 3285616 - RNA, 15 nt, Mycobacterium tuberculosis H37Rv
ggcgcgggcgccggg

SEQ ID NO: 3285617 - RNA, 23 nt, Mycobacterium tuberculosis H37Rv
ggcgcggggcggccugcccgccg

SEQ ID NO: 3285618 - RNA, 16 nt, Mycobacterium tuberculosis H37Rv
ggcgcgggucggcgac

SEQ ID NO: 3285619 - RNA, 17 nt, Mycobacterium tuberculosis H37Rv
ggcgcgggucggcgacc

SEQ ID NO: 3285620 - RNA, 17 nt, Mycobacterium tuberculosis H37Rv
ggcgcgggugaccaggc

SEQ ID NO: 3285621 - RNA, 21 nt, Mycobacterium tuberculosis H37Rv
ggcgcgggugaccaggcggcg

SEQ ID NO: 3285622 - RNA, 16 nt, Mycobacterium tuberculosis H37Rv
ggcgcgggugcggauc

SEQ ID NO: 3285623 - RNA, 21 nt, Mycobacterium tuberculosis H37Rv
ggcgcggguggcgccaguucg

SEQ ID NO: 3285624 - RNA, 13 nt, Mycobacterium tuberculosis H37Rv
ggcgcggucgacc

SEQ ID NO: 3285625 - RNA, 16 nt, Mycobacterium tuberculosis H37Rv
ggcgcggugcgcucac

SEQ ID NO: 3285626 - RNA, 19 nt, Mycobacterium tuberculosis H37Rv
ggcgcggugcgcucacugg

SEQ ID NO: 3285627 - RNA, 18 nt, Mycobacterium tuberculosis H37Rv
ggcgcgguucgucggcga

SEQ ID NO: 3285628 - RNA, 17 nt, Mycobacterium tuberculosis H37Rv
ggcgcgguuucggcguc

SEQ ID NO: 3285629 - RNA, 23 nt, Mycobacterium tuberculosis H37Rv
ggcgcgguuucggcgucaccgug

SEQ ID NO: 3285630 - RNA, 18 nt, Mycobacterium tuberculosis H37Rv
ggcgcguccgggcucgcg

SEQ ID NO: 3285631 - RNA, 15 nt, Mycobacterium tuberculosis H37Rv
ggcgcguccucgccg

SEQ ID NO: 3285632 - RNA, 14 nt, Mycobacterium tuberculosis H37Rv
ggcgcgucggcacc

SEQ ID NO: 3285633 - RNA, 17 nt, Mycobacterium tuberculosis H37Rv
ggcgcgucggcguuggg

SEQ ID NO: 3285634 - RNA, 18 nt, Mycobacterium tuberculosis H37Rv
ggcgcgugcagcggcgcc

SEQ ID NO: 3285635 - RNA, 17 nt, Mycobacterium tuberculosis H37Rv
ggcgcguggucgggaac

SEQ ID NO: 3285636 - RNA, 20 nt, Mycobacterium tuberculosis H37Rv
ggcgcguucgucgucgcuga

SEQ ID NO: 3285637 - RNA, 20 nt, Mycobacterium tuberculosis H37Rv
ggcgcguugcguaucgaccc

SEQ ID NO: 3285638 - RNA, 17 nt, Mycobacterium tuberculosis H37Rv
ggcgcuaaaacgccagu

SEQ ID NO: 3285639 - RNA, 23 nt, Mycobacterium tuberculosis H37Rv
ggcgcuaaaacgccagucgagca

SEQ ID NO: 3285640 - RNA, 13 nt, Mycobacterium tuberculosis H37Rv
ggcgcuaccagcc

SEQ ID NO: 3285641 - RNA, 23 nt, Mycobacterium tuberculosis H37Rv
ggcgcuaccuguguugagcggca

SEQ ID NO: 3285642 - RNA, 17 nt, Mycobacterium tuberculosis H37Rv
ggcgcuagccagggauc

SEQ ID NO: 3285643 - RNA, 22 nt, Mycobacterium tuberculosis H37Rv
ggcgcuagccagggaucagccg

SEQ ID NO: 3285644 - RNA, 13 nt, Mycobacterium tuberculosis H37Rv
ggcgcuagcgccg

SEQ ID NO: 3285645 - RNA, 14 nt, Mycobacterium tuberculosis H37Rv
ggcgcuagcugcug

SEQ ID NO: 3285646 - RNA, 15 nt, Mycobacterium tuberculosis H37Rv
ggcgcuaggaacgcc

SEQ ID NO: 3285647 - RNA, 16 nt, Mycobacterium tuberculosis H37Rv
ggcgcuaggaacgcca

SEQ ID NO: 3285648 - RNA, 19 nt, Mycobacterium tuberculosis H37Rv
ggcgcucacaauggcucug

SEQ ID NO: 3285649 - RNA, 18 nt, Mycobacterium tuberculosis H37Rv
ggcgcucacccgccgcgg

SEQ ID NO: 3285650 - RNA, 14 nt, Mycobacterium tuberculosis H37Rv
ggcgcucagcgcgg

SEQ ID NO: 3285651 - RNA, 19 nt, Mycobacterium tuberculosis H37Rv
ggcgcucagcgcggccacg

SEQ ID NO: 3285652 - RNA, 20 nt, Mycobacterium tuberculosis H37Rv
ggcgcucauaggccggcggu

SEQ ID NO: 3285653 - RNA, 14 nt, Mycobacterium tuberculosis H37Rv
ggcgcucaucgcgu

SEQ ID NO: 3285654 - RNA, 19 nt, Mycobacterium tuberculosis H37Rv
ggcgcucccgccggcagcg

SEQ ID NO: 3285655 - RNA, 21 nt, Mycobacterium tuberculosis H37Rv
ggcgcucccgccggcagcguc

SEQ ID NO: 3285656 - RNA, 23 nt, Mycobacterium tuberculosis H37Rv
ggcgcucccgccggcagcgucgg

SEQ ID NO: 3285657 - RNA, 13 nt, Mycobacterium tuberculosis H37Rv
ggcgcuccuucag

SEQ ID NO: 3285658 - RNA, 18 nt, Mycobacterium tuberculosis H37Rv
ggcgcucgcaucaucgga

SEQ ID NO: 3285659 - RNA, 13 nt, Mycobacterium tuberculosis H37Rv
ggcgcucgcgcgc

SEQ ID NO: 3285660 - RNA, 17 nt, Mycobacterium tuberculosis H37Rv
ggcgcucgcgcgcuggg

SEQ ID NO: 3285661 - RNA, 21 nt, Mycobacterium tuberculosis H37Rv
ggcgcucgcgcgcugggcgcg

SEQ ID NO: 3285662 - RNA, 17 nt, Mycobacterium tuberculosis H37Rv
ggcgcucggcgagcuca

SEQ ID NO: 3285663 - RNA, 16 nt, Mycobacterium tuberculosis H37Rv
ggcgcugaacgcgagc

SEQ ID NO: 3285664 - RNA, 20 nt, Mycobacterium tuberculosis H37Rv
ggcgcugaacgcgagcaaca

SEQ ID NO: 3285665 - RNA, 22 nt, Mycobacterium tuberculosis H37Rv
ggcgcugaagccgacgauccac

SEQ ID NO: 3285666 - RNA, 22 nt, Mycobacterium tuberculosis H37Rv
ggcgcugaaugcuugcgcagca

SEQ ID NO: 3285667 - RNA, 18 nt, Mycobacterium tuberculosis H37Rv
ggcgcugaucggcagggu

SEQ ID NO: 3285668 - RNA, 12 nt, Mycobacterium tuberculosis H37Rv
ggcgcugcagca

SEQ ID NO: 3285669 - RNA, 11 nt, Mycobacterium tuberculosis H37Rv
ggcgcugccaa

SEQ ID NO: 3285670 - RNA, 14 nt, Mycobacterium tuberculosis H37Rv
ggcgcugccgggau

SEQ ID NO: 3285671 - RNA, 15 nt, Mycobacterium tuberculosis H37Rv
ggcgcugccgggauc

SEQ ID NO: 3285672 - RNA, 21 nt, Mycobacterium tuberculosis H37Rv
ggcgcugcgcaccgccgcgcg

SEQ ID NO: 3285673 - RNA, 14 nt, Mycobacterium tuberculosis H37Rv
ggcgcugcgcgauc

SEQ ID NO: 3285674 - RNA, 19 nt, Mycobacterium tuberculosis H37Rv
ggcgcugcgcgcgauccac

SEQ ID NO: 3285675 - RNA, 12 nt, Mycobacterium tuberculosis H37Rv
ggcgcugcuggc

SEQ ID NO: 3285676 - RNA, 15 nt, Mycobacterium tuberculosis H37Rv
ggcgcugcuggcaga

SEQ ID NO: 3285677 - RNA, 16 nt, Mycobacterium tuberculosis H37Rv
ggcgcuggacggcggg

SEQ ID NO: 3285678 - RNA, 14 nt, Mycobacterium tuberculosis H37Rv
ggcgcuggccagca

SEQ ID NO: 3285679 - RNA, 17 nt, Mycobacterium tuberculosis H37Rv
ggcgcugggacggucgc

SEQ ID NO: 3285680 - RNA, 12 nt, Mycobacterium tuberculosis H37Rv
ggcggccgagcg

SEQ ID NO: 3285681 - RNA, 16 nt, Mycobacterium tuberculosis H37Rv
ggcggccgagcgcacc

SEQ ID NO: 3285682 - RNA, 15 nt, Mycobacterium tuberculosis H37Rv
ggcggccgcagcggc

SEQ ID NO: 3285683 - RNA, 16 nt, Mycobacterium tuberculosis H37Rv
ggcggccgcagcggcc

SEQ ID NO: 3285684 - RNA, 19 nt, Mycobacterium tuberculosis H37Rv
ggcggccgccaucagccgc

SEQ ID NO: 3285685 - RNA, 23 nt, Mycobacterium tuberculosis H37Rv
ggcggccgcgaccagcgccgcac

SEQ ID NO: 3285686 - RNA, 19 nt, Mycobacterium tuberculosis H37Rv
ggcggccgcgucgucgaga

SEQ ID NO: 3285687 - RNA, 16 nt, Mycobacterium tuberculosis H37Rv
ggcggccgggcucccc

SEQ ID NO: 3285688 - RNA, 15 nt, Mycobacterium tuberculosis H37Rv
ggcggccggguagca

SEQ ID NO: 3285689 - RNA, 15 nt, Mycobacterium tuberculosis H37Rv
ggcggccgucaccgg

SEQ ID NO: 3285690 - RNA, 19 nt, Mycobacterium tuberculosis H37Rv
ggcggccuaacucgccugc

SEQ ID NO: 3285691 - RNA, 20 nt, Mycobacterium tuberculosis H37Rv
ggcggccucccgggccgccg

SEQ ID NO: 3285692 - RNA, 11 nt, Mycobacterium tuberculosis H37Rv
ggcggccuccg

SEQ ID NO: 3285693 - RNA, 15 nt, Mycobacterium tuberculosis H37Rv
ggcggccuccucccc

SEQ ID NO: 3285694 - RNA, 15 nt, Mycobacterium tuberculosis H37Rv
ggcggccucgcugcu

SEQ ID NO: 3285695 - RNA, 15 nt, Mycobacterium tuberculosis H37Rv
ggcggccucggucug

SEQ ID NO: 3285696 - RNA, 17 nt, Mycobacterium tuberculosis H37Rv
ggcggccugcccgccgu

SEQ ID NO: 3285697 - RNA, 14 nt, Mycobacterium tuberculosis H37Rv
ggcggccuggcacc

SEQ ID NO: 3285698 - RNA, 19 nt, Mycobacterium tuberculosis H37Rv
ggcggccuucggccggcgu

SEQ ID NO: 3285699 - RNA, 21 nt, Mycobacterium tuberculosis H37Rv
ggcggccuugcgggcucucgg

SEQ ID NO: 3285700 - RNA, 22 nt, Mycobacterium tuberculosis H37Rv
ggcggcgaagaagccggcaagc

SEQ ID NO: 3285701 - RNA, 21 nt, Mycobacterium tuberculosis H37Rv
ggcggcgacacgccaggugau

SEQ ID NO: 3285702 - RNA, 20 nt, Mycobacterium tuberculosis H37Rv
ggcggcgaccagcucagcug

SEQ ID NO: 3285703 - RNA, 20 nt, Mycobacterium tuberculosis H37Rv
ggcggcgacgaccgucggcu

SEQ ID NO: 3285704 - RNA, 18 nt, Mycobacterium tuberculosis H37Rv
ggcggcgagaaucccggg

SEQ ID NO: 3285705 - RNA, 20 nt, Mycobacterium tuberculosis H37Rv
ggcggcgaggcgagucaccg

SEQ ID NO: 3285706 - RNA, 20 nt, Mycobacterium tuberculosis H37Rv
ggcggcgaucaacucgggca

SEQ ID NO: 3285707 - RNA, 22 nt, Mycobacterium tuberculosis H37Rv
ggcggcgaucaacucgggcagc

SEQ ID NO: 3285708 - RNA, 22 nt, Mycobacterium tuberculosis H37Rv
ggcggcgauccggucgggggcg

SEQ ID NO: 3285709 - RNA, 14 nt, Mycobacterium tuberculosis H37Rv
ggcggcgaugaccg

SEQ ID NO: 3285710 - RNA, 23 nt, Mycobacterium tuberculosis H37Rv
ggcggcgaugggcuacuugguca

SEQ ID NO: 3285711 - RNA, 13 nt, Mycobacterium tuberculosis H37Rv
ggcggcgccgcag

SEQ ID NO: 3285712 - RNA, 14 nt, Mycobacterium tuberculosis H37Rv
ggcggcgccgcaga

SEQ ID NO: 3285713 - RNA, 13 nt, Mycobacterium tuberculosis H37Rv
ggcggcgccggcg

SEQ ID NO: 3285714 - RNA, 22 nt, Mycobacterium tuberculosis H37Rv
ggcggcgccggggggcugcugc

SEQ ID NO: 3285715 - RNA, 17 nt, Mycobacterium tuberculosis H37Rv
ggcggcgcgaucgacgc

SEQ ID NO: 3285716 - RNA, 14 nt, Mycobacterium tuberculosis H37Rv
ggcggcgcgcgcug

SEQ ID NO: 3285717 - RNA, 20 nt, Mycobacterium tuberculosis H37Rv
ggcggcgcguucgucgucgc

SEQ ID NO: 3285718 - RNA, 12 nt, Mycobacterium tuberculosis H37Rv
ggcggcgcucgu

SEQ ID NO: 3285719 - RNA, 14 nt, Mycobacterium tuberculosis H37Rv
ggcggcgcucgucg

SEQ ID NO: 3285720 - RNA, 16 nt, Mycobacterium tuberculosis H37Rv
ggcggcgcugcagcug

SEQ ID NO: 3285721 - RNA, 14 nt, Mycobacterium tuberculosis H37Rv
ggcggcgcugcgcg

SEQ ID NO: 3285722 - RNA, 22 nt, Mycobacterium tuberculosis H37Rv
ggcggcggacccgcucgcggcg

SEQ ID NO: 3285723 - RNA, 14 nt, Mycobacterium tuberculosis H37Rv
ggcggcggaggcug

SEQ ID NO: 3285724 - RNA, 18 nt, Mycobacterium tuberculosis H37Rv
ggcggcggaggcugggcu

SEQ ID NO: 3285725 - RNA, 13 nt, Mycobacterium tuberculosis H37Rv
ggcggcggcaagu

SEQ ID NO: 3285726 - RNA, 13 nt, Mycobacterium tuberculosis H37Rv
ggcggcggcacgc

SEQ ID NO: 3285727 - RNA, 23 nt, Mycobacterium tuberculosis H37Rv
ggcggcggccauagugaggccga

SEQ ID NO: 3285728 - RNA, 18 nt, Mycobacterium tuberculosis H37Rv
ggcggcgggccucggcga

SEQ ID NO: 3285729 - RNA, 18 nt, Mycobacterium tuberculosis H37Rv
ggcggcgggggcggcggc

SEQ ID NO: 3285730 - RNA, 19 nt, Mycobacterium tuberculosis H37Rv
ggcggcgggggcggcggcu

SEQ ID NO: 3285731 - RNA, 13 nt, Mycobacterium tuberculosis H37Rv
ggcggcgguccgc

SEQ ID NO: 3285732 - RNA, 15 nt, Mycobacterium tuberculosis H37Rv
ggcggcggucgagcu

SEQ ID NO: 3285733 - RNA, 16 nt, Mycobacterium tuberculosis H37Rv
ggcggcggucggcugg

SEQ ID NO: 3285734 - RNA, 16 nt, Mycobacterium tuberculosis H37Rv
ggcggcggugccacga

SEQ ID NO: 3285735 - RNA, 13 nt, Mycobacterium tuberculosis H37Rv
ggcggcgguggcg

SEQ ID NO: 3285736 - RNA, 16 nt, Mycobacterium tuberculosis H37Rv
ggcggcgguggcguua

SEQ ID NO: 3285737 - RNA, 14 nt, Mycobacterium tuberculosis H37Rv
ggcggcggugggcg

SEQ ID NO: 3285738 - RNA, 22 nt, Mycobacterium tuberculosis H37Rv
ggcggcggugguaccggcgcca

SEQ ID NO: 3285739 - RNA, 13 nt, Mycobacterium tuberculosis H37Rv
ggcggcguccagc

SEQ ID NO: 3285740 - RNA, 13 nt, Mycobacterium tuberculosis H37Rv
ggcggcgucgaca

SEQ ID NO: 3285741 - RNA, 14 nt, Mycobacterium tuberculosis H37Rv
ggcggcgucgacgg

SEQ ID NO: 3285742 - RNA, 17 nt, Mycobacterium tuberculosis H37Rv
ggcggcgucgacggcuc

SEQ ID NO: 3285743 - RNA, 18 nt, Mycobacterium tuberculosis H37Rv
ggcggcgucgacggcucc

SEQ ID NO: 3285744 - RNA, 21 nt, Mycobacterium tuberculosis H37Rv
ggcggcgucgacggcuccucc

SEQ ID NO: 3285745 - RNA, 14 nt, Mycobacterium tuberculosis H37Rv
ggcggcgucgagca

SEQ ID NO: 3285746 - RNA, 11 nt, Mycobacterium tuberculosis H37Rv
ggcggcgucgc

SEQ ID NO: 3285747 - RNA, 17 nt, Mycobacterium tuberculosis H37Rv
ggcggcgugaagugagc

SEQ ID NO: 3285748 - RNA, 18 nt, Mycobacterium tuberculosis H37Rv
ggcggcgugguauccgcc

SEQ ID NO: 3285749 - RNA, 22 nt, Mycobacterium tuberculosis H37Rv
ggcggcgugguuuugucgacgu

SEQ ID NO: 3285750 - RNA, 17 nt, Mycobacterium tuberculosis H37Rv
ggcggcuacuccaacug

SEQ ID NO: 3285751 - RNA, 23 nt, Mycobacterium tuberculosis H37Rv
ggcggcuaggcaccagcggaucg

SEQ ID NO: 3285752 - RNA, 12 nt, Mycobacterium tuberculosis H37Rv
ggcggcuccacc

SEQ ID NO: 3285753 - RNA, 22 nt, Mycobacterium tuberculosis H37Rv
ggcggcuccaccgggcccgccg

SEQ ID NO: 3285754 - RNA, 21 nt, Mycobacterium tuberculosis H37Rv
ggcggcuccgcccggcguguc

SEQ ID NO: 3285755 - RNA, 14 nt, Mycobacterium tuberculosis H37Rv
ggcggcucgggugc

SEQ ID NO: 3285756 - RNA, 18 nt, Mycobacterium tuberculosis H37Rv
ggcggcucuagaucgccg

SEQ ID NO: 3285757 - RNA, 19 nt, Mycobacterium tuberculosis H37Rv
ggcggcucuagaucgccga

SEQ ID NO: 3285758 - RNA, 18 nt, Mycobacterium tuberculosis H37Rv
ggcggcugcagccgaccg

SEQ ID NO: 3285759 - RNA, 14 nt, Mycobacterium tuberculosis H37Rv
ggcggcugcgggcc

SEQ ID NO: 3285760 - RNA, 21 nt, Mycobacterium tuberculosis H37Rv
ggcggcuuagaacgugcuggu

SEQ ID NO: 3285761 - RNA, 15 nt, Mycobacterium tuberculosis H37Rv
ggcggcuuccucgag

SEQ ID NO: 3285762 - RNA, 21 nt, Mycobacterium tuberculosis H37Rv
ggcggcuuggccgccccggcc

SEQ ID NO: 3285763 - RNA, 17 nt, Mycobacterium tuberculosis H37Rv
ggcggcuuuggccgccg

SEQ ID NO: 3285764 - RNA, 20 nt, Mycobacterium tuberculosis H37Rv
ggcgggaacccuugccacga

SEQ ID NO: 3285765 - RNA, 16 nt, Mycobacterium tuberculosis H37Rv
ggcgggaacgggcaaa

SEQ ID NO: 3285766 - RNA, 22 nt, Mycobacterium tuberculosis H37Rv
ggcgggacccgugagcucgucg

SEQ ID NO: 3285767 - RNA, 14 nt, Mycobacterium tuberculosis H37Rv
ggcgggacucggcg

SEQ ID NO: 3285768 - RNA, 16 nt, Mycobacterium tuberculosis H37Rv
ggcgggacucggcgag

SEQ ID NO: 3285769 - RNA, 16 nt, Mycobacterium tuberculosis H37Rv
ggcgggagcgugggcg

SEQ ID NO: 3285770 - RNA, 14 nt, Mycobacterium tuberculosis H37Rv
ggcgggagcugccg

SEQ ID NO: 3285771 - RNA, 16 nt, Mycobacterium tuberculosis H37Rv
ggcgggagucgucgag

SEQ ID NO: 3285772 - RNA, 17 nt, Mycobacterium tuberculosis H37Rv
ggcgggagucgucgagc

SEQ ID NO: 3285773 - RNA, 23 nt, Mycobacterium tuberculosis H37Rv
ggcgggauauagccggugucugg

SEQ ID NO: 3285774 - RNA, 21 nt, Mycobacterium tuberculosis H37Rv
ggcgggaucgagagccgaccg

SEQ ID NO: 3285775 - RNA, 15 nt, Mycobacterium tuberculosis H37Rv
ggcgggaugcagcug

SEQ ID NO: 3285776 - RNA, 15 nt, Mycobacterium tuberculosis H37Rv
ggcguacaccagggu

SEQ ID NO: 3285777 - RNA, 13 nt, Mycobacterium tuberculosis H37Rv
ggcguacagcgcc

SEQ ID NO: 3285778 - RNA, 15 nt, Mycobacterium tuberculosis H37Rv
ggcguaccagcuggc

SEQ ID NO: 3285779 - RNA, 23 nt, Mycobacterium tuberculosis H37Rv
ggcguacccguuaugcgccgccc

SEQ ID NO: 3285780 - RNA, 21 nt, Mycobacterium tuberculosis H37Rv
ggcguagacguccgcggucgc

SEQ ID NO: 3285781 - RNA, 15 nt, Mycobacterium tuberculosis H37Rv
ggcguagcgagcggg

SEQ ID NO: 3285782 - RNA, 22 nt, Mycobacterium tuberculosis H37Rv
ggcguaggcaggaucgccugag

SEQ ID NO: 3285783 - RNA, 24 nt, Mycobacterium tuberculosis H37Rv
ggcguaggcaggaucgccugagcg

SEQ ID NO: 3285784 - RNA, 15 nt, Mycobacterium tuberculosis H37Rv
ggcguagggcugucc

SEQ ID NO: 3285785 - RNA, 19 nt, Mycobacterium tuberculosis H37Rv
ggcguagucgcugucggca

SEQ ID NO: 3285786 - RNA, 14 nt, Mycobacterium tuberculosis H37Rv
ggcguagugcagcu

SEQ ID NO: 3285787 - RNA, 16 nt, Mycobacterium tuberculosis H37Rv
ggcguagugcucgccg

SEQ ID NO: 3285788 - RNA, 22 nt, Mycobacterium tuberculosis H37Rv
ggcguauccuugcgacguucuu

SEQ ID NO: 3285789 - RNA, 16 nt, Mycobacterium tuberculosis H37Rv
ggcguauucggugcac

SEQ ID NO: 3285790 - RNA, 16 nt, Mycobacterium tuberculosis H37Rv
ggcgucaaauccagcg

SEQ ID NO: 3285791 - RNA, 23 nt, Mycobacterium tuberculosis H37Rv
ggcgucaagcaaguccaccggau

SEQ ID NO: 3285792 - RNA, 14 nt, Mycobacterium tuberculosis H37Rv
ggcgucaccccggu

SEQ ID NO: 3285793 - RNA, 15 nt, Mycobacterium tuberculosis H37Rv
ggcgucaccgccggu

SEQ ID NO: 3285794 - RNA, 18 nt, Mycobacterium tuberculosis H37Rv
ggcgucacguaauucccc

SEQ ID NO: 3285795 - RNA, 14 nt, Mycobacterium tuberculosis H37Rv
ggcgucagcagcaa

SEQ ID NO: 3285796 - RNA, 19 nt, Mycobacterium tuberculosis H37Rv
ggcgucaggcacaacgcga

SEQ ID NO: 3285797 - RNA, 22 nt, Mycobacterium tuberculosis H37Rv
ggcgucaggcacaacgcgacgc

SEQ ID NO: 3285798 - RNA, 22 nt, Mycobacterium tuberculosis H37Rv
ggcgucaggccagagucgcccg

SEQ ID NO: 3285799 - RNA, 23 nt, Mycobacterium tuberculosis H37Rv
ggcgucagugcagaagacaagug

SEQ ID NO: 3285800 - RNA, 19 nt, Mycobacterium tuberculosis H37Rv
ggcgucaugaugucgacau

SEQ ID NO: 3285801 - RNA, 24 nt, Mycobacterium tuberculosis H37Rv
ggcguccaccugcuccgcugucac

SEQ ID NO: 3285802 - RNA, 15 nt, Mycobacterium tuberculosis H37Rv
ggcguccacgcugac

SEQ ID NO: 3285803 - RNA, 23 nt, Mycobacterium tuberculosis H37Rv
ggcguccagaagaagaugaucgc

SEQ ID NO: 3285804 - RNA, 15 nt, Mycobacterium tuberculosis H37Rv
ggcguccaggcagcg

SEQ ID NO: 3285805 - RNA, 15 nt, Mycobacterium tuberculosis H37Rv
ggcguccaucagaga

SEQ ID NO: 3285806 - RNA, 14 nt, Mycobacterium tuberculosis H37Rv
ggcguccaucgcca

SEQ ID NO: 3285807 - RNA, 14 nt, Mycobacterium tuberculosis H37Rv
ggcguccaucucgg

SEQ ID NO: 3285808 - RNA, 19 nt, Mycobacterium tuberculosis H37Rv
ggcgucccaaucgggaucg

SEQ ID NO: 3285809 - RNA, 16 nt, Mycobacterium tuberculosis H37Rv
ggcgucccagggcaca

SEQ ID NO: 3285810 - RNA, 14 nt, Mycobacterium tuberculosis H37Rv
ggcgucccgcccgg

SEQ ID NO: 3285811 - RNA, 22 nt, Mycobacterium tuberculosis H37Rv
ggcgucccggcggucagcggcu

SEQ ID NO: 3285812 - RNA, 20 nt, Mycobacterium tuberculosis H37Rv
ggcguccgcccagcacccuc

SEQ ID NO: 3285813 - RNA, 14 nt, Mycobacterium tuberculosis H37Rv
ggcguccucgucga

SEQ ID NO: 3285814 - RNA, 15 nt, Mycobacterium tuberculosis H37Rv
ggcguccucgucgag

SEQ ID NO: 3285815 - RNA, 17 nt, Mycobacterium tuberculosis H37Rv
ggcguccuugcgcagca

SEQ ID NO: 3285816 - RNA, 21 nt, Mycobacterium tuberculosis H37Rv
ggcguccuugcgcagcaccag

SEQ ID NO: 3285817 - RNA, 14 nt, Mycobacterium tuberculosis H37Rv
ggcgucgaacucau

SEQ ID NO: 3285818 - RNA, 23 nt, Mycobacterium tuberculosis H37Rv
ggcgucgaaggugaccaggcgga

SEQ ID NO: 3285819 - RNA, 19 nt, Mycobacterium tuberculosis H37Rv
ggcgucgaauucagcugca

SEQ ID NO: 3285820 - RNA, 21 nt, Mycobacterium tuberculosis H37Rv
ggcgucgaauucagcugcacc

SEQ ID NO: 3285821 - RNA, 19 nt, Mycobacterium tuberculosis H37Rv
ggcgucgacaacacgccgu

SEQ ID NO: 3285822 - RNA, 20 nt, Mycobacterium tuberculosis H37Rv
ggcgucgacccugcccagca

SEQ ID NO: 3285823 - RNA, 16 nt, Mycobacterium tuberculosis H37Rv
ggcgucgaccgcggcc

SEQ ID NO: 3285824 - RNA, 22 nt, Mycobacterium tuberculosis H37Rv
ggcgucgaccucgcgggcgauc

SEQ ID NO: 3285825 - RNA, 14 nt, Mycobacterium tuberculosis H37Rv
ggcgucgacgucga

SEQ ID NO: 3285826 - RNA, 14 nt, Mycobacterium tuberculosis H37Rv
ggcgucgacuggcc

SEQ ID NO: 3285827 - RNA, 20 nt, Mycobacterium tuberculosis H37Rv
ggcgucgagguuuuucgaug

SEQ ID NO: 3285828 - RNA, 18 nt, Mycobacterium tuberculosis H37Rv
ggcgucgaguucgguugc

SEQ ID NO: 3285829 - RNA, 18 nt, Mycobacterium tuberculosis H37Rv
ggcgucgaucagggcccc

SEQ ID NO: 3285830 - RNA, 17 nt, Mycobacterium tuberculosis H37Rv
ggcgucgaugacgacgc

SEQ ID NO: 3285831 - RNA, 16 nt, Mycobacterium tuberculosis H37Rv
ggcgucgaugcgggcc

SEQ ID NO: 3285832 - RNA, 23 nt, Mycobacterium tuberculosis H37Rv
ggcgucgaugucauccgacaagc

SEQ ID NO: 3285833 - RNA, 17 nt, Mycobacterium tuberculosis H37Rv
ggcgucgcaacccggcc

SEQ ID NO: 3285834 - RNA, 15 nt, Mycobacterium tuberculosis H37Rv
ggcgucgcaacgcga

SEQ ID NO: 3285835 - RNA, 17 nt, Mycobacterium tuberculosis H37Rv
ggcgucgcaacgcgauc

SEQ ID NO: 3285836 - RNA, 21 nt, Mycobacterium tuberculosis H37Rv
ggcgucgccgccauugccgcc

SEQ ID NO: 3285837 - RNA, 19 nt, Mycobacterium tuberculosis H37Rv
ggcgucgccggccccgccg

SEQ ID NO: 3285838 - RNA, 22 nt, Mycobacterium tuberculosis H37Rv
ggcgucgccggccccgccggcg

SEQ ID NO: 3285839 - RNA, 13 nt, Mycobacterium tuberculosis H37Rv
ggcgucgccgugc

SEQ ID NO: 3285840 - RNA, 20 nt, Mycobacterium tuberculosis H37Rv
ggcgucgcggaucuguuccu

SEQ ID NO: 3285841 - RNA, 12 nt, Mycobacterium tuberculosis H37Rv
ggcgucgcugcc

SEQ ID NO: 3285842 - RNA, 17 nt, Mycobacterium tuberculosis H37Rv
ggcgucggccacccggu

SEQ ID NO: 3285843 - RNA, 22 nt, Mycobacterium tuberculosis H37Rv
ggcgucggccaccgccugagcg

SEQ ID NO: 3285844 - RNA, 15 nt, Mycobacterium tuberculosis H37Rv
ggcgucggcgcccag

SEQ ID NO: 3285845 - RNA, 17 nt, Mycobacterium tuberculosis H37Rv
ggcgucggcgcggccgu

SEQ ID NO: 3285846 - RNA, 20 nt, Mycobacterium tuberculosis H37Rv
ggcgucggugaaugccgucg

SEQ ID NO: 3285847 - RNA, 19 nt, Mycobacterium tuberculosis H37Rv
ggcgucggugccgcugaug

SEQ ID NO: 3285848 - RNA, 20 nt, Mycobacterium tuberculosis H37Rv
ggcgucgucgaguuggccau

SEQ ID NO: 3285849 - RNA, 16 nt, Mycobacterium tuberculosis H37Rv
ggcgucgucggcggcg

SEQ ID NO: 3285850 - RNA, 16 nt, Mycobacterium tuberculosis H37Rv
ggcgucgucggcgggc

SEQ ID NO: 3285851 - RNA, 15 nt, Mycobacterium tuberculosis H37Rv
ggcgucgugagaggc

SEQ ID NO: 3285852 - RNA, 16 nt, Mycobacterium tuberculosis H37Rv
ggcgucgugcgcggcc

SEQ ID NO: 3285853 - RNA, 22 nt, Mycobacterium tuberculosis H37Rv
ggcgucgugcgcggccggcacg

SEQ ID NO: 3285854 - RNA, 18 nt, Mycobacterium tuberculosis H37Rv
ggcgucguucgcgggugc

SEQ ID NO: 3285855 - RNA, 20 nt, Mycobacterium tuberculosis H37Rv
ggcgucugagcgagcucccg

SEQ ID NO: 3285856 - RNA, 14 nt, Mycobacterium tuberculosis H37Rv
ggcgucugcccgcc

SEQ ID NO: 3285857 - RNA, 11 nt, Mycobacterium tuberculosis H37Rv
ggcgucugcgg

SEQ ID NO: 3285858 - RNA, 19 nt, Mycobacterium tuberculosis H37Rv
ggcgugacagggcggcaac

SEQ ID NO: 3285859 - RNA, 20 nt, Mycobacterium tuberculosis H37Rv
ggcgugaccuaccuccucgg

SEQ ID NO: 3285860 - RNA, 23 nt, Mycobacterium tuberculosis H37Rv
ggcgugaccuaccuccucggcgu

SEQ ID NO: 3285861 - RNA, 15 nt, Mycobacterium tuberculosis H37Rv
ggcgugacgggcagg

SEQ ID NO: 3285862 - RNA, 21 nt, Mycobacterium tuberculosis H37Rv
ggcgugacgucgucggugcgc

SEQ ID NO: 3285863 - RNA, 12 nt, Mycobacterium tuberculosis H37Rv
ggcgugagccga

SEQ ID NO: 3285864 - RNA, 18 nt, Mycobacterium tuberculosis H37Rv
ggcgugcacaggucagcg

SEQ ID NO: 3285865 - RNA, 20 nt, Mycobacterium tuberculosis H37Rv
ggcgugcacccccaucaccg

SEQ ID NO: 3285866 - RNA, 16 nt, Mycobacterium tuberculosis H37Rv
ggcgugcagacccggu

SEQ ID NO: 3285867 - RNA, 17 nt, Mycobacterium tuberculosis H37Rv
ggcgugcccgccggcga

SEQ ID NO: 3285868 - RNA, 21 nt, Mycobacterium tuberculosis H37Rv
ggcgugcccgucgugcggggg

SEQ ID NO: 3285869 - RNA, 18 nt, Mycobacterium tuberculosis H37Rv
ggcgugcggacugacguc

SEQ ID NO: 3285870 - RNA, 14 nt, Mycobacterium tuberculosis H37Rv
ggcgugcggcggcc

SEQ ID NO: 3285871 - RNA, 14 nt, Mycobacterium tuberculosis H37Rv
ggcgugcucgccgg

SEQ ID NO: 3285872 - RNA, 13 nt, Mycobacterium tuberculosis H37Rv
ggcuccaccgggc

SEQ ID NO: 3285873 - RNA, 20 nt, Mycobacterium tuberculosis H37Rv
ggcuccaccgggcccgccgu

SEQ ID NO: 3285874 - RNA, 15 nt, Mycobacterium tuberculosis H37Rv
ggcuccagcagcgcc

SEQ ID NO: 3285875 - RNA, 13 nt, Mycobacterium tuberculosis H37Rv
ggcuccagcgcgc

SEQ ID NO: 3285876 - RNA, 15 nt, Mycobacterium tuberculosis H37Rv
ggcuccagcgcgcgc

SEQ ID NO: 3285877 - RNA, 17 nt, Mycobacterium tuberculosis H37Rv
ggcuccagcgcgcgccg

SEQ ID NO: 3285878 - RNA, 19 nt, Mycobacterium tuberculosis H37Rv
ggcuccagcgcgcgccgca

SEQ ID NO: 3285879 - RNA, 22 nt, Mycobacterium tuberculosis H37Rv
ggcuccagcgcgcgccgcagcg

SEQ ID NO: 3285880 - RNA, 14 nt, Mycobacterium tuberculosis H37Rv
ggcuccagguccac

SEQ ID NO: 3285881 - RNA, 23 nt, Mycobacterium tuberculosis H37Rv
ggcuccagguccacauccagggu

SEQ ID NO: 3285882 - RNA, 21 nt, Mycobacterium tuberculosis H37Rv
ggcuccaucgucugguggcag

SEQ ID NO: 3285883 - RNA, 15 nt, Mycobacterium tuberculosis H37Rv
ggcucccccaccagg

SEQ ID NO: 3285884 - RNA, 19 nt, Mycobacterium tuberculosis H37Rv
ggcucccgcaauggggcgc

SEQ ID NO: 3285885 - RNA, 24 nt, Mycobacterium tuberculosis H37Rv
ggcucccguacucccguggccgau

SEQ ID NO: 3285886 - RNA, 17 nt, Mycobacterium tuberculosis H37Rv
ggcucccuuuuccaaag

SEQ ID NO: 3285887 - RNA, 21 nt, Mycobacterium tuberculosis H37Rv
ggcuccgaacauggccagcau

SEQ ID NO: 3285888 - RNA, 21 nt, Mycobacterium tuberculosis H37Rv
ggcuccgauuccgaacugguc

SEQ ID NO: 3285889 - RNA, 17 nt, Mycobacterium tuberculosis H37Rv
ggcuccgcagcgaagac

SEQ ID NO: 3285890 - RNA, 13 nt, Mycobacterium tuberculosis H37Rv
ggcuccgccagcg

SEQ ID NO: 3285891 - RNA, 14 nt, Mycobacterium tuberculosis H37Rv
ggcuccgcccagga

SEQ ID NO: 3285892 - RNA, 20 nt, Mycobacterium tuberculosis H37Rv
ggcuccgcccggcgugucgc

SEQ ID NO: 3285893 - RNA, 22 nt, Mycobacterium tuberculosis H37Rv
ggcuccgcccggcgugucgccg

SEQ ID NO: 3285894 - RNA, 18 nt, Mycobacterium tuberculosis H37Rv
ggcuccgccguugccgcc

SEQ ID NO: 3285895 - RNA, 16 nt, Mycobacterium tuberculosis H37Rv
ggcuccgggacgguga

SEQ ID NO: 3285896 - RNA, 17 nt, Mycobacterium tuberculosis H37Rv
ggcuccgggaugaagcu

SEQ ID NO: 3285897 - RNA, 14 nt, Mycobacterium tuberculosis H37Rv
ggcuccgugguugc

SEQ ID NO: 3285898 - RNA, 19 nt, Mycobacterium tuberculosis H37Rv
ggcuccuccccggcccgcu

SEQ ID NO: 3285899 - RNA, 20 nt, Mycobacterium tuberculosis H37Rv
ggcucgaagcuggcgccgca

SEQ ID NO: 3285900 - RNA, 22 nt, Mycobacterium tuberculosis H37Rv
ggcucgacgaugcggucaacgc

SEQ ID NO: 3285901 - RNA, 15 nt, Mycobacterium tuberculosis H37Rv
ggcucgacgcgucgc

SEQ ID NO: 3285902 - RNA, 20 nt, Mycobacterium tuberculosis H37Rv
ggcucgacgcgucgccggcc

SEQ ID NO: 3285903 - RNA, 19 nt, Mycobacterium tuberculosis H37Rv
ggcucgagcaagaucaccu

SEQ ID NO: 3285904 - RNA, 15 nt, Mycobacterium tuberculosis H37Rv
ggcucgagcucggcg

SEQ ID NO: 3285905 - RNA, 16 nt, Mycobacterium tuberculosis H37Rv
ggcucgagcucggcga

SEQ ID NO: 3285906 - RNA, 18 nt, Mycobacterium tuberculosis H37Rv
ggcucgagcucggcgaug

SEQ ID NO: 3285907 - RNA, 17 nt, Mycobacterium tuberculosis H37Rv
ggcucgagucgcagcac

SEQ ID NO: 3285908 - RNA, 19 nt, Mycobacterium tuberculosis H37Rv
ggcucgagucgcagcacgg

SEQ ID NO: 3285909 - RNA, 23 nt, Mycobacterium tuberculosis H37Rv
ggcucgcaccgugaguacucggu

SEQ ID NO: 3285910 - RNA, 20 nt, Mycobacterium tuberculosis H37Rv
ggcucgcauguucuccacgc

SEQ ID NO: 3285911 - RNA, 23 nt, Mycobacterium tuberculosis H37Rv
ggcucgcauguucuccacgccga

SEQ ID NO: 3285912 - RNA, 18 nt, Mycobacterium tuberculosis H37Rv
ggcucgcauucggcgagc

SEQ ID NO: 3285913 - RNA, 15 nt, Mycobacterium tuberculosis H37Rv
ggcucgccaccucgg

SEQ ID NO: 3285914 - RNA, 21 nt, Mycobacterium tuberculosis H37Rv
ggcucgcccgcuacggcagcc

SEQ ID NO: 3285915 - RNA, 16 nt, Mycobacterium tuberculosis H37Rv
ggcucgcgaucgucac

SEQ ID NO: 3285916 - RNA, 23 nt, Mycobacterium tuberculosis H37Rv
ggcucgcgaucgucacggaggcc

SEQ ID NO: 3285917 - RNA, 21 nt, Mycobacterium tuberculosis H37Rv
ggcucgcgcucgauggcggcc

SEQ ID NO: 3285918 - RNA, 15 nt, Mycobacterium tuberculosis H37Rv
ggcucgcucgccgag

SEQ ID NO: 3285919 - RNA, 17 nt, Mycobacterium tuberculosis H37Rv
ggcucgcucgccgagcu

SEQ ID NO: 3285920 - RNA, 21 nt, Mycobacterium tuberculosis H37Rv
ggcucgcucgccgagcugugc

SEQ ID NO: 3285921 - RNA, 17 nt, Mycobacterium tuberculosis H37Rv
ggcucgcugcaccagcu

SEQ ID NO: 3285922 - RNA, 13 nt, Mycobacterium tuberculosis H37Rv
ggcucggccagcc

SEQ ID NO: 3285923 - RNA, 17 nt, Mycobacterium tuberculosis H37Rv
ggcucggccagccagcg

SEQ ID NO: 3285924 - RNA, 20 nt, Mycobacterium tuberculosis H37Rv
ggcucggccagccagcgggc

SEQ ID NO: 3285925 - RNA, 13 nt, Mycobacterium tuberculosis H37Rv
ggcucggccggag

SEQ ID NO: 3285926 - RNA, 16 nt, Mycobacterium tuberculosis H37Rv
ggcucggcgucgccgc

SEQ ID NO: 3285927 - RNA, 21 nt, Mycobacterium tuberculosis H37Rv
ggcucgggugcgcccggccaa

SEQ ID NO: 3285928 - RNA, 22 nt, Mycobacterium tuberculosis H37Rv
ggcucggugcgccagaucaccg

SEQ ID NO: 3285929 - RNA, 20 nt, Mycobacterium tuberculosis H37Rv
ggcucgucagguuccgcgac

SEQ ID NO: 3285930 - RNA, 16 nt, Mycobacterium tuberculosis H37Rv
ggcucgugcgcuuggu

SEQ ID NO: 3285931 - RNA, 22 nt, Mycobacterium tuberculosis H37Rv
ggcucgugcguguaccugucca

SEQ ID NO: 3285932 - RNA, 16 nt, Mycobacterium tuberculosis H37Rv
ggcucuacucgcggcc

SEQ ID NO: 3285933 - RNA, 22 nt, Mycobacterium tuberculosis H37Rv
ggcucuacucgcggccggcguc

SEQ ID NO: 3285934 - RNA, 14 nt, Mycobacterium tuberculosis H37Rv
ggcucucacgagcg

SEQ ID NO: 3285935 - RNA, 14 nt, Mycobacterium tuberculosis H37Rv
ggcucucagcgaca

SEQ ID NO: 3285936 - RNA, 16 nt, Mycobacterium tuberculosis H37Rv
ggcucucagcgacagc

SEQ ID NO: 3285937 - RNA, 19 nt, Mycobacterium tuberculosis H37Rv
ggcucucagcgacagcugc

SEQ ID NO: 3285938 - RNA, 13 nt, Mycobacterium tuberculosis H37Rv
ggcucucggcguc

SEQ ID NO: 3285939 - RNA, 20 nt, Mycobacterium tuberculosis H37Rv
ggcucucguagcgcucagcu

SEQ ID NO: 3285940 - RNA, 20 nt, Mycobacterium tuberculosis H37Rv
ggcucucuucgcgcgcuggg

SEQ ID NO: 3285941 - RNA, 22 nt, Mycobacterium tuberculosis H37Rv
ggcucuucgcagcgguggucgg

SEQ ID NO: 3285942 - RNA, 16 nt, Mycobacterium tuberculosis H37Rv
ggcugaaacauccccg

SEQ ID NO: 3285943 - RNA, 18 nt, Mycobacterium tuberculosis H37Rv
ggcugaaaccuugcggca

SEQ ID NO: 3285944 - RNA, 22 nt, Mycobacterium tuberculosis H37Rv
ggcugaaauaagggccggcggu

SEQ ID NO: 3285945 - RNA, 14 nt, Mycobacterium tuberculosis H37Rv
ggcugaacaccgcg

SEQ ID NO: 3285946 - RNA, 21 nt, Mycobacterium tuberculosis H37Rv
ggcugaaggacggcagcuugg

SEQ ID NO: 3285947 - RNA, 23 nt, Mycobacterium tuberculosis H37Rv
ggcugacaacgacaacacccacg

SEQ ID NO: 3285948 - RNA, 22 nt, Mycobacterium tuberculosis H37Rv
ggcugacccauggucaccagcu

SEQ ID NO: 3285949 - RNA, 19 nt, Mycobacterium tuberculosis H37Rv
ggcugaccgaagaagcccg

SEQ ID NO: 3285950 - RNA, 21 nt, Mycobacterium tuberculosis H37Rv
ggcugaccggggcgcccggcc

SEQ ID NO: 3285951 - RNA, 20 nt, Mycobacterium tuberculosis H37Rv
ggcugaccucccacccccgg

SEQ ID NO: 3285952 - RNA, 19 nt, Mycobacterium tuberculosis H37Rv
ggcugagaugggccacccg

SEQ ID NO: 3285953 - RNA, 20 nt, Mycobacterium tuberculosis H37Rv
ggcugagaugggccacccgc

SEQ ID NO: 3285954 - RNA, 17 nt, Mycobacterium tuberculosis H37Rv
ggcugagcagcgcggcc

SEQ ID NO: 3285955 - RNA, 14 nt, Mycobacterium tuberculosis H37Rv
ggcugagcccgccg

SEQ ID NO: 3285956 - RNA, 14 nt, Mycobacterium tuberculosis H37Rv
ggcugaggaacgcc

SEQ ID NO: 3285957 - RNA, 17 nt, Mycobacterium tuberculosis H37Rv
ggcugagggcccuuggc

SEQ ID NO: 3285958 - RNA, 15 nt, Mycobacterium tuberculosis H37Rv
ggcugaucccggcca

SEQ ID NO: 3285959 - RNA, 19 nt, Mycobacterium tuberculosis H37Rv
ggcugaucccggccaggcc

SEQ ID NO: 3285960 - RNA, 13 nt, Mycobacterium tuberculosis H37Rv
ggcugaucgcccg

SEQ ID NO: 3285961 - RNA, 15 nt, Mycobacterium tuberculosis H37Rv
ggcugaugacgcgga

SEQ ID NO: 3285962 - RNA, 13 nt, Mycobacterium tuberculosis H37Rv
ggcugauuggccc

SEQ ID NO: 3285963 - RNA, 14 nt, Mycobacterium tuberculosis H37Rv
ggcugauuggccca

SEQ ID NO: 3285964 - RNA, 19 nt, Mycobacterium tuberculosis H37Rv
ggcugauuggcccaccgcc

SEQ ID NO: 3285965 - RNA, 22 nt, Mycobacterium tuberculosis H37Rv
ggcugauuggcccaccgccguu

SEQ ID NO: 3285966 - RNA, 17 nt, Mycobacterium tuberculosis H37Rv
ggcugcaaccagcggca

SEQ ID NO: 3285967 - RNA, 17 nt, Mycobacterium tuberculosis H37Rv
ggcuguugacgccacga

SEQ ID NO: 3285968 - RNA, 18 nt, Mycobacterium tuberculosis H37Rv
ggcuguugacgccacgac

SEQ ID NO: 3285969 - RNA, 16 nt, Mycobacterium tuberculosis H37Rv
ggcuguugcggcggcg

SEQ ID NO: 3285970 - RNA, 20 nt, Mycobacterium tuberculosis H37Rv
ggcuguugcguucggucagu

SEQ ID NO: 3285971 - RNA, 20 nt, Mycobacterium tuberculosis H37Rv
ggcuuacuugaucucggcga

SEQ ID NO: 3285972 - RNA, 13 nt, Mycobacterium tuberculosis H37Rv
ggcuuagcggcuu

SEQ ID NO: 3285973 - RNA, 21 nt, Mycobacterium tuberculosis H37Rv
ggcuuaugcgucugcucgccg

SEQ ID NO: 3285974 - RNA, 13 nt, Mycobacterium tuberculosis H37Rv
ggcuuauugcccg

SEQ ID NO: 3285975 - RNA, 19 nt, Mycobacterium tuberculosis H37Rv
ggcuucacccaaccccgcc

SEQ ID NO: 3285976 - RNA, 21 nt, Mycobacterium tuberculosis H37Rv
ggcuucacccaaccccgccgg

SEQ ID NO: 3285977 - RNA, 13 nt, Mycobacterium tuberculosis H37Rv
ggcuucaucuggc

SEQ ID NO: 3285978 - RNA, 19 nt, Mycobacterium tuberculosis H37Rv
ggcuuccaacucggcggcc

SEQ ID NO: 3285979 - RNA, 23 nt, Mycobacterium tuberculosis H37Rv
ggcuuccaacucggcggccagcg

SEQ ID NO: 3285980 - RNA, 13 nt, Mycobacterium tuberculosis H37Rv
ggcuuccagccac

SEQ ID NO: 3285981 - RNA, 19 nt, Mycobacterium tuberculosis H37Rv
ggcuuccagggcgacggcc

SEQ ID NO: 3285982 - RNA, 19 nt, Mycobacterium tuberculosis H37Rv
ggcuuccagggcggccauc

SEQ ID NO: 3285983 - RNA, 19 nt, Mycobacterium tuberculosis H37Rv
ggcuuccggcgcgaccggu

SEQ ID NO: 3285984 - RNA, 15 nt, Mycobacterium tuberculosis H37Rv
ggcuuccuccucggc

SEQ ID NO: 3285985 - RNA, 19 nt, Mycobacterium tuberculosis H37Rv
ggcuucgacaaccucgagu

SEQ ID NO: 3285986 - RNA, 19 nt, Mycobacterium tuberculosis H37Rv
ggcuucgacgcuuccuggg

SEQ ID NO: 3285987 - RNA, 15 nt, Mycobacterium tuberculosis H37Rv
ggcuucgacggcggc

SEQ ID NO: 3285988 - RNA, 19 nt, Mycobacterium tuberculosis H37Rv
ggcuucgacgucggcgacc

SEQ ID NO: 3285989 - RNA, 20 nt, Mycobacterium tuberculosis H37Rv
ggcuucgaguuuggcgacga

SEQ ID NO: 3285990 - RNA, 21 nt, Mycobacterium tuberculosis H37Rv
ggcuucgcagcgccggcgggc

SEQ ID NO: 3285991 - RNA, 11 nt, Mycobacterium tuberculosis H37Rv
ggcuucgccga

SEQ ID NO: 3285992 - RNA, 23 nt, Mycobacterium tuberculosis H37Rv
ggcuucgcuggcuugggccagcg

SEQ ID NO: 3285993 - RNA, 23 nt, Mycobacterium tuberculosis H37Rv
ggcuucggagaacacgucgacac

SEQ ID NO: 3285994 - RNA, 15 nt, Mycobacterium tuberculosis H37Rv
ggcuucggagccgac

SEQ ID NO: 3285995 - RNA, 15 nt, Mycobacterium tuberculosis H37Rv
ggcuucggcagccgc

SEQ ID NO: 3285996 - RNA, 21 nt, Mycobacterium tuberculosis H37Rv
ggcuucggcgaacccuccgca

SEQ ID NO: 3285997 - RNA, 20 nt, Mycobacterium tuberculosis H37Rv
ggcuucggcgagcgcaucgg

SEQ ID NO: 3285998 - RNA, 15 nt, Mycobacterium tuberculosis H37Rv
ggcuucggcggccga

SEQ ID NO: 3285999 - RNA, 20 nt, Mycobacterium tuberculosis H37Rv
ggcuucggcggccgagcgca

SEQ ID NO: 3286000 - RNA, 21 nt, Mycobacterium tuberculosis H37Rv
ggcuucuucuucuugaccgcg

SEQ ID NO: 3286001 - RNA, 19 nt, Mycobacterium tuberculosis H37Rv
ggcuucuugaccacgaacg

SEQ ID NO: 3286002 - RNA, 17 nt, Mycobacterium tuberculosis H37Rv
ggcuugacugcacacca

SEQ ID NO: 3286003 - RNA, 19 nt, Mycobacterium tuberculosis H37Rv
ggcuugcccggcucggcag

SEQ ID NO: 3286004 - RNA, 16 nt, Mycobacterium tuberculosis H37Rv
ggcuugcgcagcagcg

SEQ ID NO: 3286005 - RNA, 17 nt, Mycobacterium tuberculosis H37Rv
ggcuugcggcacccagu

SEQ ID NO: 3286006 - RNA, 21 nt, Mycobacterium tuberculosis H37Rv
ggcuugcgugaugguugcucg

SEQ ID NO: 3286007 - RNA, 14 nt, Mycobacterium tuberculosis H37Rv
ggcuuggaccagcg

SEQ ID NO: 3286008 - RNA, 15 nt, Mycobacterium tuberculosis H37Rv
ggcuuggaccagcgu

SEQ ID NO: 3286009 - RNA, 16 nt, Mycobacterium tuberculosis H37Rv
ggcuuggaccagcgug

SEQ ID NO: 3286010 - RNA, 17 nt, Mycobacterium tuberculosis H37Rv
ggcuuggaucucaucca

SEQ ID NO: 3286011 - RNA, 14 nt, Mycobacterium tuberculosis H37Rv
ggcuuggccaucac

SEQ ID NO: 3286012 - RNA, 22 nt, Mycobacterium tuberculosis H37Rv
ggcuuggccgggaguguguccg

SEQ ID NO: 3286013 - RNA, 22 nt, Mycobacterium tuberculosis H37Rv
ggcuuggcgccgaugccggcca

SEQ ID NO: 3286014 - RNA, 13 nt, Mycobacterium tuberculosis H37Rv
ggcuuggcgucga

SEQ ID NO: 3286015 - RNA, 13 nt, Mycobacterium tuberculosis H37Rv
ggcuuggcgucgg

SEQ ID NO: 3286016 - RNA, 15 nt, Mycobacterium tuberculosis H37Rv
ggcuuggcgucggcc

SEQ ID NO: 3286017 - RNA, 16 nt, Mycobacterium tuberculosis H37Rv
ggcuugggccagcgca

SEQ ID NO: 3286018 - RNA, 18 nt, Mycobacterium tuberculosis H37Rv
ggcuuggggucccgccgg

SEQ ID NO: 3286019 - RNA, 23 nt, Mycobacterium tuberculosis H37Rv
ggcuuggguugauuggccccggc

SEQ ID NO: 3286020 - RNA, 13 nt, Mycobacterium tuberculosis H37Rv
ggcuuggugccca

SEQ ID NO: 3286021 - RNA, 15 nt, Mycobacterium tuberculosis H37Rv
ggcuugucauccccg

SEQ ID NO: 3286022 - RNA, 14 nt, Mycobacterium tuberculosis H37Rv
ggcuugucgccggc

SEQ ID NO: 3286023 - RNA, 23 nt, Mycobacterium tuberculosis H37Rv
ggcuuucagcaccggaucgacca

SEQ ID NO: 3286024 - RNA, 15 nt, Mycobacterium tuberculosis H37Rv
ggcuuugagccgcuc

SEQ ID NO: 3286025 - RNA, 16 nt, Mycobacterium tuberculosis H37Rv
ggcuuugccgcuguga

SEQ ID NO: 3286026 - RNA, 17 nt, Mycobacterium tuberculosis H37Rv
ggcuuugccgucgagca

SEQ ID NO: 3286027 - RNA, 16 nt, Mycobacterium tuberculosis H37Rv
ggcuuugcucgccagc

SEQ ID NO: 3286028 - RNA, 19 nt, Mycobacterium tuberculosis H37Rv
ggcuuuugcgcccagcacg

SEQ ID NO: 3286029 - RNA, 17 nt, Mycobacterium tuberculosis H37Rv
ggcuuuugcgucugcuc

SEQ ID NO: 3286030 - RNA, 18 nt, Mycobacterium tuberculosis H37Rv
ggcuuuugcgucugcucg

SEQ ID NO: 3286031 - RNA, 14 nt, Mycobacterium tuberculosis H37Rv
gggaaacccggcca

SEQ ID NO: 3286032 - RNA, 17 nt, Mycobacterium tuberculosis H37Rv
gggaaacccggccagcu

SEQ ID NO: 3286033 - RNA, 21 nt, Mycobacterium tuberculosis H37Rv
gggaaaguuguaucgcagcau

SEQ ID NO: 3286034 - RNA, 21 nt, Mycobacterium tuberculosis H37Rv
gggaacaggccguaccaguua

SEQ ID NO: 3286035 - RNA, 12 nt, Mycobacterium tuberculosis H37Rv
gggaaccaccag

SEQ ID NO: 3286036 - RNA, 20 nt, Mycobacterium tuberculosis H37Rv
gggaaccacggucagcacgc

SEQ ID NO: 3286037 - RNA, 13 nt, Mycobacterium tuberculosis H37Rv
gggaacccgagcu

SEQ ID NO: 3286038 - RNA, 20 nt, Mycobacterium tuberculosis H37Rv
gggaaccguccaagccggcu

SEQ ID NO: 3286039 - RNA, 17 nt, Mycobacterium tuberculosis H37Rv
gggaacgaugccgccgg

SEQ ID NO: 3286040 - RNA, 20 nt, Mycobacterium tuberculosis H37Rv
gggaacgcggaagccgccua

SEQ ID NO: 3286041 - RNA, 16 nt, Mycobacterium tuberculosis H37Rv
gggaaggaaccgggca

SEQ ID NO: 3286042 - RNA, 21 nt, Mycobacterium tuberculosis H37Rv
gggaaggaaccgggcaaauca

SEQ ID NO: 3286043 - RNA, 23 nt, Mycobacterium tuberculosis H37Rv
gggaaggaaccgggcaaaucaag

SEQ ID NO: 3286044 - RNA, 21 nt, Mycobacterium tuberculosis H37Rv
gggaaucagugaagacaccag

SEQ ID NO: 3286045 - RNA, 22 nt, Mycobacterium tuberculosis H37Rv
gggacaaucguccacccgagcu

SEQ ID NO: 3286046 - RNA, 15 nt, Mycobacterium tuberculosis H37Rv
gggacaccaaaagga

SEQ ID NO: 3286047 - RNA, 12 nt, Mycobacterium tuberculosis H37Rv
gggacaccaucu

SEQ ID NO: 3286048 - RNA, 18 nt, Mycobacterium tuberculosis H37Rv
gggacacgucgcgccagg

SEQ ID NO: 3286049 - RNA, 16 nt, Mycobacterium tuberculosis H37Rv
gggacagauggcggcc

SEQ ID NO: 3286050 - RNA, 21 nt, Mycobacterium tuberculosis H37Rv
gggacagauggcggccgaggu

SEQ ID NO: 3286051 - RNA, 14 nt, Mycobacterium tuberculosis H37Rv
gggacagcagccgg

SEQ ID NO: 3286052 - RNA, 20 nt, Mycobacterium tuberculosis H37Rv
gggacauccagugcgguggc

SEQ ID NO: 3286053 - RNA, 16 nt, Mycobacterium tuberculosis H37Rv
gggacaucugcccacc

SEQ ID NO: 3286054 - RNA, 20 nt, Mycobacterium tuberculosis H37Rv
gggaccacccgguccugcuc

SEQ ID NO: 3286055 - RNA, 13 nt, Mycobacterium tuberculosis H37Rv
gggaccacgguga

SEQ ID NO: 3286056 - RNA, 16 nt, Mycobacterium tuberculosis H37Rv
gggaccccgcugcgac

SEQ ID NO: 3286057 - RNA, 14 nt, Mycobacterium tuberculosis H37Rv
gggacccgagauca

SEQ ID NO: 3286058 - RNA, 17 nt, Mycobacterium tuberculosis H37Rv
gggacccgagcagugga

SEQ ID NO: 3286059 - RNA, 14 nt, Mycobacterium tuberculosis H37Rv
gggacccggggccg

SEQ ID NO: 3286060 - RNA, 19 nt, Mycobacterium tuberculosis H37Rv
gggaccgcaucgguggggc

SEQ ID NO: 3286061 - RNA, 12 nt, Mycobacterium tuberculosis H37Rv
gggaccgcccga

SEQ ID NO: 3286062 - RNA, 13 nt, Mycobacterium tuberculosis H37Rv
gggaccgcgguca

SEQ ID NO: 3286063 - RNA, 16 nt, Mycobacterium tuberculosis H37Rv
gggcacgucggugguc

SEQ ID NO: 3286064 - RNA, 17 nt, Mycobacterium tuberculosis H37Rv
gggcacguggcgguaca

SEQ ID NO: 3286065 - RNA, 19 nt, Mycobacterium tuberculosis H37Rv
gggcacuccgggcucggcg

SEQ ID NO: 3286066 - RNA, 14 nt, Mycobacterium tuberculosis H37Rv
gggcacucuugucc

SEQ ID NO: 3286067 - RNA, 15 nt, Mycobacterium tuberculosis H37Rv
gggcagaagaguguc

SEQ ID NO: 3286068 - RNA, 18 nt, Mycobacterium tuberculosis H37Rv
gggcagaccgaucggcag

SEQ ID NO: 3286069 - RNA, 12 nt, Mycobacterium tuberculosis H37Rv
gggcagcaaaaa

SEQ ID NO: 3286070 - RNA, 18 nt, Mycobacterium tuberculosis H37Rv
gggcagcacccgcgccag

SEQ ID NO: 3286071 - RNA, 14 nt, Mycobacterium tuberculosis H37Rv
gggcagcagcuggu

SEQ ID NO: 3286072 - RNA, 19 nt, Mycobacterium tuberculosis H37Rv
gggcagcaggcccacccgg

SEQ ID NO: 3286073 - RNA, 22 nt, Mycobacterium tuberculosis H37Rv
gggcagccgcccgcccaccucg

SEQ ID NO: 3286074 - RNA, 16 nt, Mycobacterium tuberculosis H37Rv
gggcagccugcugcau

SEQ ID NO: 3286075 - RNA, 19 nt, Mycobacterium tuberculosis H37Rv
gggcagcgaaacgagccgg

SEQ ID NO: 3286076 - RNA, 15 nt, Mycobacterium tuberculosis H37Rv
gggcagcgcggccag

SEQ ID NO: 3286077 - RNA, 16 nt, Mycobacterium tuberculosis H37Rv
gggcagcgcggccagu

SEQ ID NO: 3286078 - RNA, 17 nt, Mycobacterium tuberculosis H37Rv
gggcagcgcgugcugug

SEQ ID NO: 3286079 - RNA, 14 nt, Mycobacterium tuberculosis H37Rv
gggcagcgcucuca

SEQ ID NO: 3286080 - RNA, 18 nt, Mycobacterium tuberculosis H37Rv
gggcagcuccaccaggac

SEQ ID NO: 3286081 - RNA, 20 nt, Mycobacterium tuberculosis H37Rv
gggcagcucguccagcgagc

SEQ ID NO: 3286082 - RNA, 11 nt, Mycobacterium tuberculosis H37Rv
gggcagcuggc

SEQ ID NO: 3286083 - RNA, 12 nt, Mycobacterium tuberculosis H37Rv
gggcagcugggc

SEQ ID NO: 3286084 - RNA, 15 nt, Mycobacterium tuberculosis H37Rv
gggcagcugguaggu

SEQ ID NO: 3286085 - RNA, 18 nt, Mycobacterium tuberculosis H37Rv
gggcagcugguaggucac

SEQ ID NO: 3286086 - RNA, 20 nt, Mycobacterium tuberculosis H37Rv
gggcagcugguaggucaccg

SEQ ID NO: 3286087 - RNA, 20 nt, Mycobacterium tuberculosis H37Rv
gggcaggaucuccgggucga

SEQ ID NO: 3286088 - RNA, 13 nt, Mycobacterium tuberculosis H37Rv
gggcaggccccac

SEQ ID NO: 3286089 - RNA, 17 nt, Mycobacterium tuberculosis H37Rv
gggcaggcggccagcga

SEQ ID NO: 3286090 - RNA, 14 nt, Mycobacterium tuberculosis H37Rv
gggcaguagcugug

SEQ ID NO: 3286091 - RNA, 16 nt, Mycobacterium tuberculosis H37Rv
gggcagucaggccuag

SEQ ID NO: 3286092 - RNA, 18 nt, Mycobacterium tuberculosis H37Rv
gggcaguggcagcccguc

SEQ ID NO: 3286093 - RNA, 22 nt, Mycobacterium tuberculosis H37Rv
gggcaguuguugacagacacag

SEQ ID NO: 3286094 - RNA, 19 nt, Mycobacterium tuberculosis H37Rv
gggcaguuuggcggcaggu

SEQ ID NO: 3286095 - RNA, 14 nt, Mycobacterium tuberculosis H37Rv
gggcaucaccgacg

SEQ ID NO: 3286096 - RNA, 13 nt, Mycobacterium tuberculosis H37Rv
gggcaucaccgcc

SEQ ID NO: 3286097 - RNA, 15 nt, Mycobacterium tuberculosis H37Rv
gggcaucaccgccgc

SEQ ID NO: 3286098 - RNA, 20 nt, Mycobacterium tuberculosis H37Rv
gggcaucagcagagccccgg

SEQ ID NO: 3286099 - RNA, 23 nt, Mycobacterium tuberculosis H37Rv
gggcaucgcgaauauagcggcgu

SEQ ID NO: 3286100 - RNA, 17 nt, Mycobacterium tuberculosis H37Rv
gggcaucgggccuagcc

SEQ ID NO: 3286101 - RNA, 14 nt, Mycobacterium tuberculosis H37Rv
gggcaucgucgccg

SEQ ID NO: 3286102 - RNA, 15 nt, Mycobacterium tuberculosis H37Rv
gggcaucgucgccga

SEQ ID NO: 3286103 - RNA, 14 nt, Mycobacterium tuberculosis H37Rv
gggcauggucgccg

SEQ ID NO: 3286104 - RNA, 13 nt, Mycobacterium tuberculosis H37Rv
gggcaugucgccg

SEQ ID NO: 3286105 - RNA, 16 nt, Mycobacterium tuberculosis H37Rv
gggcauugcggcgcgg

SEQ ID NO: 3286106 - RNA, 17 nt, Mycobacterium tuberculosis H37Rv
gggccaagacggcgggc

SEQ ID NO: 3286107 - RNA, 17 nt, Mycobacterium tuberculosis H37Rv
gggccaccaccacggcc

SEQ ID NO: 3286108 - RNA, 18 nt, Mycobacterium tuberculosis H37Rv
gggccaccacgcgccgca

SEQ ID NO: 3286109 - RNA, 16 nt, Mycobacterium tuberculosis H37Rv
gggccaccgccgccug

SEQ ID NO: 3286110 - RNA, 22 nt, Mycobacterium tuberculosis H37Rv
gggccaccgccgccugcccggc

SEQ ID NO: 3286111 - RNA, 19 nt, Mycobacterium tuberculosis H37Rv
gggccacgaugaucccaag

SEQ ID NO: 3286112 - RNA, 14 nt, Mycobacterium tuberculosis H37Rv
gggccacggcugcg

SEQ ID NO: 3286113 - RNA, 23 nt, Mycobacterium tuberculosis H37Rv
gggccacugagccacagggaagc

SEQ ID NO: 3286114 - RNA, 16 nt, Mycobacterium tuberculosis H37Rv
gggccacuggccgguu

SEQ ID NO: 3286115 - RNA, 19 nt, Mycobacterium tuberculosis H37Rv
gggccagaucgaagcgcag

SEQ ID NO: 3286116 - RNA, 20 nt, Mycobacterium tuberculosis H37Rv
gggccagaucgaagcgcagc

SEQ ID NO: 3286117 - RNA, 22 nt, Mycobacterium tuberculosis H37Rv
gggccagauuucugggagccgg

SEQ ID NO: 3286118 - RNA, 15 nt, Mycobacterium tuberculosis H37Rv
gggccagcacccgcu

SEQ ID NO: 3286119 - RNA, 21 nt, Mycobacterium tuberculosis H37Rv
gggccagccgcucacccgguc

SEQ ID NO: 3286120 - RNA, 13 nt, Mycobacterium tuberculosis H37Rv
gggccagcgccuc

SEQ ID NO: 3286121 - RNA, 16 nt, Mycobacterium tuberculosis H37Rv
gggccagcgucaccuc

SEQ ID NO: 3286122 - RNA, 15 nt, Mycobacterium tuberculosis H37Rv
gggccaggcccagcu

SEQ ID NO: 3286123 - RNA, 17 nt, Mycobacterium tuberculosis H37Rv
gggccaggcgaagucga

SEQ ID NO: 3286124 - RNA, 16 nt, Mycobacterium tuberculosis H37Rv
gggccaggucagccgc

SEQ ID NO: 3286125 - RNA, 17 nt, Mycobacterium tuberculosis H37Rv
gggccaggucagccgcg

SEQ ID NO: 3286126 - RNA, 13 nt, Mycobacterium tuberculosis H37Rv
gggccaggucggc

SEQ ID NO: 3286127 - RNA, 23 nt, Mycobacterium tuberculosis H37Rv
gggccagugaaaccaccggccgu

SEQ ID NO: 3286128 - RNA, 20 nt, Mycobacterium tuberculosis H37Rv
gggccaucgcauccccagca

SEQ ID NO: 3286129 - RNA, 15 nt, Mycobacterium tuberculosis H37Rv
gggccauucaccgcg

SEQ ID NO: 3286130 - RNA, 17 nt, Mycobacterium tuberculosis H37Rv
gggcccacacggugcga

SEQ ID NO: 3286131 - RNA, 13 nt, Mycobacterium tuberculosis H37Rv
gggcccagcagcg

SEQ ID NO: 3286132 - RNA, 13 nt, Mycobacterium tuberculosis H37Rv
gggcccagcaggu

SEQ ID NO: 3286133 - RNA, 14 nt, Mycobacterium tuberculosis H37Rv
gggcccagccggac

SEQ ID NO: 3286134 - RNA, 14 nt, Mycobacterium tuberculosis H37Rv
gggcccagcggccg

SEQ ID NO: 3286135 - RNA, 18 nt, Mycobacterium tuberculosis H37Rv
gggcccagcggccgcgau

SEQ ID NO: 3286136 - RNA, 21 nt, Mycobacterium tuberculosis H37Rv
gggccccacaucgccccccag

SEQ ID NO: 3286137 - RNA, 13 nt, Mycobacterium tuberculosis H37Rv
gggccccacggcg

SEQ ID NO: 3286138 - RNA, 16 nt, Mycobacterium tuberculosis H37Rv
gggccccuccggccac

SEQ ID NO: 3286139 - RNA, 19 nt, Mycobacterium tuberculosis H37Rv
gggccccuucgcagcaugu

SEQ ID NO: 3286140 - RNA, 23 nt, Mycobacterium tuberculosis H37Rv
gggcccgacguugccgaagccgg

SEQ ID NO: 3286141 - RNA, 13 nt, Mycobacterium tuberculosis H37Rv
gggcccgaugagg

SEQ ID NO: 3286142 - RNA, 12 nt, Mycobacterium tuberculosis H37Rv
gggcccgccagc

SEQ ID NO: 3286143 - RNA, 13 nt, Mycobacterium tuberculosis H37Rv
gggcccgccagcc

SEQ ID NO: 3286144 - RNA, 17 nt, Mycobacterium tuberculosis H37Rv
gggcccgccagcccagc

SEQ ID NO: 3286145 - RNA, 22 nt, Mycobacterium tuberculosis H37Rv
gggcccgccgucuuggcccggu

SEQ ID NO: 3286146 - RNA, 16 nt, Mycobacterium tuberculosis H37Rv
gggcccgcgcggcggu

SEQ ID NO: 3286147 - RNA, 22 nt, Mycobacterium tuberculosis H37Rv
gggcccggccggacgggugcgg

SEQ ID NO: 3286148 - RNA, 17 nt, Mycobacterium tuberculosis H37Rv
gggcccguagccgagcu

SEQ ID NO: 3286149 - RNA, 21 nt, Mycobacterium tuberculosis H37Rv
gggcccgucggacauaccgcg

SEQ ID NO: 3286150 - RNA, 20 nt, Mycobacterium tuberculosis H37Rv
gggcccuccacugcgagcgc

SEQ ID NO: 3286151 - RNA, 21 nt, Mycobacterium tuberculosis H37Rv
gggccgaauaccacaccguga

SEQ ID NO: 3286152 - RNA, 15 nt, Mycobacterium tuberculosis H37Rv
gggccgacagcacgc

SEQ ID NO: 3286153 - RNA, 14 nt, Mycobacterium tuberculosis H37Rv
gggccgaccagagc

SEQ ID NO: 3286154 - RNA, 16 nt, Mycobacterium tuberculosis H37Rv
gggccgacugggcgcg

SEQ ID NO: 3286155 - RNA, 23 nt, Mycobacterium tuberculosis H37Rv
gggccgacugggcgcgaccccag

SEQ ID NO: 3286156 - RNA, 13 nt, Mycobacterium tuberculosis H37Rv
gggccgagccgac

SEQ ID NO: 3286157 - RNA, 16 nt, Mycobacterium tuberculosis H37Rv
gggccgagccgacauc

SEQ ID NO: 3286158 - RNA, 18 nt, Mycobacterium tuberculosis H37Rv
gggccgagccgacaucga

SEQ ID NO: 3286159 - RNA, 12 nt, Mycobacterium tuberculosis H37Rv
gggccgaggugu

SEQ ID NO: 3286160 - RNA, 15 nt, Mycobacterium tuberculosis H37Rv
gggcgccgcgcucga

SEQ ID NO: 3286161 - RNA, 15 nt, Mycobacterium tuberculosis H37Rv
gggcgccuuagccau

SEQ ID NO: 3286162 - RNA, 20 nt, Mycobacterium tuberculosis H37Rv
gggcgccuuugccccgugga

SEQ ID NO: 3286163 - RNA, 15 nt, Mycobacterium tuberculosis H37Rv
gggcgcgcaucugcu

SEQ ID NO: 3286164 - RNA, 18 nt, Mycobacterium tuberculosis H37Rv
gggcgcgcaucugcucgg

SEQ ID NO: 3286165 - RNA, 13 nt, Mycobacterium tuberculosis H37Rv
gggcgcgccggcu

SEQ ID NO: 3286166 - RNA, 19 nt, Mycobacterium tuberculosis H37Rv
gggcgcgcguagccgugga

SEQ ID NO: 3286167 - RNA, 17 nt, Mycobacterium tuberculosis H37Rv
gggcgcgcucaucgacc

SEQ ID NO: 3286168 - RNA, 21 nt, Mycobacterium tuberculosis H37Rv
gggcgcgcugcccacggaggg

SEQ ID NO: 3286169 - RNA, 21 nt, Mycobacterium tuberculosis H37Rv
gggcgcgcuggcgggcggcgu

SEQ ID NO: 3286170 - RNA, 13 nt, Mycobacterium tuberculosis H37Rv
gggcgcggaucug

SEQ ID NO: 3286171 - RNA, 18 nt, Mycobacterium tuberculosis H37Rv
gggcgcggaucugcagca

SEQ ID NO: 3286172 - RNA, 18 nt, Mycobacterium tuberculosis H37Rv
gggcgcgggugaccaggc

SEQ ID NO: 3286173 - RNA, 19 nt, Mycobacterium tuberculosis H37Rv
gggcgcggguggcgccagg

SEQ ID NO: 3286174 - RNA, 22 nt, Mycobacterium tuberculosis H37Rv
gggcgcguagcucagcgguaga

SEQ ID NO: 3286175 - RNA, 13 nt, Mycobacterium tuberculosis H37Rv
gggcgcgucggcg

SEQ ID NO: 3286176 - RNA, 13 nt, Mycobacterium tuberculosis H37Rv
gggcgcucgcauc

SEQ ID NO: 3286177 - RNA, 13 nt, Mycobacterium tuberculosis H37Rv
gggcgcucggucu

SEQ ID NO: 3286178 - RNA, 22 nt, Mycobacterium tuberculosis H37Rv
gggcgcuuaugcgucugcucgc

SEQ ID NO: 3286179 - RNA, 22 nt, Mycobacterium tuberculosis H37Rv
gggcgcuugcaccaggggcgcg

SEQ ID NO: 3286180 - RNA, 12 nt, Mycobacterium tuberculosis H37Rv
gggcggaaaaga

SEQ ID NO: 3286181 - RNA, 21 nt, Mycobacterium tuberculosis H37Rv
gggcggacaaaagaacgccag

SEQ ID NO: 3286182 - RNA, 13 nt, Mycobacterium tuberculosis H37Rv
gggcggaggccgc

SEQ ID NO: 3286183 - RNA, 14 nt, Mycobacterium tuberculosis H37Rv
gggcggcaucgccg

SEQ ID NO: 3286184 - RNA, 18 nt, Mycobacterium tuberculosis H37Rv
gggcggcauuaccaacgc

SEQ ID NO: 3286185 - RNA, 21 nt, Mycobacterium tuberculosis H37Rv
gggcggccaccgcacgcuggc

SEQ ID NO: 3286186 - RNA, 21 nt, Mycobacterium tuberculosis H37Rv
gggcggccagcugcagcagac

SEQ ID NO: 3286187 - RNA, 12 nt, Mycobacterium tuberculosis H37Rv
gggcggccagga

SEQ ID NO: 3286188 - RNA, 17 nt, Mycobacterium tuberculosis H37Rv
gggcggcccaccggcca

SEQ ID NO: 3286189 - RNA, 18 nt, Mycobacterium tuberculosis H37Rv
gggcggcccaccggccac

SEQ ID NO: 3286190 - RNA, 15 nt, Mycobacterium tuberculosis H37Rv
gggcggccgggcucc

SEQ ID NO: 3286191 - RNA, 17 nt, Mycobacterium tuberculosis H37Rv
gggcggcgaccucgggu

SEQ ID NO: 3286192 - RNA, 12 nt, Mycobacterium tuberculosis H37Rv
gggcggcgccgg

SEQ ID NO: 3286193 - RNA, 14 nt, Mycobacterium tuberculosis H37Rv
gggcggcgccggcg

SEQ ID NO: 3286194 - RNA, 18 nt, Mycobacterium tuberculosis H37Rv
gggcggcggcgcgaucga

SEQ ID NO: 3286195 - RNA, 14 nt, Mycobacterium tuberculosis H37Rv
gggcggcggugcgu

SEQ ID NO: 3286196 - RNA, 19 nt, Mycobacterium tuberculosis H37Rv
gggcggcgucgcggaucug

SEQ ID NO: 3286197 - RNA, 12 nt, Mycobacterium tuberculosis H37Rv
gggcggcgucgg

SEQ ID NO: 3286198 - RNA, 14 nt, Mycobacterium tuberculosis H37Rv
gggcggcucgucga

SEQ ID NO: 3286199 - RNA, 23 nt, Mycobacterium tuberculosis H37Rv
gggcggcuucgaugucguaccgg

SEQ ID NO: 3286200 - RNA, 18 nt, Mycobacterium tuberculosis H37Rv
gggcgggcaaucaccgcc

SEQ ID NO: 3286201 - RNA, 15 nt, Mycobacterium tuberculosis H37Rv
gggcgggucugggug

SEQ ID NO: 3286202 - RNA, 18 nt, Mycobacterium tuberculosis H37Rv
gggcggguucggacgagg

SEQ ID NO: 3286203 - RNA, 20 nt, Mycobacterium tuberculosis H37Rv
gggcgguagccauccgugaa

SEQ ID NO: 3286204 - RNA, 15 nt, Mycobacterium tuberculosis H37Rv
gggcgguccgcgucu

SEQ ID NO: 3286205 - RNA, 19 nt, Mycobacterium tuberculosis H37Rv
gggcggugcacaccgucgc

SEQ ID NO: 3286206 - RNA, 16 nt, Mycobacterium tuberculosis H37Rv
gggcguacucggcgcg

SEQ ID NO: 3286207 - RNA, 23 nt, Mycobacterium tuberculosis H37Rv
gggcgucaugaugucgacaucga

SEQ ID NO: 3286208 - RNA, 18 nt, Mycobacterium tuberculosis H37Rv
gggcgucgcaacgcgauc

SEQ ID NO: 3286209 - RNA, 14 nt, Mycobacterium tuberculosis H37Rv
gggcgucgccgccg

SEQ ID NO: 3286210 - RNA, 18 nt, Mycobacterium tuberculosis H37Rv
gggcgucgccgccgggca

SEQ ID NO: 3286211 - RNA, 14 nt, Mycobacterium tuberculosis H37Rv
gggcgucgucggug

SEQ ID NO: 3286212 - RNA, 18 nt, Mycobacterium tuberculosis H37Rv
gggcgucugcagcgggcg

SEQ ID NO: 3286213 - RNA, 19 nt, Mycobacterium tuberculosis H37Rv
gggcgugacgggcaggagc

SEQ ID NO: 3286214 - RNA, 13 nt, Mycobacterium tuberculosis H37Rv
gggcgugcugccg

SEQ ID NO: 3286215 - RNA, 23 nt, Mycobacterium tuberculosis H37Rv
gggcgugguaaccagggcagccg

SEQ ID NO: 3286216 - RNA, 17 nt, Mycobacterium tuberculosis H37Rv
gggcguggugagcagug

SEQ ID NO: 3286217 - RNA, 13 nt, Mycobacterium tuberculosis H37Rv
gggcgugugcagu

SEQ ID NO: 3286218 - RNA, 18 nt, Mycobacterium tuberculosis H37Rv
gggcgugugcaguccgau

SEQ ID NO: 3286219 - RNA, 16 nt, Mycobacterium tuberculosis H37Rv
gggcguuucggcgggc

SEQ ID NO: 3286220 - RNA, 17 nt, Mycobacterium tuberculosis H37Rv
gggcuaauccagcagca

SEQ ID NO: 3286221 - RNA, 17 nt, Mycobacterium tuberculosis H37Rv
gggcuaccggcagcugc

SEQ ID NO: 3286222 - RNA, 18 nt, Mycobacterium tuberculosis H37Rv
gggcuacuaggcccagca

SEQ ID NO: 3286223 - RNA, 13 nt, Mycobacterium tuberculosis H37Rv
gggcuagucgggg

SEQ ID NO: 3286224 - RNA, 16 nt, Mycobacterium tuberculosis H37Rv
gggcuaugaccugcga

SEQ ID NO: 3286225 - RNA, 23 nt, Mycobacterium tuberculosis H37Rv
gggcucaacaccagccggucguc

SEQ ID NO: 3286226 - RNA, 15 nt, Mycobacterium tuberculosis H37Rv
gggcucaagucuccc

SEQ ID NO: 3286227 - RNA, 14 nt, Mycobacterium tuberculosis H37Rv
gggcuccacgucau

SEQ ID NO: 3286228 - RNA, 16 nt, Mycobacterium tuberculosis H37Rv
gggcuccccaagucga

SEQ ID NO: 3286229 - RNA, 18 nt, Mycobacterium tuberculosis H37Rv
gggcuccucgugcacgca

SEQ ID NO: 3286230 - RNA, 18 nt, Mycobacterium tuberculosis H37Rv
gggcucgcucgccgagcu

SEQ ID NO: 3286231 - RNA, 20 nt, Mycobacterium tuberculosis H37Rv
gggcucggcggcccggccga

SEQ ID NO: 3286232 - RNA, 16 nt, Mycobacterium tuberculosis H37Rv
gggcucucggcgucga

SEQ ID NO: 3286233 - RNA, 17 nt, Mycobacterium tuberculosis H37Rv
gggcucugcugccagcc

SEQ ID NO: 3286234 - RNA, 17 nt, Mycobacterium tuberculosis H37Rv
gggcucuggccaguccg

SEQ ID NO: 3286235 - RNA, 14 nt, Mycobacterium tuberculosis H37Rv
gggcugaggcggcg

SEQ ID NO: 3286236 - RNA, 15 nt, Mycobacterium tuberculosis H37Rv
gggcugaggcggcga

SEQ ID NO: 3286237 - RNA, 14 nt, Mycobacterium tuberculosis H37Rv
gggcugccacggcc

SEQ ID NO: 3286238 - RNA, 13 nt, Mycobacterium tuberculosis H37Rv
gggcugcccgcgg

SEQ ID NO: 3286239 - RNA, 19 nt, Mycobacterium tuberculosis H37Rv
gggcugccggccagacggu

SEQ ID NO: 3286240 - RNA, 14 nt, Mycobacterium tuberculosis H37Rv
gggcugcggccgcg

SEQ ID NO: 3286241 - RNA, 23 nt, Mycobacterium tuberculosis H37Rv
gggcuggcgacgacgacaccgcg

SEQ ID NO: 3286242 - RNA, 18 nt, Mycobacterium tuberculosis H37Rv
gggcuggcuguggcgcgc

SEQ ID NO: 3286243 - RNA, 17 nt, Mycobacterium tuberculosis H37Rv
gggcuggguggccaacc

SEQ ID NO: 3286244 - RNA, 21 nt, Mycobacterium tuberculosis H37Rv
gggcuggucuacccgcggcgc

SEQ ID NO: 3286245 - RNA, 16 nt, Mycobacterium tuberculosis H37Rv
gggcuguccgaccucg

SEQ ID NO: 3286246 - RNA, 15 nt, Mycobacterium tuberculosis H37Rv
gggcuguugacgcca

SEQ ID NO: 3286247 - RNA, 22 nt, Mycobacterium tuberculosis H37Rv
gggcuguugacgccacgacgcc

SEQ ID NO: 3286248 - RNA, 21 nt, Mycobacterium tuberculosis H37Rv
gggcuuacuuaaccaggcgag

SEQ ID NO: 3286249 - RNA, 17 nt, Mycobacterium tuberculosis H37Rv
gggcuuaugcgucugcu

SEQ ID NO: 3286250 - RNA, 19 nt, Mycobacterium tuberculosis H37Rv
gggcuuccaacaggccggu

SEQ ID NO: 3286251 - RNA, 19 nt, Mycobacterium tuberculosis H37Rv
gggcuuccagggcggccau

SEQ ID NO: 3286252 - RNA, 19 nt, Mycobacterium tuberculosis H37Rv
gggcuucugcgucugcucg

SEQ ID NO: 3286253 - RNA, 16 nt, Mycobacterium tuberculosis H37Rv
gggcuugccgcgcacc

SEQ ID NO: 3286254 - RNA, 14 nt, Mycobacterium tuberculosis H37Rv
gggcuugcgcagca

SEQ ID NO: 3286255 - RNA, 16 nt, Mycobacterium tuberculosis H37Rv
gggcuuggcgacgaug

SEQ ID NO: 3286256 - RNA, 14 nt, Mycobacterium tuberculosis H37Rv
gggcuuggugccca

SEQ ID NO: 3286257 - RNA, 22 nt, Mycobacterium tuberculosis H37Rv
ggggcgugccgccgcagauggg

SEQ ID NO: 3286258 - RNA, 18 nt, Mycobacterium tuberculosis H37Rv
ggggcguuguugggcgag

SEQ ID NO: 3286259 - RNA, 16 nt, Mycobacterium tuberculosis H37Rv
ggggcuacaacugccg

SEQ ID NO: 3286260 - RNA, 20 nt, Mycobacterium tuberculosis H37Rv
ggggcuacaacugccgagca

SEQ ID NO: 3286261 - RNA, 19 nt, Mycobacterium tuberculosis H37Rv
ggggcuaguugagcgcugc

SEQ ID NO: 3286262 - RNA, 17 nt, Mycobacterium tuberculosis H37Rv
ggggcucaaccccgucc

SEQ ID NO: 3286263 - RNA, 15 nt, Mycobacterium tuberculosis H37Rv
ggggcucagcggugg

SEQ ID NO: 3286264 - RNA, 19 nt, Mycobacterium tuberculosis H37Rv
ggggcucagcgguggcgug

SEQ ID NO: 3286265 - RNA, 20 nt, Mycobacterium tuberculosis H37Rv
ggggcucagcgguggcgugg

SEQ ID NO: 3286266 - RNA, 22 nt, Mycobacterium tuberculosis H37Rv
ggggcucucgaguccaggcagc

SEQ ID NO: 3286267 - RNA, 13 nt, Mycobacterium tuberculosis H37Rv
ggggcuguacucg

SEQ ID NO: 3286268 - RNA, 12 nt, Mycobacterium tuberculosis H37Rv
ggggcugugcag

SEQ ID NO: 3286269 - RNA, 14 nt, Mycobacterium tuberculosis H37Rv
ggggcugugcaggc

SEQ ID NO: 3286270 - RNA, 20 nt, Mycobacterium tuberculosis H37Rv
ggggcuuauguguccgcucg

SEQ ID NO: 3286271 - RNA, 18 nt, Mycobacterium tuberculosis H37Rv
ggggcuucaucuggcgcc

SEQ ID NO: 3286272 - RNA, 19 nt, Mycobacterium tuberculosis H37Rv
ggggcuuuuacgucugcuc

SEQ ID NO: 3286273 - RNA, 20 nt, Mycobacterium tuberculosis H37Rv
ggggcuuuuacgucugcucg

SEQ ID NO: 3286274 - RNA, 20 nt, Mycobacterium tuberculosis H37Rv
ggggcuuuugcgucugcucg

SEQ ID NO: 3286275 - RNA, 22 nt, Mycobacterium tuberculosis H37Rv
ggggcuuuugcgucugcucgcc

SEQ ID NO: 3286276 - RNA, 19 nt, Mycobacterium tuberculosis H37Rv
ggggcuuuugcgucugcug

SEQ ID NO: 3286277 - RNA, 13 nt, Mycobacterium tuberculosis H37Rv
gggggagcgaacg

SEQ ID NO: 3286278 - RNA, 15 nt, Mycobacterium tuberculosis H37Rv
gggggagcggccgcc

SEQ ID NO: 3286279 - RNA, 16 nt, Mycobacterium tuberculosis H37Rv
gggggauccagcaggc

SEQ ID NO: 3286280 - RNA, 23 nt, Mycobacterium tuberculosis H37Rv
gggggauccagcaggccgggaca

SEQ ID NO: 3286281 - RNA, 19 nt, Mycobacterium tuberculosis H37Rv
gggggauccggcgcagcga

SEQ ID NO: 3286282 - RNA, 20 nt, Mycobacterium tuberculosis H37Rv
gggggauuucgcgucugcuc

SEQ ID NO: 3286283 - RNA, 18 nt, Mycobacterium tuberculosis H37Rv
gggggccgagccgacauc

SEQ ID NO: 3286284 - RNA, 14 nt, Mycobacterium tuberculosis H37Rv
gggggccggcagcg

SEQ ID NO: 3286285 - RNA, 19 nt, Mycobacterium tuberculosis H37Rv
gggggccucguugaccaga

SEQ ID NO: 3286286 - RNA, 17 nt, Mycobacterium tuberculosis H37Rv
gggggcguacugugagu

SEQ ID NO: 3286287 - RNA, 15 nt, Mycobacterium tuberculosis H37Rv
gggggcugcugcucg

SEQ ID NO: 3286288 - RNA, 21 nt, Mycobacterium tuberculosis H37Rv
gggggcuuaugcgacugcucg

SEQ ID NO: 3286289 - RNA, 20 nt, Mycobacterium tuberculosis H37Rv
gggggcuuaugcgucugcuc

SEQ ID NO: 3286290 - RNA, 21 nt, Mycobacterium tuberculosis H37Rv
gggggcuuaugcgucugcucg

SEQ ID NO: 3286291 - RNA, 20 nt, Mycobacterium tuberculosis H37Rv
gggggcuuauguguccgcuc

SEQ ID NO: 3286292 - RNA, 21 nt, Mycobacterium tuberculosis H37Rv
gggggcuuauguguccgcucg

SEQ ID NO: 3286293 - RNA, 19 nt, Mycobacterium tuberculosis H37Rv
gggggcuuuuacgucugcu

SEQ ID NO: 3286294 - RNA, 19 nt, Mycobacterium tuberculosis H37Rv
gggggcuuuugcgucugcu

SEQ ID NO: 3286295 - RNA, 15 nt, Mycobacterium tuberculosis H37Rv
ggggguccggcggcc

SEQ ID NO: 3286296 - RNA, 18 nt, Mycobacterium tuberculosis H37Rv
ggggguccggcggccgcc

SEQ ID NO: 3286297 - RNA, 17 nt, Mycobacterium tuberculosis H37Rv
gggggucuugccgagca

SEQ ID NO: 3286298 - RNA, 12 nt, Mycobacterium tuberculosis H37Rv
ggggguggcagc

SEQ ID NO: 3286299 - RNA, 16 nt, Mycobacterium tuberculosis H37Rv
ggggguggcagcgcgg

SEQ ID NO: 3286300 - RNA, 17 nt, Mycobacterium tuberculosis H37Rv
ggggguucuggccguag

SEQ ID NO: 3286301 - RNA, 19 nt, Mycobacterium tuberculosis H37Rv
ggggguugcggcagcuggc

SEQ ID NO: 3286302 - RNA, 23 nt, Mycobacterium tuberculosis H37Rv
gggguaauacgcggggccggccg

SEQ ID NO: 3286303 - RNA, 14 nt, Mycobacterium tuberculosis H37Rv
gggguaggggucga

SEQ ID NO: 3286304 - RNA, 18 nt, Mycobacterium tuberculosis H37Rv
gggguaguugaggccguc

SEQ ID NO: 3286305 - RNA, 18 nt, Mycobacterium tuberculosis H37Rv
gggguaucaaccggccgg

SEQ ID NO: 3286306 - RNA, 22 nt, Mycobacterium tuberculosis H37Rv
gggguaucgacccuccagcacg

SEQ ID NO: 3286307 - RNA, 24 nt, Mycobacterium tuberculosis H37Rv
gggguaucgacccuccagcacgcc

SEQ ID NO: 3286308 - RNA, 18 nt, Mycobacterium tuberculosis H37Rv
ggggucacccaucucgaa

SEQ ID NO: 3286309 - RNA, 14 nt, Mycobacterium tuberculosis H37Rv
ggggucagcucgcc

SEQ ID NO: 3286310 - RNA, 14 nt, Mycobacterium tuberculosis H37Rv
gggguccagcgucc

SEQ ID NO: 3286311 - RNA, 16 nt, Mycobacterium tuberculosis H37Rv
ggggucgccggcaccg

SEQ ID NO: 3286312 - RNA, 18 nt, Mycobacterium tuberculosis H37Rv
ggggucgcugugcagcgg

SEQ ID NO: 3286313 - RNA, 19 nt, Mycobacterium tuberculosis H37Rv
ggggucuugacggcgccag

SEQ ID NO: 3286314 - RNA, 22 nt, Mycobacterium tuberculosis H37Rv
ggggugcacgccuugagccgag

SEQ ID NO: 3286315 - RNA, 20 nt, Mycobacterium tuberculosis H37Rv
ggggugcccggccgccagcg

SEQ ID NO: 3286316 - RNA, 11 nt, Mycobacterium tuberculosis H37Rv
ggggugccgau

SEQ ID NO: 3286317 - RNA, 14 nt, Mycobacterium tuberculosis H37Rv
ggggugccggcgau

SEQ ID NO: 3286318 - RNA, 14 nt, Mycobacterium tuberculosis H37Rv
ggggugcgcccacc

SEQ ID NO: 3286319 - RNA, 22 nt, Mycobacterium tuberculosis H37Rv
ggggugcgcgcgaccauacccg

SEQ ID NO: 3286320 - RNA, 13 nt, Mycobacterium tuberculosis H37Rv
ggggugcuuucgc

SEQ ID NO: 3286321 - RNA, 20 nt, Mycobacterium tuberculosis H37Rv
gggguggccaccagcggcau

SEQ ID NO: 3286322 - RNA, 13 nt, Mycobacterium tuberculosis H37Rv
gggguggcgcggg

SEQ ID NO: 3286323 - RNA, 15 nt, Mycobacterium tuberculosis H37Rv
gggguggcggcaggu

SEQ ID NO: 3286324 - RNA, 16 nt, Mycobacterium tuberculosis H37Rv
gggguggucgaacucg

SEQ ID NO: 3286325 - RNA, 22 nt, Mycobacterium tuberculosis H37Rv
gggguggucucgauaucaguga

SEQ ID NO: 3286326 - RNA, 22 nt, Mycobacterium tuberculosis H37Rv
ggggugucaaucacccagccgg

SEQ ID NO: 3286327 - RNA, 16 nt, Mycobacterium tuberculosis H37Rv
ggggugugcgggcggu

SEQ ID NO: 3286328 - RNA, 21 nt, Mycobacterium tuberculosis H37Rv
ggggugugcgggcggugcaca

SEQ ID NO: 3286329 - RNA, 14 nt, Mycobacterium tuberculosis H37Rv
ggggugugcggggu

SEQ ID NO: 3286330 - RNA, 23 nt, Mycobacterium tuberculosis H37Rv
ggggugugcgggguugggcggag

SEQ ID NO: 3286331 - RNA, 15 nt, Mycobacterium tuberculosis H37Rv
ggggugugcgguugc

SEQ ID NO: 3286332 - RNA, 17 nt, Mycobacterium tuberculosis H37Rv
gggguugacuggccgcc

SEQ ID NO: 3286333 - RNA, 17 nt, Mycobacterium tuberculosis H37Rv
gggguugaucaccgaca

SEQ ID NO: 3286334 - RNA, 19 nt, Mycobacterium tuberculosis H37Rv
gggguuguucggcagccau

SEQ ID NO: 3286335 - RNA, 20 nt, Mycobacterium tuberculosis H37Rv
ggguaacaccuuucgccgag

SEQ ID NO: 3286336 - RNA, 22 nt, Mycobacterium tuberculosis H37Rv
ggguaagcgaccgacgccauug

SEQ ID NO: 3286337 - RNA, 21 nt, Mycobacterium tuberculosis H37Rv
ggguaauucuugacgccgaug

SEQ ID NO: 3286338 - RNA, 22 nt, Mycobacterium tuberculosis H37Rv
ggguacaagacgauucaccaau

SEQ ID NO: 3286339 - RNA, 18 nt, Mycobacterium tuberculosis H37Rv
ggguacagacacgcgcgc

SEQ ID NO: 3286340 - RNA, 19 nt, Mycobacterium tuberculosis H37Rv
ggguacccgguggcaccau

SEQ ID NO: 3286341 - RNA, 20 nt, Mycobacterium tuberculosis H37Rv
ggguaccucccgcuugcggg

SEQ ID NO: 3286342 - RNA, 18 nt, Mycobacterium tuberculosis H37Rv
ggguacgacaccgcagcg

SEQ ID NO: 3286343 - RNA, 24 nt, Mycobacterium tuberculosis H37Rv
ggguacgacaccgcagcgggcggu

SEQ ID NO: 3286344 - RNA, 16 nt, Mycobacterium tuberculosis H37Rv
ggguacgcaucucgag

SEQ ID NO: 3286345 - RNA, 24 nt, Mycobacterium tuberculosis H37Rv
ggguacgucaccggguccggugaa

SEQ ID NO: 3286346 - RNA, 14 nt, Mycobacterium tuberculosis H37Rv
ggguagacaccgcg

SEQ ID NO: 3286347 - RNA, 15 nt, Mycobacterium tuberculosis H37Rv
ggguagacaccgcga

SEQ ID NO: 3286348 - RNA, 16 nt, Mycobacterium tuberculosis H37Rv
ggguagaccuucucgc

SEQ ID NO: 3286349 - RNA, 18 nt, Mycobacterium tuberculosis H37Rv
ggguagaccuucucgccg

SEQ ID NO: 3286350 - RNA, 19 nt, Mycobacterium tuberculosis H37Rv
ggguagacggggcgagcau

SEQ ID NO: 3286351 - RNA, 14 nt, Mycobacterium tuberculosis H37Rv
ggguagauccgccg

SEQ ID NO: 3286352 - RNA, 14 nt, Mycobacterium tuberculosis H37Rv
gggugcuggcagga

SEQ ID NO: 3286353 - RNA, 17 nt, Mycobacterium tuberculosis H37Rv
gggugcuuccucgcgag

SEQ ID NO: 3286354 - RNA, 21 nt, Mycobacterium tuberculosis H37Rv
gggugcuuucgcgucugcucg

SEQ ID NO: 3286355 - RNA, 14 nt, Mycobacterium tuberculosis H37Rv
ggguggaaucaggg

SEQ ID NO: 3286356 - RNA, 13 nt, Mycobacterium tuberculosis H37Rv
ggguggacaccug

SEQ ID NO: 3286357 - RNA, 15 nt, Mycobacterium tuberculosis H37Rv
ggguggaccggucga

SEQ ID NO: 3286358 - RNA, 19 nt, Mycobacterium tuberculosis H37Rv
ggguggaguuggcugccgg

SEQ ID NO: 3286359 - RNA, 13 nt, Mycobacterium tuberculosis H37Rv
ggguggcaccggu

SEQ ID NO: 3286360 - RNA, 17 nt, Mycobacterium tuberculosis H37Rv
ggguggccacgcccagg

SEQ ID NO: 3286361 - RNA, 12 nt, Mycobacterium tuberculosis H37Rv
ggguggccagca

SEQ ID NO: 3286362 - RNA, 15 nt, Mycobacterium tuberculosis H37Rv
ggguggccagcaggc

SEQ ID NO: 3286363 - RNA, 17 nt, Mycobacterium tuberculosis H37Rv
ggguggccaucaccgcg

SEQ ID NO: 3286364 - RNA, 16 nt, Mycobacterium tuberculosis H37Rv
ggguggcgaggcagca

SEQ ID NO: 3286365 - RNA, 24 nt, Mycobacterium tuberculosis H37Rv
ggguggcgccaggucggcggacgc

SEQ ID NO: 3286366 - RNA, 22 nt, Mycobacterium tuberculosis H37Rv
ggguggcgccaguucggcgggc

SEQ ID NO: 3286367 - RNA, 11 nt, Mycobacterium tuberculosis H37Rv
ggguggcggcg

SEQ ID NO: 3286368 - RNA, 12 nt, Mycobacterium tuberculosis H37Rv
ggguggcggcgc

SEQ ID NO: 3286369 - RNA, 16 nt, Mycobacterium tuberculosis H37Rv
ggguggcgucaccgcc

SEQ ID NO: 3286370 - RNA, 21 nt, Mycobacterium tuberculosis H37Rv
ggguggcgucgaucucgauca

SEQ ID NO: 3286371 - RNA, 12 nt, Mycobacterium tuberculosis H37Rv
ggguggcgucgc

SEQ ID NO: 3286372 - RNA, 14 nt, Mycobacterium tuberculosis H37Rv
ggguggcgucgcgg

SEQ ID NO: 3286373 - RNA, 14 nt, Mycobacterium tuberculosis H37Rv
gggugggagcagcc

SEQ ID NO: 3286374 - RNA, 12 nt, Mycobacterium tuberculosis H37Rv
gggugggcguga

SEQ ID NO: 3286375 - RNA, 20 nt, Mycobacterium tuberculosis H37Rv
gggugggucggcuuccggug

SEQ ID NO: 3286376 - RNA, 11 nt, Mycobacterium tuberculosis H37Rv
gggugggugca

SEQ ID NO: 3286377 - RNA, 23 nt, Mycobacterium tuberculosis H37Rv
gggugguagcugacgcugcucug

SEQ ID NO: 3286378 - RNA, 12 nt, Mycobacterium tuberculosis H37Rv
gggugguccagc

SEQ ID NO: 3286379 - RNA, 21 nt, Mycobacterium tuberculosis H37Rv
ggguggucucgauaucaguga

SEQ ID NO: 3286380 - RNA, 13 nt, Mycobacterium tuberculosis H37Rv
ggguggugccagg

SEQ ID NO: 3286381 - RNA, 13 nt, Mycobacterium tuberculosis H37Rv
gggugguggugga

SEQ ID NO: 3286382 - RNA, 19 nt, Mycobacterium tuberculosis H37Rv
ggguggugucgcggccgcc

SEQ ID NO: 3286383 - RNA, 21 nt, Mycobacterium tuberculosis H37Rv
gggugguucaccucggcgacg

SEQ ID NO: 3286384 - RNA, 20 nt, Mycobacterium tuberculosis H37Rv
ggguguagcaagucgccgag

SEQ ID NO: 3286385 - RNA, 16 nt, Mycobacterium tuberculosis H37Rv
gggugucgaagagcag

SEQ ID NO: 3286386 - RNA, 14 nt, Mycobacterium tuberculosis H37Rv
gggugugcccgggu

SEQ ID NO: 3286387 - RNA, 14 nt, Mycobacterium tuberculosis H37Rv
gggugugcgggcgg

SEQ ID NO: 3286388 - RNA, 17 nt, Mycobacterium tuberculosis H37Rv
ggguguuugucgcggug

SEQ ID NO: 3286389 - RNA, 18 nt, Mycobacterium tuberculosis H37Rv
ggguuacucgcagcgccg

SEQ ID NO: 3286390 - RNA, 20 nt, Mycobacterium tuberculosis H37Rv
ggguucuuuugcgucugcuc

SEQ ID NO: 3286391 - RNA, 19 nt, Mycobacterium tuberculosis H37Rv
ggguugacguaggcggcgg

SEQ ID NO: 3286392 - RNA, 13 nt, Mycobacterium tuberculosis H37Rv
ggguugaggaucc

SEQ ID NO: 3286393 - RNA, 14 nt, Mycobacterium tuberculosis H37Rv
ggguugaucaccga

SEQ ID NO: 3286394 - RNA, 16 nt, Mycobacterium tuberculosis H37Rv
ggguugcggcagcugg

SEQ ID NO: 3286395 - RNA, 14 nt, Mycobacterium tuberculosis H37Rv
ggguuggccggcgc

SEQ ID NO: 3286396 - RNA, 14 nt, Mycobacterium tuberculosis H37Rv
ggguugggcggagc

SEQ ID NO: 3286397 - RNA, 17 nt, Mycobacterium tuberculosis H37Rv
ggguuucgaucuucucg

SEQ ID NO: 3286398 - RNA, 23 nt, Mycobacterium tuberculosis H37Rv
ggguuucgaucuucucgcggacg

SEQ ID NO: 3286399 - RNA, 18 nt, Mycobacterium tuberculosis H37Rv
ggguuugagccaaucgug

SEQ ID NO: 3286400 - RNA, 21 nt, Mycobacterium tuberculosis H37Rv
ggguuuugauagacgacccgg

SEQ ID NO: 3286401 - RNA, 13 nt, Mycobacterium tuberculosis H37Rv
gguaaagccgcgg

SEQ ID NO: 3286402 - RNA, 14 nt, Mycobacterium tuberculosis H37Rv
gguaaagcgauggg

SEQ ID NO: 3286403 - RNA, 17 nt, Mycobacterium tuberculosis H37Rv
gguaaaguucuccaaca

SEQ ID NO: 3286404 - RNA, 15 nt, Mycobacterium tuberculosis H37Rv
gguaaccggcggauu

SEQ ID NO: 3286405 - RNA, 19 nt, Mycobacterium tuberculosis H37Rv
gguaaccggcggcagcgau

SEQ ID NO: 3286406 - RNA, 17 nt, Mycobacterium tuberculosis H37Rv
gguaacgcgacaagguc

SEQ ID NO: 3286407 - RNA, 14 nt, Mycobacterium tuberculosis H37Rv
gguaagcagccagc

SEQ ID NO: 3286408 - RNA, 21 nt, Mycobacterium tuberculosis H37Rv
gguaagugccucgcgggaagu

SEQ ID NO: 3286409 - RNA, 13 nt, Mycobacterium tuberculosis H37Rv
gguaaucgcgaga

SEQ ID NO: 3286410 - RNA, 14 nt, Mycobacterium tuberculosis H37Rv
gguaauucgcggcc

SEQ ID NO: 3286411 - RNA, 15 nt, Mycobacterium tuberculosis H37Rv
gguacacccgcucgc

SEQ ID NO: 3286412 - RNA, 17 nt, Mycobacterium tuberculosis H37Rv
gguacacccgcucgccc

SEQ ID NO: 3286413 - RNA, 22 nt, Mycobacterium tuberculosis H37Rv
gguacagacacgcgcgcucgcg

SEQ ID NO: 3286414 - RNA, 21 nt, Mycobacterium tuberculosis H37Rv
gguacaucgaggccacgccag

SEQ ID NO: 3286415 - RNA, 16 nt, Mycobacterium tuberculosis H37Rv
gguaccaaccugcgcg

SEQ ID NO: 3286416 - RNA, 21 nt, Mycobacterium tuberculosis H37Rv
gguaccccccagcgacggcaa

SEQ ID NO: 3286417 - RNA, 19 nt, Mycobacterium tuberculosis H37Rv
gguaccgagcacaucgcca

SEQ ID NO: 3286418 - RNA, 20 nt, Mycobacterium tuberculosis H37Rv
gguaccgccacuggcgcuga

SEQ ID NO: 3286419 - RNA, 11 nt, Mycobacterium tuberculosis H37Rv
gguaccgcccg

SEQ ID NO: 3286420 - RNA, 17 nt, Mycobacterium tuberculosis H37Rv
gguaccggaaucggcgg

SEQ ID NO: 3286421 - RNA, 17 nt, Mycobacterium tuberculosis H37Rv
gguaccggcggcaaagc

SEQ ID NO: 3286422 - RNA, 13 nt, Mycobacterium tuberculosis H37Rv
gguaccggcggcg

SEQ ID NO: 3286423 - RNA, 22 nt, Mycobacterium tuberculosis H37Rv
gguaccggcuucgucggccagc

SEQ ID NO: 3286424 - RNA, 21 nt, Mycobacterium tuberculosis H37Rv
gguaccucgucgagcgugcgc

SEQ ID NO: 3286425 - RNA, 18 nt, Mycobacterium tuberculosis H37Rv
gguacgccaggugcagca

SEQ ID NO: 3286426 - RNA, 19 nt, Mycobacterium tuberculosis H37Rv
gguacgccggucggugcgg

SEQ ID NO: 3286427 - RNA, 19 nt, Mycobacterium tuberculosis H37Rv
gguacggucucacggcgcg

SEQ ID NO: 3286428 - RNA, 15 nt, Mycobacterium tuberculosis H37Rv
gguacgucaccgggu

SEQ ID NO: 3286429 - RNA, 14 nt, Mycobacterium tuberculosis H37Rv
gguacucccgcgau

SEQ ID NO: 3286430 - RNA, 16 nt, Mycobacterium tuberculosis H37Rv
gguacugcggcucgcu

SEQ ID NO: 3286431 - RNA, 18 nt, Mycobacterium tuberculosis H37Rv
gguacuugccacggcgau

SEQ ID NO: 3286432 - RNA, 19 nt, Mycobacterium tuberculosis H37Rv
gguacuugccacggcgauu

SEQ ID NO: 3286433 - RNA, 13 nt, Mycobacterium tuberculosis H37Rv
gguagacacccca

SEQ ID NO: 3286434 - RNA, 16 nt, Mycobacterium tuberculosis H37Rv
gguagacaccgcgauc

SEQ ID NO: 3286435 - RNA, 18 nt, Mycobacterium tuberculosis H37Rv
gguagaccaccugcaugu

SEQ ID NO: 3286436 - RNA, 13 nt, Mycobacterium tuberculosis H37Rv
gguagaccaugaa

SEQ ID NO: 3286437 - RNA, 16 nt, Mycobacterium tuberculosis H37Rv
gguagaccaugaagaa

SEQ ID NO: 3286438 - RNA, 12 nt, Mycobacterium tuberculosis H37Rv
gguagagguugu

SEQ ID NO: 3286439 - RNA, 15 nt, Mycobacterium tuberculosis H37Rv
gguagcacagcagca

SEQ ID NO: 3286440 - RNA, 14 nt, Mycobacterium tuberculosis H37Rv
gguagcacggucug

SEQ ID NO: 3286441 - RNA, 21 nt, Mycobacterium tuberculosis H37Rv
gguagccaaccugaagccagc

SEQ ID NO: 3286442 - RNA, 16 nt, Mycobacterium tuberculosis H37Rv
gguagccauucggugu

SEQ ID NO: 3286443 - RNA, 23 nt, Mycobacterium tuberculosis H37Rv
gguagccccgucgaccuccacca

SEQ ID NO: 3286444 - RNA, 15 nt, Mycobacterium tuberculosis H37Rv
gguagccgaccagcg

SEQ ID NO: 3286445 - RNA, 13 nt, Mycobacterium tuberculosis H37Rv
gguagccgacgac

SEQ ID NO: 3286446 - RNA, 16 nt, Mycobacterium tuberculosis H37Rv
gguagccgcggccaca

SEQ ID NO: 3286447 - RNA, 13 nt, Mycobacterium tuberculosis H37Rv
gguagccgggcac

SEQ ID NO: 3286448 - RNA, 13 nt, Mycobacterium tuberculosis H37Rv
gguagccgucgau

SEQ ID NO: 3286449 - RNA, 15 nt, Mycobacterium tuberculosis H37Rv
ggucaguccgacacc

SEQ ID NO: 3286450 - RNA, 19 nt, Mycobacterium tuberculosis H37Rv
ggucaguccgucggccugg

SEQ ID NO: 3286451 - RNA, 20 nt, Mycobacterium tuberculosis H37Rv
ggucagugggacgggcgcgu

SEQ ID NO: 3286452 - RNA, 15 nt, Mycobacterium tuberculosis H37Rv
ggucaucagcgugca

SEQ ID NO: 3286453 - RNA, 23 nt, Mycobacterium tuberculosis H37Rv
ggucaucagcgugcauggcggug

SEQ ID NO: 3286454 - RNA, 21 nt, Mycobacterium tuberculosis H37Rv
ggucaucauggccggauccca

SEQ ID NO: 3286455 - RNA, 16 nt, Mycobacterium tuberculosis H37Rv
ggucauccagccagca

SEQ ID NO: 3286456 - RNA, 18 nt, Mycobacterium tuberculosis H37Rv
ggucauccagccagcaag

SEQ ID NO: 3286457 - RNA, 15 nt, Mycobacterium tuberculosis H37Rv
ggucaucgagcugac

SEQ ID NO: 3286458 - RNA, 19 nt, Mycobacterium tuberculosis H37Rv
ggucaucgccacgccugcu

SEQ ID NO: 3286459 - RNA, 13 nt, Mycobacterium tuberculosis H37Rv
ggucaucggcgcc

SEQ ID NO: 3286460 - RNA, 22 nt, Mycobacterium tuberculosis H37Rv
ggucaucuuguugucgacaucg

SEQ ID NO: 3286461 - RNA, 14 nt, Mycobacterium tuberculosis H37Rv
ggucaugggcgcgu

SEQ ID NO: 3286462 - RNA, 15 nt, Mycobacterium tuberculosis H37Rv
ggucaugucgaucag

SEQ ID NO: 3286463 - RNA, 14 nt, Mycobacterium tuberculosis H37Rv
gguccaaagcacgu

SEQ ID NO: 3286464 - RNA, 13 nt, Mycobacterium tuberculosis H37Rv
gguccaacagcgc

SEQ ID NO: 3286465 - RNA, 14 nt, Mycobacterium tuberculosis H37Rv
gguccaacagcgcc

SEQ ID NO: 3286466 - RNA, 15 nt, Mycobacterium tuberculosis H37Rv
gguccaaccagcacc

SEQ ID NO: 3286467 - RNA, 18 nt, Mycobacterium tuberculosis H37Rv
gguccaaccccagcgaca

SEQ ID NO: 3286468 - RNA, 22 nt, Mycobacterium tuberculosis H37Rv
gguccaaccccagcgacaugcc

SEQ ID NO: 3286469 - RNA, 22 nt, Mycobacterium tuberculosis H37Rv
gguccaagugcuuccggccauu

SEQ ID NO: 3286470 - RNA, 17 nt, Mycobacterium tuberculosis H37Rv
gguccaagugggccggc

SEQ ID NO: 3286471 - RNA, 14 nt, Mycobacterium tuberculosis H37Rv
gguccaaugccuug

SEQ ID NO: 3286472 - RNA, 19 nt, Mycobacterium tuberculosis H37Rv
gguccacaaaccgugcacg

SEQ ID NO: 3286473 - RNA, 14 nt, Mycobacterium tuberculosis H37Rv
gguccacacgcugc

SEQ ID NO: 3286474 - RNA, 16 nt, Mycobacterium tuberculosis H37Rv
gguccacagccggcgg

SEQ ID NO: 3286475 - RNA, 16 nt, Mycobacterium tuberculosis H37Rv
gguccaccccgccgau

SEQ ID NO: 3286476 - RNA, 21 nt, Mycobacterium tuberculosis H37Rv
gguccaccgaccuaccgucga

SEQ ID NO: 3286477 - RNA, 14 nt, Mycobacterium tuberculosis H37Rv
gguccaccggccag

SEQ ID NO: 3286478 - RNA, 18 nt, Mycobacterium tuberculosis H37Rv
gguccaccuuggucgcca

SEQ ID NO: 3286479 - RNA, 19 nt, Mycobacterium tuberculosis H37Rv
gguccaccuuggucgccaa

SEQ ID NO: 3286480 - RNA, 23 nt, Mycobacterium tuberculosis H37Rv
gguccagacaucagugcgccggc

SEQ ID NO: 3286481 - RNA, 22 nt, Mycobacterium tuberculosis H37Rv
gguccagcagcucggccgaggc

SEQ ID NO: 3286482 - RNA, 18 nt, Mycobacterium tuberculosis H37Rv
gguccagccaacgggaac

SEQ ID NO: 3286483 - RNA, 20 nt, Mycobacterium tuberculosis H37Rv
gguccagccuuuuucggcga

SEQ ID NO: 3286484 - RNA, 14 nt, Mycobacterium tuberculosis H37Rv
gguccagcggccgc

SEQ ID NO: 3286485 - RNA, 23 nt, Mycobacterium tuberculosis H37Rv
gguccagcgggaucugacccagc

SEQ ID NO: 3286486 - RNA, 15 nt, Mycobacterium tuberculosis H37Rv
gguccaggcccuggc

SEQ ID NO: 3286487 - RNA, 22 nt, Mycobacterium tuberculosis H37Rv
gguccaggcguuggaucccagc

SEQ ID NO: 3286488 - RNA, 13 nt, Mycobacterium tuberculosis H37Rv
gguccaggucggg

SEQ ID NO: 3286489 - RNA, 21 nt, Mycobacterium tuberculosis H37Rv
ggucccacaccuccucgagca

SEQ ID NO: 3286490 - RNA, 14 nt, Mycobacterium tuberculosis H37Rv
ggucccagccuggc

SEQ ID NO: 3286491 - RNA, 17 nt, Mycobacterium tuberculosis H37Rv
ggucccagccuggcaac

SEQ ID NO: 3286492 - RNA, 14 nt, Mycobacterium tuberculosis H37Rv
ggucccccgcagcc

SEQ ID NO: 3286493 - RNA, 20 nt, Mycobacterium tuberculosis H37Rv
gguccccgcagcucgaccag

SEQ ID NO: 3286494 - RNA, 19 nt, Mycobacterium tuberculosis H37Rv
ggucccgcuacaccugcgg

SEQ ID NO: 3286495 - RNA, 15 nt, Mycobacterium tuberculosis H37Rv
ggucccggcagcugg

SEQ ID NO: 3286496 - RNA, 19 nt, Mycobacterium tuberculosis H37Rv
ggucccggccgggucuucc

SEQ ID NO: 3286497 - RNA, 12 nt, Mycobacterium tuberculosis H37Rv
ggucccgugcgc

SEQ ID NO: 3286498 - RNA, 18 nt, Mycobacterium tuberculosis H37Rv
ggucccgugcgcgcgcag

SEQ ID NO: 3286499 - RNA, 22 nt, Mycobacterium tuberculosis H37Rv
ggucccgugcgcgcgcagcuga

SEQ ID NO: 3286500 - RNA, 21 nt, Mycobacterium tuberculosis H37Rv
ggucccguugccgcccacuag

SEQ ID NO: 3286501 - RNA, 22 nt, Mycobacterium tuberculosis H37Rv
ggucccuuguggucugccagca

SEQ ID NO: 3286502 - RNA, 15 nt, Mycobacterium tuberculosis H37Rv
gguccgacagccccg

SEQ ID NO: 3286503 - RNA, 13 nt, Mycobacterium tuberculosis H37Rv
gguccgaccagcg

SEQ ID NO: 3286504 - RNA, 16 nt, Mycobacterium tuberculosis H37Rv
gguccgaccagcggcc

SEQ ID NO: 3286505 - RNA, 15 nt, Mycobacterium tuberculosis H37Rv
gguccgacgggccac

SEQ ID NO: 3286506 - RNA, 17 nt, Mycobacterium tuberculosis H37Rv
gguccgaugcgugccga

SEQ ID NO: 3286507 - RNA, 22 nt, Mycobacterium tuberculosis H37Rv
gguccgaugcgugccgacccgc

SEQ ID NO: 3286508 - RNA, 18 nt, Mycobacterium tuberculosis H37Rv
gguccgcacgaucugcag

SEQ ID NO: 3286509 - RNA, 16 nt, Mycobacterium tuberculosis H37Rv
gguccgccaacggcac

SEQ ID NO: 3286510 - RNA, 17 nt, Mycobacterium tuberculosis H37Rv
gguccgccacggcgggc

SEQ ID NO: 3286511 - RNA, 14 nt, Mycobacterium tuberculosis H37Rv
gguccgccggugcc

SEQ ID NO: 3286512 - RNA, 18 nt, Mycobacterium tuberculosis H37Rv
gguccgcgugcugccgua

SEQ ID NO: 3286513 - RNA, 22 nt, Mycobacterium tuberculosis H37Rv
gguccggcccaccagcgcagcc

SEQ ID NO: 3286514 - RNA, 12 nt, Mycobacterium tuberculosis H37Rv
gguccggcggcc

SEQ ID NO: 3286515 - RNA, 13 nt, Mycobacterium tuberculosis H37Rv
gguccggggcaac

SEQ ID NO: 3286516 - RNA, 15 nt, Mycobacterium tuberculosis H37Rv
gguccggugaacccg

SEQ ID NO: 3286517 - RNA, 17 nt, Mycobacterium tuberculosis H37Rv
gguccgucaccaccgcc

SEQ ID NO: 3286518 - RNA, 17 nt, Mycobacterium tuberculosis H37Rv
gguccgucggguagugc

SEQ ID NO: 3286519 - RNA, 13 nt, Mycobacterium tuberculosis H37Rv
gguccgugccgau

SEQ ID NO: 3286520 - RNA, 14 nt, Mycobacterium tuberculosis H37Rv
gguccucagcgaug

SEQ ID NO: 3286521 - RNA, 14 nt, Mycobacterium tuberculosis H37Rv
gguccuccuucggu

SEQ ID NO: 3286522 - RNA, 21 nt, Mycobacterium tuberculosis H37Rv
gguccucgagguccucgucgg

SEQ ID NO: 3286523 - RNA, 14 nt, Mycobacterium tuberculosis H37Rv
gguccucgcggagc

SEQ ID NO: 3286524 - RNA, 15 nt, Mycobacterium tuberculosis H37Rv
gguccucgucggcga

SEQ ID NO: 3286525 - RNA, 15 nt, Mycobacterium tuberculosis H37Rv
gguccucgucgucga

SEQ ID NO: 3286526 - RNA, 12 nt, Mycobacterium tuberculosis H37Rv
gguccugcgguc

SEQ ID NO: 3286527 - RNA, 17 nt, Mycobacterium tuberculosis H37Rv
gguccugcggucgcgga

SEQ ID NO: 3286528 - RNA, 19 nt, Mycobacterium tuberculosis H37Rv
gguccugcucgcacagcac

SEQ ID NO: 3286529 - RNA, 21 nt, Mycobacterium tuberculosis H37Rv
gguccugcucgcacagcacca

SEQ ID NO: 3286530 - RNA, 18 nt, Mycobacterium tuberculosis H37Rv
gguccugguguagccgag

SEQ ID NO: 3286531 - RNA, 18 nt, Mycobacterium tuberculosis H37Rv
gguccuucugccgggaga

SEQ ID NO: 3286532 - RNA, 17 nt, Mycobacterium tuberculosis H37Rv
gguccuugcggccgggc

SEQ ID NO: 3286533 - RNA, 15 nt, Mycobacterium tuberculosis H37Rv
ggucgaacagcgaac

SEQ ID NO: 3286534 - RNA, 19 nt, Mycobacterium tuberculosis H37Rv
ggucgaacuugaucaccgc

SEQ ID NO: 3286535 - RNA, 20 nt, Mycobacterium tuberculosis H37Rv
ggucgaacuugaucaccgcg

SEQ ID NO: 3286536 - RNA, 22 nt, Mycobacterium tuberculosis H37Rv
ggucgaacuugaucaccgcgua

SEQ ID NO: 3286537 - RNA, 21 nt, Mycobacterium tuberculosis H37Rv
ggucgaagaccaagagcgcgc

SEQ ID NO: 3286538 - RNA, 12 nt, Mycobacterium tuberculosis H37Rv
ggucgaagcugg

SEQ ID NO: 3286539 - RNA, 17 nt, Mycobacterium tuberculosis H37Rv
ggucgaaucgcugccgc

SEQ ID NO: 3286540 - RNA, 20 nt, Mycobacterium tuberculosis H37Rv
ggucgaaucgcugccgccga

SEQ ID NO: 3286541 - RNA, 21 nt, Mycobacterium tuberculosis H37Rv
ggucgacagcgaaggcgccga

SEQ ID NO: 3286542 - RNA, 19 nt, Mycobacterium tuberculosis H37Rv
ggucgacaggugccagacc

SEQ ID NO: 3286543 - RNA, 13 nt, Mycobacterium tuberculosis H37Rv
ggucgaccaucgg

SEQ ID NO: 3286544 - RNA, 14 nt, Mycobacterium tuberculosis H37Rv
ggucgaccaucggu

SEQ ID NO: 3286545 - RNA, 22 nt, Mycobacterium tuberculosis H37Rv
ggucggcuacggccagugccau

SEQ ID NO: 3286546 - RNA, 13 nt, Mycobacterium tuberculosis H37Rv
ggucggcugucac

SEQ ID NO: 3286547 - RNA, 22 nt, Mycobacterium tuberculosis H37Rv
ggucggcugucgugccucucgg

SEQ ID NO: 3286548 - RNA, 21 nt, Mycobacterium tuberculosis H37Rv
ggucggcuucgacaaccucga

SEQ ID NO: 3286549 - RNA, 17 nt, Mycobacterium tuberculosis H37Rv
ggucgggcaaccugccg

SEQ ID NO: 3286550 - RNA, 14 nt, Mycobacterium tuberculosis H37Rv
ggucgggcagcacu

SEQ ID NO: 3286551 - RNA, 12 nt, Mycobacterium tuberculosis H37Rv
ggucgggcggcg

SEQ ID NO: 3286552 - RNA, 13 nt, Mycobacterium tuberculosis H37Rv
ggucgggcggcga

SEQ ID NO: 3286553 - RNA, 15 nt, Mycobacterium tuberculosis H37Rv
ggucgggcggcgacc

SEQ ID NO: 3286554 - RNA, 19 nt, Mycobacterium tuberculosis H37Rv
ggucgggcggcgaccucgg

SEQ ID NO: 3286555 - RNA, 20 nt, Mycobacterium tuberculosis H37Rv
ggucggggagcugcggcggc

SEQ ID NO: 3286556 - RNA, 17 nt, Mycobacterium tuberculosis H37Rv
ggucgggguccgcggca

SEQ ID NO: 3286557 - RNA, 17 nt, Mycobacterium tuberculosis H37Rv
ggucgggucgaucaccg

SEQ ID NO: 3286558 - RNA, 13 nt, Mycobacterium tuberculosis H37Rv
ggucggucacgac

SEQ ID NO: 3286559 - RNA, 12 nt, Mycobacterium tuberculosis H37Rv
ggucggucaggu

SEQ ID NO: 3286560 - RNA, 20 nt, Mycobacterium tuberculosis H37Rv
ggucgguccgcacugugccc

SEQ ID NO: 3286561 - RNA, 15 nt, Mycobacterium tuberculosis H37Rv
ggucggugacugugc

SEQ ID NO: 3286562 - RNA, 22 nt, Mycobacterium tuberculosis H37Rv
ggucggugaugguuucggcggg

SEQ ID NO: 3286563 - RNA, 15 nt, Mycobacterium tuberculosis H37Rv
ggucggugggcggcg

SEQ ID NO: 3286564 - RNA, 20 nt, Mycobacterium tuberculosis H37Rv
ggucgguggucucgacggcg

SEQ ID NO: 3286565 - RNA, 18 nt, Mycobacterium tuberculosis H37Rv
ggucgguuuccuccggca

SEQ ID NO: 3286566 - RNA, 20 nt, Mycobacterium tuberculosis H37Rv
ggucguagacgguuaccgcg

SEQ ID NO: 3286567 - RNA, 20 nt, Mycobacterium tuberculosis H37Rv
ggucguaggacaccaccgug

SEQ ID NO: 3286568 - RNA, 22 nt, Mycobacterium tuberculosis H37Rv
ggucguaggcgcuaggaacgcc

SEQ ID NO: 3286569 - RNA, 14 nt, Mycobacterium tuberculosis H37Rv
ggucgucauugccc

SEQ ID NO: 3286570 - RNA, 14 nt, Mycobacterium tuberculosis H37Rv
ggucguccggcggc

SEQ ID NO: 3286571 - RNA, 13 nt, Mycobacterium tuberculosis H37Rv
ggucgucgcgauc

SEQ ID NO: 3286572 - RNA, 15 nt, Mycobacterium tuberculosis H37Rv
ggucgucggcgucgc

SEQ ID NO: 3286573 - RNA, 20 nt, Mycobacterium tuberculosis H37Rv
ggucgugcaggcgacggcuc

SEQ ID NO: 3286574 - RNA, 15 nt, Mycobacterium tuberculosis H37Rv
ggucgugccagcagc

SEQ ID NO: 3286575 - RNA, 12 nt, Mycobacterium tuberculosis H37Rv
ggucgugccgcc

SEQ ID NO: 3286576 - RNA, 22 nt, Mycobacterium tuberculosis H37Rv
ggucguucuccgcgccgccgau

SEQ ID NO: 3286577 - RNA, 14 nt, Mycobacterium tuberculosis H37Rv
ggucguugaggccg

SEQ ID NO: 3286578 - RNA, 16 nt, Mycobacterium tuberculosis H37Rv
ggucguugaggccggu

SEQ ID NO: 3286579 - RNA, 15 nt, Mycobacterium tuberculosis H37Rv
ggucguuggucgggg

SEQ ID NO: 3286580 - RNA, 18 nt, Mycobacterium tuberculosis H37Rv
ggucguugucgggguugc

SEQ ID NO: 3286581 - RNA, 23 nt, Mycobacterium tuberculosis H37Rv
ggucuacgccaccgagaucggac

SEQ ID NO: 3286582 - RNA, 22 nt, Mycobacterium tuberculosis H37Rv
ggucucaacgcaucgguggcac

SEQ ID NO: 3286583 - RNA, 19 nt, Mycobacterium tuberculosis H37Rv
ggucucacguugugagcca

SEQ ID NO: 3286584 - RNA, 15 nt, Mycobacterium tuberculosis H37Rv
ggucucacucaucgg

SEQ ID NO: 3286585 - RNA, 23 nt, Mycobacterium tuberculosis H37Rv
ggucucccagaggucgagcgccu

SEQ ID NO: 3286586 - RNA, 15 nt, Mycobacterium tuberculosis H37Rv
ggucucgaccuucgg

SEQ ID NO: 3286587 - RNA, 13 nt, Mycobacterium tuberculosis H37Rv
ggucucgagucgg

SEQ ID NO: 3286588 - RNA, 20 nt, Mycobacterium tuberculosis H37Rv
ggucucggaaacggaccucc

SEQ ID NO: 3286589 - RNA, 11 nt, Mycobacterium tuberculosis H37Rv
ggucucggccg

SEQ ID NO: 3286590 - RNA, 13 nt, Mycobacterium tuberculosis H37Rv
ggucucggugcgg

SEQ ID NO: 3286591 - RNA, 22 nt, Mycobacterium tuberculosis H37Rv
ggucugacagaccgggcaccag

SEQ ID NO: 3286592 - RNA, 19 nt, Mycobacterium tuberculosis H37Rv
ggucugcagugcagcgauc

SEQ ID NO: 3286593 - RNA, 20 nt, Mycobacterium tuberculosis H37Rv
ggucugccaaaagggcggca

SEQ ID NO: 3286594 - RNA, 16 nt, Mycobacterium tuberculosis H37Rv
ggucugcgccaaaauc

SEQ ID NO: 3286595 - RNA, 20 nt, Mycobacterium tuberculosis H37Rv
ggucugcgccgccggcggcg

SEQ ID NO: 3286596 - RNA, 23 nt, Mycobacterium tuberculosis H37Rv
ggucugcuauugguugaggaggu

SEQ ID NO: 3286597 - RNA, 14 nt, Mycobacterium tuberculosis H37Rv
ggucugcuccaggc

SEQ ID NO: 3286598 - RNA, 17 nt, Mycobacterium tuberculosis H37Rv
ggucugcuccaggcgcg

SEQ ID NO: 3286599 - RNA, 16 nt, Mycobacterium tuberculosis H37Rv
ggucuggacugcagcc

SEQ ID NO: 3286600 - RNA, 18 nt, Mycobacterium tuberculosis H37Rv
ggucuggcaggccagcau

SEQ ID NO: 3286601 - RNA, 18 nt, Mycobacterium tuberculosis H37Rv
ggucuggcgcggagcuga

SEQ ID NO: 3286602 - RNA, 17 nt, Mycobacterium tuberculosis H37Rv
ggucuguaagacagcua

SEQ ID NO: 3286603 - RNA, 15 nt, Mycobacterium tuberculosis H37Rv
ggucuugaacccgau

SEQ ID NO: 3286604 - RNA, 16 nt, Mycobacterium tuberculosis H37Rv
ggucuugcaucgccga

SEQ ID NO: 3286605 - RNA, 21 nt, Mycobacterium tuberculosis H37Rv
ggucuuggauccggccgccaa

SEQ ID NO: 3286606 - RNA, 20 nt, Mycobacterium tuberculosis H37Rv
ggucuugggcgcgggugcgc

SEQ ID NO: 3286607 - RNA, 18 nt, Mycobacterium tuberculosis H37Rv
ggucuuugcucucggucu

SEQ ID NO: 3286608 - RNA, 15 nt, Mycobacterium tuberculosis H37Rv
ggugaaaaucgccau

SEQ ID NO: 3286609 - RNA, 15 nt, Mycobacterium tuberculosis H37Rv
ggugaaaugacggcu

SEQ ID NO: 3286610 - RNA, 15 nt, Mycobacterium tuberculosis H37Rv
ggugaaccccgccgg

SEQ ID NO: 3286611 - RNA, 19 nt, Mycobacterium tuberculosis H37Rv
ggugaacccgauuggggug

SEQ ID NO: 3286612 - RNA, 14 nt, Mycobacterium tuberculosis H37Rv
ggugaacccgccgg

SEQ ID NO: 3286613 - RNA, 21 nt, Mycobacterium tuberculosis H37Rv
ggugaaccgcgcggcgaucga

SEQ ID NO: 3286614 - RNA, 20 nt, Mycobacterium tuberculosis H37Rv
ggugaaccgggacagcagcc

SEQ ID NO: 3286615 - RNA, 23 nt, Mycobacterium tuberculosis H37Rv
ggugaacgacaugggcaggccgc

SEQ ID NO: 3286616 - RNA, 15 nt, Mycobacterium tuberculosis H37Rv
ggugaacggcagcac

SEQ ID NO: 3286617 - RNA, 21 nt, Mycobacterium tuberculosis H37Rv
ggugaacggcagcacggucug

SEQ ID NO: 3286618 - RNA, 21 nt, Mycobacterium tuberculosis H37Rv
ggugaacucguucagcgucga

SEQ ID NO: 3286619 - RNA, 19 nt, Mycobacterium tuberculosis H37Rv
ggugaacuucuccaccagc

SEQ ID NO: 3286620 - RNA, 16 nt, Mycobacterium tuberculosis H37Rv
ggugaagaacaugcuc

SEQ ID NO: 3286621 - RNA, 16 nt, Mycobacterium tuberculosis H37Rv
ggugaagccgagcgcc

SEQ ID NO: 3286622 - RNA, 13 nt, Mycobacterium tuberculosis H37Rv
ggugaaggcaaac

SEQ ID NO: 3286623 - RNA, 20 nt, Mycobacterium tuberculosis H37Rv
ggugaaggcaaacaccagcc

SEQ ID NO: 3286624 - RNA, 20 nt, Mycobacterium tuberculosis H37Rv
ggugaaguagucggcgccga

SEQ ID NO: 3286625 - RNA, 19 nt, Mycobacterium tuberculosis H37Rv
ggugaaguagugcucgcag

SEQ ID NO: 3286626 - RNA, 22 nt, Mycobacterium tuberculosis H37Rv
ggugaaguugccggucaggcag

SEQ ID NO: 3286627 - RNA, 16 nt, Mycobacterium tuberculosis H37Rv
ggugaauaaggcugca

SEQ ID NO: 3286628 - RNA, 17 nt, Mycobacterium tuberculosis H37Rv
ggugaauccgugcaggg

SEQ ID NO: 3286629 - RNA, 20 nt, Mycobacterium tuberculosis H37Rv
ggugaaucgacaccgcccga

SEQ ID NO: 3286630 - RNA, 18 nt, Mycobacterium tuberculosis H37Rv
ggugaaucgacugaucgc

SEQ ID NO: 3286631 - RNA, 16 nt, Mycobacterium tuberculosis H37Rv
ggugacaaauggggug

SEQ ID NO: 3286632 - RNA, 22 nt, Mycobacterium tuberculosis H37Rv
ggugacaaggauggucgccugc

SEQ ID NO: 3286633 - RNA, 18 nt, Mycobacterium tuberculosis H37Rv
ggugaccaacaccccccc

SEQ ID NO: 3286634 - RNA, 17 nt, Mycobacterium tuberculosis H37Rv
ggugaccaacgucgacu

SEQ ID NO: 3286635 - RNA, 16 nt, Mycobacterium tuberculosis H37Rv
ggugaccacggcaagc

SEQ ID NO: 3286636 - RNA, 14 nt, Mycobacterium tuberculosis H37Rv
ggugaccaggccgg

SEQ ID NO: 3286637 - RNA, 22 nt, Mycobacterium tuberculosis H37Rv
ggugaccaggccggcccgcaac

SEQ ID NO: 3286638 - RNA, 15 nt, Mycobacterium tuberculosis H37Rv
ggugaccaggcggcg

SEQ ID NO: 3286639 - RNA, 16 nt, Mycobacterium tuberculosis H37Rv
ggugacccccgagauc

SEQ ID NO: 3286640 - RNA, 16 nt, Mycobacterium tuberculosis H37Rv
ggugacccgcuauucg

SEQ ID NO: 3286641 - RNA, 15 nt, Mycobacterium tuberculosis H37Rv
ggugcccggccgcca

SEQ ID NO: 3286642 - RNA, 17 nt, Mycobacterium tuberculosis H37Rv
ggugcccggccgccagc

SEQ ID NO: 3286643 - RNA, 20 nt, Mycobacterium tuberculosis H37Rv
ggugccgaagcugcccaacc

SEQ ID NO: 3286644 - RNA, 14 nt, Mycobacterium tuberculosis H37Rv
ggugccgacccgcc

SEQ ID NO: 3286645 - RNA, 12 nt, Mycobacterium tuberculosis H37Rv
ggugccgacguc

SEQ ID NO: 3286646 - RNA, 23 nt, Mycobacterium tuberculosis H37Rv
ggugccgagcgcaaggucgacgg

SEQ ID NO: 3286647 - RNA, 17 nt, Mycobacterium tuberculosis H37Rv
ggugccgagcuggcgac

SEQ ID NO: 3286648 - RNA, 18 nt, Mycobacterium tuberculosis H37Rv
ggugccgaucagcagugg

SEQ ID NO: 3286649 - RNA, 17 nt, Mycobacterium tuberculosis H37Rv
ggugccgccaccggcgu

SEQ ID NO: 3286650 - RNA, 19 nt, Mycobacterium tuberculosis H37Rv
ggugccgccaucgccgccg

SEQ ID NO: 3286651 - RNA, 20 nt, Mycobacterium tuberculosis H37Rv
ggugccgccaucgccgccgg

SEQ ID NO: 3286652 - RNA, 12 nt, Mycobacterium tuberculosis H37Rv
ggugccgcccga

SEQ ID NO: 3286653 - RNA, 12 nt, Mycobacterium tuberculosis H37Rv
ggugccgcccgc

SEQ ID NO: 3286654 - RNA, 14 nt, Mycobacterium tuberculosis H37Rv
ggugccgcccgcgc

SEQ ID NO: 3286655 - RNA, 15 nt, Mycobacterium tuberculosis H37Rv
ggugccgcccgcgcc

SEQ ID NO: 3286656 - RNA, 19 nt, Mycobacterium tuberculosis H37Rv
ggugccgcccgcgccgccg

SEQ ID NO: 3286657 - RNA, 18 nt, Mycobacterium tuberculosis H37Rv
ggugccgcccgcgccucc

SEQ ID NO: 3286658 - RNA, 16 nt, Mycobacterium tuberculosis H37Rv
ggugccgccgccggcg

SEQ ID NO: 3286659 - RNA, 18 nt, Mycobacterium tuberculosis H37Rv
ggugccgccgcggccacc

SEQ ID NO: 3286660 - RNA, 15 nt, Mycobacterium tuberculosis H37Rv
ggugccgccgucgcc

SEQ ID NO: 3286661 - RNA, 15 nt, Mycobacterium tuberculosis H37Rv
ggugccgccguuccc

SEQ ID NO: 3286662 - RNA, 16 nt, Mycobacterium tuberculosis H37Rv
ggugccgccugugcca

SEQ ID NO: 3286663 - RNA, 13 nt, Mycobacterium tuberculosis H37Rv
ggugccgcgcagc

SEQ ID NO: 3286664 - RNA, 14 nt, Mycobacterium tuberculosis H37Rv
ggugccgcgcagcu

SEQ ID NO: 3286665 - RNA, 17 nt, Mycobacterium tuberculosis H37Rv
ggugccgcgcagcugcc

SEQ ID NO: 3286666 - RNA, 15 nt, Mycobacterium tuberculosis H37Rv
ggugccgcggcuagg

SEQ ID NO: 3286667 - RNA, 22 nt, Mycobacterium tuberculosis H37Rv
ggugccgcggcuaggccaagcc

SEQ ID NO: 3286668 - RNA, 18 nt, Mycobacterium tuberculosis H37Rv
ggugccggaaacgccagg

SEQ ID NO: 3286669 - RNA, 12 nt, Mycobacterium tuberculosis H37Rv
ggugccggcgac

SEQ ID NO: 3286670 - RNA, 21 nt, Mycobacterium tuberculosis H37Rv
ggugccggcgccgccagcacc

SEQ ID NO: 3286671 - RNA, 21 nt, Mycobacterium tuberculosis H37Rv
ggugccggcgccgcccuugcc

SEQ ID NO: 3286672 - RNA, 19 nt, Mycobacterium tuberculosis H37Rv
ggugccggcguaggcagga

SEQ ID NO: 3286673 - RNA, 15 nt, Mycobacterium tuberculosis H37Rv
ggugccgggcaccac

SEQ ID NO: 3286674 - RNA, 18 nt, Mycobacterium tuberculosis H37Rv
ggugccggggcugccgcc

SEQ ID NO: 3286675 - RNA, 15 nt, Mycobacterium tuberculosis H37Rv
ggugccgggguggcg

SEQ ID NO: 3286676 - RNA, 14 nt, Mycobacterium tuberculosis H37Rv
ggugccggucacgu

SEQ ID NO: 3286677 - RNA, 14 nt, Mycobacterium tuberculosis H37Rv
ggugccggucgagu

SEQ ID NO: 3286678 - RNA, 19 nt, Mycobacterium tuberculosis H37Rv
ggugccggugauggccgac

SEQ ID NO: 3286679 - RNA, 14 nt, Mycobacterium tuberculosis H37Rv
ggugccggugcucc

SEQ ID NO: 3286680 - RNA, 23 nt, Mycobacterium tuberculosis H37Rv
ggugccggugcuccucggcaggc

SEQ ID NO: 3286681 - RNA, 19 nt, Mycobacterium tuberculosis H37Rv
ggugccgguguugccgccg

SEQ ID NO: 3286682 - RNA, 19 nt, Mycobacterium tuberculosis H37Rv
ggugccgucagcggcggcc

SEQ ID NO: 3286683 - RNA, 14 nt, Mycobacterium tuberculosis H37Rv
ggugccgucgggua

SEQ ID NO: 3286684 - RNA, 23 nt, Mycobacterium tuberculosis H37Rv
ggugccguuggagccgccaccga

SEQ ID NO: 3286685 - RNA, 20 nt, Mycobacterium tuberculosis H37Rv
ggugccuacaccggcaagcc

SEQ ID NO: 3286686 - RNA, 21 nt, Mycobacterium tuberculosis H37Rv
ggugccuacaccggcaagcca

SEQ ID NO: 3286687 - RNA, 13 nt, Mycobacterium tuberculosis H37Rv
ggugccugucaga

SEQ ID NO: 3286688 - RNA, 17 nt, Mycobacterium tuberculosis H37Rv
ggugccugucagaagga

SEQ ID NO: 3286689 - RNA, 20 nt, Mycobacterium tuberculosis H37Rv
ggugccuucaccgccguucc

SEQ ID NO: 3286690 - RNA, 19 nt, Mycobacterium tuberculosis H37Rv
ggugcgaucccacccucgg

SEQ ID NO: 3286691 - RNA, 14 nt, Mycobacterium tuberculosis H37Rv
ggugcgcaccaccg

SEQ ID NO: 3286692 - RNA, 12 nt, Mycobacterium tuberculosis H37Rv
ggugcgcacggc

SEQ ID NO: 3286693 - RNA, 16 nt, Mycobacterium tuberculosis H37Rv
ggugcgcacggcggcc

SEQ ID NO: 3286694 - RNA, 23 nt, Mycobacterium tuberculosis H37Rv
ggugcgcauggacaacagcuugg

SEQ ID NO: 3286695 - RNA, 23 nt, Mycobacterium tuberculosis H37Rv
ggugcgccacgaccgcggcggca

SEQ ID NO: 3286696 - RNA, 20 nt, Mycobacterium tuberculosis H37Rv
ggugcgccauucgcccggcc

SEQ ID NO: 3286697 - RNA, 19 nt, Mycobacterium tuberculosis H37Rv
ggugcgccauugcgggaac

SEQ ID NO: 3286698 - RNA, 16 nt, Mycobacterium tuberculosis H37Rv
ggugcgcccaccgacc

SEQ ID NO: 3286699 - RNA, 16 nt, Mycobacterium tuberculosis H37Rv
ggugcgccgcagcagg

SEQ ID NO: 3286700 - RNA, 13 nt, Mycobacterium tuberculosis H37Rv
ggugcgccggcgu

SEQ ID NO: 3286701 - RNA, 14 nt, Mycobacterium tuberculosis H37Rv
ggugcgcgaccagg

SEQ ID NO: 3286702 - RNA, 15 nt, Mycobacterium tuberculosis H37Rv
ggugcgcgaccagga

SEQ ID NO: 3286703 - RNA, 14 nt, Mycobacterium tuberculosis H37Rv
ggugcgcgaggucg

SEQ ID NO: 3286704 - RNA, 19 nt, Mycobacterium tuberculosis H37Rv
ggugcgcgugacgaccagc

SEQ ID NO: 3286705 - RNA, 22 nt, Mycobacterium tuberculosis H37Rv
ggugcgcgugacgaccagcccc

SEQ ID NO: 3286706 - RNA, 17 nt, Mycobacterium tuberculosis H37Rv
ggugcgcugaugacgcg

SEQ ID NO: 3286707 - RNA, 20 nt, Mycobacterium tuberculosis H37Rv
ggugcgcugcgaucaccccc

SEQ ID NO: 3286708 - RNA, 16 nt, Mycobacterium tuberculosis H37Rv
ggugcgcuggcggcgc

SEQ ID NO: 3286709 - RNA, 16 nt, Mycobacterium tuberculosis H37Rv
ggugcggaucugcugc

SEQ ID NO: 3286710 - RNA, 20 nt, Mycobacterium tuberculosis H37Rv
ggugcggcacgccggccgcg

SEQ ID NO: 3286711 - RNA, 15 nt, Mycobacterium tuberculosis H37Rv
ggugcggccgcggcg

SEQ ID NO: 3286712 - RNA, 20 nt, Mycobacterium tuberculosis H37Rv
ggugcggccgggucucuugc

SEQ ID NO: 3286713 - RNA, 14 nt, Mycobacterium tuberculosis H37Rv
ggugcgggccacga

SEQ ID NO: 3286714 - RNA, 17 nt, Mycobacterium tuberculosis H37Rv
ggugcgggccacgaucg

SEQ ID NO: 3286715 - RNA, 22 nt, Mycobacterium tuberculosis H37Rv
ggugcgggcgugguaaccaggg

SEQ ID NO: 3286716 - RNA, 15 nt, Mycobacterium tuberculosis H37Rv
ggugcgggucggcgc

SEQ ID NO: 3286717 - RNA, 19 nt, Mycobacterium tuberculosis H37Rv
ggugcgggugggacaccau

SEQ ID NO: 3286718 - RNA, 16 nt, Mycobacterium tuberculosis H37Rv
ggugcgggugggcaca

SEQ ID NO: 3286719 - RNA, 19 nt, Mycobacterium tuberculosis H37Rv
ggugcgguucgcugcggcg

SEQ ID NO: 3286720 - RNA, 21 nt, Mycobacterium tuberculosis H37Rv
ggugcgguucgcugcggcggu

SEQ ID NO: 3286721 - RNA, 14 nt, Mycobacterium tuberculosis H37Rv
ggugcgucacagcc

SEQ ID NO: 3286722 - RNA, 17 nt, Mycobacterium tuberculosis H37Rv
ggugcuaaccgacgcug

SEQ ID NO: 3286723 - RNA, 18 nt, Mycobacterium tuberculosis H37Rv
ggugcuaaccgacgcuga

SEQ ID NO: 3286724 - RNA, 15 nt, Mycobacterium tuberculosis H37Rv
ggugcuacuggugug

SEQ ID NO: 3286725 - RNA, 21 nt, Mycobacterium tuberculosis H37Rv
ggugcuacuggugugacgauc

SEQ ID NO: 3286726 - RNA, 15 nt, Mycobacterium tuberculosis H37Rv
ggugcucagcggcuc

SEQ ID NO: 3286727 - RNA, 18 nt, Mycobacterium tuberculosis H37Rv
ggugcucagcggcucgcc

SEQ ID NO: 3286728 - RNA, 19 nt, Mycobacterium tuberculosis H37Rv
ggugcucgcgaucugcucg

SEQ ID NO: 3286729 - RNA, 15 nt, Mycobacterium tuberculosis H37Rv
ggugcucgggcggcg

SEQ ID NO: 3286730 - RNA, 14 nt, Mycobacterium tuberculosis H37Rv
ggugcucgucacca

SEQ ID NO: 3286731 - RNA, 24 nt, Mycobacterium tuberculosis H37Rv
ggugcucgucaccaaacccgaugg

SEQ ID NO: 3286732 - RNA, 23 nt, Mycobacterium tuberculosis H37Rv
ggugcucucguggauggccgcca

SEQ ID NO: 3286733 - RNA, 19 nt, Mycobacterium tuberculosis H37Rv
ggugcugaucuugccgccg

SEQ ID NO: 3286734 - RNA, 22 nt, Mycobacterium tuberculosis H37Rv
ggugcugaugggucaggccgac

SEQ ID NO: 3286735 - RNA, 21 nt, Mycobacterium tuberculosis H37Rv
ggugcugcacacugccgcgcu

SEQ ID NO: 3286736 - RNA, 14 nt, Mycobacterium tuberculosis H37Rv
ggugcugccaagca

SEQ ID NO: 3286737 - RNA, 13 nt, Mycobacterium tuberculosis H37Rv
gguggugucgcuc

SEQ ID NO: 3286738 - RNA, 17 nt, Mycobacterium tuberculosis H37Rv
ggugguuccgcccggug

SEQ ID NO: 3286739 - RNA, 15 nt, Mycobacterium tuberculosis H37Rv
ggugguuguggcggg

SEQ ID NO: 3286740 - RNA, 23 nt, Mycobacterium tuberculosis H37Rv
gguguaauuggcaacacagcuga

SEQ ID NO: 3286741 - RNA, 14 nt, Mycobacterium tuberculosis H37Rv
gguguacagucgcg

SEQ ID NO: 3286742 - RNA, 13 nt, Mycobacterium tuberculosis H37Rv
gguguacugcugc

SEQ ID NO: 3286743 - RNA, 20 nt, Mycobacterium tuberculosis H37Rv
gguguagcaagucgccgagg

SEQ ID NO: 3286744 - RNA, 14 nt, Mycobacterium tuberculosis H37Rv
gguguagcccagcc

SEQ ID NO: 3286745 - RNA, 18 nt, Mycobacterium tuberculosis H37Rv
gguguagcccagccgggu

SEQ ID NO: 3286746 - RNA, 15 nt, Mycobacterium tuberculosis H37Rv
gguguagcccaucgg

SEQ ID NO: 3286747 - RNA, 20 nt, Mycobacterium tuberculosis H37Rv
gguguagcccaucggcagca

SEQ ID NO: 3286748 - RNA, 18 nt, Mycobacterium tuberculosis H37Rv
gguguagcccuccgagca

SEQ ID NO: 3286749 - RNA, 14 nt, Mycobacterium tuberculosis H37Rv
gguguagccgagca

SEQ ID NO: 3286750 - RNA, 20 nt, Mycobacterium tuberculosis H37Rv
gguguaggccucggcagcaa

SEQ ID NO: 3286751 - RNA, 19 nt, Mycobacterium tuberculosis H37Rv
gguguaggccugcccccgg

SEQ ID NO: 3286752 - RNA, 17 nt, Mycobacterium tuberculosis H37Rv
gguguccccgcccggcc

SEQ ID NO: 3286753 - RNA, 17 nt, Mycobacterium tuberculosis H37Rv
gguguccuccagcugcg

SEQ ID NO: 3286754 - RNA, 15 nt, Mycobacterium tuberculosis H37Rv
ggugucgaagagcag

SEQ ID NO: 3286755 - RNA, 16 nt, Mycobacterium tuberculosis H37Rv
ggugucgacgcgggcg

SEQ ID NO: 3286756 - RNA, 18 nt, Mycobacterium tuberculosis H37Rv
ggugucgccgaacaccga

SEQ ID NO: 3286757 - RNA, 20 nt, Mycobacterium tuberculosis H37Rv
ggugucgcgaucgcggcauc

SEQ ID NO: 3286758 - RNA, 22 nt, Mycobacterium tuberculosis H37Rv
ggugucggcuggucgcugcugc

SEQ ID NO: 3286759 - RNA, 15 nt, Mycobacterium tuberculosis H37Rv
ggugucgggcagcaa

SEQ ID NO: 3286760 - RNA, 14 nt, Mycobacterium tuberculosis H37Rv
ggugucggugacau

SEQ ID NO: 3286761 - RNA, 22 nt, Mycobacterium tuberculosis H37Rv
ggugucggugguaccggcggcg

SEQ ID NO: 3286762 - RNA, 21 nt, Mycobacterium tuberculosis H37Rv
ggugucgucaucggggccugc

SEQ ID NO: 3286763 - RNA, 18 nt, Mycobacterium tuberculosis H37Rv
ggugucguucggcgagga

SEQ ID NO: 3286764 - RNA, 23 nt, Mycobacterium tuberculosis H37Rv
ggugucguucggcgaggacggcg

SEQ ID NO: 3286765 - RNA, 18 nt, Mycobacterium tuberculosis H37Rv
ggugugauacagcgccag

SEQ ID NO: 3286766 - RNA, 19 nt, Mycobacterium tuberculosis H37Rv
ggugugcaucgacucacgg

SEQ ID NO: 3286767 - RNA, 14 nt, Mycobacterium tuberculosis H37Rv
ggugugccggucuc

SEQ ID NO: 3286768 - RNA, 15 nt, Mycobacterium tuberculosis H37Rv
ggugugcggcagccc

SEQ ID NO: 3286769 - RNA, 19 nt, Mycobacterium tuberculosis H37Rv
ggugugcgucuccagcugg

SEQ ID NO: 3286770 - RNA, 14 nt, Mycobacterium tuberculosis H37Rv
ggugugcugcacgg

SEQ ID NO: 3286771 - RNA, 22 nt, Mycobacterium tuberculosis H37Rv
ggugugcugccaccggccggcg

SEQ ID NO: 3286772 - RNA, 22 nt, Mycobacterium tuberculosis H37Rv
ggugugcuggcuaucugaucca

SEQ ID NO: 3286773 - RNA, 16 nt, Mycobacterium tuberculosis H37Rv
gguguggacugggcca

SEQ ID NO: 3286774 - RNA, 20 nt, Mycobacterium tuberculosis H37Rv
gguguggcgcugaucggcag

SEQ ID NO: 3286775 - RNA, 16 nt, Mycobacterium tuberculosis H37Rv
gguguggucgguggcg

SEQ ID NO: 3286776 - RNA, 13 nt, Mycobacterium tuberculosis H37Rv
ggugugucccggg

SEQ ID NO: 3286777 - RNA, 11 nt, Mycobacterium tuberculosis H37Rv
ggugugugccu

SEQ ID NO: 3286778 - RNA, 15 nt, Mycobacterium tuberculosis H37Rv
gguguucgggcagcu

SEQ ID NO: 3286779 - RNA, 19 nt, Mycobacterium tuberculosis H37Rv
gguguuggacacucccggg

SEQ ID NO: 3286780 - RNA, 15 nt, Mycobacterium tuberculosis H37Rv
gguguuguacuggcu

SEQ ID NO: 3286781 - RNA, 18 nt, Mycobacterium tuberculosis H37Rv
gguguuguaggccgggcc

SEQ ID NO: 3286782 - RNA, 16 nt, Mycobacterium tuberculosis H37Rv
gguguuucaggcagcg

SEQ ID NO: 3286783 - RNA, 11 nt, Mycobacterium tuberculosis H37Rv
gguguuuuugu

SEQ ID NO: 3286784 - RNA, 14 nt, Mycobacterium tuberculosis H37Rv
gguuagccgcggcc

SEQ ID NO: 3286785 - RNA, 16 nt, Mycobacterium tuberculosis H37Rv
gguuagggcgugucuu

SEQ ID NO: 3286786 - RNA, 21 nt, Mycobacterium tuberculosis H37Rv
gguuaucgccgagauccgcgc

SEQ ID NO: 3286787 - RNA, 17 nt, Mycobacterium tuberculosis H37Rv
gguuaucgucgggucac

SEQ ID NO: 3286788 - RNA, 11 nt, Mycobacterium tuberculosis H37Rv
gguucaaagca

SEQ ID NO: 3286789 - RNA, 15 nt, Mycobacterium tuberculosis H37Rv
gguucacccagcggc

SEQ ID NO: 3286790 - RNA, 22 nt, Mycobacterium tuberculosis H37Rv
gguucaccgaggugccgcgcag

SEQ ID NO: 3286791 - RNA, 13 nt, Mycobacterium tuberculosis H37Rv
gguucaccucccc

SEQ ID NO: 3286792 - RNA, 18 nt, Mycobacterium tuberculosis H37Rv
gguucaccucggcgacga

SEQ ID NO: 3286793 - RNA, 19 nt, Mycobacterium tuberculosis H37Rv
gguucacuuccgggcagcu

SEQ ID NO: 3286794 - RNA, 22 nt, Mycobacterium tuberculosis H37Rv
gguucagccacgcagcacggca

SEQ ID NO: 3286795 - RNA, 20 nt, Mycobacterium tuberculosis H37Rv
gguucagcgcuggcaggccg

SEQ ID NO: 3286796 - RNA, 15 nt, Mycobacterium tuberculosis H37Rv
gguucagcucgagga

SEQ ID NO: 3286797 - RNA, 23 nt, Mycobacterium tuberculosis H37Rv
gguucaucaagguguugcggugg

SEQ ID NO: 3286798 - RNA, 16 nt, Mycobacterium tuberculosis H37Rv
gguucaugaacaucgg

SEQ ID NO: 3286799 - RNA, 23 nt, Mycobacterium tuberculosis H37Rv
gguucaugcaaaagccgcgaucg

SEQ ID NO: 3286800 - RNA, 20 nt, Mycobacterium tuberculosis H37Rv
gguuccacgcguugacgauc

SEQ ID NO: 3286801 - RNA, 21 nt, Mycobacterium tuberculosis H37Rv
gguucccgaucaggcgggcaa

SEQ ID NO: 3286802 - RNA, 18 nt, Mycobacterium tuberculosis H37Rv
gguucccgggcagccgca

SEQ ID NO: 3286803 - RNA, 19 nt, Mycobacterium tuberculosis H37Rv
gguucccuuguucccgaaa

SEQ ID NO: 3286804 - RNA, 15 nt, Mycobacterium tuberculosis H37Rv
gguuccgccggcccc

SEQ ID NO: 3286805 - RNA, 14 nt, Mycobacterium tuberculosis H37Rv
gguuccgcugucga

SEQ ID NO: 3286806 - RNA, 20 nt, Mycobacterium tuberculosis H37Rv
gguuccgcugucgagccggu

SEQ ID NO: 3286807 - RNA, 13 nt, Mycobacterium tuberculosis H37Rv
gguuccggccggc

SEQ ID NO: 3286808 - RNA, 18 nt, Mycobacterium tuberculosis H37Rv
gguuccggcgugcagcac

SEQ ID NO: 3286809 - RNA, 22 nt, Mycobacterium tuberculosis H37Rv
gguuccgguguaggccugcccc

SEQ ID NO: 3286810 - RNA, 15 nt, Mycobacterium tuberculosis H37Rv
gguuccucagcggcc

SEQ ID NO: 3286811 - RNA, 16 nt, Mycobacterium tuberculosis H37Rv
gguuccuccucggcag

SEQ ID NO: 3286812 - RNA, 20 nt, Mycobacterium tuberculosis H37Rv
gguucgaacgcgaucgaccu

SEQ ID NO: 3286813 - RNA, 17 nt, Mycobacterium tuberculosis H37Rv
gguucgaaucccaucgg

SEQ ID NO: 3286814 - RNA, 19 nt, Mycobacterium tuberculosis H37Rv
gguucgacggacacccugg

SEQ ID NO: 3286815 - RNA, 20 nt, Mycobacterium tuberculosis H37Rv
gguucgcacaccuccucgac

SEQ ID NO: 3286816 - RNA, 22 nt, Mycobacterium tuberculosis H37Rv
gguucgccgaagccggaccgca

SEQ ID NO: 3286817 - RNA, 20 nt, Mycobacterium tuberculosis H37Rv
gguucggagucacgcagccg

SEQ ID NO: 3286818 - RNA, 13 nt, Mycobacterium tuberculosis H37Rv
gguucggcgucga

SEQ ID NO: 3286819 - RNA, 19 nt, Mycobacterium tuberculosis H37Rv
gguucgggcagcacccgcg

SEQ ID NO: 3286820 - RNA, 19 nt, Mycobacterium tuberculosis H37Rv
gguucuuccuggucgacgc

SEQ ID NO: 3286821 - RNA, 17 nt, Mycobacterium tuberculosis H37Rv
gguugaaccgguacaac

SEQ ID NO: 3286822 - RNA, 18 nt, Mycobacterium tuberculosis H37Rv
gguugaacgaccucugca

SEQ ID NO: 3286823 - RNA, 16 nt, Mycobacterium tuberculosis H37Rv
gguugacccccgggua

SEQ ID NO: 3286824 - RNA, 22 nt, Mycobacterium tuberculosis H37Rv
gguugaccgccaccccggucgg

SEQ ID NO: 3286825 - RNA, 17 nt, Mycobacterium tuberculosis H37Rv
gguugacgucaggcuga

SEQ ID NO: 3286826 - RNA, 18 nt, Mycobacterium tuberculosis H37Rv
gguugagauggucaccgg

SEQ ID NO: 3286827 - RNA, 17 nt, Mycobacterium tuberculosis H37Rv
gguugaucaccgacacc

SEQ ID NO: 3286828 - RNA, 15 nt, Mycobacterium tuberculosis H37Rv
gguugaucggccacg

SEQ ID NO: 3286829 - RNA, 18 nt, Mycobacterium tuberculosis H37Rv
gguugauggaguggcugu

SEQ ID NO: 3286830 - RNA, 11 nt, Mycobacterium tuberculosis H37Rv
gguugccaacc

SEQ ID NO: 3286831 - RNA, 18 nt, Mycobacterium tuberculosis H37Rv
gguugccaacgaaccgcu

SEQ ID NO: 3286832 - RNA, 18 nt, Mycobacterium tuberculosis H37Rv
gguugcccgcauugccaa

SEQ ID NO: 3286833 - RNA, 13 nt, Mycobacterium tuberculosis H37Rv
guaccgcggaucg

SEQ ID NO: 3286834 - RNA, 20 nt, Mycobacterium tuberculosis H37Rv
guaccggaaucggcggcgga

SEQ ID NO: 3286835 - RNA, 22 nt, Mycobacterium tuberculosis H37Rv
guaccggcaaacgcgcagguca

SEQ ID NO: 3286836 - RNA, 15 nt, Mycobacterium tuberculosis H37Rv
guaccggcgccgcaa

SEQ ID NO: 3286837 - RNA, 16 nt, Mycobacterium tuberculosis H37Rv
guaccggcgccgcaau

SEQ ID NO: 3286838 - RNA, 18 nt, Mycobacterium tuberculosis H37Rv
guaccggcuucgucggcc

SEQ ID NO: 3286839 - RNA, 21 nt, Mycobacterium tuberculosis H37Rv
guaccggcuucgucggccagc

SEQ ID NO: 3286840 - RNA, 19 nt, Mycobacterium tuberculosis H37Rv
guaccgggcgagucccggc

SEQ ID NO: 3286841 - RNA, 19 nt, Mycobacterium tuberculosis H37Rv
guaccgguugacgggcucg

SEQ ID NO: 3286842 - RNA, 19 nt, Mycobacterium tuberculosis H37Rv
guaccguagcucuuugagu

SEQ ID NO: 3286843 - RNA, 22 nt, Mycobacterium tuberculosis H37Rv
guaccgucaucgcggugugccg

SEQ ID NO: 3286844 - RNA, 18 nt, Mycobacterium tuberculosis H37Rv
guaccucaacaccaggcc

SEQ ID NO: 3286845 - RNA, 14 nt, Mycobacterium tuberculosis H37Rv
guacgaacugcuga

SEQ ID NO: 3286846 - RNA, 17 nt, Mycobacterium tuberculosis H37Rv
guacgaacugcugauga

SEQ ID NO: 3286847 - RNA, 16 nt, Mycobacterium tuberculosis H37Rv
guacgaauugggcucu

SEQ ID NO: 3286848 - RNA, 16 nt, Mycobacterium tuberculosis H37Rv
guacgacaccgcagcg

SEQ ID NO: 3286849 - RNA, 18 nt, Mycobacterium tuberculosis H37Rv
guacgacccccgaucagg

SEQ ID NO: 3286850 - RNA, 18 nt, Mycobacterium tuberculosis H37Rv
guacgaucgugagacgcc

SEQ ID NO: 3286851 - RNA, 18 nt, Mycobacterium tuberculosis H37Rv
guacgcaagcucaaggga

SEQ ID NO: 3286852 - RNA, 16 nt, Mycobacterium tuberculosis H37Rv
guacgcaucgccguca

SEQ ID NO: 3286853 - RNA, 19 nt, Mycobacterium tuberculosis H37Rv
guacgccaggugcagcacc

SEQ ID NO: 3286854 - RNA, 23 nt, Mycobacterium tuberculosis H37Rv
guacgcccgcucggagaucgcca

SEQ ID NO: 3286855 - RNA, 19 nt, Mycobacterium tuberculosis H37Rv
guacgcccuggaaugccgc

SEQ ID NO: 3286856 - RNA, 14 nt, Mycobacterium tuberculosis H37Rv
guacgccgagcaga

SEQ ID NO: 3286857 - RNA, 16 nt, Mycobacterium tuberculosis H37Rv
guacgcgaucagcgcg

SEQ ID NO: 3286858 - RNA, 12 nt, Mycobacterium tuberculosis H37Rv
guacgcggcugc

SEQ ID NO: 3286859 - RNA, 16 nt, Mycobacterium tuberculosis H37Rv
guacgcgucggugacc

SEQ ID NO: 3286860 - RNA, 22 nt, Mycobacterium tuberculosis H37Rv
guacggaccguggcagcugcuc

SEQ ID NO: 3286861 - RNA, 17 nt, Mycobacterium tuberculosis H37Rv
guacggcacuaacggcg

SEQ ID NO: 3286862 - RNA, 15 nt, Mycobacterium tuberculosis H37Rv
guacggcccgcaucg

SEQ ID NO: 3286863 - RNA, 15 nt, Mycobacterium tuberculosis H37Rv
guacggcucggcgcu

SEQ ID NO: 3286864 - RNA, 16 nt, Mycobacterium tuberculosis H37Rv
guacggcucggcgcug

SEQ ID NO: 3286865 - RNA, 14 nt, Mycobacterium tuberculosis H37Rv
guacggcugugcga

SEQ ID NO: 3286866 - RNA, 18 nt, Mycobacterium tuberculosis H37Rv
guacgggagccggcuguu

SEQ ID NO: 3286867 - RNA, 13 nt, Mycobacterium tuberculosis H37Rv
guacgggcaggcc

SEQ ID NO: 3286868 - RNA, 14 nt, Mycobacterium tuberculosis H37Rv
guacgggcaggccg

SEQ ID NO: 3286869 - RNA, 17 nt, Mycobacterium tuberculosis H37Rv
guacgggcaggccgcug

SEQ ID NO: 3286870 - RNA, 22 nt, Mycobacterium tuberculosis H37Rv
guacgggcaggccgcugggccg

SEQ ID NO: 3286871 - RNA, 14 nt, Mycobacterium tuberculosis H37Rv
guacgggucgccgg

SEQ ID NO: 3286872 - RNA, 12 nt, Mycobacterium tuberculosis H37Rv
guacgggugauc

SEQ ID NO: 3286873 - RNA, 17 nt, Mycobacterium tuberculosis H37Rv
guacggugguaagacgc

SEQ ID NO: 3286874 - RNA, 21 nt, Mycobacterium tuberculosis H37Rv
guacucagguggaagugcacc

SEQ ID NO: 3286875 - RNA, 23 nt, Mycobacterium tuberculosis H37Rv
guacucaucgacguuccagcagu

SEQ ID NO: 3286876 - RNA, 13 nt, Mycobacterium tuberculosis H37Rv
guacuccauggca

SEQ ID NO: 3286877 - RNA, 21 nt, Mycobacterium tuberculosis H37Rv
guacucccccgaaccugcggc

SEQ ID NO: 3286878 - RNA, 20 nt, Mycobacterium tuberculosis H37Rv
guacuccuggguuugccgau

SEQ ID NO: 3286879 - RNA, 12 nt, Mycobacterium tuberculosis H37Rv
guacugcggaug

SEQ ID NO: 3286880 - RNA, 18 nt, Mycobacterium tuberculosis H37Rv
guacuucgcuggaaaccu

SEQ ID NO: 3286881 - RNA, 14 nt, Mycobacterium tuberculosis H37Rv
guacuugccacggc

SEQ ID NO: 3286882 - RNA, 17 nt, Mycobacterium tuberculosis H37Rv
guacuuggcuuccggau

SEQ ID NO: 3286883 - RNA, 17 nt, Mycobacterium tuberculosis H37Rv
guagaacgcuagcgcca

SEQ ID NO: 3286884 - RNA, 18 nt, Mycobacterium tuberculosis H37Rv
guagaacgcuagcgccaa

SEQ ID NO: 3286885 - RNA, 15 nt, Mycobacterium tuberculosis H37Rv
guagaagucgaucgc

SEQ ID NO: 3286886 - RNA, 18 nt, Mycobacterium tuberculosis H37Rv
guagacaacagucgacaa

SEQ ID NO: 3286887 - RNA, 16 nt, Mycobacterium tuberculosis H37Rv
guagacaccccaccac

SEQ ID NO: 3286888 - RNA, 13 nt, Mycobacterium tuberculosis H37Rv
guagacaccgcga

SEQ ID NO: 3286889 - RNA, 14 nt, Mycobacterium tuberculosis H37Rv
guagacaccgcgau

SEQ ID NO: 3286890 - RNA, 19 nt, Mycobacterium tuberculosis H37Rv
guagacauuggcuccgaac

SEQ ID NO: 3286891 - RNA, 21 nt, Mycobacterium tuberculosis H37Rv
guagaccagugaccgcagucc

SEQ ID NO: 3286892 - RNA, 19 nt, Mycobacterium tuberculosis H37Rv
guagacccacaucaggucg

SEQ ID NO: 3286893 - RNA, 22 nt, Mycobacterium tuberculosis H37Rv
guagacccacaucaggucggcg

SEQ ID NO: 3286894 - RNA, 19 nt, Mycobacterium tuberculosis H37Rv
guagaccccaaucgaccgc

SEQ ID NO: 3286895 - RNA, 23 nt, Mycobacterium tuberculosis H37Rv
guagaccccaaucgaccgcccgc

SEQ ID NO: 3286896 - RNA, 14 nt, Mycobacterium tuberculosis H37Rv
guagaccucuucgg

SEQ ID NO: 3286897 - RNA, 21 nt, Mycobacterium tuberculosis H37Rv
guagaccuucucgccgccgcu

SEQ ID NO: 3286898 - RNA, 20 nt, Mycobacterium tuberculosis H37Rv
guagacgacgucggccgcau

SEQ ID NO: 3286899 - RNA, 16 nt, Mycobacterium tuberculosis H37Rv
guagacgccaugcacg

SEQ ID NO: 3286900 - RNA, 16 nt, Mycobacterium tuberculosis H37Rv
guagacggcacccccg

SEQ ID NO: 3286901 - RNA, 23 nt, Mycobacterium tuberculosis H37Rv
guagacggggugagccgacccgc

SEQ ID NO: 3286902 - RNA, 17 nt, Mycobacterium tuberculosis H37Rv
guagacgguggcgcuga

SEQ ID NO: 3286903 - RNA, 17 nt, Mycobacterium tuberculosis H37Rv
guagacgguuaccgcga

SEQ ID NO: 3286904 - RNA, 21 nt, Mycobacterium tuberculosis H37Rv
guagacgucgaccgugucacc

SEQ ID NO: 3286905 - RNA, 15 nt, Mycobacterium tuberculosis H37Rv
guagacuugcugcuc

SEQ ID NO: 3286906 - RNA, 17 nt, Mycobacterium tuberculosis H37Rv
guagacuugcugcuccu

SEQ ID NO: 3286907 - RNA, 17 nt, Mycobacterium tuberculosis H37Rv
guagaggucaucagcgu

SEQ ID NO: 3286908 - RNA, 23 nt, Mycobacterium tuberculosis H37Rv
guagagucguuuggcgccgccga

SEQ ID NO: 3286909 - RNA, 19 nt, Mycobacterium tuberculosis H37Rv
guagaucaucuggcuggug

SEQ ID NO: 3286910 - RNA, 17 nt, Mycobacterium tuberculosis H37Rv
guagaucgccucgacgc

SEQ ID NO: 3286911 - RNA, 20 nt, Mycobacterium tuberculosis H37Rv
guagaucucuucggagccga

SEQ ID NO: 3286912 - RNA, 13 nt, Mycobacterium tuberculosis H37Rv
guagaugguggug

SEQ ID NO: 3286913 - RNA, 14 nt, Mycobacterium tuberculosis H37Rv
guagcaacgguagc

SEQ ID NO: 3286914 - RNA, 13 nt, Mycobacterium tuberculosis H37Rv
guagcacaccgac

SEQ ID NO: 3286915 - RNA, 15 nt, Mycobacterium tuberculosis H37Rv
guagcacccacggcg

SEQ ID NO: 3286916 - RNA, 13 nt, Mycobacterium tuberculosis H37Rv
guagcacggcgau

SEQ ID NO: 3286917 - RNA, 14 nt, Mycobacterium tuberculosis H37Rv
guagcacucgaugc

SEQ ID NO: 3286918 - RNA, 19 nt, Mycobacterium tuberculosis H37Rv
guagcacuucagcuucggu

SEQ ID NO: 3286919 - RNA, 22 nt, Mycobacterium tuberculosis H37Rv
guagcagcagacgacgaucagc

SEQ ID NO: 3286920 - RNA, 16 nt, Mycobacterium tuberculosis H37Rv
guagcagcagcgggcc

SEQ ID NO: 3286921 - RNA, 14 nt, Mycobacterium tuberculosis H37Rv
guagcagcgccagc

SEQ ID NO: 3286922 - RNA, 18 nt, Mycobacterium tuberculosis H37Rv
guagcagcgccagcagcu

SEQ ID NO: 3286923 - RNA, 13 nt, Mycobacterium tuberculosis H37Rv
guagcagcgcggc

SEQ ID NO: 3286924 - RNA, 19 nt, Mycobacterium tuberculosis H37Rv
guagccaagcgagcggucg

SEQ ID NO: 3286925 - RNA, 14 nt, Mycobacterium tuberculosis H37Rv
guagccacgcccac

SEQ ID NO: 3286926 - RNA, 23 nt, Mycobacterium tuberculosis H37Rv
guagccacgcccacaggggcagc

SEQ ID NO: 3286927 - RNA, 22 nt, Mycobacterium tuberculosis H37Rv
guagccauucgguguggccgug

SEQ ID NO: 3286928 - RNA, 22 nt, Mycobacterium tuberculosis H37Rv
guagcccacccgggugggccag

SEQ ID NO: 3286929 - RNA, 15 nt, Mycobacterium tuberculosis H37Rv
guaguugccggcuuc

SEQ ID NO: 3286930 - RNA, 13 nt, Mycobacterium tuberculosis H37Rv
guaguugcgcggc

SEQ ID NO: 3286931 - RNA, 16 nt, Mycobacterium tuberculosis H37Rv
guaguuggcgaccugc

SEQ ID NO: 3286932 - RNA, 17 nt, Mycobacterium tuberculosis H37Rv
guaguuggugaacaugu

SEQ ID NO: 3286933 - RNA, 19 nt, Mycobacterium tuberculosis H37Rv
guauaccgagggucgggca

SEQ ID NO: 3286934 - RNA, 18 nt, Mycobacterium tuberculosis H37Rv
guauagcgcacugccggg

SEQ ID NO: 3286935 - RNA, 19 nt, Mycobacterium tuberculosis H37Rv
guauagcucacgguggccg

SEQ ID NO: 3286936 - RNA, 23 nt, Mycobacterium tuberculosis H37Rv
guaucaacagauuucauuguccc

SEQ ID NO: 3286937 - RNA, 21 nt, Mycobacterium tuberculosis H37Rv
guaucacgguugccgcgaucg

SEQ ID NO: 3286938 - RNA, 11 nt, Mycobacterium tuberculosis H37Rv
guauccaccgc

SEQ ID NO: 3286939 - RNA, 19 nt, Mycobacterium tuberculosis H37Rv
guauccacggucgaccagg

SEQ ID NO: 3286940 - RNA, 20 nt, Mycobacterium tuberculosis H37Rv
guauccaugucgcgccaggc

SEQ ID NO: 3286941 - RNA, 23 nt, Mycobacterium tuberculosis H37Rv
guauccgacgucggugaccucgg

SEQ ID NO: 3286942 - RNA, 14 nt, Mycobacterium tuberculosis H37Rv
guauccgacuggcc

SEQ ID NO: 3286943 - RNA, 15 nt, Mycobacterium tuberculosis H37Rv
guaucgacggcggcc

SEQ ID NO: 3286944 - RNA, 14 nt, Mycobacterium tuberculosis H37Rv
guaucgagaugcca

SEQ ID NO: 3286945 - RNA, 20 nt, Mycobacterium tuberculosis H37Rv
guaucgagaugccaucggug

SEQ ID NO: 3286946 - RNA, 19 nt, Mycobacterium tuberculosis H37Rv
guaucgauugaugcguggu

SEQ ID NO: 3286947 - RNA, 19 nt, Mycobacterium tuberculosis H37Rv
guaucgcagcaucugcggg

SEQ ID NO: 3286948 - RNA, 22 nt, Mycobacterium tuberculosis H37Rv
guaucgccaguggugcaccgau

SEQ ID NO: 3286949 - RNA, 20 nt, Mycobacterium tuberculosis H37Rv
guaucggugcuggucgccgc

SEQ ID NO: 3286950 - RNA, 13 nt, Mycobacterium tuberculosis H37Rv
guaucucggcucc

SEQ ID NO: 3286951 - RNA, 16 nt, Mycobacterium tuberculosis H37Rv
guaugcccacgaaccg

SEQ ID NO: 3286952 - RNA, 19 nt, Mycobacterium tuberculosis H37Rv
guaugccgccaaccgcgug

SEQ ID NO: 3286953 - RNA, 17 nt, Mycobacterium tuberculosis H37Rv
guaugccgcccgcagcg

SEQ ID NO: 3286954 - RNA, 18 nt, Mycobacterium tuberculosis H37Rv
guaugccguggccgccau

SEQ ID NO: 3286955 - RNA, 19 nt, Mycobacterium tuberculosis H37Rv
guaugcgccaucucgacgg

SEQ ID NO: 3286956 - RNA, 13 nt, Mycobacterium tuberculosis H37Rv
guaugcggugacg

SEQ ID NO: 3286957 - RNA, 19 nt, Mycobacterium tuberculosis H37Rv
guaugcguuacgccgcgag

SEQ ID NO: 3286958 - RNA, 18 nt, Mycobacterium tuberculosis H37Rv
guauggacgaggagcuca

SEQ ID NO: 3286959 - RNA, 22 nt, Mycobacterium tuberculosis H37Rv
guauggcggcgacggccgcucg

SEQ ID NO: 3286960 - RNA, 22 nt, Mycobacterium tuberculosis H37Rv
guaugggggugcuuccucgcga

SEQ ID NO: 3286961 - RNA, 22 nt, Mycobacterium tuberculosis H37Rv
guauucccgcuuggcgugaccu

SEQ ID NO: 3286962 - RNA, 14 nt, Mycobacterium tuberculosis H37Rv
guauucggcaucgc

SEQ ID NO: 3286963 - RNA, 19 nt, Mycobacterium tuberculosis H37Rv
guauucgguggagcgcggg

SEQ ID NO: 3286964 - RNA, 14 nt, Mycobacterium tuberculosis H37Rv
guauucguggucgg

SEQ ID NO: 3286965 - RNA, 22 nt, Mycobacterium tuberculosis H37Rv
guauucguggucggccucgaga

SEQ ID NO: 3286966 - RNA, 15 nt, Mycobacterium tuberculosis H37Rv
guauuggucgguggg

SEQ ID NO: 3286967 - RNA, 21 nt, Mycobacterium tuberculosis H37Rv
guauuugccgugcucaccggc

SEQ ID NO: 3286968 - RNA, 13 nt, Mycobacterium tuberculosis H37Rv
gucaaaauccgcg

SEQ ID NO: 3286969 - RNA, 14 nt, Mycobacterium tuberculosis H37Rv
gucaaacgccguca

SEQ ID NO: 3286970 - RNA, 21 nt, Mycobacterium tuberculosis H37Rv
gucaaacgccgucacggcagu

SEQ ID NO: 3286971 - RNA, 23 nt, Mycobacterium tuberculosis H37Rv
gucaaagaauucguucagcgcca

SEQ ID NO: 3286972 - RNA, 17 nt, Mycobacterium tuberculosis H37Rv
gucaaauccagcagcca

SEQ ID NO: 3286973 - RNA, 16 nt, Mycobacterium tuberculosis H37Rv
gucaacacccgcccgg

SEQ ID NO: 3286974 - RNA, 14 nt, Mycobacterium tuberculosis H37Rv
gucaacaccgcggc

SEQ ID NO: 3286975 - RNA, 18 nt, Mycobacterium tuberculosis H37Rv
gucaacagccagggcaac

SEQ ID NO: 3286976 - RNA, 16 nt, Mycobacterium tuberculosis H37Rv
gucaacagcggcaaga

SEQ ID NO: 3286977 - RNA, 19 nt, Mycobacterium tuberculosis H37Rv
gucaaccccggaccgcggc

SEQ ID NO: 3286978 - RNA, 18 nt, Mycobacterium tuberculosis H37Rv
gucaacccgcaccccggc

SEQ ID NO: 3286979 - RNA, 12 nt, Mycobacterium tuberculosis H37Rv
gucaaccgaucg

SEQ ID NO: 3286980 - RNA, 12 nt, Mycobacterium tuberculosis H37Rv
gucaacgauggu

SEQ ID NO: 3286981 - RNA, 17 nt, Mycobacterium tuberculosis H37Rv
gucaacgccacgccgau

SEQ ID NO: 3286982 - RNA, 18 nt, Mycobacterium tuberculosis H37Rv
gucaacgccacgccgaug

SEQ ID NO: 3286983 - RNA, 18 nt, Mycobacterium tuberculosis H37Rv
gucaacggccgacuuggu

SEQ ID NO: 3286984 - RNA, 21 nt, Mycobacterium tuberculosis H37Rv
gucaacggucucaacgcaucg

SEQ ID NO: 3286985 - RNA, 22 nt, Mycobacterium tuberculosis H37Rv
gucaacggucucaacgcaucgg

SEQ ID NO: 3286986 - RNA, 16 nt, Mycobacterium tuberculosis H37Rv
gucaacucaccgucgg

SEQ ID NO: 3286987 - RNA, 21 nt, Mycobacterium tuberculosis H37Rv
gucaagaacgccacgacgucg

SEQ ID NO: 3286988 - RNA, 19 nt, Mycobacterium tuberculosis H37Rv
gucaagaucggugccagca

SEQ ID NO: 3286989 - RNA, 16 nt, Mycobacterium tuberculosis H37Rv
gucaagcaaguccacc

SEQ ID NO: 3286990 - RNA, 21 nt, Mycobacterium tuberculosis H37Rv
gucaagcagcagcagcuucgg

SEQ ID NO: 3286991 - RNA, 17 nt, Mycobacterium tuberculosis H37Rv
gucaagccgggcacggg

SEQ ID NO: 3286992 - RNA, 12 nt, Mycobacterium tuberculosis H37Rv
gucaagucuggc

SEQ ID NO: 3286993 - RNA, 20 nt, Mycobacterium tuberculosis H37Rv
gucaaguggcaaccgcaccg

SEQ ID NO: 3286994 - RNA, 17 nt, Mycobacterium tuberculosis H37Rv
gucaaguucgccagcaa

SEQ ID NO: 3286995 - RNA, 17 nt, Mycobacterium tuberculosis H37Rv
gucaaucaccaccgcca

SEQ ID NO: 3286996 - RNA, 19 nt, Mycobacterium tuberculosis H37Rv
gucaaucacccagccggaa

SEQ ID NO: 3286997 - RNA, 23 nt, Mycobacterium tuberculosis H37Rv
gucacaacgcgugaccagggccu

SEQ ID NO: 3286998 - RNA, 15 nt, Mycobacterium tuberculosis H37Rv
gucacaagccugccg

SEQ ID NO: 3286999 - RNA, 17 nt, Mycobacterium tuberculosis H37Rv
gucacaagcugacacga

SEQ ID NO: 3287000 - RNA, 16 nt, Mycobacterium tuberculosis H37Rv
gucacaagucgacacg

SEQ ID NO: 3287001 - RNA, 20 nt, Mycobacterium tuberculosis H37Rv
gucacaagucgacacgccga

SEQ ID NO: 3287002 - RNA, 19 nt, Mycobacterium tuberculosis H37Rv
gucacaccacgacgcgaug

SEQ ID NO: 3287003 - RNA, 22 nt, Mycobacterium tuberculosis H37Rv
gucacaccagcgggcaucgcga

SEQ ID NO: 3287004 - RNA, 16 nt, Mycobacterium tuberculosis H37Rv
gucacaccgaugcguu

SEQ ID NO: 3287005 - RNA, 13 nt, Mycobacterium tuberculosis H37Rv
gucacagcucacc

SEQ ID NO: 3287006 - RNA, 15 nt, Mycobacterium tuberculosis H37Rv
gucacagcucaccau

SEQ ID NO: 3287007 - RNA, 16 nt, Mycobacterium tuberculosis H37Rv
gucaccaaacccgaug

SEQ ID NO: 3287008 - RNA, 19 nt, Mycobacterium tuberculosis H37Rv
gucaccacgaucgcagugg

SEQ ID NO: 3287009 - RNA, 13 nt, Mycobacterium tuberculosis H37Rv
gucaccagccacc

SEQ ID NO: 3287010 - RNA, 16 nt, Mycobacterium tuberculosis H37Rv
gucaccagccaccgcg

SEQ ID NO: 3287011 - RNA, 21 nt, Mycobacterium tuberculosis H37Rv
gucaccagccaccgcgcguca

SEQ ID NO: 3287012 - RNA, 16 nt, Mycobacterium tuberculosis H37Rv
gucaccagcgcaucgg

SEQ ID NO: 3287013 - RNA, 17 nt, Mycobacterium tuberculosis H37Rv
gucaccagcgcaucggc

SEQ ID NO: 3287014 - RNA, 19 nt, Mycobacterium tuberculosis H37Rv
gucaccagcgcaucggcca

SEQ ID NO: 3287015 - RNA, 13 nt, Mycobacterium tuberculosis H37Rv
gucaccagcugga

SEQ ID NO: 3287016 - RNA, 13 nt, Mycobacterium tuberculosis H37Rv
gucaccaggccga

SEQ ID NO: 3287017 - RNA, 21 nt, Mycobacterium tuberculosis H37Rv
gucaccaggccgaaauccaga

SEQ ID NO: 3287018 - RNA, 17 nt, Mycobacterium tuberculosis H37Rv
gucaccauagcucaggg

SEQ ID NO: 3287019 - RNA, 21 nt, Mycobacterium tuberculosis H37Rv
gucaccauggcgccgcgccga

SEQ ID NO: 3287020 - RNA, 22 nt, Mycobacterium tuberculosis H37Rv
gucaccauggcgccgcgccgau

SEQ ID NO: 3287021 - RNA, 21 nt, Mycobacterium tuberculosis H37Rv
gucacccacguugaugaugcc

SEQ ID NO: 3287022 - RNA, 20 nt, Mycobacterium tuberculosis H37Rv
gucacccaucucgaagguga

SEQ ID NO: 3287023 - RNA, 19 nt, Mycobacterium tuberculosis H37Rv
gucaccccggucccgccga

SEQ ID NO: 3287024 - RNA, 20 nt, Mycobacterium tuberculosis H37Rv
gucaccccuucgccagcgcc

SEQ ID NO: 3287025 - RNA, 19 nt, Mycobacterium tuberculosis H37Rv
gucaggccagagucgcccg

SEQ ID NO: 3287026 - RNA, 17 nt, Mycobacterium tuberculosis H37Rv
gucaggccagggugacc

SEQ ID NO: 3287027 - RNA, 15 nt, Mycobacterium tuberculosis H37Rv
gucaggccgccgcgg

SEQ ID NO: 3287028 - RNA, 17 nt, Mycobacterium tuberculosis H37Rv
gucaggccuccaaaauc

SEQ ID NO: 3287029 - RNA, 13 nt, Mycobacterium tuberculosis H37Rv
gucaggcggcgga

SEQ ID NO: 3287030 - RNA, 21 nt, Mycobacterium tuberculosis H37Rv
gucaggcggcggacccgcucg

SEQ ID NO: 3287031 - RNA, 14 nt, Mycobacterium tuberculosis H37Rv
gucaggcggcuggc

SEQ ID NO: 3287032 - RNA, 16 nt, Mycobacterium tuberculosis H37Rv
gucaggcguagguccu

SEQ ID NO: 3287033 - RNA, 17 nt, Mycobacterium tuberculosis H37Rv
gucaggcucacacucgg

SEQ ID NO: 3287034 - RNA, 20 nt, Mycobacterium tuberculosis H37Rv
gucaggcucauccgccgggc

SEQ ID NO: 3287035 - RNA, 17 nt, Mycobacterium tuberculosis H37Rv
gucaggcuggaggugaa

SEQ ID NO: 3287036 - RNA, 17 nt, Mycobacterium tuberculosis H37Rv
gucagggucagcuggga

SEQ ID NO: 3287037 - RNA, 21 nt, Mycobacterium tuberculosis H37Rv
gucaggguguugcggcugacc

SEQ ID NO: 3287038 - RNA, 14 nt, Mycobacterium tuberculosis H37Rv
gucaggugauucgc

SEQ ID NO: 3287039 - RNA, 16 nt, Mycobacterium tuberculosis H37Rv
gucagguggccaaugc

SEQ ID NO: 3287040 - RNA, 16 nt, Mycobacterium tuberculosis H37Rv
gucagguugucggcga

SEQ ID NO: 3287041 - RNA, 17 nt, Mycobacterium tuberculosis H37Rv
gucagguugucggcgau

SEQ ID NO: 3287042 - RNA, 20 nt, Mycobacterium tuberculosis H37Rv
gucagguugucggcgaucaa

SEQ ID NO: 3287043 - RNA, 13 nt, Mycobacterium tuberculosis H37Rv
gucaguagccacg

SEQ ID NO: 3287044 - RNA, 14 nt, Mycobacterium tuberculosis H37Rv
gucaguaggcggau

SEQ ID NO: 3287045 - RNA, 14 nt, Mycobacterium tuberculosis H37Rv
gucagucaccaacc

SEQ ID NO: 3287046 - RNA, 15 nt, Mycobacterium tuberculosis H37Rv
gucagugaucaccaa

SEQ ID NO: 3287047 - RNA, 17 nt, Mycobacterium tuberculosis H37Rv
gucagugccccgcccgg

SEQ ID NO: 3287048 - RNA, 23 nt, Mycobacterium tuberculosis H37Rv
gucaguugugcguugcgcugcgc

SEQ ID NO: 3287049 - RNA, 23 nt, Mycobacterium tuberculosis H37Rv
gucauaagacggauuguccggga

SEQ ID NO: 3287050 - RNA, 22 nt, Mycobacterium tuberculosis H37Rv
gucauacccagcucgucgcuga

SEQ ID NO: 3287051 - RNA, 22 nt, Mycobacterium tuberculosis H37Rv
gucauagagcucgccggugcgc

SEQ ID NO: 3287052 - RNA, 16 nt, Mycobacterium tuberculosis H37Rv
gucauaucgacgggcc

SEQ ID NO: 3287053 - RNA, 15 nt, Mycobacterium tuberculosis H37Rv
gucaucaacguucaa

SEQ ID NO: 3287054 - RNA, 16 nt, Mycobacterium tuberculosis H37Rv
gucaucagcgugcaug

SEQ ID NO: 3287055 - RNA, 19 nt, Mycobacterium tuberculosis H37Rv
gucaucagcgugcauggcg

SEQ ID NO: 3287056 - RNA, 18 nt, Mycobacterium tuberculosis H37Rv
gucaucauggccggaucc

SEQ ID NO: 3287057 - RNA, 21 nt, Mycobacterium tuberculosis H37Rv
gucaucccuuucgcgccgcga

SEQ ID NO: 3287058 - RNA, 20 nt, Mycobacterium tuberculosis H37Rv
gucauccgacaagcugucgg

SEQ ID NO: 3287059 - RNA, 22 nt, Mycobacterium tuberculosis H37Rv
gucauccggccgucggcgggca

SEQ ID NO: 3287060 - RNA, 17 nt, Mycobacterium tuberculosis H37Rv
gucauccgggcgaccac

SEQ ID NO: 3287061 - RNA, 15 nt, Mycobacterium tuberculosis H37Rv
gucauccuugagguc

SEQ ID NO: 3287062 - RNA, 14 nt, Mycobacterium tuberculosis H37Rv
gucaucgacgagcg

SEQ ID NO: 3287063 - RNA, 14 nt, Mycobacterium tuberculosis H37Rv
gucaucgagcugac

SEQ ID NO: 3287064 - RNA, 16 nt, Mycobacterium tuberculosis H37Rv
gucaucgccagcggca

SEQ ID NO: 3287065 - RNA, 21 nt, Mycobacterium tuberculosis H37Rv
gucaucgcggugugccggucu

SEQ ID NO: 3287066 - RNA, 15 nt, Mycobacterium tuberculosis H37Rv
gucaucggcuaucgc

SEQ ID NO: 3287067 - RNA, 17 nt, Mycobacterium tuberculosis H37Rv
gucaucgggcagcggca

SEQ ID NO: 3287068 - RNA, 15 nt, Mycobacterium tuberculosis H37Rv
gucaucuggcgcugc

SEQ ID NO: 3287069 - RNA, 17 nt, Mycobacterium tuberculosis H37Rv
gucaugaacgaccggac

SEQ ID NO: 3287070 - RNA, 13 nt, Mycobacterium tuberculosis H37Rv
gucaugcaagcgc

SEQ ID NO: 3287071 - RNA, 17 nt, Mycobacterium tuberculosis H37Rv
gucaugccagucgccga

SEQ ID NO: 3287072 - RNA, 14 nt, Mycobacterium tuberculosis H37Rv
gucaugcccaggug

SEQ ID NO: 3287073 - RNA, 19 nt, Mycobacterium tuberculosis H37Rv
gucaugccgccgccgagau

SEQ ID NO: 3287074 - RNA, 19 nt, Mycobacterium tuberculosis H37Rv
gucaugcggaucacaucgg

SEQ ID NO: 3287075 - RNA, 11 nt, Mycobacterium tuberculosis H37Rv
gucauggccga

SEQ ID NO: 3287076 - RNA, 20 nt, Mycobacterium tuberculosis H37Rv
gucauggcgaaccgucagcg

SEQ ID NO: 3287077 - RNA, 21 nt, Mycobacterium tuberculosis H37Rv
gucauggcgaguacggccugc

SEQ ID NO: 3287078 - RNA, 21 nt, Mycobacterium tuberculosis H37Rv
gucauggcuuuggccgcuucg

SEQ ID NO: 3287079 - RNA, 16 nt, Mycobacterium tuberculosis H37Rv
gucaugggaucaggcu

SEQ ID NO: 3287080 - RNA, 15 nt, Mycobacterium tuberculosis H37Rv
gucaugggcggcuuc

SEQ ID NO: 3287081 - RNA, 23 nt, Mycobacterium tuberculosis H37Rv
gucaugggcggcuucgaugucgu

SEQ ID NO: 3287082 - RNA, 13 nt, Mycobacterium tuberculosis H37Rv
gucauguccgucc

SEQ ID NO: 3287083 - RNA, 16 nt, Mycobacterium tuberculosis H37Rv
gucauuauucgcgcaa

SEQ ID NO: 3287084 - RNA, 15 nt, Mycobacterium tuberculosis H37Rv
guccaaccccagcga

SEQ ID NO: 3287085 - RNA, 20 nt, Mycobacterium tuberculosis H37Rv
guccaacucggcccggguga

SEQ ID NO: 3287086 - RNA, 16 nt, Mycobacterium tuberculosis H37Rv
guccaagccggccacg

SEQ ID NO: 3287087 - RNA, 23 nt, Mycobacterium tuberculosis H37Rv
guccaagccggccacgcauucca

SEQ ID NO: 3287088 - RNA, 22 nt, Mycobacterium tuberculosis H37Rv
guccaagccguagaccaggccc

SEQ ID NO: 3287089 - RNA, 17 nt, Mycobacterium tuberculosis H37Rv
guccaagugcuuccggc

SEQ ID NO: 3287090 - RNA, 18 nt, Mycobacterium tuberculosis H37Rv
guccaaucuucucgagcc

SEQ ID NO: 3287091 - RNA, 22 nt, Mycobacterium tuberculosis H37Rv
guccaauuccagcucacgaugu

SEQ ID NO: 3287092 - RNA, 18 nt, Mycobacterium tuberculosis H37Rv
guccaauuggcgucgucg

SEQ ID NO: 3287093 - RNA, 16 nt, Mycobacterium tuberculosis H37Rv
guccaauugucaagcc

SEQ ID NO: 3287094 - RNA, 16 nt, Mycobacterium tuberculosis H37Rv
guccacaacgucguga

SEQ ID NO: 3287095 - RNA, 14 nt, Mycobacterium tuberculosis H37Rv
guccacacgcugcc

SEQ ID NO: 3287096 - RNA, 13 nt, Mycobacterium tuberculosis H37Rv
guccacagccggc

SEQ ID NO: 3287097 - RNA, 20 nt, Mycobacterium tuberculosis H37Rv
guccacauccagggugccgg

SEQ ID NO: 3287098 - RNA, 22 nt, Mycobacterium tuberculosis H37Rv
guccacauccagggugccgguc

SEQ ID NO: 3287099 - RNA, 19 nt, Mycobacterium tuberculosis H37Rv
guccacaugguacggacgc

SEQ ID NO: 3287100 - RNA, 21 nt, Mycobacterium tuberculosis H37Rv
guccaccacaccugcggcugc

SEQ ID NO: 3287101 - RNA, 14 nt, Mycobacterium tuberculosis H37Rv
guccaccaccggca

SEQ ID NO: 3287102 - RNA, 15 nt, Mycobacterium tuberculosis H37Rv
guccaccaccggcac

SEQ ID NO: 3287103 - RNA, 18 nt, Mycobacterium tuberculosis H37Rv
guccaccagccgguuggc

SEQ ID NO: 3287104 - RNA, 23 nt, Mycobacterium tuberculosis H37Rv
guccacccacgaucagcagcguc

SEQ ID NO: 3287105 - RNA, 14 nt, Mycobacterium tuberculosis H37Rv
guccaccgaugcca

SEQ ID NO: 3287106 - RNA, 18 nt, Mycobacterium tuberculosis H37Rv
guccaccgcgaugcccca

SEQ ID NO: 3287107 - RNA, 16 nt, Mycobacterium tuberculosis H37Rv
guccaccgcugccggc

SEQ ID NO: 3287108 - RNA, 14 nt, Mycobacterium tuberculosis H37Rv
guccaccggaccga

SEQ ID NO: 3287109 - RNA, 21 nt, Mycobacterium tuberculosis H37Rv
guccacgcaccacgagcagcc

SEQ ID NO: 3287110 - RNA, 16 nt, Mycobacterium tuberculosis H37Rv
guccacgccgugcuug

SEQ ID NO: 3287111 - RNA, 22 nt, Mycobacterium tuberculosis H37Rv
guccacgcgcucggugccgccc

SEQ ID NO: 3287112 - RNA, 15 nt, Mycobacterium tuberculosis H37Rv
guccacgggccgggc

SEQ ID NO: 3287113 - RNA, 16 nt, Mycobacterium tuberculosis H37Rv
guccacguucggcugc

SEQ ID NO: 3287114 - RNA, 16 nt, Mycobacterium tuberculosis H37Rv
guccacugaucaggcc

SEQ ID NO: 3287115 - RNA, 18 nt, Mycobacterium tuberculosis H37Rv
guccacugaucaggccga

SEQ ID NO: 3287116 - RNA, 17 nt, Mycobacterium tuberculosis H37Rv
guccacugucagcgauc

SEQ ID NO: 3287117 - RNA, 15 nt, Mycobacterium tuberculosis H37Rv
guccagaacggcgau

SEQ ID NO: 3287118 - RNA, 15 nt, Mycobacterium tuberculosis H37Rv
guccagaacgguggc

SEQ ID NO: 3287119 - RNA, 13 nt, Mycobacterium tuberculosis H37Rv
guccagcaccggg

SEQ ID NO: 3287120 - RNA, 14 nt, Mycobacterium tuberculosis H37Rv
guccagcaccugcc

SEQ ID NO: 3287121 - RNA, 21 nt, Mycobacterium tuberculosis H37Rv
guccgacgcaccaacgcgauc

SEQ ID NO: 3287122 - RNA, 13 nt, Mycobacterium tuberculosis H37Rv
guccgacgcgugu

SEQ ID NO: 3287123 - RNA, 12 nt, Mycobacterium tuberculosis H37Rv
guccgacgggcc

SEQ ID NO: 3287124 - RNA, 20 nt, Mycobacterium tuberculosis H37Rv
guccgagcguaaugcugcug

SEQ ID NO: 3287125 - RNA, 22 nt, Mycobacterium tuberculosis H37Rv
guccgagcguaaugcugcugca

SEQ ID NO: 3287126 - RNA, 19 nt, Mycobacterium tuberculosis H37Rv
guccgagcuuggccgccgc

SEQ ID NO: 3287127 - RNA, 18 nt, Mycobacterium tuberculosis H37Rv
guccgagggcgucgccgc

SEQ ID NO: 3287128 - RNA, 19 nt, Mycobacterium tuberculosis H37Rv
guccgaucggcgcgccgau

SEQ ID NO: 3287129 - RNA, 13 nt, Mycobacterium tuberculosis H37Rv
guccgcacaacga

SEQ ID NO: 3287130 - RNA, 14 nt, Mycobacterium tuberculosis H37Rv
guccgcaccggcgg

SEQ ID NO: 3287131 - RNA, 17 nt, Mycobacterium tuberculosis H37Rv
guccgcagcaccgucgg

SEQ ID NO: 3287132 - RNA, 13 nt, Mycobacterium tuberculosis H37Rv
guccgcagcgucc

SEQ ID NO: 3287133 - RNA, 19 nt, Mycobacterium tuberculosis H37Rv
guccgcagcguccagcgcc

SEQ ID NO: 3287134 - RNA, 20 nt, Mycobacterium tuberculosis H37Rv
guccgcauccgcgacggcgc

SEQ ID NO: 3287135 - RNA, 20 nt, Mycobacterium tuberculosis H37Rv
guccgccaacggcaccucga

SEQ ID NO: 3287136 - RNA, 23 nt, Mycobacterium tuberculosis H37Rv
guccgccaacggcaccucgacgu

SEQ ID NO: 3287137 - RNA, 16 nt, Mycobacterium tuberculosis H37Rv
guccgccaccaagaag

SEQ ID NO: 3287138 - RNA, 14 nt, Mycobacterium tuberculosis H37Rv
guccgccaccgcga

SEQ ID NO: 3287139 - RNA, 17 nt, Mycobacterium tuberculosis H37Rv
guccgccacggcgggcg

SEQ ID NO: 3287140 - RNA, 22 nt, Mycobacterium tuberculosis H37Rv
guccgccauuggcgccgucacc

SEQ ID NO: 3287141 - RNA, 15 nt, Mycobacterium tuberculosis H37Rv
guccgccgaacaccg

SEQ ID NO: 3287142 - RNA, 12 nt, Mycobacterium tuberculosis H37Rv
guccgccgcaga

SEQ ID NO: 3287143 - RNA, 14 nt, Mycobacterium tuberculosis H37Rv
guccgccgcagcgc

SEQ ID NO: 3287144 - RNA, 20 nt, Mycobacterium tuberculosis H37Rv
guccgccggauagcaccggc

SEQ ID NO: 3287145 - RNA, 13 nt, Mycobacterium tuberculosis H37Rv
guccgccggcgag

SEQ ID NO: 3287146 - RNA, 16 nt, Mycobacterium tuberculosis H37Rv
guccgccgucgaccac

SEQ ID NO: 3287147 - RNA, 21 nt, Mycobacterium tuberculosis H37Rv
guccgccuaagcauucagcgc

SEQ ID NO: 3287148 - RNA, 20 nt, Mycobacterium tuberculosis H37Rv
guccgcgaucugcagcgcgg

SEQ ID NO: 3287149 - RNA, 23 nt, Mycobacterium tuberculosis H37Rv
guccgcgcccaccggcuagcugu

SEQ ID NO: 3287150 - RNA, 15 nt, Mycobacterium tuberculosis H37Rv
guccgcgcccgagcc

SEQ ID NO: 3287151 - RNA, 15 nt, Mycobacterium tuberculosis H37Rv
guccgcgccgacggc

SEQ ID NO: 3287152 - RNA, 22 nt, Mycobacterium tuberculosis H37Rv
guccgcgccgacggccagcagg

SEQ ID NO: 3287153 - RNA, 20 nt, Mycobacterium tuberculosis H37Rv
guccgcgcgaacgucaaccg

SEQ ID NO: 3287154 - RNA, 17 nt, Mycobacterium tuberculosis H37Rv
guccgcgcucagcuccg

SEQ ID NO: 3287155 - RNA, 22 nt, Mycobacterium tuberculosis H37Rv
guccgcggagaacaucccccgg

SEQ ID NO: 3287156 - RNA, 13 nt, Mycobacterium tuberculosis H37Rv
guccgcggccacc

SEQ ID NO: 3287157 - RNA, 15 nt, Mycobacterium tuberculosis H37Rv
guccgcgggccgcgc

SEQ ID NO: 3287158 - RNA, 16 nt, Mycobacterium tuberculosis H37Rv
guccgcugagcgggca

SEQ ID NO: 3287159 - RNA, 18 nt, Mycobacterium tuberculosis H37Rv
guccgcugguggucagca

SEQ ID NO: 3287160 - RNA, 19 nt, Mycobacterium tuberculosis H37Rv
guccggaaauuccggcgcg

SEQ ID NO: 3287161 - RNA, 21 nt, Mycobacterium tuberculosis H37Rv
guccggaaauuccggcgcggc

SEQ ID NO: 3287162 - RNA, 16 nt, Mycobacterium tuberculosis H37Rv
guccggaucggucggc

SEQ ID NO: 3287163 - RNA, 23 nt, Mycobacterium tuberculosis H37Rv
guccggaugcgcaaccgcggccc

SEQ ID NO: 3287164 - RNA, 21 nt, Mycobacterium tuberculosis H37Rv
guccggcaacaugagcgucgc

SEQ ID NO: 3287165 - RNA, 19 nt, Mycobacterium tuberculosis H37Rv
guccggcauaccgaacagc

SEQ ID NO: 3287166 - RNA, 12 nt, Mycobacterium tuberculosis H37Rv
guccggccacgg

SEQ ID NO: 3287167 - RNA, 12 nt, Mycobacterium tuberculosis H37Rv
guccggcccccc

SEQ ID NO: 3287168 - RNA, 13 nt, Mycobacterium tuberculosis H37Rv
guccggccccccg

SEQ ID NO: 3287169 - RNA, 16 nt, Mycobacterium tuberculosis H37Rv
guccggcccguagcug

SEQ ID NO: 3287170 - RNA, 17 nt, Mycobacterium tuberculosis H37Rv
guccggcccguagcugc

SEQ ID NO: 3287171 - RNA, 17 nt, Mycobacterium tuberculosis H37Rv
guccggcgccgaggucg

SEQ ID NO: 3287172 - RNA, 15 nt, Mycobacterium tuberculosis H37Rv
guccggcgccugcug

SEQ ID NO: 3287173 - RNA, 15 nt, Mycobacterium tuberculosis H37Rv
guccggcggcaggaa

SEQ ID NO: 3287174 - RNA, 20 nt, Mycobacterium tuberculosis H37Rv
guccggcguacucggugauc

SEQ ID NO: 3287175 - RNA, 14 nt, Mycobacterium tuberculosis H37Rv
guccggcgugggca

SEQ ID NO: 3287176 - RNA, 18 nt, Mycobacterium tuberculosis H37Rv
guccggcuuaccggcggg

SEQ ID NO: 3287177 - RNA, 17 nt, Mycobacterium tuberculosis H37Rv
guccggcuucggcgaac

SEQ ID NO: 3287178 - RNA, 16 nt, Mycobacterium tuberculosis H37Rv
guccggcuuggcggcg

SEQ ID NO: 3287179 - RNA, 18 nt, Mycobacterium tuberculosis H37Rv
guccggcuuggcggcgau

SEQ ID NO: 3287180 - RNA, 23 nt, Mycobacterium tuberculosis H37Rv
guccggcuuguccucacaugccc

SEQ ID NO: 3287181 - RNA, 20 nt, Mycobacterium tuberculosis H37Rv
guccgggcggccucccgggc

SEQ ID NO: 3287182 - RNA, 20 nt, Mycobacterium tuberculosis H37Rv
guccggggaccucggcgauc

SEQ ID NO: 3287183 - RNA, 16 nt, Mycobacterium tuberculosis H37Rv
guccggguagcggcgc

SEQ ID NO: 3287184 - RNA, 16 nt, Mycobacterium tuberculosis H37Rv
guccgggucaccagcg

SEQ ID NO: 3287185 - RNA, 17 nt, Mycobacterium tuberculosis H37Rv
guccgggucaccagcgc

SEQ ID NO: 3287186 - RNA, 21 nt, Mycobacterium tuberculosis H37Rv
guccgguagcuguggugguga

SEQ ID NO: 3287187 - RNA, 18 nt, Mycobacterium tuberculosis H37Rv
guccgguauugaucgaau

SEQ ID NO: 3287188 - RNA, 20 nt, Mycobacterium tuberculosis H37Rv
guccggucgccaagugcagg

SEQ ID NO: 3287189 - RNA, 22 nt, Mycobacterium tuberculosis H37Rv
guccggucgccucaccggcgcg

SEQ ID NO: 3287190 - RNA, 13 nt, Mycobacterium tuberculosis H37Rv
guccggugcuggu

SEQ ID NO: 3287191 - RNA, 23 nt, Mycobacterium tuberculosis H37Rv
guccgguggaccgccgaucggcc

SEQ ID NO: 3287192 - RNA, 16 nt, Mycobacterium tuberculosis H37Rv
guccgguggacgcaga

SEQ ID NO: 3287193 - RNA, 23 nt, Mycobacterium tuberculosis H37Rv
guccgguguggcgcugaucggca

SEQ ID NO: 3287194 - RNA, 18 nt, Mycobacterium tuberculosis H37Rv
guccgguuacgcucgcga

SEQ ID NO: 3287195 - RNA, 23 nt, Mycobacterium tuberculosis H37Rv
guccgguuacuuuuccaguguga

SEQ ID NO: 3287196 - RNA, 17 nt, Mycobacterium tuberculosis H37Rv
guccguacuugccaccc

SEQ ID NO: 3287197 - RNA, 18 nt, Mycobacterium tuberculosis H37Rv
guccguagcgcggccgau

SEQ ID NO: 3287198 - RNA, 23 nt, Mycobacterium tuberculosis H37Rv
guccguagugaucgcaaaggccc

SEQ ID NO: 3287199 - RNA, 20 nt, Mycobacterium tuberculosis H37Rv
guccgucagcaccccgccgc

SEQ ID NO: 3287200 - RNA, 13 nt, Mycobacterium tuberculosis H37Rv
guccgucggggac

SEQ ID NO: 3287201 - RNA, 20 nt, Mycobacterium tuberculosis H37Rv
guccgucggguagugcccac

SEQ ID NO: 3287202 - RNA, 15 nt, Mycobacterium tuberculosis H37Rv
guccguggacaagca

SEQ ID NO: 3287203 - RNA, 19 nt, Mycobacterium tuberculosis H37Rv
guccguucaccgucugcgg

SEQ ID NO: 3287204 - RNA, 16 nt, Mycobacterium tuberculosis H37Rv
guccguucgaugccag

SEQ ID NO: 3287205 - RNA, 22 nt, Mycobacterium tuberculosis H37Rv
guccguucgaugccagugcauc

SEQ ID NO: 3287206 - RNA, 16 nt, Mycobacterium tuberculosis H37Rv
guccuagcgugccgcc

SEQ ID NO: 3287207 - RNA, 20 nt, Mycobacterium tuberculosis H37Rv
guccuagcgugccgcccggu

SEQ ID NO: 3287208 - RNA, 18 nt, Mycobacterium tuberculosis H37Rv
guccuauuugcagccuuc

SEQ ID NO: 3287209 - RNA, 19 nt, Mycobacterium tuberculosis H37Rv
guccucacaugcccggacg

SEQ ID NO: 3287210 - RNA, 14 nt, Mycobacterium tuberculosis H37Rv
guccucaucgagcg

SEQ ID NO: 3287211 - RNA, 20 nt, Mycobacterium tuberculosis H37Rv
guccuccaaggcggucacca

SEQ ID NO: 3287212 - RNA, 18 nt, Mycobacterium tuberculosis H37Rv
guccuccagcugcgcggg

SEQ ID NO: 3287213 - RNA, 22 nt, Mycobacterium tuberculosis H37Rv
guccucccaucccaugucgagg

SEQ ID NO: 3287214 - RNA, 22 nt, Mycobacterium tuberculosis H37Rv
guccucccauucccaacacagc

SEQ ID NO: 3287215 - RNA, 12 nt, Mycobacterium tuberculosis H37Rv
guccuccgggcu

SEQ ID NO: 3287216 - RNA, 19 nt, Mycobacterium tuberculosis H37Rv
guccuccuucggugguggg

SEQ ID NO: 3287217 - RNA, 21 nt, Mycobacterium tuberculosis H37Rv
gucgacgccgagaccgccgcu

SEQ ID NO: 3287218 - RNA, 15 nt, Mycobacterium tuberculosis H37Rv
gucgacgccgcagcg

SEQ ID NO: 3287219 - RNA, 16 nt, Mycobacterium tuberculosis H37Rv
gucgacgccggccagc

SEQ ID NO: 3287220 - RNA, 19 nt, Mycobacterium tuberculosis H37Rv
gucgacgcgguccucgagc

SEQ ID NO: 3287221 - RNA, 19 nt, Mycobacterium tuberculosis H37Rv
gucgacggaaucgucggcg

SEQ ID NO: 3287222 - RNA, 14 nt, Mycobacterium tuberculosis H37Rv
gucgacggcaucgg

SEQ ID NO: 3287223 - RNA, 15 nt, Mycobacterium tuberculosis H37Rv
gucgacggccacccc

SEQ ID NO: 3287224 - RNA, 20 nt, Mycobacterium tuberculosis H37Rv
gucgacggccagugcgcaga

SEQ ID NO: 3287225 - RNA, 22 nt, Mycobacterium tuberculosis H37Rv
gucgacggccuggggcagccgg

SEQ ID NO: 3287226 - RNA, 13 nt, Mycobacterium tuberculosis H37Rv
gucgacggcggcc

SEQ ID NO: 3287227 - RNA, 17 nt, Mycobacterium tuberculosis H37Rv
gucgacgggcacgcggc

SEQ ID NO: 3287228 - RNA, 19 nt, Mycobacterium tuberculosis H37Rv
gucgacgggcacgcggcga

SEQ ID NO: 3287229 - RNA, 13 nt, Mycobacterium tuberculosis H37Rv
gucgacggucacc

SEQ ID NO: 3287230 - RNA, 14 nt, Mycobacterium tuberculosis H37Rv
gucgacggucaucc

SEQ ID NO: 3287231 - RNA, 21 nt, Mycobacterium tuberculosis H37Rv
gucgacggucuggcccgcgac

SEQ ID NO: 3287232 - RNA, 12 nt, Mycobacterium tuberculosis H37Rv
gucgacgucgac

SEQ ID NO: 3287233 - RNA, 13 nt, Mycobacterium tuberculosis H37Rv
gucgacgucgauc

SEQ ID NO: 3287234 - RNA, 22 nt, Mycobacterium tuberculosis H37Rv
gucgacgugaucgcgguccaac

SEQ ID NO: 3287235 - RNA, 23 nt, Mycobacterium tuberculosis H37Rv
gucgacgugaucgcgguccaaca

SEQ ID NO: 3287236 - RNA, 22 nt, Mycobacterium tuberculosis H37Rv
gucgacgugugccguccccggc

SEQ ID NO: 3287237 - RNA, 22 nt, Mycobacterium tuberculosis H37Rv
gucgacguuaccgaccgcgugc

SEQ ID NO: 3287238 - RNA, 23 nt, Mycobacterium tuberculosis H37Rv
gucgacguuggcaaagccgaaau

SEQ ID NO: 3287239 - RNA, 14 nt, Mycobacterium tuberculosis H37Rv
gucgacuccagcac

SEQ ID NO: 3287240 - RNA, 13 nt, Mycobacterium tuberculosis H37Rv
gucgacuccgauc

SEQ ID NO: 3287241 - RNA, 17 nt, Mycobacterium tuberculosis H37Rv
gucgacucguggcgcca

SEQ ID NO: 3287242 - RNA, 20 nt, Mycobacterium tuberculosis H37Rv
gucgacucguggcgccacgg

SEQ ID NO: 3287243 - RNA, 22 nt, Mycobacterium tuberculosis H37Rv
gucgacuguucgggaugcagcu

SEQ ID NO: 3287244 - RNA, 16 nt, Mycobacterium tuberculosis H37Rv
gucgacuugcaggcgu

SEQ ID NO: 3287245 - RNA, 14 nt, Mycobacterium tuberculosis H37Rv
gucgacuugccgac

SEQ ID NO: 3287246 - RNA, 21 nt, Mycobacterium tuberculosis H37Rv
gucgagaucucacgugcccgc

SEQ ID NO: 3287247 - RNA, 22 nt, Mycobacterium tuberculosis H37Rv
gucgagcaccacccgggccucg

SEQ ID NO: 3287248 - RNA, 18 nt, Mycobacterium tuberculosis H37Rv
gucgagcaccugccgauc

SEQ ID NO: 3287249 - RNA, 19 nt, Mycobacterium tuberculosis H37Rv
gucgagcaccugccgaucg

SEQ ID NO: 3287250 - RNA, 16 nt, Mycobacterium tuberculosis H37Rv
gucgagcacgcugcug

SEQ ID NO: 3287251 - RNA, 16 nt, Mycobacterium tuberculosis H37Rv
gucgagcacggugagc

SEQ ID NO: 3287252 - RNA, 17 nt, Mycobacterium tuberculosis H37Rv
gucgagcacggugagcc

SEQ ID NO: 3287253 - RNA, 14 nt, Mycobacterium tuberculosis H37Rv
gucgagcagcacca

SEQ ID NO: 3287254 - RNA, 13 nt, Mycobacterium tuberculosis H37Rv
gucgagcaggccc

SEQ ID NO: 3287255 - RNA, 16 nt, Mycobacterium tuberculosis H37Rv
gucgagcaucccgguc

SEQ ID NO: 3287256 - RNA, 22 nt, Mycobacterium tuberculosis H37Rv
gucgagccgugccucgaggacg

SEQ ID NO: 3287257 - RNA, 22 nt, Mycobacterium tuberculosis H37Rv
gucgagcgaccccacacgccga

SEQ ID NO: 3287258 - RNA, 16 nt, Mycobacterium tuberculosis H37Rv
gucgagcgcccacugg

SEQ ID NO: 3287259 - RNA, 21 nt, Mycobacterium tuberculosis H37Rv
gucgagcgcccacuggugauc

SEQ ID NO: 3287260 - RNA, 15 nt, Mycobacterium tuberculosis H37Rv
gucgagcgccgcagu

SEQ ID NO: 3287261 - RNA, 17 nt, Mycobacterium tuberculosis H37Rv
gucgagcgccgcaguga

SEQ ID NO: 3287262 - RNA, 16 nt, Mycobacterium tuberculosis H37Rv
gucgagcgccuugucg

SEQ ID NO: 3287263 - RNA, 19 nt, Mycobacterium tuberculosis H37Rv
gucgagcgcgucggucacc

SEQ ID NO: 3287264 - RNA, 19 nt, Mycobacterium tuberculosis H37Rv
gucgagcgcuucgucgccg

SEQ ID NO: 3287265 - RNA, 22 nt, Mycobacterium tuberculosis H37Rv
gucgagcgcuucgucgccgaac

SEQ ID NO: 3287266 - RNA, 20 nt, Mycobacterium tuberculosis H37Rv
gucgagcgucugcgaucccg

SEQ ID NO: 3287267 - RNA, 21 nt, Mycobacterium tuberculosis H37Rv
gucgagcguuuuggugcggac

SEQ ID NO: 3287268 - RNA, 16 nt, Mycobacterium tuberculosis H37Rv
gucgagcugaccacgg

SEQ ID NO: 3287269 - RNA, 19 nt, Mycobacterium tuberculosis H37Rv
gucgagcuuuucgaccuuc

SEQ ID NO: 3287270 - RNA, 23 nt, Mycobacterium tuberculosis H37Rv
gucgaggcaggccucggcgccgc

SEQ ID NO: 3287271 - RNA, 18 nt, Mycobacterium tuberculosis H37Rv
gucgaggcccucgcgcgc

SEQ ID NO: 3287272 - RNA, 16 nt, Mycobacterium tuberculosis H37Rv
gucgagggagcgccgc

SEQ ID NO: 3287273 - RNA, 17 nt, Mycobacterium tuberculosis H37Rv
gucgaggucagcucccg

SEQ ID NO: 3287274 - RNA, 20 nt, Mycobacterium tuberculosis H37Rv
gucgagguccucgagguccu

SEQ ID NO: 3287275 - RNA, 12 nt, Mycobacterium tuberculosis H37Rv
gucgaggucggc

SEQ ID NO: 3287276 - RNA, 14 nt, Mycobacterium tuberculosis H37Rv
gucgaggugacuug

SEQ ID NO: 3287277 - RNA, 18 nt, Mycobacterium tuberculosis H37Rv
gucgagguucucccgcgc

SEQ ID NO: 3287278 - RNA, 22 nt, Mycobacterium tuberculosis H37Rv
gucgagguucucccgcgcuugg

SEQ ID NO: 3287279 - RNA, 21 nt, Mycobacterium tuberculosis H37Rv
gucgaguagccguagccgccg

SEQ ID NO: 3287280 - RNA, 16 nt, Mycobacterium tuberculosis H37Rv
gucgagucgacaagcc

SEQ ID NO: 3287281 - RNA, 21 nt, Mycobacterium tuberculosis H37Rv
gucgagucgacggcaucgggg

SEQ ID NO: 3287282 - RNA, 15 nt, Mycobacterium tuberculosis H37Rv
gucgagucgaugacc

SEQ ID NO: 3287283 - RNA, 22 nt, Mycobacterium tuberculosis H37Rv
gucgagucgguccugccaaugc

SEQ ID NO: 3287284 - RNA, 20 nt, Mycobacterium tuberculosis H37Rv
gucgagugccucgaccugga

SEQ ID NO: 3287285 - RNA, 13 nt, Mycobacterium tuberculosis H37Rv
gucgagugcggac

SEQ ID NO: 3287286 - RNA, 19 nt, Mycobacterium tuberculosis H37Rv
gucgaguuuugcggccagg

SEQ ID NO: 3287287 - RNA, 14 nt, Mycobacterium tuberculosis H37Rv
gucgauaaccuggc

SEQ ID NO: 3287288 - RNA, 19 nt, Mycobacterium tuberculosis H37Rv
gucgauaaccuggcggucc

SEQ ID NO: 3287289 - RNA, 22 nt, Mycobacterium tuberculosis H37Rv
gucgauaaugaucucggcaagg

SEQ ID NO: 3287290 - RNA, 15 nt, Mycobacterium tuberculosis H37Rv
gucgauaccggcgug

SEQ ID NO: 3287291 - RNA, 12 nt, Mycobacterium tuberculosis H37Rv
gucgaucaacaa

SEQ ID NO: 3287292 - RNA, 12 nt, Mycobacterium tuberculosis H37Rv
gucgaucaccga

SEQ ID NO: 3287293 - RNA, 14 nt, Mycobacterium tuberculosis H37Rv
gucgaucacgucgu

SEQ ID NO: 3287294 - RNA, 21 nt, Mycobacterium tuberculosis H37Rv
gucgaucacgucgucagccac

SEQ ID NO: 3287295 - RNA, 13 nt, Mycobacterium tuberculosis H37Rv
gucgaucagcgcg

SEQ ID NO: 3287296 - RNA, 19 nt, Mycobacterium tuberculosis H37Rv
gucgaucagcggcagcacc

SEQ ID NO: 3287297 - RNA, 14 nt, Mycobacterium tuberculosis H37Rv
gucgaucaggccgu

SEQ ID NO: 3287298 - RNA, 16 nt, Mycobacterium tuberculosis H37Rv
gucgaucauggcggca

SEQ ID NO: 3287299 - RNA, 19 nt, Mycobacterium tuberculosis H37Rv
gucgaucgaauugcguucg

SEQ ID NO: 3287300 - RNA, 14 nt, Mycobacterium tuberculosis H37Rv
gucgaucgccgcga

SEQ ID NO: 3287301 - RNA, 20 nt, Mycobacterium tuberculosis H37Rv
gucgaucuccgucggugagc

SEQ ID NO: 3287302 - RNA, 23 nt, Mycobacterium tuberculosis H37Rv
gucgaucuccucuugcaccaggg

SEQ ID NO: 3287303 - RNA, 16 nt, Mycobacterium tuberculosis H37Rv
gucgaucucgaucgac

SEQ ID NO: 3287304 - RNA, 20 nt, Mycobacterium tuberculosis H37Rv
gucgaucucgaucgacccgg

SEQ ID NO: 3287305 - RNA, 21 nt, Mycobacterium tuberculosis H37Rv
gucgaucucggccagggucac

SEQ ID NO: 3287306 - RNA, 21 nt, Mycobacterium tuberculosis H37Rv
gucgaucucggcgcagggacu

SEQ ID NO: 3287307 - RNA, 20 nt, Mycobacterium tuberculosis H37Rv
gucgaugaagcgucguugcu

SEQ ID NO: 3287308 - RNA, 18 nt, Mycobacterium tuberculosis H37Rv
gucgaugccggugugcgc

SEQ ID NO: 3287309 - RNA, 14 nt, Mycobacterium tuberculosis H37Rv
gucgaugcgcugcu

SEQ ID NO: 3287310 - RNA, 20 nt, Mycobacterium tuberculosis H37Rv
gucgaugcgcugcucacgca

SEQ ID NO: 3287311 - RNA, 17 nt, Mycobacterium tuberculosis H37Rv
gucgauggucuccggac

SEQ ID NO: 3287312 - RNA, 18 nt, Mycobacterium tuberculosis H37Rv
gucgauggugcggcccaa

SEQ ID NO: 3287313 - RNA, 19 nt, Mycobacterium tuberculosis H37Rv
gucgauguccacgccgugc

SEQ ID NO: 3287314 - RNA, 19 nt, Mycobacterium tuberculosis H37Rv
gucgauguccccggcggca

SEQ ID NO: 3287315 - RNA, 23 nt, Mycobacterium tuberculosis H37Rv
gucgauguccgcagcaccgucgg

SEQ ID NO: 3287316 - RNA, 17 nt, Mycobacterium tuberculosis H37Rv
gucgaugucgacgucgc

SEQ ID NO: 3287317 - RNA, 14 nt, Mycobacterium tuberculosis H37Rv
gucgaugucgccgc

SEQ ID NO: 3287318 - RNA, 18 nt, Mycobacterium tuberculosis H37Rv
gucgaugucguuggccac

SEQ ID NO: 3287319 - RNA, 17 nt, Mycobacterium tuberculosis H37Rv
gucgauguucgccgcgc

SEQ ID NO: 3287320 - RNA, 18 nt, Mycobacterium tuberculosis H37Rv
gucgauuagcccacccau

SEQ ID NO: 3287321 - RNA, 17 nt, Mycobacterium tuberculosis H37Rv
gucgauuggcucgccga

SEQ ID NO: 3287322 - RNA, 18 nt, Mycobacterium tuberculosis H37Rv
gucgauuggcugcgccga

SEQ ID NO: 3287323 - RNA, 15 nt, Mycobacterium tuberculosis H37Rv
gucgauuucgacgac

SEQ ID NO: 3287324 - RNA, 18 nt, Mycobacterium tuberculosis H37Rv
gucgauuucgccgucgcu

SEQ ID NO: 3287325 - RNA, 15 nt, Mycobacterium tuberculosis H37Rv
gucgauuucggcgac

SEQ ID NO: 3287326 - RNA, 15 nt, Mycobacterium tuberculosis H37Rv
gucgauuucggcggc

SEQ ID NO: 3287327 - RNA, 15 nt, Mycobacterium tuberculosis H37Rv
gucgauuugaucgac

SEQ ID NO: 3287328 - RNA, 14 nt, Mycobacterium tuberculosis H37Rv
gucgcaacgcgauc

SEQ ID NO: 3287329 - RNA, 22 nt, Mycobacterium tuberculosis H37Rv
gucgcaaggcccgcaccgcuga

SEQ ID NO: 3287330 - RNA, 21 nt, Mycobacterium tuberculosis H37Rv
gucgcaauauccggccgagcc

SEQ ID NO: 3287331 - RNA, 18 nt, Mycobacterium tuberculosis H37Rv
gucgcaauaugccacaga

SEQ ID NO: 3287332 - RNA, 19 nt, Mycobacterium tuberculosis H37Rv
gucgcaccacagugccaau

SEQ ID NO: 3287333 - RNA, 12 nt, Mycobacterium tuberculosis H37Rv
gucgcaccagcg

SEQ ID NO: 3287334 - RNA, 19 nt, Mycobacterium tuberculosis H37Rv
gucgcacccaacuccauca

SEQ ID NO: 3287335 - RNA, 12 nt, Mycobacterium tuberculosis H37Rv
gucgcacggugc

SEQ ID NO: 3287336 - RNA, 14 nt, Mycobacterium tuberculosis H37Rv
gucgcacggugccg

SEQ ID NO: 3287337 - RNA, 22 nt, Mycobacterium tuberculosis H37Rv
gucgcacucauagaacucgccg

SEQ ID NO: 3287338 - RNA, 15 nt, Mycobacterium tuberculosis H37Rv
gucgcagccagcuga

SEQ ID NO: 3287339 - RNA, 14 nt, Mycobacterium tuberculosis H37Rv
gucgcagcucgucg

SEQ ID NO: 3287340 - RNA, 13 nt, Mycobacterium tuberculosis H37Rv
gucgcagcugccg

SEQ ID NO: 3287341 - RNA, 19 nt, Mycobacterium tuberculosis H37Rv
gucgcaguauucacagucg

SEQ ID NO: 3287342 - RNA, 20 nt, Mycobacterium tuberculosis H37Rv
gucgcaguauucacagucgc

SEQ ID NO: 3287343 - RNA, 15 nt, Mycobacterium tuberculosis H37Rv
gucgcagugcaagcg

SEQ ID NO: 3287344 - RNA, 15 nt, Mycobacterium tuberculosis H37Rv
gucgccaacgccagc

SEQ ID NO: 3287345 - RNA, 17 nt, Mycobacterium tuberculosis H37Rv
gucgccaagaucgggug

SEQ ID NO: 3287346 - RNA, 22 nt, Mycobacterium tuberculosis H37Rv
gucgccaagaucggguggcggg

SEQ ID NO: 3287347 - RNA, 15 nt, Mycobacterium tuberculosis H37Rv
gucgccaagcccagg

SEQ ID NO: 3287348 - RNA, 19 nt, Mycobacterium tuberculosis H37Rv
gucgccaagcccaggcgau

SEQ ID NO: 3287349 - RNA, 17 nt, Mycobacterium tuberculosis H37Rv
gucgccaaucgaguagc

SEQ ID NO: 3287350 - RNA, 23 nt, Mycobacterium tuberculosis H37Rv
gucgccaaucgaguagcugaccg

SEQ ID NO: 3287351 - RNA, 20 nt, Mycobacterium tuberculosis H37Rv
gucgccaccagagucaacau

SEQ ID NO: 3287352 - RNA, 21 nt, Mycobacterium tuberculosis H37Rv
gucgccacccgcgcuccaaca

SEQ ID NO: 3287353 - RNA, 22 nt, Mycobacterium tuberculosis H37Rv
gucgccaccgccggcagcaucg

SEQ ID NO: 3287354 - RNA, 16 nt, Mycobacterium tuberculosis H37Rv
gucgccaccgguaccg

SEQ ID NO: 3287355 - RNA, 22 nt, Mycobacterium tuberculosis H37Rv
gucgccaccgguaccgaucagc

SEQ ID NO: 3287356 - RNA, 13 nt, Mycobacterium tuberculosis H37Rv
gucgccagaccgc

SEQ ID NO: 3287357 - RNA, 20 nt, Mycobacterium tuberculosis H37Rv
gucgccagaccgcaccauug

SEQ ID NO: 3287358 - RNA, 18 nt, Mycobacterium tuberculosis H37Rv
gucgccagggagcgcagc

SEQ ID NO: 3287359 - RNA, 20 nt, Mycobacterium tuberculosis H37Rv
gucgccagggagcgcagcgc

SEQ ID NO: 3287360 - RNA, 23 nt, Mycobacterium tuberculosis H37Rv
gucgccagggagcgcagcgccgg

SEQ ID NO: 3287361 - RNA, 13 nt, Mycobacterium tuberculosis H37Rv
gucgccagggccg

SEQ ID NO: 3287362 - RNA, 14 nt, Mycobacterium tuberculosis H37Rv
gucgccagggccgc

SEQ ID NO: 3287363 - RNA, 13 nt, Mycobacterium tuberculosis H37Rv
gucgccaggucau

SEQ ID NO: 3287364 - RNA, 15 nt, Mycobacterium tuberculosis H37Rv
gucgccaggucaucg

SEQ ID NO: 3287365 - RNA, 13 nt, Mycobacterium tuberculosis H37Rv
gucgccauaccug

SEQ ID NO: 3287366 - RNA, 17 nt, Mycobacterium tuberculosis H37Rv
gucgccauccucgagcu

SEQ ID NO: 3287367 - RNA, 18 nt, Mycobacterium tuberculosis H37Rv
gucgccauccucgagcug

SEQ ID NO: 3287368 - RNA, 16 nt, Mycobacterium tuberculosis H37Rv
gucgccaugucggcca

SEQ ID NO: 3287369 - RNA, 18 nt, Mycobacterium tuberculosis H37Rv
gucgccaugucggccagg

SEQ ID NO: 3287370 - RNA, 19 nt, Mycobacterium tuberculosis H37Rv
gucgccaugucggccaggu

SEQ ID NO: 3287371 - RNA, 18 nt, Mycobacterium tuberculosis H37Rv
gucgccauuccaucgcgc

SEQ ID NO: 3287372 - RNA, 16 nt, Mycobacterium tuberculosis H37Rv
gucgcccaaccgaacc

SEQ ID NO: 3287373 - RNA, 18 nt, Mycobacterium tuberculosis H37Rv
gucgcccagccacugacg

SEQ ID NO: 3287374 - RNA, 20 nt, Mycobacterium tuberculosis H37Rv
gucgcccagccacugacggc

SEQ ID NO: 3287375 - RNA, 13 nt, Mycobacterium tuberculosis H37Rv
gucgcccagccga

SEQ ID NO: 3287376 - RNA, 15 nt, Mycobacterium tuberculosis H37Rv
gucgcccagccgagc

SEQ ID NO: 3287377 - RNA, 16 nt, Mycobacterium tuberculosis H37Rv
gucgccccgaugaccg

SEQ ID NO: 3287378 - RNA, 24 nt, Mycobacterium tuberculosis H37Rv
gucgcccgugucguaccagccaug

SEQ ID NO: 3287379 - RNA, 17 nt, Mycobacterium tuberculosis H37Rv
gucgcccuguucggccc

SEQ ID NO: 3287380 - RNA, 20 nt, Mycobacterium tuberculosis H37Rv
gucgccgaaagggucgacgu

SEQ ID NO: 3287381 - RNA, 23 nt, Mycobacterium tuberculosis H37Rv
gucgccgaacagcagcccgcccu

SEQ ID NO: 3287382 - RNA, 18 nt, Mycobacterium tuberculosis H37Rv
gucgccgacccgggggcg

SEQ ID NO: 3287383 - RNA, 16 nt, Mycobacterium tuberculosis H37Rv
gucgccgaggacgccg

SEQ ID NO: 3287384 - RNA, 20 nt, Mycobacterium tuberculosis H37Rv
gucgccgaucgagacuucuu

SEQ ID NO: 3287385 - RNA, 16 nt, Mycobacterium tuberculosis H37Rv
gucgccgcaucggcgg

SEQ ID NO: 3287386 - RNA, 14 nt, Mycobacterium tuberculosis H37Rv
gucgccgccaccag

SEQ ID NO: 3287387 - RNA, 15 nt, Mycobacterium tuberculosis H37Rv
gucgccgccaccagc

SEQ ID NO: 3287388 - RNA, 18 nt, Mycobacterium tuberculosis H37Rv
gucgccgccaccagcgca

SEQ ID NO: 3287389 - RNA, 20 nt, Mycobacterium tuberculosis H37Rv
gucgccgccauugccgccgg

SEQ ID NO: 3287390 - RNA, 13 nt, Mycobacterium tuberculosis H37Rv
gucgccgcccgug

SEQ ID NO: 3287391 - RNA, 18 nt, Mycobacterium tuberculosis H37Rv
gucgccgcccgugccgcc

SEQ ID NO: 3287392 - RNA, 21 nt, Mycobacterium tuberculosis H37Rv
gucgccgcccgugccgcccuc

SEQ ID NO: 3287393 - RNA, 14 nt, Mycobacterium tuberculosis H37Rv
gucgccgccgcgac

SEQ ID NO: 3287394 - RNA, 20 nt, Mycobacterium tuberculosis H37Rv
gucgccgccgcuaccgccgg

SEQ ID NO: 3287395 - RNA, 11 nt, Mycobacterium tuberculosis H37Rv
gucgccgccgu

SEQ ID NO: 3287396 - RNA, 21 nt, Mycobacterium tuberculosis H37Rv
gucgccgccguugccgccagc

SEQ ID NO: 3287397 - RNA, 21 nt, Mycobacterium tuberculosis H37Rv
gucgccgccuuacgcaccgau

SEQ ID NO: 3287398 - RNA, 22 nt, Mycobacterium tuberculosis H37Rv
gucgccgccuuccuggcgggcg

SEQ ID NO: 3287399 - RNA, 21 nt, Mycobacterium tuberculosis H37Rv
gucgccgccuucuuggcggcc

SEQ ID NO: 3287400 - RNA, 15 nt, Mycobacterium tuberculosis H37Rv
gucgccgcggcggca

SEQ ID NO: 3287401 - RNA, 21 nt, Mycobacterium tuberculosis H37Rv
gucgccgcggcggcagcggcg

SEQ ID NO: 3287402 - RNA, 23 nt, Mycobacterium tuberculosis H37Rv
gucgccgcggcggcagcggcgau

SEQ ID NO: 3287403 - RNA, 15 nt, Mycobacterium tuberculosis H37Rv
gucgccgcgggcagc

SEQ ID NO: 3287404 - RNA, 15 nt, Mycobacterium tuberculosis H37Rv
gucgccgcuuucuug

SEQ ID NO: 3287405 - RNA, 22 nt, Mycobacterium tuberculosis H37Rv
gucgccggaccagagccaacga

SEQ ID NO: 3287406 - RNA, 21 nt, Mycobacterium tuberculosis H37Rv
gucgccggacgacaacaggcc

SEQ ID NO: 3287407 - RNA, 16 nt, Mycobacterium tuberculosis H37Rv
gucgccggauagcgca

SEQ ID NO: 3287408 - RNA, 22 nt, Mycobacterium tuberculosis H37Rv
gucgccggauagcgcagcucgc

SEQ ID NO: 3287409 - RNA, 13 nt, Mycobacterium tuberculosis H37Rv
gucggcaaucucg

SEQ ID NO: 3287410 - RNA, 22 nt, Mycobacterium tuberculosis H37Rv
gucggcaaugucuucgauaccg

SEQ ID NO: 3287411 - RNA, 15 nt, Mycobacterium tuberculosis H37Rv
gucggcaccagcagc

SEQ ID NO: 3287412 - RNA, 20 nt, Mycobacterium tuberculosis H37Rv
gucggcaccauagcuggagu

SEQ ID NO: 3287413 - RNA, 13 nt, Mycobacterium tuberculosis H37Rv
gucggcaccgauc

SEQ ID NO: 3287414 - RNA, 14 nt, Mycobacterium tuberculosis H37Rv
gucggcaccgguuu

SEQ ID NO: 3287415 - RNA, 15 nt, Mycobacterium tuberculosis H37Rv
gucggcacgacccgg

SEQ ID NO: 3287416 - RNA, 18 nt, Mycobacterium tuberculosis H37Rv
gucggcagaccgaccucg

SEQ ID NO: 3287417 - RNA, 14 nt, Mycobacterium tuberculosis H37Rv
gucggcagcgacgc

SEQ ID NO: 3287418 - RNA, 14 nt, Mycobacterium tuberculosis H37Rv
gucggcagcugggg

SEQ ID NO: 3287419 - RNA, 23 nt, Mycobacterium tuberculosis H37Rv
gucggcaugacauacagcgggcg

SEQ ID NO: 3287420 - RNA, 17 nt, Mycobacterium tuberculosis H37Rv
gucggccaaagacccgg

SEQ ID NO: 3287421 - RNA, 18 nt, Mycobacterium tuberculosis H37Rv
gucggccacauccagcgc

SEQ ID NO: 3287422 - RNA, 15 nt, Mycobacterium tuberculosis H37Rv
gucggccaccggcgu

SEQ ID NO: 3287423 - RNA, 23 nt, Mycobacterium tuberculosis H37Rv
gucggccaccugcucgucgguca

SEQ ID NO: 3287424 - RNA, 22 nt, Mycobacterium tuberculosis H37Rv
gucggccagcagcagugccacc

SEQ ID NO: 3287425 - RNA, 14 nt, Mycobacterium tuberculosis H37Rv
gucggccagcucgc

SEQ ID NO: 3287426 - RNA, 12 nt, Mycobacterium tuberculosis H37Rv
gucggccaggcc

SEQ ID NO: 3287427 - RNA, 14 nt, Mycobacterium tuberculosis H37Rv
gucggccaggccac

SEQ ID NO: 3287428 - RNA, 22 nt, Mycobacterium tuberculosis H37Rv
gucggccaggccgucggcgucg

SEQ ID NO: 3287429 - RNA, 12 nt, Mycobacterium tuberculosis H37Rv
gucggccaggcu

SEQ ID NO: 3287430 - RNA, 19 nt, Mycobacterium tuberculosis H37Rv
gucggccauccaccgcaga

SEQ ID NO: 3287431 - RNA, 21 nt, Mycobacterium tuberculosis H37Rv
gucggccauccaccgcagauc

SEQ ID NO: 3287432 - RNA, 17 nt, Mycobacterium tuberculosis H37Rv
gucggccccggccgcgu

SEQ ID NO: 3287433 - RNA, 16 nt, Mycobacterium tuberculosis H37Rv
gucggcccgcggucgc

SEQ ID NO: 3287434 - RNA, 19 nt, Mycobacterium tuberculosis H37Rv
gucggcccuccaccggugu

SEQ ID NO: 3287435 - RNA, 14 nt, Mycobacterium tuberculosis H37Rv
gucggccgacaccg

SEQ ID NO: 3287436 - RNA, 16 nt, Mycobacterium tuberculosis H37Rv
gucggccgcaucgccc

SEQ ID NO: 3287437 - RNA, 23 nt, Mycobacterium tuberculosis H37Rv
gucggccgccuucuccggcguca

SEQ ID NO: 3287438 - RNA, 16 nt, Mycobacterium tuberculosis H37Rv
gucggccgcgcugcug

SEQ ID NO: 3287439 - RNA, 13 nt, Mycobacterium tuberculosis H37Rv
gucggccggcggu

SEQ ID NO: 3287440 - RNA, 16 nt, Mycobacterium tuberculosis H37Rv
gucggccggggccacc

SEQ ID NO: 3287441 - RNA, 19 nt, Mycobacterium tuberculosis H37Rv
gucggccugaccggucacc

SEQ ID NO: 3287442 - RNA, 14 nt, Mycobacterium tuberculosis H37Rv
gucggccugcggca

SEQ ID NO: 3287443 - RNA, 21 nt, Mycobacterium tuberculosis H37Rv
gucggccuggcaggguggggc

SEQ ID NO: 3287444 - RNA, 22 nt, Mycobacterium tuberculosis H37Rv
gucggcgaaaggccagucgugc

SEQ ID NO: 3287445 - RNA, 19 nt, Mycobacterium tuberculosis H37Rv
gucggcgaacaaccgccgc

SEQ ID NO: 3287446 - RNA, 22 nt, Mycobacterium tuberculosis H37Rv
gucggcgaaccacggcagccaa

SEQ ID NO: 3287447 - RNA, 19 nt, Mycobacterium tuberculosis H37Rv
gucggcgaacgcggcgucg

SEQ ID NO: 3287448 - RNA, 15 nt, Mycobacterium tuberculosis H37Rv
gucggcgaagcgggc

SEQ ID NO: 3287449 - RNA, 22 nt, Mycobacterium tuberculosis H37Rv
gucggcgaagguguccuccagc

SEQ ID NO: 3287450 - RNA, 16 nt, Mycobacterium tuberculosis H37Rv
gucggcgaccaccagc

SEQ ID NO: 3287451 - RNA, 21 nt, Mycobacterium tuberculosis H37Rv
gucggcgaccaccagcgccga

SEQ ID NO: 3287452 - RNA, 13 nt, Mycobacterium tuberculosis H37Rv
gucggcgaccagg

SEQ ID NO: 3287453 - RNA, 22 nt, Mycobacterium tuberculosis H37Rv
gucggcgaccgagacggcgucg

SEQ ID NO: 3287454 - RNA, 15 nt, Mycobacterium tuberculosis H37Rv
gucggcgaccgcgcu

SEQ ID NO: 3287455 - RNA, 15 nt, Mycobacterium tuberculosis H37Rv
gucggcgacgaaccg

SEQ ID NO: 3287456 - RNA, 18 nt, Mycobacterium tuberculosis H37Rv
gucggcgacgaaccgcca

SEQ ID NO: 3287457 - RNA, 20 nt, Mycobacterium tuberculosis H37Rv
gucggcgacguagacggucc

SEQ ID NO: 3287458 - RNA, 21 nt, Mycobacterium tuberculosis H37Rv
gucggcgagcagacgccgcgu

SEQ ID NO: 3287459 - RNA, 16 nt, Mycobacterium tuberculosis H37Rv
gucggcgagcgcccgc

SEQ ID NO: 3287460 - RNA, 14 nt, Mycobacterium tuberculosis H37Rv
gucggcgaucaacg

SEQ ID NO: 3287461 - RNA, 16 nt, Mycobacterium tuberculosis H37Rv
gucggcgaucugcgca

SEQ ID NO: 3287462 - RNA, 17 nt, Mycobacterium tuberculosis H37Rv
gucggcgaugcguccgc

SEQ ID NO: 3287463 - RNA, 22 nt, Mycobacterium tuberculosis H37Rv
gucggcgaugcguccgcccagc

SEQ ID NO: 3287464 - RNA, 16 nt, Mycobacterium tuberculosis H37Rv
gucggcgauggccagc

SEQ ID NO: 3287465 - RNA, 17 nt, Mycobacterium tuberculosis H37Rv
gucggcgaugucgaagc

SEQ ID NO: 3287466 - RNA, 13 nt, Mycobacterium tuberculosis H37Rv
gucggcgccgaag

SEQ ID NO: 3287467 - RNA, 20 nt, Mycobacterium tuberculosis H37Rv
gucggcgccgagcagcccgc

SEQ ID NO: 3287468 - RNA, 14 nt, Mycobacterium tuberculosis H37Rv
gucggcgccggcau

SEQ ID NO: 3287469 - RNA, 16 nt, Mycobacterium tuberculosis H37Rv
gucggcgccggcaucg

SEQ ID NO: 3287470 - RNA, 18 nt, Mycobacterium tuberculosis H37Rv
gucggcgccggcggccgc

SEQ ID NO: 3287471 - RNA, 16 nt, Mycobacterium tuberculosis H37Rv
gucggcgcgcaccucg

SEQ ID NO: 3287472 - RNA, 12 nt, Mycobacterium tuberculosis H37Rv
gucggcgcgccg

SEQ ID NO: 3287473 - RNA, 20 nt, Mycobacterium tuberculosis H37Rv
gucggcggacgcgggugcca

SEQ ID NO: 3287474 - RNA, 22 nt, Mycobacterium tuberculosis H37Rv
gucggcggccuucuccccgauc

SEQ ID NO: 3287475 - RNA, 23 nt, Mycobacterium tuberculosis H37Rv
gucggcggcuuccucgagcgaac

SEQ ID NO: 3287476 - RNA, 14 nt, Mycobacterium tuberculosis H37Rv
gucggcggcuucgu

SEQ ID NO: 3287477 - RNA, 15 nt, Mycobacterium tuberculosis H37Rv
gucggcggggcgccg

SEQ ID NO: 3287478 - RNA, 22 nt, Mycobacterium tuberculosis H37Rv
gucggcggguagaaccagcccg

SEQ ID NO: 3287479 - RNA, 14 nt, Mycobacterium tuberculosis H37Rv
gucggcggugaacg

SEQ ID NO: 3287480 - RNA, 12 nt, Mycobacterium tuberculosis H37Rv
gucggcggugac

SEQ ID NO: 3287481 - RNA, 12 nt, Mycobacterium tuberculosis H37Rv
gucggcggugcc

SEQ ID NO: 3287482 - RNA, 15 nt, Mycobacterium tuberculosis H37Rv
gucggcggugccgug

SEQ ID NO: 3287483 - RNA, 15 nt, Mycobacterium tuberculosis H37Rv
gucggcguacagcgc

SEQ ID NO: 3287484 - RNA, 22 nt, Mycobacterium tuberculosis H37Rv
gucggcguagucgcugucggca

SEQ ID NO: 3287485 - RNA, 15 nt, Mycobacterium tuberculosis H37Rv
gucggcgucauccac

SEQ ID NO: 3287486 - RNA, 20 nt, Mycobacterium tuberculosis H37Rv
gucggcgucgagcucguccu

SEQ ID NO: 3287487 - RNA, 14 nt, Mycobacterium tuberculosis H37Rv
gucggcgugcaggg

SEQ ID NO: 3287488 - RNA, 16 nt, Mycobacterium tuberculosis H37Rv
gucggcguggucgcgc

SEQ ID NO: 3287489 - RNA, 18 nt, Mycobacterium tuberculosis H37Rv
gucggcgugucgcgucgc

SEQ ID NO: 3287490 - RNA, 19 nt, Mycobacterium tuberculosis H37Rv
gucggcguuaccgaccuug

SEQ ID NO: 3287491 - RNA, 16 nt, Mycobacterium tuberculosis H37Rv
gucggcuagcaacggg

SEQ ID NO: 3287492 - RNA, 19 nt, Mycobacterium tuberculosis H37Rv
gucggcugauuggcccacc

SEQ ID NO: 3287493 - RNA, 18 nt, Mycobacterium tuberculosis H37Rv
gucggcugccgcggcugc

SEQ ID NO: 3287494 - RNA, 18 nt, Mycobacterium tuberculosis H37Rv
gucggcuggucgcugcug

SEQ ID NO: 3287495 - RNA, 13 nt, Mycobacterium tuberculosis H37Rv
gucggcugucgug

SEQ ID NO: 3287496 - RNA, 17 nt, Mycobacterium tuberculosis H37Rv
gucggcuuccuccucgg

SEQ ID NO: 3287497 - RNA, 19 nt, Mycobacterium tuberculosis H37Rv
gucggcuucgacaaccucg

SEQ ID NO: 3287498 - RNA, 23 nt, Mycobacterium tuberculosis H37Rv
gucggcuucgacaaccucgagua

SEQ ID NO: 3287499 - RNA, 22 nt, Mycobacterium tuberculosis H37Rv
gucgggaacuucuccgagaugc

SEQ ID NO: 3287500 - RNA, 14 nt, Mycobacterium tuberculosis H37Rv
gucgggacgccgcc

SEQ ID NO: 3287501 - RNA, 15 nt, Mycobacterium tuberculosis H37Rv
gucgggacggccaac

SEQ ID NO: 3287502 - RNA, 19 nt, Mycobacterium tuberculosis H37Rv
gucgggaugcccgcugauc

SEQ ID NO: 3287503 - RNA, 17 nt, Mycobacterium tuberculosis H37Rv
gucgggcacaucgcacg

SEQ ID NO: 3287504 - RNA, 19 nt, Mycobacterium tuberculosis H37Rv
gucgggcacugugagguca

SEQ ID NO: 3287505 - RNA, 18 nt, Mycobacterium tuberculosis H37Rv
gucguccgcugacccgcc

SEQ ID NO: 3287506 - RNA, 19 nt, Mycobacterium tuberculosis H37Rv
gucguccggaucggucggc

SEQ ID NO: 3287507 - RNA, 20 nt, Mycobacterium tuberculosis H37Rv
gucguccuguccgggcugca

SEQ ID NO: 3287508 - RNA, 22 nt, Mycobacterium tuberculosis H37Rv
gucgucgaaauggauugcggca

SEQ ID NO: 3287509 - RNA, 16 nt, Mycobacterium tuberculosis H37Rv
gucgucgaccaccuga

SEQ ID NO: 3287510 - RNA, 14 nt, Mycobacterium tuberculosis H37Rv
gucgucgaccaggc

SEQ ID NO: 3287511 - RNA, 20 nt, Mycobacterium tuberculosis H37Rv
gucgucgaccaggccacugc

SEQ ID NO: 3287512 - RNA, 14 nt, Mycobacterium tuberculosis H37Rv
gucgucgagcgcgc

SEQ ID NO: 3287513 - RNA, 13 nt, Mycobacterium tuberculosis H37Rv
gucgucgagcuga

SEQ ID NO: 3287514 - RNA, 14 nt, Mycobacterium tuberculosis H37Rv
gucgucgaggucac

SEQ ID NO: 3287515 - RNA, 21 nt, Mycobacterium tuberculosis H37Rv
gucgucgagguccucgagguc

SEQ ID NO: 3287516 - RNA, 18 nt, Mycobacterium tuberculosis H37Rv
gucgucgagucgacaagc

SEQ ID NO: 3287517 - RNA, 15 nt, Mycobacterium tuberculosis H37Rv
gucgucgaguuggcc

SEQ ID NO: 3287518 - RNA, 13 nt, Mycobacterium tuberculosis H37Rv
gucgucgaucgac

SEQ ID NO: 3287519 - RNA, 16 nt, Mycobacterium tuberculosis H37Rv
gucgucgauuagccca

SEQ ID NO: 3287520 - RNA, 23 nt, Mycobacterium tuberculosis H37Rv
gucgucgauuagcccacccaugg

SEQ ID NO: 3287521 - RNA, 23 nt, Mycobacterium tuberculosis H37Rv
gucgucgccaaucgaguagcuga

SEQ ID NO: 3287522 - RNA, 14 nt, Mycobacterium tuberculosis H37Rv
gucgucgccgccgg

SEQ ID NO: 3287523 - RNA, 16 nt, Mycobacterium tuberculosis H37Rv
gucgucgccggcgcuc

SEQ ID NO: 3287524 - RNA, 14 nt, Mycobacterium tuberculosis H37Rv
gucgucgcugagca

SEQ ID NO: 3287525 - RNA, 17 nt, Mycobacterium tuberculosis H37Rv
gucgucgcuugcugggu

SEQ ID NO: 3287526 - RNA, 17 nt, Mycobacterium tuberculosis H37Rv
gucgucggacucguccu

SEQ ID NO: 3287527 - RNA, 19 nt, Mycobacterium tuberculosis H37Rv
gucgucggacucguccuuc

SEQ ID NO: 3287528 - RNA, 13 nt, Mycobacterium tuberculosis H37Rv
gucgucggccauc

SEQ ID NO: 3287529 - RNA, 13 nt, Mycobacterium tuberculosis H37Rv
gucgucggcggcg

SEQ ID NO: 3287530 - RNA, 16 nt, Mycobacterium tuberculosis H37Rv
gucgucggcggcgaac

SEQ ID NO: 3287531 - RNA, 18 nt, Mycobacterium tuberculosis H37Rv
gucgucgguaaugccggg

SEQ ID NO: 3287532 - RNA, 18 nt, Mycobacterium tuberculosis H37Rv
gucgucggugcgccacga

SEQ ID NO: 3287533 - RNA, 17 nt, Mycobacterium tuberculosis H37Rv
gucgucguacggcucau

SEQ ID NO: 3287534 - RNA, 12 nt, Mycobacterium tuberculosis H37Rv
gucgucguccuc

SEQ ID NO: 3287535 - RNA, 14 nt, Mycobacterium tuberculosis H37Rv
gucgucgugguagc

SEQ ID NO: 3287536 - RNA, 21 nt, Mycobacterium tuberculosis H37Rv
gucgucguguuggccgggucg

SEQ ID NO: 3287537 - RNA, 21 nt, Mycobacterium tuberculosis H37Rv
gucgucguugugugccagcgu

SEQ ID NO: 3287538 - RNA, 21 nt, Mycobacterium tuberculosis H37Rv
gucgucguuucgccagccggc

SEQ ID NO: 3287539 - RNA, 15 nt, Mycobacterium tuberculosis H37Rv
gucgucuuggcgauc

SEQ ID NO: 3287540 - RNA, 17 nt, Mycobacterium tuberculosis H37Rv
gucgucuugguugugga

SEQ ID NO: 3287541 - RNA, 20 nt, Mycobacterium tuberculosis H37Rv
gucgugaggaaccccggucg

SEQ ID NO: 3287542 - RNA, 14 nt, Mycobacterium tuberculosis H37Rv
gucgugaucagcag

SEQ ID NO: 3287543 - RNA, 19 nt, Mycobacterium tuberculosis H37Rv
gucgugaucuucugccuug

SEQ ID NO: 3287544 - RNA, 15 nt, Mycobacterium tuberculosis H37Rv
gucgugcacggcggc

SEQ ID NO: 3287545 - RNA, 16 nt, Mycobacterium tuberculosis H37Rv
gucgugcacggcggcc

SEQ ID NO: 3287546 - RNA, 21 nt, Mycobacterium tuberculosis H37Rv
gucgugccggggcugccgaac

SEQ ID NO: 3287547 - RNA, 22 nt, Mycobacterium tuberculosis H37Rv
gucgugcgauucacacucgggc

SEQ ID NO: 3287548 - RNA, 18 nt, Mycobacterium tuberculosis H37Rv
gucgugcggggguggucu

SEQ ID NO: 3287549 - RNA, 20 nt, Mycobacterium tuberculosis H37Rv
gucguggauccagccaugcg

SEQ ID NO: 3287550 - RNA, 16 nt, Mycobacterium tuberculosis H37Rv
gucguggggacuggca

SEQ ID NO: 3287551 - RNA, 17 nt, Mycobacterium tuberculosis H37Rv
gucguggggacuggcag

SEQ ID NO: 3287552 - RNA, 12 nt, Mycobacterium tuberculosis H37Rv
gucguggucgau

SEQ ID NO: 3287553 - RNA, 16 nt, Mycobacterium tuberculosis H37Rv
gucgugguggccacgg

SEQ ID NO: 3287554 - RNA, 14 nt, Mycobacterium tuberculosis H37Rv
gucguguaggaccu

SEQ ID NO: 3287555 - RNA, 20 nt, Mycobacterium tuberculosis H37Rv
gucgugucgccacaccgggg

SEQ ID NO: 3287556 - RNA, 17 nt, Mycobacterium tuberculosis H37Rv
gucguugaggaagcccg

SEQ ID NO: 3287557 - RNA, 18 nt, Mycobacterium tuberculosis H37Rv
gucguugaggaagcccga

SEQ ID NO: 3287558 - RNA, 22 nt, Mycobacterium tuberculosis H37Rv
gucguugccagggcgggcgucg

SEQ ID NO: 3287559 - RNA, 14 nt, Mycobacterium tuberculosis H37Rv
gucguugcccgcga

SEQ ID NO: 3287560 - RNA, 17 nt, Mycobacterium tuberculosis H37Rv
gucguugccgcggucgg

SEQ ID NO: 3287561 - RNA, 13 nt, Mycobacterium tuberculosis H37Rv
gucguugccggac

SEQ ID NO: 3287562 - RNA, 19 nt, Mycobacterium tuberculosis H37Rv
gucguugccggacaaccug

SEQ ID NO: 3287563 - RNA, 14 nt, Mycobacterium tuberculosis H37Rv
gucguuggacggca

SEQ ID NO: 3287564 - RNA, 17 nt, Mycobacterium tuberculosis H37Rv
gucguuguuagugacgu

SEQ ID NO: 3287565 - RNA, 18 nt, Mycobacterium tuberculosis H37Rv
gucguuuggcgccgccga

SEQ ID NO: 3287566 - RNA, 17 nt, Mycobacterium tuberculosis H37Rv
gucuaaggaugaccuuc

SEQ ID NO: 3287567 - RNA, 13 nt, Mycobacterium tuberculosis H37Rv
gucuaaugagguc

SEQ ID NO: 3287568 - RNA, 21 nt, Mycobacterium tuberculosis H37Rv
gucuacgacgucgcuguaggc

SEQ ID NO: 3287569 - RNA, 16 nt, Mycobacterium tuberculosis H37Rv
gucuacgccgggaauu

SEQ ID NO: 3287570 - RNA, 18 nt, Mycobacterium tuberculosis H37Rv
gucuagcugguggugcgg

SEQ ID NO: 3287571 - RNA, 18 nt, Mycobacterium tuberculosis H37Rv
gucuaggccaaaccccug

SEQ ID NO: 3287572 - RNA, 21 nt, Mycobacterium tuberculosis H37Rv
gucucacguugugagccacgc

SEQ ID NO: 3287573 - RNA, 17 nt, Mycobacterium tuberculosis H37Rv
gucucagugcucgccca

SEQ ID NO: 3287574 - RNA, 20 nt, Mycobacterium tuberculosis H37Rv
gucuccaccgcgaugacgac

SEQ ID NO: 3287575 - RNA, 22 nt, Mycobacterium tuberculosis H37Rv
gucuccagcaccaaaaggauca

SEQ ID NO: 3287576 - RNA, 16 nt, Mycobacterium tuberculosis H37Rv
gucuccagcuggguga

SEQ ID NO: 3287577 - RNA, 21 nt, Mycobacterium tuberculosis H37Rv
gucucccagaggucgagcgcc

SEQ ID NO: 3287578 - RNA, 20 nt, Mycobacterium tuberculosis H37Rv
gucucccuugccgccauucc

SEQ ID NO: 3287579 - RNA, 23 nt, Mycobacterium tuberculosis H37Rv
gucuccgcccgcgggccccaucg

SEQ ID NO: 3287580 - RNA, 19 nt, Mycobacterium tuberculosis H37Rv
gucuccgcugaugagccgc

SEQ ID NO: 3287581 - RNA, 12 nt, Mycobacterium tuberculosis H37Rv
gucuccggcaag

SEQ ID NO: 3287582 - RNA, 18 nt, Mycobacterium tuberculosis H37Rv
gucuccggcaccgagucu

SEQ ID NO: 3287583 - RNA, 19 nt, Mycobacterium tuberculosis H37Rv
gucuccggcaccgagucua

SEQ ID NO: 3287584 - RNA, 22 nt, Mycobacterium tuberculosis H37Rv
gucuccggcgccaccgccgcug

SEQ ID NO: 3287585 - RNA, 21 nt, Mycobacterium tuberculosis H37Rv
gucuccucgaauucgcgcucu

SEQ ID NO: 3287586 - RNA, 18 nt, Mycobacterium tuberculosis H37Rv
gucuccucggucaccgag

SEQ ID NO: 3287587 - RNA, 21 nt, Mycobacterium tuberculosis H37Rv
gucuccuucggcgacugcgca

SEQ ID NO: 3287588 - RNA, 22 nt, Mycobacterium tuberculosis H37Rv
gucuccuugagcuucucgucgg

SEQ ID NO: 3287589 - RNA, 16 nt, Mycobacterium tuberculosis H37Rv
gucucgaacuccaugc

SEQ ID NO: 3287590 - RNA, 18 nt, Mycobacterium tuberculosis H37Rv
gucucgacaaagcggcug

SEQ ID NO: 3287591 - RNA, 20 nt, Mycobacterium tuberculosis H37Rv
gucucgacaaagcggcugcc

SEQ ID NO: 3287592 - RNA, 16 nt, Mycobacterium tuberculosis H37Rv
gucucgacacugcagu

SEQ ID NO: 3287593 - RNA, 15 nt, Mycobacterium tuberculosis H37Rv
gucucgacggcggcc

SEQ ID NO: 3287594 - RNA, 16 nt, Mycobacterium tuberculosis H37Rv
gucucgcaugcucacg

SEQ ID NO: 3287595 - RNA, 21 nt, Mycobacterium tuberculosis H37Rv
gucucgcgagcguuucaccag

SEQ ID NO: 3287596 - RNA, 14 nt, Mycobacterium tuberculosis H37Rv
gucucgcggugcgg

SEQ ID NO: 3287597 - RNA, 23 nt, Mycobacterium tuberculosis H37Rv
gucucgcggugcggcaacagcgc

SEQ ID NO: 3287598 - RNA, 12 nt, Mycobacterium tuberculosis H37Rv
gucucggcaugc

SEQ ID NO: 3287599 - RNA, 13 nt, Mycobacterium tuberculosis H37Rv
gucucggcgaccg

SEQ ID NO: 3287600 - RNA, 17 nt, Mycobacterium tuberculosis H37Rv
gucucggcgaccgacgc

SEQ ID NO: 3287601 - RNA, 22 nt, Mycobacterium tuberculosis H37Rv
gugaggaucagcgugucgccga

SEQ ID NO: 3287602 - RNA, 16 nt, Mycobacterium tuberculosis H37Rv
gugaggccccccgcgc

SEQ ID NO: 3287603 - RNA, 18 nt, Mycobacterium tuberculosis H37Rv
gugaggccgaccagcaca

SEQ ID NO: 3287604 - RNA, 16 nt, Mycobacterium tuberculosis H37Rv
gugaggccuucgccga

SEQ ID NO: 3287605 - RNA, 17 nt, Mycobacterium tuberculosis H37Rv
gugaggucgaucagcgg

SEQ ID NO: 3287606 - RNA, 20 nt, Mycobacterium tuberculosis H37Rv
gugaggucgaucagcggcga

SEQ ID NO: 3287607 - RNA, 14 nt, Mycobacterium tuberculosis H37Rv
gugagguggucagc

SEQ ID NO: 3287608 - RNA, 20 nt, Mycobacterium tuberculosis H37Rv
gugaguaccaauccaggcca

SEQ ID NO: 3287609 - RNA, 22 nt, Mycobacterium tuberculosis H37Rv
gugaguacggugugcgugcggu

SEQ ID NO: 3287610 - RNA, 15 nt, Mycobacterium tuberculosis H37Rv
gugagucacccggcc

SEQ ID NO: 3287611 - RNA, 14 nt, Mycobacterium tuberculosis H37Rv
gugagucccacgcc

SEQ ID NO: 3287612 - RNA, 14 nt, Mycobacterium tuberculosis H37Rv
gugagugaaucgcg

SEQ ID NO: 3287613 - RNA, 13 nt, Mycobacterium tuberculosis H37Rv
gugagugaccacg

SEQ ID NO: 3287614 - RNA, 12 nt, Mycobacterium tuberculosis H37Rv
gugagugccggc

SEQ ID NO: 3287615 - RNA, 18 nt, Mycobacterium tuberculosis H37Rv
gugaguuccaugugcgau

SEQ ID NO: 3287616 - RNA, 23 nt, Mycobacterium tuberculosis H37Rv
gugauauccgugaauggcagcac

SEQ ID NO: 3287617 - RNA, 18 nt, Mycobacterium tuberculosis H37Rv
gugaucaaaccggccuua

SEQ ID NO: 3287618 - RNA, 16 nt, Mycobacterium tuberculosis H37Rv
gugaucacccgcaucg

SEQ ID NO: 3287619 - RNA, 16 nt, Mycobacterium tuberculosis H37Rv
gugaucaccgaugagc

SEQ ID NO: 3287620 - RNA, 14 nt, Mycobacterium tuberculosis H37Rv
gugaucacggucgg

SEQ ID NO: 3287621 - RNA, 13 nt, Mycobacterium tuberculosis H37Rv
gugaucagcagca

SEQ ID NO: 3287622 - RNA, 13 nt, Mycobacterium tuberculosis H37Rv
gugaucagcagga

SEQ ID NO: 3287623 - RNA, 19 nt, Mycobacterium tuberculosis H37Rv
gugaucagcaggacgauga

SEQ ID NO: 3287624 - RNA, 21 nt, Mycobacterium tuberculosis H37Rv
gugaucagcaggaucggcagc

SEQ ID NO: 3287625 - RNA, 13 nt, Mycobacterium tuberculosis H37Rv
gugauccgacagu

SEQ ID NO: 3287626 - RNA, 17 nt, Mycobacterium tuberculosis H37Rv
gugauccgagaccaugc

SEQ ID NO: 3287627 - RNA, 15 nt, Mycobacterium tuberculosis H37Rv
gugaucgagucgcga

SEQ ID NO: 3287628 - RNA, 21 nt, Mycobacterium tuberculosis H37Rv
gugaucgauccggcuccaccc

SEQ ID NO: 3287629 - RNA, 22 nt, Mycobacterium tuberculosis H37Rv
gugaucgaucgcggcgcccagg

SEQ ID NO: 3287630 - RNA, 12 nt, Mycobacterium tuberculosis H37Rv
gugaucgcacag

SEQ ID NO: 3287631 - RNA, 22 nt, Mycobacterium tuberculosis H37Rv
gugaucgcauuggcggcggucc

SEQ ID NO: 3287632 - RNA, 14 nt, Mycobacterium tuberculosis H37Rv
gugaucgcggucga

SEQ ID NO: 3287633 - RNA, 18 nt, Mycobacterium tuberculosis H37Rv
gugaucgcggucgacagc

SEQ ID NO: 3287634 - RNA, 17 nt, Mycobacterium tuberculosis H37Rv
gugaucgcgguggcuuc

SEQ ID NO: 3287635 - RNA, 17 nt, Mycobacterium tuberculosis H37Rv
gugaucggcgucaggca

SEQ ID NO: 3287636 - RNA, 23 nt, Mycobacterium tuberculosis H37Rv
gugaucggguacccaucugcuca

SEQ ID NO: 3287637 - RNA, 17 nt, Mycobacterium tuberculosis H37Rv
gugaucgugaccggcaa

SEQ ID NO: 3287638 - RNA, 19 nt, Mycobacterium tuberculosis H37Rv
gugaucugguccggcaaca

SEQ ID NO: 3287639 - RNA, 15 nt, Mycobacterium tuberculosis H37Rv
gugaucuucggcgau

SEQ ID NO: 3287640 - RNA, 14 nt, Mycobacterium tuberculosis H37Rv
gugaucuugccggc

SEQ ID NO: 3287641 - RNA, 14 nt, Mycobacterium tuberculosis H37Rv
gugaugaacaccgg

SEQ ID NO: 3287642 - RNA, 20 nt, Mycobacterium tuberculosis H37Rv
gugaugaauucgcuugcagc

SEQ ID NO: 3287643 - RNA, 21 nt, Mycobacterium tuberculosis H37Rv
gugaugaccgcguagagcagc

SEQ ID NO: 3287644 - RNA, 18 nt, Mycobacterium tuberculosis H37Rv
gugaugccacggcgucgc

SEQ ID NO: 3287645 - RNA, 17 nt, Mycobacterium tuberculosis H37Rv
gugaugcgggcucggcu

SEQ ID NO: 3287646 - RNA, 19 nt, Mycobacterium tuberculosis H37Rv
gugauggcgcggucgcuga

SEQ ID NO: 3287647 - RNA, 19 nt, Mycobacterium tuberculosis H37Rv
gugaugggggagccgguga

SEQ ID NO: 3287648 - RNA, 22 nt, Mycobacterium tuberculosis H37Rv
gugaugggggagccggugacgg

SEQ ID NO: 3287649 - RNA, 16 nt, Mycobacterium tuberculosis H37Rv
gugauggucaccgucu

SEQ ID NO: 3287650 - RNA, 17 nt, Mycobacterium tuberculosis H37Rv
gugauggugaccagcag

SEQ ID NO: 3287651 - RNA, 15 nt, Mycobacterium tuberculosis H37Rv
gugauggugugcagc

SEQ ID NO: 3287652 - RNA, 19 nt, Mycobacterium tuberculosis H37Rv
gugauggugugcagcagca

SEQ ID NO: 3287653 - RNA, 13 nt, Mycobacterium tuberculosis H37Rv
gugauguagcugc

SEQ ID NO: 3287654 - RNA, 23 nt, Mycobacterium tuberculosis H37Rv
gugaugucuaccaacaccgcccg

SEQ ID NO: 3287655 - RNA, 15 nt, Mycobacterium tuberculosis H37Rv
gugauucgcgcagcg

SEQ ID NO: 3287656 - RNA, 13 nt, Mycobacterium tuberculosis H37Rv
gugauucggcgac

SEQ ID NO: 3287657 - RNA, 22 nt, Mycobacterium tuberculosis H37Rv
gugauugacggugcgauaccga

SEQ ID NO: 3287658 - RNA, 16 nt, Mycobacterium tuberculosis H37Rv
gugauugagcucaggu

SEQ ID NO: 3287659 - RNA, 19 nt, Mycobacterium tuberculosis H37Rv
gugauugcgcgggcaucgu

SEQ ID NO: 3287660 - RNA, 22 nt, Mycobacterium tuberculosis H37Rv
gugcaacacgccggcccgguga

SEQ ID NO: 3287661 - RNA, 17 nt, Mycobacterium tuberculosis H37Rv
gugcaaccacggcggca

SEQ ID NO: 3287662 - RNA, 18 nt, Mycobacterium tuberculosis H37Rv
gugcaaccacggcggcau

SEQ ID NO: 3287663 - RNA, 17 nt, Mycobacterium tuberculosis H37Rv
gugcaaccauggcggcu

SEQ ID NO: 3287664 - RNA, 21 nt, Mycobacterium tuberculosis H37Rv
gugcaaccauggcggcuccgc

SEQ ID NO: 3287665 - RNA, 23 nt, Mycobacterium tuberculosis H37Rv
gugcaaccccaaguccagcagcg

SEQ ID NO: 3287666 - RNA, 14 nt, Mycobacterium tuberculosis H37Rv
gugcaacggcguug

SEQ ID NO: 3287667 - RNA, 22 nt, Mycobacterium tuberculosis H37Rv
gugcaacggcguuggcgccguu

SEQ ID NO: 3287668 - RNA, 20 nt, Mycobacterium tuberculosis H37Rv
gugcaagccgaacaccguca

SEQ ID NO: 3287669 - RNA, 20 nt, Mycobacterium tuberculosis H37Rv
gugcaaugcuuccagcauca

SEQ ID NO: 3287670 - RNA, 13 nt, Mycobacterium tuberculosis H37Rv
gugcacaccgucg

SEQ ID NO: 3287671 - RNA, 21 nt, Mycobacterium tuberculosis H37Rv
gugcacacugguggugcccgg

SEQ ID NO: 3287672 - RNA, 22 nt, Mycobacterium tuberculosis H37Rv
gugcacagacacggcagcugca

SEQ ID NO: 3287673 - RNA, 14 nt, Mycobacterium tuberculosis H37Rv
gugcacagcaguga

SEQ ID NO: 3287674 - RNA, 18 nt, Mycobacterium tuberculosis H37Rv
gugcaccacauuggcgau

SEQ ID NO: 3287675 - RNA, 13 nt, Mycobacterium tuberculosis H37Rv
gugcaccagcuca

SEQ ID NO: 3287676 - RNA, 12 nt, Mycobacterium tuberculosis H37Rv
gugcaccaggua

SEQ ID NO: 3287677 - RNA, 16 nt, Mycobacterium tuberculosis H37Rv
gugcaccgcgaccgcg

SEQ ID NO: 3287678 - RNA, 22 nt, Mycobacterium tuberculosis H37Rv
gugcaccgcgucguagccacgc

SEQ ID NO: 3287679 - RNA, 13 nt, Mycobacterium tuberculosis H37Rv
gugcaccgucggg

SEQ ID NO: 3287680 - RNA, 20 nt, Mycobacterium tuberculosis H37Rv
gugcaccuccagguagucgc

SEQ ID NO: 3287681 - RNA, 18 nt, Mycobacterium tuberculosis H37Rv
gugcaccucguguccggg

SEQ ID NO: 3287682 - RNA, 17 nt, Mycobacterium tuberculosis H37Rv
gugcacgaucgcgguga

SEQ ID NO: 3287683 - RNA, 13 nt, Mycobacterium tuberculosis H37Rv
gugcacgcgggcg

SEQ ID NO: 3287684 - RNA, 14 nt, Mycobacterium tuberculosis H37Rv
gugcacgcgggcgu

SEQ ID NO: 3287685 - RNA, 14 nt, Mycobacterium tuberculosis H37Rv
gugcacggcggcca

SEQ ID NO: 3287686 - RNA, 19 nt, Mycobacterium tuberculosis H37Rv
gugcacggcuucggcgagc

SEQ ID NO: 3287687 - RNA, 20 nt, Mycobacterium tuberculosis H37Rv
gugcacggcuuuucgacgcu

SEQ ID NO: 3287688 - RNA, 23 nt, Mycobacterium tuberculosis H37Rv
gugcacggcuuuucgacgcugug

SEQ ID NO: 3287689 - RNA, 22 nt, Mycobacterium tuberculosis H37Rv
gugcacuacaggguuggcagca

SEQ ID NO: 3287690 - RNA, 23 nt, Mycobacterium tuberculosis H37Rv
gugcacuacaggguuggcagcaa

SEQ ID NO: 3287691 - RNA, 14 nt, Mycobacterium tuberculosis H37Rv
gugcacugaccgcg

SEQ ID NO: 3287692 - RNA, 13 nt, Mycobacterium tuberculosis H37Rv
gugcacugccggg

SEQ ID NO: 3287693 - RNA, 22 nt, Mycobacterium tuberculosis H37Rv
gugcagaagacaagugguggua

SEQ ID NO: 3287694 - RNA, 13 nt, Mycobacterium tuberculosis H37Rv
gugcagacaggcg

SEQ ID NO: 3287695 - RNA, 17 nt, Mycobacterium tuberculosis H37Rv
gugcagacaggcggcgg

SEQ ID NO: 3287696 - RNA, 21 nt, Mycobacterium tuberculosis H37Rv
gugcagacaggcggcggccug

SEQ ID NO: 3287697 - RNA, 12 nt, Mycobacterium tuberculosis H37Rv
gugccgaccagc

SEQ ID NO: 3287698 - RNA, 15 nt, Mycobacterium tuberculosis H37Rv
gugccgacccgccgc

SEQ ID NO: 3287699 - RNA, 15 nt, Mycobacterium tuberculosis H37Rv
gugccgacgccccga

SEQ ID NO: 3287700 - RNA, 21 nt, Mycobacterium tuberculosis H37Rv
gugccgacgccccgaucggcc

SEQ ID NO: 3287701 - RNA, 14 nt, Mycobacterium tuberculosis H37Rv
gugccgacggugau

SEQ ID NO: 3287702 - RNA, 13 nt, Mycobacterium tuberculosis H37Rv
gugccgacgucgg

SEQ ID NO: 3287703 - RNA, 15 nt, Mycobacterium tuberculosis H37Rv
gugccgagaucccag

SEQ ID NO: 3287704 - RNA, 17 nt, Mycobacterium tuberculosis H37Rv
gugccgagaucccagcg

SEQ ID NO: 3287705 - RNA, 22 nt, Mycobacterium tuberculosis H37Rv
gugccgagcgugcgcugguggc

SEQ ID NO: 3287706 - RNA, 14 nt, Mycobacterium tuberculosis H37Rv
gugccgagcuggcg

SEQ ID NO: 3287707 - RNA, 16 nt, Mycobacterium tuberculosis H37Rv
gugccgagcuggcgac

SEQ ID NO: 3287708 - RNA, 20 nt, Mycobacterium tuberculosis H37Rv
gugccgagcuugucgagcag

SEQ ID NO: 3287709 - RNA, 14 nt, Mycobacterium tuberculosis H37Rv
gugccgaucgaugc

SEQ ID NO: 3287710 - RNA, 22 nt, Mycobacterium tuberculosis H37Rv
gugccgaugccggcgagggcca

SEQ ID NO: 3287711 - RNA, 12 nt, Mycobacterium tuberculosis H37Rv
gugccgcaaccg

SEQ ID NO: 3287712 - RNA, 23 nt, Mycobacterium tuberculosis H37Rv
gugccgcacagcggauucggcgu

SEQ ID NO: 3287713 - RNA, 15 nt, Mycobacterium tuberculosis H37Rv
gugccgccaccaccg

SEQ ID NO: 3287714 - RNA, 13 nt, Mycobacterium tuberculosis H37Rv
gugccgccagcaa

SEQ ID NO: 3287715 - RNA, 20 nt, Mycobacterium tuberculosis H37Rv
gugccgccauugacgccguu

SEQ ID NO: 3287716 - RNA, 20 nt, Mycobacterium tuberculosis H37Rv
gugccgcccaccacacagcc

SEQ ID NO: 3287717 - RNA, 15 nt, Mycobacterium tuberculosis H37Rv
gugccgcccaggagc

SEQ ID NO: 3287718 - RNA, 16 nt, Mycobacterium tuberculosis H37Rv
gugccgcccaggagca

SEQ ID NO: 3287719 - RNA, 20 nt, Mycobacterium tuberculosis H37Rv
gugccgcccgccucugucuu

SEQ ID NO: 3287720 - RNA, 20 nt, Mycobacterium tuberculosis H37Rv
gugccgcccgcgccgccgcu

SEQ ID NO: 3287721 - RNA, 21 nt, Mycobacterium tuberculosis H37Rv
gugccgcccgcgccgccgcua

SEQ ID NO: 3287722 - RNA, 17 nt, Mycobacterium tuberculosis H37Rv
gugccgcccgcgccucc

SEQ ID NO: 3287723 - RNA, 19 nt, Mycobacterium tuberculosis H37Rv
gugccgccgauaccgccgg

SEQ ID NO: 3287724 - RNA, 12 nt, Mycobacterium tuberculosis H37Rv
gugccgccgaug

SEQ ID NO: 3287725 - RNA, 14 nt, Mycobacterium tuberculosis H37Rv
gugccgccgccggc

SEQ ID NO: 3287726 - RNA, 23 nt, Mycobacterium tuberculosis H37Rv
gugccgccggaaucgagacggua

SEQ ID NO: 3287727 - RNA, 14 nt, Mycobacterium tuberculosis H37Rv
gugccgccggccag

SEQ ID NO: 3287728 - RNA, 20 nt, Mycobacterium tuberculosis H37Rv
gugccgccggugccgccugc

SEQ ID NO: 3287729 - RNA, 14 nt, Mycobacterium tuberculosis H37Rv
gugccgccgucgau

SEQ ID NO: 3287730 - RNA, 18 nt, Mycobacterium tuberculosis H37Rv
gugccgccgucgccgcca

SEQ ID NO: 3287731 - RNA, 22 nt, Mycobacterium tuberculosis H37Rv
gugccgccugcgccgccagcgc

SEQ ID NO: 3287732 - RNA, 23 nt, Mycobacterium tuberculosis H37Rv
gugccgccugcgccgccagcgcc

SEQ ID NO: 3287733 - RNA, 13 nt, Mycobacterium tuberculosis H37Rv
gugccgcgcagcu

SEQ ID NO: 3287734 - RNA, 17 nt, Mycobacterium tuberculosis H37Rv
gugccgcggccaccgcc

SEQ ID NO: 3287735 - RNA, 19 nt, Mycobacterium tuberculosis H37Rv
gugccgcgguaggugcaug

SEQ ID NO: 3287736 - RNA, 16 nt, Mycobacterium tuberculosis H37Rv
gugccgcggucccguc

SEQ ID NO: 3287737 - RNA, 19 nt, Mycobacterium tuberculosis H37Rv
gugccgcgucggccgcgcu

SEQ ID NO: 3287738 - RNA, 16 nt, Mycobacterium tuberculosis H37Rv
gugccgcuagcggauu

SEQ ID NO: 3287739 - RNA, 21 nt, Mycobacterium tuberculosis H37Rv
gugccgcugcauccgcagcac

SEQ ID NO: 3287740 - RNA, 14 nt, Mycobacterium tuberculosis H37Rv
gugccggaaacgcc

SEQ ID NO: 3287741 - RNA, 11 nt, Mycobacterium tuberculosis H37Rv
gugccggcaua

SEQ ID NO: 3287742 - RNA, 17 nt, Mycobacterium tuberculosis H37Rv
gugccggccaucgcccg

SEQ ID NO: 3287743 - RNA, 20 nt, Mycobacterium tuberculosis H37Rv
gugccggcccugcucggcca

SEQ ID NO: 3287744 - RNA, 20 nt, Mycobacterium tuberculosis H37Rv
gugccggccgcacaugagcu

SEQ ID NO: 3287745 - RNA, 14 nt, Mycobacterium tuberculosis H37Rv
gugccggcgacgcu

SEQ ID NO: 3287746 - RNA, 15 nt, Mycobacterium tuberculosis H37Rv
gugccggcgccgcca

SEQ ID NO: 3287747 - RNA, 17 nt, Mycobacterium tuberculosis H37Rv
gugccggcgccgcccuu

SEQ ID NO: 3287748 - RNA, 20 nt, Mycobacterium tuberculosis H37Rv
gugccggcgguguuggcgcc

SEQ ID NO: 3287749 - RNA, 14 nt, Mycobacterium tuberculosis H37Rv
gugccggcgugcgc

SEQ ID NO: 3287750 - RNA, 20 nt, Mycobacterium tuberculosis H37Rv
gugccggcguugccgccguu

SEQ ID NO: 3287751 - RNA, 21 nt, Mycobacterium tuberculosis H37Rv
gugccgggaucgccguccagc

SEQ ID NO: 3287752 - RNA, 15 nt, Mycobacterium tuberculosis H37Rv
gugccgggcaccacc

SEQ ID NO: 3287753 - RNA, 20 nt, Mycobacterium tuberculosis H37Rv
gugccgggccauucaccgcg

SEQ ID NO: 3287754 - RNA, 19 nt, Mycobacterium tuberculosis H37Rv
gugccgggcgaugcugggc

SEQ ID NO: 3287755 - RNA, 15 nt, Mycobacterium tuberculosis H37Rv
gugccggggcugccg

SEQ ID NO: 3287756 - RNA, 19 nt, Mycobacterium tuberculosis H37Rv
gugccggggcugccgccgu

SEQ ID NO: 3287757 - RNA, 17 nt, Mycobacterium tuberculosis H37Rv
gugccgggguggcgcgc

SEQ ID NO: 3287758 - RNA, 23 nt, Mycobacterium tuberculosis H37Rv
gugccgguaugcgccaucucgac

SEQ ID NO: 3287759 - RNA, 22 nt, Mycobacterium tuberculosis H37Rv
gugccggugauggccgaccagc

SEQ ID NO: 3287760 - RNA, 14 nt, Mycobacterium tuberculosis H37Rv
gugccgguggcgcc

SEQ ID NO: 3287761 - RNA, 21 nt, Mycobacterium tuberculosis H37Rv
gugccgguuuggccgaacagc

SEQ ID NO: 3287762 - RNA, 21 nt, Mycobacterium tuberculosis H37Rv
gugccgucggcgugcagcagc

SEQ ID NO: 3287763 - RNA, 22 nt, Mycobacterium tuberculosis H37Rv
gugccgucggcgugcagcagcu

SEQ ID NO: 3287764 - RNA, 17 nt, Mycobacterium tuberculosis H37Rv
gugccgucggugccgcg

SEQ ID NO: 3287765 - RNA, 13 nt, Mycobacterium tuberculosis H37Rv
gugccguggucga

SEQ ID NO: 3287766 - RNA, 17 nt, Mycobacterium tuberculosis H37Rv
gugccguguccagcaug

SEQ ID NO: 3287767 - RNA, 18 nt, Mycobacterium tuberculosis H37Rv
gugccguguccagcaugc

SEQ ID NO: 3287768 - RNA, 21 nt, Mycobacterium tuberculosis H37Rv
gugccucggcgaugggccggu

SEQ ID NO: 3287769 - RNA, 17 nt, Mycobacterium tuberculosis H37Rv
gugccugcaguucggcg

SEQ ID NO: 3287770 - RNA, 16 nt, Mycobacterium tuberculosis H37Rv
gugccugcggguggau

SEQ ID NO: 3287771 - RNA, 17 nt, Mycobacterium tuberculosis H37Rv
gugccugcuuggccacu

SEQ ID NO: 3287772 - RNA, 13 nt, Mycobacterium tuberculosis H37Rv
gugccuggccggu

SEQ ID NO: 3287773 - RNA, 22 nt, Mycobacterium tuberculosis H37Rv
gugccuggccggugcgcaggua

SEQ ID NO: 3287774 - RNA, 21 nt, Mycobacterium tuberculosis H37Rv
gugccugucagaaggaucagc

SEQ ID NO: 3287775 - RNA, 17 nt, Mycobacterium tuberculosis H37Rv
gugccuucaccgccguu

SEQ ID NO: 3287776 - RNA, 18 nt, Mycobacterium tuberculosis H37Rv
gugccuucaccgccguuc

SEQ ID NO: 3287777 - RNA, 18 nt, Mycobacterium tuberculosis H37Rv
gugccuuccucggcaagu

SEQ ID NO: 3287778 - RNA, 21 nt, Mycobacterium tuberculosis H37Rv
gugccuugaucugagcgcggg

SEQ ID NO: 3287779 - RNA, 16 nt, Mycobacterium tuberculosis H37Rv
gugcgaaaaucgcgcg

SEQ ID NO: 3287780 - RNA, 12 nt, Mycobacterium tuberculosis H37Rv
gugcgacaucgg

SEQ ID NO: 3287781 - RNA, 19 nt, Mycobacterium tuberculosis H37Rv
gugcgacucugcgucugcu

SEQ ID NO: 3287782 - RNA, 17 nt, Mycobacterium tuberculosis H37Rv
gugcgagcgacaccgua

SEQ ID NO: 3287783 - RNA, 15 nt, Mycobacterium tuberculosis H37Rv
gugcgagggcacggc

SEQ ID NO: 3287784 - RNA, 19 nt, Mycobacterium tuberculosis H37Rv
gugcgauccagggccgacg

SEQ ID NO: 3287785 - RNA, 16 nt, Mycobacterium tuberculosis H37Rv
gugcgauccccaacac

SEQ ID NO: 3287786 - RNA, 20 nt, Mycobacterium tuberculosis H37Rv
gugcgauuccgcgucugcuc

SEQ ID NO: 3287787 - RNA, 19 nt, Mycobacterium tuberculosis H37Rv
gugcgauucugcgucugcu

SEQ ID NO: 3287788 - RNA, 20 nt, Mycobacterium tuberculosis H37Rv
gugcgauucugcgucugcuc

SEQ ID NO: 3287789 - RNA, 19 nt, Mycobacterium tuberculosis H37Rv
gugcgauucugugucugcu

SEQ ID NO: 3287790 - RNA, 20 nt, Mycobacterium tuberculosis H37Rv
gugcgauucugugucugcuc

SEQ ID NO: 3287791 - RNA, 20 nt, Mycobacterium tuberculosis H37Rv
gugcgauuuugugucugcuc

SEQ ID NO: 3287792 - RNA, 17 nt, Mycobacterium tuberculosis H37Rv
gugcgcaacccagccgc

SEQ ID NO: 3287793 - RNA, 21 nt, Mycobacterium tuberculosis H37Rv
gugcugcgcaauagcgacagc

SEQ ID NO: 3287794 - RNA, 21 nt, Mycobacterium tuberculosis H37Rv
gugcuggccuuguuguccuuc

SEQ ID NO: 3287795 - RNA, 22 nt, Mycobacterium tuberculosis H37Rv
gugcuggcuuugaucgcccggu

SEQ ID NO: 3287796 - RNA, 22 nt, Mycobacterium tuberculosis H37Rv
gugcuggggaugcgauggcccg

SEQ ID NO: 3287797 - RNA, 16 nt, Mycobacterium tuberculosis H37Rv
gugcuggucaacagcg

SEQ ID NO: 3287798 - RNA, 18 nt, Mycobacterium tuberculosis H37Rv
gugcuggucgccgcggca

SEQ ID NO: 3287799 - RNA, 15 nt, Mycobacterium tuberculosis H37Rv
gugcuggugggccgg

SEQ ID NO: 3287800 - RNA, 21 nt, Mycobacterium tuberculosis H37Rv
gugcuggugggccggaccuug

SEQ ID NO: 3287801 - RNA, 13 nt, Mycobacterium tuberculosis H37Rv
gugcuguggucgg

SEQ ID NO: 3287802 - RNA, 22 nt, Mycobacterium tuberculosis H37Rv
gugcuguuugguugcgccagga

SEQ ID NO: 3287803 - RNA, 19 nt, Mycobacterium tuberculosis H37Rv
gugcuuccauucgcggucc

SEQ ID NO: 3287804 - RNA, 19 nt, Mycobacterium tuberculosis H37Rv
gugcuuucgcgucugcucg

SEQ ID NO: 3287805 - RNA, 19 nt, Mycobacterium tuberculosis H37Rv
guggaaaaaggcggcguug

SEQ ID NO: 3287806 - RNA, 13 nt, Mycobacterium tuberculosis H37Rv
guggaaagugcgu

SEQ ID NO: 3287807 - RNA, 15 nt, Mycobacterium tuberculosis H37Rv
guggaaccacggcgc

SEQ ID NO: 3287808 - RNA, 19 nt, Mycobacterium tuberculosis H37Rv
guggaagcccgucgcggcc

SEQ ID NO: 3287809 - RNA, 14 nt, Mycobacterium tuberculosis H37Rv
guggaagccgacca

SEQ ID NO: 3287810 - RNA, 21 nt, Mycobacterium tuberculosis H37Rv
guggaagccgaccaccgccgg

SEQ ID NO: 3287811 - RNA, 22 nt, Mycobacterium tuberculosis H37Rv
guggaagccgacgaccagcaga

SEQ ID NO: 3287812 - RNA, 16 nt, Mycobacterium tuberculosis H37Rv
guggaagguguuggug

SEQ ID NO: 3287813 - RNA, 20 nt, Mycobacterium tuberculosis H37Rv
guggaauacgcugcuggucu

SEQ ID NO: 3287814 - RNA, 16 nt, Mycobacterium tuberculosis H37Rv
guggaauccaccagcc

SEQ ID NO: 3287815 - RNA, 22 nt, Mycobacterium tuberculosis H37Rv
guggacaccugcugcaccguca

SEQ ID NO: 3287816 - RNA, 14 nt, Mycobacterium tuberculosis H37Rv
guggaccgccgauc

SEQ ID NO: 3287817 - RNA, 19 nt, Mycobacterium tuberculosis H37Rv
guggaccggucgacagcga

SEQ ID NO: 3287818 - RNA, 20 nt, Mycobacterium tuberculosis H37Rv
guggacgcagagucaacaga

SEQ ID NO: 3287819 - RNA, 19 nt, Mycobacterium tuberculosis H37Rv
guggacgcagagucaacga

SEQ ID NO: 3287820 - RNA, 21 nt, Mycobacterium tuberculosis H37Rv
guggacgcgguuuugugcggg

SEQ ID NO: 3287821 - RNA, 15 nt, Mycobacterium tuberculosis H37Rv
guggacggcaggcgg

SEQ ID NO: 3287822 - RNA, 23 nt, Mycobacterium tuberculosis H37Rv
guggagacguuuugcggcccggg

SEQ ID NO: 3287823 - RNA, 22 nt, Mycobacterium tuberculosis H37Rv
guggagauuggguccagcgagg

SEQ ID NO: 3287824 - RNA, 16 nt, Mycobacterium tuberculosis H37Rv
guggagcacagcacgg

SEQ ID NO: 3287825 - RNA, 18 nt, Mycobacterium tuberculosis H37Rv
guggaggaaucguucggg

SEQ ID NO: 3287826 - RNA, 20 nt, Mycobacterium tuberculosis H37Rv
guggaguuggcugccggaga

SEQ ID NO: 3287827 - RNA, 20 nt, Mycobacterium tuberculosis H37Rv
guggaguuuccgaagcccgg

SEQ ID NO: 3287828 - RNA, 21 nt, Mycobacterium tuberculosis H37Rv
guggaguuuccgaagcccggg

SEQ ID NO: 3287829 - RNA, 11 nt, Mycobacterium tuberculosis H37Rv
guggaucacca

SEQ ID NO: 3287830 - RNA, 15 nt, Mycobacterium tuberculosis H37Rv
guggaucauguucgg

SEQ ID NO: 3287831 - RNA, 19 nt, Mycobacterium tuberculosis H37Rv
guggaucauguucggccac

SEQ ID NO: 3287832 - RNA, 23 nt, Mycobacterium tuberculosis H37Rv
guggaucauguucggccaccaga

SEQ ID NO: 3287833 - RNA, 18 nt, Mycobacterium tuberculosis H37Rv
guggauccggcagcagcc

SEQ ID NO: 3287834 - RNA, 18 nt, Mycobacterium tuberculosis H37Rv
guggaucuggcgcagcau

SEQ ID NO: 3287835 - RNA, 17 nt, Mycobacterium tuberculosis H37Rv
guggaucuuggccagca

SEQ ID NO: 3287836 - RNA, 16 nt, Mycobacterium tuberculosis H37Rv
guggaugaacaccuca

SEQ ID NO: 3287837 - RNA, 19 nt, Mycobacterium tuberculosis H37Rv
guggaugccgacggcgggc

SEQ ID NO: 3287838 - RNA, 15 nt, Mycobacterium tuberculosis H37Rv
guggaugugugaguc

SEQ ID NO: 3287839 - RNA, 18 nt, Mycobacterium tuberculosis H37Rv
guggauucgaucaggccu

SEQ ID NO: 3287840 - RNA, 17 nt, Mycobacterium tuberculosis H37Rv
guggauuggcgaugaca

SEQ ID NO: 3287841 - RNA, 22 nt, Mycobacterium tuberculosis H37Rv
guggcaaggccaaccgggccgc

SEQ ID NO: 3287842 - RNA, 16 nt, Mycobacterium tuberculosis H37Rv
guggcaaucccgccau

SEQ ID NO: 3287843 - RNA, 14 nt, Mycobacterium tuberculosis H37Rv
guggcaaucgagga

SEQ ID NO: 3287844 - RNA, 18 nt, Mycobacterium tuberculosis H37Rv
guggcacacccgcaccgg

SEQ ID NO: 3287845 - RNA, 21 nt, Mycobacterium tuberculosis H37Rv
guggcaccauaauggucgucg

SEQ ID NO: 3287846 - RNA, 13 nt, Mycobacterium tuberculosis H37Rv
guggcacccggcu

SEQ ID NO: 3287847 - RNA, 22 nt, Mycobacterium tuberculosis H37Rv
guggcacccggcugaaacgucc

SEQ ID NO: 3287848 - RNA, 12 nt, Mycobacterium tuberculosis H37Rv
guggcaccgguu

SEQ ID NO: 3287849 - RNA, 13 nt, Mycobacterium tuberculosis H37Rv
guggcacgcauga

SEQ ID NO: 3287850 - RNA, 18 nt, Mycobacterium tuberculosis H37Rv
guggcacgcaugagggca

SEQ ID NO: 3287851 - RNA, 18 nt, Mycobacterium tuberculosis H37Rv
guggcacgcugagcgucc

SEQ ID NO: 3287852 - RNA, 23 nt, Mycobacterium tuberculosis H37Rv
guggcacgugaaagccgaccagc

SEQ ID NO: 3287853 - RNA, 21 nt, Mycobacterium tuberculosis H37Rv
guggcacguggcgaccggcga

SEQ ID NO: 3287854 - RNA, 15 nt, Mycobacterium tuberculosis H37Rv
guggcagagccgccg

SEQ ID NO: 3287855 - RNA, 16 nt, Mycobacterium tuberculosis H37Rv
guggcagagccgccgu

SEQ ID NO: 3287856 - RNA, 16 nt, Mycobacterium tuberculosis H37Rv
guggcagccagcggcg

SEQ ID NO: 3287857 - RNA, 16 nt, Mycobacterium tuberculosis H37Rv
guggcagcgcggccgg

SEQ ID NO: 3287858 - RNA, 17 nt, Mycobacterium tuberculosis H37Rv
guggcagcgcggccggg

SEQ ID NO: 3287859 - RNA, 22 nt, Mycobacterium tuberculosis H37Rv
guggcaguacaccggcgugcug

SEQ ID NO: 3287860 - RNA, 16 nt, Mycobacterium tuberculosis H37Rv
guggcauccagcagcg

SEQ ID NO: 3287861 - RNA, 23 nt, Mycobacterium tuberculosis H37Rv
guggcauccuugccaaucgccgu

SEQ ID NO: 3287862 - RNA, 16 nt, Mycobacterium tuberculosis H37Rv
guggcaucgccuccag

SEQ ID NO: 3287863 - RNA, 15 nt, Mycobacterium tuberculosis H37Rv
guggcaucggcggcc

SEQ ID NO: 3287864 - RNA, 20 nt, Mycobacterium tuberculosis H37Rv
guggccaacaccgccagcau

SEQ ID NO: 3287865 - RNA, 16 nt, Mycobacterium tuberculosis H37Rv
guggccaaccaaccgg

SEQ ID NO: 3287866 - RNA, 18 nt, Mycobacterium tuberculosis H37Rv
guggccaauccggcggcg

SEQ ID NO: 3287867 - RNA, 15 nt, Mycobacterium tuberculosis H37Rv
guggccaccacggcg

SEQ ID NO: 3287868 - RNA, 18 nt, Mycobacterium tuberculosis H37Rv
guggccaccacggcgcgc

SEQ ID NO: 3287869 - RNA, 12 nt, Mycobacterium tuberculosis H37Rv
guggccaccagc

SEQ ID NO: 3287870 - RNA, 22 nt, Mycobacterium tuberculosis H37Rv
guggccagaucgaacgcagcca

SEQ ID NO: 3287871 - RNA, 14 nt, Mycobacterium tuberculosis H37Rv
guggccagcaggcg

SEQ ID NO: 3287872 - RNA, 14 nt, Mycobacterium tuberculosis H37Rv
guggccagcccgcc

SEQ ID NO: 3287873 - RNA, 13 nt, Mycobacterium tuberculosis H37Rv
guggccagcgcgg

SEQ ID NO: 3287874 - RNA, 18 nt, Mycobacterium tuberculosis H37Rv
guggccagcgcggcgagg

SEQ ID NO: 3287875 - RNA, 14 nt, Mycobacterium tuberculosis H37Rv
guggccagcgcuug

SEQ ID NO: 3287876 - RNA, 16 nt, Mycobacterium tuberculosis H37Rv
guggccagcgcuugug

SEQ ID NO: 3287877 - RNA, 17 nt, Mycobacterium tuberculosis H37Rv
guggcccaacaccgcca

SEQ ID NO: 3287878 - RNA, 16 nt, Mycobacterium tuberculosis H37Rv
guggccccaagcgugc

SEQ ID NO: 3287879 - RNA, 23 nt, Mycobacterium tuberculosis H37Rv
guggccccaagcgugcugccgcc

SEQ ID NO: 3287880 - RNA, 14 nt, Mycobacterium tuberculosis H37Rv
guggcccgcgggca

SEQ ID NO: 3287881 - RNA, 13 nt, Mycobacterium tuberculosis H37Rv
guggcccgcggug

SEQ ID NO: 3287882 - RNA, 14 nt, Mycobacterium tuberculosis H37Rv
guggcccgcgguga

SEQ ID NO: 3287883 - RNA, 16 nt, Mycobacterium tuberculosis H37Rv
guggcccgggccaccg

SEQ ID NO: 3287884 - RNA, 19 nt, Mycobacterium tuberculosis H37Rv
guggccgacaagucaagau

SEQ ID NO: 3287885 - RNA, 16 nt, Mycobacterium tuberculosis H37Rv
guggccgccggcgcug

SEQ ID NO: 3287886 - RNA, 19 nt, Mycobacterium tuberculosis H37Rv
guggccgccggcgcuggcg

SEQ ID NO: 3287887 - RNA, 16 nt, Mycobacterium tuberculosis H37Rv
guggccgcgcaggggc

SEQ ID NO: 3287888 - RNA, 20 nt, Mycobacterium tuberculosis H37Rv
guggccgcggcggucugggu

SEQ ID NO: 3287889 - RNA, 13 nt, Mycobacterium tuberculosis H37Rv
gugguaggccggg

SEQ ID NO: 3287890 - RNA, 19 nt, Mycobacterium tuberculosis H37Rv
gugguaggccggggcgucg

SEQ ID NO: 3287891 - RNA, 14 nt, Mycobacterium tuberculosis H37Rv
gugguaggccggug

SEQ ID NO: 3287892 - RNA, 16 nt, Mycobacterium tuberculosis H37Rv
gugguaggccggugcg

SEQ ID NO: 3287893 - RNA, 15 nt, Mycobacterium tuberculosis H37Rv
gugguaucggcgugc

SEQ ID NO: 3287894 - RNA, 15 nt, Mycobacterium tuberculosis H37Rv
guggucaccaccauc

SEQ ID NO: 3287895 - RNA, 22 nt, Mycobacterium tuberculosis H37Rv
guggucaccccuucgccagcgc

SEQ ID NO: 3287896 - RNA, 13 nt, Mycobacterium tuberculosis H37Rv
guggucagcgccg

SEQ ID NO: 3287897 - RNA, 15 nt, Mycobacterium tuberculosis H37Rv
guggucagcugcugc

SEQ ID NO: 3287898 - RNA, 19 nt, Mycobacterium tuberculosis H37Rv
guggucagcugcugccacc

SEQ ID NO: 3287899 - RNA, 19 nt, Mycobacterium tuberculosis H37Rv
guggucaguccgacaccgg

SEQ ID NO: 3287900 - RNA, 14 nt, Mycobacterium tuberculosis H37Rv
guggucaucgccac

SEQ ID NO: 3287901 - RNA, 22 nt, Mycobacterium tuberculosis H37Rv
guggucccguucgcccgcccgu

SEQ ID NO: 3287902 - RNA, 15 nt, Mycobacterium tuberculosis H37Rv
guggucgacccggcc

SEQ ID NO: 3287903 - RNA, 17 nt, Mycobacterium tuberculosis H37Rv
guggucgagguggggug

SEQ ID NO: 3287904 - RNA, 17 nt, Mycobacterium tuberculosis H37Rv
guggucgaucagguacu

SEQ ID NO: 3287905 - RNA, 14 nt, Mycobacterium tuberculosis H37Rv
guggucgccccgau

SEQ ID NO: 3287906 - RNA, 22 nt, Mycobacterium tuberculosis H37Rv
guggucgcugcugccgcaccgg

SEQ ID NO: 3287907 - RNA, 17 nt, Mycobacterium tuberculosis H37Rv
guggucggagcgggugc

SEQ ID NO: 3287908 - RNA, 21 nt, Mycobacterium tuberculosis H37Rv
guggucggcgacgucgcgcag

SEQ ID NO: 3287909 - RNA, 14 nt, Mycobacterium tuberculosis H37Rv
guggucggcgguga

SEQ ID NO: 3287910 - RNA, 21 nt, Mycobacterium tuberculosis H37Rv
guggucgucccgauggcggug

SEQ ID NO: 3287911 - RNA, 23 nt, Mycobacterium tuberculosis H37Rv
guggucgucccgauggcgguggg

SEQ ID NO: 3287912 - RNA, 23 nt, Mycobacterium tuberculosis H37Rv
guggucgugggugagcgaccugg

SEQ ID NO: 3287913 - RNA, 19 nt, Mycobacterium tuberculosis H37Rv
guggucucgguaggcggug

SEQ ID NO: 3287914 - RNA, 18 nt, Mycobacterium tuberculosis H37Rv
guggucugccagcacccu

SEQ ID NO: 3287915 - RNA, 14 nt, Mycobacterium tuberculosis H37Rv
guggucugcgcggu

SEQ ID NO: 3287916 - RNA, 16 nt, Mycobacterium tuberculosis H37Rv
guggucugcgcggugc

SEQ ID NO: 3287917 - RNA, 19 nt, Mycobacterium tuberculosis H37Rv
guggucugcgcggugcccg

SEQ ID NO: 3287918 - RNA, 18 nt, Mycobacterium tuberculosis H37Rv
guggucuuggcccggcgg

SEQ ID NO: 3287919 - RNA, 19 nt, Mycobacterium tuberculosis H37Rv
guggugaaguagucggcgc

SEQ ID NO: 3287920 - RNA, 15 nt, Mycobacterium tuberculosis H37Rv
guggugacacgacgu

SEQ ID NO: 3287921 - RNA, 16 nt, Mycobacterium tuberculosis H37Rv
guggugaucuuggucu

SEQ ID NO: 3287922 - RNA, 14 nt, Mycobacterium tuberculosis H37Rv
guggugauugcgga

SEQ ID NO: 3287923 - RNA, 23 nt, Mycobacterium tuberculosis H37Rv
guggugcaccgauuccagcggaa

SEQ ID NO: 3287924 - RNA, 15 nt, Mycobacterium tuberculosis H37Rv
guggugccaaccugg

SEQ ID NO: 3287925 - RNA, 16 nt, Mycobacterium tuberculosis H37Rv
guggugccaaccuggg

SEQ ID NO: 3287926 - RNA, 20 nt, Mycobacterium tuberculosis H37Rv
guggugccaggucggcgggc

SEQ ID NO: 3287927 - RNA, 17 nt, Mycobacterium tuberculosis H37Rv
guggugccgcggccacc

SEQ ID NO: 3287928 - RNA, 14 nt, Mycobacterium tuberculosis H37Rv
guggugcgcaaucg

SEQ ID NO: 3287929 - RNA, 15 nt, Mycobacterium tuberculosis H37Rv
gugguggagcggcgc

SEQ ID NO: 3287930 - RNA, 18 nt, Mycobacterium tuberculosis H37Rv
gugguggaguuuccgaag

SEQ ID NO: 3287931 - RNA, 19 nt, Mycobacterium tuberculosis H37Rv
gugguggcauaaccgcuga

SEQ ID NO: 3287932 - RNA, 12 nt, Mycobacterium tuberculosis H37Rv
gugguggcguug

SEQ ID NO: 3287933 - RNA, 15 nt, Mycobacterium tuberculosis H37Rv
guggugggcuuggcu

SEQ ID NO: 3287934 - RNA, 18 nt, Mycobacterium tuberculosis H37Rv
gugguggguugaucgcgc

SEQ ID NO: 3287935 - RNA, 18 nt, Mycobacterium tuberculosis H37Rv
guggugguugaucagcca

SEQ ID NO: 3287936 - RNA, 19 nt, Mycobacterium tuberculosis H37Rv
guggugucagccaccggug

SEQ ID NO: 3287937 - RNA, 20 nt, Mycobacterium tuberculosis H37Rv
gugguguccaccgcaucggu

SEQ ID NO: 3287938 - RNA, 19 nt, Mycobacterium tuberculosis H37Rv
gugguucggcggcgccccg

SEQ ID NO: 3287939 - RNA, 14 nt, Mycobacterium tuberculosis H37Rv
gugguucgucgucg

SEQ ID NO: 3287940 - RNA, 18 nt, Mycobacterium tuberculosis H37Rv
gugguuguaccagccgaa

SEQ ID NO: 3287941 - RNA, 16 nt, Mycobacterium tuberculosis H37Rv
gugguuguccacggcg

SEQ ID NO: 3287942 - RNA, 18 nt, Mycobacterium tuberculosis H37Rv
gugguuugcgcccugagc

SEQ ID NO: 3287943 - RNA, 20 nt, Mycobacterium tuberculosis H37Rv
guguacaccgcgcccgccga

SEQ ID NO: 3287944 - RNA, 12 nt, Mycobacterium tuberculosis H37Rv
guguacccgccu

SEQ ID NO: 3287945 - RNA, 16 nt, Mycobacterium tuberculosis H37Rv
guguacgcccgcucgg

SEQ ID NO: 3287946 - RNA, 14 nt, Mycobacterium tuberculosis H37Rv
guguacggcggcua

SEQ ID NO: 3287947 - RNA, 19 nt, Mycobacterium tuberculosis H37Rv
guguagaagcgggcgucgc

SEQ ID NO: 3287948 - RNA, 20 nt, Mycobacterium tuberculosis H37Rv
guguagacaggaccgguggg

SEQ ID NO: 3287949 - RNA, 19 nt, Mycobacterium tuberculosis H37Rv
guguagagcgcaccgcgaa

SEQ ID NO: 3287950 - RNA, 16 nt, Mycobacterium tuberculosis H37Rv
guguagcagcgccagc

SEQ ID NO: 3287951 - RNA, 20 nt, Mycobacterium tuberculosis H37Rv
guguagcagcgccagcagcu

SEQ ID NO: 3287952 - RNA, 22 nt, Mycobacterium tuberculosis H37Rv
guguaggcaaccuuuggccgcu

SEQ ID NO: 3287953 - RNA, 18 nt, Mycobacterium tuberculosis H37Rv
guguaggccucggcagca

SEQ ID NO: 3287954 - RNA, 15 nt, Mycobacterium tuberculosis H37Rv
guguaguacagcgca

SEQ ID NO: 3287955 - RNA, 22 nt, Mycobacterium tuberculosis H37Rv
guguaugcauccacugcggcgc

SEQ ID NO: 3287956 - RNA, 14 nt, Mycobacterium tuberculosis H37Rv
guguauuggggugg

SEQ ID NO: 3287957 - RNA, 22 nt, Mycobacterium tuberculosis H37Rv
gugucaaaaccguugucgucca

SEQ ID NO: 3287958 - RNA, 14 nt, Mycobacterium tuberculosis H37Rv
gugucaacggcacc

SEQ ID NO: 3287959 - RNA, 16 nt, Mycobacterium tuberculosis H37Rv
gugucaaucacccagc

SEQ ID NO: 3287960 - RNA, 16 nt, Mycobacterium tuberculosis H37Rv
gugucaaugacaccgg

SEQ ID NO: 3287961 - RNA, 21 nt, Mycobacterium tuberculosis H37Rv
gugucacccaauggagccgcg

SEQ ID NO: 3287962 - RNA, 19 nt, Mycobacterium tuberculosis H37Rv
guguccaccaccggcaccc

SEQ ID NO: 3287963 - RNA, 11 nt, Mycobacterium tuberculosis H37Rv
guguccaccgg

SEQ ID NO: 3287964 - RNA, 12 nt, Mycobacterium tuberculosis H37Rv
guguccagcaug

SEQ ID NO: 3287965 - RNA, 19 nt, Mycobacterium tuberculosis H37Rv
guguccccgcccggccagc

SEQ ID NO: 3287966 - RNA, 21 nt, Mycobacterium tuberculosis H37Rv
guguccccgcccggccagcuc

SEQ ID NO: 3287967 - RNA, 20 nt, Mycobacterium tuberculosis H37Rv
guguccccggcugccagcgc

SEQ ID NO: 3287968 - RNA, 21 nt, Mycobacterium tuberculosis H37Rv
gugucccggaccaucgccugc

SEQ ID NO: 3287969 - RNA, 13 nt, Mycobacterium tuberculosis H37Rv
guguccgccggau

SEQ ID NO: 3287970 - RNA, 21 nt, Mycobacterium tuberculosis H37Rv
guguccgccggauagcaccgg

SEQ ID NO: 3287971 - RNA, 13 nt, Mycobacterium tuberculosis H37Rv
guguccucgucga

SEQ ID NO: 3287972 - RNA, 16 nt, Mycobacterium tuberculosis H37Rv
guguccugucgcacca

SEQ ID NO: 3287973 - RNA, 15 nt, Mycobacterium tuberculosis H37Rv
gugucgaagagcagg

SEQ ID NO: 3287974 - RNA, 20 nt, Mycobacterium tuberculosis H37Rv
gugucgacaaccgcugccgc

SEQ ID NO: 3287975 - RNA, 19 nt, Mycobacterium tuberculosis H37Rv
gugucgagcgccgcaguga

SEQ ID NO: 3287976 - RNA, 15 nt, Mycobacterium tuberculosis H37Rv
gugucgaucagcucc

SEQ ID NO: 3287977 - RNA, 16 nt, Mycobacterium tuberculosis H37Rv
gugucgaugcgggcug

SEQ ID NO: 3287978 - RNA, 15 nt, Mycobacterium tuberculosis H37Rv
gugucgccacccgcg

SEQ ID NO: 3287979 - RNA, 21 nt, Mycobacterium tuberculosis H37Rv
gugucgcccuguucggcccga

SEQ ID NO: 3287980 - RNA, 14 nt, Mycobacterium tuberculosis H37Rv
gugucgccgccguu

SEQ ID NO: 3287981 - RNA, 16 nt, Mycobacterium tuberculosis H37Rv
gugucgggcugucagg

SEQ ID NO: 3287982 - RNA, 22 nt, Mycobacterium tuberculosis H37Rv
gugucgggguacagacacgcgc

SEQ ID NO: 3287983 - RNA, 21 nt, Mycobacterium tuberculosis H37Rv
gugucggguccaaccccagcg

SEQ ID NO: 3287984 - RNA, 12 nt, Mycobacterium tuberculosis H37Rv
gugucggugcgc

SEQ ID NO: 3287985 - RNA, 19 nt, Mycobacterium tuberculosis H37Rv
guucaucacgccgccggag

SEQ ID NO: 3287986 - RNA, 21 nt, Mycobacterium tuberculosis H37Rv
guucaucgcagucauguccau

SEQ ID NO: 3287987 - RNA, 11 nt, Mycobacterium tuberculosis H37Rv
guucaugaucg

SEQ ID NO: 3287988 - RNA, 14 nt, Mycobacterium tuberculosis H37Rv
guucaugcggcggc

SEQ ID NO: 3287989 - RNA, 15 nt, Mycobacterium tuberculosis H37Rv
guucaugcggcggcg

SEQ ID NO: 3287990 - RNA, 14 nt, Mycobacterium tuberculosis H37Rv
guucauguccaccg

SEQ ID NO: 3287991 - RNA, 14 nt, Mycobacterium tuberculosis H37Rv
guuccacaccaggc

SEQ ID NO: 3287992 - RNA, 19 nt, Mycobacterium tuberculosis H37Rv
guuccacaccaggccgagc

SEQ ID NO: 3287993 - RNA, 16 nt, Mycobacterium tuberculosis H37Rv
guuccacacccaguug

SEQ ID NO: 3287994 - RNA, 18 nt, Mycobacterium tuberculosis H37Rv
guuccaccgcgcaggugc

SEQ ID NO: 3287995 - RNA, 16 nt, Mycobacterium tuberculosis H37Rv
guuccacgacaaccgu

SEQ ID NO: 3287996 - RNA, 14 nt, Mycobacterium tuberculosis H37Rv
guuccacggccagg

SEQ ID NO: 3287997 - RNA, 13 nt, Mycobacterium tuberculosis H37Rv
guuccagcaguac

SEQ ID NO: 3287998 - RNA, 19 nt, Mycobacterium tuberculosis H37Rv
guuccagggucacggucgg

SEQ ID NO: 3287999 - RNA, 21 nt, Mycobacterium tuberculosis H37Rv
guuccaguuggaacugaugaa

SEQ ID NO: 3288000 - RNA, 18 nt, Mycobacterium tuberculosis H37Rv
guuccauacagccgccga

SEQ ID NO: 3288001 - RNA, 16 nt, Mycobacterium tuberculosis H37Rv
guuccaucacggacca

SEQ ID NO: 3288002 - RNA, 20 nt, Mycobacterium tuberculosis H37Rv
guucccaccaccaccgccgg

SEQ ID NO: 3288003 - RNA, 15 nt, Mycobacterium tuberculosis H37Rv
guucccaucccucgg

SEQ ID NO: 3288004 - RNA, 20 nt, Mycobacterium tuberculosis H37Rv
guuccccgagaacggcgggc

SEQ ID NO: 3288005 - RNA, 19 nt, Mycobacterium tuberculosis H37Rv
guucccgccggcuccgcca

SEQ ID NO: 3288006 - RNA, 17 nt, Mycobacterium tuberculosis H37Rv
guucccgcucgggcaac

SEQ ID NO: 3288007 - RNA, 16 nt, Mycobacterium tuberculosis H37Rv
guucccgggcagccgc

SEQ ID NO: 3288008 - RNA, 19 nt, Mycobacterium tuberculosis H37Rv
guuccgauagccgaccagg

SEQ ID NO: 3288009 - RNA, 20 nt, Mycobacterium tuberculosis H37Rv
guuccgcaaugaccuggccg

SEQ ID NO: 3288010 - RNA, 19 nt, Mycobacterium tuberculosis H37Rv
guuccgcacgaucagggaa

SEQ ID NO: 3288011 - RNA, 21 nt, Mycobacterium tuberculosis H37Rv
guuccgccaggccgaccgcgc

SEQ ID NO: 3288012 - RNA, 11 nt, Mycobacterium tuberculosis H37Rv
guuccgccauu

SEQ ID NO: 3288013 - RNA, 18 nt, Mycobacterium tuberculosis H37Rv
guuccgcgacaaccacga

SEQ ID NO: 3288014 - RNA, 22 nt, Mycobacterium tuberculosis H37Rv
guuccgcgacaaccacgaaagc

SEQ ID NO: 3288015 - RNA, 14 nt, Mycobacterium tuberculosis H37Rv
guuccgcgcggcag

SEQ ID NO: 3288016 - RNA, 22 nt, Mycobacterium tuberculosis H37Rv
guuccgcugcggugccggcccu

SEQ ID NO: 3288017 - RNA, 13 nt, Mycobacterium tuberculosis H37Rv
guuccggccggcu

SEQ ID NO: 3288018 - RNA, 12 nt, Mycobacterium tuberculosis H37Rv
guuccggcuggu

SEQ ID NO: 3288019 - RNA, 20 nt, Mycobacterium tuberculosis H37Rv
guuccggcuucguccaccgc

SEQ ID NO: 3288020 - RNA, 16 nt, Mycobacterium tuberculosis H37Rv
guuccgggccggcgag

SEQ ID NO: 3288021 - RNA, 16 nt, Mycobacterium tuberculosis H37Rv
guuccugcaagaacca

SEQ ID NO: 3288022 - RNA, 15 nt, Mycobacterium tuberculosis H37Rv
guuccuggucgagca

SEQ ID NO: 3288023 - RNA, 21 nt, Mycobacterium tuberculosis H37Rv
guuccuugagacgccggggaa

SEQ ID NO: 3288024 - RNA, 19 nt, Mycobacterium tuberculosis H37Rv
guuccuugccgaucgccga

SEQ ID NO: 3288025 - RNA, 16 nt, Mycobacterium tuberculosis H37Rv
guucgaaagcaccgau

SEQ ID NO: 3288026 - RNA, 23 nt, Mycobacterium tuberculosis H37Rv
guucgaaggccacccgcgaagcc

SEQ ID NO: 3288027 - RNA, 13 nt, Mycobacterium tuberculosis H37Rv
guucgacccccgc

SEQ ID NO: 3288028 - RNA, 21 nt, Mycobacterium tuberculosis H37Rv
guucgaccgcagggaccgguu

SEQ ID NO: 3288029 - RNA, 21 nt, Mycobacterium tuberculosis H37Rv
guucgacucaugccgagcgac

SEQ ID NO: 3288030 - RNA, 16 nt, Mycobacterium tuberculosis H37Rv
guucgacugaaucaug

SEQ ID NO: 3288031 - RNA, 21 nt, Mycobacterium tuberculosis H37Rv
guucgaguccccuuagcucca

SEQ ID NO: 3288032 - RNA, 20 nt, Mycobacterium tuberculosis H37Rv
guucgaguccugguacccca

SEQ ID NO: 3288033 - RNA, 21 nt, Mycobacterium tuberculosis H37Rv
guucgauagcggcggcggcac

SEQ ID NO: 3288034 - RNA, 15 nt, Mycobacterium tuberculosis H37Rv
guucgaugaaaaugc

SEQ ID NO: 3288035 - RNA, 13 nt, Mycobacterium tuberculosis H37Rv
guucgaugacuga

SEQ ID NO: 3288036 - RNA, 23 nt, Mycobacterium tuberculosis H37Rv
guucgauggcaucggccaucucg

SEQ ID NO: 3288037 - RNA, 19 nt, Mycobacterium tuberculosis H37Rv
guucgaugggugcaccgaa

SEQ ID NO: 3288038 - RNA, 23 nt, Mycobacterium tuberculosis H37Rv
guucgcccgcccgucuuccagcc

SEQ ID NO: 3288039 - RNA, 13 nt, Mycobacterium tuberculosis H37Rv
guucgccggaucg

SEQ ID NO: 3288040 - RNA, 15 nt, Mycobacterium tuberculosis H37Rv
guucgcgcacgucgg

SEQ ID NO: 3288041 - RNA, 15 nt, Mycobacterium tuberculosis H37Rv
guucgcgcgccgcga

SEQ ID NO: 3288042 - RNA, 19 nt, Mycobacterium tuberculosis H37Rv
guucgcgggcgucccgcau

SEQ ID NO: 3288043 - RNA, 15 nt, Mycobacterium tuberculosis H37Rv
guucgcgucgccgau

SEQ ID NO: 3288044 - RNA, 16 nt, Mycobacterium tuberculosis H37Rv
guucgcgucgccgaug

SEQ ID NO: 3288045 - RNA, 17 nt, Mycobacterium tuberculosis H37Rv
guucgcgucgccgauga

SEQ ID NO: 3288046 - RNA, 12 nt, Mycobacterium tuberculosis H37Rv
guucgcuccccc

SEQ ID NO: 3288047 - RNA, 13 nt, Mycobacterium tuberculosis H37Rv
guucgcucccccg

SEQ ID NO: 3288048 - RNA, 22 nt, Mycobacterium tuberculosis H37Rv
guucgcucggggacucauggcc

SEQ ID NO: 3288049 - RNA, 17 nt, Mycobacterium tuberculosis H37Rv
guucggcacaaccaacg

SEQ ID NO: 3288050 - RNA, 19 nt, Mycobacterium tuberculosis H37Rv
guucggcacaaccaacgac

SEQ ID NO: 3288051 - RNA, 15 nt, Mycobacterium tuberculosis H37Rv
guucggcagcgggcu

SEQ ID NO: 3288052 - RNA, 23 nt, Mycobacterium tuberculosis H37Rv
guucggccaccaaccucaucgcg

SEQ ID NO: 3288053 - RNA, 21 nt, Mycobacterium tuberculosis H37Rv
guucggccaccagaaccagcg

SEQ ID NO: 3288054 - RNA, 21 nt, Mycobacterium tuberculosis H37Rv
guucggccaucguccagcagg

SEQ ID NO: 3288055 - RNA, 17 nt, Mycobacterium tuberculosis H37Rv
guucggcccgcaaacag

SEQ ID NO: 3288056 - RNA, 20 nt, Mycobacterium tuberculosis H37Rv
guucggccgucauggcccga

SEQ ID NO: 3288057 - RNA, 16 nt, Mycobacterium tuberculosis H37Rv
guucggcggcugccag

SEQ ID NO: 3288058 - RNA, 20 nt, Mycobacterium tuberculosis H37Rv
guucggcgggagcugccggg

SEQ ID NO: 3288059 - RNA, 12 nt, Mycobacterium tuberculosis H37Rv
guucggcgucgu

SEQ ID NO: 3288060 - RNA, 14 nt, Mycobacterium tuberculosis H37Rv
guucgggacgcgag

SEQ ID NO: 3288061 - RNA, 14 nt, Mycobacterium tuberculosis H37Rv
guucgggcagcacc

SEQ ID NO: 3288062 - RNA, 17 nt, Mycobacterium tuberculosis H37Rv
guucgggcagcuggcga

SEQ ID NO: 3288063 - RNA, 19 nt, Mycobacterium tuberculosis H37Rv
guucgggcuccagcagcgc

SEQ ID NO: 3288064 - RNA, 18 nt, Mycobacterium tuberculosis H37Rv
guucggggcgcaccacga

SEQ ID NO: 3288065 - RNA, 15 nt, Mycobacterium tuberculosis H37Rv
guucgggguggugga

SEQ ID NO: 3288066 - RNA, 14 nt, Mycobacterium tuberculosis H37Rv
guucggucagcgcc

SEQ ID NO: 3288067 - RNA, 22 nt, Mycobacterium tuberculosis H37Rv
guucggucgucucgggcucgga

SEQ ID NO: 3288068 - RNA, 19 nt, Mycobacterium tuberculosis H37Rv
guucggugguccuggcgaa

SEQ ID NO: 3288069 - RNA, 22 nt, Mycobacterium tuberculosis H37Rv
guucgucgaacggaucucggug

SEQ ID NO: 3288070 - RNA, 17 nt, Mycobacterium tuberculosis H37Rv
guucgucgguugccacg

SEQ ID NO: 3288071 - RNA, 15 nt, Mycobacterium tuberculosis H37Rv
guucgucgucgcuga

SEQ ID NO: 3288072 - RNA, 16 nt, Mycobacterium tuberculosis H37Rv
guucgugacgugcaug

SEQ ID NO: 3288073 - RNA, 15 nt, Mycobacterium tuberculosis H37Rv
guucgugagcggcca

SEQ ID NO: 3288074 - RNA, 22 nt, Mycobacterium tuberculosis H37Rv
guucucaccaccagagacgauc

SEQ ID NO: 3288075 - RNA, 14 nt, Mycobacterium tuberculosis H37Rv
guucucaucgccaa

SEQ ID NO: 3288076 - RNA, 17 nt, Mycobacterium tuberculosis H37Rv
guucucgagcucggcga

SEQ ID NO: 3288077 - RNA, 15 nt, Mycobacterium tuberculosis H37Rv
guucucgguccacgg

SEQ ID NO: 3288078 - RNA, 13 nt, Mycobacterium tuberculosis H37Rv
guucucggugcgc

SEQ ID NO: 3288079 - RNA, 18 nt, Mycobacterium tuberculosis H37Rv
guucugccuuaccaaccg

SEQ ID NO: 3288080 - RNA, 16 nt, Mycobacterium tuberculosis H37Rv
guucuucuccaccacc

SEQ ID NO: 3288081 - RNA, 14 nt, Mycobacterium tuberculosis H37Rv
guugcgcucgauca

SEQ ID NO: 3288082 - RNA, 17 nt, Mycobacterium tuberculosis H37Rv
guugcgcugcggccagc

SEQ ID NO: 3288083 - RNA, 21 nt, Mycobacterium tuberculosis H37Rv
guugcggcagcuggcgcagcc

SEQ ID NO: 3288084 - RNA, 19 nt, Mycobacterium tuberculosis H37Rv
guugcggcggcgcuggucg

SEQ ID NO: 3288085 - RNA, 15 nt, Mycobacterium tuberculosis H37Rv
guugcggcuggcgcc

SEQ ID NO: 3288086 - RNA, 17 nt, Mycobacterium tuberculosis H37Rv
guugcguaucgacccgc

SEQ ID NO: 3288087 - RNA, 18 nt, Mycobacterium tuberculosis H37Rv
guugcguuguccaccauc

SEQ ID NO: 3288088 - RNA, 22 nt, Mycobacterium tuberculosis H37Rv
guugcuaaacuccgugccgagc

SEQ ID NO: 3288089 - RNA, 20 nt, Mycobacterium tuberculosis H37Rv
guugcucaagguccagcgau

SEQ ID NO: 3288090 - RNA, 19 nt, Mycobacterium tuberculosis H37Rv
guugcucccacggcaccca

SEQ ID NO: 3288091 - RNA, 19 nt, Mycobacterium tuberculosis H37Rv
guugcugaucagagcguuc

SEQ ID NO: 3288092 - RNA, 16 nt, Mycobacterium tuberculosis H37Rv
guugcuggcggccagc

SEQ ID NO: 3288093 - RNA, 15 nt, Mycobacterium tuberculosis H37Rv
guugcuggucaagau

SEQ ID NO: 3288094 - RNA, 23 nt, Mycobacterium tuberculosis H37Rv
guuggacgccuugcacaagcuga

SEQ ID NO: 3288095 - RNA, 15 nt, Mycobacterium tuberculosis H37Rv
guuggauacggugcg

SEQ ID NO: 3288096 - RNA, 16 nt, Mycobacterium tuberculosis H37Rv
guuggaucccagcccg

SEQ ID NO: 3288097 - RNA, 21 nt, Mycobacterium tuberculosis H37Rv
guuggcaaagacgcuggccac

SEQ ID NO: 3288098 - RNA, 13 nt, Mycobacterium tuberculosis H37Rv
guuggcaccagcc

SEQ ID NO: 3288099 - RNA, 17 nt, Mycobacterium tuberculosis H37Rv
guuggcaccagccggug

SEQ ID NO: 3288100 - RNA, 20 nt, Mycobacterium tuberculosis H37Rv
guuggcacgcaacaccgcca

SEQ ID NO: 3288101 - RNA, 14 nt, Mycobacterium tuberculosis H37Rv
guuggcagcccucu

SEQ ID NO: 3288102 - RNA, 13 nt, Mycobacterium tuberculosis H37Rv
guuggcagggcca

SEQ ID NO: 3288103 - RNA, 19 nt, Mycobacterium tuberculosis H37Rv
guuggcagggccagcggca

SEQ ID NO: 3288104 - RNA, 12 nt, Mycobacterium tuberculosis H37Rv
guuggcaguggc

SEQ ID NO: 3288105 - RNA, 19 nt, Mycobacterium tuberculosis H37Rv
guuggccaccagcuggcga

SEQ ID NO: 3288106 - RNA, 14 nt, Mycobacterium tuberculosis H37Rv
guuggccagaccgc

SEQ ID NO: 3288107 - RNA, 19 nt, Mycobacterium tuberculosis H37Rv
guuggccagccacagccga

SEQ ID NO: 3288108 - RNA, 17 nt, Mycobacterium tuberculosis H37Rv
guuggccaggcccgagu

SEQ ID NO: 3288109 - RNA, 17 nt, Mycobacterium tuberculosis H37Rv
guuggccgcgcucaucg

SEQ ID NO: 3288110 - RNA, 17 nt, Mycobacterium tuberculosis H37Rv
guuggccggcgccaccg

SEQ ID NO: 3288111 - RNA, 14 nt, Mycobacterium tuberculosis H37Rv
guuggccguggucg

SEQ ID NO: 3288112 - RNA, 13 nt, Mycobacterium tuberculosis H37Rv
guuggccucgagc

SEQ ID NO: 3288113 - RNA, 18 nt, Mycobacterium tuberculosis H37Rv
guuggcgaaauccgcgau

SEQ ID NO: 3288114 - RNA, 14 nt, Mycobacterium tuberculosis H37Rv
guuggcgaagcccg

SEQ ID NO: 3288115 - RNA, 14 nt, Mycobacterium tuberculosis H37Rv
guuggcgaucgcga

SEQ ID NO: 3288116 - RNA, 19 nt, Mycobacterium tuberculosis H37Rv
guuggcggccagcgcaccg

SEQ ID NO: 3288117 - RNA, 12 nt, Mycobacterium tuberculosis H37Rv
guuggcggccuc

SEQ ID NO: 3288118 - RNA, 22 nt, Mycobacterium tuberculosis H37Rv
guuggcggccucgggcucaaac

SEQ ID NO: 3288119 - RNA, 21 nt, Mycobacterium tuberculosis H37Rv
guuggcggcggucggcugggc

SEQ ID NO: 3288120 - RNA, 12 nt, Mycobacterium tuberculosis H37Rv
guuggcggcugc

SEQ ID NO: 3288121 - RNA, 18 nt, Mycobacterium tuberculosis H37Rv
guuggcggcugcacgcug

SEQ ID NO: 3288122 - RNA, 18 nt, Mycobacterium tuberculosis H37Rv
guuggcgggagcaccgac

SEQ ID NO: 3288123 - RNA, 12 nt, Mycobacterium tuberculosis H37Rv
guuggcgggcug

SEQ ID NO: 3288124 - RNA, 22 nt, Mycobacterium tuberculosis H37Rv
guuggcggugaacaccgccagc

SEQ ID NO: 3288125 - RNA, 20 nt, Mycobacterium tuberculosis H37Rv
guuggcgucgcuacgcaacg

SEQ ID NO: 3288126 - RNA, 16 nt, Mycobacterium tuberculosis H37Rv
guuggcgugcaccgca

SEQ ID NO: 3288127 - RNA, 14 nt, Mycobacterium tuberculosis H37Rv
guuggcucgcuggg

SEQ ID NO: 3288128 - RNA, 17 nt, Mycobacterium tuberculosis H37Rv
guuggcucggcgcagca

SEQ ID NO: 3288129 - RNA, 22 nt, Mycobacterium tuberculosis H37Rv
guuggcugagcagcgcggccag

SEQ ID NO: 3288130 - RNA, 15 nt, Mycobacterium tuberculosis H37Rv
guuggcuugcgcgca

SEQ ID NO: 3288131 - RNA, 17 nt, Mycobacterium tuberculosis H37Rv
guugggcaugucgccga

SEQ ID NO: 3288132 - RNA, 18 nt, Mycobacterium tuberculosis H37Rv
guugggccgacugggcgc

SEQ ID NO: 3288133 - RNA, 23 nt, Mycobacterium tuberculosis H37Rv
guugggcgagaccgcgagcagca

SEQ ID NO: 3288134 - RNA, 19 nt, Mycobacterium tuberculosis H37Rv
guugggggucgggcucggg

SEQ ID NO: 3288135 - RNA, 20 nt, Mycobacterium tuberculosis H37Rv
guugggugggugcagcacgu

SEQ ID NO: 3288136 - RNA, 19 nt, Mycobacterium tuberculosis H37Rv
guugguacccaccagggug

SEQ ID NO: 3288137 - RNA, 22 nt, Mycobacterium tuberculosis H37Rv
guuggucaucaacgccacgaug

SEQ ID NO: 3288138 - RNA, 19 nt, Mycobacterium tuberculosis H37Rv
guuggucggcugauuggcc

SEQ ID NO: 3288139 - RNA, 13 nt, Mycobacterium tuberculosis H37Rv
guuggucggugcu

SEQ ID NO: 3288140 - RNA, 19 nt, Mycobacterium tuberculosis H37Rv
guuggucgucgcgugcauc

SEQ ID NO: 3288141 - RNA, 16 nt, Mycobacterium tuberculosis H37Rv
guuggugacagugugu

SEQ ID NO: 3288142 - RNA, 16 nt, Mycobacterium tuberculosis H37Rv
guuggugcuggccuug

SEQ ID NO: 3288143 - RNA, 12 nt, Mycobacterium tuberculosis H37Rv
guuguacuggcu

SEQ ID NO: 3288144 - RNA, 22 nt, Mycobacterium tuberculosis H37Rv
guugucagcgaacggccaggac

SEQ ID NO: 3288145 - RNA, 19 nt, Mycobacterium tuberculosis H37Rv
guuguccaccgccaccacg

SEQ ID NO: 3288146 - RNA, 23 nt, Mycobacterium tuberculosis H37Rv
guuguccgcggccaacguacauc

SEQ ID NO: 3288147 - RNA, 15 nt, Mycobacterium tuberculosis H37Rv
guuguccucggcgau

SEQ ID NO: 3288148 - RNA, 14 nt, Mycobacterium tuberculosis H37Rv
guugucgacaucgg

SEQ ID NO: 3288149 - RNA, 19 nt, Mycobacterium tuberculosis H37Rv
guugucgacgaagguggcg

SEQ ID NO: 3288150 - RNA, 18 nt, Mycobacterium tuberculosis H37Rv
guugucggcgcuccccuc

SEQ ID NO: 3288151 - RNA, 13 nt, Mycobacterium tuberculosis H37Rv
guugucguccaac

SEQ ID NO: 3288152 - RNA, 13 nt, Mycobacterium tuberculosis H37Rv
guugucgucgucg

SEQ ID NO: 3288153 - RNA, 16 nt, Mycobacterium tuberculosis H37Rv
guugucguugcuggug

SEQ ID NO: 3288154 - RNA, 15 nt, Mycobacterium tuberculosis H37Rv
guugucuagcuggug

SEQ ID NO: 3288155 - RNA, 18 nt, Mycobacterium tuberculosis H37Rv
guugucuuucacaugcgc

SEQ ID NO: 3288156 - RNA, 23 nt, Mycobacterium tuberculosis H37Rv
guugugccgcaagccucguggug

SEQ ID NO: 3288157 - RNA, 13 nt, Mycobacterium tuberculosis H37Rv
guugugcguccuc

SEQ ID NO: 3288158 - RNA, 13 nt, Mycobacterium tuberculosis H37Rv
guugugcucggug

SEQ ID NO: 3288159 - RNA, 16 nt, Mycobacterium tuberculosis H37Rv
guugugcucggugacg

SEQ ID NO: 3288160 - RNA, 18 nt, Mycobacterium tuberculosis H37Rv
guuguggaaccacggcgc

SEQ ID NO: 3288161 - RNA, 14 nt, Mycobacterium tuberculosis H37Rv
guuguggguggucc

SEQ ID NO: 3288162 - RNA, 20 nt, Mycobacterium tuberculosis H37Rv
guuguggucagcugcugcca

SEQ ID NO: 3288163 - RNA, 15 nt, Mycobacterium tuberculosis H37Rv
guuguggucgaguug

SEQ ID NO: 3288164 - RNA, 13 nt, Mycobacterium tuberculosis H37Rv
guugugucaccgg

SEQ ID NO: 3288165 - RNA, 19 nt, Mycobacterium tuberculosis H37Rv
guuguucccauagccagcc

SEQ ID NO: 3288166 - RNA, 15 nt, Mycobacterium tuberculosis H37Rv
guuguucgccaccgc

SEQ ID NO: 3288167 - RNA, 20 nt, Mycobacterium tuberculosis H37Rv
guuguugacagacacagcac

SEQ ID NO: 3288168 - RNA, 12 nt, Mycobacterium tuberculosis H37Rv
guuguugccgac

SEQ ID NO: 3288169 - RNA, 14 nt, Mycobacterium tuberculosis H37Rv
guuguuggccagac

SEQ ID NO: 3288170 - RNA, 13 nt, Mycobacterium tuberculosis H37Rv
guuguugucggug

SEQ ID NO: 3288171 - RNA, 14 nt, Mycobacterium tuberculosis H37Rv
guuuacggcccggc

SEQ ID NO: 3288172 - RNA, 17 nt, Mycobacterium tuberculosis H37Rv
guuuacggcccggcacc

SEQ ID NO: 3288173 - RNA, 18 nt, Mycobacterium tuberculosis H37Rv
guuuaggcgauucugcgu

SEQ ID NO: 3288174 - RNA, 23 nt, Mycobacterium tuberculosis H37Rv
guuuauaccucgccgcccugucc

SEQ ID NO: 3288175 - RNA, 16 nt, Mycobacterium tuberculosis H37Rv
guuucacauuuuuguu

SEQ ID NO: 3288176 - RNA, 17 nt, Mycobacterium tuberculosis H37Rv
guuucacauuuuuguug

SEQ ID NO: 3288177 - RNA, 16 nt, Mycobacterium tuberculosis H37Rv
guuucauuccugguua

SEQ ID NO: 3288178 - RNA, 13 nt, Mycobacterium tuberculosis H37Rv
uaauggucgucgc

SEQ ID NO: 3288179 - RNA, 18 nt, Mycobacterium tuberculosis H37Rv
uaauucaacagcaccgcg

SEQ ID NO: 3288180 - RNA, 13 nt, Mycobacterium tuberculosis H37Rv
uaauugccgaccg

SEQ ID NO: 3288181 - RNA, 19 nt, Mycobacterium tuberculosis H37Rv
uaauuggcaacacagcuga

SEQ ID NO: 3288182 - RNA, 20 nt, Mycobacterium tuberculosis H37Rv
uacaacacagaacucaccga

SEQ ID NO: 3288183 - RNA, 19 nt, Mycobacterium tuberculosis H37Rv
uacaacagcgucuggccgu

SEQ ID NO: 3288184 - RNA, 23 nt, Mycobacterium tuberculosis H37Rv
uacaacagcugggucaugccgua

SEQ ID NO: 3288185 - RNA, 15 nt, Mycobacterium tuberculosis H37Rv
uacaacgccgucguc

SEQ ID NO: 3288186 - RNA, 24 nt, Mycobacterium tuberculosis H37Rv
uacaacgccgucgucguagaacug

SEQ ID NO: 3288187 - RNA, 19 nt, Mycobacterium tuberculosis H37Rv
uacacaaauccgcaccagc

SEQ ID NO: 3288188 - RNA, 11 nt, Mycobacterium tuberculosis H37Rv
uacacaccgag

SEQ ID NO: 3288189 - RNA, 19 nt, Mycobacterium tuberculosis H37Rv
uacacauaggugcggggcc

SEQ ID NO: 3288190 - RNA, 22 nt, Mycobacterium tuberculosis H37Rv
uacaccuuguggacccgccagg

SEQ ID NO: 3288191 - RNA, 13 nt, Mycobacterium tuberculosis H37Rv
uacacggcggcga

SEQ ID NO: 3288192 - RNA, 23 nt, Mycobacterium tuberculosis H37Rv
uacacgucgcggguaaccggcuc

SEQ ID NO: 3288193 - RNA, 14 nt, Mycobacterium tuberculosis H37Rv
uacacuuugcccgc

SEQ ID NO: 3288194 - RNA, 16 nt, Mycobacterium tuberculosis H37Rv
uacagcacauccagcc

SEQ ID NO: 3288195 - RNA, 14 nt, Mycobacterium tuberculosis H37Rv
uacagcaucaaccg

SEQ ID NO: 3288196 - RNA, 20 nt, Mycobacterium tuberculosis H37Rv
uacagcaucaaccguccccg

SEQ ID NO: 3288197 - RNA, 13 nt, Mycobacterium tuberculosis H37Rv
uacagcgccaggg

SEQ ID NO: 3288198 - RNA, 16 nt, Mycobacterium tuberculosis H37Rv
uacagcgcguuggcga

SEQ ID NO: 3288199 - RNA, 22 nt, Mycobacterium tuberculosis H37Rv
uacagcgggaucccgaucguga

SEQ ID NO: 3288200 - RNA, 19 nt, Mycobacterium tuberculosis H37Rv
uacagcucggugcacggcg

SEQ ID NO: 3288201 - RNA, 22 nt, Mycobacterium tuberculosis H37Rv
uacaggaacaacgcgcaaccag

SEQ ID NO: 3288202 - RNA, 15 nt, Mycobacterium tuberculosis H37Rv
uacaggccacgcacc

SEQ ID NO: 3288203 - RNA, 15 nt, Mycobacterium tuberculosis H37Rv
uacaggucgccgggg

SEQ ID NO: 3288204 - RNA, 12 nt, Mycobacterium tuberculosis H37Rv
uacaggugcagg

SEQ ID NO: 3288205 - RNA, 22 nt, Mycobacterium tuberculosis H37Rv
uacagucgaccggacacuccug

SEQ ID NO: 3288206 - RNA, 13 nt, Mycobacterium tuberculosis H37Rv
uacagugcgcgga

SEQ ID NO: 3288207 - RNA, 17 nt, Mycobacterium tuberculosis H37Rv
uacagugcgcggaucaa

SEQ ID NO: 3288208 - RNA, 19 nt, Mycobacterium tuberculosis H37Rv
uacauagccggucauuuca

SEQ ID NO: 3288209 - RNA, 14 nt, Mycobacterium tuberculosis H37Rv
uacaucgaccaccu

SEQ ID NO: 3288210 - RNA, 15 nt, Mycobacterium tuberculosis H37Rv
uacaucgaccaccuc

SEQ ID NO: 3288211 - RNA, 16 nt, Mycobacterium tuberculosis H37Rv
uacaugucacacccac

SEQ ID NO: 3288212 - RNA, 16 nt, Mycobacterium tuberculosis H37Rv
uaccaauccaggccac

SEQ ID NO: 3288213 - RNA, 12 nt, Mycobacterium tuberculosis H37Rv
uaccaccggcac

SEQ ID NO: 3288214 - RNA, 14 nt, Mycobacterium tuberculosis H37Rv
uaccaccggcaccg

SEQ ID NO: 3288215 - RNA, 14 nt, Mycobacterium tuberculosis H37Rv
uaccaccgucaccg

SEQ ID NO: 3288216 - RNA, 17 nt, Mycobacterium tuberculosis H37Rv
uaccaccgucaccgccg

SEQ ID NO: 3288217 - RNA, 20 nt, Mycobacterium tuberculosis H37Rv
uaccaccgucaccgccggca

SEQ ID NO: 3288218 - RNA, 11 nt, Mycobacterium tuberculosis H37Rv
uaccagcaccg

SEQ ID NO: 3288219 - RNA, 22 nt, Mycobacterium tuberculosis H37Rv
uaccagccaugcucgucuuggg

SEQ ID NO: 3288220 - RNA, 19 nt, Mycobacterium tuberculosis H37Rv
uaccagccgaagaaccggu

SEQ ID NO: 3288221 - RNA, 15 nt, Mycobacterium tuberculosis H37Rv
uaccaggcgcggccc

SEQ ID NO: 3288222 - RNA, 13 nt, Mycobacterium tuberculosis H37Rv
uacccaccagggu

SEQ ID NO: 3288223 - RNA, 16 nt, Mycobacterium tuberculosis H37Rv
uacccacgacgggccg

SEQ ID NO: 3288224 - RNA, 17 nt, Mycobacterium tuberculosis H37Rv
uacccagcgcagcagcg

SEQ ID NO: 3288225 - RNA, 13 nt, Mycobacterium tuberculosis H37Rv
uacccagcgcggc

SEQ ID NO: 3288226 - RNA, 15 nt, Mycobacterium tuberculosis H37Rv
uacccagcgcggcca

SEQ ID NO: 3288227 - RNA, 23 nt, Mycobacterium tuberculosis H37Rv
uacccagcgcggccaccaccgag

SEQ ID NO: 3288228 - RNA, 16 nt, Mycobacterium tuberculosis H37Rv
uacccaucgccacacc

SEQ ID NO: 3288229 - RNA, 13 nt, Mycobacterium tuberculosis H37Rv
uaccccagcacaa

SEQ ID NO: 3288230 - RNA, 23 nt, Mycobacterium tuberculosis H37Rv
uaccccagcaucuuuggcggccg

SEQ ID NO: 3288231 - RNA, 17 nt, Mycobacterium tuberculosis H37Rv
uaccccagccggcagca

SEQ ID NO: 3288232 - RNA, 20 nt, Mycobacterium tuberculosis H37Rv
uaccccagccggcagcagcg

SEQ ID NO: 3288233 - RNA, 14 nt, Mycobacterium tuberculosis H37Rv
uacccccagcaccc

SEQ ID NO: 3288234 - RNA, 18 nt, Mycobacterium tuberculosis H37Rv
uaccccgcagcucaccuc

SEQ ID NO: 3288235 - RNA, 16 nt, Mycobacterium tuberculosis H37Rv
uacccgccucgggccg

SEQ ID NO: 3288236 - RNA, 15 nt, Mycobacterium tuberculosis H37Rv
uacccgcgcgaccug

SEQ ID NO: 3288237 - RNA, 18 nt, Mycobacterium tuberculosis H37Rv
uacccgcgcgaccugaau

SEQ ID NO: 3288238 - RNA, 15 nt, Mycobacterium tuberculosis H37Rv
uacccgcggcagcac

SEQ ID NO: 3288239 - RNA, 12 nt, Mycobacterium tuberculosis H37Rv
uacccgcuggcc

SEQ ID NO: 3288240 - RNA, 16 nt, Mycobacterium tuberculosis H37Rv
uacccggaccgucgug

SEQ ID NO: 3288241 - RNA, 20 nt, Mycobacterium tuberculosis H37Rv
uacccguagcaccacaucgg

SEQ ID NO: 3288242 - RNA, 15 nt, Mycobacterium tuberculosis H37Rv
uaccgaacagcaccu

SEQ ID NO: 3288243 - RNA, 17 nt, Mycobacterium tuberculosis H37Rv
uaccgaaccgguguagc

SEQ ID NO: 3288244 - RNA, 23 nt, Mycobacterium tuberculosis H37Rv
uaccgacaccgugucgccggcga

SEQ ID NO: 3288245 - RNA, 16 nt, Mycobacterium tuberculosis H37Rv
uaccgaccaucgggac

SEQ ID NO: 3288246 - RNA, 13 nt, Mycobacterium tuberculosis H37Rv
uaccgagcacauc

SEQ ID NO: 3288247 - RNA, 14 nt, Mycobacterium tuberculosis H37Rv
uaccgauuggcccg

SEQ ID NO: 3288248 - RNA, 16 nt, Mycobacterium tuberculosis H37Rv
uaccgcaggugccacc

SEQ ID NO: 3288249 - RNA, 16 nt, Mycobacterium tuberculosis H37Rv
uaccgccagcgccacc

SEQ ID NO: 3288250 - RNA, 15 nt, Mycobacterium tuberculosis H37Rv
uaccgccgcgaccgc

SEQ ID NO: 3288251 - RNA, 16 nt, Mycobacterium tuberculosis H37Rv
uaccgccgcgcagccg

SEQ ID NO: 3288252 - RNA, 21 nt, Mycobacterium tuberculosis H37Rv
uaccgccgcgcagccgcucga

SEQ ID NO: 3288253 - RNA, 20 nt, Mycobacterium tuberculosis H37Rv
uaccgccggcggcggccgca

SEQ ID NO: 3288254 - RNA, 19 nt, Mycobacterium tuberculosis H37Rv
uaccgccggcuccgccguu

SEQ ID NO: 3288255 - RNA, 20 nt, Mycobacterium tuberculosis H37Rv
uaccgccguugccgaucagc

SEQ ID NO: 3288256 - RNA, 14 nt, Mycobacterium tuberculosis H37Rv
uaccgcgaagcugc

SEQ ID NO: 3288257 - RNA, 17 nt, Mycobacterium tuberculosis H37Rv
uaccgcgaagcugcggg

SEQ ID NO: 3288258 - RNA, 16 nt, Mycobacterium tuberculosis H37Rv
uaccgcgcguugaagu

SEQ ID NO: 3288259 - RNA, 20 nt, Mycobacterium tuberculosis H37Rv
uaccgcgcguuguggcgaug

SEQ ID NO: 3288260 - RNA, 15 nt, Mycobacterium tuberculosis H37Rv
uaccgcgcucccggc

SEQ ID NO: 3288261 - RNA, 20 nt, Mycobacterium tuberculosis H37Rv
uaccgcguccuuuuccgccg

SEQ ID NO: 3288262 - RNA, 15 nt, Mycobacterium tuberculosis H37Rv
uaccggcagcugcuc

SEQ ID NO: 3288263 - RNA, 14 nt, Mycobacterium tuberculosis H37Rv
uaccggcccggguu

SEQ ID NO: 3288264 - RNA, 18 nt, Mycobacterium tuberculosis H37Rv
uaccggccgccaucaucg

SEQ ID NO: 3288265 - RNA, 18 nt, Mycobacterium tuberculosis H37Rv
uaccggcgaucugcugug

SEQ ID NO: 3288266 - RNA, 21 nt, Mycobacterium tuberculosis H37Rv
uaccggcgaucugcugugucg

SEQ ID NO: 3288267 - RNA, 19 nt, Mycobacterium tuberculosis H37Rv
uaccggcgcauaccggcgu

SEQ ID NO: 3288268 - RNA, 13 nt, Mycobacterium tuberculosis H37Rv
uaccggcggcgcc

SEQ ID NO: 3288269 - RNA, 14 nt, Mycobacterium tuberculosis H37Rv
uaccggcgugcagu

SEQ ID NO: 3288270 - RNA, 15 nt, Mycobacterium tuberculosis H37Rv
uaccggcuggccagg

SEQ ID NO: 3288271 - RNA, 16 nt, Mycobacterium tuberculosis H37Rv
uaccgguccagugugu

SEQ ID NO: 3288272 - RNA, 23 nt, Mycobacterium tuberculosis H37Rv
uaccgguccgucaccaccgccgc

SEQ ID NO: 3288273 - RNA, 23 nt, Mycobacterium tuberculosis H37Rv
uaccguucgggccguccucccac

SEQ ID NO: 3288274 - RNA, 15 nt, Mycobacterium tuberculosis H37Rv
uaccugccggaccac

SEQ ID NO: 3288275 - RNA, 17 nt, Mycobacterium tuberculosis H37Rv
uagccaucggcuaggcc

SEQ ID NO: 3288276 - RNA, 23 nt, Mycobacterium tuberculosis H37Rv
uagccaugggauucggccagacg

SEQ ID NO: 3288277 - RNA, 20 nt, Mycobacterium tuberculosis H37Rv
uagccauucgguguggccgu

SEQ ID NO: 3288278 - RNA, 19 nt, Mycobacterium tuberculosis H37Rv
uagcccacccauggccucc

SEQ ID NO: 3288279 - RNA, 13 nt, Mycobacterium tuberculosis H37Rv
uagcccacccggg

SEQ ID NO: 3288280 - RNA, 14 nt, Mycobacterium tuberculosis H37Rv
uagcccaucggcag

SEQ ID NO: 3288281 - RNA, 13 nt, Mycobacterium tuberculosis H37Rv
uagccccgucgac

SEQ ID NO: 3288282 - RNA, 19 nt, Mycobacterium tuberculosis H37Rv
uagcccgccauccgccgaa

SEQ ID NO: 3288283 - RNA, 16 nt, Mycobacterium tuberculosis H37Rv
uagcccggcagcacgu

SEQ ID NO: 3288284 - RNA, 16 nt, Mycobacterium tuberculosis H37Rv
uagcccuccgagcaca

SEQ ID NO: 3288285 - RNA, 23 nt, Mycobacterium tuberculosis H37Rv
uagcccuugccguguucgggggc

SEQ ID NO: 3288286 - RNA, 15 nt, Mycobacterium tuberculosis H37Rv
uagccgaaaaagacc

SEQ ID NO: 3288287 - RNA, 22 nt, Mycobacterium tuberculosis H37Rv
uagccgaaaaagaccgacagcg

SEQ ID NO: 3288288 - RNA, 15 nt, Mycobacterium tuberculosis H37Rv
uagccgaacagcgga

SEQ ID NO: 3288289 - RNA, 18 nt, Mycobacterium tuberculosis H37Rv
uagccgagcuugaaauag

SEQ ID NO: 3288290 - RNA, 15 nt, Mycobacterium tuberculosis H37Rv
uagccgauccagcag

SEQ ID NO: 3288291 - RNA, 16 nt, Mycobacterium tuberculosis H37Rv
uagccgauccagcagg

SEQ ID NO: 3288292 - RNA, 19 nt, Mycobacterium tuberculosis H37Rv
uagccgcagcuuggccuca

SEQ ID NO: 3288293 - RNA, 19 nt, Mycobacterium tuberculosis H37Rv
uagccgccgaagggugagc

SEQ ID NO: 3288294 - RNA, 16 nt, Mycobacterium tuberculosis H37Rv
uagccgccggugccgc

SEQ ID NO: 3288295 - RNA, 14 nt, Mycobacterium tuberculosis H37Rv
uagccgcggccaca

SEQ ID NO: 3288296 - RNA, 21 nt, Mycobacterium tuberculosis H37Rv
uagccgcuugggccugggccg

SEQ ID NO: 3288297 - RNA, 18 nt, Mycobacterium tuberculosis H37Rv
uagccggcgacaccgcag

SEQ ID NO: 3288298 - RNA, 20 nt, Mycobacterium tuberculosis H37Rv
uagccggcgacaccgcaggu

SEQ ID NO: 3288299 - RNA, 20 nt, Mycobacterium tuberculosis H37Rv
uagccggcgugcacucccuu

SEQ ID NO: 3288300 - RNA, 18 nt, Mycobacterium tuberculosis H37Rv
uagccgggaacgcugacg

SEQ ID NO: 3288301 - RNA, 15 nt, Mycobacterium tuberculosis H37Rv
uagccggguugccug

SEQ ID NO: 3288302 - RNA, 15 nt, Mycobacterium tuberculosis H37Rv
uagccggugaccgcg

SEQ ID NO: 3288303 - RNA, 17 nt, Mycobacterium tuberculosis H37Rv
uagccgucgaucccggu

SEQ ID NO: 3288304 - RNA, 19 nt, Mycobacterium tuberculosis H37Rv
uagccgugacaaggugcgc

SEQ ID NO: 3288305 - RNA, 18 nt, Mycobacterium tuberculosis H37Rv
uagccguugccgccgaac

SEQ ID NO: 3288306 - RNA, 22 nt, Mycobacterium tuberculosis H37Rv
uagccguugccgccgaacagcu

SEQ ID NO: 3288307 - RNA, 13 nt, Mycobacterium tuberculosis H37Rv
uagccugcgccga

SEQ ID NO: 3288308 - RNA, 18 nt, Mycobacterium tuberculosis H37Rv
uagccugcgccgacccgc

SEQ ID NO: 3288309 - RNA, 16 nt, Mycobacterium tuberculosis H37Rv
uagccuuacgcgggug

SEQ ID NO: 3288310 - RNA, 15 nt, Mycobacterium tuberculosis H37Rv
uagcgaagaacuggg

SEQ ID NO: 3288311 - RNA, 18 nt, Mycobacterium tuberculosis H37Rv
uagcgaagugcgcgcugg

SEQ ID NO: 3288312 - RNA, 19 nt, Mycobacterium tuberculosis H37Rv
uagcgaaugaucuugccac

SEQ ID NO: 3288313 - RNA, 17 nt, Mycobacterium tuberculosis H37Rv
uagcgagcgcacaccgg

SEQ ID NO: 3288314 - RNA, 15 nt, Mycobacterium tuberculosis H37Rv
uagcgcaccaccguc

SEQ ID NO: 3288315 - RNA, 19 nt, Mycobacterium tuberculosis H37Rv
uagcgcagcgccuccucga

SEQ ID NO: 3288316 - RNA, 20 nt, Mycobacterium tuberculosis H37Rv
uagcgcagcgccuccucgau

SEQ ID NO: 3288317 - RNA, 23 nt, Mycobacterium tuberculosis H37Rv
uagcgcaugucgauccggcgcca

SEQ ID NO: 3288318 - RNA, 22 nt, Mycobacterium tuberculosis H37Rv
uagcgccaagccgugccgcaca

SEQ ID NO: 3288319 - RNA, 23 nt, Mycobacterium tuberculosis H37Rv
uagcgcccaccguagacgacauc

SEQ ID NO: 3288320 - RNA, 19 nt, Mycobacterium tuberculosis H37Rv
uagcgccgcgcccaccaug

SEQ ID NO: 3288321 - RNA, 20 nt, Mycobacterium tuberculosis H37Rv
uagcgccgcgcuugcgaucg

SEQ ID NO: 3288322 - RNA, 19 nt, Mycobacterium tuberculosis H37Rv
uagcgcgaaagcgccgaaa

SEQ ID NO: 3288323 - RNA, 12 nt, Mycobacterium tuberculosis H37Rv
uagcgcggccag

SEQ ID NO: 3288324 - RNA, 14 nt, Mycobacterium tuberculosis H37Rv
uagcgcgugcugca

SEQ ID NO: 3288325 - RNA, 17 nt, Mycobacterium tuberculosis H37Rv
uagcgcucgaacucggc

SEQ ID NO: 3288326 - RNA, 18 nt, Mycobacterium tuberculosis H37Rv
uagcggaucaggucuggc

SEQ ID NO: 3288327 - RNA, 19 nt, Mycobacterium tuberculosis H37Rv
uagcggaucgcggucagcg

SEQ ID NO: 3288328 - RNA, 16 nt, Mycobacterium tuberculosis H37Rv
uagcggcccgaucacc

SEQ ID NO: 3288329 - RNA, 19 nt, Mycobacterium tuberculosis H37Rv
uagcggcccgaucaccagc

SEQ ID NO: 3288330 - RNA, 18 nt, Mycobacterium tuberculosis H37Rv
uagcgggcaagaugaucg

SEQ ID NO: 3288331 - RNA, 20 nt, Mycobacterium tuberculosis H37Rv
uagcgggcaagaugaucgcg

SEQ ID NO: 3288332 - RNA, 18 nt, Mycobacterium tuberculosis H37Rv
uagcgguccagcgucgcc

SEQ ID NO: 3288333 - RNA, 15 nt, Mycobacterium tuberculosis H37Rv
uagcguagcccgagu

SEQ ID NO: 3288334 - RNA, 20 nt, Mycobacterium tuberculosis H37Rv
uagcguccgagcguaaugcu

SEQ ID NO: 3288335 - RNA, 19 nt, Mycobacterium tuberculosis H37Rv
uagcgucgucccagcgcgg

SEQ ID NO: 3288336 - RNA, 17 nt, Mycobacterium tuberculosis H37Rv
uagcgucugcuggaucg

SEQ ID NO: 3288337 - RNA, 14 nt, Mycobacterium tuberculosis H37Rv
uagcguguggcgca

SEQ ID NO: 3288338 - RNA, 18 nt, Mycobacterium tuberculosis H37Rv
uagcucacgguggccgca

SEQ ID NO: 3288339 - RNA, 20 nt, Mycobacterium tuberculosis H37Rv
uagcucacguuugaggaccu

SEQ ID NO: 3288340 - RNA, 22 nt, Mycobacterium tuberculosis H37Rv
uagcucaggguguucacguuca

SEQ ID NO: 3288341 - RNA, 14 nt, Mycobacterium tuberculosis H37Rv
uagcucccugggcg

SEQ ID NO: 3288342 - RNA, 18 nt, Mycobacterium tuberculosis H37Rv
uagcucgguaggccggca

SEQ ID NO: 3288343 - RNA, 17 nt, Mycobacterium tuberculosis H37Rv
uagcugacccgcgguag

SEQ ID NO: 3288344 - RNA, 19 nt, Mycobacterium tuberculosis H37Rv
uagcugaccgagcugaucc

SEQ ID NO: 3288345 - RNA, 22 nt, Mycobacterium tuberculosis H37Rv
uagcugcgcagcgcaaacaucu

SEQ ID NO: 3288346 - RNA, 22 nt, Mycobacterium tuberculosis H37Rv
uagcugcggucgaacaucaucg

SEQ ID NO: 3288347 - RNA, 16 nt, Mycobacterium tuberculosis H37Rv
uagcugcguccggaac

SEQ ID NO: 3288348 - RNA, 16 nt, Mycobacterium tuberculosis H37Rv
uagcugcucaucgcgc

SEQ ID NO: 3288349 - RNA, 17 nt, Mycobacterium tuberculosis H37Rv
uagcuggcggggguccg

SEQ ID NO: 3288350 - RNA, 13 nt, Mycobacterium tuberculosis H37Rv
uagcuguggcccg

SEQ ID NO: 3288351 - RNA, 14 nt, Mycobacterium tuberculosis H37Rv
uagcuguuggccag

SEQ ID NO: 3288352 - RNA, 13 nt, Mycobacterium tuberculosis H37Rv
uaggacaggaucg

SEQ ID NO: 3288353 - RNA, 14 nt, Mycobacterium tuberculosis H37Rv
uaggaccaccagcg

SEQ ID NO: 3288354 - RNA, 16 nt, Mycobacterium tuberculosis H37Rv
uaggaccaccagcgcu

SEQ ID NO: 3288355 - RNA, 15 nt, Mycobacterium tuberculosis H37Rv
uaggacucggcggaa

SEQ ID NO: 3288356 - RNA, 15 nt, Mycobacterium tuberculosis H37Rv
uaggagaucagcacc

SEQ ID NO: 3288357 - RNA, 14 nt, Mycobacterium tuberculosis H37Rv
uaggaguuccucga

SEQ ID NO: 3288358 - RNA, 21 nt, Mycobacterium tuberculosis H37Rv
uaggaucggauggcggccaca

SEQ ID NO: 3288359 - RNA, 22 nt, Mycobacterium tuberculosis H37Rv
uaggcaaccuuuggccgcugug

SEQ ID NO: 3288360 - RNA, 16 nt, Mycobacterium tuberculosis H37Rv
uaggcaugccacacac

SEQ ID NO: 3288361 - RNA, 15 nt, Mycobacterium tuberculosis H37Rv
uaggccaccacugcg

SEQ ID NO: 3288362 - RNA, 20 nt, Mycobacterium tuberculosis H37Rv
uaggccaccuccgaggccgc

SEQ ID NO: 3288363 - RNA, 23 nt, Mycobacterium tuberculosis H37Rv
uaggccaccuccgaggccgccau

SEQ ID NO: 3288364 - RNA, 12 nt, Mycobacterium tuberculosis H37Rv
uaggccagcccg

SEQ ID NO: 3288365 - RNA, 11 nt, Mycobacterium tuberculosis H37Rv
uaggcccagca

SEQ ID NO: 3288366 - RNA, 20 nt, Mycobacterium tuberculosis H37Rv
uaggccccgccagcgccggu

SEQ ID NO: 3288367 - RNA, 15 nt, Mycobacterium tuberculosis H37Rv
uaggcccggucuugg

SEQ ID NO: 3288368 - RNA, 20 nt, Mycobacterium tuberculosis H37Rv
uaggccgccggacccgucga

SEQ ID NO: 3288369 - RNA, 18 nt, Mycobacterium tuberculosis H37Rv
uaggccgcgcccgagacc

SEQ ID NO: 3288370 - RNA, 22 nt, Mycobacterium tuberculosis H37Rv
uaggccgcgcggcggcgccggc

SEQ ID NO: 3288371 - RNA, 20 nt, Mycobacterium tuberculosis H37Rv
ucacccagcucgcgcaccca

SEQ ID NO: 3288372 - RNA, 22 nt, Mycobacterium tuberculosis H37Rv
ucaccccggucccgccgaccga

SEQ ID NO: 3288373 - RNA, 19 nt, Mycobacterium tuberculosis H37Rv
ucacccgcaacgacugauc

SEQ ID NO: 3288374 - RNA, 15 nt, Mycobacterium tuberculosis H37Rv
ucacccgcacguaga

SEQ ID NO: 3288375 - RNA, 16 nt, Mycobacterium tuberculosis H37Rv
ucacccgcaggucgau

SEQ ID NO: 3288376 - RNA, 12 nt, Mycobacterium tuberculosis H37Rv
ucacccgcaucg

SEQ ID NO: 3288377 - RNA, 22 nt, Mycobacterium tuberculosis H37Rv
ucacccgccgcgguuaucgccg

SEQ ID NO: 3288378 - RNA, 18 nt, Mycobacterium tuberculosis H37Rv
ucacccgggaugaccacc

SEQ ID NO: 3288379 - RNA, 18 nt, Mycobacterium tuberculosis H37Rv
ucacccgggcagccugcu

SEQ ID NO: 3288380 - RNA, 14 nt, Mycobacterium tuberculosis H37Rv
ucacccgguagacg

SEQ ID NO: 3288381 - RNA, 22 nt, Mycobacterium tuberculosis H37Rv
ucacccguagguaguuguccag

SEQ ID NO: 3288382 - RNA, 21 nt, Mycobacterium tuberculosis H37Rv
ucacccuauuggucggucgcg

SEQ ID NO: 3288383 - RNA, 18 nt, Mycobacterium tuberculosis H37Rv
ucacccugucgcgcaccg

SEQ ID NO: 3288384 - RNA, 13 nt, Mycobacterium tuberculosis H37Rv
ucaccgacaccgu

SEQ ID NO: 3288385 - RNA, 14 nt, Mycobacterium tuberculosis H37Rv
ucaccgacaccgug

SEQ ID NO: 3288386 - RNA, 17 nt, Mycobacterium tuberculosis H37Rv
ucaccgacaccgugccg

SEQ ID NO: 3288387 - RNA, 18 nt, Mycobacterium tuberculosis H37Rv
ucaccgacaugacgcggc

SEQ ID NO: 3288388 - RNA, 19 nt, Mycobacterium tuberculosis H37Rv
ucaccgacaugacgcggcc

SEQ ID NO: 3288389 - RNA, 16 nt, Mycobacterium tuberculosis H37Rv
ucaccgacgucgccaa

SEQ ID NO: 3288390 - RNA, 15 nt, Mycobacterium tuberculosis H37Rv
ucaccgagauggcga

SEQ ID NO: 3288391 - RNA, 18 nt, Mycobacterium tuberculosis H37Rv
ucaccgaucccgcggccg

SEQ ID NO: 3288392 - RNA, 18 nt, Mycobacterium tuberculosis H37Rv
ucaccgaucgaacagugc

SEQ ID NO: 3288393 - RNA, 22 nt, Mycobacterium tuberculosis H37Rv
ucaccgaucucgaccagcgccg

SEQ ID NO: 3288394 - RNA, 18 nt, Mycobacterium tuberculosis H37Rv
ucaccgaugagccgacgg

SEQ ID NO: 3288395 - RNA, 21 nt, Mycobacterium tuberculosis H37Rv
ucaccgcacaccugcgcggcg

SEQ ID NO: 3288396 - RNA, 22 nt, Mycobacterium tuberculosis H37Rv
ucaccgcacaccugcgcggcgu

SEQ ID NO: 3288397 - RNA, 13 nt, Mycobacterium tuberculosis H37Rv
ucaccgccaccac

SEQ ID NO: 3288398 - RNA, 21 nt, Mycobacterium tuberculosis H37Rv
ucaccgccagcugggcagcca

SEQ ID NO: 3288399 - RNA, 23 nt, Mycobacterium tuberculosis H37Rv
ucaccgccauugccaccaagucc

SEQ ID NO: 3288400 - RNA, 14 nt, Mycobacterium tuberculosis H37Rv
ucaccgccgcgacc

SEQ ID NO: 3288401 - RNA, 15 nt, Mycobacterium tuberculosis H37Rv
ucaccgccgcgaccg

SEQ ID NO: 3288402 - RNA, 15 nt, Mycobacterium tuberculosis H37Rv
ucaccgccgcggccg

SEQ ID NO: 3288403 - RNA, 19 nt, Mycobacterium tuberculosis H37Rv
ucaccgccgcuaccgcccg

SEQ ID NO: 3288404 - RNA, 16 nt, Mycobacterium tuberculosis H37Rv
ucaccgccgggaagcc

SEQ ID NO: 3288405 - RNA, 19 nt, Mycobacterium tuberculosis H37Rv
ucaccgccggugcugacga

SEQ ID NO: 3288406 - RNA, 18 nt, Mycobacterium tuberculosis H37Rv
ucaccgccguuaccgccg

SEQ ID NO: 3288407 - RNA, 20 nt, Mycobacterium tuberculosis H37Rv
ucaccgccguuaccgccguu

SEQ ID NO: 3288408 - RNA, 14 nt, Mycobacterium tuberculosis H37Rv
ucaccgcgcagcga

SEQ ID NO: 3288409 - RNA, 16 nt, Mycobacterium tuberculosis H37Rv
ucaccgcgcaucaucg

SEQ ID NO: 3288410 - RNA, 22 nt, Mycobacterium tuberculosis H37Rv
ucaccgcgccagccuccaccag

SEQ ID NO: 3288411 - RNA, 14 nt, Mycobacterium tuberculosis H37Rv
ucaccgcgcugaac

SEQ ID NO: 3288412 - RNA, 18 nt, Mycobacterium tuberculosis H37Rv
ucaccgcguagaccccaa

SEQ ID NO: 3288413 - RNA, 19 nt, Mycobacterium tuberculosis H37Rv
ucaccgcguagaccccaau

SEQ ID NO: 3288414 - RNA, 20 nt, Mycobacterium tuberculosis H37Rv
ucaccgcguaguccaggccg

SEQ ID NO: 3288415 - RNA, 19 nt, Mycobacterium tuberculosis H37Rv
ucaccgcguguaccgcgac

SEQ ID NO: 3288416 - RNA, 16 nt, Mycobacterium tuberculosis H37Rv
ucaccggaacccccag

SEQ ID NO: 3288417 - RNA, 16 nt, Mycobacterium tuberculosis H37Rv
ucaccggauucuucgg

SEQ ID NO: 3288418 - RNA, 11 nt, Mycobacterium tuberculosis H37Rv
ucaccggcaau

SEQ ID NO: 3288419 - RNA, 14 nt, Mycobacterium tuberculosis H37Rv
ucaccggcauacag

SEQ ID NO: 3288420 - RNA, 18 nt, Mycobacterium tuberculosis H37Rv
ucaccggcauacagccgg

SEQ ID NO: 3288421 - RNA, 13 nt, Mycobacterium tuberculosis H37Rv
ucaccggcugcug

SEQ ID NO: 3288422 - RNA, 14 nt, Mycobacterium tuberculosis H37Rv
ucaccggcugcuga

SEQ ID NO: 3288423 - RNA, 18 nt, Mycobacterium tuberculosis H37Rv
ucaccggcuggugccaac

SEQ ID NO: 3288424 - RNA, 22 nt, Mycobacterium tuberculosis H37Rv
ucaccgggguugcccgcgacga

SEQ ID NO: 3288425 - RNA, 23 nt, Mycobacterium tuberculosis H37Rv
ucaccggguuggaagccgcaccg

SEQ ID NO: 3288426 - RNA, 16 nt, Mycobacterium tuberculosis H37Rv
ucaccgguacgcaacc

SEQ ID NO: 3288427 - RNA, 21 nt, Mycobacterium tuberculosis H37Rv
ucaccguacgggacgaagacc

SEQ ID NO: 3288428 - RNA, 16 nt, Mycobacterium tuberculosis H37Rv
ucaccgugguggcgua

SEQ ID NO: 3288429 - RNA, 22 nt, Mycobacterium tuberculosis H37Rv
ucaccguugcguuggcgccacc

SEQ ID NO: 3288430 - RNA, 15 nt, Mycobacterium tuberculosis H37Rv
ucaccguuggccgcg

SEQ ID NO: 3288431 - RNA, 23 nt, Mycobacterium tuberculosis H37Rv
ucaccguuguucccauagccagc

SEQ ID NO: 3288432 - RNA, 13 nt, Mycobacterium tuberculosis H37Rv
ucaccucgcacga

SEQ ID NO: 3288433 - RNA, 18 nt, Mycobacterium tuberculosis H37Rv
ucaccucgcacgacaccu

SEQ ID NO: 3288434 - RNA, 15 nt, Mycobacterium tuberculosis H37Rv
ucaccucgccggcgg

SEQ ID NO: 3288435 - RNA, 20 nt, Mycobacterium tuberculosis H37Rv
ucaccucggugccggccgca

SEQ ID NO: 3288436 - RNA, 22 nt, Mycobacterium tuberculosis H37Rv
ucaccucggugccggccgcaca

SEQ ID NO: 3288437 - RNA, 18 nt, Mycobacterium tuberculosis H37Rv
ucaccuggcgugucgccg

SEQ ID NO: 3288438 - RNA, 18 nt, Mycobacterium tuberculosis H37Rv
ucaccugggccagcagcc

SEQ ID NO: 3288439 - RNA, 18 nt, Mycobacterium tuberculosis H37Rv
ucaccuucaccgggugac

SEQ ID NO: 3288440 - RNA, 17 nt, Mycobacterium tuberculosis H37Rv
ucaccuucggccgaccg

SEQ ID NO: 3288441 - RNA, 21 nt, Mycobacterium tuberculosis H37Rv
ucaccuucggccgaccgggcu

SEQ ID NO: 3288442 - RNA, 18 nt, Mycobacterium tuberculosis H37Rv
ucaccuucgucgcggccg

SEQ ID NO: 3288443 - RNA, 20 nt, Mycobacterium tuberculosis H37Rv
ucaccuugccuagccgcagc

SEQ ID NO: 3288444 - RNA, 21 nt, Mycobacterium tuberculosis H37Rv
ucaccuugcuccacaucggcu

SEQ ID NO: 3288445 - RNA, 16 nt, Mycobacterium tuberculosis H37Rv
ucaccuugcugcaguc

SEQ ID NO: 3288446 - RNA, 22 nt, Mycobacterium tuberculosis H37Rv
ucacgaagaccaggccggugac

SEQ ID NO: 3288447 - RNA, 18 nt, Mycobacterium tuberculosis H37Rv
ucacgaagugacccgaac

SEQ ID NO: 3288448 - RNA, 22 nt, Mycobacterium tuberculosis H37Rv
ucacgaccugcucauccaccuc

SEQ ID NO: 3288449 - RNA, 23 nt, Mycobacterium tuberculosis H37Rv
ucacgagccaaggcuuccuccga

SEQ ID NO: 3288450 - RNA, 13 nt, Mycobacterium tuberculosis H37Rv
ucacgagccaggg

SEQ ID NO: 3288451 - RNA, 20 nt, Mycobacterium tuberculosis H37Rv
ucacgaggcacaaucaccgc

SEQ ID NO: 3288452 - RNA, 22 nt, Mycobacterium tuberculosis H37Rv
ucacgaggcguucaccacgauc

SEQ ID NO: 3288453 - RNA, 14 nt, Mycobacterium tuberculosis H37Rv
ucacgaucacgaug

SEQ ID NO: 3288454 - RNA, 15 nt, Mycobacterium tuberculosis H37Rv
ucacgcacaagccuc

SEQ ID NO: 3288455 - RNA, 12 nt, Mycobacterium tuberculosis H37Rv
ucacgcaccaca

SEQ ID NO: 3288456 - RNA, 13 nt, Mycobacterium tuberculosis H37Rv
ucacgcacccggc

SEQ ID NO: 3288457 - RNA, 19 nt, Mycobacterium tuberculosis H37Rv
ucacgcacccggcgcaaca

SEQ ID NO: 3288458 - RNA, 15 nt, Mycobacterium tuberculosis H37Rv
ucacgcaccggcgca

SEQ ID NO: 3288459 - RNA, 12 nt, Mycobacterium tuberculosis H37Rv
ucacgcacugau

SEQ ID NO: 3288460 - RNA, 21 nt, Mycobacterium tuberculosis H37Rv
ucacgcagcacccugcgggcc

SEQ ID NO: 3288461 - RNA, 13 nt, Mycobacterium tuberculosis H37Rv
ucacgcccaccac

SEQ ID NO: 3288462 - RNA, 14 nt, Mycobacterium tuberculosis H37Rv
ucacgccgucaccg

SEQ ID NO: 3288463 - RNA, 16 nt, Mycobacterium tuberculosis H37Rv
ucacgccgucaccgcu

SEQ ID NO: 3288464 - RNA, 15 nt, Mycobacterium tuberculosis H37Rv
ucacgccgucgcaga

SEQ ID NO: 3288465 - RNA, 15 nt, Mycobacterium tuberculosis H37Rv
ucacgcgaccaccgc

SEQ ID NO: 3288466 - RNA, 13 nt, Mycobacterium tuberculosis H37Rv
ucacgcgcggauc

SEQ ID NO: 3288467 - RNA, 21 nt, Mycobacterium tuberculosis H37Rv
ucagcgcaucgccgcuggcca

SEQ ID NO: 3288468 - RNA, 22 nt, Mycobacterium tuberculosis H37Rv
ucagcgcaucgccgcuggccag

SEQ ID NO: 3288469 - RNA, 13 nt, Mycobacterium tuberculosis H37Rv
ucagcgccagcga

SEQ ID NO: 3288470 - RNA, 17 nt, Mycobacterium tuberculosis H37Rv
ucagcgccgcgcgcgcc

SEQ ID NO: 3288471 - RNA, 14 nt, Mycobacterium tuberculosis H37Rv
ucagcgcgaccgaa

SEQ ID NO: 3288472 - RNA, 12 nt, Mycobacterium tuberculosis H37Rv
ucagcgcgcugc

SEQ ID NO: 3288473 - RNA, 16 nt, Mycobacterium tuberculosis H37Rv
ucagcgcggcacggug

SEQ ID NO: 3288474 - RNA, 20 nt, Mycobacterium tuberculosis H37Rv
ucagcgcggccacgccgauc

SEQ ID NO: 3288475 - RNA, 19 nt, Mycobacterium tuberculosis H37Rv
ucagcgcggcgcccuggcc

SEQ ID NO: 3288476 - RNA, 15 nt, Mycobacterium tuberculosis H37Rv
ucagcgcggcgucua

SEQ ID NO: 3288477 - RNA, 22 nt, Mycobacterium tuberculosis H37Rv
ucagcgcggcgucuagcccgcc

SEQ ID NO: 3288478 - RNA, 15 nt, Mycobacterium tuberculosis H37Rv
ucagcgcgguccauc

SEQ ID NO: 3288479 - RNA, 16 nt, Mycobacterium tuberculosis H37Rv
ucagcgcguagccaau

SEQ ID NO: 3288480 - RNA, 19 nt, Mycobacterium tuberculosis H37Rv
ucagcgcguagccaaugcc

SEQ ID NO: 3288481 - RNA, 13 nt, Mycobacterium tuberculosis H37Rv
ucagcgcugagcc

SEQ ID NO: 3288482 - RNA, 16 nt, Mycobacterium tuberculosis H37Rv
ucagcgcugagccgcu

SEQ ID NO: 3288483 - RNA, 15 nt, Mycobacterium tuberculosis H37Rv
ucagcggcagcaccg

SEQ ID NO: 3288484 - RNA, 14 nt, Mycobacterium tuberculosis H37Rv
ucagcggccaaccc

SEQ ID NO: 3288485 - RNA, 17 nt, Mycobacterium tuberculosis H37Rv
ucagcggccaacccauc

SEQ ID NO: 3288486 - RNA, 16 nt, Mycobacterium tuberculosis H37Rv
ucagcggcgaccgcau

SEQ ID NO: 3288487 - RNA, 19 nt, Mycobacterium tuberculosis H37Rv
ucagcggcguggucucgau

SEQ ID NO: 3288488 - RNA, 13 nt, Mycobacterium tuberculosis H37Rv
ucagcgggcagca

SEQ ID NO: 3288489 - RNA, 23 nt, Mycobacterium tuberculosis H37Rv
ucagcgggcagcaggcgaugcgc

SEQ ID NO: 3288490 - RNA, 20 nt, Mycobacterium tuberculosis H37Rv
ucagcguauuggacgcugcc

SEQ ID NO: 3288491 - RNA, 21 nt, Mycobacterium tuberculosis H37Rv
ucagcgucugagcgccggcau

SEQ ID NO: 3288492 - RNA, 15 nt, Mycobacterium tuberculosis H37Rv
ucagcgugcgcuggc

SEQ ID NO: 3288493 - RNA, 14 nt, Mycobacterium tuberculosis H37Rv
ucagcgugucgccg

SEQ ID NO: 3288494 - RNA, 21 nt, Mycobacterium tuberculosis H37Rv
ucagcuagcgcgggcucacau

SEQ ID NO: 3288495 - RNA, 18 nt, Mycobacterium tuberculosis H37Rv
ucagcucaccacccagau

SEQ ID NO: 3288496 - RNA, 13 nt, Mycobacterium tuberculosis H37Rv
ucagcucgaucac

SEQ ID NO: 3288497 - RNA, 17 nt, Mycobacterium tuberculosis H37Rv
ucagcucgaucacgccg

SEQ ID NO: 3288498 - RNA, 15 nt, Mycobacterium tuberculosis H37Rv
ucagcucgccagccu

SEQ ID NO: 3288499 - RNA, 15 nt, Mycobacterium tuberculosis H37Rv
ucagcucgcuugcau

SEQ ID NO: 3288500 - RNA, 15 nt, Mycobacterium tuberculosis H37Rv
ucagcucggcagcau

SEQ ID NO: 3288501 - RNA, 18 nt, Mycobacterium tuberculosis H37Rv
ucagcucggcagcaucuc

SEQ ID NO: 3288502 - RNA, 12 nt, Mycobacterium tuberculosis H37Rv
ucagcucggucu

SEQ ID NO: 3288503 - RNA, 22 nt, Mycobacterium tuberculosis H37Rv
ucagcucgucggcgauggccag

SEQ ID NO: 3288504 - RNA, 20 nt, Mycobacterium tuberculosis H37Rv
ucagcugauuaccgacaccg

SEQ ID NO: 3288505 - RNA, 22 nt, Mycobacterium tuberculosis H37Rv
ucagcugcggacuggcauccgc

SEQ ID NO: 3288506 - RNA, 12 nt, Mycobacterium tuberculosis H37Rv
ucagcugcggau

SEQ ID NO: 3288507 - RNA, 15 nt, Mycobacterium tuberculosis H37Rv
ucagcugcggauaca

SEQ ID NO: 3288508 - RNA, 15 nt, Mycobacterium tuberculosis H37Rv
ucagcugcucgucuu

SEQ ID NO: 3288509 - RNA, 13 nt, Mycobacterium tuberculosis H37Rv
ucagcuggccgcg

SEQ ID NO: 3288510 - RNA, 17 nt, Mycobacterium tuberculosis H37Rv
ucagcuggccgcggcga

SEQ ID NO: 3288511 - RNA, 18 nt, Mycobacterium tuberculosis H37Rv
ucagcugugcgacccgca

SEQ ID NO: 3288512 - RNA, 22 nt, Mycobacterium tuberculosis H37Rv
ucagcuuggacccugcgccgcc

SEQ ID NO: 3288513 - RNA, 22 nt, Mycobacterium tuberculosis H37Rv
ucagcuugugggcgacggcgau

SEQ ID NO: 3288514 - RNA, 20 nt, Mycobacterium tuberculosis H37Rv
ucaggaaaccggcgcggaac

SEQ ID NO: 3288515 - RNA, 20 nt, Mycobacterium tuberculosis H37Rv
ucaggaaccacccaccggcc

SEQ ID NO: 3288516 - RNA, 20 nt, Mycobacterium tuberculosis H37Rv
ucaggaagcgugcggucguu

SEQ ID NO: 3288517 - RNA, 18 nt, Mycobacterium tuberculosis H37Rv
ucaggacgaacgcuggcg

SEQ ID NO: 3288518 - RNA, 12 nt, Mycobacterium tuberculosis H37Rv
ucaggacggcac

SEQ ID NO: 3288519 - RNA, 14 nt, Mycobacterium tuberculosis H37Rv
ucaggaucccggug

SEQ ID NO: 3288520 - RNA, 20 nt, Mycobacterium tuberculosis H37Rv
ucaggaucccgguggcagca

SEQ ID NO: 3288521 - RNA, 16 nt, Mycobacterium tuberculosis H37Rv
ucaggaucggcgauug

SEQ ID NO: 3288522 - RNA, 21 nt, Mycobacterium tuberculosis H37Rv
ucaggcaacgaagagggcgcc

SEQ ID NO: 3288523 - RNA, 14 nt, Mycobacterium tuberculosis H37Rv
ucaggccagcgcuc

SEQ ID NO: 3288524 - RNA, 14 nt, Mycobacterium tuberculosis H37Rv
ucaggccccgggaa

SEQ ID NO: 3288525 - RNA, 22 nt, Mycobacterium tuberculosis H37Rv
ucaggccgacgucuaggccaaa

SEQ ID NO: 3288526 - RNA, 12 nt, Mycobacterium tuberculosis H37Rv
ucaggccgagga

SEQ ID NO: 3288527 - RNA, 19 nt, Mycobacterium tuberculosis H37Rv
ucaggccgaugcgggucuc

SEQ ID NO: 3288528 - RNA, 22 nt, Mycobacterium tuberculosis H37Rv
ucaggcggacgggacgcaugcg

SEQ ID NO: 3288529 - RNA, 23 nt, Mycobacterium tuberculosis H37Rv
ucaggcggcagguucgaggguga

SEQ ID NO: 3288530 - RNA, 22 nt, Mycobacterium tuberculosis H37Rv
ucaggcgguaguggcgaucugc

SEQ ID NO: 3288531 - RNA, 23 nt, Mycobacterium tuberculosis H37Rv
ucagggcacgcuggaacuuggcg

SEQ ID NO: 3288532 - RNA, 21 nt, Mycobacterium tuberculosis H37Rv
ucagggcgcaaaccacccgca

SEQ ID NO: 3288533 - RNA, 22 nt, Mycobacterium tuberculosis H37Rv
ucaggggaucccccgcgcgaac

SEQ ID NO: 3288534 - RNA, 22 nt, Mycobacterium tuberculosis H37Rv
ucaggggcuacuaggcccagca

SEQ ID NO: 3288535 - RNA, 22 nt, Mycobacterium tuberculosis H37Rv
ucagggguggcgcgggccggcg

SEQ ID NO: 3288536 - RNA, 20 nt, Mycobacterium tuberculosis H37Rv
ucagggugcugaucuugccg

SEQ ID NO: 3288537 - RNA, 24 nt, Mycobacterium tuberculosis H37Rv
ucagggugggcgacgucaucgccg

SEQ ID NO: 3288538 - RNA, 13 nt, Mycobacterium tuberculosis H37Rv
ucagggugucgaa

SEQ ID NO: 3288539 - RNA, 15 nt, Mycobacterium tuberculosis H37Rv
ucaggucaccggccg

SEQ ID NO: 3288540 - RNA, 20 nt, Mycobacterium tuberculosis H37Rv
ucaggucgccgagaccggcc

SEQ ID NO: 3288541 - RNA, 16 nt, Mycobacterium tuberculosis H37Rv
ucaggucggggucaga

SEQ ID NO: 3288542 - RNA, 16 nt, Mycobacterium tuberculosis H37Rv
ucaggucgguggucuc

SEQ ID NO: 3288543 - RNA, 20 nt, Mycobacterium tuberculosis H37Rv
ucaggucgucacgccccuca

SEQ ID NO: 3288544 - RNA, 19 nt, Mycobacterium tuberculosis H37Rv
ucaggucugacagaccggg

SEQ ID NO: 3288545 - RNA, 17 nt, Mycobacterium tuberculosis H37Rv
ucaggugagaccagguu

SEQ ID NO: 3288546 - RNA, 15 nt, Mycobacterium tuberculosis H37Rv
ucaggugcgcgacca

SEQ ID NO: 3288547 - RNA, 13 nt, Mycobacterium tuberculosis H37Rv
ucagguuggcacg

SEQ ID NO: 3288548 - RNA, 15 nt, Mycobacterium tuberculosis H37Rv
ucaguagccacgccc

SEQ ID NO: 3288549 - RNA, 14 nt, Mycobacterium tuberculosis H37Rv
ucaguauggcgacg

SEQ ID NO: 3288550 - RNA, 20 nt, Mycobacterium tuberculosis H37Rv
ucaguauucguaguccgguc

SEQ ID NO: 3288551 - RNA, 23 nt, Mycobacterium tuberculosis H37Rv
ucaguccgacaccggcggcaucg

SEQ ID NO: 3288552 - RNA, 23 nt, Mycobacterium tuberculosis H37Rv
ucagugaccuguugaacggccgc

SEQ ID NO: 3288553 - RNA, 16 nt, Mycobacterium tuberculosis H37Rv
ucagugaucaccaacc

SEQ ID NO: 3288554 - RNA, 13 nt, Mycobacterium tuberculosis H37Rv
ucagugccaggug

SEQ ID NO: 3288555 - RNA, 16 nt, Mycobacterium tuberculosis H37Rv
ucagugccccgcagca

SEQ ID NO: 3288556 - RNA, 20 nt, Mycobacterium tuberculosis H37Rv
ucagugggcgguugaucgcc

SEQ ID NO: 3288557 - RNA, 14 nt, Mycobacterium tuberculosis H37Rv
ucaguucacgcucg

SEQ ID NO: 3288558 - RNA, 13 nt, Mycobacterium tuberculosis H37Rv
ucaguucccgaac

SEQ ID NO: 3288559 - RNA, 20 nt, Mycobacterium tuberculosis H37Rv
ucaguucccgaaccccgacc

SEQ ID NO: 3288560 - RNA, 22 nt, Mycobacterium tuberculosis H37Rv
ucaguucccgcuugaucugggc

SEQ ID NO: 3288561 - RNA, 19 nt, Mycobacterium tuberculosis H37Rv
ucaguucgacggugccguc

SEQ ID NO: 3288562 - RNA, 22 nt, Mycobacterium tuberculosis H37Rv
ucaguucggccgucauggcccg

SEQ ID NO: 3288563 - RNA, 18 nt, Mycobacterium tuberculosis H37Rv
uccacacgcugcccgcca

SEQ ID NO: 3288564 - RNA, 13 nt, Mycobacterium tuberculosis H37Rv
uccacaucaaaac

SEQ ID NO: 3288565 - RNA, 16 nt, Mycobacterium tuberculosis H37Rv
uccacaucggcucuga

SEQ ID NO: 3288566 - RNA, 17 nt, Mycobacterium tuberculosis H37Rv
uccacaugguacggacg

SEQ ID NO: 3288567 - RNA, 20 nt, Mycobacterium tuberculosis H37Rv
uccaccaagcucgcaaccga

SEQ ID NO: 3288568 - RNA, 20 nt, Mycobacterium tuberculosis H37Rv
uccaccacgcuggccucguc

SEQ ID NO: 3288569 - RNA, 13 nt, Mycobacterium tuberculosis H37Rv
uccaccagccggu

SEQ ID NO: 3288570 - RNA, 22 nt, Mycobacterium tuberculosis H37Rv
uccaccagcguguagcgaugcc

SEQ ID NO: 3288571 - RNA, 18 nt, Mycobacterium tuberculosis H37Rv
uccaccaggacguggucg

SEQ ID NO: 3288572 - RNA, 19 nt, Mycobacterium tuberculosis H37Rv
uccacccaccuggaucagc

SEQ ID NO: 3288573 - RNA, 20 nt, Mycobacterium tuberculosis H37Rv
uccacccaccuggaucagcg

SEQ ID NO: 3288574 - RNA, 19 nt, Mycobacterium tuberculosis H37Rv
uccacccacgaucagcagc

SEQ ID NO: 3288575 - RNA, 23 nt, Mycobacterium tuberculosis H37Rv
uccacccaggccgaugugucgau

SEQ ID NO: 3288576 - RNA, 18 nt, Mycobacterium tuberculosis H37Rv
uccacccagugccacgcc

SEQ ID NO: 3288577 - RNA, 16 nt, Mycobacterium tuberculosis H37Rv
uccacccccacgcugc

SEQ ID NO: 3288578 - RNA, 22 nt, Mycobacterium tuberculosis H37Rv
uccaccccgccgaucaccgcug

SEQ ID NO: 3288579 - RNA, 14 nt, Mycobacterium tuberculosis H37Rv
uccacccgccggcc

SEQ ID NO: 3288580 - RNA, 22 nt, Mycobacterium tuberculosis H37Rv
uccacccgccggccgucggccg

SEQ ID NO: 3288581 - RNA, 22 nt, Mycobacterium tuberculosis H37Rv
uccaccgaaaaguccgccgccu

SEQ ID NO: 3288582 - RNA, 21 nt, Mycobacterium tuberculosis H37Rv
uccaccgacguggccagcccg

SEQ ID NO: 3288583 - RNA, 18 nt, Mycobacterium tuberculosis H37Rv
uccaccgauucggcgacg

SEQ ID NO: 3288584 - RNA, 23 nt, Mycobacterium tuberculosis H37Rv
uccaccgcagauccccgccaccg

SEQ ID NO: 3288585 - RNA, 12 nt, Mycobacterium tuberculosis H37Rv
uccaccgcaucg

SEQ ID NO: 3288586 - RNA, 13 nt, Mycobacterium tuberculosis H37Rv
uccaccgccacca

SEQ ID NO: 3288587 - RNA, 18 nt, Mycobacterium tuberculosis H37Rv
uccaccgccgacgcccga

SEQ ID NO: 3288588 - RNA, 19 nt, Mycobacterium tuberculosis H37Rv
uccaccgcgaugacgacga

SEQ ID NO: 3288589 - RNA, 22 nt, Mycobacterium tuberculosis H37Rv
uccaccgcgcggcgcagcaccg

SEQ ID NO: 3288590 - RNA, 23 nt, Mycobacterium tuberculosis H37Rv
uccaccgcugccggcagcguccg

SEQ ID NO: 3288591 - RNA, 17 nt, Mycobacterium tuberculosis H37Rv
uccaccggaccgaccac

SEQ ID NO: 3288592 - RNA, 13 nt, Mycobacterium tuberculosis H37Rv
uccaccggaucgu

SEQ ID NO: 3288593 - RNA, 19 nt, Mycobacterium tuberculosis H37Rv
uccaccgggauagccgcga

SEQ ID NO: 3288594 - RNA, 18 nt, Mycobacterium tuberculosis H37Rv
uccaccgggcccgccguc

SEQ ID NO: 3288595 - RNA, 17 nt, Mycobacterium tuberculosis H37Rv
uccaccgguccagggcc

SEQ ID NO: 3288596 - RNA, 18 nt, Mycobacterium tuberculosis H37Rv
uccaccgucgcaccagcg

SEQ ID NO: 3288597 - RNA, 18 nt, Mycobacterium tuberculosis H37Rv
uccaccguuagccagguc

SEQ ID NO: 3288598 - RNA, 20 nt, Mycobacterium tuberculosis H37Rv
uccaccucggcguuggaaaa

SEQ ID NO: 3288599 - RNA, 22 nt, Mycobacterium tuberculosis H37Rv
uccaccugcuccgcugucaccc

SEQ ID NO: 3288600 - RNA, 23 nt, Mycobacterium tuberculosis H37Rv
uccaccuuggccagacccaccac

SEQ ID NO: 3288601 - RNA, 14 nt, Mycobacterium tuberculosis H37Rv
uccacgacaaccgu

SEQ ID NO: 3288602 - RNA, 13 nt, Mycobacterium tuberculosis H37Rv
uccacgacgucga

SEQ ID NO: 3288603 - RNA, 21 nt, Mycobacterium tuberculosis H37Rv
uccacgauaucgaugcggcga

SEQ ID NO: 3288604 - RNA, 18 nt, Mycobacterium tuberculosis H37Rv
uccacgaucggcccagcc

SEQ ID NO: 3288605 - RNA, 13 nt, Mycobacterium tuberculosis H37Rv
uccacgcaccacg

SEQ ID NO: 3288606 - RNA, 23 nt, Mycobacterium tuberculosis H37Rv
uccacgcacucgucgggguugau

SEQ ID NO: 3288607 - RNA, 20 nt, Mycobacterium tuberculosis H37Rv
uccacgcacugccgcggacg

SEQ ID NO: 3288608 - RNA, 18 nt, Mycobacterium tuberculosis H37Rv
uccacgcagcccgucggc

SEQ ID NO: 3288609 - RNA, 18 nt, Mycobacterium tuberculosis H37Rv
uccacgccgggcaaggcc

SEQ ID NO: 3288610 - RNA, 17 nt, Mycobacterium tuberculosis H37Rv
uccacggcagcaccggu

SEQ ID NO: 3288611 - RNA, 20 nt, Mycobacterium tuberculosis H37Rv
uccacggcgaugcagccaca

SEQ ID NO: 3288612 - RNA, 20 nt, Mycobacterium tuberculosis H37Rv
uccacggguggugccagguc

SEQ ID NO: 3288613 - RNA, 20 nt, Mycobacterium tuberculosis H37Rv
uccacgguugccggcggcga

SEQ ID NO: 3288614 - RNA, 22 nt, Mycobacterium tuberculosis H37Rv
uccacgguugccggcggcgacg

SEQ ID NO: 3288615 - RNA, 18 nt, Mycobacterium tuberculosis H37Rv
uccacgucaucuggcgcu

SEQ ID NO: 3288616 - RNA, 15 nt, Mycobacterium tuberculosis H37Rv
uccacgucgcggcgu

SEQ ID NO: 3288617 - RNA, 12 nt, Mycobacterium tuberculosis H37Rv
uccacgucucga

SEQ ID NO: 3288618 - RNA, 12 nt, Mycobacterium tuberculosis H37Rv
uccacucggucu

SEQ ID NO: 3288619 - RNA, 15 nt, Mycobacterium tuberculosis H37Rv
uccacugaccagguc

SEQ ID NO: 3288620 - RNA, 19 nt, Mycobacterium tuberculosis H37Rv
uccacugacgucucaucaa

SEQ ID NO: 3288621 - RNA, 17 nt, Mycobacterium tuberculosis H37Rv
uccacugccaccgcgag

SEQ ID NO: 3288622 - RNA, 20 nt, Mycobacterium tuberculosis H37Rv
uccacugggccugccagucc

SEQ ID NO: 3288623 - RNA, 21 nt, Mycobacterium tuberculosis H37Rv
uccacugugcgagcugcgggu

SEQ ID NO: 3288624 - RNA, 18 nt, Mycobacterium tuberculosis H37Rv
uccacuuggggcgccagg

SEQ ID NO: 3288625 - RNA, 15 nt, Mycobacterium tuberculosis H37Rv
uccagaacgcaucgg

SEQ ID NO: 3288626 - RNA, 13 nt, Mycobacterium tuberculosis H37Rv
uccagaaggccgc

SEQ ID NO: 3288627 - RNA, 17 nt, Mycobacterium tuberculosis H37Rv
uccagaaggccgcaccg

SEQ ID NO: 3288628 - RNA, 18 nt, Mycobacterium tuberculosis H37Rv
uccagaaggccgcaccgc

SEQ ID NO: 3288629 - RNA, 20 nt, Mycobacterium tuberculosis H37Rv
uccagacguuccaucacgga

SEQ ID NO: 3288630 - RNA, 15 nt, Mycobacterium tuberculosis H37Rv
uccagagacagcgcc

SEQ ID NO: 3288631 - RNA, 17 nt, Mycobacterium tuberculosis H37Rv
uccagauaccaccgccg

SEQ ID NO: 3288632 - RNA, 16 nt, Mycobacterium tuberculosis H37Rv
uccagaucaacgcguc

SEQ ID NO: 3288633 - RNA, 15 nt, Mycobacterium tuberculosis H37Rv
uccagaugcccagca

SEQ ID NO: 3288634 - RNA, 15 nt, Mycobacterium tuberculosis H37Rv
uccagcaacgcggug

SEQ ID NO: 3288635 - RNA, 18 nt, Mycobacterium tuberculosis H37Rv
uccagcaaggccagcacg

SEQ ID NO: 3288636 - RNA, 13 nt, Mycobacterium tuberculosis H37Rv
uccagcaccaccg

SEQ ID NO: 3288637 - RNA, 24 nt, Mycobacterium tuberculosis H37Rv
uccagcaccacggcgcgcgcgccg

SEQ ID NO: 3288638 - RNA, 13 nt, Mycobacterium tuberculosis H37Rv
uccagcaccagca

SEQ ID NO: 3288639 - RNA, 23 nt, Mycobacterium tuberculosis H37Rv
uccagcaccgggaagucgggguc

SEQ ID NO: 3288640 - RNA, 12 nt, Mycobacterium tuberculosis H37Rv
uccagcacggcc

SEQ ID NO: 3288641 - RNA, 17 nt, Mycobacterium tuberculosis H37Rv
uccagcagccaggagcc

SEQ ID NO: 3288642 - RNA, 22 nt, Mycobacterium tuberculosis H37Rv
uccagcagcccgguggugcugu

SEQ ID NO: 3288643 - RNA, 18 nt, Mycobacterium tuberculosis H37Rv
uccagcagcgacgcugcc

SEQ ID NO: 3288644 - RNA, 21 nt, Mycobacterium tuberculosis H37Rv
uccagcagcgacgcugccgcc

SEQ ID NO: 3288645 - RNA, 13 nt, Mycobacterium tuberculosis H37Rv
uccagcagcgcca

SEQ ID NO: 3288646 - RNA, 14 nt, Mycobacterium tuberculosis H37Rv
uccagcagcgccuc

SEQ ID NO: 3288647 - RNA, 14 nt, Mycobacterium tuberculosis H37Rv
uccagcagcucggc

SEQ ID NO: 3288648 - RNA, 19 nt, Mycobacterium tuberculosis H37Rv
uccagcaggacggugaagc

SEQ ID NO: 3288649 - RNA, 23 nt, Mycobacterium tuberculosis H37Rv
uccagcaggccgggacagcgccg

SEQ ID NO: 3288650 - RNA, 17 nt, Mycobacterium tuberculosis H37Rv
uccagcaguacaccgcc

SEQ ID NO: 3288651 - RNA, 22 nt, Mycobacterium tuberculosis H37Rv
uccagcaucaguuugacgccga

SEQ ID NO: 3288652 - RNA, 23 nt, Mycobacterium tuberculosis H37Rv
uccagcaugcccgccauccgaug

SEQ ID NO: 3288653 - RNA, 15 nt, Mycobacterium tuberculosis H37Rv
uccagccacagcccg

SEQ ID NO: 3288654 - RNA, 17 nt, Mycobacterium tuberculosis H37Rv
uccagccaccgaccccg

SEQ ID NO: 3288655 - RNA, 12 nt, Mycobacterium tuberculosis H37Rv
uccagccaggcc

SEQ ID NO: 3288656 - RNA, 23 nt, Mycobacterium tuberculosis H37Rv
uccagcccaugcgccacgccacu

SEQ ID NO: 3288657 - RNA, 21 nt, Mycobacterium tuberculosis H37Rv
uccagccccaucgcuggucga

SEQ ID NO: 3288658 - RNA, 15 nt, Mycobacterium tuberculosis H37Rv
uccagcccgagcaga

SEQ ID NO: 3288659 - RNA, 12 nt, Mycobacterium tuberculosis H37Rv
ucccccgcgaag

SEQ ID NO: 3288660 - RNA, 16 nt, Mycobacterium tuberculosis H37Rv
ucccccgcgcgaaccg

SEQ ID NO: 3288661 - RNA, 20 nt, Mycobacterium tuberculosis H37Rv
ucccccgcuacgcgcgcucg

SEQ ID NO: 3288662 - RNA, 15 nt, Mycobacterium tuberculosis H37Rv
uccccgaccgaaccg

SEQ ID NO: 3288663 - RNA, 17 nt, Mycobacterium tuberculosis H37Rv
uccccgaccgccaccgc

SEQ ID NO: 3288664 - RNA, 21 nt, Mycobacterium tuberculosis H37Rv
uccccgaucugcuccucgguc

SEQ ID NO: 3288665 - RNA, 14 nt, Mycobacterium tuberculosis H37Rv
uccccgcccuugcc

SEQ ID NO: 3288666 - RNA, 14 nt, Mycobacterium tuberculosis H37Rv
uccccgccgccguu

SEQ ID NO: 3288667 - RNA, 21 nt, Mycobacterium tuberculosis H37Rv
uccccgccggaacugcgcaac

SEQ ID NO: 3288668 - RNA, 21 nt, Mycobacterium tuberculosis H37Rv
uccccgccggcggguuuugau

SEQ ID NO: 3288669 - RNA, 15 nt, Mycobacterium tuberculosis H37Rv
uccccgcgcugagca

SEQ ID NO: 3288670 - RNA, 16 nt, Mycobacterium tuberculosis H37Rv
uccccgcgcugagcac

SEQ ID NO: 3288671 - RNA, 14 nt, Mycobacterium tuberculosis H37Rv
uccccgcuuggcga

SEQ ID NO: 3288672 - RNA, 22 nt, Mycobacterium tuberculosis H37Rv
uccccggagaacuugagcuccu

SEQ ID NO: 3288673 - RNA, 16 nt, Mycobacterium tuberculosis H37Rv
uccccggauuccucgu

SEQ ID NO: 3288674 - RNA, 21 nt, Mycobacterium tuberculosis H37Rv
uccccggauuccucgucaccg

SEQ ID NO: 3288675 - RNA, 20 nt, Mycobacterium tuberculosis H37Rv
uccccggcggcagcauaucc

SEQ ID NO: 3288676 - RNA, 19 nt, Mycobacterium tuberculosis H37Rv
uccccggcugccagcgccg

SEQ ID NO: 3288677 - RNA, 14 nt, Mycobacterium tuberculosis H37Rv
uccccgggcucggu

SEQ ID NO: 3288678 - RNA, 22 nt, Mycobacterium tuberculosis H37Rv
uccccgguacgucgagggugac

SEQ ID NO: 3288679 - RNA, 15 nt, Mycobacterium tuberculosis H37Rv
uccccgguagccccg

SEQ ID NO: 3288680 - RNA, 17 nt, Mycobacterium tuberculosis H37Rv
uccccggucgccgcguc

SEQ ID NO: 3288681 - RNA, 18 nt, Mycobacterium tuberculosis H37Rv
uccccguccugccagucc

SEQ ID NO: 3288682 - RNA, 13 nt, Mycobacterium tuberculosis H37Rv
uccccucggccgc

SEQ ID NO: 3288683 - RNA, 15 nt, Mycobacterium tuberculosis H37Rv
uccccugauggaccc

SEQ ID NO: 3288684 - RNA, 19 nt, Mycobacterium tuberculosis H37Rv
uccccuggccaaccggguc

SEQ ID NO: 3288685 - RNA, 13 nt, Mycobacterium tuberculosis H37Rv
uccccuggccagc

SEQ ID NO: 3288686 - RNA, 15 nt, Mycobacterium tuberculosis H37Rv
ucccgaaacccgaug

SEQ ID NO: 3288687 - RNA, 14 nt, Mycobacterium tuberculosis H37Rv
ucccgaaacgccgg

SEQ ID NO: 3288688 - RNA, 17 nt, Mycobacterium tuberculosis H37Rv
ucccgaaauucucgccc

SEQ ID NO: 3288689 - RNA, 23 nt, Mycobacterium tuberculosis H37Rv
ucccgaacaacucggugccuguc

SEQ ID NO: 3288690 - RNA, 21 nt, Mycobacterium tuberculosis H37Rv
ucccgaacaauucacgcacca

SEQ ID NO: 3288691 - RNA, 21 nt, Mycobacterium tuberculosis H37Rv
ucccgaacacuuugcgcacua

SEQ ID NO: 3288692 - RNA, 19 nt, Mycobacterium tuberculosis H37Rv
ucccgaaucucacccacau

SEQ ID NO: 3288693 - RNA, 14 nt, Mycobacterium tuberculosis H37Rv
ucccgaccagcaga

SEQ ID NO: 3288694 - RNA, 24 nt, Mycobacterium tuberculosis H37Rv
ucccgacccuucgggcuggucggu

SEQ ID NO: 3288695 - RNA, 15 nt, Mycobacterium tuberculosis H37Rv
ucccgacgucggccu

SEQ ID NO: 3288696 - RNA, 20 nt, Mycobacterium tuberculosis H37Rv
ucccgagcccgucagcuccc

SEQ ID NO: 3288697 - RNA, 19 nt, Mycobacterium tuberculosis H37Rv
ucccgaguugcccucuggc

SEQ ID NO: 3288698 - RNA, 17 nt, Mycobacterium tuberculosis H37Rv
ucccgaucgcgcuggga

SEQ ID NO: 3288699 - RNA, 14 nt, Mycobacterium tuberculosis H37Rv
ucccgaugaccuug

SEQ ID NO: 3288700 - RNA, 21 nt, Mycobacterium tuberculosis H37Rv
ucccgaugguggccgcgcggu

SEQ ID NO: 3288701 - RNA, 19 nt, Mycobacterium tuberculosis H37Rv
ucccgauguaugacagguc

SEQ ID NO: 3288702 - RNA, 20 nt, Mycobacterium tuberculosis H37Rv
ucccgauguaugacagguca

SEQ ID NO: 3288703 - RNA, 14 nt, Mycobacterium tuberculosis H37Rv
ucccgcaaugcgag

SEQ ID NO: 3288704 - RNA, 13 nt, Mycobacterium tuberculosis H37Rv
ucccgcaauucgc

SEQ ID NO: 3288705 - RNA, 20 nt, Mycobacterium tuberculosis H37Rv
ucccgcacaagcccagcccg

SEQ ID NO: 3288706 - RNA, 14 nt, Mycobacterium tuberculosis H37Rv
ucccgcagccgggc

SEQ ID NO: 3288707 - RNA, 18 nt, Mycobacterium tuberculosis H37Rv
ucccgcaggcucaccgag

SEQ ID NO: 3288708 - RNA, 20 nt, Mycobacterium tuberculosis H37Rv
ucccgcaggcucaccgagcc

SEQ ID NO: 3288709 - RNA, 21 nt, Mycobacterium tuberculosis H37Rv
ucccgcaggcucaccgagccg

SEQ ID NO: 3288710 - RNA, 16 nt, Mycobacterium tuberculosis H37Rv
ucccgcauugacgaaa

SEQ ID NO: 3288711 - RNA, 14 nt, Mycobacterium tuberculosis H37Rv
ucccgccacgucgc

SEQ ID NO: 3288712 - RNA, 14 nt, Mycobacterium tuberculosis H37Rv
ucccgcccagcagc

SEQ ID NO: 3288713 - RNA, 18 nt, Mycobacterium tuberculosis H37Rv
ucccgccgaccgacacca

SEQ ID NO: 3288714 - RNA, 19 nt, Mycobacterium tuberculosis H37Rv
ucccgccgaccgacaccac

SEQ ID NO: 3288715 - RNA, 15 nt, Mycobacterium tuberculosis H37Rv
ucccgccgaucgaac

SEQ ID NO: 3288716 - RNA, 14 nt, Mycobacterium tuberculosis H37Rv
ucccgccgcaccgc

SEQ ID NO: 3288717 - RNA, 14 nt, Mycobacterium tuberculosis H37Rv
ucccgccgccugga

SEQ ID NO: 3288718 - RNA, 14 nt, Mycobacterium tuberculosis H37Rv
ucccgccgcgcguc

SEQ ID NO: 3288719 - RNA, 20 nt, Mycobacterium tuberculosis H37Rv
ucccgccggccccgccgaug

SEQ ID NO: 3288720 - RNA, 14 nt, Mycobacterium tuberculosis H37Rv
ucccgccggucacg

SEQ ID NO: 3288721 - RNA, 19 nt, Mycobacterium tuberculosis H37Rv
ucccgccgugcugcggcga

SEQ ID NO: 3288722 - RNA, 21 nt, Mycobacterium tuberculosis H37Rv
ucccgccgugcugcggcgacg

SEQ ID NO: 3288723 - RNA, 16 nt, Mycobacterium tuberculosis H37Rv
ucccgccguugccgcc

SEQ ID NO: 3288724 - RNA, 22 nt, Mycobacterium tuberculosis H37Rv
ucccgccguugccgccgucacc

SEQ ID NO: 3288725 - RNA, 23 nt, Mycobacterium tuberculosis H37Rv
ucccgccguugccgccgucaccg

SEQ ID NO: 3288726 - RNA, 23 nt, Mycobacterium tuberculosis H37Rv
ucccgccuucucccgcacggccg

SEQ ID NO: 3288727 - RNA, 23 nt, Mycobacterium tuberculosis H37Rv
ucccgcgagcggaugaaaucggc

SEQ ID NO: 3288728 - RNA, 13 nt, Mycobacterium tuberculosis H37Rv
ucccgcgaucgcg

SEQ ID NO: 3288729 - RNA, 17 nt, Mycobacterium tuberculosis H37Rv
ucccgcgccggcguugc

SEQ ID NO: 3288730 - RNA, 14 nt, Mycobacterium tuberculosis H37Rv
ucccgcgcgagccg

SEQ ID NO: 3288731 - RNA, 12 nt, Mycobacterium tuberculosis H37Rv
ucccgcgcggcg

SEQ ID NO: 3288732 - RNA, 13 nt, Mycobacterium tuberculosis H37Rv
ucccgcucgcagg

SEQ ID NO: 3288733 - RNA, 23 nt, Mycobacterium tuberculosis H37Rv
ucccgcuugaucugggcugcggc

SEQ ID NO: 3288734 - RNA, 17 nt, Mycobacterium tuberculosis H37Rv
ucccggaauauggcggc

SEQ ID NO: 3288735 - RNA, 15 nt, Mycobacterium tuberculosis H37Rv
ucccggaccaucgcc

SEQ ID NO: 3288736 - RNA, 17 nt, Mycobacterium tuberculosis H37Rv
ucccggauauugccauc

SEQ ID NO: 3288737 - RNA, 12 nt, Mycobacterium tuberculosis H37Rv
ucccggccaggc

SEQ ID NO: 3288738 - RNA, 20 nt, Mycobacterium tuberculosis H37Rv
ucccggccgucgcgcgaccg

SEQ ID NO: 3288739 - RNA, 15 nt, Mycobacterium tuberculosis H37Rv
ucccggccucgaugu

SEQ ID NO: 3288740 - RNA, 23 nt, Mycobacterium tuberculosis H37Rv
ucccggccucgaugucgcggucg

SEQ ID NO: 3288741 - RNA, 16 nt, Mycobacterium tuberculosis H37Rv
ucccggcgaccggguc

SEQ ID NO: 3288742 - RNA, 22 nt, Mycobacterium tuberculosis H37Rv
ucccggcgaccggguccggcgu

SEQ ID NO: 3288743 - RNA, 14 nt, Mycobacterium tuberculosis H37Rv
ucccggcggucagc

SEQ ID NO: 3288744 - RNA, 19 nt, Mycobacterium tuberculosis H37Rv
ucccggcucgagcucggcg

SEQ ID NO: 3288745 - RNA, 14 nt, Mycobacterium tuberculosis H37Rv
ucccggcuggggcc

SEQ ID NO: 3288746 - RNA, 21 nt, Mycobacterium tuberculosis H37Rv
ucccgggccgccgcgauggcc

SEQ ID NO: 3288747 - RNA, 19 nt, Mycobacterium tuberculosis H37Rv
ucccgggcggcggccuggg

SEQ ID NO: 3288748 - RNA, 17 nt, Mycobacterium tuberculosis H37Rv
ucccgggggcacuccgg

SEQ ID NO: 3288749 - RNA, 22 nt, Mycobacterium tuberculosis H37Rv
ucccggggugccgaucgaugcc

SEQ ID NO: 3288750 - RNA, 18 nt, Mycobacterium tuberculosis H37Rv
ucccgggugcgacgcgac

SEQ ID NO: 3288751 - RNA, 20 nt, Mycobacterium tuberculosis H37Rv
ucccgggugcgacgcgaccg

SEQ ID NO: 3288752 - RNA, 21 nt, Mycobacterium tuberculosis H37Rv
ucccggucgguguggacuggg

SEQ ID NO: 3288753 - RNA, 17 nt, Mycobacterium tuberculosis H37Rv
ucccggucuacgacguc

SEQ ID NO: 3288754 - RNA, 18 nt, Mycobacterium tuberculosis H37Rv
ucccggugaccacuugca

SEQ ID NO: 3288755 - RNA, 19 nt, Mycobacterium tuberculosis H37Rv
uccgccgauagcaccggaa

SEQ ID NO: 3288756 - RNA, 22 nt, Mycobacterium tuberculosis H37Rv
uccgccgcagaccugcaucaca

SEQ ID NO: 3288757 - RNA, 14 nt, Mycobacterium tuberculosis H37Rv
uccgccgccgacgg

SEQ ID NO: 3288758 - RNA, 22 nt, Mycobacterium tuberculosis H37Rv
uccgccgccgccaucgccgaug

SEQ ID NO: 3288759 - RNA, 14 nt, Mycobacterium tuberculosis H37Rv
uccgccgccggguu

SEQ ID NO: 3288760 - RNA, 13 nt, Mycobacterium tuberculosis H37Rv
uccgccggcccca

SEQ ID NO: 3288761 - RNA, 16 nt, Mycobacterium tuberculosis H37Rv
uccgccgggccaggcc

SEQ ID NO: 3288762 - RNA, 22 nt, Mycobacterium tuberculosis H37Rv
uccgccgggcucagcugggccg

SEQ ID NO: 3288763 - RNA, 17 nt, Mycobacterium tuberculosis H37Rv
uccgccgucgccgccgg

SEQ ID NO: 3288764 - RNA, 17 nt, Mycobacterium tuberculosis H37Rv
uccgccguugacgccgu

SEQ ID NO: 3288765 - RNA, 18 nt, Mycobacterium tuberculosis H37Rv
uccgccguugccgauccc

SEQ ID NO: 3288766 - RNA, 20 nt, Mycobacterium tuberculosis H37Rv
uccgccguugccgaucccca

SEQ ID NO: 3288767 - RNA, 22 nt, Mycobacterium tuberculosis H37Rv
uccgccguugccgauccccagg

SEQ ID NO: 3288768 - RNA, 19 nt, Mycobacterium tuberculosis H37Rv
uccgccguugccgccgccu

SEQ ID NO: 3288769 - RNA, 22 nt, Mycobacterium tuberculosis H37Rv
uccgccuaagcauucagcgcgc

SEQ ID NO: 3288770 - RNA, 19 nt, Mycobacterium tuberculosis H37Rv
uccgcgacaccuguucacc

SEQ ID NO: 3288771 - RNA, 21 nt, Mycobacterium tuberculosis H37Rv
uccgcgacgcucgcugcagca

SEQ ID NO: 3288772 - RNA, 14 nt, Mycobacterium tuberculosis H37Rv
uccgcgagcccggc

SEQ ID NO: 3288773 - RNA, 19 nt, Mycobacterium tuberculosis H37Rv
uccgcgaguagaucaucga

SEQ ID NO: 3288774 - RNA, 16 nt, Mycobacterium tuberculosis H37Rv
uccgcgaucaccgacg

SEQ ID NO: 3288775 - RNA, 19 nt, Mycobacterium tuberculosis H37Rv
uccgcgaucugcagcgcgg

SEQ ID NO: 3288776 - RNA, 12 nt, Mycobacterium tuberculosis H37Rv
uccgcgaugugc

SEQ ID NO: 3288777 - RNA, 14 nt, Mycobacterium tuberculosis H37Rv
uccgcgaugugggc

SEQ ID NO: 3288778 - RNA, 23 nt, Mycobacterium tuberculosis H37Rv
uccgcgcaacuuccauuuucgcc

SEQ ID NO: 3288779 - RNA, 18 nt, Mycobacterium tuberculosis H37Rv
uccgcgccaguggccacc

SEQ ID NO: 3288780 - RNA, 22 nt, Mycobacterium tuberculosis H37Rv
uccgcgccgacggccagcagga

SEQ ID NO: 3288781 - RNA, 12 nt, Mycobacterium tuberculosis H37Rv
uccgcgccgauc

SEQ ID NO: 3288782 - RNA, 21 nt, Mycobacterium tuberculosis H37Rv
uccgcgccgcucaucgggcac

SEQ ID NO: 3288783 - RNA, 21 nt, Mycobacterium tuberculosis H37Rv
uccgcgcgcaagucgauguac

SEQ ID NO: 3288784 - RNA, 24 nt, Mycobacterium tuberculosis H37Rv
uccgcgcgcaagucgauguacacc

SEQ ID NO: 3288785 - RNA, 12 nt, Mycobacterium tuberculosis H37Rv
uccgcgcgguuu

SEQ ID NO: 3288786 - RNA, 17 nt, Mycobacterium tuberculosis H37Rv
uccgcgcuucacagcca

SEQ ID NO: 3288787 - RNA, 12 nt, Mycobacterium tuberculosis H37Rv
uccgcggaaccc

SEQ ID NO: 3288788 - RNA, 17 nt, Mycobacterium tuberculosis H37Rv
uccgcggaucaccaucg

SEQ ID NO: 3288789 - RNA, 20 nt, Mycobacterium tuberculosis H37Rv
uccgcggaucugguccagug

SEQ ID NO: 3288790 - RNA, 17 nt, Mycobacterium tuberculosis H37Rv
uccgcggcauuggcguc

SEQ ID NO: 3288791 - RNA, 14 nt, Mycobacterium tuberculosis H37Rv
uccgcggccgcggu

SEQ ID NO: 3288792 - RNA, 11 nt, Mycobacterium tuberculosis H37Rv
uccgcggcgca

SEQ ID NO: 3288793 - RNA, 14 nt, Mycobacterium tuberculosis H37Rv
uccgcggcgcagca

SEQ ID NO: 3288794 - RNA, 23 nt, Mycobacterium tuberculosis H37Rv
uccgcgguguuggacgcgggccg

SEQ ID NO: 3288795 - RNA, 16 nt, Mycobacterium tuberculosis H37Rv
uccgcguagagcagca

SEQ ID NO: 3288796 - RNA, 19 nt, Mycobacterium tuberculosis H37Rv
uccgcguagagcagcagcg

SEQ ID NO: 3288797 - RNA, 13 nt, Mycobacterium tuberculosis H37Rv
uccgcgucgccgg

SEQ ID NO: 3288798 - RNA, 22 nt, Mycobacterium tuberculosis H37Rv
uccgcgucggucagcugugcga

SEQ ID NO: 3288799 - RNA, 13 nt, Mycobacterium tuberculosis H37Rv
uccgcgucgucga

SEQ ID NO: 3288800 - RNA, 17 nt, Mycobacterium tuberculosis H37Rv
uccgcgucugcucggcg

SEQ ID NO: 3288801 - RNA, 17 nt, Mycobacterium tuberculosis H37Rv
uccgcgucuggacgcga

SEQ ID NO: 3288802 - RNA, 16 nt, Mycobacterium tuberculosis H37Rv
uccgcguggugcugac

SEQ ID NO: 3288803 - RNA, 18 nt, Mycobacterium tuberculosis H37Rv
uccgcguggugcugaccg

SEQ ID NO: 3288804 - RNA, 23 nt, Mycobacterium tuberculosis H37Rv
uccgcguggugcugaccgcgccg

SEQ ID NO: 3288805 - RNA, 16 nt, Mycobacterium tuberculosis H37Rv
uccgcguugggcaccu

SEQ ID NO: 3288806 - RNA, 17 nt, Mycobacterium tuberculosis H37Rv
uccgcuaggucagguga

SEQ ID NO: 3288807 - RNA, 20 nt, Mycobacterium tuberculosis H37Rv
uccgcucgaaucgucacgga

SEQ ID NO: 3288808 - RNA, 14 nt, Mycobacterium tuberculosis H37Rv
uccgcucgccgcca

SEQ ID NO: 3288809 - RNA, 15 nt, Mycobacterium tuberculosis H37Rv
uccgcugaacaccgu

SEQ ID NO: 3288810 - RNA, 16 nt, Mycobacterium tuberculosis H37Rv
uccgcugaacaccgug

SEQ ID NO: 3288811 - RNA, 22 nt, Mycobacterium tuberculosis H37Rv
uccgcugguggaguucgcgcug

SEQ ID NO: 3288812 - RNA, 20 nt, Mycobacterium tuberculosis H37Rv
uccgcugucgagccggugcc

SEQ ID NO: 3288813 - RNA, 21 nt, Mycobacterium tuberculosis H37Rv
uccgcugucgagccggugccg

SEQ ID NO: 3288814 - RNA, 15 nt, Mycobacterium tuberculosis H37Rv
uccgcuguuccucga

SEQ ID NO: 3288815 - RNA, 22 nt, Mycobacterium tuberculosis H37Rv
uccggaagcggcguucgaugcc

SEQ ID NO: 3288816 - RNA, 20 nt, Mycobacterium tuberculosis H37Rv
uccggaauagcaacgcugca

SEQ ID NO: 3288817 - RNA, 22 nt, Mycobacterium tuberculosis H37Rv
uccggacccacccgcaccgccg

SEQ ID NO: 3288818 - RNA, 18 nt, Mycobacterium tuberculosis H37Rv
uccggaguuuaagacgcc

SEQ ID NO: 3288819 - RNA, 19 nt, Mycobacterium tuberculosis H37Rv
uccggauaacccagcggcg

SEQ ID NO: 3288820 - RNA, 21 nt, Mycobacterium tuberculosis H37Rv
uccggauccucggccgccauc

SEQ ID NO: 3288821 - RNA, 15 nt, Mycobacterium tuberculosis H37Rv
uccggaucgccgaau

SEQ ID NO: 3288822 - RNA, 20 nt, Mycobacterium tuberculosis H37Rv
uccggaucggccuguccacc

SEQ ID NO: 3288823 - RNA, 15 nt, Mycobacterium tuberculosis H37Rv
uccggcaaccaccgg

SEQ ID NO: 3288824 - RNA, 18 nt, Mycobacterium tuberculosis H37Rv
uccggcaaccaccggccg

SEQ ID NO: 3288825 - RNA, 18 nt, Mycobacterium tuberculosis H37Rv
uccggcaagcacaccgcc

SEQ ID NO: 3288826 - RNA, 19 nt, Mycobacterium tuberculosis H37Rv
uccggcaagcacaccgcca

SEQ ID NO: 3288827 - RNA, 20 nt, Mycobacterium tuberculosis H37Rv
uccggcaagcacaccgccag

SEQ ID NO: 3288828 - RNA, 23 nt, Mycobacterium tuberculosis H37Rv
uccggcaagcacaccgccagcgg

SEQ ID NO: 3288829 - RNA, 18 nt, Mycobacterium tuberculosis H37Rv
uccggcaccaacgccacc

SEQ ID NO: 3288830 - RNA, 14 nt, Mycobacterium tuberculosis H37Rv
uccggcaccuccag

SEQ ID NO: 3288831 - RNA, 13 nt, Mycobacterium tuberculosis H37Rv
uccggcacgcguc

SEQ ID NO: 3288832 - RNA, 19 nt, Mycobacterium tuberculosis H37Rv
uccggcacugcggccaguc

SEQ ID NO: 3288833 - RNA, 16 nt, Mycobacterium tuberculosis H37Rv
uccggcauacaucgcc

SEQ ID NO: 3288834 - RNA, 15 nt, Mycobacterium tuberculosis H37Rv
uccggcauaccgaac

SEQ ID NO: 3288835 - RNA, 22 nt, Mycobacterium tuberculosis H37Rv
uccggccacacucgccagggcc

SEQ ID NO: 3288836 - RNA, 14 nt, Mycobacterium tuberculosis H37Rv
uccggccacuccgg

SEQ ID NO: 3288837 - RNA, 19 nt, Mycobacterium tuberculosis H37Rv
uccggccaggggaucaccg

SEQ ID NO: 3288838 - RNA, 15 nt, Mycobacterium tuberculosis H37Rv
uccggccaguccaag

SEQ ID NO: 3288839 - RNA, 15 nt, Mycobacterium tuberculosis H37Rv
uccggcccaccagcg

SEQ ID NO: 3288840 - RNA, 17 nt, Mycobacterium tuberculosis H37Rv
uccggcccaccagcgca

SEQ ID NO: 3288841 - RNA, 18 nt, Mycobacterium tuberculosis H37Rv
uccggcccaccagcgcag

SEQ ID NO: 3288842 - RNA, 16 nt, Mycobacterium tuberculosis H37Rv
uccggcccacucacac

SEQ ID NO: 3288843 - RNA, 17 nt, Mycobacterium tuberculosis H37Rv
uccggcccguagcugcg

SEQ ID NO: 3288844 - RNA, 20 nt, Mycobacterium tuberculosis H37Rv
uccggcccguagcugcgcag

SEQ ID NO: 3288845 - RNA, 15 nt, Mycobacterium tuberculosis H37Rv
uccggcccugccgcc

SEQ ID NO: 3288846 - RNA, 22 nt, Mycobacterium tuberculosis H37Rv
uccggccgaugcgacccgcaga

SEQ ID NO: 3288847 - RNA, 17 nt, Mycobacterium tuberculosis H37Rv
uccggccgggcccucca

SEQ ID NO: 3288848 - RNA, 19 nt, Mycobacterium tuberculosis H37Rv
uccggccgguaguagcuga

SEQ ID NO: 3288849 - RNA, 17 nt, Mycobacterium tuberculosis H37Rv
uccggccgguccgggaa

SEQ ID NO: 3288850 - RNA, 22 nt, Mycobacterium tuberculosis H37Rv
uccggccgguuggccagccaca

SEQ ID NO: 3288851 - RNA, 20 nt, Mycobacterium tuberculosis H37Rv
uccucaaggucggccaggcu

SEQ ID NO: 3288852 - RNA, 22 nt, Mycobacterium tuberculosis H37Rv
uccuccaaggcggucaccaccg

SEQ ID NO: 3288853 - RNA, 20 nt, Mycobacterium tuberculosis H37Rv
uccuccagagacagcgccau

SEQ ID NO: 3288854 - RNA, 13 nt, Mycobacterium tuberculosis H37Rv
uccuccagcagcg

SEQ ID NO: 3288855 - RNA, 16 nt, Mycobacterium tuberculosis H37Rv
uccucccaucccaugu

SEQ ID NO: 3288856 - RNA, 22 nt, Mycobacterium tuberculosis H37Rv
uccuccggcaccaacgccaccg

SEQ ID NO: 3288857 - RNA, 18 nt, Mycobacterium tuberculosis H37Rv
uccuccggguuggcgacg

SEQ ID NO: 3288858 - RNA, 18 nt, Mycobacterium tuberculosis H37Rv
uccuccgguaucggcgac

SEQ ID NO: 3288859 - RNA, 16 nt, Mycobacterium tuberculosis H37Rv
uccuccugcgccgcag

SEQ ID NO: 3288860 - RNA, 23 nt, Mycobacterium tuberculosis H37Rv
uccuccuggaugaaguguuuggc

SEQ ID NO: 3288861 - RNA, 23 nt, Mycobacterium tuberculosis H37Rv
uccucgacacccauccucgcggu

SEQ ID NO: 3288862 - RNA, 18 nt, Mycobacterium tuberculosis H37Rv
uccucgacguggccgacg

SEQ ID NO: 3288863 - RNA, 17 nt, Mycobacterium tuberculosis H37Rv
uccucgagugccgccgu

SEQ ID NO: 3288864 - RNA, 22 nt, Mycobacterium tuberculosis H37Rv
uccucgagugccgccgucgcca

SEQ ID NO: 3288865 - RNA, 17 nt, Mycobacterium tuberculosis H37Rv
uccucgauagcggcgcc

SEQ ID NO: 3288866 - RNA, 19 nt, Mycobacterium tuberculosis H37Rv
uccucgauauggguugcca

SEQ ID NO: 3288867 - RNA, 11 nt, Mycobacterium tuberculosis H37Rv
uccucgaucgu

SEQ ID NO: 3288868 - RNA, 20 nt, Mycobacterium tuberculosis H37Rv
uccucgcccauuggccaggu

SEQ ID NO: 3288869 - RNA, 18 nt, Mycobacterium tuberculosis H37Rv
uccucgcccgcaccagcu

SEQ ID NO: 3288870 - RNA, 22 nt, Mycobacterium tuberculosis H37Rv
uccucgcgguaguugucccgcc

SEQ ID NO: 3288871 - RNA, 20 nt, Mycobacterium tuberculosis H37Rv
uccucggacugaagagcaau

SEQ ID NO: 3288872 - RNA, 15 nt, Mycobacterium tuberculosis H37Rv
uccucggcaggaagg

SEQ ID NO: 3288873 - RNA, 19 nt, Mycobacterium tuberculosis H37Rv
uccucggcgguaaaugccu

SEQ ID NO: 3288874 - RNA, 21 nt, Mycobacterium tuberculosis H37Rv
uccucggcguggcaguacacc

SEQ ID NO: 3288875 - RNA, 20 nt, Mycobacterium tuberculosis H37Rv
uccucggguucgucagucaa

SEQ ID NO: 3288876 - RNA, 14 nt, Mycobacterium tuberculosis H37Rv
uccucggucaccga

SEQ ID NO: 3288877 - RNA, 13 nt, Mycobacterium tuberculosis H37Rv
uccucggucacga

SEQ ID NO: 3288878 - RNA, 13 nt, Mycobacterium tuberculosis H37Rv
uccucggucagcu

SEQ ID NO: 3288879 - RNA, 19 nt, Mycobacterium tuberculosis H37Rv
uccucggucagcucgucgg

SEQ ID NO: 3288880 - RNA, 22 nt, Mycobacterium tuberculosis H37Rv
uccucggugugcucgccgacca

SEQ ID NO: 3288881 - RNA, 21 nt, Mycobacterium tuberculosis H37Rv
uccucgucgaggucagcuccc

SEQ ID NO: 3288882 - RNA, 18 nt, Mycobacterium tuberculosis H37Rv
uccucugaaccugcugag

SEQ ID NO: 3288883 - RNA, 14 nt, Mycobacterium tuberculosis H37Rv
uccugaccagccag

SEQ ID NO: 3288884 - RNA, 19 nt, Mycobacterium tuberculosis H37Rv
uccugaccagccaggugau

SEQ ID NO: 3288885 - RNA, 13 nt, Mycobacterium tuberculosis H37Rv
uccugcagcuggc

SEQ ID NO: 3288886 - RNA, 16 nt, Mycobacterium tuberculosis H37Rv
uccugcaggaucaaaa

SEQ ID NO: 3288887 - RNA, 17 nt, Mycobacterium tuberculosis H37Rv
uccugcagugcggcguu

SEQ ID NO: 3288888 - RNA, 19 nt, Mycobacterium tuberculosis H37Rv
uccugccaaugcugcaggu

SEQ ID NO: 3288889 - RNA, 20 nt, Mycobacterium tuberculosis H37Rv
uccugcgccgguaacugucc

SEQ ID NO: 3288890 - RNA, 15 nt, Mycobacterium tuberculosis H37Rv
uccugcggcaccgcu

SEQ ID NO: 3288891 - RNA, 17 nt, Mycobacterium tuberculosis H37Rv
uccugcggcaccgcuga

SEQ ID NO: 3288892 - RNA, 18 nt, Mycobacterium tuberculosis H37Rv
uccugcgucaaguccgag

SEQ ID NO: 3288893 - RNA, 18 nt, Mycobacterium tuberculosis H37Rv
uccugcuuguagcgcauc

SEQ ID NO: 3288894 - RNA, 20 nt, Mycobacterium tuberculosis H37Rv
uccuggaaaggacggccggc

SEQ ID NO: 3288895 - RNA, 14 nt, Mycobacterium tuberculosis H37Rv
uccuggaucgcggu

SEQ ID NO: 3288896 - RNA, 20 nt, Mycobacterium tuberculosis H37Rv
uccuggaugaaguguuuggc

SEQ ID NO: 3288897 - RNA, 19 nt, Mycobacterium tuberculosis H37Rv
uccuggccacucccagcca

SEQ ID NO: 3288898 - RNA, 21 nt, Mycobacterium tuberculosis H37Rv
uccuggccggugguagcggac

SEQ ID NO: 3288899 - RNA, 23 nt, Mycobacterium tuberculosis H37Rv
uccuggcgcagcgccucgguaaa

SEQ ID NO: 3288900 - RNA, 13 nt, Mycobacterium tuberculosis H37Rv
uccuggcggcugc

SEQ ID NO: 3288901 - RNA, 18 nt, Mycobacterium tuberculosis H37Rv
uccugggcccgaaucgcc

SEQ ID NO: 3288902 - RNA, 16 nt, Mycobacterium tuberculosis H37Rv
uccugggccgccgccc

SEQ ID NO: 3288903 - RNA, 21 nt, Mycobacterium tuberculosis H37Rv
uccugggccgccgcccugguc

SEQ ID NO: 3288904 - RNA, 22 nt, Mycobacterium tuberculosis H37Rv
uccuggggugucaaucacccag

SEQ ID NO: 3288905 - RNA, 21 nt, Mycobacterium tuberculosis H37Rv
uccuggguguagcaagucgcc

SEQ ID NO: 3288906 - RNA, 14 nt, Mycobacterium tuberculosis H37Rv
uccuggguugugcc

SEQ ID NO: 3288907 - RNA, 17 nt, Mycobacterium tuberculosis H37Rv
uccugguaggugucgug

SEQ ID NO: 3288908 - RNA, 14 nt, Mycobacterium tuberculosis H37Rv
uccugguggcagac

SEQ ID NO: 3288909 - RNA, 13 nt, Mycobacterium tuberculosis H37Rv
uccuucaccagcu

SEQ ID NO: 3288910 - RNA, 15 nt, Mycobacterium tuberculosis H37Rv
uccuucagccagucc

SEQ ID NO: 3288911 - RNA, 14 nt, Mycobacterium tuberculosis H37Rv
uccuuccuggguug

SEQ ID NO: 3288912 - RNA, 21 nt, Mycobacterium tuberculosis H37Rv
uccuucuccagauccacgccg

SEQ ID NO: 3288913 - RNA, 19 nt, Mycobacterium tuberculosis H37Rv
uccuugaggucacccauca

SEQ ID NO: 3288914 - RNA, 19 nt, Mycobacterium tuberculosis H37Rv
uccuugcgccagcgggcug

SEQ ID NO: 3288915 - RNA, 13 nt, Mycobacterium tuberculosis H37Rv
uccuugucggccc

SEQ ID NO: 3288916 - RNA, 18 nt, Mycobacterium tuberculosis H37Rv
ucgaaaaccgaggcauuc

SEQ ID NO: 3288917 - RNA, 16 nt, Mycobacterium tuberculosis H37Rv
ucgaaagccaacucga

SEQ ID NO: 3288918 - RNA, 17 nt, Mycobacterium tuberculosis H37Rv
ucgaaagcgauauugga

SEQ ID NO: 3288919 - RNA, 13 nt, Mycobacterium tuberculosis H37Rv
ucgaacaccgucc

SEQ ID NO: 3288920 - RNA, 19 nt, Mycobacterium tuberculosis H37Rv
ucgaacaccguccaauugg

SEQ ID NO: 3288921 - RNA, 21 nt, Mycobacterium tuberculosis H37Rv
ucgaacaccguccaauuggcg

SEQ ID NO: 3288922 - RNA, 16 nt, Mycobacterium tuberculosis H37Rv
ucgaacagcaccgccg

SEQ ID NO: 3288923 - RNA, 21 nt, Mycobacterium tuberculosis H37Rv
ucgaacagcgaaccggcuggg

SEQ ID NO: 3288924 - RNA, 15 nt, Mycobacterium tuberculosis H37Rv
ucgaacaggaucagc

SEQ ID NO: 3288925 - RNA, 17 nt, Mycobacterium tuberculosis H37Rv
ucgaacaucaucggguc

SEQ ID NO: 3288926 - RNA, 13 nt, Mycobacterium tuberculosis H37Rv
ucgaacaucggaa

SEQ ID NO: 3288927 - RNA, 18 nt, Mycobacterium tuberculosis H37Rv
ucgaaccagaggucacgc

SEQ ID NO: 3288928 - RNA, 16 nt, Mycobacterium tuberculosis H37Rv
ucgaacgcagccagcg

SEQ ID NO: 3288929 - RNA, 20 nt, Mycobacterium tuberculosis H37Rv
ucgaacgcagccagcgccau

SEQ ID NO: 3288930 - RNA, 15 nt, Mycobacterium tuberculosis H37Rv
ucgaacgcugaggaa

SEQ ID NO: 3288931 - RNA, 21 nt, Mycobacterium tuberculosis H37Rv
ucgaacugguuucgcaccgug

SEQ ID NO: 3288932 - RNA, 16 nt, Mycobacterium tuberculosis H37Rv
ucgaacuucagcggcg

SEQ ID NO: 3288933 - RNA, 15 nt, Mycobacterium tuberculosis H37Rv
ucgaagaaccggccg

SEQ ID NO: 3288934 - RNA, 12 nt, Mycobacterium tuberculosis H37Rv
ucgaagaauaug

SEQ ID NO: 3288935 - RNA, 19 nt, Mycobacterium tuberculosis H37Rv
ucgaagaccucgucgcguc

SEQ ID NO: 3288936 - RNA, 21 nt, Mycobacterium tuberculosis H37Rv
ucgaagaccucgucgcgucgc

SEQ ID NO: 3288937 - RNA, 18 nt, Mycobacterium tuberculosis H37Rv
ucgaagacgaacgugucg

SEQ ID NO: 3288938 - RNA, 16 nt, Mycobacterium tuberculosis H37Rv
ucgaagccccucaccu

SEQ ID NO: 3288939 - RNA, 20 nt, Mycobacterium tuberculosis H37Rv
ucgaagccccucaccucggc

SEQ ID NO: 3288940 - RNA, 21 nt, Mycobacterium tuberculosis H37Rv
ucgaagcggcugcugcgcggu

SEQ ID NO: 3288941 - RNA, 12 nt, Mycobacterium tuberculosis H37Rv
ucgaagcgggcu

SEQ ID NO: 3288942 - RNA, 19 nt, Mycobacterium tuberculosis H37Rv
ucgaaggcacugcgaucgc

SEQ ID NO: 3288943 - RNA, 22 nt, Mycobacterium tuberculosis H37Rv
ucgaaggcguaccaguugauuc

SEQ ID NO: 3288944 - RNA, 18 nt, Mycobacterium tuberculosis H37Rv
ucgaaggcgugggugucg

SEQ ID NO: 3288945 - RNA, 17 nt, Mycobacterium tuberculosis H37Rv
ucgaauagguguguggc

SEQ ID NO: 3288946 - RNA, 18 nt, Mycobacterium tuberculosis H37Rv
ucgaauaguugaccaggc

SEQ ID NO: 3288947 - RNA, 14 nt, Mycobacterium tuberculosis H37Rv
ucgacguagucgcg

SEQ ID NO: 3288948 - RNA, 16 nt, Mycobacterium tuberculosis H37Rv
ucgacgucaugcaggg

SEQ ID NO: 3288949 - RNA, 15 nt, Mycobacterium tuberculosis H37Rv
ucgacguccaucccg

SEQ ID NO: 3288950 - RNA, 21 nt, Mycobacterium tuberculosis H37Rv
ucgacguccaucccggcgccg

SEQ ID NO: 3288951 - RNA, 16 nt, Mycobacterium tuberculosis H37Rv
ucgacgucgcggcgcc

SEQ ID NO: 3288952 - RNA, 14 nt, Mycobacterium tuberculosis H37Rv
ucgacgugcacggu

SEQ ID NO: 3288953 - RNA, 16 nt, Mycobacterium tuberculosis H37Rv
ucgacguuaccgaccg

SEQ ID NO: 3288954 - RNA, 14 nt, Mycobacterium tuberculosis H37Rv
ucgacguugcggac

SEQ ID NO: 3288955 - RNA, 20 nt, Mycobacterium tuberculosis H37Rv
ucgacguuggcgugcaccgc

SEQ ID NO: 3288956 - RNA, 14 nt, Mycobacterium tuberculosis H37Rv
ucgacucacacacc

SEQ ID NO: 3288957 - RNA, 16 nt, Mycobacterium tuberculosis H37Rv
ucgacuccagcaccag

SEQ ID NO: 3288958 - RNA, 16 nt, Mycobacterium tuberculosis H37Rv
ucgacugaaucaugga

SEQ ID NO: 3288959 - RNA, 12 nt, Mycobacterium tuberculosis H37Rv
ucgacugaucga

SEQ ID NO: 3288960 - RNA, 20 nt, Mycobacterium tuberculosis H37Rv
ucgacugaucgccacccggu

SEQ ID NO: 3288961 - RNA, 20 nt, Mycobacterium tuberculosis H37Rv
ucgacuugccgaccccggaa

SEQ ID NO: 3288962 - RNA, 22 nt, Mycobacterium tuberculosis H37Rv
ucgagaagaucucguagccgcc

SEQ ID NO: 3288963 - RNA, 16 nt, Mycobacterium tuberculosis H37Rv
ucgagaaucggcauuc

SEQ ID NO: 3288964 - RNA, 22 nt, Mycobacterium tuberculosis H37Rv
ucgagaaugcugacggugcagg

SEQ ID NO: 3288965 - RNA, 16 nt, Mycobacterium tuberculosis H37Rv
ucgagacgagccacgg

SEQ ID NO: 3288966 - RNA, 17 nt, Mycobacterium tuberculosis H37Rv
ucgagacgcuuuccgcc

SEQ ID NO: 3288967 - RNA, 22 nt, Mycobacterium tuberculosis H37Rv
ucgagagccccgaccagcagac

SEQ ID NO: 3288968 - RNA, 18 nt, Mycobacterium tuberculosis H37Rv
ucgagagccucuaaacca

SEQ ID NO: 3288969 - RNA, 22 nt, Mycobacterium tuberculosis H37Rv
ucgagcaacggacgaagcaccu

SEQ ID NO: 3288970 - RNA, 19 nt, Mycobacterium tuberculosis H37Rv
ucgagcaacugcucgacga

SEQ ID NO: 3288971 - RNA, 13 nt, Mycobacterium tuberculosis H37Rv
ucgagcaccaccc

SEQ ID NO: 3288972 - RNA, 14 nt, Mycobacterium tuberculosis H37Rv
ucgagcaccacccg

SEQ ID NO: 3288973 - RNA, 15 nt, Mycobacterium tuberculosis H37Rv
ucgagcaccacccgg

SEQ ID NO: 3288974 - RNA, 17 nt, Mycobacterium tuberculosis H37Rv
ucgagcaccgacaccgg

SEQ ID NO: 3288975 - RNA, 19 nt, Mycobacterium tuberculosis H37Rv
ucgagcaccgacaccggcc

SEQ ID NO: 3288976 - RNA, 15 nt, Mycobacterium tuberculosis H37Rv
ucgagcaccgcgaac

SEQ ID NO: 3288977 - RNA, 14 nt, Mycobacterium tuberculosis H37Rv
ucgagcaccggcug

SEQ ID NO: 3288978 - RNA, 17 nt, Mycobacterium tuberculosis H37Rv
ucgagcaccucggccuc

SEQ ID NO: 3288979 - RNA, 19 nt, Mycobacterium tuberculosis H37Rv
ucgagcaccuugcgauugc

SEQ ID NO: 3288980 - RNA, 12 nt, Mycobacterium tuberculosis H37Rv
ucgagcacgaug

SEQ ID NO: 3288981 - RNA, 19 nt, Mycobacterium tuberculosis H37Rv
ucgagcacgaugucgaugc

SEQ ID NO: 3288982 - RNA, 20 nt, Mycobacterium tuberculosis H37Rv
ucgagcacgccaacguugcg

SEQ ID NO: 3288983 - RNA, 17 nt, Mycobacterium tuberculosis H37Rv
ucgagcagcgccacccg

SEQ ID NO: 3288984 - RNA, 15 nt, Mycobacterium tuberculosis H37Rv
ucgagcaggcgcacc

SEQ ID NO: 3288985 - RNA, 13 nt, Mycobacterium tuberculosis H37Rv
ucgagcaggcugg

SEQ ID NO: 3288986 - RNA, 22 nt, Mycobacterium tuberculosis H37Rv
ucgagcagugccucggcgaugg

SEQ ID NO: 3288987 - RNA, 20 nt, Mycobacterium tuberculosis H37Rv
ucgagcaucucgucggugaa

SEQ ID NO: 3288988 - RNA, 15 nt, Mycobacterium tuberculosis H37Rv
ucgagcaugcccagc

SEQ ID NO: 3288989 - RNA, 12 nt, Mycobacterium tuberculosis H37Rv
ucgagccagcgg

SEQ ID NO: 3288990 - RNA, 13 nt, Mycobacterium tuberculosis H37Rv
ucgagccgaucgc

SEQ ID NO: 3288991 - RNA, 20 nt, Mycobacterium tuberculosis H37Rv
ucgagccggauucggcugcc

SEQ ID NO: 3288992 - RNA, 23 nt, Mycobacterium tuberculosis H37Rv
ucgagccggauucggcugccacc

SEQ ID NO: 3288993 - RNA, 18 nt, Mycobacterium tuberculosis H37Rv
ucgagccggugccgcggu

SEQ ID NO: 3288994 - RNA, 17 nt, Mycobacterium tuberculosis H37Rv
ucgagccgugccucgag

SEQ ID NO: 3288995 - RNA, 15 nt, Mycobacterium tuberculosis H37Rv
ucgagcgacccccag

SEQ ID NO: 3288996 - RNA, 20 nt, Mycobacterium tuberculosis H37Rv
ucgagcgacccccagcgccc

SEQ ID NO: 3288997 - RNA, 22 nt, Mycobacterium tuberculosis H37Rv
ucgagcgacguuguuuuugcac

SEQ ID NO: 3288998 - RNA, 21 nt, Mycobacterium tuberculosis H37Rv
ucgagcgccgcggacucgggc

SEQ ID NO: 3288999 - RNA, 17 nt, Mycobacterium tuberculosis H37Rv
ucgagcgcgaucgggcc

SEQ ID NO: 3289000 - RNA, 19 nt, Mycobacterium tuberculosis H37Rv
ucgagcgcgccgcgcucgc

SEQ ID NO: 3289001 - RNA, 21 nt, Mycobacterium tuberculosis H37Rv
ucgagcgcgccuucacgcugg

SEQ ID NO: 3289002 - RNA, 15 nt, Mycobacterium tuberculosis H37Rv
ucgagcgguggcguc

SEQ ID NO: 3289003 - RNA, 14 nt, Mycobacterium tuberculosis H37Rv
ucgagcgugaaccu

SEQ ID NO: 3289004 - RNA, 18 nt, Mycobacterium tuberculosis H37Rv
ucgagcgugcgcacggcg

SEQ ID NO: 3289005 - RNA, 13 nt, Mycobacterium tuberculosis H37Rv
ucgagcguggcga

SEQ ID NO: 3289006 - RNA, 22 nt, Mycobacterium tuberculosis H37Rv
ucgagcucccacaggaccgaug

SEQ ID NO: 3289007 - RNA, 18 nt, Mycobacterium tuberculosis H37Rv
ucgagcucgaagcccgga

SEQ ID NO: 3289008 - RNA, 19 nt, Mycobacterium tuberculosis H37Rv
ucgagcugacgauggccag

SEQ ID NO: 3289009 - RNA, 15 nt, Mycobacterium tuberculosis H37Rv
ucgagcugcuggcgc

SEQ ID NO: 3289010 - RNA, 17 nt, Mycobacterium tuberculosis H37Rv
ucgagcuucaucccgga

SEQ ID NO: 3289011 - RNA, 17 nt, Mycobacterium tuberculosis H37Rv
ucgaggaacacgaugcc

SEQ ID NO: 3289012 - RNA, 18 nt, Mycobacterium tuberculosis H37Rv
ucgaggaacacgaugccc

SEQ ID NO: 3289013 - RNA, 14 nt, Mycobacterium tuberculosis H37Rv
ucgaggaacucgga

SEQ ID NO: 3289014 - RNA, 16 nt, Mycobacterium tuberculosis H37Rv
ucgaggaaggugugcg

SEQ ID NO: 3289015 - RNA, 19 nt, Mycobacterium tuberculosis H37Rv
ucgaggaguuggugcagcg

SEQ ID NO: 3289016 - RNA, 23 nt, Mycobacterium tuberculosis H37Rv
ucgaggcaggccucggcgccgcc

SEQ ID NO: 3289017 - RNA, 16 nt, Mycobacterium tuberculosis H37Rv
ucgaggccacgccagc

SEQ ID NO: 3289018 - RNA, 20 nt, Mycobacterium tuberculosis H37Rv
ucgagggcagccgcccaccc

SEQ ID NO: 3289019 - RNA, 18 nt, Mycobacterium tuberculosis H37Rv
ucgagguacaacgggcac

SEQ ID NO: 3289020 - RNA, 21 nt, Mycobacterium tuberculosis H37Rv
ucgagguacaacgggcacgcu

SEQ ID NO: 3289021 - RNA, 18 nt, Mycobacterium tuberculosis H37Rv
ucgaggucagugggcggu

SEQ ID NO: 3289022 - RNA, 18 nt, Mycobacterium tuberculosis H37Rv
ucgagguccucagcgaug

SEQ ID NO: 3289023 - RNA, 14 nt, Mycobacterium tuberculosis H37Rv
ucgagguccucggu

SEQ ID NO: 3289024 - RNA, 13 nt, Mycobacterium tuberculosis H37Rv
ucgagguccucgu

SEQ ID NO: 3289025 - RNA, 19 nt, Mycobacterium tuberculosis H37Rv
ucgagguccucgucgucga

SEQ ID NO: 3289026 - RNA, 15 nt, Mycobacterium tuberculosis H37Rv
ucgaggucgagcgcc

SEQ ID NO: 3289027 - RNA, 17 nt, Mycobacterium tuberculosis H37Rv
ucgagguggcgggcgau

SEQ ID NO: 3289028 - RNA, 22 nt, Mycobacterium tuberculosis H37Rv
ucgagguguagcccuccgagca

SEQ ID NO: 3289029 - RNA, 22 nt, Mycobacterium tuberculosis H37Rv
ucgaguaacaccccgacaccac

SEQ ID NO: 3289030 - RNA, 15 nt, Mycobacterium tuberculosis H37Rv
ucgaguagguaacgc

SEQ ID NO: 3289031 - RNA, 19 nt, Mycobacterium tuberculosis H37Rv
ucgaguagucgcuggccag

SEQ ID NO: 3289032 - RNA, 20 nt, Mycobacterium tuberculosis H37Rv
ucgaguagugcaggugcccg

SEQ ID NO: 3289033 - RNA, 17 nt, Mycobacterium tuberculosis H37Rv
ucgaguccaccaccugg

SEQ ID NO: 3289034 - RNA, 17 nt, Mycobacterium tuberculosis H37Rv
ucgaguccaggcagcuu

SEQ ID NO: 3289035 - RNA, 17 nt, Mycobacterium tuberculosis H37Rv
ucgagugccgccaccgc

SEQ ID NO: 3289036 - RNA, 15 nt, Mycobacterium tuberculosis H37Rv
ucgaguuccgcaucg

SEQ ID NO: 3289037 - RNA, 16 nt, Mycobacterium tuberculosis H37Rv
ucgaguuccgcaucgg

SEQ ID NO: 3289038 - RNA, 17 nt, Mycobacterium tuberculosis H37Rv
ucgaguuccgcaucggc

SEQ ID NO: 3289039 - RNA, 17 nt, Mycobacterium tuberculosis H37Rv
ucgaguuucucggcgug

SEQ ID NO: 3289040 - RNA, 14 nt, Mycobacterium tuberculosis H37Rv
ucgaguuuggccag

SEQ ID NO: 3289041 - RNA, 14 nt, Mycobacterium tuberculosis H37Rv
ucgauaccggcgug

SEQ ID NO: 3289042 - RNA, 22 nt, Mycobacterium tuberculosis H37Rv
ucgauauaacccggcuccagca

SEQ ID NO: 3289043 - RNA, 15 nt, Mycobacterium tuberculosis H37Rv
ucgccacgcucggcg

SEQ ID NO: 3289044 - RNA, 13 nt, Mycobacterium tuberculosis H37Rv
ucgccacggucgc

SEQ ID NO: 3289045 - RNA, 16 nt, Mycobacterium tuberculosis H37Rv
ucgccacggucgccga

SEQ ID NO: 3289046 - RNA, 18 nt, Mycobacterium tuberculosis H37Rv
ucgccacggucgccgacc

SEQ ID NO: 3289047 - RNA, 20 nt, Mycobacterium tuberculosis H37Rv
ucgccacuguugaagaagcc

SEQ ID NO: 3289048 - RNA, 19 nt, Mycobacterium tuberculosis H37Rv
ucgccagccggccgcgacc

SEQ ID NO: 3289049 - RNA, 21 nt, Mycobacterium tuberculosis H37Rv
ucgccagccggccgcgaccgc

SEQ ID NO: 3289050 - RNA, 14 nt, Mycobacterium tuberculosis H37Rv
ucgccagccugugc

SEQ ID NO: 3289051 - RNA, 17 nt, Mycobacterium tuberculosis H37Rv
ucgccagccugugcugc

SEQ ID NO: 3289052 - RNA, 17 nt, Mycobacterium tuberculosis H37Rv
ucgccagcgccggccag

SEQ ID NO: 3289053 - RNA, 12 nt, Mycobacterium tuberculosis H37Rv
ucgccagcggca

SEQ ID NO: 3289054 - RNA, 12 nt, Mycobacterium tuberculosis H37Rv
ucgccagcggcc

SEQ ID NO: 3289055 - RNA, 18 nt, Mycobacterium tuberculosis H37Rv
ucgccagcugacacccgc

SEQ ID NO: 3289056 - RNA, 23 nt, Mycobacterium tuberculosis H37Rv
ucgccaggccuaggccgaggccg

SEQ ID NO: 3289057 - RNA, 20 nt, Mycobacterium tuberculosis H37Rv
ucgccagggccaucuggcug

SEQ ID NO: 3289058 - RNA, 17 nt, Mycobacterium tuberculosis H37Rv
ucgccagggucgcgagc

SEQ ID NO: 3289059 - RNA, 21 nt, Mycobacterium tuberculosis H37Rv
ucgccagguggccgcucucca

SEQ ID NO: 3289060 - RNA, 23 nt, Mycobacterium tuberculosis H37Rv
ucgccaugauggacagcugcggg

SEQ ID NO: 3289061 - RNA, 14 nt, Mycobacterium tuberculosis H37Rv
ucgccaugcugccc

SEQ ID NO: 3289062 - RNA, 17 nt, Mycobacterium tuberculosis H37Rv
ucgcccaauucggcacg

SEQ ID NO: 3289063 - RNA, 22 nt, Mycobacterium tuberculosis H37Rv
ucgcccaccacgaacacguucg

SEQ ID NO: 3289064 - RNA, 15 nt, Mycobacterium tuberculosis H37Rv
ucgcccagcaaggcc

SEQ ID NO: 3289065 - RNA, 20 nt, Mycobacterium tuberculosis H37Rv
ucgcccagccgagcguggcg

SEQ ID NO: 3289066 - RNA, 16 nt, Mycobacterium tuberculosis H37Rv
ucgcccagcgugaacu

SEQ ID NO: 3289067 - RNA, 17 nt, Mycobacterium tuberculosis H37Rv
ucgcccagcgugaacug

SEQ ID NO: 3289068 - RNA, 18 nt, Mycobacterium tuberculosis H37Rv
ucgcccaggccaaggugg

SEQ ID NO: 3289069 - RNA, 23 nt, Mycobacterium tuberculosis H37Rv
ucgcccaggccaagguggccacc

SEQ ID NO: 3289070 - RNA, 13 nt, Mycobacterium tuberculosis H37Rv
ucgcccaggcgcg

SEQ ID NO: 3289071 - RNA, 13 nt, Mycobacterium tuberculosis H37Rv
ucgcccagggugg

SEQ ID NO: 3289072 - RNA, 17 nt, Mycobacterium tuberculosis H37Rv
ucgcccagugcgcaacc

SEQ ID NO: 3289073 - RNA, 15 nt, Mycobacterium tuberculosis H37Rv
ucgcccauuggccag

SEQ ID NO: 3289074 - RNA, 12 nt, Mycobacterium tuberculosis H37Rv
ucgccccacccg

SEQ ID NO: 3289075 - RNA, 14 nt, Mycobacterium tuberculosis H37Rv
ucgccccacccgag

SEQ ID NO: 3289076 - RNA, 20 nt, Mycobacterium tuberculosis H37Rv
ucgcccccagugcacgcucg

SEQ ID NO: 3289077 - RNA, 16 nt, Mycobacterium tuberculosis H37Rv
ucgccccgaugaccgc

SEQ ID NO: 3289078 - RNA, 17 nt, Mycobacterium tuberculosis H37Rv
ucgccccguucacgcuc

SEQ ID NO: 3289079 - RNA, 18 nt, Mycobacterium tuberculosis H37Rv
ucgccccguucacgcucg

SEQ ID NO: 3289080 - RNA, 19 nt, Mycobacterium tuberculosis H37Rv
ucgccccguuucggucgac

SEQ ID NO: 3289081 - RNA, 20 nt, Mycobacterium tuberculosis H37Rv
ucgccccugcacagcaggcu

SEQ ID NO: 3289082 - RNA, 21 nt, Mycobacterium tuberculosis H37Rv
ucgcccgaggcaacgaacgcc

SEQ ID NO: 3289083 - RNA, 20 nt, Mycobacterium tuberculosis H37Rv
ucgcccgaguugaagaagcc

SEQ ID NO: 3289084 - RNA, 17 nt, Mycobacterium tuberculosis H37Rv
ucgcccgauccggaucc

SEQ ID NO: 3289085 - RNA, 23 nt, Mycobacterium tuberculosis H37Rv
ucgcccgggcgggauccacccag

SEQ ID NO: 3289086 - RNA, 16 nt, Mycobacterium tuberculosis H37Rv
ucgcccggguggcguc

SEQ ID NO: 3289087 - RNA, 14 nt, Mycobacterium tuberculosis H37Rv
ucgcccguggcggu

SEQ ID NO: 3289088 - RNA, 13 nt, Mycobacterium tuberculosis H37Rv
ucgcccugacacc

SEQ ID NO: 3289089 - RNA, 23 nt, Mycobacterium tuberculosis H37Rv
ucgcccugacacccaucgaccgc

SEQ ID NO: 3289090 - RNA, 19 nt, Mycobacterium tuberculosis H37Rv
ucgcccugacccggagccg

SEQ ID NO: 3289091 - RNA, 20 nt, Mycobacterium tuberculosis H37Rv
ucgcccugacgucacguucg

SEQ ID NO: 3289092 - RNA, 17 nt, Mycobacterium tuberculosis H37Rv
ucgcccuuagggucgcc

SEQ ID NO: 3289093 - RNA, 15 nt, Mycobacterium tuberculosis H37Rv
ucgcccuugccgcag

SEQ ID NO: 3289094 - RNA, 20 nt, Mycobacterium tuberculosis H37Rv
ucgccgaaaagggcgacagc

SEQ ID NO: 3289095 - RNA, 22 nt, Mycobacterium tuberculosis H37Rv
ucgccgaaagccuugccgucga

SEQ ID NO: 3289096 - RNA, 16 nt, Mycobacterium tuberculosis H37Rv
ucgccgaaaucggcca

SEQ ID NO: 3289097 - RNA, 18 nt, Mycobacterium tuberculosis H37Rv
ucgccgaaaucggccagc

SEQ ID NO: 3289098 - RNA, 17 nt, Mycobacterium tuberculosis H37Rv
ucgccgaacgccaccac

SEQ ID NO: 3289099 - RNA, 16 nt, Mycobacterium tuberculosis H37Rv
ucgccgaagcgccgcu

SEQ ID NO: 3289100 - RNA, 12 nt, Mycobacterium tuberculosis H37Rv
ucgccgaagugg

SEQ ID NO: 3289101 - RNA, 17 nt, Mycobacterium tuberculosis H37Rv
ucgccgaaucgcugacc

SEQ ID NO: 3289102 - RNA, 15 nt, Mycobacterium tuberculosis H37Rv
ucgccgacagcgccu

SEQ ID NO: 3289103 - RNA, 18 nt, Mycobacterium tuberculosis H37Rv
ucgccgaccgucacugau

SEQ ID NO: 3289104 - RNA, 17 nt, Mycobacterium tuberculosis H37Rv
ucgccgaccuuggcguc

SEQ ID NO: 3289105 - RNA, 15 nt, Mycobacterium tuberculosis H37Rv
ucgccgacgccagaa

SEQ ID NO: 3289106 - RNA, 13 nt, Mycobacterium tuberculosis H37Rv
ucgccgacgccca

SEQ ID NO: 3289107 - RNA, 14 nt, Mycobacterium tuberculosis H37Rv
ucgccgacgcgaag

SEQ ID NO: 3289108 - RNA, 17 nt, Mycobacterium tuberculosis H37Rv
ucgccgagaacgauguc

SEQ ID NO: 3289109 - RNA, 14 nt, Mycobacterium tuberculosis H37Rv
ucgccgagcagguc

SEQ ID NO: 3289110 - RNA, 21 nt, Mycobacterium tuberculosis H37Rv
ucgccgagcgugcaaucacug

SEQ ID NO: 3289111 - RNA, 20 nt, Mycobacterium tuberculosis H37Rv
ucgccgagcugugcgcagac

SEQ ID NO: 3289112 - RNA, 17 nt, Mycobacterium tuberculosis H37Rv
ucgccgaggcagcgucg

SEQ ID NO: 3289113 - RNA, 21 nt, Mycobacterium tuberculosis H37Rv
ucgccgaggccucggccagcg

SEQ ID NO: 3289114 - RNA, 18 nt, Mycobacterium tuberculosis H37Rv
ucgccgaguaccggccag

SEQ ID NO: 3289115 - RNA, 21 nt, Mycobacterium tuberculosis H37Rv
ucgccgaguaccggccagccg

SEQ ID NO: 3289116 - RNA, 20 nt, Mycobacterium tuberculosis H37Rv
ucgccgaucaacagcaccgu

SEQ ID NO: 3289117 - RNA, 23 nt, Mycobacterium tuberculosis H37Rv
ucgccgaucagcugcgcaucgcc

SEQ ID NO: 3289118 - RNA, 22 nt, Mycobacterium tuberculosis H37Rv
ucgccgaugauguuuuccccgc

SEQ ID NO: 3289119 - RNA, 23 nt, Mycobacterium tuberculosis H37Rv
ucgccgaugauguuuuccccgcc

SEQ ID NO: 3289120 - RNA, 20 nt, Mycobacterium tuberculosis H37Rv
ucgccgauguuggcagggcc

SEQ ID NO: 3289121 - RNA, 16 nt, Mycobacterium tuberculosis H37Rv
ucgccgcacgccggca

SEQ ID NO: 3289122 - RNA, 22 nt, Mycobacterium tuberculosis H37Rv
ucgccgcaguccgcacgcggca

SEQ ID NO: 3289123 - RNA, 18 nt, Mycobacterium tuberculosis H37Rv
ucgccgccaaagccggga

SEQ ID NO: 3289124 - RNA, 23 nt, Mycobacterium tuberculosis H37Rv
ucgccgccaccagcgcacgcucg

SEQ ID NO: 3289125 - RNA, 20 nt, Mycobacterium tuberculosis H37Rv
ucgccgccaccggcgacgcc

SEQ ID NO: 3289126 - RNA, 18 nt, Mycobacterium tuberculosis H37Rv
ucgccgcccgcagggccg

SEQ ID NO: 3289127 - RNA, 15 nt, Mycobacterium tuberculosis H37Rv
ucgccgcccgugccg

SEQ ID NO: 3289128 - RNA, 14 nt, Mycobacterium tuberculosis H37Rv
ucgccgccgcgcgu

SEQ ID NO: 3289129 - RNA, 18 nt, Mycobacterium tuberculosis H37Rv
ucgccgccgcuaccgccg

SEQ ID NO: 3289130 - RNA, 14 nt, Mycobacterium tuberculosis H37Rv
ucgccgccgggcag

SEQ ID NO: 3289131 - RNA, 23 nt, Mycobacterium tuberculosis H37Rv
ucgccgccggugaggaucagcgu

SEQ ID NO: 3289132 - RNA, 15 nt, Mycobacterium tuberculosis H37Rv
ucgccgccggugccg

SEQ ID NO: 3289133 - RNA, 17 nt, Mycobacterium tuberculosis H37Rv
ucgccgccgucggguug

SEQ ID NO: 3289134 - RNA, 17 nt, Mycobacterium tuberculosis H37Rv
ucgccgccguugccgcc

SEQ ID NO: 3289135 - RNA, 19 nt, Mycobacterium tuberculosis H37Rv
ucgccgccuuacgcaccga

SEQ ID NO: 3289136 - RNA, 13 nt, Mycobacterium tuberculosis H37Rv
ucgccgcgcaccg

SEQ ID NO: 3289137 - RNA, 22 nt, Mycobacterium tuberculosis H37Rv
ucgccgcgcagccuucucgcug

SEQ ID NO: 3289138 - RNA, 21 nt, Mycobacterium tuberculosis H37Rv
ucgccgcgcuggucggagacc

SEQ ID NO: 3289139 - RNA, 15 nt, Mycobacterium tuberculosis H37Rv
ucgcgccaggccacg

SEQ ID NO: 3289140 - RNA, 21 nt, Mycobacterium tuberculosis H37Rv
ucgcgccaggcuugcggcacc

SEQ ID NO: 3289141 - RNA, 15 nt, Mycobacterium tuberculosis H37Rv
ucgcgccaucgucgc

SEQ ID NO: 3289142 - RNA, 23 nt, Mycobacterium tuberculosis H37Rv
ucgcgcccgccaucagcccggcg

SEQ ID NO: 3289143 - RNA, 21 nt, Mycobacterium tuberculosis H37Rv
ucgcgcccgcuaacuggcccg

SEQ ID NO: 3289144 - RNA, 20 nt, Mycobacterium tuberculosis H37Rv
ucgcgccgcgugguuccggc

SEQ ID NO: 3289145 - RNA, 12 nt, Mycobacterium tuberculosis H37Rv
ucgcgccgguga

SEQ ID NO: 3289146 - RNA, 15 nt, Mycobacterium tuberculosis H37Rv
ucgcgccgucggcga

SEQ ID NO: 3289147 - RNA, 16 nt, Mycobacterium tuberculosis H37Rv
ucgcgccucaucggcu

SEQ ID NO: 3289148 - RNA, 21 nt, Mycobacterium tuberculosis H37Rv
ucgcgcgaccuggucgaacug

SEQ ID NO: 3289149 - RNA, 22 nt, Mycobacterium tuberculosis H37Rv
ucgcgcgccacggugucgucga

SEQ ID NO: 3289150 - RNA, 13 nt, Mycobacterium tuberculosis H37Rv
ucgcgcgcgaaac

SEQ ID NO: 3289151 - RNA, 20 nt, Mycobacterium tuberculosis H37Rv
ucgcgcgcgaacacccgaag

SEQ ID NO: 3289152 - RNA, 16 nt, Mycobacterium tuberculosis H37Rv
ucgcgcgcggcauggg

SEQ ID NO: 3289153 - RNA, 12 nt, Mycobacterium tuberculosis H37Rv
ucgcgcgcucgc

SEQ ID NO: 3289154 - RNA, 16 nt, Mycobacterium tuberculosis H37Rv
ucgcgcggcaccgaug

SEQ ID NO: 3289155 - RNA, 16 nt, Mycobacterium tuberculosis H37Rv
ucgcgcggcugugccc

SEQ ID NO: 3289156 - RNA, 24 nt, Mycobacterium tuberculosis H37Rv
ucgcgcggcugugcccgaucagcc

SEQ ID NO: 3289157 - RNA, 18 nt, Mycobacterium tuberculosis H37Rv
ucgcgcgguagucgucgc

SEQ ID NO: 3289158 - RNA, 14 nt, Mycobacterium tuberculosis H37Rv
ucgcgcgucgucgc

SEQ ID NO: 3289159 - RNA, 18 nt, Mycobacterium tuberculosis H37Rv
ucgcgcuaaggugggcac

SEQ ID NO: 3289160 - RNA, 22 nt, Mycobacterium tuberculosis H37Rv
ucgcgcuaaggugggcacagcg

SEQ ID NO: 3289161 - RNA, 22 nt, Mycobacterium tuberculosis H37Rv
ucgcgcucauguucucgaccgc

SEQ ID NO: 3289162 - RNA, 22 nt, Mycobacterium tuberculosis H37Rv
ucgcgcucccacgcuucggccu

SEQ ID NO: 3289163 - RNA, 16 nt, Mycobacterium tuberculosis H37Rv
ucgcgcucgcaccacc

SEQ ID NO: 3289164 - RNA, 12 nt, Mycobacterium tuberculosis H37Rv
ucgcgcugauca

SEQ ID NO: 3289165 - RNA, 14 nt, Mycobacterium tuberculosis H37Rv
ucgcgcugaucagc

SEQ ID NO: 3289166 - RNA, 12 nt, Mycobacterium tuberculosis H37Rv
ucgcgcugcggc

SEQ ID NO: 3289167 - RNA, 19 nt, Mycobacterium tuberculosis H37Rv
ucgcgcugcggcccacacc

SEQ ID NO: 3289168 - RNA, 24 nt, Mycobacterium tuberculosis H37Rv
ucgcgcugcggcccacaccagcgc

SEQ ID NO: 3289169 - RNA, 21 nt, Mycobacterium tuberculosis H37Rv
ucgcgcuggcaaguucggccg

SEQ ID NO: 3289170 - RNA, 14 nt, Mycobacterium tuberculosis H37Rv
ucgcgcuggccaug

SEQ ID NO: 3289171 - RNA, 14 nt, Mycobacterium tuberculosis H37Rv
ucgcgcuugaaacu

SEQ ID NO: 3289172 - RNA, 22 nt, Mycobacterium tuberculosis H37Rv
ucgcgcuugcgccgcccaugcc

SEQ ID NO: 3289173 - RNA, 20 nt, Mycobacterium tuberculosis H37Rv
ucgcggaacucgucgcugcc

SEQ ID NO: 3289174 - RNA, 13 nt, Mycobacterium tuberculosis H37Rv
ucgcggacccgcg

SEQ ID NO: 3289175 - RNA, 19 nt, Mycobacterium tuberculosis H37Rv
ucgcggacccgcgcgucgc

SEQ ID NO: 3289176 - RNA, 20 nt, Mycobacterium tuberculosis H37Rv
ucgcggaccucggcgaccug

SEQ ID NO: 3289177 - RNA, 22 nt, Mycobacterium tuberculosis H37Rv
ucgcggacucguagcaccgguc

SEQ ID NO: 3289178 - RNA, 21 nt, Mycobacterium tuberculosis H37Rv
ucgcggagccaggacgacgcc

SEQ ID NO: 3289179 - RNA, 23 nt, Mycobacterium tuberculosis H37Rv
ucgcggagccaggacgacgccga

SEQ ID NO: 3289180 - RNA, 17 nt, Mycobacterium tuberculosis H37Rv
ucgcggagccgucgcau

SEQ ID NO: 3289181 - RNA, 19 nt, Mycobacterium tuberculosis H37Rv
ucgcggagccgucgcauca

SEQ ID NO: 3289182 - RNA, 23 nt, Mycobacterium tuberculosis H37Rv
ucgcggagccgucgcaucagguc

SEQ ID NO: 3289183 - RNA, 17 nt, Mycobacterium tuberculosis H37Rv
ucgcggaucucaucggg

SEQ ID NO: 3289184 - RNA, 13 nt, Mycobacterium tuberculosis H37Rv
ucgcggaugccag

SEQ ID NO: 3289185 - RNA, 21 nt, Mycobacterium tuberculosis H37Rv
ucgcggauuucucgcccugag

SEQ ID NO: 3289186 - RNA, 21 nt, Mycobacterium tuberculosis H37Rv
ucgcggcacgaucaaccgggu

SEQ ID NO: 3289187 - RNA, 15 nt, Mycobacterium tuberculosis H37Rv
ucgcggcaucgucgc

SEQ ID NO: 3289188 - RNA, 16 nt, Mycobacterium tuberculosis H37Rv
ucgcggcaucgucgcc

SEQ ID NO: 3289189 - RNA, 21 nt, Mycobacterium tuberculosis H37Rv
ucgcggcccgagaagcguugc

SEQ ID NO: 3289190 - RNA, 21 nt, Mycobacterium tuberculosis H37Rv
ucgcggccgcggccucccgca

SEQ ID NO: 3289191 - RNA, 17 nt, Mycobacterium tuberculosis H37Rv
ucgcggccgucuucggu

SEQ ID NO: 3289192 - RNA, 22 nt, Mycobacterium tuberculosis H37Rv
ucgcggccguggaugucgcggu

SEQ ID NO: 3289193 - RNA, 15 nt, Mycobacterium tuberculosis H37Rv
ucgcggcgacccggu

SEQ ID NO: 3289194 - RNA, 23 nt, Mycobacterium tuberculosis H37Rv
ucgcggcgacccggucgcggaac

SEQ ID NO: 3289195 - RNA, 13 nt, Mycobacterium tuberculosis H37Rv
ucgcggcgaucgc

SEQ ID NO: 3289196 - RNA, 11 nt, Mycobacterium tuberculosis H37Rv
ucgcggcggcg

SEQ ID NO: 3289197 - RNA, 23 nt, Mycobacterium tuberculosis H37Rv
ucgcggcggucccugaagccagc

SEQ ID NO: 3289198 - RNA, 22 nt, Mycobacterium tuberculosis H37Rv
ucgcggcgguuaucgucggguc

SEQ ID NO: 3289199 - RNA, 17 nt, Mycobacterium tuberculosis H37Rv
ucgcggcguucggcuuc

SEQ ID NO: 3289200 - RNA, 23 nt, Mycobacterium tuberculosis H37Rv
ucgcggcguugugaccgccgaug

SEQ ID NO: 3289201 - RNA, 16 nt, Mycobacterium tuberculosis H37Rv
ucgcgggacaacagca

SEQ ID NO: 3289202 - RNA, 19 nt, Mycobacterium tuberculosis H37Rv
ucgcgggacaacagcaugg

SEQ ID NO: 3289203 - RNA, 20 nt, Mycobacterium tuberculosis H37Rv
ucgcgggccgcgucgaacug

SEQ ID NO: 3289204 - RNA, 15 nt, Mycobacterium tuberculosis H37Rv
ucgcgggcgauggcc

SEQ ID NO: 3289205 - RNA, 22 nt, Mycobacterium tuberculosis H37Rv
ucgcgggcgucgcugcgcuggu

SEQ ID NO: 3289206 - RNA, 18 nt, Mycobacterium tuberculosis H37Rv
ucgcgggguaggcccagc

SEQ ID NO: 3289207 - RNA, 16 nt, Mycobacterium tuberculosis H37Rv
ucgcggguaaccggcu

SEQ ID NO: 3289208 - RNA, 19 nt, Mycobacterium tuberculosis H37Rv
ucgcgggugcggacaccga

SEQ ID NO: 3289209 - RNA, 20 nt, Mycobacterium tuberculosis H37Rv
ucgcgguaguuaacccaggg

SEQ ID NO: 3289210 - RNA, 14 nt, Mycobacterium tuberculosis H37Rv
ucgcggucgccacc

SEQ ID NO: 3289211 - RNA, 16 nt, Mycobacterium tuberculosis H37Rv
ucgcggucgccaccgu

SEQ ID NO: 3289212 - RNA, 12 nt, Mycobacterium tuberculosis H37Rv
ucgcggugaccu

SEQ ID NO: 3289213 - RNA, 20 nt, Mycobacterium tuberculosis H37Rv
ucgcgguggcggugucggcg

SEQ ID NO: 3289214 - RNA, 17 nt, Mycobacterium tuberculosis H37Rv
ucgcguacguacugcuu

SEQ ID NO: 3289215 - RNA, 19 nt, Mycobacterium tuberculosis H37Rv
ucgcguagcuggccagguu

SEQ ID NO: 3289216 - RNA, 15 nt, Mycobacterium tuberculosis H37Rv
ucgcgucaucaacgu

SEQ ID NO: 3289217 - RNA, 12 nt, Mycobacterium tuberculosis H37Rv
ucgcguccaccc

SEQ ID NO: 3289218 - RNA, 16 nt, Mycobacterium tuberculosis H37Rv
ucgcguccaugcgggu

SEQ ID NO: 3289219 - RNA, 17 nt, Mycobacterium tuberculosis H37Rv
ucgcguccgcgaucugc

SEQ ID NO: 3289220 - RNA, 14 nt, Mycobacterium tuberculosis H37Rv
ucgcguccuccucg

SEQ ID NO: 3289221 - RNA, 18 nt, Mycobacterium tuberculosis H37Rv
ucgcgucgacccgaacug

SEQ ID NO: 3289222 - RNA, 19 nt, Mycobacterium tuberculosis H37Rv
ucgcgucugacaucgucga

SEQ ID NO: 3289223 - RNA, 15 nt, Mycobacterium tuberculosis H37Rv
ucgcgugccacagca

SEQ ID NO: 3289224 - RNA, 18 nt, Mycobacterium tuberculosis H37Rv
ucgcguucugcaccagcu

SEQ ID NO: 3289225 - RNA, 19 nt, Mycobacterium tuberculosis H37Rv
ucgcguugcagaccaccag

SEQ ID NO: 3289226 - RNA, 15 nt, Mycobacterium tuberculosis H37Rv
ucgcuaauugcggcc

SEQ ID NO: 3289227 - RNA, 15 nt, Mycobacterium tuberculosis H37Rv
ucgcuacgcaacggg

SEQ ID NO: 3289228 - RNA, 22 nt, Mycobacterium tuberculosis H37Rv
ucgcuacgcaacgggucggguc

SEQ ID NO: 3289229 - RNA, 13 nt, Mycobacterium tuberculosis H37Rv
ucgcuauccggcg

SEQ ID NO: 3289230 - RNA, 13 nt, Mycobacterium tuberculosis H37Rv
ucgcucaccggcg

SEQ ID NO: 3289231 - RNA, 13 nt, Mycobacterium tuberculosis H37Rv
ucgcucaccggcu

SEQ ID NO: 3289232 - RNA, 14 nt, Mycobacterium tuberculosis H37Rv
ucgcucaccggcug

SEQ ID NO: 3289233 - RNA, 18 nt, Mycobacterium tuberculosis H37Rv
ucgcucagggugucgaca

SEQ ID NO: 3289234 - RNA, 20 nt, Mycobacterium tuberculosis H37Rv
ucgcucaguuuggcgggugc

SEQ ID NO: 3289235 - RNA, 20 nt, Mycobacterium tuberculosis H37Rv
ucggccaccaaccucaucgc

SEQ ID NO: 3289236 - RNA, 13 nt, Mycobacterium tuberculosis H37Rv
ucggccaccaacu

SEQ ID NO: 3289237 - RNA, 18 nt, Mycobacterium tuberculosis H37Rv
ucggccaccaacucggcg

SEQ ID NO: 3289238 - RNA, 20 nt, Mycobacterium tuberculosis H37Rv
ucggccaccaacucggcgac

SEQ ID NO: 3289239 - RNA, 22 nt, Mycobacterium tuberculosis H37Rv
ucggccaccagaaccagcgacc

SEQ ID NO: 3289240 - RNA, 15 nt, Mycobacterium tuberculosis H37Rv
ucggccaccagcgcc

SEQ ID NO: 3289241 - RNA, 12 nt, Mycobacterium tuberculosis H37Rv
ucggccaccauc

SEQ ID NO: 3289242 - RNA, 18 nt, Mycobacterium tuberculosis H37Rv
ucggccaccggcgucugc

SEQ ID NO: 3289243 - RNA, 19 nt, Mycobacterium tuberculosis H37Rv
ucggccaccggcgucugcc

SEQ ID NO: 3289244 - RNA, 12 nt, Mycobacterium tuberculosis H37Rv
ucggccaccgug

SEQ ID NO: 3289245 - RNA, 14 nt, Mycobacterium tuberculosis H37Rv
ucggccacggcguc

SEQ ID NO: 3289246 - RNA, 17 nt, Mycobacterium tuberculosis H37Rv
ucggccagaucacgcac

SEQ ID NO: 3289247 - RNA, 21 nt, Mycobacterium tuberculosis H37Rv
ucggccagcagaucagguccu

SEQ ID NO: 3289248 - RNA, 13 nt, Mycobacterium tuberculosis H37Rv
ucggccagcagca

SEQ ID NO: 3289249 - RNA, 17 nt, Mycobacterium tuberculosis H37Rv
ucggccagcagcagugc

SEQ ID NO: 3289250 - RNA, 13 nt, Mycobacterium tuberculosis H37Rv
ucggccagcagcg

SEQ ID NO: 3289251 - RNA, 19 nt, Mycobacterium tuberculosis H37Rv
ucggccagcuccgccugcc

SEQ ID NO: 3289252 - RNA, 21 nt, Mycobacterium tuberculosis H37Rv
ucggccaucagaaccuccucg

SEQ ID NO: 3289253 - RNA, 14 nt, Mycobacterium tuberculosis H37Rv
ucggccauccaccg

SEQ ID NO: 3289254 - RNA, 13 nt, Mycobacterium tuberculosis H37Rv
ucggccaucgagu

SEQ ID NO: 3289255 - RNA, 16 nt, Mycobacterium tuberculosis H37Rv
ucggccaucguccagc

SEQ ID NO: 3289256 - RNA, 17 nt, Mycobacterium tuberculosis H37Rv
ucggccaucguccagca

SEQ ID NO: 3289257 - RNA, 20 nt, Mycobacterium tuberculosis H37Rv
ucggcccacacggucgucgc

SEQ ID NO: 3289258 - RNA, 17 nt, Mycobacterium tuberculosis H37Rv
ucggcccacgguguccc

SEQ ID NO: 3289259 - RNA, 18 nt, Mycobacterium tuberculosis H37Rv
ucggcccacggugucccg

SEQ ID NO: 3289260 - RNA, 15 nt, Mycobacterium tuberculosis H37Rv
ucggcccagcgcgcc

SEQ ID NO: 3289261 - RNA, 19 nt, Mycobacterium tuberculosis H37Rv
ucggcccaucuuuccggcg

SEQ ID NO: 3289262 - RNA, 21 nt, Mycobacterium tuberculosis H37Rv
ucggcccccaagcucugcguc

SEQ ID NO: 3289263 - RNA, 19 nt, Mycobacterium tuberculosis H37Rv
ucggccccgaaacgauggc

SEQ ID NO: 3289264 - RNA, 21 nt, Mycobacterium tuberculosis H37Rv
ucggcccgaggugccggggcc

SEQ ID NO: 3289265 - RNA, 14 nt, Mycobacterium tuberculosis H37Rv
ucggcccgcucacc

SEQ ID NO: 3289266 - RNA, 16 nt, Mycobacterium tuberculosis H37Rv
ucggcccgugccacag

SEQ ID NO: 3289267 - RNA, 17 nt, Mycobacterium tuberculosis H37Rv
ucggccgacaccgccac

SEQ ID NO: 3289268 - RNA, 14 nt, Mycobacterium tuberculosis H37Rv
ucggccgcaaggcg

SEQ ID NO: 3289269 - RNA, 15 nt, Mycobacterium tuberculosis H37Rv
ucggccgcaaggcgc

SEQ ID NO: 3289270 - RNA, 15 nt, Mycobacterium tuberculosis H37Rv
ucggccgcaccagca

SEQ ID NO: 3289271 - RNA, 20 nt, Mycobacterium tuberculosis H37Rv
ucggccgccagccccacccg

SEQ ID NO: 3289272 - RNA, 13 nt, Mycobacterium tuberculosis H37Rv
ucggccgccggau

SEQ ID NO: 3289273 - RNA, 20 nt, Mycobacterium tuberculosis H37Rv
ucggccgccggguccggaac

SEQ ID NO: 3289274 - RNA, 20 nt, Mycobacterium tuberculosis H37Rv
ucggccgcgagacgcauguc

SEQ ID NO: 3289275 - RNA, 20 nt, Mycobacterium tuberculosis H37Rv
ucggccggcaccccacggcc

SEQ ID NO: 3289276 - RNA, 19 nt, Mycobacterium tuberculosis H37Rv
ucggccggcggucgccagu

SEQ ID NO: 3289277 - RNA, 15 nt, Mycobacterium tuberculosis H37Rv
ucggccggcgucagc

SEQ ID NO: 3289278 - RNA, 21 nt, Mycobacterium tuberculosis H37Rv
ucggccgggccguguccgccg

SEQ ID NO: 3289279 - RNA, 23 nt, Mycobacterium tuberculosis H37Rv
ucggccggggccacccgcagacc

SEQ ID NO: 3289280 - RNA, 20 nt, Mycobacterium tuberculosis H37Rv
ucggccggguuaucggcagc

SEQ ID NO: 3289281 - RNA, 18 nt, Mycobacterium tuberculosis H37Rv
ucggccgguauuucggcg

SEQ ID NO: 3289282 - RNA, 19 nt, Mycobacterium tuberculosis H37Rv
ucggccgucauggcccgau

SEQ ID NO: 3289283 - RNA, 21 nt, Mycobacterium tuberculosis H37Rv
ucggccgugaauucgccgaac

SEQ ID NO: 3289284 - RNA, 17 nt, Mycobacterium tuberculosis H37Rv
ucggccguuuccaccgu

SEQ ID NO: 3289285 - RNA, 23 nt, Mycobacterium tuberculosis H37Rv
ucggccucgagacggucgaucac

SEQ ID NO: 3289286 - RNA, 17 nt, Mycobacterium tuberculosis H37Rv
ucggccucgucgugcac

SEQ ID NO: 3289287 - RNA, 15 nt, Mycobacterium tuberculosis H37Rv
ucggccugcagcgau

SEQ ID NO: 3289288 - RNA, 20 nt, Mycobacterium tuberculosis H37Rv
ucggccugccggcagcggcg

SEQ ID NO: 3289289 - RNA, 21 nt, Mycobacterium tuberculosis H37Rv
ucggccugcgaacacgcgaug

SEQ ID NO: 3289290 - RNA, 18 nt, Mycobacterium tuberculosis H37Rv
ucggccugcugcugcagc

SEQ ID NO: 3289291 - RNA, 16 nt, Mycobacterium tuberculosis H37Rv
ucggccuguccaccga

SEQ ID NO: 3289292 - RNA, 18 nt, Mycobacterium tuberculosis H37Rv
ucggccuguccaccgaug

SEQ ID NO: 3289293 - RNA, 19 nt, Mycobacterium tuberculosis H37Rv
ucggccuguucggcggcug

SEQ ID NO: 3289294 - RNA, 15 nt, Mycobacterium tuberculosis H37Rv
ucggccuucagcguc

SEQ ID NO: 3289295 - RNA, 23 nt, Mycobacterium tuberculosis H37Rv
ucggccuucuugagguagcugcg

SEQ ID NO: 3289296 - RNA, 15 nt, Mycobacterium tuberculosis H37Rv
ucggcgaacgcggcg

SEQ ID NO: 3289297 - RNA, 21 nt, Mycobacterium tuberculosis H37Rv
ucggcgaacggauucccgccc

SEQ ID NO: 3289298 - RNA, 16 nt, Mycobacterium tuberculosis H37Rv
ucggcgaacggcacca

SEQ ID NO: 3289299 - RNA, 17 nt, Mycobacterium tuberculosis H37Rv
ucggcgaagcacaccgu

SEQ ID NO: 3289300 - RNA, 20 nt, Mycobacterium tuberculosis H37Rv
ucggcgaauccgccgccuag

SEQ ID NO: 3289301 - RNA, 21 nt, Mycobacterium tuberculosis H37Rv
ucggcgaccagaaucucgccg

SEQ ID NO: 3289302 - RNA, 12 nt, Mycobacterium tuberculosis H37Rv
ucggcgaccagc

SEQ ID NO: 3289303 - RNA, 16 nt, Mycobacterium tuberculosis H37Rv
ucggcgaccagcugug

SEQ ID NO: 3289304 - RNA, 22 nt, Mycobacterium tuberculosis H37Rv
ucggcgaccgacgccggugucg

SEQ ID NO: 3289305 - RNA, 15 nt, Mycobacterium tuberculosis H37Rv
ucggcgaccgagacg

SEQ ID NO: 3289306 - RNA, 14 nt, Mycobacterium tuberculosis H37Rv
ucggcgaccggccg

SEQ ID NO: 3289307 - RNA, 19 nt, Mycobacterium tuberculosis H37Rv
ucggcgaccuggcucaucg

SEQ ID NO: 3289308 - RNA, 16 nt, Mycobacterium tuberculosis H37Rv
ucggcgagcaccaccc

SEQ ID NO: 3289309 - RNA, 18 nt, Mycobacterium tuberculosis H37Rv
ucggcgagcagacgccgc

SEQ ID NO: 3289310 - RNA, 15 nt, Mycobacterium tuberculosis H37Rv
ucggcgagcagcgca

SEQ ID NO: 3289311 - RNA, 20 nt, Mycobacterium tuberculosis H37Rv
ucggcgagccgugcuaccca

SEQ ID NO: 3289312 - RNA, 13 nt, Mycobacterium tuberculosis H37Rv
ucggcgagcgccc

SEQ ID NO: 3289313 - RNA, 20 nt, Mycobacterium tuberculosis H37Rv
ucggcgagcgcccgcagcgc

SEQ ID NO: 3289314 - RNA, 14 nt, Mycobacterium tuberculosis H37Rv
ucggcgaggacggc

SEQ ID NO: 3289315 - RNA, 15 nt, Mycobacterium tuberculosis H37Rv
ucggcgaggacggcg

SEQ ID NO: 3289316 - RNA, 16 nt, Mycobacterium tuberculosis H37Rv
ucggcgauaccgagga

SEQ ID NO: 3289317 - RNA, 17 nt, Mycobacterium tuberculosis H37Rv
ucggcgaucaacgcgca

SEQ ID NO: 3289318 - RNA, 19 nt, Mycobacterium tuberculosis H37Rv
ucggcgaucaagccucuau

SEQ ID NO: 3289319 - RNA, 20 nt, Mycobacterium tuberculosis H37Rv
ucggcgaucgucaagccggg

SEQ ID NO: 3289320 - RNA, 16 nt, Mycobacterium tuberculosis H37Rv
ucggcgaucuccggcg

SEQ ID NO: 3289321 - RNA, 22 nt, Mycobacterium tuberculosis H37Rv
ucggcgaugauguugagcugga

SEQ ID NO: 3289322 - RNA, 16 nt, Mycobacterium tuberculosis H37Rv
ucggcgaugcgcacca

SEQ ID NO: 3289323 - RNA, 19 nt, Mycobacterium tuberculosis H37Rv
ucggcgaugcgcaccagca

SEQ ID NO: 3289324 - RNA, 16 nt, Mycobacterium tuberculosis H37Rv
ucggcgaugcguccgc

SEQ ID NO: 3289325 - RNA, 17 nt, Mycobacterium tuberculosis H37Rv
ucggcgauugcaccaug

SEQ ID NO: 3289326 - RNA, 17 nt, Mycobacterium tuberculosis H37Rv
ucggcgcacagcgagca

SEQ ID NO: 3289327 - RNA, 12 nt, Mycobacterium tuberculosis H37Rv
ucggcgcaggcg

SEQ ID NO: 3289328 - RNA, 12 nt, Mycobacterium tuberculosis H37Rv
ucggcgccagau

SEQ ID NO: 3289329 - RNA, 19 nt, Mycobacterium tuberculosis H37Rv
ucggcgcccgcucggccgc

SEQ ID NO: 3289330 - RNA, 15 nt, Mycobacterium tuberculosis H37Rv
ucggcgccgaacuca

SEQ ID NO: 3289331 - RNA, 22 nt, Mycobacterium tuberculosis H37Rv
ucgggacaucugcccaccgcag

SEQ ID NO: 3289332 - RNA, 19 nt, Mycobacterium tuberculosis H37Rv
ucgggaccaccgaccgcgu

SEQ ID NO: 3289333 - RNA, 19 nt, Mycobacterium tuberculosis H37Rv
ucgggaccggcuugccgcc

SEQ ID NO: 3289334 - RNA, 12 nt, Mycobacterium tuberculosis H37Rv
ucgggaccggga

SEQ ID NO: 3289335 - RNA, 18 nt, Mycobacterium tuberculosis H37Rv
ucgggaccggggacgcgc

SEQ ID NO: 3289336 - RNA, 21 nt, Mycobacterium tuberculosis H37Rv
ucgggacgaaaaaaucgugcg

SEQ ID NO: 3289337 - RNA, 15 nt, Mycobacterium tuberculosis H37Rv
ucgggacgcgagugc

SEQ ID NO: 3289338 - RNA, 13 nt, Mycobacterium tuberculosis H37Rv
ucgggacggccaa

SEQ ID NO: 3289339 - RNA, 15 nt, Mycobacterium tuberculosis H37Rv
ucgggacugcgcggc

SEQ ID NO: 3289340 - RNA, 18 nt, Mycobacterium tuberculosis H37Rv
ucgggagcggcugcggca

SEQ ID NO: 3289341 - RNA, 19 nt, Mycobacterium tuberculosis H37Rv
ucgggagucuucggcgaca

SEQ ID NO: 3289342 - RNA, 14 nt, Mycobacterium tuberculosis H37Rv
ucgggaucgcugcc

SEQ ID NO: 3289343 - RNA, 17 nt, Mycobacterium tuberculosis H37Rv
ucgggaucgcugccagc

SEQ ID NO: 3289344 - RNA, 17 nt, Mycobacterium tuberculosis H37Rv
ucgggaucggccggcgg

SEQ ID NO: 3289345 - RNA, 15 nt, Mycobacterium tuberculosis H37Rv
ucgggaugcaaggaa

SEQ ID NO: 3289346 - RNA, 19 nt, Mycobacterium tuberculosis H37Rv
ucgggaugcccgcugauca

SEQ ID NO: 3289347 - RNA, 14 nt, Mycobacterium tuberculosis H37Rv
ucgggaugcucgau

SEQ ID NO: 3289348 - RNA, 20 nt, Mycobacterium tuberculosis H37Rv
ucgggcaaccugccgggcca

SEQ ID NO: 3289349 - RNA, 17 nt, Mycobacterium tuberculosis H37Rv
ucgggcaacggcagccc

SEQ ID NO: 3289350 - RNA, 15 nt, Mycobacterium tuberculosis H37Rv
ucgggcacaccgacg

SEQ ID NO: 3289351 - RNA, 17 nt, Mycobacterium tuberculosis H37Rv
ucgggcacaccgacgcc

SEQ ID NO: 3289352 - RNA, 20 nt, Mycobacterium tuberculosis H37Rv
ucgggcacaucgcacggucg

SEQ ID NO: 3289353 - RNA, 22 nt, Mycobacterium tuberculosis H37Rv
ucgggcagauaugacggcagac

SEQ ID NO: 3289354 - RNA, 12 nt, Mycobacterium tuberculosis H37Rv
ucgggcagcacc

SEQ ID NO: 3289355 - RNA, 14 nt, Mycobacterium tuberculosis H37Rv
ucgggcagcgucac

SEQ ID NO: 3289356 - RNA, 17 nt, Mycobacterium tuberculosis H37Rv
ucgggcaggccgucgag

SEQ ID NO: 3289357 - RNA, 15 nt, Mycobacterium tuberculosis H37Rv
ucgggcauggucgcc

SEQ ID NO: 3289358 - RNA, 13 nt, Mycobacterium tuberculosis H37Rv
ucgggccacagca

SEQ ID NO: 3289359 - RNA, 21 nt, Mycobacterium tuberculosis H37Rv
ucgggccacagcaacgugugc

SEQ ID NO: 3289360 - RNA, 13 nt, Mycobacterium tuberculosis H37Rv
ucgggcccaccgc

SEQ ID NO: 3289361 - RNA, 15 nt, Mycobacterium tuberculosis H37Rv
ucgggcccagcagcg

SEQ ID NO: 3289362 - RNA, 18 nt, Mycobacterium tuberculosis H37Rv
ucgggcccagcagcgcaa

SEQ ID NO: 3289363 - RNA, 17 nt, Mycobacterium tuberculosis H37Rv
ucgggcccuccggcgca

SEQ ID NO: 3289364 - RNA, 22 nt, Mycobacterium tuberculosis H37Rv
ucgggccgaauaccacaccgug

SEQ ID NO: 3289365 - RNA, 21 nt, Mycobacterium tuberculosis H37Rv
ucgggccggccgccgcgggac

SEQ ID NO: 3289366 - RNA, 13 nt, Mycobacterium tuberculosis H37Rv
ucgggcgacugga

SEQ ID NO: 3289367 - RNA, 15 nt, Mycobacterium tuberculosis H37Rv
ucgggcgacuggacc

SEQ ID NO: 3289368 - RNA, 13 nt, Mycobacterium tuberculosis H37Rv
ucgggcgagaucu

SEQ ID NO: 3289369 - RNA, 16 nt, Mycobacterium tuberculosis H37Rv
ucgggcgcccgcguga

SEQ ID NO: 3289370 - RNA, 19 nt, Mycobacterium tuberculosis H37Rv
ucgggcgcggggcggccug

SEQ ID NO: 3289371 - RNA, 19 nt, Mycobacterium tuberculosis H37Rv
ucgggcggcgucgcggauc

SEQ ID NO: 3289372 - RNA, 14 nt, Mycobacterium tuberculosis H37Rv
ucgggcgucagcag

SEQ ID NO: 3289373 - RNA, 23 nt, Mycobacterium tuberculosis H37Rv
ucgggcgucagcaguucggcgau

SEQ ID NO: 3289374 - RNA, 21 nt, Mycobacterium tuberculosis H37Rv
ucgggcgucaugaugucgaca

SEQ ID NO: 3289375 - RNA, 16 nt, Mycobacterium tuberculosis H37Rv
ucgggcgugaucccgc

SEQ ID NO: 3289376 - RNA, 19 nt, Mycobacterium tuberculosis H37Rv
ucgggcgugcucgccgggu

SEQ ID NO: 3289377 - RNA, 17 nt, Mycobacterium tuberculosis H37Rv
ucgggcgugucgggaac

SEQ ID NO: 3289378 - RNA, 17 nt, Mycobacterium tuberculosis H37Rv
ucgggcuccagcagcgc

SEQ ID NO: 3289379 - RNA, 16 nt, Mycobacterium tuberculosis H37Rv
ucgggcucggagauga

SEQ ID NO: 3289380 - RNA, 17 nt, Mycobacterium tuberculosis H37Rv
ucgggcucggggaguuc

SEQ ID NO: 3289381 - RNA, 17 nt, Mycobacterium tuberculosis H37Rv
ucgggcugccaggagca

SEQ ID NO: 3289382 - RNA, 19 nt, Mycobacterium tuberculosis H37Rv
ucgggcuugacccuugggc

SEQ ID NO: 3289383 - RNA, 22 nt, Mycobacterium tuberculosis H37Rv
ucgggcuugcgcagcagcgugc

SEQ ID NO: 3289384 - RNA, 17 nt, Mycobacterium tuberculosis H37Rv
ucggggacggcgaaucg

SEQ ID NO: 3289385 - RNA, 15 nt, Mycobacterium tuberculosis H37Rv
ucggggagcugcggc

SEQ ID NO: 3289386 - RNA, 21 nt, Mycobacterium tuberculosis H37Rv
ucggggaguucgcgcagcacc

SEQ ID NO: 3289387 - RNA, 18 nt, Mycobacterium tuberculosis H37Rv
ucggggaugcugaccuuc

SEQ ID NO: 3289388 - RNA, 21 nt, Mycobacterium tuberculosis H37Rv
ucggggcaccacgccagcccg

SEQ ID NO: 3289389 - RNA, 17 nt, Mycobacterium tuberculosis H37Rv
ucggggccgcaggccag

SEQ ID NO: 3289390 - RNA, 18 nt, Mycobacterium tuberculosis H37Rv
ucggggcgcaccacgaug

SEQ ID NO: 3289391 - RNA, 22 nt, Mycobacterium tuberculosis H37Rv
ucggggcgcugcagcucacgac

SEQ ID NO: 3289392 - RNA, 19 nt, Mycobacterium tuberculosis H37Rv
ucgggggcuuaugcgucug

SEQ ID NO: 3289393 - RNA, 20 nt, Mycobacterium tuberculosis H37Rv
ucgggggcuuuuacgucugc

SEQ ID NO: 3289394 - RNA, 19 nt, Mycobacterium tuberculosis H37Rv
ucgggggcuuuugcgucug

SEQ ID NO: 3289395 - RNA, 20 nt, Mycobacterium tuberculosis H37Rv
ucgggggcuuuugcgucugc

SEQ ID NO: 3289396 - RNA, 17 nt, Mycobacterium tuberculosis H37Rv
ucgggguaaccggcgga

SEQ ID NO: 3289397 - RNA, 19 nt, Mycobacterium tuberculosis H37Rv
ucgggguaguugaggccgu

SEQ ID NO: 3289398 - RNA, 15 nt, Mycobacterium tuberculosis H37Rv
ucggggucaccggcu

SEQ ID NO: 3289399 - RNA, 19 nt, Mycobacterium tuberculosis H37Rv
ucggggucguugaggccgg

SEQ ID NO: 3289400 - RNA, 15 nt, Mycobacterium tuberculosis H37Rv
ucggggugcacaccg

SEQ ID NO: 3289401 - RNA, 18 nt, Mycobacterium tuberculosis H37Rv
ucgggguucuuccacagc

SEQ ID NO: 3289402 - RNA, 13 nt, Mycobacterium tuberculosis H37Rv
ucggguaccagca

SEQ ID NO: 3289403 - RNA, 13 nt, Mycobacterium tuberculosis H37Rv
ucggguagaucgc

SEQ ID NO: 3289404 - RNA, 20 nt, Mycobacterium tuberculosis H37Rv
ucgggucccagccuggcaac

SEQ ID NO: 3289405 - RNA, 17 nt, Mycobacterium tuberculosis H37Rv
ucggguccgacagcccc

SEQ ID NO: 3289406 - RNA, 17 nt, Mycobacterium tuberculosis H37Rv
ucgggucgaucaccgac

SEQ ID NO: 3289407 - RNA, 18 nt, Mycobacterium tuberculosis H37Rv
ucgggucgaucaccgaca

SEQ ID NO: 3289408 - RNA, 21 nt, Mycobacterium tuberculosis H37Rv
ucgggugguacagggugugcg

SEQ ID NO: 3289409 - RNA, 14 nt, Mycobacterium tuberculosis H37Rv
ucggguguggucac

SEQ ID NO: 3289410 - RNA, 18 nt, Mycobacterium tuberculosis H37Rv
ucggguuccacgaucacc

SEQ ID NO: 3289411 - RNA, 21 nt, Mycobacterium tuberculosis H37Rv
ucggguugguuggcucgcugg

SEQ ID NO: 3289412 - RNA, 16 nt, Mycobacterium tuberculosis H37Rv
ucgguaaagccgcgga

SEQ ID NO: 3289413 - RNA, 13 nt, Mycobacterium tuberculosis H37Rv
ucgguaagugccu

SEQ ID NO: 3289414 - RNA, 19 nt, Mycobacterium tuberculosis H37Rv
ucgguacgaauugggcucu

SEQ ID NO: 3289415 - RNA, 17 nt, Mycobacterium tuberculosis H37Rv
ucgguacgguggguggu

SEQ ID NO: 3289416 - RNA, 16 nt, Mycobacterium tuberculosis H37Rv
ucgguagcgaucgugc

SEQ ID NO: 3289417 - RNA, 15 nt, Mycobacterium tuberculosis H37Rv
ucgguagcugaccgu

SEQ ID NO: 3289418 - RNA, 17 nt, Mycobacterium tuberculosis H37Rv
ucgguaggcggugucca

SEQ ID NO: 3289419 - RNA, 12 nt, Mycobacterium tuberculosis H37Rv
ucggucaacucg

SEQ ID NO: 3289420 - RNA, 18 nt, Mycobacterium tuberculosis H37Rv
ucggucaaugcgcgcugg

SEQ ID NO: 3289421 - RNA, 22 nt, Mycobacterium tuberculosis H37Rv
ucggucaauucggugcgcuggc

SEQ ID NO: 3289422 - RNA, 12 nt, Mycobacterium tuberculosis H37Rv
ucggucaccgaa

SEQ ID NO: 3289423 - RNA, 12 nt, Mycobacterium tuberculosis H37Rv
ucggucaccgac

SEQ ID NO: 3289424 - RNA, 19 nt, Mycobacterium tuberculosis H37Rv
ucggucagccaccugacaa

SEQ ID NO: 3289425 - RNA, 19 nt, Mycobacterium tuberculosis H37Rv
ucggucagcgccgacucca

SEQ ID NO: 3289426 - RNA, 22 nt, Mycobacterium tuberculosis H37Rv
ucggucagcgucaggugcgcga

SEQ ID NO: 3289427 - RNA, 22 nt, Mycobacterium tuberculosis H37Rv
ucgucgacgcgucguggucggc

SEQ ID NO: 3289428 - RNA, 16 nt, Mycobacterium tuberculosis H37Rv
ucgucgacggccuggg

SEQ ID NO: 3289429 - RNA, 16 nt, Mycobacterium tuberculosis H37Rv
ucgucgagcaccaccc

SEQ ID NO: 3289430 - RNA, 22 nt, Mycobacterium tuberculosis H37Rv
ucgucgagcaccacccgggccu

SEQ ID NO: 3289431 - RNA, 16 nt, Mycobacterium tuberculosis H37Rv
ucgucgagcugaccac

SEQ ID NO: 3289432 - RNA, 15 nt, Mycobacterium tuberculosis H37Rv
ucgucgagcugaucc

SEQ ID NO: 3289433 - RNA, 16 nt, Mycobacterium tuberculosis H37Rv
ucgucgaggaagauca

SEQ ID NO: 3289434 - RNA, 15 nt, Mycobacterium tuberculosis H37Rv
ucgucgaggucacgc

SEQ ID NO: 3289435 - RNA, 22 nt, Mycobacterium tuberculosis H37Rv
ucgucgaggucacgcgaggcga

SEQ ID NO: 3289436 - RNA, 21 nt, Mycobacterium tuberculosis H37Rv
ucgucgagguccucgucgucg

SEQ ID NO: 3289437 - RNA, 14 nt, Mycobacterium tuberculosis H37Rv
ucgucgagucgaca

SEQ ID NO: 3289438 - RNA, 16 nt, Mycobacterium tuberculosis H37Rv
ucgucgaguuggccau

SEQ ID NO: 3289439 - RNA, 14 nt, Mycobacterium tuberculosis H37Rv
ucgucgaucgccgc

SEQ ID NO: 3289440 - RNA, 15 nt, Mycobacterium tuberculosis H37Rv
ucgucgaucuugccg

SEQ ID NO: 3289441 - RNA, 20 nt, Mycobacterium tuberculosis H37Rv
ucgucgauggucuccggacg

SEQ ID NO: 3289442 - RNA, 15 nt, Mycobacterium tuberculosis H37Rv
ucgucgaugucgacg

SEQ ID NO: 3289443 - RNA, 22 nt, Mycobacterium tuberculosis H37Rv
ucgucgcaaacuucgcgcacgc

SEQ ID NO: 3289444 - RNA, 19 nt, Mycobacterium tuberculosis H37Rv
ucgucgccaagcccaggcg

SEQ ID NO: 3289445 - RNA, 14 nt, Mycobacterium tuberculosis H37Rv
ucgucgccacgaug

SEQ ID NO: 3289446 - RNA, 13 nt, Mycobacterium tuberculosis H37Rv
ucgucgccagggc

SEQ ID NO: 3289447 - RNA, 14 nt, Mycobacterium tuberculosis H37Rv
ucgucgccagggcc

SEQ ID NO: 3289448 - RNA, 14 nt, Mycobacterium tuberculosis H37Rv
ucgucgcccaggcg

SEQ ID NO: 3289449 - RNA, 22 nt, Mycobacterium tuberculosis H37Rv
ucgucgcccaggcgugucgucg

SEQ ID NO: 3289450 - RNA, 22 nt, Mycobacterium tuberculosis H37Rv
ucgucgccgaccgucacugaug

SEQ ID NO: 3289451 - RNA, 14 nt, Mycobacterium tuberculosis H37Rv
ucgucgccgagcgg

SEQ ID NO: 3289452 - RNA, 22 nt, Mycobacterium tuberculosis H37Rv
ucgucgccgcgguagacgccgc

SEQ ID NO: 3289453 - RNA, 21 nt, Mycobacterium tuberculosis H37Rv
ucgucgccggcggcggugcgc

SEQ ID NO: 3289454 - RNA, 19 nt, Mycobacterium tuberculosis H37Rv
ucgucgccgucggugccgc

SEQ ID NO: 3289455 - RNA, 13 nt, Mycobacterium tuberculosis H37Rv
ucgucgcugagca

SEQ ID NO: 3289456 - RNA, 21 nt, Mycobacterium tuberculosis H37Rv
ucgucgcugcccaucacaccc

SEQ ID NO: 3289457 - RNA, 14 nt, Mycobacterium tuberculosis H37Rv
ucgucggcaggcag

SEQ ID NO: 3289458 - RNA, 18 nt, Mycobacterium tuberculosis H37Rv
ucgucggcaugggccggc

SEQ ID NO: 3289459 - RNA, 22 nt, Mycobacterium tuberculosis H37Rv
ucgucggcaugggccggcgccg

SEQ ID NO: 3289460 - RNA, 16 nt, Mycobacterium tuberculosis H37Rv
ucgucggccaccgcgg

SEQ ID NO: 3289461 - RNA, 22 nt, Mycobacterium tuberculosis H37Rv
ucgucggccagcagaucagguc

SEQ ID NO: 3289462 - RNA, 20 nt, Mycobacterium tuberculosis H37Rv
ucgucggccgacaccgccac

SEQ ID NO: 3289463 - RNA, 18 nt, Mycobacterium tuberculosis H37Rv
ucgucggcgggcugcagu

SEQ ID NO: 3289464 - RNA, 15 nt, Mycobacterium tuberculosis H37Rv
ucgucggcggugcgc

SEQ ID NO: 3289465 - RNA, 13 nt, Mycobacterium tuberculosis H37Rv
ucgucgggcaugc

SEQ ID NO: 3289466 - RNA, 20 nt, Mycobacterium tuberculosis H37Rv
ucgucgguaaugccgggccc

SEQ ID NO: 3289467 - RNA, 22 nt, Mycobacterium tuberculosis H37Rv
ucgucggucucaugcacccggu

SEQ ID NO: 3289468 - RNA, 15 nt, Mycobacterium tuberculosis H37Rv
ucgucgguugccacg

SEQ ID NO: 3289469 - RNA, 19 nt, Mycobacterium tuberculosis H37Rv
ucgucgguugccacgccgc

SEQ ID NO: 3289470 - RNA, 20 nt, Mycobacterium tuberculosis H37Rv
ucgucguccuguccgggcug

SEQ ID NO: 3289471 - RNA, 10 nt, Mycobacterium tuberculosis H37Rv
ucgucgucga

SEQ ID NO: 3289472 - RNA, 12 nt, Mycobacterium tuberculosis H37Rv
ucgucgucgaca

SEQ ID NO: 3289473 - RNA, 13 nt, Mycobacterium tuberculosis H37Rv
ucgucgucgguca

SEQ ID NO: 3289474 - RNA, 21 nt, Mycobacterium tuberculosis H37Rv
ucgucgugagucacccggccg

SEQ ID NO: 3289475 - RNA, 18 nt, Mycobacterium tuberculosis H37Rv
ucgucguggagcucacgu

SEQ ID NO: 3289476 - RNA, 15 nt, Mycobacterium tuberculosis H37Rv
ucgucgugucgccgc

SEQ ID NO: 3289477 - RNA, 16 nt, Mycobacterium tuberculosis H37Rv
ucgucugaaucgucgc

SEQ ID NO: 3289478 - RNA, 20 nt, Mycobacterium tuberculosis H37Rv
ucgucuugcguccauccgca

SEQ ID NO: 3289479 - RNA, 14 nt, Mycobacterium tuberculosis H37Rv
ucgugaacaacucc

SEQ ID NO: 3289480 - RNA, 18 nt, Mycobacterium tuberculosis H37Rv
ucgugaacacgucgcggu

SEQ ID NO: 3289481 - RNA, 13 nt, Mycobacterium tuberculosis H37Rv
ucgugacagcggc

SEQ ID NO: 3289482 - RNA, 23 nt, Mycobacterium tuberculosis H37Rv
ucgugacguuguaggagaacguc

SEQ ID NO: 3289483 - RNA, 14 nt, Mycobacterium tuberculosis H37Rv
ucgugagacgccgu

SEQ ID NO: 3289484 - RNA, 14 nt, Mycobacterium tuberculosis H37Rv
ucgugagacugggc

SEQ ID NO: 3289485 - RNA, 12 nt, Mycobacterium tuberculosis H37Rv
ucgugagccagc

SEQ ID NO: 3289486 - RNA, 14 nt, Mycobacterium tuberculosis H37Rv
ucgugagcggccag

SEQ ID NO: 3289487 - RNA, 14 nt, Mycobacterium tuberculosis H37Rv
ucgugcaaucgcgu

SEQ ID NO: 3289488 - RNA, 23 nt, Mycobacterium tuberculosis H37Rv
ucgugcaaugcuuccagcaucag

SEQ ID NO: 3289489 - RNA, 14 nt, Mycobacterium tuberculosis H37Rv
ucgugcaccgucgg

SEQ ID NO: 3289490 - RNA, 20 nt, Mycobacterium tuberculosis H37Rv
ucgugcacgacgacaucgag

SEQ ID NO: 3289491 - RNA, 21 nt, Mycobacterium tuberculosis H37Rv
ucgugcacgacgacaucgagc

SEQ ID NO: 3289492 - RNA, 16 nt, Mycobacterium tuberculosis H37Rv
ucgugcacgcacagcc

SEQ ID NO: 3289493 - RNA, 13 nt, Mycobacterium tuberculosis H37Rv
ucgugcacgcuga

SEQ ID NO: 3289494 - RNA, 12 nt, Mycobacterium tuberculosis H37Rv
ucgugcacggcg

SEQ ID NO: 3289495 - RNA, 14 nt, Mycobacterium tuberculosis H37Rv
ucgugcagcccaag

SEQ ID NO: 3289496 - RNA, 19 nt, Mycobacterium tuberculosis H37Rv
ucgugccagcagcaaucag

SEQ ID NO: 3289497 - RNA, 13 nt, Mycobacterium tuberculosis H37Rv
ucgugccggcguu

SEQ ID NO: 3289498 - RNA, 16 nt, Mycobacterium tuberculosis H37Rv
ucgugccggcguugcc

SEQ ID NO: 3289499 - RNA, 13 nt, Mycobacterium tuberculosis H37Rv
ucgugccgggcca

SEQ ID NO: 3289500 - RNA, 22 nt, Mycobacterium tuberculosis H37Rv
ucgugccgggccauucaccgcg

SEQ ID NO: 3289501 - RNA, 23 nt, Mycobacterium tuberculosis H37Rv
ucgugcgacaacacgaccucuug

SEQ ID NO: 3289502 - RNA, 21 nt, Mycobacterium tuberculosis H37Rv
ucgugcgacgcaggaucacac

SEQ ID NO: 3289503 - RNA, 20 nt, Mycobacterium tuberculosis H37Rv
ucgugcgauuuugugucugc

SEQ ID NO: 3289504 - RNA, 21 nt, Mycobacterium tuberculosis H37Rv
ucgugcgcuuggucgaccgcc

SEQ ID NO: 3289505 - RNA, 16 nt, Mycobacterium tuberculosis H37Rv
ucgugcgugcggcgaa

SEQ ID NO: 3289506 - RNA, 15 nt, Mycobacterium tuberculosis H37Rv
ucgugcugaagcugu

SEQ ID NO: 3289507 - RNA, 12 nt, Mycobacterium tuberculosis H37Rv
ucguggagcuca

SEQ ID NO: 3289508 - RNA, 22 nt, Mycobacterium tuberculosis H37Rv
ucguggagcucacgugcugccg

SEQ ID NO: 3289509 - RNA, 20 nt, Mycobacterium tuberculosis H37Rv
ucguggauccagccaugcgg

SEQ ID NO: 3289510 - RNA, 21 nt, Mycobacterium tuberculosis H37Rv
ucguggcgcgccgcaucggcg

SEQ ID NO: 3289511 - RNA, 20 nt, Mycobacterium tuberculosis H37Rv
ucguggcuuccggugguguc

SEQ ID NO: 3289512 - RNA, 14 nt, Mycobacterium tuberculosis H37Rv
ucgugggcugugcg

SEQ ID NO: 3289513 - RNA, 21 nt, Mycobacterium tuberculosis H37Rv
ucguggggaucgaccaugguc

SEQ ID NO: 3289514 - RNA, 12 nt, Mycobacterium tuberculosis H37Rv
ucguggguccgu

SEQ ID NO: 3289515 - RNA, 13 nt, Mycobacterium tuberculosis H37Rv
ucguggucgacgu

SEQ ID NO: 3289516 - RNA, 22 nt, Mycobacterium tuberculosis H37Rv
ucguggugagaucaugagguga

SEQ ID NO: 3289517 - RNA, 16 nt, Mycobacterium tuberculosis H37Rv
ucgugucaugcucacc

SEQ ID NO: 3289518 - RNA, 20 nt, Mycobacterium tuberculosis H37Rv
ucguguccaccggaccgacc

SEQ ID NO: 3289519 - RNA, 13 nt, Mycobacterium tuberculosis H37Rv
ucguucaccgauc

SEQ ID NO: 3289520 - RNA, 18 nt, Mycobacterium tuberculosis H37Rv
ucguucaccgcagcgggu

SEQ ID NO: 3289521 - RNA, 23 nt, Mycobacterium tuberculosis H37Rv
ucguucaccgcagcggguggugc

SEQ ID NO: 3289522 - RNA, 18 nt, Mycobacterium tuberculosis H37Rv
ucguucagcgccagcgcc

SEQ ID NO: 3289523 - RNA, 17 nt, Mycobacterium tuberculosis H37Rv
ucucguggaucugccuc

SEQ ID NO: 3289524 - RNA, 17 nt, Mycobacterium tuberculosis H37Rv
ucucguugauacggcau

SEQ ID NO: 3289525 - RNA, 18 nt, Mycobacterium tuberculosis H37Rv
ucucguuggugccuucac

SEQ ID NO: 3289526 - RNA, 18 nt, Mycobacterium tuberculosis H37Rv
ucucugagcgggcgggcc

SEQ ID NO: 3289527 - RNA, 20 nt, Mycobacterium tuberculosis H37Rv
ucucugagcgggcgggccug

SEQ ID NO: 3289528 - RNA, 20 nt, Mycobacterium tuberculosis H37Rv
ucucuucgcgcgcugggcgc

SEQ ID NO: 3289529 - RNA, 14 nt, Mycobacterium tuberculosis H37Rv
ucugaaccugcuga

SEQ ID NO: 3289530 - RNA, 22 nt, Mycobacterium tuberculosis H37Rv
ucugaacugacguuaccgccgc

SEQ ID NO: 3289531 - RNA, 11 nt, Mycobacterium tuberculosis H37Rv
ucugaagcccg

SEQ ID NO: 3289532 - RNA, 22 nt, Mycobacterium tuberculosis H37Rv
ucugacaucggccaagguuguc

SEQ ID NO: 3289533 - RNA, 20 nt, Mycobacterium tuberculosis H37Rv
ucugagaccucagccggcgg

SEQ ID NO: 3289534 - RNA, 22 nt, Mycobacterium tuberculosis H37Rv
ucugauccagccgcgucgucgg

SEQ ID NO: 3289535 - RNA, 15 nt, Mycobacterium tuberculosis H37Rv
ucugaucugagaccu

SEQ ID NO: 3289536 - RNA, 22 nt, Mycobacterium tuberculosis H37Rv
ucugaucuguguuugcggcuuc

SEQ ID NO: 3289537 - RNA, 15 nt, Mycobacterium tuberculosis H37Rv
ucugauucaggcgcc

SEQ ID NO: 3289538 - RNA, 22 nt, Mycobacterium tuberculosis H37Rv
ucugcacguugauccgcgcaac

SEQ ID NO: 3289539 - RNA, 13 nt, Mycobacterium tuberculosis H37Rv
ucugcagcacgcg

SEQ ID NO: 3289540 - RNA, 21 nt, Mycobacterium tuberculosis H37Rv
ucugcagcacgcgugguucgg

SEQ ID NO: 3289541 - RNA, 17 nt, Mycobacterium tuberculosis H37Rv
ucugcaggcccaggcug

SEQ ID NO: 3289542 - RNA, 13 nt, Mycobacterium tuberculosis H37Rv
ucugcaugcgcug

SEQ ID NO: 3289543 - RNA, 18 nt, Mycobacterium tuberculosis H37Rv
ucugccacguugaucccg

SEQ ID NO: 3289544 - RNA, 17 nt, Mycobacterium tuberculosis H37Rv
ucugccagcacccugau

SEQ ID NO: 3289545 - RNA, 20 nt, Mycobacterium tuberculosis H37Rv
ucugcccgauacccggugau

SEQ ID NO: 3289546 - RNA, 15 nt, Mycobacterium tuberculosis H37Rv
ucugcccugcacuuc

SEQ ID NO: 3289547 - RNA, 23 nt, Mycobacterium tuberculosis H37Rv
ucugccgccgcggccacaaccuc

SEQ ID NO: 3289548 - RNA, 22 nt, Mycobacterium tuberculosis H37Rv
ucugccgguaccggcgaucugc

SEQ ID NO: 3289549 - RNA, 23 nt, Mycobacterium tuberculosis H37Rv
ucugccucucagcacgguuguug

SEQ ID NO: 3289550 - RNA, 15 nt, Mycobacterium tuberculosis H37Rv
ucugcgacaagaccg

SEQ ID NO: 3289551 - RNA, 12 nt, Mycobacterium tuberculosis H37Rv
ucugcgacacca

SEQ ID NO: 3289552 - RNA, 17 nt, Mycobacterium tuberculosis H37Rv
ucugcgaucccgaucgc

SEQ ID NO: 3289553 - RNA, 13 nt, Mycobacterium tuberculosis H37Rv
ucugcgccacagc

SEQ ID NO: 3289554 - RNA, 13 nt, Mycobacterium tuberculosis H37Rv
ucugcgccaggcg

SEQ ID NO: 3289555 - RNA, 19 nt, Mycobacterium tuberculosis H37Rv
ucugcgccaggggcaccau

SEQ ID NO: 3289556 - RNA, 12 nt, Mycobacterium tuberculosis H37Rv
ucugcgccgccg

SEQ ID NO: 3289557 - RNA, 21 nt, Mycobacterium tuberculosis H37Rv
ucugcgccuucgccagcggcg

SEQ ID NO: 3289558 - RNA, 17 nt, Mycobacterium tuberculosis H37Rv
ucugcgcgaugcccacg

SEQ ID NO: 3289559 - RNA, 14 nt, Mycobacterium tuberculosis H37Rv
ucugcgcgcggaag

SEQ ID NO: 3289560 - RNA, 20 nt, Mycobacterium tuberculosis H37Rv
ucugcgcgucaggccagcgc

SEQ ID NO: 3289561 - RNA, 22 nt, Mycobacterium tuberculosis H37Rv
ucugcgcucccguacgccggcg

SEQ ID NO: 3289562 - RNA, 14 nt, Mycobacterium tuberculosis H37Rv
ucugcggcggucuc

SEQ ID NO: 3289563 - RNA, 12 nt, Mycobacterium tuberculosis H37Rv
ucugcgggccgg

SEQ ID NO: 3289564 - RNA, 14 nt, Mycobacterium tuberculosis H37Rv
ucugcguccaccac

SEQ ID NO: 3289565 - RNA, 17 nt, Mycobacterium tuberculosis H37Rv
ucugcgucugcucggcg

SEQ ID NO: 3289566 - RNA, 15 nt, Mycobacterium tuberculosis H37Rv
ucugcucgccaggcc

SEQ ID NO: 3289567 - RNA, 18 nt, Mycobacterium tuberculosis H37Rv
ucugcucgccgggcagcu

SEQ ID NO: 3289568 - RNA, 17 nt, Mycobacterium tuberculosis H37Rv
ucugcucgcgcaaggcg

SEQ ID NO: 3289569 - RNA, 18 nt, Mycobacterium tuberculosis H37Rv
ucugcucggcgcuagcug

SEQ ID NO: 3289570 - RNA, 16 nt, Mycobacterium tuberculosis H37Rv
ucugcugaccggaguu

SEQ ID NO: 3289571 - RNA, 19 nt, Mycobacterium tuberculosis H37Rv
ucugcugagcugcucgccg

SEQ ID NO: 3289572 - RNA, 23 nt, Mycobacterium tuberculosis H37Rv
ucugcugggcacgauggcucuca

SEQ ID NO: 3289573 - RNA, 20 nt, Mycobacterium tuberculosis H37Rv
ucuggacaucggccggcguc

SEQ ID NO: 3289574 - RNA, 20 nt, Mycobacterium tuberculosis H37Rv
ucuggacggucauccggccg

SEQ ID NO: 3289575 - RNA, 18 nt, Mycobacterium tuberculosis H37Rv
ucuggagugaggcugugc

SEQ ID NO: 3289576 - RNA, 22 nt, Mycobacterium tuberculosis H37Rv
ucuggagugaggcugugcccca

SEQ ID NO: 3289577 - RNA, 13 nt, Mycobacterium tuberculosis H37Rv
ucuggauacccag

SEQ ID NO: 3289578 - RNA, 22 nt, Mycobacterium tuberculosis H37Rv
ucuggaugucccaugcacggcc

SEQ ID NO: 3289579 - RNA, 18 nt, Mycobacterium tuberculosis H37Rv
ucuggcacaugcucaguc

SEQ ID NO: 3289580 - RNA, 15 nt, Mycobacterium tuberculosis H37Rv
ucuggcaggccagca

SEQ ID NO: 3289581 - RNA, 15 nt, Mycobacterium tuberculosis H37Rv
ucuggcgaacaguga

SEQ ID NO: 3289582 - RNA, 19 nt, Mycobacterium tuberculosis H37Rv
ucuggcgacgauucacggc

SEQ ID NO: 3289583 - RNA, 18 nt, Mycobacterium tuberculosis H37Rv
ucuggcgaugacgaucgc

SEQ ID NO: 3289584 - RNA, 19 nt, Mycobacterium tuberculosis H37Rv
ucuggcuccgauucuucga

SEQ ID NO: 3289585 - RNA, 14 nt, Mycobacterium tuberculosis H37Rv
ucuggcucgcgaac

SEQ ID NO: 3289586 - RNA, 13 nt, Mycobacterium tuberculosis H37Rv
ucugggcgaucgc

SEQ ID NO: 3289587 - RNA, 11 nt, Mycobacterium tuberculosis H37Rv
ucugggcuguc

SEQ ID NO: 3289588 - RNA, 20 nt, Mycobacterium tuberculosis H37Rv
ucuggggcaccacgcugugc

SEQ ID NO: 3289589 - RNA, 18 nt, Mycobacterium tuberculosis H37Rv
ucugggguuggcucggcg

SEQ ID NO: 3289590 - RNA, 14 nt, Mycobacterium tuberculosis H37Rv
ucuggguaacaccu

SEQ ID NO: 3289591 - RNA, 14 nt, Mycobacterium tuberculosis H37Rv
ucugggugcagguu

SEQ ID NO: 3289592 - RNA, 22 nt, Mycobacterium tuberculosis H37Rv
ucuggucgaccaucgguuugca

SEQ ID NO: 3289593 - RNA, 22 nt, Mycobacterium tuberculosis H37Rv
ucuggucggcuacggccagugc

SEQ ID NO: 3289594 - RNA, 15 nt, Mycobacterium tuberculosis H37Rv
ucugguggcagcgca

SEQ ID NO: 3289595 - RNA, 21 nt, Mycobacterium tuberculosis H37Rv
ucugguggcgcugaagccgac

SEQ ID NO: 3289596 - RNA, 20 nt, Mycobacterium tuberculosis H37Rv
ucugguugucgaucucggcc

SEQ ID NO: 3289597 - RNA, 16 nt, Mycobacterium tuberculosis H37Rv
ucugucauugcugccc

SEQ ID NO: 3289598 - RNA, 14 nt, Mycobacterium tuberculosis H37Rv
ucugugcugcgcug

SEQ ID NO: 3289599 - RNA, 20 nt, Mycobacterium tuberculosis H37Rv
ucugugggugguugugucgg

SEQ ID NO: 3289600 - RNA, 18 nt, Mycobacterium tuberculosis H37Rv
ucugugugacggaggucg

SEQ ID NO: 3289601 - RNA, 22 nt, Mycobacterium tuberculosis H37Rv
ucuucaacgucgagauccucgu

SEQ ID NO: 3289602 - RNA, 22 nt, Mycobacterium tuberculosis H37Rv
ucuucagcugcggauacagccg

SEQ ID NO: 3289603 - RNA, 23 nt, Mycobacterium tuberculosis H37Rv
ucuucagguccaccgcugccggc

SEQ ID NO: 3289604 - RNA, 18 nt, Mycobacterium tuberculosis H37Rv
ucuuccccucggccgccc

SEQ ID NO: 3289605 - RNA, 19 nt, Mycobacterium tuberculosis H37Rv
ucuuccggugcgccgaucc

SEQ ID NO: 3289606 - RNA, 22 nt, Mycobacterium tuberculosis H37Rv
ucuucgaaggcgugggugucgg

SEQ ID NO: 3289607 - RNA, 20 nt, Mycobacterium tuberculosis H37Rv
ucuucgccgaugaauuucau

SEQ ID NO: 3289608 - RNA, 21 nt, Mycobacterium tuberculosis H37Rv
ucuucgccgucacgcacgccg

SEQ ID NO: 3289609 - RNA, 17 nt, Mycobacterium tuberculosis H37Rv
ucuucgcgauguccucg

SEQ ID NO: 3289610 - RNA, 16 nt, Mycobacterium tuberculosis H37Rv
ucuucgcuaccuucuu

SEQ ID NO: 3289611 - RNA, 19 nt, Mycobacterium tuberculosis H37Rv
ucuucgggcucguccagca

SEQ ID NO: 3289612 - RNA, 20 nt, Mycobacterium tuberculosis H37Rv
ucuucgguuaaggugcgauc

SEQ ID NO: 3289613 - RNA, 14 nt, Mycobacterium tuberculosis H37Rv
ucuucucggcuacu

SEQ ID NO: 3289614 - RNA, 14 nt, Mycobacterium tuberculosis H37Rv
ucuucuucuugacc

SEQ ID NO: 3289615 - RNA, 16 nt, Mycobacterium tuberculosis H37Rv
ucuugaacugggccuc

SEQ ID NO: 3289616 - RNA, 16 nt, Mycobacterium tuberculosis H37Rv
ucuugaccgcaccggc

SEQ ID NO: 3289617 - RNA, 23 nt, Mycobacterium tuberculosis H37Rv
ucuugaccgcggugacucggccu

SEQ ID NO: 3289618 - RNA, 19 nt, Mycobacterium tuberculosis H37Rv
ucuugcagugcgccagcga

SEQ ID NO: 3289619 - RNA, 15 nt, Mycobacterium tuberculosis H37Rv
ugacacccgggccac

SEQ ID NO: 3289620 - RNA, 21 nt, Mycobacterium tuberculosis H37Rv
ugacaccgaaccgccgcugcc

SEQ ID NO: 3289621 - RNA, 17 nt, Mycobacterium tuberculosis H37Rv
ugacaccgaccgggucg

SEQ ID NO: 3289622 - RNA, 21 nt, Mycobacterium tuberculosis H37Rv
ugacaccgccggggugcaccg

SEQ ID NO: 3289623 - RNA, 13 nt, Mycobacterium tuberculosis H37Rv
ugacaccggccac

SEQ ID NO: 3289624 - RNA, 18 nt, Mycobacterium tuberculosis H37Rv
ugacaccggggacgucga

SEQ ID NO: 3289625 - RNA, 20 nt, Mycobacterium tuberculosis H37Rv
ugacacgacgugcaggaaca

SEQ ID NO: 3289626 - RNA, 18 nt, Mycobacterium tuberculosis H37Rv
ugacacgaugcccggcau

SEQ ID NO: 3289627 - RNA, 24 nt, Mycobacterium tuberculosis H37Rv
ugacacugccuuaaccgagccgac

SEQ ID NO: 3289628 - RNA, 17 nt, Mycobacterium tuberculosis H37Rv
ugacagacacagcaccg

SEQ ID NO: 3289629 - RNA, 18 nt, Mycobacterium tuberculosis H37Rv
ugacagacaucgcgacga

SEQ ID NO: 3289630 - RNA, 23 nt, Mycobacterium tuberculosis H37Rv
ugacagggcggcaaccucaugca

SEQ ID NO: 3289631 - RNA, 13 nt, Mycobacterium tuberculosis H37Rv
ugacaguccccag

SEQ ID NO: 3289632 - RNA, 20 nt, Mycobacterium tuberculosis H37Rv
ugacauccuugacgcggcca

SEQ ID NO: 3289633 - RNA, 22 nt, Mycobacterium tuberculosis H37Rv
ugacaucggccaagguugucgc

SEQ ID NO: 3289634 - RNA, 15 nt, Mycobacterium tuberculosis H37Rv
ugacaucggucagca

SEQ ID NO: 3289635 - RNA, 20 nt, Mycobacterium tuberculosis H37Rv
ugacaucgucgccagggccg

SEQ ID NO: 3289636 - RNA, 22 nt, Mycobacterium tuberculosis H37Rv
ugaccaacaccccccccaccca

SEQ ID NO: 3289637 - RNA, 18 nt, Mycobacterium tuberculosis H37Rv
ugaccaacgucgcuccga

SEQ ID NO: 3289638 - RNA, 22 nt, Mycobacterium tuberculosis H37Rv
ugaccaauccacugaucaaggc

SEQ ID NO: 3289639 - RNA, 23 nt, Mycobacterium tuberculosis H37Rv
ugaccaaugucagugccccgccc

SEQ ID NO: 3289640 - RNA, 21 nt, Mycobacterium tuberculosis H37Rv
ugaccacaaccgugagcacca

SEQ ID NO: 3289641 - RNA, 13 nt, Mycobacterium tuberculosis H37Rv
ugaccaccaccga

SEQ ID NO: 3289642 - RNA, 18 nt, Mycobacterium tuberculosis H37Rv
ugaccaccaccgagccgu

SEQ ID NO: 3289643 - RNA, 14 nt, Mycobacterium tuberculosis H37Rv
ugaccaccacgaug

SEQ ID NO: 3289644 - RNA, 17 nt, Mycobacterium tuberculosis H37Rv
ugaccaccgccgacagg

SEQ ID NO: 3289645 - RNA, 17 nt, Mycobacterium tuberculosis H37Rv
ugaccacgcugcuggug

SEQ ID NO: 3289646 - RNA, 20 nt, Mycobacterium tuberculosis H37Rv
ugaccacgcugcuggugacg

SEQ ID NO: 3289647 - RNA, 12 nt, Mycobacterium tuberculosis H37Rv
ugaccacgucgg

SEQ ID NO: 3289648 - RNA, 14 nt, Mycobacterium tuberculosis H37Rv
ugaccagaucgacg

SEQ ID NO: 3289649 - RNA, 22 nt, Mycobacterium tuberculosis H37Rv
ugaccaggaagcagaaguccuc

SEQ ID NO: 3289650 - RNA, 21 nt, Mycobacterium tuberculosis H37Rv
ugaccaggccgagcucguugc

SEQ ID NO: 3289651 - RNA, 22 nt, Mycobacterium tuberculosis H37Rv
ugaccaggucggucaggucgag

SEQ ID NO: 3289652 - RNA, 10 nt, Mycobacterium tuberculosis H37Rv
ugaccaggug

SEQ ID NO: 3289653 - RNA, 11 nt, Mycobacterium tuberculosis H37Rv
ugaccaggugc

SEQ ID NO: 3289654 - RNA, 22 nt, Mycobacterium tuberculosis H37Rv
ugaccaucguguacuggucugg

SEQ ID NO: 3289655 - RNA, 12 nt, Mycobacterium tuberculosis H37Rv
ugacccacugca

SEQ ID NO: 3289656 - RNA, 22 nt, Mycobacterium tuberculosis H37Rv
ugacccauacgaacucaccgcc

SEQ ID NO: 3289657 - RNA, 17 nt, Mycobacterium tuberculosis H37Rv
ugacccaucucgucguc

SEQ ID NO: 3289658 - RNA, 17 nt, Mycobacterium tuberculosis H37Rv
ugacccauucucggccg

SEQ ID NO: 3289659 - RNA, 13 nt, Mycobacterium tuberculosis H37Rv
ugacccccagcag

SEQ ID NO: 3289660 - RNA, 14 nt, Mycobacterium tuberculosis H37Rv
ugacccccuagacc

SEQ ID NO: 3289661 - RNA, 22 nt, Mycobacterium tuberculosis H37Rv
ugaccccgccggcugcggaggc

SEQ ID NO: 3289662 - RNA, 17 nt, Mycobacterium tuberculosis H37Rv
ugaccccggcagcgccc

SEQ ID NO: 3289663 - RNA, 19 nt, Mycobacterium tuberculosis H37Rv
ugaccccguaggcgccgaa

SEQ ID NO: 3289664 - RNA, 24 nt, Mycobacterium tuberculosis H37Rv
ugacccgacaugguccgaccagcg

SEQ ID NO: 3289665 - RNA, 14 nt, Mycobacterium tuberculosis H37Rv
ugacccgccgacga

SEQ ID NO: 3289666 - RNA, 15 nt, Mycobacterium tuberculosis H37Rv
ugacccggcagcccg

SEQ ID NO: 3289667 - RNA, 17 nt, Mycobacterium tuberculosis H37Rv
ugacccggcagcccggc

SEQ ID NO: 3289668 - RNA, 22 nt, Mycobacterium tuberculosis H37Rv
ugacccggcagcccggcggccg

SEQ ID NO: 3289669 - RNA, 17 nt, Mycobacterium tuberculosis H37Rv
ugacccgggccgggccg

SEQ ID NO: 3289670 - RNA, 23 nt, Mycobacterium tuberculosis H37Rv
ugacccguacccacgacgggccg

SEQ ID NO: 3289671 - RNA, 18 nt, Mycobacterium tuberculosis H37Rv
ugacccucagcaccgcug

SEQ ID NO: 3289672 - RNA, 16 nt, Mycobacterium tuberculosis H37Rv
ugacccuccgcaucgc

SEQ ID NO: 3289673 - RNA, 18 nt, Mycobacterium tuberculosis H37Rv
ugaccgaacgcacgucga

SEQ ID NO: 3289674 - RNA, 14 nt, Mycobacterium tuberculosis H37Rv
ugaccgaagaagcc

SEQ ID NO: 3289675 - RNA, 22 nt, Mycobacterium tuberculosis H37Rv
ugaccgaagucugcagacgguc

SEQ ID NO: 3289676 - RNA, 15 nt, Mycobacterium tuberculosis H37Rv
ugaccgaauggccgc

SEQ ID NO: 3289677 - RNA, 14 nt, Mycobacterium tuberculosis H37Rv
ugaccgacgccguc

SEQ ID NO: 3289678 - RNA, 16 nt, Mycobacterium tuberculosis H37Rv
ugaccgacgccgucga

SEQ ID NO: 3289679 - RNA, 21 nt, Mycobacterium tuberculosis H37Rv
ugaccgcaaccgguaucgccg

SEQ ID NO: 3289680 - RNA, 12 nt, Mycobacterium tuberculosis H37Rv
ugaccgcaccgg

SEQ ID NO: 3289681 - RNA, 18 nt, Mycobacterium tuberculosis H37Rv
ugaccgcaccggccgcua

SEQ ID NO: 3289682 - RNA, 22 nt, Mycobacterium tuberculosis H37Rv
ugaccgcagcacucccugguuc

SEQ ID NO: 3289683 - RNA, 17 nt, Mycobacterium tuberculosis H37Rv
ugaccgccaucgccaac

SEQ ID NO: 3289684 - RNA, 15 nt, Mycobacterium tuberculosis H37Rv
ugaccgccgacacca

SEQ ID NO: 3289685 - RNA, 17 nt, Mycobacterium tuberculosis H37Rv
ugaccgccgcgccggca

SEQ ID NO: 3289686 - RNA, 19 nt, Mycobacterium tuberculosis H37Rv
ugaccgcgaucgccgacgc

SEQ ID NO: 3289687 - RNA, 14 nt, Mycobacterium tuberculosis H37Rv
ugaccgcgaugauc

SEQ ID NO: 3289688 - RNA, 22 nt, Mycobacterium tuberculosis H37Rv
ugaccgcgaugaucgcaucgac

SEQ ID NO: 3289689 - RNA, 20 nt, Mycobacterium tuberculosis H37Rv
ugaccgcgaugucacggaug

SEQ ID NO: 3289690 - RNA, 18 nt, Mycobacterium tuberculosis H37Rv
ugaccgcggucugcgcgu

SEQ ID NO: 3289691 - RNA, 21 nt, Mycobacterium tuberculosis H37Rv
ugaccgcggugacucggccuc

SEQ ID NO: 3289692 - RNA, 14 nt, Mycobacterium tuberculosis H37Rv
ugaccgggcaggua

SEQ ID NO: 3289693 - RNA, 22 nt, Mycobacterium tuberculosis H37Rv
ugaccggggcgcccggccaggu

SEQ ID NO: 3289694 - RNA, 22 nt, Mycobacterium tuberculosis H37Rv
ugaccgggucgaugacgccguc

SEQ ID NO: 3289695 - RNA, 14 nt, Mycobacterium tuberculosis H37Rv
ugaccgggucgccg

SEQ ID NO: 3289696 - RNA, 18 nt, Mycobacterium tuberculosis H37Rv
ugaccgggucgccgauga

SEQ ID NO: 3289697 - RNA, 18 nt, Mycobacterium tuberculosis H37Rv
ugaccgguauuaccgccg

SEQ ID NO: 3289698 - RNA, 18 nt, Mycobacterium tuberculosis H37Rv
ugaccgguguuccgccca

SEQ ID NO: 3289699 - RNA, 18 nt, Mycobacterium tuberculosis H37Rv
ugaccgguucccgggcag

SEQ ID NO: 3289700 - RNA, 22 nt, Mycobacterium tuberculosis H37Rv
ugaccgucugcgacccgggccg

SEQ ID NO: 3289701 - RNA, 14 nt, Mycobacterium tuberculosis H37Rv
ugaccuauugaacc

SEQ ID NO: 3289702 - RNA, 13 nt, Mycobacterium tuberculosis H37Rv
ugaccucaccaac

SEQ ID NO: 3289703 - RNA, 13 nt, Mycobacterium tuberculosis H37Rv
ugaccucggcgac

SEQ ID NO: 3289704 - RNA, 18 nt, Mycobacterium tuberculosis H37Rv
ugaccucggcgaccagaa

SEQ ID NO: 3289705 - RNA, 15 nt, Mycobacterium tuberculosis H37Rv
ugaccucggcgacga

SEQ ID NO: 3289706 - RNA, 15 nt, Mycobacterium tuberculosis H37Rv
ugaccucggugaaga

SEQ ID NO: 3289707 - RNA, 16 nt, Mycobacterium tuberculosis H37Rv
ugaccugauccggccg

SEQ ID NO: 3289708 - RNA, 15 nt, Mycobacterium tuberculosis H37Rv
ugaccugcagcgcau

SEQ ID NO: 3289709 - RNA, 17 nt, Mycobacterium tuberculosis H37Rv
ugaccugggcgccccag

SEQ ID NO: 3289710 - RNA, 17 nt, Mycobacterium tuberculosis H37Rv
ugaccuguuuggggcug

SEQ ID NO: 3289711 - RNA, 21 nt, Mycobacterium tuberculosis H37Rv
ugaccuucccgucgacgagcg

SEQ ID NO: 3289712 - RNA, 18 nt, Mycobacterium tuberculosis H37Rv
ugaccuuguugaccacca

SEQ ID NO: 3289713 - RNA, 14 nt, Mycobacterium tuberculosis H37Rv
ugacgaacaagaaa

SEQ ID NO: 3289714 - RNA, 14 nt, Mycobacterium tuberculosis H37Rv
ugacgaacccaccg

SEQ ID NO: 3289715 - RNA, 18 nt, Mycobacterium tuberculosis H37Rv
ugauccgccggcaacgcg

SEQ ID NO: 3289716 - RNA, 18 nt, Mycobacterium tuberculosis H37Rv
ugauccgccugccgacgg

SEQ ID NO: 3289717 - RNA, 19 nt, Mycobacterium tuberculosis H37Rv
ugauccgcgcaacuuccau

SEQ ID NO: 3289718 - RNA, 13 nt, Mycobacterium tuberculosis H37Rv
ugauccggucgua

SEQ ID NO: 3289719 - RNA, 21 nt, Mycobacterium tuberculosis H37Rv
ugaucgaacacggcacaaucg

SEQ ID NO: 3289720 - RNA, 16 nt, Mycobacterium tuberculosis H37Rv
ugaucgaauacaccug

SEQ ID NO: 3289721 - RNA, 20 nt, Mycobacterium tuberculosis H37Rv
ugaucgacaccgagccacga

SEQ ID NO: 3289722 - RNA, 18 nt, Mycobacterium tuberculosis H37Rv
ugaucgacggccagccca

SEQ ID NO: 3289723 - RNA, 21 nt, Mycobacterium tuberculosis H37Rv
ugaucgagcagggugaccagg

SEQ ID NO: 3289724 - RNA, 21 nt, Mycobacterium tuberculosis H37Rv
ugaucgagcaguuccagcucg

SEQ ID NO: 3289725 - RNA, 17 nt, Mycobacterium tuberculosis H37Rv
ugaucgcacaggaagcc

SEQ ID NO: 3289726 - RNA, 12 nt, Mycobacterium tuberculosis H37Rv
ugaucgcaucga

SEQ ID NO: 3289727 - RNA, 15 nt, Mycobacterium tuberculosis H37Rv
ugaucgccacccggu

SEQ ID NO: 3289728 - RNA, 14 nt, Mycobacterium tuberculosis H37Rv
ugaucgccauggug

SEQ ID NO: 3289729 - RNA, 14 nt, Mycobacterium tuberculosis H37Rv
ugaucgccgggccg

SEQ ID NO: 3289730 - RNA, 19 nt, Mycobacterium tuberculosis H37Rv
ugaucgcgguccaacagcg

SEQ ID NO: 3289731 - RNA, 15 nt, Mycobacterium tuberculosis H37Rv
ugaucgcuggcgacc

SEQ ID NO: 3289732 - RNA, 11 nt, Mycobacterium tuberculosis H37Rv
ugaucggcaac

SEQ ID NO: 3289733 - RNA, 19 nt, Mycobacterium tuberculosis H37Rv
ugaucggcgaggucccggc

SEQ ID NO: 3289734 - RNA, 15 nt, Mycobacterium tuberculosis H37Rv
ugaucggcgcggccg

SEQ ID NO: 3289735 - RNA, 17 nt, Mycobacterium tuberculosis H37Rv
ugaucguccagcccaga

SEQ ID NO: 3289736 - RNA, 18 nt, Mycobacterium tuberculosis H37Rv
ugaucgugaacacgucgc

SEQ ID NO: 3289737 - RNA, 13 nt, Mycobacterium tuberculosis H37Rv
ugaucucggcgaa

SEQ ID NO: 3289738 - RNA, 17 nt, Mycobacterium tuberculosis H37Rv
ugaucugagcgcgggug

SEQ ID NO: 3289739 - RNA, 13 nt, Mycobacterium tuberculosis H37Rv
ugaucuggccacg

SEQ ID NO: 3289740 - RNA, 24 nt, Mycobacterium tuberculosis H37Rv
ugaucuucggcgaucgucucggug

SEQ ID NO: 3289741 - RNA, 13 nt, Mycobacterium tuberculosis H37Rv
ugaucuugacggu

SEQ ID NO: 3289742 - RNA, 19 nt, Mycobacterium tuberculosis H37Rv
ugaucuugccacuccagga

SEQ ID NO: 3289743 - RNA, 22 nt, Mycobacterium tuberculosis H37Rv
ugaucuugccacuccaggagcc

SEQ ID NO: 3289744 - RNA, 18 nt, Mycobacterium tuberculosis H37Rv
ugaugaccaggucgguca

SEQ ID NO: 3289745 - RNA, 23 nt, Mycobacterium tuberculosis H37Rv
ugaugacgccgucggcgcgcacc

SEQ ID NO: 3289746 - RNA, 18 nt, Mycobacterium tuberculosis H37Rv
ugaugacguugcagccgg

SEQ ID NO: 3289747 - RNA, 13 nt, Mycobacterium tuberculosis H37Rv
ugaugaucggaaa

SEQ ID NO: 3289748 - RNA, 17 nt, Mycobacterium tuberculosis H37Rv
ugaugcaacgccaaaau

SEQ ID NO: 3289749 - RNA, 21 nt, Mycobacterium tuberculosis H37Rv
ugaugcagugauugagcagca

SEQ ID NO: 3289750 - RNA, 23 nt, Mycobacterium tuberculosis H37Rv
ugaugccggcgccggcccgcagc

SEQ ID NO: 3289751 - RNA, 21 nt, Mycobacterium tuberculosis H37Rv
ugaugccguucggacccaccu

SEQ ID NO: 3289752 - RNA, 14 nt, Mycobacterium tuberculosis H37Rv
ugaugcggccgcgg

SEQ ID NO: 3289753 - RNA, 16 nt, Mycobacterium tuberculosis H37Rv
ugaugcgggcucggcu

SEQ ID NO: 3289754 - RNA, 20 nt, Mycobacterium tuberculosis H37Rv
ugaugcucgacaaccacggc

SEQ ID NO: 3289755 - RNA, 14 nt, Mycobacterium tuberculosis H37Rv
ugaugcuggccagg

SEQ ID NO: 3289756 - RNA, 15 nt, Mycobacterium tuberculosis H37Rv
ugauggacaccagcc

SEQ ID NO: 3289757 - RNA, 14 nt, Mycobacterium tuberculosis H37Rv
ugauggacagcugc

SEQ ID NO: 3289758 - RNA, 14 nt, Mycobacterium tuberculosis H37Rv
ugauggaguggcug

SEQ ID NO: 3289759 - RNA, 18 nt, Mycobacterium tuberculosis H37Rv
ugauggccaucuggccgc

SEQ ID NO: 3289760 - RNA, 13 nt, Mycobacterium tuberculosis H37Rv
ugauggccgacgu

SEQ ID NO: 3289761 - RNA, 16 nt, Mycobacterium tuberculosis H37Rv
ugauggccgucagcca

SEQ ID NO: 3289762 - RNA, 22 nt, Mycobacterium tuberculosis H37Rv
ugauggccucgcgaauccuggc

SEQ ID NO: 3289763 - RNA, 20 nt, Mycobacterium tuberculosis H37Rv
ugauggcgcgaucggugccg

SEQ ID NO: 3289764 - RNA, 22 nt, Mycobacterium tuberculosis H37Rv
ugauggcguauagcaugccgcg

SEQ ID NO: 3289765 - RNA, 15 nt, Mycobacterium tuberculosis H37Rv
ugaugggcagccgcc

SEQ ID NO: 3289766 - RNA, 19 nt, Mycobacterium tuberculosis H37Rv
ugaugggcauggugguggc

SEQ ID NO: 3289767 - RNA, 20 nt, Mycobacterium tuberculosis H37Rv
ugaugggccgguuccucagc

SEQ ID NO: 3289768 - RNA, 19 nt, Mycobacterium tuberculosis H37Rv
ugaugggggagccggugac

SEQ ID NO: 3289769 - RNA, 15 nt, Mycobacterium tuberculosis H37Rv
ugaugguaccgccac

SEQ ID NO: 3289770 - RNA, 22 nt, Mycobacterium tuberculosis H37Rv
ugauggucaaugccggccgcgg

SEQ ID NO: 3289771 - RNA, 18 nt, Mycobacterium tuberculosis H37Rv
ugauggucaccgucugca

SEQ ID NO: 3289772 - RNA, 22 nt, Mycobacterium tuberculosis H37Rv
ugauggucacggcgucgacugg

SEQ ID NO: 3289773 - RNA, 18 nt, Mycobacterium tuberculosis H37Rv
ugauggucagcuggccgc

SEQ ID NO: 3289774 - RNA, 13 nt, Mycobacterium tuberculosis H37Rv
ugauggugccauc

SEQ ID NO: 3289775 - RNA, 16 nt, Mycobacterium tuberculosis H37Rv
ugaugguucaugaaca

SEQ ID NO: 3289776 - RNA, 16 nt, Mycobacterium tuberculosis H37Rv
ugauguaaccguagcc

SEQ ID NO: 3289777 - RNA, 17 nt, Mycobacterium tuberculosis H37Rv
ugauguagggcugcucc

SEQ ID NO: 3289778 - RNA, 19 nt, Mycobacterium tuberculosis H37Rv
ugauguagggcugcuccug

SEQ ID NO: 3289779 - RNA, 21 nt, Mycobacterium tuberculosis H37Rv
ugaugucaacgugucccaagc

SEQ ID NO: 3289780 - RNA, 17 nt, Mycobacterium tuberculosis H37Rv
ugauguccgcacaacga

SEQ ID NO: 3289781 - RNA, 21 nt, Mycobacterium tuberculosis H37Rv
ugauguccucccaucccaugu

SEQ ID NO: 3289782 - RNA, 14 nt, Mycobacterium tuberculosis H37Rv
ugaugucggugcgu

SEQ ID NO: 3289783 - RNA, 21 nt, Mycobacterium tuberculosis H37Rv
ugauguugaucguugugcacc

SEQ ID NO: 3289784 - RNA, 12 nt, Mycobacterium tuberculosis H37Rv
ugauuccggguc

SEQ ID NO: 3289785 - RNA, 23 nt, Mycobacterium tuberculosis H37Rv
ugauuccguaugucccggugcgg

SEQ ID NO: 3289786 - RNA, 22 nt, Mycobacterium tuberculosis H37Rv
ugauugacugcuugguggucuu

SEQ ID NO: 3289787 - RNA, 12 nt, Mycobacterium tuberculosis H37Rv
ugauugcgcggg

SEQ ID NO: 3289788 - RNA, 22 nt, Mycobacterium tuberculosis H37Rv
ugauugcggaacaccaccaggc

SEQ ID NO: 3289789 - RNA, 15 nt, Mycobacterium tuberculosis H37Rv
ugauuggggccaggu

SEQ ID NO: 3289790 - RNA, 21 nt, Mycobacterium tuberculosis H37Rv
ugauugucggcgaaaugaagu

SEQ ID NO: 3289791 - RNA, 19 nt, Mycobacterium tuberculosis H37Rv
ugauuguguuccaccagcg

SEQ ID NO: 3289792 - RNA, 23 nt, Mycobacterium tuberculosis H37Rv
ugcaaagucgggggucgcacccu

SEQ ID NO: 3289793 - RNA, 14 nt, Mycobacterium tuberculosis H37Rv
ugcaaaucgucgau

SEQ ID NO: 3289794 - RNA, 12 nt, Mycobacterium tuberculosis H37Rv
ugcaacacaccg

SEQ ID NO: 3289795 - RNA, 13 nt, Mycobacterium tuberculosis H37Rv
ugcaacacaccgc

SEQ ID NO: 3289796 - RNA, 12 nt, Mycobacterium tuberculosis H37Rv
ugcaacaccgca

SEQ ID NO: 3289797 - RNA, 16 nt, Mycobacterium tuberculosis H37Rv
ugcaacaccgcaccgg

SEQ ID NO: 3289798 - RNA, 21 nt, Mycobacterium tuberculosis H37Rv
ugcaacacgccggcccgguga

SEQ ID NO: 3289799 - RNA, 19 nt, Mycobacterium tuberculosis H37Rv
ugcaaccccaaguccagca

SEQ ID NO: 3289800 - RNA, 22 nt, Mycobacterium tuberculosis H37Rv
ugcaaccccaaguccagcagcg

SEQ ID NO: 3289801 - RNA, 12 nt, Mycobacterium tuberculosis H37Rv
ugcaaccgccgg

SEQ ID NO: 3289802 - RNA, 20 nt, Mycobacterium tuberculosis H37Rv
ugcaaccucggcuuggccgg

SEQ ID NO: 3289803 - RNA, 19 nt, Mycobacterium tuberculosis H37Rv
ugcaacgauugaacucugg

SEQ ID NO: 3289804 - RNA, 13 nt, Mycobacterium tuberculosis H37Rv
ugcaacgcgccuu

SEQ ID NO: 3289805 - RNA, 20 nt, Mycobacterium tuberculosis H37Rv
ugcaagaccguuacaccauc

SEQ ID NO: 3289806 - RNA, 16 nt, Mycobacterium tuberculosis H37Rv
ugcaagcuaagcgccu

SEQ ID NO: 3289807 - RNA, 17 nt, Mycobacterium tuberculosis H37Rv
ugcaaucgcgugcugga

SEQ ID NO: 3289808 - RNA, 15 nt, Mycobacterium tuberculosis H37Rv
ugcaaugcuggcggc

SEQ ID NO: 3289809 - RNA, 18 nt, Mycobacterium tuberculosis H37Rv
ugcaaugcuggcggcgcg

SEQ ID NO: 3289810 - RNA, 21 nt, Mycobacterium tuberculosis H37Rv
ugcaauuucagccuuguugcc

SEQ ID NO: 3289811 - RNA, 19 nt, Mycobacterium tuberculosis H37Rv
ugcagcgcacgcagccgau

SEQ ID NO: 3289812 - RNA, 21 nt, Mycobacterium tuberculosis H37Rv
ugcagcgcaggauucugcuga

SEQ ID NO: 3289813 - RNA, 19 nt, Mycobacterium tuberculosis H37Rv
ugcagcgccucgaccugac

SEQ ID NO: 3289814 - RNA, 18 nt, Mycobacterium tuberculosis H37Rv
ugcagcgcgauggccugg

SEQ ID NO: 3289815 - RNA, 17 nt, Mycobacterium tuberculosis H37Rv
ugcagcgcguucggcac

SEQ ID NO: 3289816 - RNA, 16 nt, Mycobacterium tuberculosis H37Rv
ugcagcggcgccgcca

SEQ ID NO: 3289817 - RNA, 22 nt, Mycobacterium tuberculosis H37Rv
ugcagcgggccacugagccaca

SEQ ID NO: 3289818 - RNA, 16 nt, Mycobacterium tuberculosis H37Rv
ugcagcggguugcggu

SEQ ID NO: 3289819 - RNA, 21 nt, Mycobacterium tuberculosis H37Rv
ugcagcgucuccuugagcuuc

SEQ ID NO: 3289820 - RNA, 20 nt, Mycobacterium tuberculosis H37Rv
ugcagcuccccgccggaacu

SEQ ID NO: 3289821 - RNA, 19 nt, Mycobacterium tuberculosis H37Rv
ugcagcucgggcagggacc

SEQ ID NO: 3289822 - RNA, 13 nt, Mycobacterium tuberculosis H37Rv
ugcaggaaggcuu

SEQ ID NO: 3289823 - RNA, 15 nt, Mycobacterium tuberculosis H37Rv
ugcaggaccagaacu

SEQ ID NO: 3289824 - RNA, 16 nt, Mycobacterium tuberculosis H37Rv
ugcaggaccagcaccg

SEQ ID NO: 3289825 - RNA, 23 nt, Mycobacterium tuberculosis H37Rv
ugcaggacgcccacaugcucagg

SEQ ID NO: 3289826 - RNA, 15 nt, Mycobacterium tuberculosis H37Rv
ugcaggaucaaaacc

SEQ ID NO: 3289827 - RNA, 20 nt, Mycobacterium tuberculosis H37Rv
ugcaggaucggcuugggaaa

SEQ ID NO: 3289828 - RNA, 12 nt, Mycobacterium tuberculosis H37Rv
ugcaggauucgg

SEQ ID NO: 3289829 - RNA, 16 nt, Mycobacterium tuberculosis H37Rv
ugcaggauucggcggu

SEQ ID NO: 3289830 - RNA, 13 nt, Mycobacterium tuberculosis H37Rv
ugcaggccagagu

SEQ ID NO: 3289831 - RNA, 16 nt, Mycobacterium tuberculosis H37Rv
ugcaggcccaggcugu

SEQ ID NO: 3289832 - RNA, 22 nt, Mycobacterium tuberculosis H37Rv
ugcaggcggccuugccgggccg

SEQ ID NO: 3289833 - RNA, 20 nt, Mycobacterium tuberculosis H37Rv
ugcagggcugcuacucugca

SEQ ID NO: 3289834 - RNA, 18 nt, Mycobacterium tuberculosis H37Rv
ugcaggucauugcacgcc

SEQ ID NO: 3289835 - RNA, 16 nt, Mycobacterium tuberculosis H37Rv
ugcaggucggcccagg

SEQ ID NO: 3289836 - RNA, 20 nt, Mycobacterium tuberculosis H37Rv
aaacgccgucgccugcaagc

SEQ ID NO: 3289837 - RNA, 22 nt, Mycobacterium tuberculosis H37Rv
aaacgggguggcacgcaugagg

SEQ ID NO: 3289838 - RNA, 19 nt, Mycobacterium tuberculosis H37Rv
aaacguaccgucauggcga

SEQ ID NO: 3289839 - RNA, 20 nt, Mycobacterium tuberculosis H37Rv
aaacgucaccgccgggaugc

SEQ ID NO: 3289840 - RNA, 19 nt, Mycobacterium tuberculosis H37Rv
aaacuaacggcagccaccg

SEQ ID NO: 3289841 - RNA, 18 nt, Mycobacterium tuberculosis H37Rv
aaacucaccagcaccccg

SEQ ID NO: 3289842 - RNA, 19 nt, Mycobacterium tuberculosis H37Rv
aaacucaccagcaccccga

SEQ ID NO: 3289843 - RNA, 12 nt, Mycobacterium tuberculosis H37Rv
aaacuccgcggc

SEQ ID NO: 3289844 - RNA, 16 nt, Mycobacterium tuberculosis H37Rv
aaacugccgcggcacc

SEQ ID NO: 3289845 - RNA, 16 nt, Mycobacterium tuberculosis H37Rv
aaagacccggcaccca

SEQ ID NO: 3289846 - RNA, 19 nt, Mycobacterium tuberculosis H37Rv
aaagaccgccgcugggucc

SEQ ID NO: 3289847 - RNA, 15 nt, Mycobacterium tuberculosis H37Rv
aaagagccagcggca

SEQ ID NO: 3289848 - RNA, 17 nt, Mycobacterium tuberculosis H37Rv
aaagaucagcauggucc

SEQ ID NO: 3289849 - RNA, 13 nt, Mycobacterium tuberculosis H37Rv
aaagcagcagcgg

SEQ ID NO: 3289850 - RNA, 15 nt, Mycobacterium tuberculosis H37Rv
aaagccaacucgacc

SEQ ID NO: 3289851 - RNA, 22 nt, Mycobacterium tuberculosis H37Rv
aaagccuaguacgccgagcaga

SEQ ID NO: 3289852 - RNA, 14 nt, Mycobacterium tuberculosis H37Rv
aaagcgacagcgcg

SEQ ID NO: 3289853 - RNA, 15 nt, Mycobacterium tuberculosis H37Rv
aaagcgacgagcagc

SEQ ID NO: 3289854 - RNA, 13 nt, Mycobacterium tuberculosis H37Rv
aaagcgagcaccg

SEQ ID NO: 3289855 - RNA, 16 nt, Mycobacterium tuberculosis H37Rv
aaagcgagcaccgcgg

SEQ ID NO: 3289856 - RNA, 14 nt, Mycobacterium tuberculosis H37Rv
aaagcgccagcagc

SEQ ID NO: 3289857 - RNA, 20 nt, Mycobacterium tuberculosis H37Rv
aaagcgccgaaacagcaccc

SEQ ID NO: 3289858 - RNA, 21 nt, Mycobacterium tuberculosis H37Rv
aaagcguaaggccggagucga

SEQ ID NO: 3289859 - RNA, 21 nt, Mycobacterium tuberculosis H37Rv
aaagcgugaaguccgcuugcc

SEQ ID NO: 3289860 - RNA, 14 nt, Mycobacterium tuberculosis H37Rv
aaagcugucgaccg

SEQ ID NO: 3289861 - RNA, 19 nt, Mycobacterium tuberculosis H37Rv
aaaggccgcggugaugggc

SEQ ID NO: 3289862 - RNA, 18 nt, Mycobacterium tuberculosis H37Rv
aaaggcuuccgcgugcga

SEQ ID NO: 3289863 - RNA, 16 nt, Mycobacterium tuberculosis H37Rv
aaaguacgcccuggaa

SEQ ID NO: 3289864 - RNA, 18 nt, Mycobacterium tuberculosis H37Rv
aaaguaucgcagcaucug

SEQ ID NO: 3289865 - RNA, 22 nt, Mycobacterium tuberculosis H37Rv
aaagucaccguccacgacagca

SEQ ID NO: 3289866 - RNA, 19 nt, Mycobacterium tuberculosis H37Rv
aaagucaggacggccggcg

SEQ ID NO: 3289867 - RNA, 13 nt, Mycobacterium tuberculosis H37Rv
aaaguuccacgac

SEQ ID NO: 3289868 - RNA, 15 nt, Mycobacterium tuberculosis H37Rv
aaauaagggccggcg

SEQ ID NO: 3289869 - RNA, 21 nt, Mycobacterium tuberculosis H37Rv
aaauacccagcgcagcagcgg

SEQ ID NO: 3289870 - RNA, 16 nt, Mycobacterium tuberculosis H37Rv
aaauagauucccggcu

SEQ ID NO: 3289871 - RNA, 13 nt, Mycobacterium tuberculosis H37Rv
aaauagcgagcgu

SEQ ID NO: 3289872 - RNA, 13 nt, Mycobacterium tuberculosis H37Rv
aaauagcugcgga

SEQ ID NO: 3289873 - RNA, 20 nt, Mycobacterium tuberculosis H37Rv
aaauauuaugcgcacucuag

SEQ ID NO: 3289874 - RNA, 12 nt, Mycobacterium tuberculosis H37Rv
aaaucaagcaca

SEQ ID NO: 3289875 - RNA, 13 nt, Mycobacterium tuberculosis H37Rv
aaaucaagcacag

SEQ ID NO: 3289876 - RNA, 14 nt, Mycobacterium tuberculosis H37Rv
aaaucaagcacagc

SEQ ID NO: 3289877 - RNA, 20 nt, Mycobacterium tuberculosis H37Rv
aaaucaagcacagcccggcu

SEQ ID NO: 3289878 - RNA, 21 nt, Mycobacterium tuberculosis H37Rv
aaaucaccucaccagucaggu

SEQ ID NO: 3289879 - RNA, 14 nt, Mycobacterium tuberculosis H37Rv
aaaucagccaggcg

SEQ ID NO: 3289880 - RNA, 19 nt, Mycobacterium tuberculosis H37Rv
aaauccagcagccaggagc

SEQ ID NO: 3289881 - RNA, 20 nt, Mycobacterium tuberculosis H37Rv
aaauccagcgaggugauggu

SEQ ID NO: 3289882 - RNA, 14 nt, Mycobacterium tuberculosis H37Rv
aaauccgcccaccg

SEQ ID NO: 3289883 - RNA, 13 nt, Mycobacterium tuberculosis H37Rv
aaauccgcguggu

SEQ ID NO: 3289884 - RNA, 16 nt, Mycobacterium tuberculosis H37Rv
aaaucgacagcagcgc

SEQ ID NO: 3289885 - RNA, 21 nt, Mycobacterium tuberculosis H37Rv
aaaucgaucguguacugcucc

SEQ ID NO: 3289886 - RNA, 20 nt, Mycobacterium tuberculosis H37Rv
aaaucggcggcguccagcag

SEQ ID NO: 3289887 - RNA, 22 nt, Mycobacterium tuberculosis H37Rv
aaaucgggaucugcgccgcgcg

SEQ ID NO: 3289888 - RNA, 22 nt, Mycobacterium tuberculosis H37Rv
aaaucgucgauggucuccggac

SEQ ID NO: 3289889 - RNA, 22 nt, Mycobacterium tuberculosis H37Rv
aaaucgucggguaccagcaccg

SEQ ID NO: 3289890 - RNA, 15 nt, Mycobacterium tuberculosis H37Rv
aaaugaagugcaccg

SEQ ID NO: 3289891 - RNA, 22 nt, Mycobacterium tuberculosis H37Rv
aaaugacggcugaaccugcugg

SEQ ID NO: 3289892 - RNA, 18 nt, Mycobacterium tuberculosis H37Rv
aaaugccgggcccgacgu

SEQ ID NO: 3289893 - RNA, 23 nt, Mycobacterium tuberculosis H37Rv
aaaugccugcccaccuucgaguu

SEQ ID NO: 3289894 - RNA, 22 nt, Mycobacterium tuberculosis H37Rv
aaaugcuucgccaacugcggca

SEQ ID NO: 3289895 - RNA, 15 nt, Mycobacterium tuberculosis H37Rv
aaauggccaccggcg

SEQ ID NO: 3289896 - RNA, 13 nt, Mycobacterium tuberculosis H37Rv
aaaugucuccucc

SEQ ID NO: 3289897 - RNA, 14 nt, Mycobacterium tuberculosis H37Rv
aacaacaccaccag

SEQ ID NO: 3289898 - RNA, 15 nt, Mycobacterium tuberculosis H37Rv
aacaacagccgcagc

SEQ ID NO: 3289899 - RNA, 18 nt, Mycobacterium tuberculosis H37Rv
aacaacagccgcagccag

SEQ ID NO: 3289900 - RNA, 14 nt, Mycobacterium tuberculosis H37Rv
aacaacagcggcaa

SEQ ID NO: 3289901 - RNA, 22 nt, Mycobacterium tuberculosis H37Rv
aacaaccccgaggcaacaagca

SEQ ID NO: 3289902 - RNA, 20 nt, Mycobacterium tuberculosis H37Rv
aacaacgcuaacugcuuuuc

SEQ ID NO: 3289903 - RNA, 16 nt, Mycobacterium tuberculosis H37Rv
aacaacgucugcagcc

SEQ ID NO: 3289904 - RNA, 19 nt, Mycobacterium tuberculosis H37Rv
aacaacguucggcacaacc

SEQ ID NO: 3289905 - RNA, 13 nt, Mycobacterium tuberculosis H37Rv
aacaacuccagca

SEQ ID NO: 3289906 - RNA, 20 nt, Mycobacterium tuberculosis H37Rv
aacaagaucagacccagcgc

SEQ ID NO: 3289907 - RNA, 21 nt, Mycobacterium tuberculosis H37Rv
aacaagguauagccggagcgc

SEQ ID NO: 3289908 - RNA, 20 nt, Mycobacterium tuberculosis H37Rv
aacacaugcaagucgaacgg

SEQ ID NO: 3289909 - RNA, 14 nt, Mycobacterium tuberculosis H37Rv
aacacaugcaucug

SEQ ID NO: 3289910 - RNA, 18 nt, Mycobacterium tuberculosis H37Rv
aacaccaacgacagcgac

SEQ ID NO: 3289911 - RNA, 21 nt, Mycobacterium tuberculosis H37Rv
aacaccacaccgagcaccuga

SEQ ID NO: 3289912 - RNA, 22 nt, Mycobacterium tuberculosis H37Rv
aacaccacaccgagcaccugac

SEQ ID NO: 3289913 - RNA, 22 nt, Mycobacterium tuberculosis H37Rv
aacaccagcgaggccagcggua

SEQ ID NO: 3289914 - RNA, 20 nt, Mycobacterium tuberculosis H37Rv
aacaccagcgcgccguagac

SEQ ID NO: 3289915 - RNA, 13 nt, Mycobacterium tuberculosis H37Rv
aacaccagcgcgu

SEQ ID NO: 3289916 - RNA, 20 nt, Mycobacterium tuberculosis H37Rv
aacaccagggccuccacccg

SEQ ID NO: 3289917 - RNA, 14 nt, Mycobacterium tuberculosis H37Rv
aacaccccacacag

SEQ ID NO: 3289918 - RNA, 13 nt, Mycobacterium tuberculosis H37Rv
aacacccgcccgg

SEQ ID NO: 3289919 - RNA, 22 nt, Mycobacterium tuberculosis H37Rv
aacacccuugcccacggcgacc

SEQ ID NO: 3289920 - RNA, 13 nt, Mycobacterium tuberculosis H37Rv
aacaccgacgaca

SEQ ID NO: 3289921 - RNA, 11 nt, Mycobacterium tuberculosis H37Rv
aacaccgccag

SEQ ID NO: 3289922 - RNA, 20 nt, Mycobacterium tuberculosis H37Rv
aacaccgccagcaugacacc

SEQ ID NO: 3289923 - RNA, 14 nt, Mycobacterium tuberculosis H37Rv
aacaccgccagcuc

SEQ ID NO: 3289924 - RNA, 21 nt, Mycobacterium tuberculosis H37Rv
aacaccgcggugaguucgccg

SEQ ID NO: 3289925 - RNA, 16 nt, Mycobacterium tuberculosis H37Rv
aacaccggccagcggc

SEQ ID NO: 3289926 - RNA, 18 nt, Mycobacterium tuberculosis H37Rv
aacaccgucggcagcagc

SEQ ID NO: 3289927 - RNA, 17 nt, Mycobacterium tuberculosis H37Rv
aacaccucauacgccaa

SEQ ID NO: 3289928 - RNA, 14 nt, Mycobacterium tuberculosis H37Rv
aacacgacagccag

SEQ ID NO: 3289929 - RNA, 22 nt, Mycobacterium tuberculosis H37Rv
aacacgagcgguacgcccgaau

SEQ ID NO: 3289930 - RNA, 23 nt, Mycobacterium tuberculosis H37Rv
aacacgaugcccaagcccucgac

SEQ ID NO: 3289931 - RNA, 22 nt, Mycobacterium tuberculosis H37Rv
aacacgccgucgaccggcggga

SEQ ID NO: 3289932 - RNA, 15 nt, Mycobacterium tuberculosis H37Rv
aacacgccucgccga

SEQ ID NO: 3289933 - RNA, 15 nt, Mycobacterium tuberculosis H37Rv
aacacgcguugguga

SEQ ID NO: 3289934 - RNA, 19 nt, Mycobacterium tuberculosis H37Rv
aacagagcgcuuuggucgu

SEQ ID NO: 3289935 - RNA, 23 nt, Mycobacterium tuberculosis H37Rv
aacagagucaccgcgcuggucag

SEQ ID NO: 3289936 - RNA, 21 nt, Mycobacterium tuberculosis H37Rv
aacagauucggugccagcagg

SEQ ID NO: 3289937 - RNA, 18 nt, Mycobacterium tuberculosis H37Rv
aacagcaacggcagcgug

SEQ ID NO: 3289938 - RNA, 12 nt, Mycobacterium tuberculosis H37Rv
aacagcaccagu

SEQ ID NO: 3289939 - RNA, 17 nt, Mycobacterium tuberculosis H37Rv
aacagcaccgaacccgc

SEQ ID NO: 3289940 - RNA, 15 nt, Mycobacterium tuberculosis H37Rv
aacagcaggccucca

SEQ ID NO: 3289941 - RNA, 18 nt, Mycobacterium tuberculosis H37Rv
aacagcgacgccaugguc

SEQ ID NO: 3289942 - RNA, 22 nt, Mycobacterium tuberculosis H37Rv
aacagcggcaacgccuccggag

SEQ ID NO: 3289943 - RNA, 19 nt, Mycobacterium tuberculosis H37Rv
aacagcgucuggccgucgc

SEQ ID NO: 3289944 - RNA, 16 nt, Mycobacterium tuberculosis H37Rv
aacagcugcccgccag

SEQ ID NO: 3289945 - RNA, 14 nt, Mycobacterium tuberculosis H37Rv
aacaggaucagcga

SEQ ID NO: 3289946 - RNA, 15 nt, Mycobacterium tuberculosis H37Rv
aacaggccggugugc

SEQ ID NO: 3289947 - RNA, 17 nt, Mycobacterium tuberculosis H37Rv
aacaggccgguucccuu

SEQ ID NO: 3289948 - RNA, 14 nt, Mycobacterium tuberculosis H37Rv
aacaggccgucgau

SEQ ID NO: 3289949 - RNA, 12 nt, Mycobacterium tuberculosis H37Rv
aacaggccuagg

SEQ ID NO: 3289950 - RNA, 21 nt, Mycobacterium tuberculosis H37Rv
aacagguaagcagccagcaac

SEQ ID NO: 3289951 - RNA, 11 nt, Mycobacterium tuberculosis H37Rv
aacagguugaa

SEQ ID NO: 3289952 - RNA, 19 nt, Mycobacterium tuberculosis H37Rv
aacagucgagugaagccga

SEQ ID NO: 3289953 - RNA, 12 nt, Mycobacterium tuberculosis H37Rv
aacagucgcagc

SEQ ID NO: 3289954 - RNA, 15 nt, Mycobacterium tuberculosis H37Rv
aacagugccucgcgu

SEQ ID NO: 3289955 - RNA, 14 nt, Mycobacterium tuberculosis H37Rv
aacagugccugggu

SEQ ID NO: 3289956 - RNA, 22 nt, Mycobacterium tuberculosis H37Rv
aacaguugcacaccggcacugc

SEQ ID NO: 3289957 - RNA, 15 nt, Mycobacterium tuberculosis H37Rv
aacauacgaaacaug

SEQ ID NO: 3289958 - RNA, 13 nt, Mycobacterium tuberculosis H37Rv
aacaucaccgucg

SEQ ID NO: 3289959 - RNA, 17 nt, Mycobacterium tuberculosis H37Rv
aacaucaccucgaugcc

SEQ ID NO: 3289960 - RNA, 23 nt, Mycobacterium tuberculosis H37Rv
aacaucccagcgaaugcugacau

SEQ ID NO: 3289961 - RNA, 16 nt, Mycobacterium tuberculosis H37Rv
aacauccugggcaagu

SEQ ID NO: 3289962 - RNA, 17 nt, Mycobacterium tuberculosis H37Rv
aacaucgacagcaucac

SEQ ID NO: 3289963 - RNA, 14 nt, Mycobacterium tuberculosis H37Rv
aacaucgccagcgc

SEQ ID NO: 3289964 - RNA, 20 nt, Mycobacterium tuberculosis H37Rv
aacaucuccucggcgaugcc

SEQ ID NO: 3289965 - RNA, 23 nt, Mycobacterium tuberculosis H37Rv
aacaugcucacgaucacccgcac

SEQ ID NO: 3289966 - RNA, 15 nt, Mycobacterium tuberculosis H37Rv
aacauggccagcauc

SEQ ID NO: 3289967 - RNA, 21 nt, Mycobacterium tuberculosis H37Rv
aacaugggaugcucaccggga

SEQ ID NO: 3289968 - RNA, 19 nt, Mycobacterium tuberculosis H37Rv
aacauguccgcacgcucgg

SEQ ID NO: 3289969 - RNA, 20 nt, Mycobacterium tuberculosis H37Rv
aacauuccggcaccuccgcc

SEQ ID NO: 3289970 - RNA, 21 nt, Mycobacterium tuberculosis H37Rv
aaccaaagcgacgagcagcaa

SEQ ID NO: 3289971 - RNA, 14 nt, Mycobacterium tuberculosis H37Rv
aaccaacgcgaccg

SEQ ID NO: 3289972 - RNA, 20 nt, Mycobacterium tuberculosis H37Rv
aaccacccaccggccaccag

SEQ ID NO: 3289973 - RNA, 16 nt, Mycobacterium tuberculosis H37Rv
aaccacccgcaacaca

SEQ ID NO: 3289974 - RNA, 15 nt, Mycobacterium tuberculosis H37Rv
aaccacgagcaucaa

SEQ ID NO: 3289975 - RNA, 18 nt, Mycobacterium tuberculosis H37Rv
aaccacggcggcaucacc

SEQ ID NO: 3289976 - RNA, 17 nt, Mycobacterium tuberculosis H37Rv
aaccacggucagcacgc

SEQ ID NO: 3289977 - RNA, 23 nt, Mycobacterium tuberculosis H37Rv
aaccacucgcucaggaacaauga

SEQ ID NO: 3289978 - RNA, 19 nt, Mycobacterium tuberculosis H37Rv
aaccacuggauggcucgcc

SEQ ID NO: 3289979 - RNA, 18 nt, Mycobacterium tuberculosis H37Rv
aaccagaggucacgcagc

SEQ ID NO: 3289980 - RNA, 11 nt, Mycobacterium tuberculosis H37Rv
aaccagcagca

SEQ ID NO: 3289981 - RNA, 21 nt, Mycobacterium tuberculosis H37Rv
aaccagccaccaccaggucgg

SEQ ID NO: 3289982 - RNA, 19 nt, Mycobacterium tuberculosis H37Rv
aaccagcgcgucucguuga

SEQ ID NO: 3289983 - RNA, 18 nt, Mycobacterium tuberculosis H37Rv
aaccaggcgagccgccac

SEQ ID NO: 3289984 - RNA, 11 nt, Mycobacterium tuberculosis H37Rv
aaccaguccuc

SEQ ID NO: 3289985 - RNA, 13 nt, Mycobacterium tuberculosis H37Rv
aaccagucgaccc

SEQ ID NO: 3289986 - RNA, 23 nt, Mycobacterium tuberculosis H37Rv
aaccagugaccguauuucgucca

SEQ ID NO: 3289987 - RNA, 14 nt, Mycobacterium tuberculosis H37Rv
aaccagugcagcuc

SEQ ID NO: 3289988 - RNA, 22 nt, Mycobacterium tuberculosis H37Rv
aaccaucguuguugaccaccac

SEQ ID NO: 3289989 - RNA, 19 nt, Mycobacterium tuberculosis H37Rv
aacccaccgcauuaagggu

SEQ ID NO: 3289990 - RNA, 20 nt, Mycobacterium tuberculosis H37Rv
aacccagcaucgggugagau

SEQ ID NO: 3289991 - RNA, 15 nt, Mycobacterium tuberculosis H37Rv
aacccaggccgucgc

SEQ ID NO: 3289992 - RNA, 23 nt, Mycobacterium tuberculosis H37Rv
aacccaggucuuucgaauccccg

SEQ ID NO: 3289993 - RNA, 14 nt, Mycobacterium tuberculosis H37Rv
aacccagucccaac

SEQ ID NO: 3289994 - RNA, 22 nt, Mycobacterium tuberculosis H37Rv
aaccccacgcagaaguugaugg

SEQ ID NO: 3289995 - RNA, 17 nt, Mycobacterium tuberculosis H37Rv
aaccccaggcgcugccg

SEQ ID NO: 3289996 - RNA, 18 nt, Mycobacterium tuberculosis H37Rv
aaccccaucagaaugccu

SEQ ID NO: 3289997 - RNA, 13 nt, Mycobacterium tuberculosis H37Rv
aacccccggggcg

SEQ ID NO: 3289998 - RNA, 14 nt, Mycobacterium tuberculosis H37Rv
aaccccgagcugcc

SEQ ID NO: 3289999 - RNA, 17 nt, Mycobacterium tuberculosis H37Rv
aaccccgccaggaucug

SEQ ID NO: 3290000 - RNA, 22 nt, Mycobacterium tuberculosis H37Rv
aaccccggccaccagcaugccu

SEQ ID NO: 3290001 - RNA, 18 nt, Mycobacterium tuberculosis H37Rv
aacccgaucucugcggcg

SEQ ID NO: 3290002 - RNA, 16 nt, Mycobacterium tuberculosis H37Rv
aacccgccgaugccgc

SEQ ID NO: 3290003 - RNA, 13 nt, Mycobacterium tuberculosis H37Rv
aacccgccgucac

SEQ ID NO: 3290004 - RNA, 13 nt, Mycobacterium tuberculosis H37Rv
aacccggaaguug

SEQ ID NO: 3290005 - RNA, 12 nt, Mycobacterium tuberculosis H37Rv
aacccggcggca

SEQ ID NO: 3290006 - RNA, 14 nt, Mycobacterium tuberculosis H37Rv
aacccggcgucgac

SEQ ID NO: 3290007 - RNA, 14 nt, Mycobacterium tuberculosis H37Rv
aacccgggccgcca

SEQ ID NO: 3290008 - RNA, 13 nt, Mycobacterium tuberculosis H37Rv
aacccggucggca

SEQ ID NO: 3290009 - RNA, 19 nt, Mycobacterium tuberculosis H37Rv
aacccguaaaagccgauga

SEQ ID NO: 3290010 - RNA, 15 nt, Mycobacterium tuberculosis H37Rv
aacccguaagacaga

SEQ ID NO: 3290011 - RNA, 15 nt, Mycobacterium tuberculosis H37Rv
aacccgucgagccgu

SEQ ID NO: 3290012 - RNA, 19 nt, Mycobacterium tuberculosis H37Rv
aacccgucuuaucggcguc

SEQ ID NO: 3290013 - RNA, 18 nt, Mycobacterium tuberculosis H37Rv
aacccguuaccgauuggc

SEQ ID NO: 3290014 - RNA, 19 nt, Mycobacterium tuberculosis H37Rv
aacccguuuugggugaucg

SEQ ID NO: 3290015 - RNA, 13 nt, Mycobacterium tuberculosis H37Rv
aacccucgccggu

SEQ ID NO: 3290016 - RNA, 13 nt, Mycobacterium tuberculosis H37Rv
aacccugcggcgu

SEQ ID NO: 3290017 - RNA, 22 nt, Mycobacterium tuberculosis H37Rv
aacccugcggugcaggauucgg

SEQ ID NO: 3290018 - RNA, 22 nt, Mycobacterium tuberculosis H37Rv
aacccugcuugggcagcucguc

SEQ ID NO: 3290019 - RNA, 23 nt, Mycobacterium tuberculosis H37Rv
aaccgaagccucggcaugcagcc

SEQ ID NO: 3290020 - RNA, 14 nt, Mycobacterium tuberculosis H37Rv
aaccgaccgcgcug

SEQ ID NO: 3290021 - RNA, 17 nt, Mycobacterium tuberculosis H37Rv
aaccgagauggaauggc

SEQ ID NO: 3290022 - RNA, 18 nt, Mycobacterium tuberculosis H37Rv
aaccgagcgcccuccucg

SEQ ID NO: 3290023 - RNA, 16 nt, Mycobacterium tuberculosis H37Rv
aaccgauugagcccca

SEQ ID NO: 3290024 - RNA, 12 nt, Mycobacterium tuberculosis H37Rv
aaccgcagucgc

SEQ ID NO: 3290025 - RNA, 15 nt, Mycobacterium tuberculosis H37Rv
aaccgcaguucuuga

SEQ ID NO: 3290026 - RNA, 23 nt, Mycobacterium tuberculosis H37Rv
aaccgccaucgucgaagaccuca

SEQ ID NO: 3290027 - RNA, 22 nt, Mycobacterium tuberculosis H37Rv
aaccgccccgugggccucgauc

SEQ ID NO: 3290028 - RNA, 16 nt, Mycobacterium tuberculosis H37Rv
aaccgccggcaccgcc

SEQ ID NO: 3290029 - RNA, 17 nt, Mycobacterium tuberculosis H37Rv
aacggauucccgcccag

SEQ ID NO: 3290030 - RNA, 17 nt, Mycobacterium tuberculosis H37Rv
aacggcacccugcggca

SEQ ID NO: 3290031 - RNA, 20 nt, Mycobacterium tuberculosis H37Rv
aacggcacccugcggcaccu

SEQ ID NO: 3290032 - RNA, 17 nt, Mycobacterium tuberculosis H37Rv
aacggcaccucgacguc

SEQ ID NO: 3290033 - RNA, 14 nt, Mycobacterium tuberculosis H37Rv
aacggcagcguggg

SEQ ID NO: 3290034 - RNA, 18 nt, Mycobacterium tuberculosis H37Rv
aacggcgaaacucgucga

SEQ ID NO: 3290035 - RNA, 18 nt, Mycobacterium tuberculosis H37Rv
aacggcgcgccgaccacc

SEQ ID NO: 3290036 - RNA, 16 nt, Mycobacterium tuberculosis H37Rv
aacggcggggccggcg

SEQ ID NO: 3290037 - RNA, 17 nt, Mycobacterium tuberculosis H37Rv
aacggcgguaagggcgg

SEQ ID NO: 3290038 - RNA, 13 nt, Mycobacterium tuberculosis H37Rv
aacgggaugccgg

SEQ ID NO: 3290039 - RNA, 17 nt, Mycobacterium tuberculosis H37Rv
aacgggcaaaccauugc

SEQ ID NO: 3290040 - RNA, 14 nt, Mycobacterium tuberculosis H37Rv
aacgggcagguagg

SEQ ID NO: 3290041 - RNA, 22 nt, Mycobacterium tuberculosis H37Rv
aacgggccuucagcucaccacc

SEQ ID NO: 3290042 - RNA, 23 nt, Mycobacterium tuberculosis H37Rv
aacgggcgaacuuguugaccucc

SEQ ID NO: 3290043 - RNA, 17 nt, Mycobacterium tuberculosis H37Rv
aacgggggcgccuucac

SEQ ID NO: 3290044 - RNA, 22 nt, Mycobacterium tuberculosis H37Rv
aacggggugagccauacgcgcu

SEQ ID NO: 3290045 - RNA, 19 nt, Mycobacterium tuberculosis H37Rv
aacgggguggcacgcauga

SEQ ID NO: 3290046 - RNA, 20 nt, Mycobacterium tuberculosis H37Rv
aacggguagucgggcaaggc

SEQ ID NO: 3290047 - RNA, 19 nt, Mycobacterium tuberculosis H37Rv
aacguauccccgaccacug

SEQ ID NO: 3290048 - RNA, 14 nt, Mycobacterium tuberculosis H37Rv
aacgucaccgccgg

SEQ ID NO: 3290049 - RNA, 20 nt, Mycobacterium tuberculosis H37Rv
aacgucacgucgacggcggc

SEQ ID NO: 3290050 - RNA, 12 nt, Mycobacterium tuberculosis H37Rv
aacgucagugcc

SEQ ID NO: 3290051 - RNA, 19 nt, Mycobacterium tuberculosis H37Rv
aacgucagugccccgcagc

SEQ ID NO: 3290052 - RNA, 12 nt, Mycobacterium tuberculosis H37Rv
aacgucugccac

SEQ ID NO: 3290053 - RNA, 17 nt, Mycobacterium tuberculosis H37Rv
aacguucggcacaacca

SEQ ID NO: 3290054 - RNA, 18 nt, Mycobacterium tuberculosis H37Rv
aacguuuugggcgccgga

SEQ ID NO: 3290055 - RNA, 18 nt, Mycobacterium tuberculosis H37Rv
aacuaacggcagccaccg

SEQ ID NO: 3290056 - RNA, 18 nt, Mycobacterium tuberculosis H37Rv
aacuacccgcccacggca

SEQ ID NO: 3290057 - RNA, 21 nt, Mycobacterium tuberculosis H37Rv
aacuacucauccagaagccgg

SEQ ID NO: 3290058 - RNA, 16 nt, Mycobacterium tuberculosis H37Rv
aacuagguucagcgac

SEQ ID NO: 3290059 - RNA, 22 nt, Mycobacterium tuberculosis H37Rv
aacucaugcccgacgagucgcc

SEQ ID NO: 3290060 - RNA, 17 nt, Mycobacterium tuberculosis H37Rv
aacuccgcguugggcac

SEQ ID NO: 3290061 - RNA, 16 nt, Mycobacterium tuberculosis H37Rv
aacuccugcagcccgg

SEQ ID NO: 3290062 - RNA, 20 nt, Mycobacterium tuberculosis H37Rv
aacucgagaguggccucguc

SEQ ID NO: 3290063 - RNA, 17 nt, Mycobacterium tuberculosis H37Rv
aacucgaguagucgcug

SEQ ID NO: 3290064 - RNA, 15 nt, Mycobacterium tuberculosis H37Rv
aacucgccccgcgug

SEQ ID NO: 3290065 - RNA, 15 nt, Mycobacterium tuberculosis H37Rv
aacucgcgcgucguc

SEQ ID NO: 3290066 - RNA, 19 nt, Mycobacterium tuberculosis H37Rv
aacucggcgaccugccgga

SEQ ID NO: 3290067 - RNA, 13 nt, Mycobacterium tuberculosis H37Rv
aacucggcgucgu

SEQ ID NO: 3290068 - RNA, 15 nt, Mycobacterium tuberculosis H37Rv
aacucguccagcagu

SEQ ID NO: 3290069 - RNA, 17 nt, Mycobacterium tuberculosis H37Rv
aacucguccagcagugc

SEQ ID NO: 3290070 - RNA, 15 nt, Mycobacterium tuberculosis H37Rv
aacucgucgauucgg

SEQ ID NO: 3290071 - RNA, 17 nt, Mycobacterium tuberculosis H37Rv
aacugacccgcauaccg

SEQ ID NO: 3290072 - RNA, 23 nt, Mycobacterium tuberculosis H37Rv
aacugacguuaccgccgcauucg

SEQ ID NO: 3290073 - RNA, 15 nt, Mycobacterium tuberculosis H37Rv
aacugcagcauggcc

SEQ ID NO: 3290074 - RNA, 21 nt, Mycobacterium tuberculosis H37Rv
aacugcgccagcaacagcgcg

SEQ ID NO: 3290075 - RNA, 21 nt, Mycobacterium tuberculosis H37Rv
aacugcggcccaugaucucgg

SEQ ID NO: 3290076 - RNA, 15 nt, Mycobacterium tuberculosis H37Rv
aacugcucgccgagg

SEQ ID NO: 3290077 - RNA, 23 nt, Mycobacterium tuberculosis H37Rv
aacugcugaugaaacgccgucgc

SEQ ID NO: 3290078 - RNA, 14 nt, Mycobacterium tuberculosis H37Rv
aacuggaccacagc

SEQ ID NO: 3290079 - RNA, 18 nt, Mycobacterium tuberculosis H37Rv
aacuggacggggaagccc

SEQ ID NO: 3290080 - RNA, 19 nt, Mycobacterium tuberculosis H37Rv
aacuggacggggaagcccg

SEQ ID NO: 3290081 - RNA, 23 nt, Mycobacterium tuberculosis H37Rv
aacuggacgggguacugcggcuc

SEQ ID NO: 3290082 - RNA, 20 nt, Mycobacterium tuberculosis H37Rv
aacugggcaccggcggucug

SEQ ID NO: 3290083 - RNA, 21 nt, Mycobacterium tuberculosis H37Rv
aacugggcaccggcggucugc

SEQ ID NO: 3290084 - RNA, 14 nt, Mycobacterium tuberculosis H37Rv
aacuggucgacgcc

SEQ ID NO: 3290085 - RNA, 15 nt, Mycobacterium tuberculosis H37Rv
aacuguccggguggg

SEQ ID NO: 3290086 - RNA, 18 nt, Mycobacterium tuberculosis H37Rv
aacuguggaaggugauca

SEQ ID NO: 3290087 - RNA, 14 nt, Mycobacterium tuberculosis H37Rv
aacuucaacuggau

SEQ ID NO: 3290088 - RNA, 17 nt, Mycobacterium tuberculosis H37Rv
aacuuccauuuucgcca

SEQ ID NO: 3290089 - RNA, 16 nt, Mycobacterium tuberculosis H37Rv
aacuucgacaacgcau

SEQ ID NO: 3290090 - RNA, 20 nt, Mycobacterium tuberculosis H37Rv
aacuugacgaacucgccguc

SEQ ID NO: 3290091 - RNA, 15 nt, Mycobacterium tuberculosis H37Rv
aacuugagcuccuca

SEQ ID NO: 3290092 - RNA, 13 nt, Mycobacterium tuberculosis H37Rv
aacuugcugacga

SEQ ID NO: 3290093 - RNA, 12 nt, Mycobacterium tuberculosis H37Rv
aacuuggcggcc

SEQ ID NO: 3290094 - RNA, 12 nt, Mycobacterium tuberculosis H37Rv
aagaaacaccac

SEQ ID NO: 3290095 - RNA, 18 nt, Mycobacterium tuberculosis H37Rv
aagaaacagguaagcagc

SEQ ID NO: 3290096 - RNA, 23 nt, Mycobacterium tuberculosis H37Rv
aagaaagacgcuguccaggucug

SEQ ID NO: 3290097 - RNA, 14 nt, Mycobacterium tuberculosis H37Rv
aagaacaugcucac

SEQ ID NO: 3290098 - RNA, 21 nt, Mycobacterium tuberculosis H37Rv
aagaacaugcucacgaucacc

SEQ ID NO: 3290099 - RNA, 22 nt, Mycobacterium tuberculosis H37Rv
aagaaccgccaccagaccagga

SEQ ID NO: 3290100 - RNA, 19 nt, Mycobacterium tuberculosis H37Rv
aagaaccugagcaccaaga

SEQ ID NO: 3290101 - RNA, 20 nt, Mycobacterium tuberculosis H37Rv
aagaacucaaagacccgacg

SEQ ID NO: 3290102 - RNA, 20 nt, Mycobacterium tuberculosis H37Rv
aagaagaugaucgcgaacau

SEQ ID NO: 3290103 - RNA, 18 nt, Mycobacterium tuberculosis H37Rv
aagaagcccgaguuguuc

SEQ ID NO: 3290104 - RNA, 16 nt, Mycobacterium tuberculosis H37Rv
aagaagccgguguuga

SEQ ID NO: 3290105 - RNA, 13 nt, Mycobacterium tuberculosis H37Rv
aagaauaugccga

SEQ ID NO: 3290106 - RNA, 15 nt, Mycobacterium tuberculosis H37Rv
aagaaucagcagcag

SEQ ID NO: 3290107 - RNA, 16 nt, Mycobacterium tuberculosis H37Rv
aagaaugugggcgacg

SEQ ID NO: 3290108 - RNA, 12 nt, Mycobacterium tuberculosis H37Rv
aagacaugcuga

SEQ ID NO: 3290109 - RNA, 18 nt, Mycobacterium tuberculosis H37Rv
aagaccaccgcccacagc

SEQ ID NO: 3290110 - RNA, 22 nt, Mycobacterium tuberculosis H37Rv
aagaccgcguuccgggccggcg

SEQ ID NO: 3290111 - RNA, 19 nt, Mycobacterium tuberculosis H37Rv
aagaccugaguugguucga

SEQ ID NO: 3290112 - RNA, 15 nt, Mycobacterium tuberculosis H37Rv
aagaccuggccugcg

SEQ ID NO: 3290113 - RNA, 15 nt, Mycobacterium tuberculosis H37Rv
aagacggauuguccg

SEQ ID NO: 3290114 - RNA, 19 nt, Mycobacterium tuberculosis H37Rv
aagacggauuguccgggac

SEQ ID NO: 3290115 - RNA, 13 nt, Mycobacterium tuberculosis H37Rv
aagacggccaccg

SEQ ID NO: 3290116 - RNA, 20 nt, Mycobacterium tuberculosis H37Rv
aagacgugguagaggaacag

SEQ ID NO: 3290117 - RNA, 19 nt, Mycobacterium tuberculosis H37Rv
aagacuuagcgggugccag

SEQ ID NO: 3290118 - RNA, 16 nt, Mycobacterium tuberculosis H37Rv
aagagcacgucaacag

SEQ ID NO: 3290119 - RNA, 19 nt, Mycobacterium tuberculosis H37Rv
aagagcacgucaacagcca

SEQ ID NO: 3290120 - RNA, 11 nt, Mycobacterium tuberculosis H37Rv
aagagccgucc

SEQ ID NO: 3290121 - RNA, 14 nt, Mycobacterium tuberculosis H37Rv
aagaggagaacgag

SEQ ID NO: 3290122 - RNA, 22 nt, Mycobacterium tuberculosis H37Rv
aagaucaccucccgcggcaccu

SEQ ID NO: 3290123 - RNA, 15 nt, Mycobacterium tuberculosis H37Rv
aagaucacgcgucgu

SEQ ID NO: 3290124 - RNA, 15 nt, Mycobacterium tuberculosis H37Rv
aagaucagacccagc

SEQ ID NO: 3290125 - RNA, 16 nt, Mycobacterium tuberculosis H37Rv
aaggccgccaaccguu

SEQ ID NO: 3290126 - RNA, 18 nt, Mycobacterium tuberculosis H37Rv
aaggccggagucgacgac

SEQ ID NO: 3290127 - RNA, 13 nt, Mycobacterium tuberculosis H37Rv
aaggcgacucggu

SEQ ID NO: 3290128 - RNA, 21 nt, Mycobacterium tuberculosis H37Rv
aaggcggccacaaacccgaug

SEQ ID NO: 3290129 - RNA, 14 nt, Mycobacterium tuberculosis H37Rv
aaggcggccaggug

SEQ ID NO: 3290130 - RNA, 15 nt, Mycobacterium tuberculosis H37Rv
aaggcggucaccacc

SEQ ID NO: 3290131 - RNA, 22 nt, Mycobacterium tuberculosis H37Rv
aaggcgucgaacagugccucgc

SEQ ID NO: 3290132 - RNA, 14 nt, Mycobacterium tuberculosis H37Rv
aaggcucagcagcg

SEQ ID NO: 3290133 - RNA, 21 nt, Mycobacterium tuberculosis H37Rv
aagggauccgaagagccagca

SEQ ID NO: 3290134 - RNA, 15 nt, Mycobacterium tuberculosis H37Rv
aagggcaacagugaa

SEQ ID NO: 3290135 - RNA, 14 nt, Mycobacterium tuberculosis H37Rv
aagggccgccucgc

SEQ ID NO: 3290136 - RNA, 14 nt, Mycobacterium tuberculosis H37Rv
aagggcuuccaggg

SEQ ID NO: 3290137 - RNA, 21 nt, Mycobacterium tuberculosis H37Rv
aagggggucgagcgcuucguc

SEQ ID NO: 3290138 - RNA, 17 nt, Mycobacterium tuberculosis H37Rv
aaggggugugugcugcc

SEQ ID NO: 3290139 - RNA, 17 nt, Mycobacterium tuberculosis H37Rv
aagggucaucgccagcg

SEQ ID NO: 3290140 - RNA, 14 nt, Mycobacterium tuberculosis H37Rv
aaggucaccgucga

SEQ ID NO: 3290141 - RNA, 20 nt, Mycobacterium tuberculosis H37Rv
aagguccgugccgaugccgg

SEQ ID NO: 3290142 - RNA, 22 nt, Mycobacterium tuberculosis H37Rv
aaggucgacaugggucggcugu

SEQ ID NO: 3290143 - RNA, 14 nt, Mycobacterium tuberculosis H37Rv
aaggucgcggucga

SEQ ID NO: 3290144 - RNA, 19 nt, Mycobacterium tuberculosis H37Rv
aaggucgcugcuugcgggc

SEQ ID NO: 3290145 - RNA, 14 nt, Mycobacterium tuberculosis H37Rv
aaggucggccaggc

SEQ ID NO: 3290146 - RNA, 17 nt, Mycobacterium tuberculosis H37Rv
aaggugaugaacaccgg

SEQ ID NO: 3290147 - RNA, 13 nt, Mycobacterium tuberculosis H37Rv
aaggugcacugcc

SEQ ID NO: 3290148 - RNA, 14 nt, Mycobacterium tuberculosis H37Rv
aaggugccgaccgu

SEQ ID NO: 3290149 - RNA, 22 nt, Mycobacterium tuberculosis H37Rv
aagguggccaccaaacgcugcu

SEQ ID NO: 3290150 - RNA, 19 nt, Mycobacterium tuberculosis H37Rv
aagguguccuccagcugcg

SEQ ID NO: 3290151 - RNA, 19 nt, Mycobacterium tuberculosis H37Rv
aaggugugcgucuccagcu

SEQ ID NO: 3290152 - RNA, 20 nt, Mycobacterium tuberculosis H37Rv
aagguguggugacagagcgg

SEQ ID NO: 3290153 - RNA, 22 nt, Mycobacterium tuberculosis H37Rv
aagguugaacgccgccagcaga

SEQ ID NO: 3290154 - RNA, 12 nt, Mycobacterium tuberculosis H37Rv
aaguaagccgcg

SEQ ID NO: 3290155 - RNA, 15 nt, Mycobacterium tuberculosis H37Rv
aaguacuccauggca

SEQ ID NO: 3290156 - RNA, 22 nt, Mycobacterium tuberculosis H37Rv
aaguagguuuucggcggcucua

SEQ ID NO: 3290157 - RNA, 13 nt, Mycobacterium tuberculosis H37Rv
aaguaucgcagca

SEQ ID NO: 3290158 - RNA, 23 nt, Mycobacterium tuberculosis H37Rv
aaguccacgcaccacgagcagcc

SEQ ID NO: 3290159 - RNA, 11 nt, Mycobacterium tuberculosis H37Rv
aaguccagcag

SEQ ID NO: 3290160 - RNA, 14 nt, Mycobacterium tuberculosis H37Rv
aaguccagcagcga

SEQ ID NO: 3290161 - RNA, 14 nt, Mycobacterium tuberculosis H37Rv
aagucccgaguggc

SEQ ID NO: 3290162 - RNA, 15 nt, Mycobacterium tuberculosis H37Rv
aagucccgggcaccg

SEQ ID NO: 3290163 - RNA, 20 nt, Mycobacterium tuberculosis H37Rv
aaguccgcccgccgaccugg

SEQ ID NO: 3290164 - RNA, 18 nt, Mycobacterium tuberculosis H37Rv
aaguccuucacugcgacc

SEQ ID NO: 3290165 - RNA, 20 nt, Mycobacterium tuberculosis H37Rv
aagucgaucuccgucgguga

SEQ ID NO: 3290166 - RNA, 18 nt, Mycobacterium tuberculosis H37Rv
aagucgcagcgaggagcc

SEQ ID NO: 3290167 - RNA, 15 nt, Mycobacterium tuberculosis H37Rv
aagucgcauggcggc

SEQ ID NO: 3290168 - RNA, 13 nt, Mycobacterium tuberculosis H37Rv
aagucgccgguga

SEQ ID NO: 3290169 - RNA, 22 nt, Mycobacterium tuberculosis H37Rv
aagucgucauauucuuggucga

SEQ ID NO: 3290170 - RNA, 13 nt, Mycobacterium tuberculosis H37Rv
aagucucccggcc

SEQ ID NO: 3290171 - RNA, 19 nt, Mycobacterium tuberculosis H37Rv
aagucucccggccgcaccc

SEQ ID NO: 3290172 - RNA, 18 nt, Mycobacterium tuberculosis H37Rv
aagucuugaccgcaccgg

SEQ ID NO: 3290173 - RNA, 23 nt, Mycobacterium tuberculosis H37Rv
aagugcacccgguugugcgcgcg

SEQ ID NO: 3290174 - RNA, 11 nt, Mycobacterium tuberculosis H37Rv
aagugcagggc

SEQ ID NO: 3290175 - RNA, 13 nt, Mycobacterium tuberculosis H37Rv
aagugcagggcug

SEQ ID NO: 3290176 - RNA, 17 nt, Mycobacterium tuberculosis H37Rv
aagugccuuccucggca

SEQ ID NO: 3290177 - RNA, 21 nt, Mycobacterium tuberculosis H37Rv
aagugcggugagauggcggug

SEQ ID NO: 3290178 - RNA, 16 nt, Mycobacterium tuberculosis H37Rv
aaguggaucuggcgca

SEQ ID NO: 3290179 - RNA, 18 nt, Mycobacterium tuberculosis H37Rv
aaguggcgucagugcaga

SEQ ID NO: 3290180 - RNA, 16 nt, Mycobacterium tuberculosis H37Rv
aagugggugccggcac

SEQ ID NO: 3290181 - RNA, 20 nt, Mycobacterium tuberculosis H37Rv
aaguggucuccggcaccgag

SEQ ID NO: 3290182 - RNA, 23 nt, Mycobacterium tuberculosis H37Rv
aagugucuccggcaacagcacca

SEQ ID NO: 3290183 - RNA, 22 nt, Mycobacterium tuberculosis H37Rv
aaguuccacggguggugccagg

SEQ ID NO: 3290184 - RNA, 20 nt, Mycobacterium tuberculosis H37Rv
aaguuccagccgacggcagu

SEQ ID NO: 3290185 - RNA, 13 nt, Mycobacterium tuberculosis H37Rv
aaguucgucacca

SEQ ID NO: 3290186 - RNA, 18 nt, Mycobacterium tuberculosis H37Rv
aaguucgugagcgaacgg

SEQ ID NO: 3290187 - RNA, 12 nt, Mycobacterium tuberculosis H37Rv
aaguugaagaag

SEQ ID NO: 3290188 - RNA, 14 nt, Mycobacterium tuberculosis H37Rv
aaguugaagaagcc

SEQ ID NO: 3290189 - RNA, 14 nt, Mycobacterium tuberculosis H37Rv
aaguugcccaggug

SEQ ID NO: 3290190 - RNA, 16 nt, Mycobacterium tuberculosis H37Rv
aaguuggcugagcagc

SEQ ID NO: 3290191 - RNA, 17 nt, Mycobacterium tuberculosis H37Rv
aaguuggcugagcagcg

SEQ ID NO: 3290192 - RNA, 18 nt, Mycobacterium tuberculosis H37Rv
aaguuggcugagcagcgc

SEQ ID NO: 3290193 - RNA, 23 nt, Mycobacterium tuberculosis H37Rv
aaguuggcuugcgcgcaggugcu

SEQ ID NO: 3290194 - RNA, 22 nt, Mycobacterium tuberculosis H37Rv
aaguugugcgcacucuuuccuu

SEQ ID NO: 3290195 - RNA, 15 nt, Mycobacterium tuberculosis H37Rv
aauaacgcgggaucc

SEQ ID NO: 3290196 - RNA, 12 nt, Mycobacterium tuberculosis H37Rv
aauacaccuugu

SEQ ID NO: 3290197 - RNA, 17 nt, Mycobacterium tuberculosis H37Rv
aauacacuccugagaug

SEQ ID NO: 3290198 - RNA, 15 nt, Mycobacterium tuberculosis H37Rv
aauacccgcuggccc

SEQ ID NO: 3290199 - RNA, 20 nt, Mycobacterium tuberculosis H37Rv
aauacgcugcuggucuugcc

SEQ ID NO: 3290200 - RNA, 18 nt, Mycobacterium tuberculosis H37Rv
aauagcaacucgaucgcc

SEQ ID NO: 3290201 - RNA, 13 nt, Mycobacterium tuberculosis H37Rv
aauagccggaucc

SEQ ID NO: 3290202 - RNA, 21 nt, Mycobacterium tuberculosis H37Rv
aauagcugcgcgaagccacca

SEQ ID NO: 3290203 - RNA, 19 nt, Mycobacterium tuberculosis H37Rv
aauagcuguuggccagccg

SEQ ID NO: 3290204 - RNA, 17 nt, Mycobacterium tuberculosis H37Rv
aauaggccgggcagugc

SEQ ID NO: 3290205 - RNA, 22 nt, Mycobacterium tuberculosis H37Rv
aauaggucugagucuuucccgc

SEQ ID NO: 3290206 - RNA, 16 nt, Mycobacterium tuberculosis H37Rv
aauaggugucgacgcg

SEQ ID NO: 3290207 - RNA, 17 nt, Mycobacterium tuberculosis H37Rv
aauaucggggccacuga

SEQ ID NO: 3290208 - RNA, 14 nt, Mycobacterium tuberculosis H37Rv
aauaucucgccgua

SEQ ID NO: 3290209 - RNA, 21 nt, Mycobacterium tuberculosis H37Rv
aauaugccacagaccgaacag

SEQ ID NO: 3290210 - RNA, 14 nt, Mycobacterium tuberculosis H37Rv
aauaugccgaugac

SEQ ID NO: 3290211 - RNA, 14 nt, Mycobacterium tuberculosis H37Rv
aaucaagcacagcc

SEQ ID NO: 3290212 - RNA, 12 nt, Mycobacterium tuberculosis H37Rv
aaucaagcagcg

SEQ ID NO: 3290213 - RNA, 21 nt, Mycobacterium tuberculosis H37Rv
aaucaccgccgcgaccgccuc

SEQ ID NO: 3290214 - RNA, 16 nt, Mycobacterium tuberculosis H37Rv
aaucaccggagcgccg

SEQ ID NO: 3290215 - RNA, 14 nt, Mycobacterium tuberculosis H37Rv
aaucacggucaucu

SEQ ID NO: 3290216 - RNA, 13 nt, Mycobacterium tuberculosis H37Rv
aaucagcacccca

SEQ ID NO: 3290217 - RNA, 13 nt, Mycobacterium tuberculosis H37Rv
aaucagccaggcc

SEQ ID NO: 3290218 - RNA, 21 nt, Mycobacterium tuberculosis H37Rv
aaucagccccguuucgccaga

SEQ ID NO: 3290219 - RNA, 12 nt, Mycobacterium tuberculosis H37Rv
aaucaucucccg

SEQ ID NO: 3290220 - RNA, 18 nt, Mycobacterium tuberculosis H37Rv
aauccaaggcucagcagc

SEQ ID NO: 3290221 - RNA, 19 nt, Mycobacterium tuberculosis H37Rv
aauccaaggcucagcagcg

SEQ ID NO: 3290222 - RNA, 20 nt, Mycobacterium tuberculosis H37Rv
aauucggcacgaaauugggc

SEQ ID NO: 3290223 - RNA, 14 nt, Mycobacterium tuberculosis H37Rv
aauucggcgagcgc

SEQ ID NO: 3290224 - RNA, 15 nt, Mycobacterium tuberculosis H37Rv
aauucguagggaugc

SEQ ID NO: 3290225 - RNA, 23 nt, Mycobacterium tuberculosis H37Rv
aauugcccaagcgcguuguuguc

SEQ ID NO: 3290226 - RNA, 13 nt, Mycobacterium tuberculosis H37Rv
aauugcccugacg

SEQ ID NO: 3290227 - RNA, 22 nt, Mycobacterium tuberculosis H37Rv
aauugccgggcgcacgcccgca

SEQ ID NO: 3290228 - RNA, 15 nt, Mycobacterium tuberculosis H37Rv
aauugcggccgcgcg

SEQ ID NO: 3290229 - RNA, 15 nt, Mycobacterium tuberculosis H37Rv
aauugcguucgccgc

SEQ ID NO: 3290230 - RNA, 17 nt, Mycobacterium tuberculosis H37Rv
aauuggcuugugcccaa

SEQ ID NO: 3290231 - RNA, 14 nt, Mycobacterium tuberculosis H37Rv
aauugucgacuguu

SEQ ID NO: 3290232 - RNA, 20 nt, Mycobacterium tuberculosis H37Rv
aauuucgauuucccaugcaa

SEQ ID NO: 3290233 - RNA, 19 nt, Mycobacterium tuberculosis H37Rv
aauuucggcgccucguugc

SEQ ID NO: 3290234 - RNA, 16 nt, Mycobacterium tuberculosis H37Rv
acaaacaucgcaccca

SEQ ID NO: 3290235 - RNA, 20 nt, Mycobacterium tuberculosis H37Rv
acaaacaucgcacccaccac

SEQ ID NO: 3290236 - RNA, 23 nt, Mycobacterium tuberculosis H37Rv
acaaacaucgcacccaccacacc

SEQ ID NO: 3290237 - RNA, 22 nt, Mycobacterium tuberculosis H37Rv
acaaaccgucggggaugccgaa

SEQ ID NO: 3290238 - RNA, 23 nt, Mycobacterium tuberculosis H37Rv
acaaaccgugcacgucagcggau

SEQ ID NO: 3290239 - RNA, 15 nt, Mycobacterium tuberculosis H37Rv
acaaacggcgaccca

SEQ ID NO: 3290240 - RNA, 17 nt, Mycobacterium tuberculosis H37Rv
acaaacggcgacccagc

SEQ ID NO: 3290241 - RNA, 21 nt, Mycobacterium tuberculosis H37Rv
acaaacggcuuggcugccucc

SEQ ID NO: 3290242 - RNA, 12 nt, Mycobacterium tuberculosis H37Rv
acaaagaagugg

SEQ ID NO: 3290243 - RNA, 20 nt, Mycobacterium tuberculosis H37Rv
acaaagacgccgucggcgcc

SEQ ID NO: 3290244 - RNA, 12 nt, Mycobacterium tuberculosis H37Rv
acaaagauugcc

SEQ ID NO: 3290245 - RNA, 16 nt, Mycobacterium tuberculosis H37Rv
acaaagccgucgacgc

SEQ ID NO: 3290246 - RNA, 21 nt, Mycobacterium tuberculosis H37Rv
acaaagguaccgcuggaaaau

SEQ ID NO: 3290247 - RNA, 21 nt, Mycobacterium tuberculosis H37Rv
acaaaguucgacgagaagaca

SEQ ID NO: 3290248 - RNA, 13 nt, Mycobacterium tuberculosis H37Rv
acaaaucggcggu

SEQ ID NO: 3290249 - RNA, 14 nt, Mycobacterium tuberculosis H37Rv
acaacaaacccggc

SEQ ID NO: 3290250 - RNA, 12 nt, Mycobacterium tuberculosis H37Rv
acaacaacacgg

SEQ ID NO: 3290251 - RNA, 17 nt, Mycobacterium tuberculosis H37Rv
acaacaccaccagcacg

SEQ ID NO: 3290252 - RNA, 18 nt, Mycobacterium tuberculosis H37Rv
acaacagcggcaacgccu

SEQ ID NO: 3290253 - RNA, 12 nt, Mycobacterium tuberculosis H37Rv
acaacagcuugg

SEQ ID NO: 3290254 - RNA, 13 nt, Mycobacterium tuberculosis H37Rv
acaacaucgaauc

SEQ ID NO: 3290255 - RNA, 12 nt, Mycobacterium tuberculosis H37Rv
acaacaucgcca

SEQ ID NO: 3290256 - RNA, 13 nt, Mycobacterium tuberculosis H37Rv
acaaccacccacc

SEQ ID NO: 3290257 - RNA, 13 nt, Mycobacterium tuberculosis H37Rv
acaaccgacgggu

SEQ ID NO: 3290258 - RNA, 18 nt, Mycobacterium tuberculosis H37Rv
acaaccgcccgccaggcc

SEQ ID NO: 3290259 - RNA, 15 nt, Mycobacterium tuberculosis H37Rv
acaaccgcugcugcu

SEQ ID NO: 3290260 - RNA, 19 nt, Mycobacterium tuberculosis H37Rv
acaaccgcugcugcugccc

SEQ ID NO: 3290261 - RNA, 19 nt, Mycobacterium tuberculosis H37Rv
acaaccgugagcaccagca

SEQ ID NO: 3290262 - RNA, 20 nt, Mycobacterium tuberculosis H37Rv
acaaccgugagcaccagcag

SEQ ID NO: 3290263 - RNA, 22 nt, Mycobacterium tuberculosis H37Rv
acaaccgugagcaccagcagca

SEQ ID NO: 3290264 - RNA, 17 nt, Mycobacterium tuberculosis H37Rv
acaaccuggggccacca

SEQ ID NO: 3290265 - RNA, 13 nt, Mycobacterium tuberculosis H37Rv
acaacgacacgcc

SEQ ID NO: 3290266 - RNA, 17 nt, Mycobacterium tuberculosis H37Rv
acaacgacuccuggcga

SEQ ID NO: 3290267 - RNA, 15 nt, Mycobacterium tuberculosis H37Rv
acaacgccaggaacc

SEQ ID NO: 3290268 - RNA, 13 nt, Mycobacterium tuberculosis H37Rv
acaacgcccacca

SEQ ID NO: 3290269 - RNA, 14 nt, Mycobacterium tuberculosis H37Rv
acaacgcccaccac

SEQ ID NO: 3290270 - RNA, 17 nt, Mycobacterium tuberculosis H37Rv
acaacgcccaccacgcg

SEQ ID NO: 3290271 - RNA, 13 nt, Mycobacterium tuberculosis H37Rv
acaacgccgucga

SEQ ID NO: 3290272 - RNA, 17 nt, Mycobacterium tuberculosis H37Rv
acaacgcgacgccgcuc

SEQ ID NO: 3290273 - RNA, 17 nt, Mycobacterium tuberculosis H37Rv
acaacgcuucggcgugc

SEQ ID NO: 3290274 - RNA, 20 nt, Mycobacterium tuberculosis H37Rv
acaacggccacaugccacag

SEQ ID NO: 3290275 - RNA, 19 nt, Mycobacterium tuberculosis H37Rv
acaacgggauccgcgcgcu

SEQ ID NO: 3290276 - RNA, 13 nt, Mycobacterium tuberculosis H37Rv
acaacgucgccgc

SEQ ID NO: 3290277 - RNA, 19 nt, Mycobacterium tuberculosis H37Rv
acaacguggugucucggcu

SEQ ID NO: 3290278 - RNA, 13 nt, Mycobacterium tuberculosis H37Rv
acaacuccagcag

SEQ ID NO: 3290279 - RNA, 22 nt, Mycobacterium tuberculosis H37Rv
acaacucgcgaagcaucgcguu

SEQ ID NO: 3290280 - RNA, 14 nt, Mycobacterium tuberculosis H37Rv
acaacugcccgaug

SEQ ID NO: 3290281 - RNA, 17 nt, Mycobacterium tuberculosis H37Rv
acaacugcgccggugcc

SEQ ID NO: 3290282 - RNA, 20 nt, Mycobacterium tuberculosis H37Rv
acaacugcgccggugccggc

SEQ ID NO: 3290283 - RNA, 16 nt, Mycobacterium tuberculosis H37Rv
acaacuguccugccag

SEQ ID NO: 3290284 - RNA, 12 nt, Mycobacterium tuberculosis H37Rv
acaagaccgcgg

SEQ ID NO: 3290285 - RNA, 12 nt, Mycobacterium tuberculosis H37Rv
acaagcacagcg

SEQ ID NO: 3290286 - RNA, 12 nt, Mycobacterium tuberculosis H37Rv
acaagcccagcc

SEQ ID NO: 3290287 - RNA, 21 nt, Mycobacterium tuberculosis H37Rv
acaagccgagcccgucgauca

SEQ ID NO: 3290288 - RNA, 23 nt, Mycobacterium tuberculosis H37Rv
acaagccgugcagcucggucagc

SEQ ID NO: 3290289 - RNA, 21 nt, Mycobacterium tuberculosis H37Rv
acaagccuuaccccgcagcuc

SEQ ID NO: 3290290 - RNA, 22 nt, Mycobacterium tuberculosis H37Rv
acaaggccgccgccgucggcga

SEQ ID NO: 3290291 - RNA, 15 nt, Mycobacterium tuberculosis H37Rv
acaaguuuauggucu

SEQ ID NO: 3290292 - RNA, 16 nt, Mycobacterium tuberculosis H37Rv
acaauaggcuccagcg

SEQ ID NO: 3290293 - RNA, 13 nt, Mycobacterium tuberculosis H37Rv
acaaucaccgccg

SEQ ID NO: 3290294 - RNA, 13 nt, Mycobacterium tuberculosis H37Rv
acaaucggugguc

SEQ ID NO: 3290295 - RNA, 16 nt, Mycobacterium tuberculosis H37Rv
acaaucucggccgcau

SEQ ID NO: 3290296 - RNA, 17 nt, Mycobacterium tuberculosis H37Rv
acaaugacucggccgca

SEQ ID NO: 3290297 - RNA, 22 nt, Mycobacterium tuberculosis H37Rv
acaauggcucugaggucaccgg

SEQ ID NO: 3290298 - RNA, 20 nt, Mycobacterium tuberculosis H37Rv
acaauucacgcaccacaaac

SEQ ID NO: 3290299 - RNA, 13 nt, Mycobacterium tuberculosis H37Rv
acaauucccuugu

SEQ ID NO: 3290300 - RNA, 19 nt, Mycobacterium tuberculosis H37Rv
acaauuccuggaucgcggu

SEQ ID NO: 3290301 - RNA, 23 nt, Mycobacterium tuberculosis H37Rv
acacaacgacgaauaaguacucu

SEQ ID NO: 3290302 - RNA, 19 nt, Mycobacterium tuberculosis H37Rv
acacaacgggugucggcgu

SEQ ID NO: 3290303 - RNA, 20 nt, Mycobacterium tuberculosis H37Rv
acacacccacuggaccaccg

SEQ ID NO: 3290304 - RNA, 21 nt, Mycobacterium tuberculosis H37Rv
acacaccgaacagucgcagcc

SEQ ID NO: 3290305 - RNA, 16 nt, Mycobacterium tuberculosis H37Rv
acacaccgcgucggcc

SEQ ID NO: 3290306 - RNA, 14 nt, Mycobacterium tuberculosis H37Rv
acacagcaugguua

SEQ ID NO: 3290307 - RNA, 15 nt, Mycobacterium tuberculosis H37Rv
acacagccgcgcugc

SEQ ID NO: 3290308 - RNA, 18 nt, Mycobacterium tuberculosis H37Rv
acacagccgucgcaccag

SEQ ID NO: 3290309 - RNA, 19 nt, Mycobacterium tuberculosis H37Rv
acacagccgucgcaccaga

SEQ ID NO: 3290310 - RNA, 17 nt, Mycobacterium tuberculosis H37Rv
acacagcguaugcacau

SEQ ID NO: 3290311 - RNA, 13 nt, Mycobacterium tuberculosis H37Rv
acacaggacuugu

SEQ ID NO: 3290312 - RNA, 22 nt, Mycobacterium tuberculosis H37Rv
acacaggacuuguccaucacau

SEQ ID NO: 3290313 - RNA, 21 nt, Mycobacterium tuberculosis H37Rv
acacaggcguccaucgccacc

SEQ ID NO: 3290314 - RNA, 16 nt, Mycobacterium tuberculosis H37Rv
acacagucggugcagc

SEQ ID NO: 3290315 - RNA, 14 nt, Mycobacterium tuberculosis H37Rv
acacaugccgcagg

SEQ ID NO: 3290316 - RNA, 21 nt, Mycobacterium tuberculosis H37Rv
acacauuucuuugggcggccc

SEQ ID NO: 3290317 - RNA, 14 nt, Mycobacterium tuberculosis H37Rv
acaccaacccaccc

SEQ ID NO: 3290318 - RNA, 18 nt, Mycobacterium tuberculosis H37Rv
acaccaacgacagcgacg

SEQ ID NO: 3290319 - RNA, 13 nt, Mycobacterium tuberculosis H37Rv
acagguccaccgg

SEQ ID NO: 3290320 - RNA, 13 nt, Mycobacterium tuberculosis H37Rv
acagguccggguu

SEQ ID NO: 3290321 - RNA, 14 nt, Mycobacterium tuberculosis H37Rv
acagguccugcgcc

SEQ ID NO: 3290322 - RNA, 12 nt, Mycobacterium tuberculosis H37Rv
acaggucgcccg

SEQ ID NO: 3290323 - RNA, 19 nt, Mycobacterium tuberculosis H37Rv
acaggucgccggggccgcu

SEQ ID NO: 3290324 - RNA, 13 nt, Mycobacterium tuberculosis H37Rv
acaggucggccca

SEQ ID NO: 3290325 - RNA, 14 nt, Mycobacterium tuberculosis H37Rv
acaggugccagacc

SEQ ID NO: 3290326 - RNA, 21 nt, Mycobacterium tuberculosis H37Rv
acaggugccagaccagggcag

SEQ ID NO: 3290327 - RNA, 21 nt, Mycobacterium tuberculosis H37Rv
acagguguuggacgccuugca

SEQ ID NO: 3290328 - RNA, 22 nt, Mycobacterium tuberculosis H37Rv
acaguaggccuccgcugccgcc

SEQ ID NO: 3290329 - RNA, 21 nt, Mycobacterium tuberculosis H37Rv
acagucgcagucgcuaagacu

SEQ ID NO: 3290330 - RNA, 15 nt, Mycobacterium tuberculosis H37Rv
acagucggugcagcg

SEQ ID NO: 3290331 - RNA, 23 nt, Mycobacterium tuberculosis H37Rv
acagucgugagccagcuugcgca

SEQ ID NO: 3290332 - RNA, 20 nt, Mycobacterium tuberculosis H37Rv
acagugaccugggcgcccca

SEQ ID NO: 3290333 - RNA, 13 nt, Mycobacterium tuberculosis H37Rv
acagugccucgcg

SEQ ID NO: 3290334 - RNA, 19 nt, Mycobacterium tuberculosis H37Rv
acagugcgcaucauuugca

SEQ ID NO: 3290335 - RNA, 21 nt, Mycobacterium tuberculosis H37Rv
acagugcgcggaucaacaggc

SEQ ID NO: 3290336 - RNA, 23 nt, Mycobacterium tuberculosis H37Rv
acagugcugccuugggaccgcgc

SEQ ID NO: 3290337 - RNA, 21 nt, Mycobacterium tuberculosis H37Rv
acagugucgauagcccgccac

SEQ ID NO: 3290338 - RNA, 14 nt, Mycobacterium tuberculosis H37Rv
acagugucugccau

SEQ ID NO: 3290339 - RNA, 13 nt, Mycobacterium tuberculosis H37Rv
acaguucgccgga

SEQ ID NO: 3290340 - RNA, 18 nt, Mycobacterium tuberculosis H37Rv
acaguucggcgagcacau

SEQ ID NO: 3290341 - RNA, 18 nt, Mycobacterium tuberculosis H37Rv
acaguuuaccgugccgcc

SEQ ID NO: 3290342 - RNA, 19 nt, Mycobacterium tuberculosis H37Rv
acauacgagcagugaccgc

SEQ ID NO: 3290343 - RNA, 15 nt, Mycobacterium tuberculosis H37Rv
acauacgcggcggcc

SEQ ID NO: 3290344 - RNA, 17 nt, Mycobacterium tuberculosis H37Rv
acauaggucacaaacgg

SEQ ID NO: 3290345 - RNA, 14 nt, Mycobacterium tuberculosis H37Rv
acaucaccaaaaac

SEQ ID NO: 3290346 - RNA, 15 nt, Mycobacterium tuberculosis H37Rv
acaucaccaccgacc

SEQ ID NO: 3290347 - RNA, 18 nt, Mycobacterium tuberculosis H37Rv
acaucauggugaaggcaa

SEQ ID NO: 3290348 - RNA, 21 nt, Mycobacterium tuberculosis H37Rv
acauccaacgaccuccacgcc

SEQ ID NO: 3290349 - RNA, 13 nt, Mycobacterium tuberculosis H37Rv
acauccagcccug

SEQ ID NO: 3290350 - RNA, 23 nt, Mycobacterium tuberculosis H37Rv
acauccaggcuguggccagcauc

SEQ ID NO: 3290351 - RNA, 20 nt, Mycobacterium tuberculosis H37Rv
acauccagggccgagcagcu

SEQ ID NO: 3290352 - RNA, 10 nt, Mycobacterium tuberculosis H37Rv
acaucccgga

SEQ ID NO: 3290353 - RNA, 17 nt, Mycobacterium tuberculosis H37Rv
acauccgacagcagccg

SEQ ID NO: 3290354 - RNA, 18 nt, Mycobacterium tuberculosis H37Rv
acauccgcggcaugcaau

SEQ ID NO: 3290355 - RNA, 22 nt, Mycobacterium tuberculosis H37Rv
acauccgcggcaugcaaugcug

SEQ ID NO: 3290356 - RNA, 22 nt, Mycobacterium tuberculosis H37Rv
acauccucgauggaccgccagg

SEQ ID NO: 3290357 - RNA, 22 nt, Mycobacterium tuberculosis H37Rv
acauccugcagcucgggcaggg

SEQ ID NO: 3290358 - RNA, 13 nt, Mycobacterium tuberculosis H37Rv
acauccuggcggc

SEQ ID NO: 3290359 - RNA, 16 nt, Mycobacterium tuberculosis H37Rv
acaucgaggccacgcc

SEQ ID NO: 3290360 - RNA, 19 nt, Mycobacterium tuberculosis H37Rv
acaucgcaggcaccccgau

SEQ ID NO: 3290361 - RNA, 19 nt, Mycobacterium tuberculosis H37Rv
acaucgcgggcgugccgac

SEQ ID NO: 3290362 - RNA, 21 nt, Mycobacterium tuberculosis H37Rv
acaucgcgggcgugccgacca

SEQ ID NO: 3290363 - RNA, 20 nt, Mycobacterium tuberculosis H37Rv
acaucggcggcgucgacguc

SEQ ID NO: 3290364 - RNA, 14 nt, Mycobacterium tuberculosis H37Rv
acaucgggccgccg

SEQ ID NO: 3290365 - RNA, 13 nt, Mycobacterium tuberculosis H37Rv
acaucggugccac

SEQ ID NO: 3290366 - RNA, 23 nt, Mycobacterium tuberculosis H37Rv
acaucggugccacguucgcgggc

SEQ ID NO: 3290367 - RNA, 23 nt, Mycobacterium tuberculosis H37Rv
acaucgguggcgccgaacgccag

SEQ ID NO: 3290368 - RNA, 20 nt, Mycobacterium tuberculosis H37Rv
acaucguaggccggcauggc

SEQ ID NO: 3290369 - RNA, 16 nt, Mycobacterium tuberculosis H37Rv
acaucgucaucagcgc

SEQ ID NO: 3290370 - RNA, 14 nt, Mycobacterium tuberculosis H37Rv
acaucgucgagcgc

SEQ ID NO: 3290371 - RNA, 21 nt, Mycobacterium tuberculosis H37Rv
acaucguugacccggcgaugc

SEQ ID NO: 3290372 - RNA, 12 nt, Mycobacterium tuberculosis H37Rv
acaucuggucac

SEQ ID NO: 3290373 - RNA, 16 nt, Mycobacterium tuberculosis H37Rv
acaugagcgucgcuga

SEQ ID NO: 3290374 - RNA, 23 nt, Mycobacterium tuberculosis H37Rv
acaugcaucugaucaggccacac

SEQ ID NO: 3290375 - RNA, 14 nt, Mycobacterium tuberculosis H37Rv
acaugccggucauc

SEQ ID NO: 3290376 - RNA, 13 nt, Mycobacterium tuberculosis H37Rv
acaugcgccgaga

SEQ ID NO: 3290377 - RNA, 17 nt, Mycobacterium tuberculosis H37Rv
acaugcucacgaucacc

SEQ ID NO: 3290378 - RNA, 15 nt, Mycobacterium tuberculosis H37Rv
acaugcucagucgcu

SEQ ID NO: 3290379 - RNA, 16 nt, Mycobacterium tuberculosis H37Rv
acaugcucagucgcuc

SEQ ID NO: 3290380 - RNA, 23 nt, Mycobacterium tuberculosis H37Rv
acaugcucgacgcccgccaccgg

SEQ ID NO: 3290381 - RNA, 18 nt, Mycobacterium tuberculosis H37Rv
acaugcugccgcugcgaa

SEQ ID NO: 3290382 - RNA, 21 nt, Mycobacterium tuberculosis H37Rv
acauggcaagucaacaccgcg

SEQ ID NO: 3290383 - RNA, 21 nt, Mycobacterium tuberculosis H37Rv
acauggcggugcgcagcuugg

SEQ ID NO: 3290384 - RNA, 15 nt, Mycobacterium tuberculosis H37Rv
acaugggugaugcaa

SEQ ID NO: 3290385 - RNA, 21 nt, Mycobacterium tuberculosis H37Rv
acaugguccgaccagcggccg

SEQ ID NO: 3290386 - RNA, 15 nt, Mycobacterium tuberculosis H37Rv
acaugucacacccac

SEQ ID NO: 3290387 - RNA, 20 nt, Mycobacterium tuberculosis H37Rv
acauucugcagcgucuccuu

SEQ ID NO: 3290388 - RNA, 12 nt, Mycobacterium tuberculosis H37Rv
acauugccaccg

SEQ ID NO: 3290389 - RNA, 11 nt, Mycobacterium tuberculosis H37Rv
acauugcccgu

SEQ ID NO: 3290390 - RNA, 19 nt, Mycobacterium tuberculosis H37Rv
acauugcgcccagcgaccc

SEQ ID NO: 3290391 - RNA, 16 nt, Mycobacterium tuberculosis H37Rv
acauuggcuccgaaca

SEQ ID NO: 3290392 - RNA, 18 nt, Mycobacterium tuberculosis H37Rv
acauuggugaggugguca

SEQ ID NO: 3290393 - RNA, 23 nt, Mycobacterium tuberculosis H37Rv
acauugguguccaccaccggcac

SEQ ID NO: 3290394 - RNA, 22 nt, Mycobacterium tuberculosis H37Rv
acauuuuuguuguuauuuuugg

SEQ ID NO: 3290395 - RNA, 20 nt, Mycobacterium tuberculosis H37Rv
accaaaauccuucgcgcuca

SEQ ID NO: 3290396 - RNA, 13 nt, Mycobacterium tuberculosis H37Rv
accaaaccgccgg

SEQ ID NO: 3290397 - RNA, 20 nt, Mycobacterium tuberculosis H37Rv
accaaaccgcuguaaccggu

SEQ ID NO: 3290398 - RNA, 16 nt, Mycobacterium tuberculosis H37Rv
accaaacggauugcuc

SEQ ID NO: 3290399 - RNA, 15 nt, Mycobacterium tuberculosis H37Rv
accaaagcgacgagc

SEQ ID NO: 3290400 - RNA, 18 nt, Mycobacterium tuberculosis H37Rv
accaaagcgacgagcagc

SEQ ID NO: 3290401 - RNA, 20 nt, Mycobacterium tuberculosis H37Rv
accaaagcgacgagcagcaa

SEQ ID NO: 3290402 - RNA, 17 nt, Mycobacterium tuberculosis H37Rv
accaacaccccccccac

SEQ ID NO: 3290403 - RNA, 18 nt, Mycobacterium tuberculosis H37Rv
accaacaccccccccacc

SEQ ID NO: 3290404 - RNA, 14 nt, Mycobacterium tuberculosis H37Rv
accaacaccgcggc

SEQ ID NO: 3290405 - RNA, 17 nt, Mycobacterium tuberculosis H37Rv
accaacauacagcaauc

SEQ ID NO: 3290406 - RNA, 17 nt, Mycobacterium tuberculosis H37Rv
accaacccaccccccag

SEQ ID NO: 3290407 - RNA, 19 nt, Mycobacterium tuberculosis H37Rv
accaaccgggacaaccccu

SEQ ID NO: 3290408 - RNA, 16 nt, Mycobacterium tuberculosis H37Rv
accaaccucaucgcgg

SEQ ID NO: 3290409 - RNA, 17 nt, Mycobacterium tuberculosis H37Rv
accaaccugcgcggcga

SEQ ID NO: 3290410 - RNA, 22 nt, Mycobacterium tuberculosis H37Rv
accaacgccaacgccacggcaa

SEQ ID NO: 3290411 - RNA, 16 nt, Mycobacterium tuberculosis H37Rv
accaacgcgaccgcau

SEQ ID NO: 3290412 - RNA, 15 nt, Mycobacterium tuberculosis H37Rv
accaacgucgcuccg

SEQ ID NO: 3290413 - RNA, 17 nt, Mycobacterium tuberculosis H37Rv
accaacucggcgaccug

SEQ ID NO: 3290414 - RNA, 15 nt, Mycobacterium tuberculosis H37Rv
accaacuguggugga

SEQ ID NO: 3290415 - RNA, 12 nt, Mycobacterium tuberculosis H37Rv
accacgcaccgc

SEQ ID NO: 3290416 - RNA, 20 nt, Mycobacterium tuberculosis H37Rv
accacgcccgacgaggaugu

SEQ ID NO: 3290417 - RNA, 23 nt, Mycobacterium tuberculosis H37Rv
accacgcccgacgaggaugucga

SEQ ID NO: 3290418 - RNA, 14 nt, Mycobacterium tuberculosis H37Rv
accacgccgacgug

SEQ ID NO: 3290419 - RNA, 16 nt, Mycobacterium tuberculosis H37Rv
accacgcuccccagcg

SEQ ID NO: 3290420 - RNA, 17 nt, Mycobacterium tuberculosis H37Rv
accacgcuuaacagcgg

SEQ ID NO: 3290421 - RNA, 14 nt, Mycobacterium tuberculosis H37Rv
accacggaccagcg

SEQ ID NO: 3290422 - RNA, 22 nt, Mycobacterium tuberculosis H37Rv
accacggcagccaaccggcgca

SEQ ID NO: 3290423 - RNA, 14 nt, Mycobacterium tuberculosis H37Rv
accacggccagcgg

SEQ ID NO: 3290424 - RNA, 14 nt, Mycobacterium tuberculosis H37Rv
accacggcgauccg

SEQ ID NO: 3290425 - RNA, 22 nt, Mycobacterium tuberculosis H37Rv
accacggcgauccggucggcca

SEQ ID NO: 3290426 - RNA, 13 nt, Mycobacterium tuberculosis H37Rv
accacggcgcagu

SEQ ID NO: 3290427 - RNA, 13 nt, Mycobacterium tuberculosis H37Rv
accacggcgcgca

SEQ ID NO: 3290428 - RNA, 20 nt, Mycobacterium tuberculosis H37Rv
accacggcggcaucaccugg

SEQ ID NO: 3290429 - RNA, 15 nt, Mycobacterium tuberculosis H37Rv
accacggcggccacc

SEQ ID NO: 3290430 - RNA, 16 nt, Mycobacterium tuberculosis H37Rv
accacggcguggcgcc

SEQ ID NO: 3290431 - RNA, 19 nt, Mycobacterium tuberculosis H37Rv
accacggcguggcgccgga

SEQ ID NO: 3290432 - RNA, 20 nt, Mycobacterium tuberculosis H37Rv
accacgguagacaagucggc

SEQ ID NO: 3290433 - RNA, 17 nt, Mycobacterium tuberculosis H37Rv
accacggucaagccggc

SEQ ID NO: 3290434 - RNA, 16 nt, Mycobacterium tuberculosis H37Rv
accacggucagcacgc

SEQ ID NO: 3290435 - RNA, 20 nt, Mycobacterium tuberculosis H37Rv
accacggugacuaccgugca

SEQ ID NO: 3290436 - RNA, 23 nt, Mycobacterium tuberculosis H37Rv
accacgguuuuacagcgucaucc

SEQ ID NO: 3290437 - RNA, 22 nt, Mycobacterium tuberculosis H37Rv
accacgucgacgaugucgaaga

SEQ ID NO: 3290438 - RNA, 13 nt, Mycobacterium tuberculosis H37Rv
accacguggcccu

SEQ ID NO: 3290439 - RNA, 23 nt, Mycobacterium tuberculosis H37Rv
accacuccacgcagcccgucggc

SEQ ID NO: 3290440 - RNA, 15 nt, Mycobacterium tuberculosis H37Rv
accacugaucggcau

SEQ ID NO: 3290441 - RNA, 22 nt, Mycobacterium tuberculosis H37Rv
accacugaucggcauuccuuga

SEQ ID NO: 3290442 - RNA, 16 nt, Mycobacterium tuberculosis H37Rv
accacugcacccgauc

SEQ ID NO: 3290443 - RNA, 21 nt, Mycobacterium tuberculosis H37Rv
accacugcaugaacugcucgc

SEQ ID NO: 3290444 - RNA, 19 nt, Mycobacterium tuberculosis H37Rv
accacugcgcccgccacgu

SEQ ID NO: 3290445 - RNA, 23 nt, Mycobacterium tuberculosis H37Rv
accacuggcgguguaacccggaa

SEQ ID NO: 3290446 - RNA, 18 nt, Mycobacterium tuberculosis H37Rv
accacugugacacccgag

SEQ ID NO: 3290447 - RNA, 14 nt, Mycobacterium tuberculosis H37Rv
accacuguuacggc

SEQ ID NO: 3290448 - RNA, 22 nt, Mycobacterium tuberculosis H37Rv
accacuguuggugccgccacca

SEQ ID NO: 3290449 - RNA, 20 nt, Mycobacterium tuberculosis H37Rv
accacuuccggcguggcccc

SEQ ID NO: 3290450 - RNA, 14 nt, Mycobacterium tuberculosis H37Rv
accacuucggcgcc

SEQ ID NO: 3290451 - RNA, 13 nt, Mycobacterium tuberculosis H37Rv
accacuucggcgu

SEQ ID NO: 3290452 - RNA, 17 nt, Mycobacterium tuberculosis H37Rv
accacuuggguggcgcc

SEQ ID NO: 3290453 - RNA, 12 nt, Mycobacterium tuberculosis H37Rv
accagaaccagc

SEQ ID NO: 3290454 - RNA, 16 nt, Mycobacterium tuberculosis H37Rv
accagaaccagcgacc

SEQ ID NO: 3290455 - RNA, 17 nt, Mycobacterium tuberculosis H37Rv
accagaaccuggagccg

SEQ ID NO: 3290456 - RNA, 14 nt, Mycobacterium tuberculosis H37Rv
accagaacgacgcc

SEQ ID NO: 3290457 - RNA, 13 nt, Mycobacterium tuberculosis H37Rv
accagaacgccag

SEQ ID NO: 3290458 - RNA, 16 nt, Mycobacterium tuberculosis H37Rv
accagaacgccagacc

SEQ ID NO: 3290459 - RNA, 13 nt, Mycobacterium tuberculosis H37Rv
accagacugcagu

SEQ ID NO: 3290460 - RNA, 18 nt, Mycobacterium tuberculosis H37Rv
accagagcgucgaacacg

SEQ ID NO: 3290461 - RNA, 24 nt, Mycobacterium tuberculosis H37Rv
accagaggcgugucgacuccgauc

SEQ ID NO: 3290462 - RNA, 19 nt, Mycobacterium tuberculosis H37Rv
accagagucaacaucagca

SEQ ID NO: 3290463 - RNA, 14 nt, Mycobacterium tuberculosis H37Rv
accagaguucggcc

SEQ ID NO: 3290464 - RNA, 18 nt, Mycobacterium tuberculosis H37Rv
accagaucgacgcauucc

SEQ ID NO: 3290465 - RNA, 19 nt, Mycobacterium tuberculosis H37Rv
accagaucgacgcauuccu

SEQ ID NO: 3290466 - RNA, 16 nt, Mycobacterium tuberculosis H37Rv
accagaucgucgggca

SEQ ID NO: 3290467 - RNA, 14 nt, Mycobacterium tuberculosis H37Rv
accagaugcaccuc

SEQ ID NO: 3290468 - RNA, 22 nt, Mycobacterium tuberculosis H37Rv
accagaugcaccucgcccugca

SEQ ID NO: 3290469 - RNA, 17 nt, Mycobacterium tuberculosis H37Rv
accagcaaccaccccag

SEQ ID NO: 3290470 - RNA, 15 nt, Mycobacterium tuberculosis H37Rv
accagcaaugccgac

SEQ ID NO: 3290471 - RNA, 23 nt, Mycobacterium tuberculosis H37Rv
accagcacaccgguugacagcuc

SEQ ID NO: 3290472 - RNA, 22 nt, Mycobacterium tuberculosis H37Rv
accagcaccaaaagcccgguac

SEQ ID NO: 3290473 - RNA, 16 nt, Mycobacterium tuberculosis H37Rv
accagcaccagaaccg

SEQ ID NO: 3290474 - RNA, 20 nt, Mycobacterium tuberculosis H37Rv
accagcaccgccgcugccau

SEQ ID NO: 3290475 - RNA, 18 nt, Mycobacterium tuberculosis H37Rv
accagcacggcgaucggu

SEQ ID NO: 3290476 - RNA, 13 nt, Mycobacterium tuberculosis H37Rv
accagcagcacca

SEQ ID NO: 3290477 - RNA, 22 nt, Mycobacterium tuberculosis H37Rv
accagcagccagcccagccgcc

SEQ ID NO: 3290478 - RNA, 22 nt, Mycobacterium tuberculosis H37Rv
accagcaggccgggcgcaagca

SEQ ID NO: 3290479 - RNA, 19 nt, Mycobacterium tuberculosis H37Rv
accagcaggcggcucaacc

SEQ ID NO: 3290480 - RNA, 19 nt, Mycobacterium tuberculosis H37Rv
accagcaucguggccgcac

SEQ ID NO: 3290481 - RNA, 20 nt, Mycobacterium tuberculosis H37Rv
accagcaucguggccgcacc

SEQ ID NO: 3290482 - RNA, 19 nt, Mycobacterium tuberculosis H37Rv
accagcauggcuuuugcgc

SEQ ID NO: 3290483 - RNA, 17 nt, Mycobacterium tuberculosis H37Rv
accagcauucucgccga

SEQ ID NO: 3290484 - RNA, 18 nt, Mycobacterium tuberculosis H37Rv
accagccaaaacgagcag

SEQ ID NO: 3290485 - RNA, 15 nt, Mycobacterium tuberculosis H37Rv
accagccaccaccag

SEQ ID NO: 3290486 - RNA, 12 nt, Mycobacterium tuberculosis H37Rv
accagccagccu

SEQ ID NO: 3290487 - RNA, 15 nt, Mycobacterium tuberculosis H37Rv
accagccagcgagga

SEQ ID NO: 3290488 - RNA, 22 nt, Mycobacterium tuberculosis H37Rv
accagccccgcuggucgaccgg

SEQ ID NO: 3290489 - RNA, 22 nt, Mycobacterium tuberculosis H37Rv
accagcccggcggcggucacca

SEQ ID NO: 3290490 - RNA, 15 nt, Mycobacterium tuberculosis H37Rv
accagccgaucauca

SEQ ID NO: 3290491 - RNA, 12 nt, Mycobacterium tuberculosis H37Rv
accagccgcccc

SEQ ID NO: 3290492 - RNA, 18 nt, Mycobacterium tuberculosis H37Rv
accagccgcggaucaucc

SEQ ID NO: 3290493 - RNA, 18 nt, Mycobacterium tuberculosis H37Rv
accagccgguagccgggc

SEQ ID NO: 3290494 - RNA, 13 nt, Mycobacterium tuberculosis H37Rv
accagccggucgu

SEQ ID NO: 3290495 - RNA, 14 nt, Mycobacterium tuberculosis H37Rv
accagccggugagc

SEQ ID NO: 3290496 - RNA, 23 nt, Mycobacterium tuberculosis H37Rv
accagccgguuggcugccggcaa

SEQ ID NO: 3290497 - RNA, 14 nt, Mycobacterium tuberculosis H37Rv
accagccgucagcg

SEQ ID NO: 3290498 - RNA, 15 nt, Mycobacterium tuberculosis H37Rv
accagccgucagcgc

SEQ ID NO: 3290499 - RNA, 23 nt, Mycobacterium tuberculosis H37Rv
accagccguggugguugaucagc

SEQ ID NO: 3290500 - RNA, 23 nt, Mycobacterium tuberculosis H37Rv
accagccuuuccggccgccugcc

SEQ ID NO: 3290501 - RNA, 22 nt, Mycobacterium tuberculosis H37Rv
accagcgaaaugcccaucacca

SEQ ID NO: 3290502 - RNA, 18 nt, Mycobacterium tuberculosis H37Rv
accagcgagcccagcugc

SEQ ID NO: 3290503 - RNA, 16 nt, Mycobacterium tuberculosis H37Rv
accagcgaggccagcg

SEQ ID NO: 3290504 - RNA, 17 nt, Mycobacterium tuberculosis H37Rv
accagcgaggccagcgg

SEQ ID NO: 3290505 - RNA, 14 nt, Mycobacterium tuberculosis H37Rv
accagcgcagccga

SEQ ID NO: 3290506 - RNA, 16 nt, Mycobacterium tuberculosis H37Rv
accagcgcagccgauc

SEQ ID NO: 3290507 - RNA, 14 nt, Mycobacterium tuberculosis H37Rv
accagcgcaucggc

SEQ ID NO: 3290508 - RNA, 16 nt, Mycobacterium tuberculosis H37Rv
accagcgcaucggcca

SEQ ID NO: 3290509 - RNA, 18 nt, Mycobacterium tuberculosis H37Rv
accagcgccccggcgcgu

SEQ ID NO: 3290510 - RNA, 14 nt, Mycobacterium tuberculosis H37Rv
accagcgcccggcc

SEQ ID NO: 3290511 - RNA, 16 nt, Mycobacterium tuberculosis H37Rv
accaugaucacaccga

SEQ ID NO: 3290512 - RNA, 14 nt, Mycobacterium tuberculosis H37Rv
accaugaugaccgg

SEQ ID NO: 3290513 - RNA, 18 nt, Mycobacterium tuberculosis H37Rv
accaugaugccuaccggg

SEQ ID NO: 3290514 - RNA, 20 nt, Mycobacterium tuberculosis H37Rv
accaugauguagcggcguuc

SEQ ID NO: 3290515 - RNA, 17 nt, Mycobacterium tuberculosis H37Rv
accaugauugccaggac

SEQ ID NO: 3290516 - RNA, 20 nt, Mycobacterium tuberculosis H37Rv
accaugcgguuagcagccgc

SEQ ID NO: 3290517 - RNA, 16 nt, Mycobacterium tuberculosis H37Rv
accaugcuguguauca

SEQ ID NO: 3290518 - RNA, 14 nt, Mycobacterium tuberculosis H37Rv
accauggcgcgacc

SEQ ID NO: 3290519 - RNA, 20 nt, Mycobacterium tuberculosis H37Rv
accaugguagcgccccgaug

SEQ ID NO: 3290520 - RNA, 22 nt, Mycobacterium tuberculosis H37Rv
accauguauuucucccagccca

SEQ ID NO: 3290521 - RNA, 20 nt, Mycobacterium tuberculosis H37Rv
accaugucggccacccggac

SEQ ID NO: 3290522 - RNA, 14 nt, Mycobacterium tuberculosis H37Rv
accaugugcuccgc

SEQ ID NO: 3290523 - RNA, 12 nt, Mycobacterium tuberculosis H37Rv
accauucggcga

SEQ ID NO: 3290524 - RNA, 20 nt, Mycobacterium tuberculosis H37Rv
accauuguuccguccccgac

SEQ ID NO: 3290525 - RNA, 15 nt, Mycobacterium tuberculosis H37Rv
acccaaccgcgccac

SEQ ID NO: 3290526 - RNA, 15 nt, Mycobacterium tuberculosis H37Rv
acccaacgaccacca

SEQ ID NO: 3290527 - RNA, 22 nt, Mycobacterium tuberculosis H37Rv
acccaacgcggugggcacagcc

SEQ ID NO: 3290528 - RNA, 18 nt, Mycobacterium tuberculosis H37Rv
acccaacuccaucagcgc

SEQ ID NO: 3290529 - RNA, 14 nt, Mycobacterium tuberculosis H37Rv
acccaagucgccga

SEQ ID NO: 3290530 - RNA, 16 nt, Mycobacterium tuberculosis H37Rv
acccaagucgccgagg

SEQ ID NO: 3290531 - RNA, 14 nt, Mycobacterium tuberculosis H37Rv
acccaauaggcgaa

SEQ ID NO: 3290532 - RNA, 20 nt, Mycobacterium tuberculosis H37Rv
acccaauccggcgccagcag

SEQ ID NO: 3290533 - RNA, 21 nt, Mycobacterium tuberculosis H37Rv
acccaauccggcgccagcagu

SEQ ID NO: 3290534 - RNA, 15 nt, Mycobacterium tuberculosis H37Rv
acccacagucgccgg

SEQ ID NO: 3290535 - RNA, 18 nt, Mycobacterium tuberculosis H37Rv
acccacaucagccgcacc

SEQ ID NO: 3290536 - RNA, 19 nt, Mycobacterium tuberculosis H37Rv
acccacaucaggucggcga

SEQ ID NO: 3290537 - RNA, 23 nt, Mycobacterium tuberculosis H37Rv
acccaccaacacccgggccuugu

SEQ ID NO: 3290538 - RNA, 24 nt, Mycobacterium tuberculosis H37Rv
acccaccagugcaucgaucaccgc

SEQ ID NO: 3290539 - RNA, 18 nt, Mycobacterium tuberculosis H37Rv
acccacccgcaccgccgg

SEQ ID NO: 3290540 - RNA, 17 nt, Mycobacterium tuberculosis H37Rv
acccaccgaagcgaacg

SEQ ID NO: 3290541 - RNA, 12 nt, Mycobacterium tuberculosis H37Rv
acccaccgcucg

SEQ ID NO: 3290542 - RNA, 14 nt, Mycobacterium tuberculosis H37Rv
acccaccgucaccc

SEQ ID NO: 3290543 - RNA, 23 nt, Mycobacterium tuberculosis H37Rv
acccacgagagcgcugucccgaa

SEQ ID NO: 3290544 - RNA, 17 nt, Mycobacterium tuberculosis H37Rv
acccacgaucagcagcg

SEQ ID NO: 3290545 - RNA, 22 nt, Mycobacterium tuberculosis H37Rv
acccacgcauguuggugaucaa

SEQ ID NO: 3290546 - RNA, 12 nt, Mycobacterium tuberculosis H37Rv
acccacgccgac

SEQ ID NO: 3290547 - RNA, 15 nt, Mycobacterium tuberculosis H37Rv
acccagaaugacauc

SEQ ID NO: 3290548 - RNA, 15 nt, Mycobacterium tuberculosis H37Rv
acccagaugcaggcu

SEQ ID NO: 3290549 - RNA, 13 nt, Mycobacterium tuberculosis H37Rv
acccagcaccaca

SEQ ID NO: 3290550 - RNA, 15 nt, Mycobacterium tuberculosis H37Rv
acccagcagcggcac

SEQ ID NO: 3290551 - RNA, 20 nt, Mycobacterium tuberculosis H37Rv
acccagcauggggucagcuc

SEQ ID NO: 3290552 - RNA, 19 nt, Mycobacterium tuberculosis H37Rv
acccagccagcagcggcga

SEQ ID NO: 3290553 - RNA, 17 nt, Mycobacterium tuberculosis H37Rv
acccagcccagccguuc

SEQ ID NO: 3290554 - RNA, 17 nt, Mycobacterium tuberculosis H37Rv
acccagccgcgccagcu

SEQ ID NO: 3290555 - RNA, 14 nt, Mycobacterium tuberculosis H37Rv
acccagccggaacc

SEQ ID NO: 3290556 - RNA, 23 nt, Mycobacterium tuberculosis H37Rv
acccagccggaaccggacagcgu

SEQ ID NO: 3290557 - RNA, 20 nt, Mycobacterium tuberculosis H37Rv
acccagccggccugucccgc

SEQ ID NO: 3290558 - RNA, 23 nt, Mycobacterium tuberculosis H37Rv
acccagcgacgcggccagcggca

SEQ ID NO: 3290559 - RNA, 12 nt, Mycobacterium tuberculosis H37Rv
acccagcgcagc

SEQ ID NO: 3290560 - RNA, 16 nt, Mycobacterium tuberculosis H37Rv
acccagcgcagcagcg

SEQ ID NO: 3290561 - RNA, 19 nt, Mycobacterium tuberculosis H37Rv
acccagcgcagcagcggca

SEQ ID NO: 3290562 - RNA, 14 nt, Mycobacterium tuberculosis H37Rv
acccagcggaaccg

SEQ ID NO: 3290563 - RNA, 21 nt, Mycobacterium tuberculosis H37Rv
acccagcgguaucccccagcc

SEQ ID NO: 3290564 - RNA, 17 nt, Mycobacterium tuberculosis H37Rv
acccagcgugcccgcca

SEQ ID NO: 3290565 - RNA, 16 nt, Mycobacterium tuberculosis H37Rv
acccagcucgcgcacc

SEQ ID NO: 3290566 - RNA, 22 nt, Mycobacterium tuberculosis H37Rv
acccagcucgcgcacccagccc

SEQ ID NO: 3290567 - RNA, 17 nt, Mycobacterium tuberculosis H37Rv
acccagcucgucgcuga

SEQ ID NO: 3290568 - RNA, 17 nt, Mycobacterium tuberculosis H37Rv
acccaggaucagcccgg

SEQ ID NO: 3290569 - RNA, 16 nt, Mycobacterium tuberculosis H37Rv
acccaggcacaacauc

SEQ ID NO: 3290570 - RNA, 20 nt, Mycobacterium tuberculosis H37Rv
acccagggcguuggcggcuu

SEQ ID NO: 3290571 - RNA, 14 nt, Mycobacterium tuberculosis H37Rv
acccagucggcgcc

SEQ ID NO: 3290572 - RNA, 15 nt, Mycobacterium tuberculosis H37Rv
acccagugccacgcc

SEQ ID NO: 3290573 - RNA, 16 nt, Mycobacterium tuberculosis H37Rv
acccagugccacgccu

SEQ ID NO: 3290574 - RNA, 17 nt, Mycobacterium tuberculosis H37Rv
acccagugccacgccug

SEQ ID NO: 3290575 - RNA, 22 nt, Mycobacterium tuberculosis H37Rv
acccaguuccacccggugccgc

SEQ ID NO: 3290576 - RNA, 21 nt, Mycobacterium tuberculosis H37Rv
acccaguuucggcgucgucga

SEQ ID NO: 3290577 - RNA, 19 nt, Mycobacterium tuberculosis H37Rv
acccaucaacgccggcgac

SEQ ID NO: 3290578 - RNA, 15 nt, Mycobacterium tuberculosis H37Rv
acccaucaccagcgg

SEQ ID NO: 3290579 - RNA, 16 nt, Mycobacterium tuberculosis H37Rv
acccaucaccgccagc

SEQ ID NO: 3290580 - RNA, 15 nt, Mycobacterium tuberculosis H37Rv
acccaucagcccucg

SEQ ID NO: 3290581 - RNA, 16 nt, Mycobacterium tuberculosis H37Rv
acccaucccguucagc

SEQ ID NO: 3290582 - RNA, 13 nt, Mycobacterium tuberculosis H37Rv
acccaucgaccgc

SEQ ID NO: 3290583 - RNA, 15 nt, Mycobacterium tuberculosis H37Rv
acccaucgaccgccc

SEQ ID NO: 3290584 - RNA, 18 nt, Mycobacterium tuberculosis H37Rv
acccaucgucgagccgcc

SEQ ID NO: 3290585 - RNA, 16 nt, Mycobacterium tuberculosis H37Rv
acccaucucgaaggug

SEQ ID NO: 3290586 - RNA, 13 nt, Mycobacterium tuberculosis H37Rv
acccaugcaugcg

SEQ ID NO: 3290587 - RNA, 15 nt, Mycobacterium tuberculosis H37Rv
acccaugcaugcguu

SEQ ID NO: 3290588 - RNA, 21 nt, Mycobacterium tuberculosis H37Rv
acccauggccucccacucacc

SEQ ID NO: 3290589 - RNA, 19 nt, Mycobacterium tuberculosis H37Rv
acccauggucaccagcugg

SEQ ID NO: 3290590 - RNA, 22 nt, Mycobacterium tuberculosis H37Rv
acccauuggaccgagacuugcu

SEQ ID NO: 3290591 - RNA, 16 nt, Mycobacterium tuberculosis H37Rv
acccauuucgucagcg

SEQ ID NO: 3290592 - RNA, 20 nt, Mycobacterium tuberculosis H37Rv
accccaacgaccggcacggu

SEQ ID NO: 3290593 - RNA, 16 nt, Mycobacterium tuberculosis H37Rv
accccaaguccagcag

SEQ ID NO: 3290594 - RNA, 15 nt, Mycobacterium tuberculosis H37Rv
accccaccacagacg

SEQ ID NO: 3290595 - RNA, 15 nt, Mycobacterium tuberculosis H37Rv
accccacccagcgac

SEQ ID NO: 3290596 - RNA, 13 nt, Mycobacterium tuberculosis H37Rv
accccacggccag

SEQ ID NO: 3290597 - RNA, 15 nt, Mycobacterium tuberculosis H37Rv
accccagccggcagc

SEQ ID NO: 3290598 - RNA, 18 nt, Mycobacterium tuberculosis H37Rv
accccagccggcagcagc

SEQ ID NO: 3290599 - RNA, 14 nt, Mycobacterium tuberculosis H37Rv
accccagcgcaacc

SEQ ID NO: 3290600 - RNA, 15 nt, Mycobacterium tuberculosis H37Rv
accccagcggccacc

SEQ ID NO: 3290601 - RNA, 16 nt, Mycobacterium tuberculosis H37Rv
accccagcggccaccg

SEQ ID NO: 3290602 - RNA, 12 nt, Mycobacterium tuberculosis H37Rv
accccagcuugg

SEQ ID NO: 3290603 - RNA, 19 nt, Mycobacterium tuberculosis H37Rv
accccagucggccaagcug

SEQ ID NO: 3290604 - RNA, 23 nt, Mycobacterium tuberculosis H37Rv
accccaucagaaugccuggcccg

SEQ ID NO: 3290605 - RNA, 21 nt, Mycobacterium tuberculosis H37Rv
accccaugaccgggaggcggc

SEQ ID NO: 3290606 - RNA, 15 nt, Mycobacterium tuberculosis H37Rv
accccauggccaccg

SEQ ID NO: 3290607 - RNA, 15 nt, Mycobacterium tuberculosis H37Rv
acccgcagaccgcca

SEQ ID NO: 3290608 - RNA, 17 nt, Mycobacterium tuberculosis H37Rv
acccgcagaccgccacc

SEQ ID NO: 3290609 - RNA, 16 nt, Mycobacterium tuberculosis H37Rv
acccgcagccgcgagu

SEQ ID NO: 3290610 - RNA, 13 nt, Mycobacterium tuberculosis H37Rv
acccgcagcugcg

SEQ ID NO: 3290611 - RNA, 15 nt, Mycobacterium tuberculosis H37Rv
acccgcagcugcgga

SEQ ID NO: 3290612 - RNA, 20 nt, Mycobacterium tuberculosis H37Rv
acccgcauccacgucgccca

SEQ ID NO: 3290613 - RNA, 12 nt, Mycobacterium tuberculosis H37Rv
acccgcaucggc

SEQ ID NO: 3290614 - RNA, 17 nt, Mycobacterium tuberculosis H37Rv
acccgcccggaacgggu

SEQ ID NO: 3290615 - RNA, 18 nt, Mycobacterium tuberculosis H37Rv
acccgccgacgaccgccu

SEQ ID NO: 3290616 - RNA, 23 nt, Mycobacterium tuberculosis H37Rv
acccgccgacgaccgccugcaac

SEQ ID NO: 3290617 - RNA, 21 nt, Mycobacterium tuberculosis H37Rv
acccgccgaugaugcggcgca

SEQ ID NO: 3290618 - RNA, 17 nt, Mycobacterium tuberculosis H37Rv
acccgccgaugccgccg

SEQ ID NO: 3290619 - RNA, 13 nt, Mycobacterium tuberculosis H37Rv
acccgccgcccca

SEQ ID NO: 3290620 - RNA, 14 nt, Mycobacterium tuberculosis H37Rv
acccgccgccccac

SEQ ID NO: 3290621 - RNA, 18 nt, Mycobacterium tuberculosis H37Rv
acccgccggccgucggcc

SEQ ID NO: 3290622 - RNA, 21 nt, Mycobacterium tuberculosis H37Rv
acccgccggcgacugcagcga

SEQ ID NO: 3290623 - RNA, 19 nt, Mycobacterium tuberculosis H37Rv
acccgccggcggggugcgc

SEQ ID NO: 3290624 - RNA, 15 nt, Mycobacterium tuberculosis H37Rv
acccgccgucaccgc

SEQ ID NO: 3290625 - RNA, 22 nt, Mycobacterium tuberculosis H37Rv
acccgccuaaagcgugucgccc

SEQ ID NO: 3290626 - RNA, 14 nt, Mycobacterium tuberculosis H37Rv
acccgcgaagccgc

SEQ ID NO: 3290627 - RNA, 13 nt, Mycobacterium tuberculosis H37Rv
acccgcgccgcca

SEQ ID NO: 3290628 - RNA, 15 nt, Mycobacterium tuberculosis H37Rv
acccgcgccgcccgc

SEQ ID NO: 3290629 - RNA, 14 nt, Mycobacterium tuberculosis H37Rv
acccgcgcgcacca

SEQ ID NO: 3290630 - RNA, 12 nt, Mycobacterium tuberculosis H37Rv
acccgcgcgccg

SEQ ID NO: 3290631 - RNA, 21 nt, Mycobacterium tuberculosis H37Rv
acccgcggugacgccagccug

SEQ ID NO: 3290632 - RNA, 17 nt, Mycobacterium tuberculosis H37Rv
acccgcucacgcucacc

SEQ ID NO: 3290633 - RNA, 17 nt, Mycobacterium tuberculosis H37Rv
acccgcuccagcucggc

SEQ ID NO: 3290634 - RNA, 13 nt, Mycobacterium tuberculosis H37Rv
acccgcucggcgc

SEQ ID NO: 3290635 - RNA, 15 nt, Mycobacterium tuberculosis H37Rv
acccgcucggcgcgc

SEQ ID NO: 3290636 - RNA, 15 nt, Mycobacterium tuberculosis H37Rv
acccgcucggcgguc

SEQ ID NO: 3290637 - RNA, 19 nt, Mycobacterium tuberculosis H37Rv
acccgcucggcggucggga

SEQ ID NO: 3290638 - RNA, 17 nt, Mycobacterium tuberculosis H37Rv
acccgcuggcccgccag

SEQ ID NO: 3290639 - RNA, 13 nt, Mycobacterium tuberculosis H37Rv
acccgcuucgccc

SEQ ID NO: 3290640 - RNA, 14 nt, Mycobacterium tuberculosis H37Rv
acccgcuucgcccg

SEQ ID NO: 3290641 - RNA, 15 nt, Mycobacterium tuberculosis H37Rv
acccgcuucgcccgg

SEQ ID NO: 3290642 - RNA, 18 nt, Mycobacterium tuberculosis H37Rv
acccgcuucgcccggcug

SEQ ID NO: 3290643 - RNA, 21 nt, Mycobacterium tuberculosis H37Rv
acccgcuucgcccggcugcgc

SEQ ID NO: 3290644 - RNA, 15 nt, Mycobacterium tuberculosis H37Rv
acccggaagaacucg

SEQ ID NO: 3290645 - RNA, 14 nt, Mycobacterium tuberculosis H37Rv
acccggaccugggc

SEQ ID NO: 3290646 - RNA, 23 nt, Mycobacterium tuberculosis H37Rv
acccggaccugggcgacuaccgg

SEQ ID NO: 3290647 - RNA, 17 nt, Mycobacterium tuberculosis H37Rv
acccggagaaucggucc

SEQ ID NO: 3290648 - RNA, 15 nt, Mycobacterium tuberculosis H37Rv
acccggaggcaaucc

SEQ ID NO: 3290649 - RNA, 17 nt, Mycobacterium tuberculosis H37Rv
acccggauaucgaccac

SEQ ID NO: 3290650 - RNA, 16 nt, Mycobacterium tuberculosis H37Rv
acccggcacccaguuc

SEQ ID NO: 3290651 - RNA, 17 nt, Mycobacterium tuberculosis H37Rv
acccggcagagcacgcg

SEQ ID NO: 3290652 - RNA, 22 nt, Mycobacterium tuberculosis H37Rv
acccggccaggaguuugaccac

SEQ ID NO: 3290653 - RNA, 20 nt, Mycobacterium tuberculosis H37Rv
acccggcccauugucgauca

SEQ ID NO: 3290654 - RNA, 21 nt, Mycobacterium tuberculosis H37Rv
acccggcccauugucgaucac

SEQ ID NO: 3290655 - RNA, 22 nt, Mycobacterium tuberculosis H37Rv
acccggcccauugucgaucacc

SEQ ID NO: 3290656 - RNA, 22 nt, Mycobacterium tuberculosis H37Rv
acccggccgccgaaacucacca

SEQ ID NO: 3290657 - RNA, 20 nt, Mycobacterium tuberculosis H37Rv
acccggccgggccugcacca

SEQ ID NO: 3290658 - RNA, 12 nt, Mycobacterium tuberculosis H37Rv
acccggccguug

SEQ ID NO: 3290659 - RNA, 21 nt, Mycobacterium tuberculosis H37Rv
acccggccguugggccaccgg

SEQ ID NO: 3290660 - RNA, 21 nt, Mycobacterium tuberculosis H37Rv
acccggcgaccacggcaccga

SEQ ID NO: 3290661 - RNA, 20 nt, Mycobacterium tuberculosis H37Rv
acccggcgauuggaccgcca

SEQ ID NO: 3290662 - RNA, 18 nt, Mycobacterium tuberculosis H37Rv
acccggcgcaacaaccgg

SEQ ID NO: 3290663 - RNA, 18 nt, Mycobacterium tuberculosis H37Rv
acccggcgcagcaacgca

SEQ ID NO: 3290664 - RNA, 18 nt, Mycobacterium tuberculosis H37Rv
acccggcggacgacgucg

SEQ ID NO: 3290665 - RNA, 16 nt, Mycobacterium tuberculosis H37Rv
acccggcgggcccgcc

SEQ ID NO: 3290666 - RNA, 21 nt, Mycobacterium tuberculosis H37Rv
acccggcgggcggugggcagc

SEQ ID NO: 3290667 - RNA, 17 nt, Mycobacterium tuberculosis H37Rv
acccggcggugccguca

SEQ ID NO: 3290668 - RNA, 15 nt, Mycobacterium tuberculosis H37Rv
acccggcgucgacga

SEQ ID NO: 3290669 - RNA, 19 nt, Mycobacterium tuberculosis H37Rv
acccggcgugagcuccgca

SEQ ID NO: 3290670 - RNA, 18 nt, Mycobacterium tuberculosis H37Rv
acccggcuccagcaccgu

SEQ ID NO: 3290671 - RNA, 15 nt, Mycobacterium tuberculosis H37Rv
acccggcuucgccgc

SEQ ID NO: 3290672 - RNA, 14 nt, Mycobacterium tuberculosis H37Rv
acccgggaaggaac

SEQ ID NO: 3290673 - RNA, 21 nt, Mycobacterium tuberculosis H37Rv
acccgggacguuguccaccgc

SEQ ID NO: 3290674 - RNA, 19 nt, Mycobacterium tuberculosis H37Rv
acccgggaugaccaccggu

SEQ ID NO: 3290675 - RNA, 12 nt, Mycobacterium tuberculosis H37Rv
acccgggccacg

SEQ ID NO: 3290676 - RNA, 18 nt, Mycobacterium tuberculosis H37Rv
acccgggccaggcugcgc

SEQ ID NO: 3290677 - RNA, 19 nt, Mycobacterium tuberculosis H37Rv
acccgggccaggcugcgca

SEQ ID NO: 3290678 - RNA, 18 nt, Mycobacterium tuberculosis H37Rv
acccgggccaguucgucg

SEQ ID NO: 3290679 - RNA, 15 nt, Mycobacterium tuberculosis H37Rv
acccgggccugggac

SEQ ID NO: 3290680 - RNA, 21 nt, Mycobacterium tuberculosis H37Rv
acccgggccugggacggcggc

SEQ ID NO: 3290681 - RNA, 16 nt, Mycobacterium tuberculosis H37Rv
acccgggcgugggugu

SEQ ID NO: 3290682 - RNA, 22 nt, Mycobacterium tuberculosis H37Rv
acccgggcgugggugucggcga

SEQ ID NO: 3290683 - RNA, 17 nt, Mycobacterium tuberculosis H37Rv
acccggggugcccggcc

SEQ ID NO: 3290684 - RNA, 20 nt, Mycobacterium tuberculosis H37Rv
acccggguagacaccgcgau

SEQ ID NO: 3290685 - RNA, 20 nt, Mycobacterium tuberculosis H37Rv
acccgguaugcgcgucccca

SEQ ID NO: 3290686 - RNA, 17 nt, Mycobacterium tuberculosis H37Rv
acccggucaucggccgu

SEQ ID NO: 3290687 - RNA, 20 nt, Mycobacterium tuberculosis H37Rv
acccgguccggcccggggac

SEQ ID NO: 3290688 - RNA, 22 nt, Mycobacterium tuberculosis H37Rv
acccgguccugcucgcacagca

SEQ ID NO: 3290689 - RNA, 14 nt, Mycobacterium tuberculosis H37Rv
acccggucgccggg

SEQ ID NO: 3290690 - RNA, 16 nt, Mycobacterium tuberculosis H37Rv
acccggucgccgguca

SEQ ID NO: 3290691 - RNA, 20 nt, Mycobacterium tuberculosis H37Rv
acccggucgccggucaucgc

SEQ ID NO: 3290692 - RNA, 14 nt, Mycobacterium tuberculosis H37Rv
acccggucggcagc

SEQ ID NO: 3290693 - RNA, 21 nt, Mycobacterium tuberculosis H37Rv
acccggucggccauccaccgc

SEQ ID NO: 3290694 - RNA, 22 nt, Mycobacterium tuberculosis H37Rv
acccggucggguccaacgccgc

SEQ ID NO: 3290695 - RNA, 20 nt, Mycobacterium tuberculosis H37Rv
acccggugacccgcugggcc

SEQ ID NO: 3290696 - RNA, 17 nt, Mycobacterium tuberculosis H37Rv
acccggugagaagaagc

SEQ ID NO: 3290697 - RNA, 19 nt, Mycobacterium tuberculosis H37Rv
acccggugagaagaagccc

SEQ ID NO: 3290698 - RNA, 19 nt, Mycobacterium tuberculosis H37Rv
acccggugaugguggcggu

SEQ ID NO: 3290699 - RNA, 14 nt, Mycobacterium tuberculosis H37Rv
acccgguugugcgc

SEQ ID NO: 3290700 - RNA, 13 nt, Mycobacterium tuberculosis H37Rv
acccguacccacg

SEQ ID NO: 3290701 - RNA, 19 nt, Mycobacterium tuberculosis H37Rv
acccguaggguggccgacg

SEQ ID NO: 3290702 - RNA, 19 nt, Mycobacterium tuberculosis H37Rv
acccguauugccaaagccc

SEQ ID NO: 3290703 - RNA, 18 nt, Mycobacterium tuberculosis H37Rv
accgagaucaccgccacc

SEQ ID NO: 3290704 - RNA, 22 nt, Mycobacterium tuberculosis H37Rv
accgagaugcgcaauagaccgc

SEQ ID NO: 3290705 - RNA, 23 nt, Mycobacterium tuberculosis H37Rv
accgagcaaacacgccucgccga

SEQ ID NO: 3290706 - RNA, 15 nt, Mycobacterium tuberculosis H37Rv
accgagcacaucgcc

SEQ ID NO: 3290707 - RNA, 20 nt, Mycobacterium tuberculosis H37Rv
accgagcaccucggccagcg

SEQ ID NO: 3290708 - RNA, 21 nt, Mycobacterium tuberculosis H37Rv
accgagcacggguagcgucca

SEQ ID NO: 3290709 - RNA, 11 nt, Mycobacterium tuberculosis H37Rv
accgagcagca

SEQ ID NO: 3290710 - RNA, 17 nt, Mycobacterium tuberculosis H37Rv
accgagccgucagcguc

SEQ ID NO: 3290711 - RNA, 16 nt, Mycobacterium tuberculosis H37Rv
accgagcgcaacccgu

SEQ ID NO: 3290712 - RNA, 17 nt, Mycobacterium tuberculosis H37Rv
accgagcgcccuccucg

SEQ ID NO: 3290713 - RNA, 16 nt, Mycobacterium tuberculosis H37Rv
accgagcugacgccga

SEQ ID NO: 3290714 - RNA, 16 nt, Mycobacterium tuberculosis H37Rv
accgagcugagcggcc

SEQ ID NO: 3290715 - RNA, 17 nt, Mycobacterium tuberculosis H37Rv
accgagcugagcggcca

SEQ ID NO: 3290716 - RNA, 14 nt, Mycobacterium tuberculosis H37Rv
accgaggaccucgu

SEQ ID NO: 3290717 - RNA, 13 nt, Mycobacterium tuberculosis H37Rv
accgaggaucucg

SEQ ID NO: 3290718 - RNA, 15 nt, Mycobacterium tuberculosis H37Rv
accgaggaucucgcg

SEQ ID NO: 3290719 - RNA, 16 nt, Mycobacterium tuberculosis H37Rv
accgagggccgucaca

SEQ ID NO: 3290720 - RNA, 22 nt, Mycobacterium tuberculosis H37Rv
accgagggucgggcauuccggu

SEQ ID NO: 3290721 - RNA, 20 nt, Mycobacterium tuberculosis H37Rv
accgaggucgagcgacccca

SEQ ID NO: 3290722 - RNA, 14 nt, Mycobacterium tuberculosis H37Rv
accgaggucggcca

SEQ ID NO: 3290723 - RNA, 16 nt, Mycobacterium tuberculosis H37Rv
accgaggugccgcgca

SEQ ID NO: 3290724 - RNA, 20 nt, Mycobacterium tuberculosis H37Rv
accgaguaccgauagccugc

SEQ ID NO: 3290725 - RNA, 19 nt, Mycobacterium tuberculosis H37Rv
accgaguagaacuucgcca

SEQ ID NO: 3290726 - RNA, 22 nt, Mycobacterium tuberculosis H37Rv
accgagucgacggccagugcgc

SEQ ID NO: 3290727 - RNA, 13 nt, Mycobacterium tuberculosis H37Rv
accgagucgacgu

SEQ ID NO: 3290728 - RNA, 14 nt, Mycobacterium tuberculosis H37Rv
accgaguuccucug

SEQ ID NO: 3290729 - RNA, 17 nt, Mycobacterium tuberculosis H37Rv
accgauaucgcugcgga

SEQ ID NO: 3290730 - RNA, 22 nt, Mycobacterium tuberculosis H37Rv
accgauaucgcugcggaaauga

SEQ ID NO: 3290731 - RNA, 15 nt, Mycobacterium tuberculosis H37Rv
accgaucaauccgcc

SEQ ID NO: 3290732 - RNA, 19 nt, Mycobacterium tuberculosis H37Rv
accgaucaucauauccgcc

SEQ ID NO: 3290733 - RNA, 15 nt, Mycobacterium tuberculosis H37Rv
accgauccaguucac

SEQ ID NO: 3290734 - RNA, 23 nt, Mycobacterium tuberculosis H37Rv
accgaucggcaaaccgucggagg

SEQ ID NO: 3290735 - RNA, 13 nt, Mycobacterium tuberculosis H37Rv
accgaucggcgcg

SEQ ID NO: 3290736 - RNA, 20 nt, Mycobacterium tuberculosis H37Rv
accgaucuuggccaccgccg

SEQ ID NO: 3290737 - RNA, 18 nt, Mycobacterium tuberculosis H37Rv
accgaugaaccaggcggc

SEQ ID NO: 3290738 - RNA, 23 nt, Mycobacterium tuberculosis H37Rv
accgaugacgcguucaacaccgc

SEQ ID NO: 3290739 - RNA, 18 nt, Mycobacterium tuberculosis H37Rv
accgaugaucucacccag

SEQ ID NO: 3290740 - RNA, 15 nt, Mycobacterium tuberculosis H37Rv
accgaugccacaucg

SEQ ID NO: 3290741 - RNA, 23 nt, Mycobacterium tuberculosis H37Rv
accgaugcgccggaccagcuccu

SEQ ID NO: 3290742 - RNA, 22 nt, Mycobacterium tuberculosis H37Rv
accgauggcucacaugcccgca

SEQ ID NO: 3290743 - RNA, 23 nt, Mycobacterium tuberculosis H37Rv
accgaugguggugccaaccuggg

SEQ ID NO: 3290744 - RNA, 23 nt, Mycobacterium tuberculosis H37Rv
accgaugugggcgccgucgccgu

SEQ ID NO: 3290745 - RNA, 15 nt, Mycobacterium tuberculosis H37Rv
accgauucggcgacg

SEQ ID NO: 3290746 - RNA, 20 nt, Mycobacterium tuberculosis H37Rv
accgauucgggcuucuccau

SEQ ID NO: 3290747 - RNA, 15 nt, Mycobacterium tuberculosis H37Rv
accgauugucggcaa

SEQ ID NO: 3290748 - RNA, 18 nt, Mycobacterium tuberculosis H37Rv
accgcaaaggagaagaca

SEQ ID NO: 3290749 - RNA, 22 nt, Mycobacterium tuberculosis H37Rv
accgcaaaggagaagacaugcc

SEQ ID NO: 3290750 - RNA, 14 nt, Mycobacterium tuberculosis H37Rv
accgcaagaaucag

SEQ ID NO: 3290751 - RNA, 18 nt, Mycobacterium tuberculosis H37Rv
accgcaagaaucagcagc

SEQ ID NO: 3290752 - RNA, 22 nt, Mycobacterium tuberculosis H37Rv
accgcaaucggauacccagccg

SEQ ID NO: 3290753 - RNA, 16 nt, Mycobacterium tuberculosis H37Rv
accgcaauggcggccu

SEQ ID NO: 3290754 - RNA, 15 nt, Mycobacterium tuberculosis H37Rv
accgcacaccugcgc

SEQ ID NO: 3290755 - RNA, 13 nt, Mycobacterium tuberculosis H37Rv
accgcacccgcuc

SEQ ID NO: 3290756 - RNA, 21 nt, Mycobacterium tuberculosis H37Rv
accgcaccgacuccugggcca

SEQ ID NO: 3290757 - RNA, 13 nt, Mycobacterium tuberculosis H37Rv
accgcaccugggc

SEQ ID NO: 3290758 - RNA, 19 nt, Mycobacterium tuberculosis H37Rv
accgcacggaugucgccca

SEQ ID NO: 3290759 - RNA, 16 nt, Mycobacterium tuberculosis H37Rv
accgcagacccucguc

SEQ ID NO: 3290760 - RNA, 19 nt, Mycobacterium tuberculosis H37Rv
accgcagacccucgucguc

SEQ ID NO: 3290761 - RNA, 21 nt, Mycobacterium tuberculosis H37Rv
accgcagacccucgucgucga

SEQ ID NO: 3290762 - RNA, 14 nt, Mycobacterium tuberculosis H37Rv
accgcagacgccgu

SEQ ID NO: 3290763 - RNA, 18 nt, Mycobacterium tuberculosis H37Rv
accgcagauccccgccac

SEQ ID NO: 3290764 - RNA, 19 nt, Mycobacterium tuberculosis H37Rv
accgcagcggaacugggcc

SEQ ID NO: 3290765 - RNA, 12 nt, Mycobacterium tuberculosis H37Rv
accgcagggacc

SEQ ID NO: 3290766 - RNA, 16 nt, Mycobacterium tuberculosis H37Rv
accgcaggugccaccu

SEQ ID NO: 3290767 - RNA, 24 nt, Mycobacterium tuberculosis H37Rv
accgcaggugccguggcuaccgca

SEQ ID NO: 3290768 - RNA, 17 nt, Mycobacterium tuberculosis H37Rv
accgcaucauggugcgc

SEQ ID NO: 3290769 - RNA, 13 nt, Mycobacterium tuberculosis H37Rv
accgcaucgccga

SEQ ID NO: 3290770 - RNA, 14 nt, Mycobacterium tuberculosis H37Rv
accgcaucgguguc

SEQ ID NO: 3290771 - RNA, 21 nt, Mycobacterium tuberculosis H37Rv
accgcauucggacgccacgga

SEQ ID NO: 3290772 - RNA, 16 nt, Mycobacterium tuberculosis H37Rv
accgccaaacgcugcg

SEQ ID NO: 3290773 - RNA, 18 nt, Mycobacterium tuberculosis H37Rv
accgccaacauuggugag

SEQ ID NO: 3290774 - RNA, 22 nt, Mycobacterium tuberculosis H37Rv
accgccaauuacagcuugcgca

SEQ ID NO: 3290775 - RNA, 20 nt, Mycobacterium tuberculosis H37Rv
accgccacacggggccgcca

SEQ ID NO: 3290776 - RNA, 17 nt, Mycobacterium tuberculosis H37Rv
accgccaccacccaggc

SEQ ID NO: 3290777 - RNA, 14 nt, Mycobacterium tuberculosis H37Rv
accgccaccacggu

SEQ ID NO: 3290778 - RNA, 16 nt, Mycobacterium tuberculosis H37Rv
accgccaccagaccag

SEQ ID NO: 3290779 - RNA, 17 nt, Mycobacterium tuberculosis H37Rv
accgccaccgcggccug

SEQ ID NO: 3290780 - RNA, 13 nt, Mycobacterium tuberculosis H37Rv
accgccaccuugg

SEQ ID NO: 3290781 - RNA, 13 nt, Mycobacterium tuberculosis H37Rv
accgccagccacc

SEQ ID NO: 3290782 - RNA, 13 nt, Mycobacterium tuberculosis H37Rv
accgccagcccgg

SEQ ID NO: 3290783 - RNA, 17 nt, Mycobacterium tuberculosis H37Rv
accgccagccgcgagcc

SEQ ID NO: 3290784 - RNA, 14 nt, Mycobacterium tuberculosis H37Rv
accgccagcgccac

SEQ ID NO: 3290785 - RNA, 15 nt, Mycobacterium tuberculosis H37Rv
accgccagcgccacc

SEQ ID NO: 3290786 - RNA, 19 nt, Mycobacterium tuberculosis H37Rv
accgccagcggccgcucca

SEQ ID NO: 3290787 - RNA, 22 nt, Mycobacterium tuberculosis H37Rv
accgccagcugggcagccagau

SEQ ID NO: 3290788 - RNA, 22 nt, Mycobacterium tuberculosis H37Rv
accgccaggucgaggcaggccu

SEQ ID NO: 3290789 - RNA, 20 nt, Mycobacterium tuberculosis H37Rv
accgccaucgccaacaccaa

SEQ ID NO: 3290790 - RNA, 15 nt, Mycobacterium tuberculosis H37Rv
accgccaugaacucg

SEQ ID NO: 3290791 - RNA, 14 nt, Mycobacterium tuberculosis H37Rv
accgcccagugcca

SEQ ID NO: 3290792 - RNA, 23 nt, Mycobacterium tuberculosis H37Rv
accgccccgccguugaacggcac

SEQ ID NO: 3290793 - RNA, 15 nt, Mycobacterium tuberculosis H37Rv
accgccccgugggcc

SEQ ID NO: 3290794 - RNA, 18 nt, Mycobacterium tuberculosis H37Rv
accgcccgacccaucacc

SEQ ID NO: 3290795 - RNA, 16 nt, Mycobacterium tuberculosis H37Rv
accgcccgcacccccg

SEQ ID NO: 3290796 - RNA, 23 nt, Mycobacterium tuberculosis H37Rv
accgcccgcaccguggacaccug

SEQ ID NO: 3290797 - RNA, 15 nt, Mycobacterium tuberculosis H37Rv
accgcccgccaggcc

SEQ ID NO: 3290798 - RNA, 22 nt, Mycobacterium tuberculosis H37Rv
accgcccgccaggccguugccc

SEQ ID NO: 3290799 - RNA, 22 nt, Mycobacterium tuberculosis H37Rv
accgcgcuguugccaucgacgc

SEQ ID NO: 3290800 - RNA, 10 nt, Mycobacterium tuberculosis H37Rv
accgcggaca

SEQ ID NO: 3290801 - RNA, 19 nt, Mycobacterium tuberculosis H37Rv
accgcggacccgcagcugc

SEQ ID NO: 3290802 - RNA, 20 nt, Mycobacterium tuberculosis H37Rv
accgcggacccgcagcugcg

SEQ ID NO: 3290803 - RNA, 22 nt, Mycobacterium tuberculosis H37Rv
accgcggacccgcagcugcgga

SEQ ID NO: 3290804 - RNA, 17 nt, Mycobacterium tuberculosis H37Rv
accgcggaucgaccgcc

SEQ ID NO: 3290805 - RNA, 17 nt, Mycobacterium tuberculosis H37Rv
accgcggccaccgccug

SEQ ID NO: 3290806 - RNA, 14 nt, Mycobacterium tuberculosis H37Rv
accgcggccagcac

SEQ ID NO: 3290807 - RNA, 16 nt, Mycobacterium tuberculosis H37Rv
accgcggccagcggga

SEQ ID NO: 3290808 - RNA, 17 nt, Mycobacterium tuberculosis H37Rv
accgcggccaugacacg

SEQ ID NO: 3290809 - RNA, 14 nt, Mycobacterium tuberculosis H37Rv
accgcggccccgac

SEQ ID NO: 3290810 - RNA, 15 nt, Mycobacterium tuberculosis H37Rv
accgcggccccgccg

SEQ ID NO: 3290811 - RNA, 18 nt, Mycobacterium tuberculosis H37Rv
accgcggcccggacgucg

SEQ ID NO: 3290812 - RNA, 22 nt, Mycobacterium tuberculosis H37Rv
accgcggcgaagauaucggcac

SEQ ID NO: 3290813 - RNA, 19 nt, Mycobacterium tuberculosis H37Rv
accgcggcgaucugcgaca

SEQ ID NO: 3290814 - RNA, 14 nt, Mycobacterium tuberculosis H37Rv
accgcggcgucgcc

SEQ ID NO: 3290815 - RNA, 16 nt, Mycobacterium tuberculosis H37Rv
accgcggcgucgccgu

SEQ ID NO: 3290816 - RNA, 17 nt, Mycobacterium tuberculosis H37Rv
accgcggcugucacgcc

SEQ ID NO: 3290817 - RNA, 18 nt, Mycobacterium tuberculosis H37Rv
accgcggcugucacgccu

SEQ ID NO: 3290818 - RNA, 21 nt, Mycobacterium tuberculosis H37Rv
accgcggcugucacgccugcc

SEQ ID NO: 3290819 - RNA, 17 nt, Mycobacterium tuberculosis H37Rv
accgcgggaacccccca

SEQ ID NO: 3290820 - RNA, 18 nt, Mycobacterium tuberculosis H37Rv
accgcgggcggcaucgcc

SEQ ID NO: 3290821 - RNA, 14 nt, Mycobacterium tuberculosis H37Rv
accgcgguagccga

SEQ ID NO: 3290822 - RNA, 17 nt, Mycobacterium tuberculosis H37Rv
accgcgguagccgagcu

SEQ ID NO: 3290823 - RNA, 12 nt, Mycobacterium tuberculosis H37Rv
accgcggucagc

SEQ ID NO: 3290824 - RNA, 13 nt, Mycobacterium tuberculosis H37Rv
accgcggucgcca

SEQ ID NO: 3290825 - RNA, 16 nt, Mycobacterium tuberculosis H37Rv
accgcggucgcugcga

SEQ ID NO: 3290826 - RNA, 23 nt, Mycobacterium tuberculosis H37Rv
accgcggucugcgcgucgcgugg

SEQ ID NO: 3290827 - RNA, 23 nt, Mycobacterium tuberculosis H37Rv
accgcggugacucggccuccgcc

SEQ ID NO: 3290828 - RNA, 23 nt, Mycobacterium tuberculosis H37Rv
accgcgguggccagaucgaacgc

SEQ ID NO: 3290829 - RNA, 20 nt, Mycobacterium tuberculosis H37Rv
accgcggugugcgugucacc

SEQ ID NO: 3290830 - RNA, 17 nt, Mycobacterium tuberculosis H37Rv
accgcguacaggccggc

SEQ ID NO: 3290831 - RNA, 22 nt, Mycobacterium tuberculosis H37Rv
accgcguagaccagugaccgca

SEQ ID NO: 3290832 - RNA, 17 nt, Mycobacterium tuberculosis H37Rv
accgcguagagcagcag

SEQ ID NO: 3290833 - RNA, 17 nt, Mycobacterium tuberculosis H37Rv
accgcgucacuucccgg

SEQ ID NO: 3290834 - RNA, 16 nt, Mycobacterium tuberculosis H37Rv
accgcgucaucaccgg

SEQ ID NO: 3290835 - RNA, 14 nt, Mycobacterium tuberculosis H37Rv
accgcgucggcguu

SEQ ID NO: 3290836 - RNA, 18 nt, Mycobacterium tuberculosis H37Rv
accgcgugcgccggggac

SEQ ID NO: 3290837 - RNA, 15 nt, Mycobacterium tuberculosis H37Rv
accgcgugcgucagc

SEQ ID NO: 3290838 - RNA, 21 nt, Mycobacterium tuberculosis H37Rv
accgcguggucggcgaacgcg

SEQ ID NO: 3290839 - RNA, 18 nt, Mycobacterium tuberculosis H37Rv
accgcguuaugccaggcg

SEQ ID NO: 3290840 - RNA, 20 nt, Mycobacterium tuberculosis H37Rv
accgcguuccgggccggcga

SEQ ID NO: 3290841 - RNA, 15 nt, Mycobacterium tuberculosis H37Rv
accgcguugaugacc

SEQ ID NO: 3290842 - RNA, 16 nt, Mycobacterium tuberculosis H37Rv
accgcguugaugaccg

SEQ ID NO: 3290843 - RNA, 19 nt, Mycobacterium tuberculosis H37Rv
accgcguuguccgcggcca

SEQ ID NO: 3290844 - RNA, 23 nt, Mycobacterium tuberculosis H37Rv
accgcguuuugcaggcccgaguu

SEQ ID NO: 3290845 - RNA, 21 nt, Mycobacterium tuberculosis H37Rv
accgcuaacagauuguccggc

SEQ ID NO: 3290846 - RNA, 15 nt, Mycobacterium tuberculosis H37Rv
accgcuaccagcugg

SEQ ID NO: 3290847 - RNA, 17 nt, Mycobacterium tuberculosis H37Rv
accgcuaugaugccgcc

SEQ ID NO: 3290848 - RNA, 18 nt, Mycobacterium tuberculosis H37Rv
accgcucagggugcgccg

SEQ ID NO: 3290849 - RNA, 24 nt, Mycobacterium tuberculosis H37Rv
accgcucggaguugagcugucgca

SEQ ID NO: 3290850 - RNA, 13 nt, Mycobacterium tuberculosis H37Rv
accgcucgucguc

SEQ ID NO: 3290851 - RNA, 21 nt, Mycobacterium tuberculosis H37Rv
accgcucgucguccggccacg

SEQ ID NO: 3290852 - RNA, 13 nt, Mycobacterium tuberculosis H37Rv
accgcugaccgca

SEQ ID NO: 3290853 - RNA, 12 nt, Mycobacterium tuberculosis H37Rv
accgcugagccc

SEQ ID NO: 3290854 - RNA, 22 nt, Mycobacterium tuberculosis H37Rv
accgcugagguaauucgcggcc

SEQ ID NO: 3290855 - RNA, 15 nt, Mycobacterium tuberculosis H37Rv
accgcugauagcggu

SEQ ID NO: 3290856 - RNA, 18 nt, Mycobacterium tuberculosis H37Rv
accgcugccgcugccgaa

SEQ ID NO: 3290857 - RNA, 22 nt, Mycobacterium tuberculosis H37Rv
accgcugccggcacgcaugccg

SEQ ID NO: 3290858 - RNA, 15 nt, Mycobacterium tuberculosis H37Rv
accgcugccggcagc

SEQ ID NO: 3290859 - RNA, 18 nt, Mycobacterium tuberculosis H37Rv
accgcugcuccucgcggu

SEQ ID NO: 3290860 - RNA, 16 nt, Mycobacterium tuberculosis H37Rv
accgcugcugcugccc

SEQ ID NO: 3290861 - RNA, 17 nt, Mycobacterium tuberculosis H37Rv
accgcugcugcugcccc

SEQ ID NO: 3290862 - RNA, 17 nt, Mycobacterium tuberculosis H37Rv
accgcuggaucgacuuc

SEQ ID NO: 3290863 - RNA, 13 nt, Mycobacterium tuberculosis H37Rv
accgcuggaucgc

SEQ ID NO: 3290864 - RNA, 16 nt, Mycobacterium tuberculosis H37Rv
accgcugggacaacgu

SEQ ID NO: 3290865 - RNA, 19 nt, Mycobacterium tuberculosis H37Rv
accgcugggggcggucgcc

SEQ ID NO: 3290866 - RNA, 16 nt, Mycobacterium tuberculosis H37Rv
accgcugggucgccgu

SEQ ID NO: 3290867 - RNA, 14 nt, Mycobacterium tuberculosis H37Rv
accgcugucagccg

SEQ ID NO: 3290868 - RNA, 17 nt, Mycobacterium tuberculosis H37Rv
accgcuguucuugguga

SEQ ID NO: 3290869 - RNA, 13 nt, Mycobacterium tuberculosis H37Rv
accgcuucccccg

SEQ ID NO: 3290870 - RNA, 14 nt, Mycobacterium tuberculosis H37Rv
accgcuucccccgg

SEQ ID NO: 3290871 - RNA, 16 nt, Mycobacterium tuberculosis H37Rv
accgcuucccccgguc

SEQ ID NO: 3290872 - RNA, 16 nt, Mycobacterium tuberculosis H37Rv
accgcuugcccgcgca

SEQ ID NO: 3290873 - RNA, 19 nt, Mycobacterium tuberculosis H37Rv
accggaaaccacagcgcca

SEQ ID NO: 3290874 - RNA, 23 nt, Mycobacterium tuberculosis H37Rv
accggaaaccacagcgccaucag

SEQ ID NO: 3290875 - RNA, 16 nt, Mycobacterium tuberculosis H37Rv
accggaaaugucuccu

SEQ ID NO: 3290876 - RNA, 15 nt, Mycobacterium tuberculosis H37Rv
accggaacguuccug

SEQ ID NO: 3290877 - RNA, 23 nt, Mycobacterium tuberculosis H37Rv
accggaauccccccugucgccga

SEQ ID NO: 3290878 - RNA, 22 nt, Mycobacterium tuberculosis H37Rv
accggaauccgggccgccgccc

SEQ ID NO: 3290879 - RNA, 17 nt, Mycobacterium tuberculosis H37Rv
accggacaaacaucgca

SEQ ID NO: 3290880 - RNA, 17 nt, Mycobacterium tuberculosis H37Rv
accggacaaagcugcuc

SEQ ID NO: 3290881 - RNA, 21 nt, Mycobacterium tuberculosis H37Rv
accggaccgaagaccuccucg

SEQ ID NO: 3290882 - RNA, 23 nt, Mycobacterium tuberculosis H37Rv
accggaccgaagaccuccucggu

SEQ ID NO: 3290883 - RNA, 11 nt, Mycobacterium tuberculosis H37Rv
accggaccugg

SEQ ID NO: 3290884 - RNA, 17 nt, Mycobacterium tuberculosis H37Rv
accggacgagcgucaga

SEQ ID NO: 3290885 - RNA, 13 nt, Mycobacterium tuberculosis H37Rv
accggacgaucag

SEQ ID NO: 3290886 - RNA, 17 nt, Mycobacterium tuberculosis H37Rv
accggacgaucagggug

SEQ ID NO: 3290887 - RNA, 16 nt, Mycobacterium tuberculosis H37Rv
accggacgcccucacg

SEQ ID NO: 3290888 - RNA, 21 nt, Mycobacterium tuberculosis H37Rv
accggagaacgggucgacguu

SEQ ID NO: 3290889 - RNA, 16 nt, Mycobacterium tuberculosis H37Rv
accggagcgccgagcu

SEQ ID NO: 3290890 - RNA, 20 nt, Mycobacterium tuberculosis H37Rv
accggagucggcgucgaaga

SEQ ID NO: 3290891 - RNA, 12 nt, Mycobacterium tuberculosis H37Rv
accggaguucag

SEQ ID NO: 3290892 - RNA, 19 nt, Mycobacterium tuberculosis H37Rv
accggauacagccacgcaa

SEQ ID NO: 3290893 - RNA, 14 nt, Mycobacterium tuberculosis H37Rv
accggaucaucgcc

SEQ ID NO: 3290894 - RNA, 16 nt, Mycobacterium tuberculosis H37Rv
accggauccacggaga

SEQ ID NO: 3290895 - RNA, 12 nt, Mycobacterium tuberculosis H37Rv
accggcuugccg

SEQ ID NO: 3290896 - RNA, 15 nt, Mycobacterium tuberculosis H37Rv
accggcuuggcggga

SEQ ID NO: 3290897 - RNA, 17 nt, Mycobacterium tuberculosis H37Rv
accggcuuugcuugccg

SEQ ID NO: 3290898 - RNA, 17 nt, Mycobacterium tuberculosis H37Rv
accgggaaccacgguca

SEQ ID NO: 3290899 - RNA, 19 nt, Mycobacterium tuberculosis H37Rv
accgggaaccacggucagc

SEQ ID NO: 3290900 - RNA, 19 nt, Mycobacterium tuberculosis H37Rv
accgggacaaccgcgccga

SEQ ID NO: 3290901 - RNA, 14 nt, Mycobacterium tuberculosis H37Rv
accgggacaaucuc

SEQ ID NO: 3290902 - RNA, 18 nt, Mycobacterium tuberculosis H37Rv
accgggacaccaaaagga

SEQ ID NO: 3290903 - RNA, 18 nt, Mycobacterium tuberculosis H37Rv
accgggacagcagccgga

SEQ ID NO: 3290904 - RNA, 15 nt, Mycobacterium tuberculosis H37Rv
accgggcaaaucaag

SEQ ID NO: 3290905 - RNA, 18 nt, Mycobacterium tuberculosis H37Rv
accgggcaaaucaagcac

SEQ ID NO: 3290906 - RNA, 19 nt, Mycobacterium tuberculosis H37Rv
accgggcaaaucaagcaca

SEQ ID NO: 3290907 - RNA, 21 nt, Mycobacterium tuberculosis H37Rv
accgggcaaaucaagcacagc

SEQ ID NO: 3290908 - RNA, 22 nt, Mycobacterium tuberculosis H37Rv
accgggcaaaucaagcacagcc

SEQ ID NO: 3290909 - RNA, 17 nt, Mycobacterium tuberculosis H37Rv
accgggcaccagucgcc

SEQ ID NO: 3290910 - RNA, 17 nt, Mycobacterium tuberculosis H37Rv
accgggcccgacgacga

SEQ ID NO: 3290911 - RNA, 15 nt, Mycobacterium tuberculosis H37Rv
accgggcggacagga

SEQ ID NO: 3290912 - RNA, 19 nt, Mycobacterium tuberculosis H37Rv
accgggcgggacucggcga

SEQ ID NO: 3290913 - RNA, 17 nt, Mycobacterium tuberculosis H37Rv
accgggcguuucccugc

SEQ ID NO: 3290914 - RNA, 12 nt, Mycobacterium tuberculosis H37Rv
accgggcucugg

SEQ ID NO: 3290915 - RNA, 17 nt, Mycobacterium tuberculosis H37Rv
accggggacgucgacuu

SEQ ID NO: 3290916 - RNA, 20 nt, Mycobacterium tuberculosis H37Rv
accggggcgcccggccaggu

SEQ ID NO: 3290917 - RNA, 13 nt, Mycobacterium tuberculosis H37Rv
accggggcggccg

SEQ ID NO: 3290918 - RNA, 16 nt, Mycobacterium tuberculosis H37Rv
accggguagcucccug

SEQ ID NO: 3290919 - RNA, 18 nt, Mycobacterium tuberculosis H37Rv
accggguccggugaaccc

SEQ ID NO: 3290920 - RNA, 18 nt, Mycobacterium tuberculosis H37Rv
accgggucgggcaccgcg

SEQ ID NO: 3290921 - RNA, 23 nt, Mycobacterium tuberculosis H37Rv
accgggucguagccgaacccgcc

SEQ ID NO: 3290922 - RNA, 14 nt, Mycobacterium tuberculosis H37Rv
accgggugcaggug

SEQ ID NO: 3290923 - RNA, 16 nt, Mycobacterium tuberculosis H37Rv
accgggugggucguuc

SEQ ID NO: 3290924 - RNA, 19 nt, Mycobacterium tuberculosis H37Rv
accgggugugcgucgaggu

SEQ ID NO: 3290925 - RNA, 12 nt, Mycobacterium tuberculosis H37Rv
accgguacccgu

SEQ ID NO: 3290926 - RNA, 13 nt, Mycobacterium tuberculosis H37Rv
accgguaccggcg

SEQ ID NO: 3290927 - RNA, 15 nt, Mycobacterium tuberculosis H37Rv
accgguagucgccgu

SEQ ID NO: 3290928 - RNA, 16 nt, Mycobacterium tuberculosis H37Rv
accgguauagccaagu

SEQ ID NO: 3290929 - RNA, 13 nt, Mycobacterium tuberculosis H37Rv
accggucaacgug

SEQ ID NO: 3290930 - RNA, 13 nt, Mycobacterium tuberculosis H37Rv
accggucacccgu

SEQ ID NO: 3290931 - RNA, 14 nt, Mycobacterium tuberculosis H37Rv
accggucaccgcgc

SEQ ID NO: 3290932 - RNA, 18 nt, Mycobacterium tuberculosis H37Rv
accggucagcgcgcggcu

SEQ ID NO: 3290933 - RNA, 21 nt, Mycobacterium tuberculosis H37Rv
accggucgaccaauuggucga

SEQ ID NO: 3290934 - RNA, 15 nt, Mycobacterium tuberculosis H37Rv
accggucggcagcuu

SEQ ID NO: 3290935 - RNA, 12 nt, Mycobacterium tuberculosis H37Rv
accggucggcca

SEQ ID NO: 3290936 - RNA, 21 nt, Mycobacterium tuberculosis H37Rv
accggucgguguagcaacggu

SEQ ID NO: 3290937 - RNA, 15 nt, Mycobacterium tuberculosis H37Rv
accggugagcaccgg

SEQ ID NO: 3290938 - RNA, 22 nt, Mycobacterium tuberculosis H37Rv
accggugauggugaccagcagg

SEQ ID NO: 3290939 - RNA, 14 nt, Mycobacterium tuberculosis H37Rv
accggugccagcag

SEQ ID NO: 3290940 - RNA, 17 nt, Mycobacterium tuberculosis H37Rv
accggugcccaccaccg

SEQ ID NO: 3290941 - RNA, 14 nt, Mycobacterium tuberculosis H37Rv
accggugccgcccg

SEQ ID NO: 3290942 - RNA, 23 nt, Mycobacterium tuberculosis H37Rv
accggugccgcccgcgccgccgc

SEQ ID NO: 3290943 - RNA, 16 nt, Mycobacterium tuberculosis H37Rv
accggugccugcaacg

SEQ ID NO: 3290944 - RNA, 16 nt, Mycobacterium tuberculosis H37Rv
accggugcgcauccgu

SEQ ID NO: 3290945 - RNA, 17 nt, Mycobacterium tuberculosis H37Rv
accggugcugucgacgu

SEQ ID NO: 3290946 - RNA, 21 nt, Mycobacterium tuberculosis H37Rv
accggugcugucgacgucggc

SEQ ID NO: 3290947 - RNA, 14 nt, Mycobacterium tuberculosis H37Rv
accgguggcagccu

SEQ ID NO: 3290948 - RNA, 16 nt, Mycobacterium tuberculosis H37Rv
accgguggcagccugc

SEQ ID NO: 3290949 - RNA, 21 nt, Mycobacterium tuberculosis H37Rv
accgguggcagccugcugcac

SEQ ID NO: 3290950 - RNA, 22 nt, Mycobacterium tuberculosis H37Rv
accgguggcagccugcugcaca

SEQ ID NO: 3290951 - RNA, 19 nt, Mycobacterium tuberculosis H37Rv
accgguggcgcccuugggc

SEQ ID NO: 3290952 - RNA, 17 nt, Mycobacterium tuberculosis H37Rv
accggugguagcgacga

SEQ ID NO: 3290953 - RNA, 14 nt, Mycobacterium tuberculosis H37Rv
accgguguagcagc

SEQ ID NO: 3290954 - RNA, 19 nt, Mycobacterium tuberculosis H37Rv
accgguguuccgcccagcg

SEQ ID NO: 3290955 - RNA, 17 nt, Mycobacterium tuberculosis H37Rv
accgguucccgggcagc

SEQ ID NO: 3290956 - RNA, 19 nt, Mycobacterium tuberculosis H37Rv
accgguuggguagcaccga

SEQ ID NO: 3290957 - RNA, 22 nt, Mycobacterium tuberculosis H37Rv
accgguuggguagcaccgauuu

SEQ ID NO: 3290958 - RNA, 19 nt, Mycobacterium tuberculosis H37Rv
accgguuuggagcucaucg

SEQ ID NO: 3290959 - RNA, 16 nt, Mycobacterium tuberculosis H37Rv
accgguuuucgccggc

SEQ ID NO: 3290960 - RNA, 19 nt, Mycobacterium tuberculosis H37Rv
accgguuuucgccggcucc

SEQ ID NO: 3290961 - RNA, 22 nt, Mycobacterium tuberculosis H37Rv
accguaauuucuucacggucga

SEQ ID NO: 3290962 - RNA, 23 nt, Mycobacterium tuberculosis H37Rv
accguagccagcaggaacgccgu

SEQ ID NO: 3290963 - RNA, 15 nt, Mycobacterium tuberculosis H37Rv
accguagcccugcuc

SEQ ID NO: 3290964 - RNA, 21 nt, Mycobacterium tuberculosis H37Rv
accguaguaguucagccaggc

SEQ ID NO: 3290965 - RNA, 13 nt, Mycobacterium tuberculosis H37Rv
accguaguccaca

SEQ ID NO: 3290966 - RNA, 17 nt, Mycobacterium tuberculosis H37Rv
accgucaaccugcugca

SEQ ID NO: 3290967 - RNA, 23 nt, Mycobacterium tuberculosis H37Rv
accgucacaagucgacacgccga

SEQ ID NO: 3290968 - RNA, 16 nt, Mycobacterium tuberculosis H37Rv
accgucaccgccggca

SEQ ID NO: 3290969 - RNA, 14 nt, Mycobacterium tuberculosis H37Rv
accgucaccgccgu

SEQ ID NO: 3290970 - RNA, 15 nt, Mycobacterium tuberculosis H37Rv
accgucacgccaccg

SEQ ID NO: 3290971 - RNA, 15 nt, Mycobacterium tuberculosis H37Rv
accgucagcccgacg

SEQ ID NO: 3290972 - RNA, 16 nt, Mycobacterium tuberculosis H37Rv
accgucagcgccgcug

SEQ ID NO: 3290973 - RNA, 19 nt, Mycobacterium tuberculosis H37Rv
accgucagcgccgcugacu

SEQ ID NO: 3290974 - RNA, 14 nt, Mycobacterium tuberculosis H37Rv
accgucagcgcgac

SEQ ID NO: 3290975 - RNA, 15 nt, Mycobacterium tuberculosis H37Rv
accgucagcgcgccg

SEQ ID NO: 3290976 - RNA, 23 nt, Mycobacterium tuberculosis H37Rv
accgucaguucggugugcggcgc

SEQ ID NO: 3290977 - RNA, 23 nt, Mycobacterium tuberculosis H37Rv
accgucaugaaaucgaugaccgc

SEQ ID NO: 3290978 - RNA, 14 nt, Mycobacterium tuberculosis H37Rv
accgucaugccgac

SEQ ID NO: 3290979 - RNA, 16 nt, Mycobacterium tuberculosis H37Rv
accgucaugggcggcu

SEQ ID NO: 3290980 - RNA, 15 nt, Mycobacterium tuberculosis H37Rv
accguccaauuggcg

SEQ ID NO: 3290981 - RNA, 22 nt, Mycobacterium tuberculosis H37Rv
accguccacgacagcagagugg

SEQ ID NO: 3290982 - RNA, 13 nt, Mycobacterium tuberculosis H37Rv
accguccagcaac

SEQ ID NO: 3290983 - RNA, 14 nt, Mycobacterium tuberculosis H37Rv
accguccagcaaca

SEQ ID NO: 3290984 - RNA, 17 nt, Mycobacterium tuberculosis H37Rv
accgucccagcgccgca

SEQ ID NO: 3290985 - RNA, 12 nt, Mycobacterium tuberculosis H37Rv
accguccgucgg

SEQ ID NO: 3290986 - RNA, 22 nt, Mycobacterium tuberculosis H37Rv
accguccucggucacgaucacg

SEQ ID NO: 3290987 - RNA, 20 nt, Mycobacterium tuberculosis H37Rv
accgucgaaaaaucgaucgu

SEQ ID NO: 3290988 - RNA, 22 nt, Mycobacterium tuberculosis H37Rv
accgucgaaccaugguugauga

SEQ ID NO: 3290989 - RNA, 13 nt, Mycobacterium tuberculosis H37Rv
accgucgaagaug

SEQ ID NO: 3290990 - RNA, 17 nt, Mycobacterium tuberculosis H37Rv
accgucgagucgacggc

SEQ ID NO: 3290991 - RNA, 21 nt, Mycobacterium tuberculosis H37Rv
accucggaucgccaggccguc

SEQ ID NO: 3290992 - RNA, 22 nt, Mycobacterium tuberculosis H37Rv
accucggcgacgaugaucucgc

SEQ ID NO: 3290993 - RNA, 23 nt, Mycobacterium tuberculosis H37Rv
accucggcgacgaugucgagcgc

SEQ ID NO: 3290994 - RNA, 14 nt, Mycobacterium tuberculosis H37Rv
accucggcgaucaa

SEQ ID NO: 3290995 - RNA, 20 nt, Mycobacterium tuberculosis H37Rv
accucggcggugucgaccuc

SEQ ID NO: 3290996 - RNA, 16 nt, Mycobacterium tuberculosis H37Rv
accucggcguuggaaa

SEQ ID NO: 3290997 - RNA, 20 nt, Mycobacterium tuberculosis H37Rv
accucggugcggaacaccgc

SEQ ID NO: 3290998 - RNA, 21 nt, Mycobacterium tuberculosis H37Rv
accucguauacccgggcgguc

SEQ ID NO: 3290999 - RNA, 23 nt, Mycobacterium tuberculosis H37Rv
accucgucaaucaccaccgccag

SEQ ID NO: 3291000 - RNA, 14 nt, Mycobacterium tuberculosis H37Rv
accucgucacccgg

SEQ ID NO: 3291001 - RNA, 15 nt, Mycobacterium tuberculosis H37Rv
accucgucacccggu

SEQ ID NO: 3291002 - RNA, 13 nt, Mycobacterium tuberculosis H37Rv
accucgucaccgg

SEQ ID NO: 3291003 - RNA, 14 nt, Mycobacterium tuberculosis H37Rv
accucgucaccggu

SEQ ID NO: 3291004 - RNA, 19 nt, Mycobacterium tuberculosis H37Rv
accucgucgagcgugcgca

SEQ ID NO: 3291005 - RNA, 20 nt, Mycobacterium tuberculosis H37Rv
accucgucggccgacaccgc

SEQ ID NO: 3291006 - RNA, 22 nt, Mycobacterium tuberculosis H37Rv
accucgucggccgacaccgcca

SEQ ID NO: 3291007 - RNA, 23 nt, Mycobacterium tuberculosis H37Rv
accucgucggccgacaccgccac

SEQ ID NO: 3291008 - RNA, 20 nt, Mycobacterium tuberculosis H37Rv
accucgucggcgacggccag

SEQ ID NO: 3291009 - RNA, 21 nt, Mycobacterium tuberculosis H37Rv
accucgucggcuuuggacagg

SEQ ID NO: 3291010 - RNA, 18 nt, Mycobacterium tuberculosis H37Rv
accucgucgucgaaguug

SEQ ID NO: 3291011 - RNA, 13 nt, Mycobacterium tuberculosis H37Rv
accucgugggcca

SEQ ID NO: 3291012 - RNA, 17 nt, Mycobacterium tuberculosis H37Rv
accucguucgucaccac

SEQ ID NO: 3291013 - RNA, 15 nt, Mycobacterium tuberculosis H37Rv
accucguugcugccg

SEQ ID NO: 3291014 - RNA, 22 nt, Mycobacterium tuberculosis H37Rv
accucucgcuugccgaaauccu

SEQ ID NO: 3291015 - RNA, 17 nt, Mycobacterium tuberculosis H37Rv
accucugcugagcugcu

SEQ ID NO: 3291016 - RNA, 13 nt, Mycobacterium tuberculosis H37Rv
accucuggcggcg

SEQ ID NO: 3291017 - RNA, 21 nt, Mycobacterium tuberculosis H37Rv
accucuucgaucuguuccugc

SEQ ID NO: 3291018 - RNA, 21 nt, Mycobacterium tuberculosis H37Rv
accucuugcccuucuucgacc

SEQ ID NO: 3291019 - RNA, 23 nt, Mycobacterium tuberculosis H37Rv
accucuugcccuucuucgaccgc

SEQ ID NO: 3291020 - RNA, 20 nt, Mycobacterium tuberculosis H37Rv
accugaaccggccgcgacga

SEQ ID NO: 3291021 - RNA, 15 nt, Mycobacterium tuberculosis H37Rv
accugaacggcaacg

SEQ ID NO: 3291022 - RNA, 15 nt, Mycobacterium tuberculosis H37Rv
accugaagccgcgcu

SEQ ID NO: 3291023 - RNA, 17 nt, Mycobacterium tuberculosis H37Rv
accugacacgcccgcga

SEQ ID NO: 3291024 - RNA, 15 nt, Mycobacterium tuberculosis H37Rv
accugacgcucgguc

SEQ ID NO: 3291025 - RNA, 22 nt, Mycobacterium tuberculosis H37Rv
accugacgcucggucgccaccg

SEQ ID NO: 3291026 - RNA, 19 nt, Mycobacterium tuberculosis H37Rv
accugacuaccgucaucga

SEQ ID NO: 3291027 - RNA, 18 nt, Mycobacterium tuberculosis H37Rv
accugagcaccaagaccg

SEQ ID NO: 3291028 - RNA, 21 nt, Mycobacterium tuberculosis H37Rv
accugagcaucuccucgccug

SEQ ID NO: 3291029 - RNA, 16 nt, Mycobacterium tuberculosis H37Rv
accugaggcaccucgg

SEQ ID NO: 3291030 - RNA, 15 nt, Mycobacterium tuberculosis H37Rv
accugaguccggcac

SEQ ID NO: 3291031 - RNA, 15 nt, Mycobacterium tuberculosis H37Rv
accugaguugguucg

SEQ ID NO: 3291032 - RNA, 15 nt, Mycobacterium tuberculosis H37Rv
accugcacccaggca

SEQ ID NO: 3291033 - RNA, 13 nt, Mycobacterium tuberculosis H37Rv
accugcaucacaa

SEQ ID NO: 3291034 - RNA, 15 nt, Mycobacterium tuberculosis H37Rv
accugccaccagaca

SEQ ID NO: 3291035 - RNA, 15 nt, Mycobacterium tuberculosis H37Rv
accugccgcagugac

SEQ ID NO: 3291036 - RNA, 15 nt, Mycobacterium tuberculosis H37Rv
accugccgggccacg

SEQ ID NO: 3291037 - RNA, 20 nt, Mycobacterium tuberculosis H37Rv
accugcggcagcggaccgcu

SEQ ID NO: 3291038 - RNA, 19 nt, Mycobacterium tuberculosis H37Rv
accugcuccgcugucaccc

SEQ ID NO: 3291039 - RNA, 20 nt, Mycobacterium tuberculosis H37Rv
accugcucgucggucaccga

SEQ ID NO: 3291040 - RNA, 17 nt, Mycobacterium tuberculosis H37Rv
accugcugagccgucgg

SEQ ID NO: 3291041 - RNA, 21 nt, Mycobacterium tuberculosis H37Rv
accugcugagccgucggcgcc

SEQ ID NO: 3291042 - RNA, 14 nt, Mycobacterium tuberculosis H37Rv
accugcugcacggu

SEQ ID NO: 3291043 - RNA, 15 nt, Mycobacterium tuberculosis H37Rv
accugcuggaagccg

SEQ ID NO: 3291044 - RNA, 19 nt, Mycobacterium tuberculosis H37Rv
accugcuggaagccgucuc

SEQ ID NO: 3291045 - RNA, 13 nt, Mycobacterium tuberculosis H37Rv
accugcuggcgca

SEQ ID NO: 3291046 - RNA, 22 nt, Mycobacterium tuberculosis H37Rv
accuggagcuaugucauagcgc

SEQ ID NO: 3291047 - RNA, 15 nt, Mycobacterium tuberculosis H37Rv
accuggaucagggcu

SEQ ID NO: 3291048 - RNA, 12 nt, Mycobacterium tuberculosis H37Rv
accuggccacgg

SEQ ID NO: 3291049 - RNA, 19 nt, Mycobacterium tuberculosis H37Rv
accuggccugcggcaggug

SEQ ID NO: 3291050 - RNA, 21 nt, Mycobacterium tuberculosis H37Rv
accuggccugcggcaggugcg

SEQ ID NO: 3291051 - RNA, 19 nt, Mycobacterium tuberculosis H37Rv
accuggcgauaaccgacga

SEQ ID NO: 3291052 - RNA, 23 nt, Mycobacterium tuberculosis H37Rv
accuggcgcagcaacucgacguc

SEQ ID NO: 3291053 - RNA, 17 nt, Mycobacterium tuberculosis H37Rv
accuggcgugucgccgc

SEQ ID NO: 3291054 - RNA, 19 nt, Mycobacterium tuberculosis H37Rv
accuggcgugucgccgcca

SEQ ID NO: 3291055 - RNA, 15 nt, Mycobacterium tuberculosis H37Rv
accuggcuaucgcag

SEQ ID NO: 3291056 - RNA, 16 nt, Mycobacterium tuberculosis H37Rv
accuggcucaucgaug

SEQ ID NO: 3291057 - RNA, 22 nt, Mycobacterium tuberculosis H37Rv
accuggcucaucgaugcgauga

SEQ ID NO: 3291058 - RNA, 16 nt, Mycobacterium tuberculosis H37Rv
accugggcgacuaccg

SEQ ID NO: 3291059 - RNA, 20 nt, Mycobacterium tuberculosis H37Rv
accugggcgacuaccggcuc

SEQ ID NO: 3291060 - RNA, 13 nt, Mycobacterium tuberculosis H37Rv
accuggggccacc

SEQ ID NO: 3291061 - RNA, 20 nt, Mycobacterium tuberculosis H37Rv
accugguaugccgcccgcag

SEQ ID NO: 3291062 - RNA, 15 nt, Mycobacterium tuberculosis H37Rv
accuggucggccgca

SEQ ID NO: 3291063 - RNA, 16 nt, Mycobacterium tuberculosis H37Rv
accugguuccagaggc

SEQ ID NO: 3291064 - RNA, 21 nt, Mycobacterium tuberculosis H37Rv
accugguugcugacgacuggg

SEQ ID NO: 3291065 - RNA, 23 nt, Mycobacterium tuberculosis H37Rv
accuguaguucgaugacugaauc

SEQ ID NO: 3291066 - RNA, 17 nt, Mycobacterium tuberculosis H37Rv
accuguugcccuugcgc

SEQ ID NO: 3291067 - RNA, 16 nt, Mycobacterium tuberculosis H37Rv
accuguuuggggcugu

SEQ ID NO: 3291068 - RNA, 23 nt, Mycobacterium tuberculosis H37Rv
accuguuuggggcugugcaggcg

SEQ ID NO: 3291069 - RNA, 21 nt, Mycobacterium tuberculosis H37Rv
accuuagcgcuugccgcugag

SEQ ID NO: 3291070 - RNA, 20 nt, Mycobacterium tuberculosis H37Rv
accuuauggcgaagaccgca

SEQ ID NO: 3291071 - RNA, 14 nt, Mycobacterium tuberculosis H37Rv
accuucccgucgac

SEQ ID NO: 3291072 - RNA, 17 nt, Mycobacterium tuberculosis H37Rv
accuucgacaaguccgc

SEQ ID NO: 3291073 - RNA, 12 nt, Mycobacterium tuberculosis H37Rv
accuucggccga

SEQ ID NO: 3291074 - RNA, 16 nt, Mycobacterium tuberculosis H37Rv
accuucgggacaaagc

SEQ ID NO: 3291075 - RNA, 16 nt, Mycobacterium tuberculosis H37Rv
accuucuuggcgggug

SEQ ID NO: 3291076 - RNA, 16 nt, Mycobacterium tuberculosis H37Rv
accuugaccgggcagg

SEQ ID NO: 3291077 - RNA, 20 nt, Mycobacterium tuberculosis H37Rv
accuugaccgggcagguagc

SEQ ID NO: 3291078 - RNA, 23 nt, Mycobacterium tuberculosis H37Rv
accuugagcacuccgucguaguu

SEQ ID NO: 3291079 - RNA, 14 nt, Mycobacterium tuberculosis H37Rv
accuugaucgagca

SEQ ID NO: 3291080 - RNA, 22 nt, Mycobacterium tuberculosis H37Rv
accuugcgguucggacacacag

SEQ ID NO: 3291081 - RNA, 16 nt, Mycobacterium tuberculosis H37Rv
accuuggcaagcacgc

SEQ ID NO: 3291082 - RNA, 18 nt, Mycobacterium tuberculosis H37Rv
accuuggugcccagcagg

SEQ ID NO: 3291083 - RNA, 18 nt, Mycobacterium tuberculosis H37Rv
accuugguguggggcggc

SEQ ID NO: 3291084 - RNA, 15 nt, Mycobacterium tuberculosis H37Rv
accuuguggacccgc

SEQ ID NO: 3291085 - RNA, 18 nt, Mycobacterium tuberculosis H37Rv
accuuguggacccgccag

SEQ ID NO: 3291086 - RNA, 13 nt, Mycobacterium tuberculosis H37Rv
acgaaaggcgcgu

SEQ ID NO: 3291087 - RNA, 22 nt, Mycobacterium tuberculosis H37Rv
acgauagccgaaaaagaccgac

SEQ ID NO: 3291088 - RNA, 20 nt, Mycobacterium tuberculosis H37Rv
acgauagcggcccgaucacc

SEQ ID NO: 3291089 - RNA, 18 nt, Mycobacterium tuberculosis H37Rv
acgaucaagagguccuug

SEQ ID NO: 3291090 - RNA, 14 nt, Mycobacterium tuberculosis H37Rv
acgaucaagcuggc

SEQ ID NO: 3291091 - RNA, 22 nt, Mycobacterium tuberculosis H37Rv
acgaucaccccgccaugcggcg

SEQ ID NO: 3291092 - RNA, 11 nt, Mycobacterium tuberculosis H37Rv
acgaucacgau

SEQ ID NO: 3291093 - RNA, 17 nt, Mycobacterium tuberculosis H37Rv
acgaucagcgaguagcc

SEQ ID NO: 3291094 - RNA, 19 nt, Mycobacterium tuberculosis H37Rv
acgaucagcgugaucugca

SEQ ID NO: 3291095 - RNA, 16 nt, Mycobacterium tuberculosis H37Rv
acgaucaggucgccga

SEQ ID NO: 3291096 - RNA, 20 nt, Mycobacterium tuberculosis H37Rv
acgaucaucgggguggccac

SEQ ID NO: 3291097 - RNA, 22 nt, Mycobacterium tuberculosis H37Rv
acgaucauugcacccaccccga

SEQ ID NO: 3291098 - RNA, 23 nt, Mycobacterium tuberculosis H37Rv
acgauccagcccaacucggccag

SEQ ID NO: 3291099 - RNA, 13 nt, Mycobacterium tuberculosis H37Rv
acgauccagcugu

SEQ ID NO: 3291100 - RNA, 18 nt, Mycobacterium tuberculosis H37Rv
acgaucccgugauccgcc

SEQ ID NO: 3291101 - RNA, 23 nt, Mycobacterium tuberculosis H37Rv
acgaucgagcccggagcggucag

SEQ ID NO: 3291102 - RNA, 21 nt, Mycobacterium tuberculosis H37Rv
acgaucgaugaccuuugaguc

SEQ ID NO: 3291103 - RNA, 19 nt, Mycobacterium tuberculosis H37Rv
acgaucgccaggccgagcc

SEQ ID NO: 3291104 - RNA, 14 nt, Mycobacterium tuberculosis H37Rv
acgaucugcagcac

SEQ ID NO: 3291105 - RNA, 19 nt, Mycobacterium tuberculosis H37Rv
acgaucugcagcacucggu

SEQ ID NO: 3291106 - RNA, 22 nt, Mycobacterium tuberculosis H37Rv
acgaugacagacaucgcgacga

SEQ ID NO: 3291107 - RNA, 23 nt, Mycobacterium tuberculosis H37Rv
acgaugaccgcgcggcccgccga

SEQ ID NO: 3291108 - RNA, 14 nt, Mycobacterium tuberculosis H37Rv
acgaugacgcgcga

SEQ ID NO: 3291109 - RNA, 15 nt, Mycobacterium tuberculosis H37Rv
acgaugacgcgcgaa

SEQ ID NO: 3291110 - RNA, 14 nt, Mycobacterium tuberculosis H37Rv
acgaugacgucgac

SEQ ID NO: 3291111 - RNA, 21 nt, Mycobacterium tuberculosis H37Rv
acgaugacguugacgucgguc

SEQ ID NO: 3291112 - RNA, 13 nt, Mycobacterium tuberculosis H37Rv
acgaugcccuucu

SEQ ID NO: 3291113 - RNA, 18 nt, Mycobacterium tuberculosis H37Rv
acgaugccucggcggccu

SEQ ID NO: 3291114 - RNA, 14 nt, Mycobacterium tuberculosis H37Rv
acgauggccggguc

SEQ ID NO: 3291115 - RNA, 15 nt, Mycobacterium tuberculosis H37Rv
acgauggcgaugagg

SEQ ID NO: 3291116 - RNA, 16 nt, Mycobacterium tuberculosis H37Rv
acgauggcgaugaggu

SEQ ID NO: 3291117 - RNA, 22 nt, Mycobacterium tuberculosis H37Rv
acgauggcgaugagguggccgc

SEQ ID NO: 3291118 - RNA, 13 nt, Mycobacterium tuberculosis H37Rv
acgauggcggcca

SEQ ID NO: 3291119 - RNA, 15 nt, Mycobacterium tuberculosis H37Rv
acgauggcggccacc

SEQ ID NO: 3291120 - RNA, 17 nt, Mycobacterium tuberculosis H37Rv
acgaugguggcgaucau

SEQ ID NO: 3291121 - RNA, 19 nt, Mycobacterium tuberculosis H37Rv
acgaugguguacugcugcu

SEQ ID NO: 3291122 - RNA, 16 nt, Mycobacterium tuberculosis H37Rv
acgauguccgcgcgaa

SEQ ID NO: 3291123 - RNA, 14 nt, Mycobacterium tuberculosis H37Rv
acgauguccucgau

SEQ ID NO: 3291124 - RNA, 23 nt, Mycobacterium tuberculosis H37Rv
acgaugucggucggaucggcgcc

SEQ ID NO: 3291125 - RNA, 16 nt, Mycobacterium tuberculosis H37Rv
acgaugugccaggugc

SEQ ID NO: 3291126 - RNA, 15 nt, Mycobacterium tuberculosis H37Rv
acgaugugcccgcca

SEQ ID NO: 3291127 - RNA, 13 nt, Mycobacterium tuberculosis H37Rv
acgauucaccaau

SEQ ID NO: 3291128 - RNA, 13 nt, Mycobacterium tuberculosis H37Rv
acgauuucggccc

SEQ ID NO: 3291129 - RNA, 14 nt, Mycobacterium tuberculosis H37Rv
acgauuucggccca

SEQ ID NO: 3291130 - RNA, 17 nt, Mycobacterium tuberculosis H37Rv
acgcaaaaucgcacggu

SEQ ID NO: 3291131 - RNA, 19 nt, Mycobacterium tuberculosis H37Rv
acgcaaaaucgcccaauuc

SEQ ID NO: 3291132 - RNA, 19 nt, Mycobacterium tuberculosis H37Rv
acgcaaaaucgcccauuuc

SEQ ID NO: 3291133 - RNA, 17 nt, Mycobacterium tuberculosis H37Rv
acgcaaaaucgcccgaa

SEQ ID NO: 3291134 - RNA, 14 nt, Mycobacterium tuberculosis H37Rv
acgcaacaccgcca

SEQ ID NO: 3291135 - RNA, 13 nt, Mycobacterium tuberculosis H37Rv
acgcaacaucgga

SEQ ID NO: 3291136 - RNA, 15 nt, Mycobacterium tuberculosis H37Rv
acgcaacggcaccca

SEQ ID NO: 3291137 - RNA, 17 nt, Mycobacterium tuberculosis H37Rv
acgcaauagccaucacg

SEQ ID NO: 3291138 - RNA, 14 nt, Mycobacterium tuberculosis H37Rv
acgcaaucgucgcc

SEQ ID NO: 3291139 - RNA, 18 nt, Mycobacterium tuberculosis H37Rv
acgcacaauacggucagc

SEQ ID NO: 3291140 - RNA, 22 nt, Mycobacterium tuberculosis H37Rv
acgcacaauacggucagcagac

SEQ ID NO: 3291141 - RNA, 21 nt, Mycobacterium tuberculosis H37Rv
acgcacacaccguaccgacga

SEQ ID NO: 3291142 - RNA, 15 nt, Mycobacterium tuberculosis H37Rv
acgcacagcccgaug

SEQ ID NO: 3291143 - RNA, 23 nt, Mycobacterium tuberculosis H37Rv
acgcaccacaaacaccccacaca

SEQ ID NO: 3291144 - RNA, 16 nt, Mycobacterium tuberculosis H37Rv
acgcaccacgagcagc

SEQ ID NO: 3291145 - RNA, 17 nt, Mycobacterium tuberculosis H37Rv
acgcaccgaaacgccga

SEQ ID NO: 3291146 - RNA, 23 nt, Mycobacterium tuberculosis H37Rv
acgcaccuauggucaaccgcgcc

SEQ ID NO: 3291147 - RNA, 20 nt, Mycobacterium tuberculosis H37Rv
acgcacgcaguucggucagc

SEQ ID NO: 3291148 - RNA, 18 nt, Mycobacterium tuberculosis H37Rv
acgcacgcccgccugcag

SEQ ID NO: 3291149 - RNA, 16 nt, Mycobacterium tuberculosis H37Rv
acgcacgcgguucacc

SEQ ID NO: 3291150 - RNA, 17 nt, Mycobacterium tuberculosis H37Rv
acgcacgucgaggcggc

SEQ ID NO: 3291151 - RNA, 22 nt, Mycobacterium tuberculosis H37Rv
acgcacucggggcugucggcga

SEQ ID NO: 3291152 - RNA, 20 nt, Mycobacterium tuberculosis H37Rv
acgcacugccccgcaucgcc

SEQ ID NO: 3291153 - RNA, 16 nt, Mycobacterium tuberculosis H37Rv
acgcagaagcccccaa

SEQ ID NO: 3291154 - RNA, 20 nt, Mycobacterium tuberculosis H37Rv
acgcagaaucgcccaauuuc

SEQ ID NO: 3291155 - RNA, 15 nt, Mycobacterium tuberculosis H37Rv
acgcagaaucgccua

SEQ ID NO: 3291156 - RNA, 15 nt, Mycobacterium tuberculosis H37Rv
acgcagaccguccag

SEQ ID NO: 3291157 - RNA, 17 nt, Mycobacterium tuberculosis H37Rv
acgcagaccguccagca

SEQ ID NO: 3291158 - RNA, 22 nt, Mycobacterium tuberculosis H37Rv
acgcagagccaacaaaucaggg

SEQ ID NO: 3291159 - RNA, 16 nt, Mycobacterium tuberculosis H37Rv
acgcagagucaacaga

SEQ ID NO: 3291160 - RNA, 14 nt, Mycobacterium tuberculosis H37Rv
acgcagcacggcac

SEQ ID NO: 3291161 - RNA, 19 nt, Mycobacterium tuberculosis H37Rv
acgcagcacguucaggugc

SEQ ID NO: 3291162 - RNA, 23 nt, Mycobacterium tuberculosis H37Rv
acgcagccguagcugggcacccc

SEQ ID NO: 3291163 - RNA, 14 nt, Mycobacterium tuberculosis H37Rv
acgcagcgcggcug

SEQ ID NO: 3291164 - RNA, 22 nt, Mycobacterium tuberculosis H37Rv
acgcagcggcaaggucaacggg

SEQ ID NO: 3291165 - RNA, 22 nt, Mycobacterium tuberculosis H37Rv
acgcaggaaaaccccggccacc

SEQ ID NO: 3291166 - RNA, 16 nt, Mycobacterium tuberculosis H37Rv
acgcaggugaacgccg

SEQ ID NO: 3291167 - RNA, 17 nt, Mycobacterium tuberculosis H37Rv
acgcaggugaacgccgg

SEQ ID NO: 3291168 - RNA, 13 nt, Mycobacterium tuberculosis H37Rv
acgcagucgccca

SEQ ID NO: 3291169 - RNA, 20 nt, Mycobacterium tuberculosis H37Rv
acgcagucgcccacuauggc

SEQ ID NO: 3291170 - RNA, 19 nt, Mycobacterium tuberculosis H37Rv
acgcagugcccgaucgcuu

SEQ ID NO: 3291171 - RNA, 16 nt, Mycobacterium tuberculosis H37Rv
acgcaguucggucagc

SEQ ID NO: 3291172 - RNA, 23 nt, Mycobacterium tuberculosis H37Rv
acgcauaagcccccgcacgcacg

SEQ ID NO: 3291173 - RNA, 21 nt, Mycobacterium tuberculosis H37Rv
acgcauaucgcuugaacgcau

SEQ ID NO: 3291174 - RNA, 18 nt, Mycobacterium tuberculosis H37Rv
acgcaugcucgaucgcgu

SEQ ID NO: 3291175 - RNA, 18 nt, Mycobacterium tuberculosis H37Rv
acgccaaaacggucgacc

SEQ ID NO: 3291176 - RNA, 15 nt, Mycobacterium tuberculosis H37Rv
acgccaacgccagcg

SEQ ID NO: 3291177 - RNA, 21 nt, Mycobacterium tuberculosis H37Rv
acgccaacgugacgccggcca

SEQ ID NO: 3291178 - RNA, 20 nt, Mycobacterium tuberculosis H37Rv
acgccaagcucggcccagcg

SEQ ID NO: 3291179 - RNA, 17 nt, Mycobacterium tuberculosis H37Rv
acgccaccaccuccgcg

SEQ ID NO: 3291180 - RNA, 15 nt, Mycobacterium tuberculosis H37Rv
acgccacccagggcc

SEQ ID NO: 3291181 - RNA, 15 nt, Mycobacterium tuberculosis H37Rv
acgccaccggcaauc

SEQ ID NO: 3291182 - RNA, 12 nt, Mycobacterium tuberculosis H37Rv
acgccacgacgu

SEQ ID NO: 3291183 - RNA, 18 nt, Mycobacterium tuberculosis H37Rv
acgccuccggagaauccg

SEQ ID NO: 3291184 - RNA, 16 nt, Mycobacterium tuberculosis H37Rv
acgccucgacacccag

SEQ ID NO: 3291185 - RNA, 18 nt, Mycobacterium tuberculosis H37Rv
acgccucgacagcggcaa

SEQ ID NO: 3291186 - RNA, 13 nt, Mycobacterium tuberculosis H37Rv
acgccucgccauc

SEQ ID NO: 3291187 - RNA, 21 nt, Mycobacterium tuberculosis H37Rv
acgccucgccggccgccagcc

SEQ ID NO: 3291188 - RNA, 22 nt, Mycobacterium tuberculosis H37Rv
acgccucgccggccgccagccg

SEQ ID NO: 3291189 - RNA, 20 nt, Mycobacterium tuberculosis H37Rv
acgccugagccaccaacacc

SEQ ID NO: 3291190 - RNA, 17 nt, Mycobacterium tuberculosis H37Rv
acgccugcucggagagc

SEQ ID NO: 3291191 - RNA, 17 nt, Mycobacterium tuberculosis H37Rv
acgccugggcgacgacg

SEQ ID NO: 3291192 - RNA, 24 nt, Mycobacterium tuberculosis H37Rv
acgccuuccagcccgagcagaaac

SEQ ID NO: 3291193 - RNA, 19 nt, Mycobacterium tuberculosis H37Rv
acgccuugaucggcgaggu

SEQ ID NO: 3291194 - RNA, 14 nt, Mycobacterium tuberculosis H37Rv
acgccuugcacaag

SEQ ID NO: 3291195 - RNA, 16 nt, Mycobacterium tuberculosis H37Rv
acgccuugucggcgug

SEQ ID NO: 3291196 - RNA, 22 nt, Mycobacterium tuberculosis H37Rv
acgccuuguuggcgcccgggcc

SEQ ID NO: 3291197 - RNA, 15 nt, Mycobacterium tuberculosis H37Rv
acgcgaacagcucgu

SEQ ID NO: 3291198 - RNA, 14 nt, Mycobacterium tuberculosis H37Rv
acgcgaacccauac

SEQ ID NO: 3291199 - RNA, 16 nt, Mycobacterium tuberculosis H37Rv
acgcgaaccggccauc

SEQ ID NO: 3291200 - RNA, 16 nt, Mycobacterium tuberculosis H37Rv
acgcgaauaccagacc

SEQ ID NO: 3291201 - RNA, 16 nt, Mycobacterium tuberculosis H37Rv
acgcgacacacgccgc

SEQ ID NO: 3291202 - RNA, 19 nt, Mycobacterium tuberculosis H37Rv
acgcgaccaucucgacguc

SEQ ID NO: 3291203 - RNA, 20 nt, Mycobacterium tuberculosis H37Rv
acgcgaccaucucgacgucg

SEQ ID NO: 3291204 - RNA, 19 nt, Mycobacterium tuberculosis H37Rv
acgcgaccgcgauccccac

SEQ ID NO: 3291205 - RNA, 17 nt, Mycobacterium tuberculosis H37Rv
acgcgacgaagcagacg

SEQ ID NO: 3291206 - RNA, 17 nt, Mycobacterium tuberculosis H37Rv
acgcgacgguguagccc

SEQ ID NO: 3291207 - RNA, 19 nt, Mycobacterium tuberculosis H37Rv
acgcgacgguguagcccau

SEQ ID NO: 3291208 - RNA, 15 nt, Mycobacterium tuberculosis H37Rv
acgcgacucggcggu

SEQ ID NO: 3291209 - RNA, 19 nt, Mycobacterium tuberculosis H37Rv
acgcgagcgcuaucaccgc

SEQ ID NO: 3291210 - RNA, 13 nt, Mycobacterium tuberculosis H37Rv
acgcgaggcgcuc

SEQ ID NO: 3291211 - RNA, 17 nt, Mycobacterium tuberculosis H37Rv
acgcgagugcgugaucu

SEQ ID NO: 3291212 - RNA, 20 nt, Mycobacterium tuberculosis H37Rv
acgcgaucaccucgccacac

SEQ ID NO: 3291213 - RNA, 14 nt, Mycobacterium tuberculosis H37Rv
acgcgaucaggcgc

SEQ ID NO: 3291214 - RNA, 14 nt, Mycobacterium tuberculosis H37Rv
acgcgaugaccgca

SEQ ID NO: 3291215 - RNA, 20 nt, Mycobacterium tuberculosis H37Rv
acgcgaugaccgcaccgacc

SEQ ID NO: 3291216 - RNA, 20 nt, Mycobacterium tuberculosis H37Rv
acgcgauggccaucaucgac

SEQ ID NO: 3291217 - RNA, 20 nt, Mycobacterium tuberculosis H37Rv
acgcgcaacucgccacgguc

SEQ ID NO: 3291218 - RNA, 18 nt, Mycobacterium tuberculosis H37Rv
acgcgcacucgaccagga

SEQ ID NO: 3291219 - RNA, 18 nt, Mycobacterium tuberculosis H37Rv
acgcgcagcaucggcgac

SEQ ID NO: 3291220 - RNA, 14 nt, Mycobacterium tuberculosis H37Rv
acgcgcaggccgac

SEQ ID NO: 3291221 - RNA, 23 nt, Mycobacterium tuberculosis H37Rv
acgcgccccaguucgacggcguc

SEQ ID NO: 3291222 - RNA, 14 nt, Mycobacterium tuberculosis H37Rv
acgcgcccgcacca

SEQ ID NO: 3291223 - RNA, 17 nt, Mycobacterium tuberculosis H37Rv
acgcgcccgcaccaccg

SEQ ID NO: 3291224 - RNA, 23 nt, Mycobacterium tuberculosis H37Rv
acgcgcgcguggucgccccgaug

SEQ ID NO: 3291225 - RNA, 12 nt, Mycobacterium tuberculosis H37Rv
acgcgcgcucgc

SEQ ID NO: 3291226 - RNA, 17 nt, Mycobacterium tuberculosis H37Rv
acgcgcggaucggcggc

SEQ ID NO: 3291227 - RNA, 16 nt, Mycobacterium tuberculosis H37Rv
acgcgcugacccgcca

SEQ ID NO: 3291228 - RNA, 17 nt, Mycobacterium tuberculosis H37Rv
acgcggaaaccaucgcc

SEQ ID NO: 3291229 - RNA, 21 nt, Mycobacterium tuberculosis H37Rv
acgcggaaaccaucgccagcc

SEQ ID NO: 3291230 - RNA, 18 nt, Mycobacterium tuberculosis H37Rv
acgcggaaaggcuuccgc

SEQ ID NO: 3291231 - RNA, 17 nt, Mycobacterium tuberculosis H37Rv
acgcggaguccgucgac

SEQ ID NO: 3291232 - RNA, 22 nt, Mycobacterium tuberculosis H37Rv
acgcggaguccgucgacaccgc

SEQ ID NO: 3291233 - RNA, 16 nt, Mycobacterium tuberculosis H37Rv
acgcggaucgggcacc

SEQ ID NO: 3291234 - RNA, 21 nt, Mycobacterium tuberculosis H37Rv
acgcggaucgggcaccccgac

SEQ ID NO: 3291235 - RNA, 12 nt, Mycobacterium tuberculosis H37Rv
acgcggccaacg

SEQ ID NO: 3291236 - RNA, 14 nt, Mycobacterium tuberculosis H37Rv
acgcggccaauggc

SEQ ID NO: 3291237 - RNA, 18 nt, Mycobacterium tuberculosis H37Rv
acgcggccaccgaccgca

SEQ ID NO: 3291238 - RNA, 16 nt, Mycobacterium tuberculosis H37Rv
acgcggccagcggcaa

SEQ ID NO: 3291239 - RNA, 17 nt, Mycobacterium tuberculosis H37Rv
acgcggccgaggucacc

SEQ ID NO: 3291240 - RNA, 20 nt, Mycobacterium tuberculosis H37Rv
acgcggccgaggucacccgg

SEQ ID NO: 3291241 - RNA, 20 nt, Mycobacterium tuberculosis H37Rv
acgcggccgggcguccucgu

SEQ ID NO: 3291242 - RNA, 21 nt, Mycobacterium tuberculosis H37Rv
acgcggccuugcgcacaggcg

SEQ ID NO: 3291243 - RNA, 12 nt, Mycobacterium tuberculosis H37Rv
acgcggcggccu

SEQ ID NO: 3291244 - RNA, 20 nt, Mycobacterium tuberculosis H37Rv
acgcggcugcgucgucugca

SEQ ID NO: 3291245 - RNA, 16 nt, Mycobacterium tuberculosis H37Rv
acgcggcuuugacgcc

SEQ ID NO: 3291246 - RNA, 15 nt, Mycobacterium tuberculosis H37Rv
acgcggcuuugccgg

SEQ ID NO: 3291247 - RNA, 18 nt, Mycobacterium tuberculosis H37Rv
acgcgggagucaucgcgg

SEQ ID NO: 3291248 - RNA, 20 nt, Mycobacterium tuberculosis H37Rv
acgcgggcuaucgguucagc

SEQ ID NO: 3291249 - RNA, 22 nt, Mycobacterium tuberculosis H37Rv
acgcggggaugucgaccgcgag

SEQ ID NO: 3291250 - RNA, 21 nt, Mycobacterium tuberculosis H37Rv
acgcggggcucaaccccgucc

SEQ ID NO: 3291251 - RNA, 18 nt, Mycobacterium tuberculosis H37Rv
acgcgggugccgacgucg

SEQ ID NO: 3291252 - RNA, 16 nt, Mycobacterium tuberculosis H37Rv
acgcggguugcgcggc

SEQ ID NO: 3291253 - RNA, 23 nt, Mycobacterium tuberculosis H37Rv
acgcggguugcgcggcuugggca

SEQ ID NO: 3291254 - RNA, 20 nt, Mycobacterium tuberculosis H37Rv
acgcggucccacucgucguc

SEQ ID NO: 3291255 - RNA, 16 nt, Mycobacterium tuberculosis H37Rv
acgcgguccucgagcc

SEQ ID NO: 3291256 - RNA, 18 nt, Mycobacterium tuberculosis H37Rv
acgcgguccucgagccga

SEQ ID NO: 3291257 - RNA, 19 nt, Mycobacterium tuberculosis H37Rv
acgcgguccucgagccgau

SEQ ID NO: 3291258 - RNA, 13 nt, Mycobacterium tuberculosis H37Rv
acgcggucugcuc

SEQ ID NO: 3291259 - RNA, 19 nt, Mycobacterium tuberculosis H37Rv
acgcggucugcuccaggcg

SEQ ID NO: 3291260 - RNA, 22 nt, Mycobacterium tuberculosis H37Rv
acgcggugccgggaucgccguc

SEQ ID NO: 3291261 - RNA, 16 nt, Mycobacterium tuberculosis H37Rv
acgcgguuuugugcgg

SEQ ID NO: 3291262 - RNA, 15 nt, Mycobacterium tuberculosis H37Rv
acgcguagcacggcg

SEQ ID NO: 3291263 - RNA, 19 nt, Mycobacterium tuberculosis H37Rv
acgcguagcucgcggggcg

SEQ ID NO: 3291264 - RNA, 21 nt, Mycobacterium tuberculosis H37Rv
acgcguauucggcaucgccga

SEQ ID NO: 3291265 - RNA, 16 nt, Mycobacterium tuberculosis H37Rv
acgcgucccgccgcac

SEQ ID NO: 3291266 - RNA, 13 nt, Mycobacterium tuberculosis H37Rv
acgcgucggucga

SEQ ID NO: 3291267 - RNA, 18 nt, Mycobacterium tuberculosis H37Rv
acgcgucguggucggcga

SEQ ID NO: 3291268 - RNA, 19 nt, Mycobacterium tuberculosis H37Rv
acgcgucguggucggcgac

SEQ ID NO: 3291269 - RNA, 18 nt, Mycobacterium tuberculosis H37Rv
acgcguggcauccagcag

SEQ ID NO: 3291270 - RNA, 20 nt, Mycobacterium tuberculosis H37Rv
acgcguggcauccagcagcg

SEQ ID NO: 3291271 - RNA, 16 nt, Mycobacterium tuberculosis H37Rv
acgcguuccauggccc

SEQ ID NO: 3291272 - RNA, 20 nt, Mycobacterium tuberculosis H37Rv
acgcguugcacagcagcggu

SEQ ID NO: 3291273 - RNA, 13 nt, Mycobacterium tuberculosis H37Rv
acgcuaaagcccc

SEQ ID NO: 3291274 - RNA, 16 nt, Mycobacterium tuberculosis H37Rv
acgcuaaauuuugcgc

SEQ ID NO: 3291275 - RNA, 13 nt, Mycobacterium tuberculosis H37Rv
acgcuagccgaca

SEQ ID NO: 3291276 - RNA, 19 nt, Mycobacterium tuberculosis H37Rv
acgcuaggcgauccagacg

SEQ ID NO: 3291277 - RNA, 17 nt, Mycobacterium tuberculosis H37Rv
acgcuccagcucggcca

SEQ ID NO: 3291278 - RNA, 21 nt, Mycobacterium tuberculosis H37Rv
acgcuccaggccuaguccggc

SEQ ID NO: 3291279 - RNA, 21 nt, Mycobacterium tuberculosis H37Rv
acggccagcaggaugaugacc

SEQ ID NO: 3291280 - RNA, 12 nt, Mycobacterium tuberculosis H37Rv
acggccagccca

SEQ ID NO: 3291281 - RNA, 16 nt, Mycobacterium tuberculosis H37Rv
acggccaggucgacgg

SEQ ID NO: 3291282 - RNA, 19 nt, Mycobacterium tuberculosis H37Rv
acggccagugcgcagaaca

SEQ ID NO: 3291283 - RNA, 16 nt, Mycobacterium tuberculosis H37Rv
acggccaucgccagcc

SEQ ID NO: 3291284 - RNA, 13 nt, Mycobacterium tuberculosis H37Rv
acggccaucgugc

SEQ ID NO: 3291285 - RNA, 19 nt, Mycobacterium tuberculosis H37Rv
acggccaugaucacaccgc

SEQ ID NO: 3291286 - RNA, 24 nt, Mycobacterium tuberculosis H37Rv
acggcccgaucccgaucgaucagc

SEQ ID NO: 3291287 - RNA, 22 nt, Mycobacterium tuberculosis H37Rv
acggcccgcaucgucgccgacc

SEQ ID NO: 3291288 - RNA, 16 nt, Mycobacterium tuberculosis H37Rv
acggcccgccguccgg

SEQ ID NO: 3291289 - RNA, 13 nt, Mycobacterium tuberculosis H37Rv
acggcccggcacc

SEQ ID NO: 3291290 - RNA, 23 nt, Mycobacterium tuberculosis H37Rv
acggccgacaacccggccgggcc

SEQ ID NO: 3291291 - RNA, 19 nt, Mycobacterium tuberculosis H37Rv
acggccgcauaaaacucgc

SEQ ID NO: 3291292 - RNA, 12 nt, Mycobacterium tuberculosis H37Rv
acggccgccgac

SEQ ID NO: 3291293 - RNA, 18 nt, Mycobacterium tuberculosis H37Rv
acggccggccgcugccac

SEQ ID NO: 3291294 - RNA, 17 nt, Mycobacterium tuberculosis H37Rv
acggccgggacggcgau

SEQ ID NO: 3291295 - RNA, 14 nt, Mycobacterium tuberculosis H37Rv
acggccgucgacga

SEQ ID NO: 3291296 - RNA, 16 nt, Mycobacterium tuberculosis H37Rv
acggccuccaucgcga

SEQ ID NO: 3291297 - RNA, 15 nt, Mycobacterium tuberculosis H37Rv
acggccucgucgaug

SEQ ID NO: 3291298 - RNA, 16 nt, Mycobacterium tuberculosis H37Rv
acggccucgucgaugu

SEQ ID NO: 3291299 - RNA, 15 nt, Mycobacterium tuberculosis H37Rv
acggccuucagcggu

SEQ ID NO: 3291300 - RNA, 18 nt, Mycobacterium tuberculosis H37Rv
acggcgaaccggcccacc

SEQ ID NO: 3291301 - RNA, 15 nt, Mycobacterium tuberculosis H37Rv
acggcgaagucgagu

SEQ ID NO: 3291302 - RNA, 18 nt, Mycobacterium tuberculosis H37Rv
acggcgacacgccagccg

SEQ ID NO: 3291303 - RNA, 15 nt, Mycobacterium tuberculosis H37Rv
acggcgaccacgccg

SEQ ID NO: 3291304 - RNA, 15 nt, Mycobacterium tuberculosis H37Rv
acggcgaccaggagc

SEQ ID NO: 3291305 - RNA, 17 nt, Mycobacterium tuberculosis H37Rv
acggcgaccaggagccu

SEQ ID NO: 3291306 - RNA, 20 nt, Mycobacterium tuberculosis H37Rv
acggcgacgaucucggcggc

SEQ ID NO: 3291307 - RNA, 22 nt, Mycobacterium tuberculosis H37Rv
acggcgacgaucucggcggccg

SEQ ID NO: 3291308 - RNA, 16 nt, Mycobacterium tuberculosis H37Rv
acggcgacucgaggac

SEQ ID NO: 3291309 - RNA, 20 nt, Mycobacterium tuberculosis H37Rv
acggcgagaaaaugacccac

SEQ ID NO: 3291310 - RNA, 22 nt, Mycobacterium tuberculosis H37Rv
acggcgagaaaaugacccacac

SEQ ID NO: 3291311 - RNA, 13 nt, Mycobacterium tuberculosis H37Rv
acggcgaggccga

SEQ ID NO: 3291312 - RNA, 14 nt, Mycobacterium tuberculosis H37Rv
acggcgaguaggcg

SEQ ID NO: 3291313 - RNA, 17 nt, Mycobacterium tuberculosis H37Rv
acggcgaguaggcgugg

SEQ ID NO: 3291314 - RNA, 12 nt, Mycobacterium tuberculosis H37Rv
acggcgaucacc

SEQ ID NO: 3291315 - RNA, 15 nt, Mycobacterium tuberculosis H37Rv
acggcgaucaccgag

SEQ ID NO: 3291316 - RNA, 20 nt, Mycobacterium tuberculosis H37Rv
acggcgcaacaccucguaug

SEQ ID NO: 3291317 - RNA, 21 nt, Mycobacterium tuberculosis H37Rv
acggcgcaugcguaugcccac

SEQ ID NO: 3291318 - RNA, 16 nt, Mycobacterium tuberculosis H37Rv
acggcgccaccaccgg

SEQ ID NO: 3291319 - RNA, 21 nt, Mycobacterium tuberculosis H37Rv
acggcgccaggcaccacgacc

SEQ ID NO: 3291320 - RNA, 18 nt, Mycobacterium tuberculosis H37Rv
acggcgcccauagcaccu

SEQ ID NO: 3291321 - RNA, 12 nt, Mycobacterium tuberculosis H37Rv
acggcgccgaac

SEQ ID NO: 3291322 - RNA, 13 nt, Mycobacterium tuberculosis H37Rv
acggcgccgaacc

SEQ ID NO: 3291323 - RNA, 14 nt, Mycobacterium tuberculosis H37Rv
acggcgccgaaccc

SEQ ID NO: 3291324 - RNA, 16 nt, Mycobacterium tuberculosis H37Rv
acggcgccgaacccgg

SEQ ID NO: 3291325 - RNA, 23 nt, Mycobacterium tuberculosis H37Rv
acggcgccgaacccgguguugag

SEQ ID NO: 3291326 - RNA, 19 nt, Mycobacterium tuberculosis H37Rv
acggcgccgccacggaucg

SEQ ID NO: 3291327 - RNA, 13 nt, Mycobacterium tuberculosis H37Rv
acggcgccgcuca

SEQ ID NO: 3291328 - RNA, 21 nt, Mycobacterium tuberculosis H37Rv
acggcgccggcaucggucagc

SEQ ID NO: 3291329 - RNA, 12 nt, Mycobacterium tuberculosis H37Rv
acggcgcgagcc

SEQ ID NO: 3291330 - RNA, 14 nt, Mycobacterium tuberculosis H37Rv
acggcgcgccgacc

SEQ ID NO: 3291331 - RNA, 13 nt, Mycobacterium tuberculosis H37Rv
acggcgcgggcca

SEQ ID NO: 3291332 - RNA, 18 nt, Mycobacterium tuberculosis H37Rv
acggcgcgggccaccacg

SEQ ID NO: 3291333 - RNA, 17 nt, Mycobacterium tuberculosis H37Rv
acggcgcucggcgagcu

SEQ ID NO: 3291334 - RNA, 14 nt, Mycobacterium tuberculosis H37Rv
acggcgcugacgaa

SEQ ID NO: 3291335 - RNA, 15 nt, Mycobacterium tuberculosis H37Rv
acggcggcagcggcg

SEQ ID NO: 3291336 - RNA, 20 nt, Mycobacterium tuberculosis H37Rv
acggcggcagucgcgguacc

SEQ ID NO: 3291337 - RNA, 18 nt, Mycobacterium tuberculosis H37Rv
acggcggcaucaccuggc

SEQ ID NO: 3291338 - RNA, 14 nt, Mycobacterium tuberculosis H37Rv
acggcggcaucggg

SEQ ID NO: 3291339 - RNA, 11 nt, Mycobacterium tuberculosis H37Rv
acggcggccag

SEQ ID NO: 3291340 - RNA, 13 nt, Mycobacterium tuberculosis H37Rv
acggcggccagga

SEQ ID NO: 3291341 - RNA, 17 nt, Mycobacterium tuberculosis H37Rv
acggcggccaggaccaa

SEQ ID NO: 3291342 - RNA, 22 nt, Mycobacterium tuberculosis H37Rv
acggcggcccacgcgcacucga

SEQ ID NO: 3291343 - RNA, 17 nt, Mycobacterium tuberculosis H37Rv
acggcggccccggcauu

SEQ ID NO: 3291344 - RNA, 23 nt, Mycobacterium tuberculosis H37Rv
acggcggccccggcauugcccga

SEQ ID NO: 3291345 - RNA, 14 nt, Mycobacterium tuberculosis H37Rv
acggcggccgccac

SEQ ID NO: 3291346 - RNA, 17 nt, Mycobacterium tuberculosis H37Rv
acggcggccuucggccg

SEQ ID NO: 3291347 - RNA, 16 nt, Mycobacterium tuberculosis H37Rv
acggcggcgucgauga

SEQ ID NO: 3291348 - RNA, 19 nt, Mycobacterium tuberculosis H37Rv
acggcgggaacggugccga

SEQ ID NO: 3291349 - RNA, 21 nt, Mycobacterium tuberculosis H37Rv
acggcgggccgcgcggcgaca

SEQ ID NO: 3291350 - RNA, 22 nt, Mycobacterium tuberculosis H37Rv
acggcgggccgcgcggcgacag

SEQ ID NO: 3291351 - RNA, 20 nt, Mycobacterium tuberculosis H37Rv
acggcgggcgauuucggcgc

SEQ ID NO: 3291352 - RNA, 21 nt, Mycobacterium tuberculosis H37Rv
acggcgggcgauuucggcgcc

SEQ ID NO: 3291353 - RNA, 18 nt, Mycobacterium tuberculosis H37Rv
acggcggggccggcggcu

SEQ ID NO: 3291354 - RNA, 18 nt, Mycobacterium tuberculosis H37Rv
acggcggggcggcggugg

SEQ ID NO: 3291355 - RNA, 14 nt, Mycobacterium tuberculosis H37Rv
acggcgucacccgc

SEQ ID NO: 3291356 - RNA, 20 nt, Mycobacterium tuberculosis H37Rv
acggcgucgaccucgcgggc

SEQ ID NO: 3291357 - RNA, 22 nt, Mycobacterium tuberculosis H37Rv
acggcgucgggccguugugcgg

SEQ ID NO: 3291358 - RNA, 21 nt, Mycobacterium tuberculosis H37Rv
acggcgugaaguggucguaga

SEQ ID NO: 3291359 - RNA, 19 nt, Mycobacterium tuberculosis H37Rv
acggcgugaccacugaacc

SEQ ID NO: 3291360 - RNA, 16 nt, Mycobacterium tuberculosis H37Rv
acggcguggucggcaa

SEQ ID NO: 3291361 - RNA, 19 nt, Mycobacterium tuberculosis H37Rv
acggcguggucggcaaagc

SEQ ID NO: 3291362 - RNA, 16 nt, Mycobacterium tuberculosis H37Rv
acggcgugucggggua

SEQ ID NO: 3291363 - RNA, 18 nt, Mycobacterium tuberculosis H37Rv
acggcguuacguggugga

SEQ ID NO: 3291364 - RNA, 17 nt, Mycobacterium tuberculosis H37Rv
acggcguugagcaggug

SEQ ID NO: 3291365 - RNA, 17 nt, Mycobacterium tuberculosis H37Rv
acggcguugaucagugc

SEQ ID NO: 3291366 - RNA, 16 nt, Mycobacterium tuberculosis H37Rv
acggcguugccggaga

SEQ ID NO: 3291367 - RNA, 14 nt, Mycobacterium tuberculosis H37Rv
acggcuccuccggu

SEQ ID NO: 3291368 - RNA, 17 nt, Mycobacterium tuberculosis H37Rv
acggcuccuccgguauc

SEQ ID NO: 3291369 - RNA, 12 nt, Mycobacterium tuberculosis H37Rv
acggcucggcgc

SEQ ID NO: 3291370 - RNA, 20 nt, Mycobacterium tuberculosis H37Rv
acggcucgggaacuucgccg

SEQ ID NO: 3291371 - RNA, 22 nt, Mycobacterium tuberculosis H37Rv
acggcucuaccgguccgucacc

SEQ ID NO: 3291372 - RNA, 21 nt, Mycobacterium tuberculosis H37Rv
acggcugaccggggucggccu

SEQ ID NO: 3291373 - RNA, 23 nt, Mycobacterium tuberculosis H37Rv
acggcugaccuucucacgcacca

SEQ ID NO: 3291374 - RNA, 14 nt, Mycobacterium tuberculosis H37Rv
acggcugccacgcg

SEQ ID NO: 3291375 - RNA, 20 nt, Mycobacterium tuberculosis H37Rv
acgguguauugggguggcag

SEQ ID NO: 3291376 - RNA, 22 nt, Mycobacterium tuberculosis H37Rv
acggugucaaaaccguugucgu

SEQ ID NO: 3291377 - RNA, 20 nt, Mycobacterium tuberculosis H37Rv
acggugucgcgaugcuuccc

SEQ ID NO: 3291378 - RNA, 13 nt, Mycobacterium tuberculosis H37Rv
acggugucgucga

SEQ ID NO: 3291379 - RNA, 15 nt, Mycobacterium tuberculosis H37Rv
acggugucucgccca

SEQ ID NO: 3291380 - RNA, 23 nt, Mycobacterium tuberculosis H37Rv
acggugucuugccaccacgcaug

SEQ ID NO: 3291381 - RNA, 13 nt, Mycobacterium tuberculosis H37Rv
acggugugcggca

SEQ ID NO: 3291382 - RNA, 11 nt, Mycobacterium tuberculosis H37Rv
acgguguuggu

SEQ ID NO: 3291383 - RNA, 14 nt, Mycobacterium tuberculosis H37Rv
acgguugagauggu

SEQ ID NO: 3291384 - RNA, 17 nt, Mycobacterium tuberculosis H37Rv
acgguugccccggcgac

SEQ ID NO: 3291385 - RNA, 15 nt, Mycobacterium tuberculosis H37Rv
acgguugccgcgauc

SEQ ID NO: 3291386 - RNA, 16 nt, Mycobacterium tuberculosis H37Rv
acgguugccgcgaucg

SEQ ID NO: 3291387 - RNA, 13 nt, Mycobacterium tuberculosis H37Rv
acgguugccggcg

SEQ ID NO: 3291388 - RNA, 18 nt, Mycobacterium tuberculosis H37Rv
acgguuggaugccugccu

SEQ ID NO: 3291389 - RNA, 12 nt, Mycobacterium tuberculosis H37Rv
acguaacccagu

SEQ ID NO: 3291390 - RNA, 20 nt, Mycobacterium tuberculosis H37Rv
acguaacgccgcucauccag

SEQ ID NO: 3291391 - RNA, 17 nt, Mycobacterium tuberculosis H37Rv
acguaccgucauggcga

SEQ ID NO: 3291392 - RNA, 15 nt, Mycobacterium tuberculosis H37Rv
acguacuuggacgac

SEQ ID NO: 3291393 - RNA, 17 nt, Mycobacterium tuberculosis H37Rv
acguagaaguaggcggc

SEQ ID NO: 3291394 - RNA, 20 nt, Mycobacterium tuberculosis H37Rv
acguagacgacgucggccgc

SEQ ID NO: 3291395 - RNA, 14 nt, Mycobacterium tuberculosis H37Rv
acguagcagcagac

SEQ ID NO: 3291396 - RNA, 23 nt, Mycobacterium tuberculosis H37Rv
acguagccguacgguccgaacac

SEQ ID NO: 3291397 - RNA, 15 nt, Mycobacterium tuberculosis H37Rv
acguaggacugccag

SEQ ID NO: 3291398 - RNA, 14 nt, Mycobacterium tuberculosis H37Rv
acguagucgccgau

SEQ ID NO: 3291399 - RNA, 19 nt, Mycobacterium tuberculosis H37Rv
acguauccacggucgacca

SEQ ID NO: 3291400 - RNA, 16 nt, Mycobacterium tuberculosis H37Rv
acguauuucgcccccu

SEQ ID NO: 3291401 - RNA, 16 nt, Mycobacterium tuberculosis H37Rv
acgucaaacgcaaaga

SEQ ID NO: 3291402 - RNA, 16 nt, Mycobacterium tuberculosis H37Rv
acgucaagaagaacuc

SEQ ID NO: 3291403 - RNA, 11 nt, Mycobacterium tuberculosis H37Rv
acgucaccggg

SEQ ID NO: 3291404 - RNA, 12 nt, Mycobacterium tuberculosis H37Rv
acgucacgucga

SEQ ID NO: 3291405 - RNA, 20 nt, Mycobacterium tuberculosis H37Rv
acgucacguggucggccacc

SEQ ID NO: 3291406 - RNA, 13 nt, Mycobacterium tuberculosis H37Rv
acgucagugcccc

SEQ ID NO: 3291407 - RNA, 14 nt, Mycobacterium tuberculosis H37Rv
acgucagugccccg

SEQ ID NO: 3291408 - RNA, 15 nt, Mycobacterium tuberculosis H37Rv
acgucauaucucgag

SEQ ID NO: 3291409 - RNA, 18 nt, Mycobacterium tuberculosis H37Rv
acgucaucuggcgcugcu

SEQ ID NO: 3291410 - RNA, 14 nt, Mycobacterium tuberculosis H37Rv
acguccaacagcgc

SEQ ID NO: 3291411 - RNA, 15 nt, Mycobacterium tuberculosis H37Rv
acguccagggccacg

SEQ ID NO: 3291412 - RNA, 24 nt, Mycobacterium tuberculosis H37Rv
acguccaguccaugugcccagguc

SEQ ID NO: 3291413 - RNA, 18 nt, Mycobacterium tuberculosis H37Rv
acguccaguggcagccag

SEQ ID NO: 3291414 - RNA, 20 nt, Mycobacterium tuberculosis H37Rv
acguccaucaccggcggccc

SEQ ID NO: 3291415 - RNA, 22 nt, Mycobacterium tuberculosis H37Rv
acguccaucaccggcggcccca

SEQ ID NO: 3291416 - RNA, 18 nt, Mycobacterium tuberculosis H37Rv
acgucgaacuucagcggc

SEQ ID NO: 3291417 - RNA, 20 nt, Mycobacterium tuberculosis H37Rv
acgucgacaccgaggaccuc

SEQ ID NO: 3291418 - RNA, 19 nt, Mycobacterium tuberculosis H37Rv
acgucgaccgaacccgacg

SEQ ID NO: 3291419 - RNA, 22 nt, Mycobacterium tuberculosis H37Rv
acgucgaccgugucaccgccgg

SEQ ID NO: 3291420 - RNA, 17 nt, Mycobacterium tuberculosis H37Rv
acgucgaccucggcaac

SEQ ID NO: 3291421 - RNA, 22 nt, Mycobacterium tuberculosis H37Rv
acgucgacggcgauggcgcgca

SEQ ID NO: 3291422 - RNA, 19 nt, Mycobacterium tuberculosis H37Rv
acgucgacuucagcggccg

SEQ ID NO: 3291423 - RNA, 16 nt, Mycobacterium tuberculosis H37Rv
acgucgacuucgcccg

SEQ ID NO: 3291424 - RNA, 20 nt, Mycobacterium tuberculosis H37Rv
acgucgagauccucgucgag

SEQ ID NO: 3291425 - RNA, 16 nt, Mycobacterium tuberculosis H37Rv
acgucgagcagcgcca

SEQ ID NO: 3291426 - RNA, 13 nt, Mycobacterium tuberculosis H37Rv
acgucgaucaaca

SEQ ID NO: 3291427 - RNA, 13 nt, Mycobacterium tuberculosis H37Rv
acgucgccaagac

SEQ ID NO: 3291428 - RNA, 13 nt, Mycobacterium tuberculosis H37Rv
acgucgccagguc

SEQ ID NO: 3291429 - RNA, 18 nt, Mycobacterium tuberculosis H37Rv
acgucgccgacgguuacc

SEQ ID NO: 3291430 - RNA, 21 nt, Mycobacterium tuberculosis H37Rv
acgucgcgccaggcgcgaucg

SEQ ID NO: 3291431 - RNA, 14 nt, Mycobacterium tuberculosis H37Rv
acgucggccagugc

SEQ ID NO: 3291432 - RNA, 14 nt, Mycobacterium tuberculosis H37Rv
acgucggcgaccag

SEQ ID NO: 3291433 - RNA, 16 nt, Mycobacterium tuberculosis H37Rv
acgucggcggccguca

SEQ ID NO: 3291434 - RNA, 22 nt, Mycobacterium tuberculosis H37Rv
acgucggcguggucgcgcggca

SEQ ID NO: 3291435 - RNA, 21 nt, Mycobacterium tuberculosis H37Rv
acgucgguaaacguugggaaa

SEQ ID NO: 3291436 - RNA, 20 nt, Mycobacterium tuberculosis H37Rv
acgucgguaagcgccaaggc

SEQ ID NO: 3291437 - RNA, 17 nt, Mycobacterium tuberculosis H37Rv
acgucggugaccucggc

SEQ ID NO: 3291438 - RNA, 17 nt, Mycobacterium tuberculosis H37Rv
acgucguagaccuccag

SEQ ID NO: 3291439 - RNA, 23 nt, Mycobacterium tuberculosis H37Rv
acgucguuggcucgugcccgacc

SEQ ID NO: 3291440 - RNA, 23 nt, Mycobacterium tuberculosis H37Rv
acgucguuuggccucagcccggc

SEQ ID NO: 3291441 - RNA, 17 nt, Mycobacterium tuberculosis H37Rv
acgucuccaccgcgaug

SEQ ID NO: 3291442 - RNA, 15 nt, Mycobacterium tuberculosis H37Rv
acgucugccaggcgc

SEQ ID NO: 3291443 - RNA, 20 nt, Mycobacterium tuberculosis H37Rv
acgucugcccaguguccggc

SEQ ID NO: 3291444 - RNA, 15 nt, Mycobacterium tuberculosis H37Rv
acgucuggguugcgu

SEQ ID NO: 3291445 - RNA, 18 nt, Mycobacterium tuberculosis H37Rv
acgucuucacucacgacg

SEQ ID NO: 3291446 - RNA, 22 nt, Mycobacterium tuberculosis H37Rv
acgucuucgaccucacccaccc

SEQ ID NO: 3291447 - RNA, 19 nt, Mycobacterium tuberculosis H37Rv
acgucuugcuggucgaugg

SEQ ID NO: 3291448 - RNA, 18 nt, Mycobacterium tuberculosis H37Rv
acgugaauuaaggugacc

SEQ ID NO: 3291449 - RNA, 18 nt, Mycobacterium tuberculosis H37Rv
acgugacgguccacgacg

SEQ ID NO: 3291450 - RNA, 17 nt, Mycobacterium tuberculosis H37Rv
acgugaguuucaccacu

SEQ ID NO: 3291451 - RNA, 14 nt, Mycobacterium tuberculosis H37Rv
acgugauagccgga

SEQ ID NO: 3291452 - RNA, 20 nt, Mycobacterium tuberculosis H37Rv
acgugauauccuuugccgcc

SEQ ID NO: 3291453 - RNA, 22 nt, Mycobacterium tuberculosis H37Rv
acgugauauccuuugccgccga

SEQ ID NO: 3291454 - RNA, 21 nt, Mycobacterium tuberculosis H37Rv
acgugaucgcgguccaacagc

SEQ ID NO: 3291455 - RNA, 23 nt, Mycobacterium tuberculosis H37Rv
acgugaucgcgguccaacagcgc

SEQ ID NO: 3291456 - RNA, 20 nt, Mycobacterium tuberculosis H37Rv
acgugaugcggucgcggaca

SEQ ID NO: 3291457 - RNA, 15 nt, Mycobacterium tuberculosis H37Rv
acgugcacaggcauc

SEQ ID NO: 3291458 - RNA, 16 nt, Mycobacterium tuberculosis H37Rv
acgugcaccagguugc

SEQ ID NO: 3291459 - RNA, 20 nt, Mycobacterium tuberculosis H37Rv
acgugccaaugauucggcac

SEQ ID NO: 3291460 - RNA, 21 nt, Mycobacterium tuberculosis H37Rv
acgugccccggcgguaccaga

SEQ ID NO: 3291461 - RNA, 21 nt, Mycobacterium tuberculosis H37Rv
acgugcccgguguucaucacg

SEQ ID NO: 3291462 - RNA, 13 nt, Mycobacterium tuberculosis H37Rv
acgugccgguccc

SEQ ID NO: 3291463 - RNA, 23 nt, Mycobacterium tuberculosis H37Rv
acgugcgaaucgagacggccacg

SEQ ID NO: 3291464 - RNA, 23 nt, Mycobacterium tuberculosis H37Rv
acgugcgagcccaccuggggccg

SEQ ID NO: 3291465 - RNA, 20 nt, Mycobacterium tuberculosis H37Rv
acgugcgagggcacggcggu

SEQ ID NO: 3291466 - RNA, 17 nt, Mycobacterium tuberculosis H37Rv
acgugcgucggcccggu

SEQ ID NO: 3291467 - RNA, 23 nt, Mycobacterium tuberculosis H37Rv
acgugcucguagacuugcugcuc

SEQ ID NO: 3291468 - RNA, 20 nt, Mycobacterium tuberculosis H37Rv
acgugcucucgcucgugcac

SEQ ID NO: 3291469 - RNA, 18 nt, Mycobacterium tuberculosis H37Rv
acguggacugaccucguc

SEQ ID NO: 3291470 - RNA, 16 nt, Mycobacterium tuberculosis H37Rv
acguggaugucucgau

SEQ ID NO: 3291471 - RNA, 14 nt, Mycobacterium tuberculosis H37Rv
acuccgcggcgcgc

SEQ ID NO: 3291472 - RNA, 15 nt, Mycobacterium tuberculosis H37Rv
acuccggcaagcaca

SEQ ID NO: 3291473 - RNA, 21 nt, Mycobacterium tuberculosis H37Rv
acuccggcaagcacaccgcca

SEQ ID NO: 3291474 - RNA, 13 nt, Mycobacterium tuberculosis H37Rv
acuccggccgcac

SEQ ID NO: 3291475 - RNA, 20 nt, Mycobacterium tuberculosis H37Rv
acuccgggcucggcgucgcc

SEQ ID NO: 3291476 - RNA, 17 nt, Mycobacterium tuberculosis H37Rv
acuccggucaacacccg

SEQ ID NO: 3291477 - RNA, 22 nt, Mycobacterium tuberculosis H37Rv
acuccggucagcgcggcgaccu

SEQ ID NO: 3291478 - RNA, 16 nt, Mycobacterium tuberculosis H37Rv
acuccgguggccaaca

SEQ ID NO: 3291479 - RNA, 22 nt, Mycobacterium tuberculosis H37Rv
acuccgucguaguuggugaaca

SEQ ID NO: 3291480 - RNA, 21 nt, Mycobacterium tuberculosis H37Rv
acuccguugagguaggugagc

SEQ ID NO: 3291481 - RNA, 13 nt, Mycobacterium tuberculosis H37Rv
acuccucagccgc

SEQ ID NO: 3291482 - RNA, 16 nt, Mycobacterium tuberculosis H37Rv
acuccucagccgccug

SEQ ID NO: 3291483 - RNA, 22 nt, Mycobacterium tuberculosis H37Rv
acuccugagaugcggccaugaa

SEQ ID NO: 3291484 - RNA, 13 nt, Mycobacterium tuberculosis H37Rv
acuccugcacaca

SEQ ID NO: 3291485 - RNA, 13 nt, Mycobacterium tuberculosis H37Rv
acuccugcagccc

SEQ ID NO: 3291486 - RNA, 20 nt, Mycobacterium tuberculosis H37Rv
acuccuggguuugccgaugg

SEQ ID NO: 3291487 - RNA, 18 nt, Mycobacterium tuberculosis H37Rv
acucgaaccguuucggga

SEQ ID NO: 3291488 - RNA, 22 nt, Mycobacterium tuberculosis H37Rv
acucgacauccucgauggaccg

SEQ ID NO: 3291489 - RNA, 15 nt, Mycobacterium tuberculosis H37Rv
acucgaccaccgccg

SEQ ID NO: 3291490 - RNA, 15 nt, Mycobacterium tuberculosis H37Rv
acucgaccaggaccg

SEQ ID NO: 3291491 - RNA, 15 nt, Mycobacterium tuberculosis H37Rv
acucgaccgcgagca

SEQ ID NO: 3291492 - RNA, 18 nt, Mycobacterium tuberculosis H37Rv
acucgagagcgaucaacg

SEQ ID NO: 3291493 - RNA, 15 nt, Mycobacterium tuberculosis H37Rv
acucgagcgcucaca

SEQ ID NO: 3291494 - RNA, 21 nt, Mycobacterium tuberculosis H37Rv
acucgagcgcucacauucaac

SEQ ID NO: 3291495 - RNA, 22 nt, Mycobacterium tuberculosis H37Rv
acucgaguggcgaacgggugag

SEQ ID NO: 3291496 - RNA, 22 nt, Mycobacterium tuberculosis H37Rv
acucgauauaacccggcuccag

SEQ ID NO: 3291497 - RNA, 15 nt, Mycobacterium tuberculosis H37Rv
acucgaucaccggca

SEQ ID NO: 3291498 - RNA, 22 nt, Mycobacterium tuberculosis H37Rv
acucgcagcgccgucaucgugc

SEQ ID NO: 3291499 - RNA, 15 nt, Mycobacterium tuberculosis H37Rv
acucgcccaagcgca

SEQ ID NO: 3291500 - RNA, 14 nt, Mycobacterium tuberculosis H37Rv
acucgccgaaaucg

SEQ ID NO: 3291501 - RNA, 19 nt, Mycobacterium tuberculosis H37Rv
acucgccgaaucgcugacc

SEQ ID NO: 3291502 - RNA, 23 nt, Mycobacterium tuberculosis H37Rv
acucgccgaaucgcugaccgcgu

SEQ ID NO: 3291503 - RNA, 21 nt, Mycobacterium tuberculosis H37Rv
acucgccggcgaauccgcaca

SEQ ID NO: 3291504 - RNA, 15 nt, Mycobacterium tuberculosis H37Rv
acucgcgcagguagc

SEQ ID NO: 3291505 - RNA, 14 nt, Mycobacterium tuberculosis H37Rv
acucgcggccggcg

SEQ ID NO: 3291506 - RNA, 12 nt, Mycobacterium tuberculosis H37Rv
acucgcucagga

SEQ ID NO: 3291507 - RNA, 17 nt, Mycobacterium tuberculosis H37Rv
acucggaauucggcguc

SEQ ID NO: 3291508 - RNA, 14 nt, Mycobacterium tuberculosis H37Rv
acucggacccaccc

SEQ ID NO: 3291509 - RNA, 21 nt, Mycobacterium tuberculosis H37Rv
acucggauagccccguguugu

SEQ ID NO: 3291510 - RNA, 13 nt, Mycobacterium tuberculosis H37Rv
acucggcaccgcg

SEQ ID NO: 3291511 - RNA, 16 nt, Mycobacterium tuberculosis H37Rv
acucggcauccaggcu

SEQ ID NO: 3291512 - RNA, 14 nt, Mycobacterium tuberculosis H37Rv
acucggccacagcg

SEQ ID NO: 3291513 - RNA, 21 nt, Mycobacterium tuberculosis H37Rv
acucggccacggcgucggcca

SEQ ID NO: 3291514 - RNA, 13 nt, Mycobacterium tuberculosis H37Rv
acucggccagcuc

SEQ ID NO: 3291515 - RNA, 12 nt, Mycobacterium tuberculosis H37Rv
acucggcccaca

SEQ ID NO: 3291516 - RNA, 17 nt, Mycobacterium tuberculosis H37Rv
acucggcccacacgguc

SEQ ID NO: 3291517 - RNA, 21 nt, Mycobacterium tuberculosis H37Rv
acucggcccggcaggacuugg

SEQ ID NO: 3291518 - RNA, 18 nt, Mycobacterium tuberculosis H37Rv
acucggcgaccugccgga

SEQ ID NO: 3291519 - RNA, 18 nt, Mycobacterium tuberculosis H37Rv
acucggcgauauggccuu

SEQ ID NO: 3291520 - RNA, 15 nt, Mycobacterium tuberculosis H37Rv
acucggcggaagacc

SEQ ID NO: 3291521 - RNA, 21 nt, Mycobacterium tuberculosis H37Rv
acucggcggaagaccggaucg

SEQ ID NO: 3291522 - RNA, 22 nt, Mycobacterium tuberculosis H37Rv
acucggcggccagcgagaucag

SEQ ID NO: 3291523 - RNA, 22 nt, Mycobacterium tuberculosis H37Rv
acucggcggccagcgcgucgcc

SEQ ID NO: 3291524 - RNA, 12 nt, Mycobacterium tuberculosis H37Rv
acucggcggcuu

SEQ ID NO: 3291525 - RNA, 20 nt, Mycobacterium tuberculosis H37Rv
acucggcgucgugguggcca

SEQ ID NO: 3291526 - RNA, 17 nt, Mycobacterium tuberculosis H37Rv
acucgggcaggccccac

SEQ ID NO: 3291527 - RNA, 18 nt, Mycobacterium tuberculosis H37Rv
acucggggcugucggcga

SEQ ID NO: 3291528 - RNA, 24 nt, Mycobacterium tuberculosis H37Rv
acucgggucaauugagucaucugg

SEQ ID NO: 3291529 - RNA, 18 nt, Mycobacterium tuberculosis H37Rv
acucggguuggugggucg

SEQ ID NO: 3291530 - RNA, 18 nt, Mycobacterium tuberculosis H37Rv
acucggucguugccgcgg

SEQ ID NO: 3291531 - RNA, 13 nt, Mycobacterium tuberculosis H37Rv
acucggucucgau

SEQ ID NO: 3291532 - RNA, 12 nt, Mycobacterium tuberculosis H37Rv
acucggugaucg

SEQ ID NO: 3291533 - RNA, 16 nt, Mycobacterium tuberculosis H37Rv
acucggugaucgcggu

SEQ ID NO: 3291534 - RNA, 20 nt, Mycobacterium tuberculosis H37Rv
acucgguucgccccugcaca

SEQ ID NO: 3291535 - RNA, 14 nt, Mycobacterium tuberculosis H37Rv
acucguaccgauuc

SEQ ID NO: 3291536 - RNA, 12 nt, Mycobacterium tuberculosis H37Rv
acucguagaacg

SEQ ID NO: 3291537 - RNA, 22 nt, Mycobacterium tuberculosis H37Rv
acucguccugacgguacagcuc

SEQ ID NO: 3291538 - RNA, 14 nt, Mycobacterium tuberculosis H37Rv
acucgucgcugccc

SEQ ID NO: 3291539 - RNA, 13 nt, Mycobacterium tuberculosis H37Rv
acucgugcgggca

SEQ ID NO: 3291540 - RNA, 20 nt, Mycobacterium tuberculosis H37Rv
acucguggaacuccguccgc

SEQ ID NO: 3291541 - RNA, 23 nt, Mycobacterium tuberculosis H37Rv
acucguggaacuccguccgccgu

SEQ ID NO: 3291542 - RNA, 19 nt, Mycobacterium tuberculosis H37Rv
acucguugagcagcuggac

SEQ ID NO: 3291543 - RNA, 15 nt, Mycobacterium tuberculosis H37Rv
acucguugccgacca

SEQ ID NO: 3291544 - RNA, 15 nt, Mycobacterium tuberculosis H37Rv
acucguuggcgaacu

SEQ ID NO: 3291545 - RNA, 14 nt, Mycobacterium tuberculosis H37Rv
acucuccccuggcc

SEQ ID NO: 3291546 - RNA, 14 nt, Mycobacterium tuberculosis H37Rv
acucucggugaacg

SEQ ID NO: 3291547 - RNA, 22 nt, Mycobacterium tuberculosis H37Rv
acucugcguccaccacgcaaaa

SEQ ID NO: 3291548 - RNA, 23 nt, Mycobacterium tuberculosis H37Rv
acucuggauucuucagcgcggca

SEQ ID NO: 3291549 - RNA, 19 nt, Mycobacterium tuberculosis H37Rv
acucuucccauuucggcaa

SEQ ID NO: 3291550 - RNA, 16 nt, Mycobacterium tuberculosis H37Rv
acucuucggaccggcu

SEQ ID NO: 3291551 - RNA, 18 nt, Mycobacterium tuberculosis H37Rv
acucuuguccagaaucca

SEQ ID NO: 3291552 - RNA, 23 nt, Mycobacterium tuberculosis H37Rv
acugaacaguugcacaccggcac

SEQ ID NO: 3291553 - RNA, 13 nt, Mycobacterium tuberculosis H37Rv
acugaagccgcga

SEQ ID NO: 3291554 - RNA, 23 nt, Mycobacterium tuberculosis H37Rv
acugaagccgcgagcgcgcgacu

SEQ ID NO: 3291555 - RNA, 20 nt, Mycobacterium tuberculosis H37Rv
acugaaucgaccggaacugu

SEQ ID NO: 3291556 - RNA, 15 nt, Mycobacterium tuberculosis H37Rv
acugaccaggucugc

SEQ ID NO: 3291557 - RNA, 22 nt, Mycobacterium tuberculosis H37Rv
acugaccccgccgccacgggug

SEQ ID NO: 3291558 - RNA, 23 nt, Mycobacterium tuberculosis H37Rv
acugaccgucugcgacccgggcc

SEQ ID NO: 3291559 - RNA, 17 nt, Mycobacterium tuberculosis H37Rv
acugaccucgucaauca

SEQ ID NO: 3291560 - RNA, 19 nt, Mycobacterium tuberculosis H37Rv
acugacgucgaacucccac

SEQ ID NO: 3291561 - RNA, 21 nt, Mycobacterium tuberculosis H37Rv
acugagccgcgaaaucaccgc

SEQ ID NO: 3291562 - RNA, 15 nt, Mycobacterium tuberculosis H37Rv
acugauagacccugg

SEQ ID NO: 3291563 - RNA, 19 nt, Mycobacterium tuberculosis H37Rv
acugaucuuggcccgggcc

SEQ ID NO: 3291564 - RNA, 21 nt, Mycobacterium tuberculosis H37Rv
acugaugaaccacggcaggca

SEQ ID NO: 3291565 - RNA, 15 nt, Mycobacterium tuberculosis H37Rv
acugauggcgcgcaa

SEQ ID NO: 3291566 - RNA, 15 nt, Mycobacterium tuberculosis H37Rv
acugaugucacccgc

SEQ ID NO: 3291567 - RNA, 19 nt, Mycobacterium tuberculosis H37Rv
acuucgacagcggcgauug

SEQ ID NO: 3291568 - RNA, 12 nt, Mycobacterium tuberculosis H37Rv
acuucggccaca

SEQ ID NO: 3291569 - RNA, 17 nt, Mycobacterium tuberculosis H37Rv
acuucggggucaccggc

SEQ ID NO: 3291570 - RNA, 13 nt, Mycobacterium tuberculosis H37Rv
acuucgugccucg

SEQ ID NO: 3291571 - RNA, 14 nt, Mycobacterium tuberculosis H37Rv
acuucuccaggcug

SEQ ID NO: 3291572 - RNA, 18 nt, Mycobacterium tuberculosis H37Rv
acuugagcuccucacgga

SEQ ID NO: 3291573 - RNA, 19 nt, Mycobacterium tuberculosis H37Rv
acuugagcuccucacggau

SEQ ID NO: 3291574 - RNA, 16 nt, Mycobacterium tuberculosis H37Rv
acuugaugcucgaugc

SEQ ID NO: 3291575 - RNA, 18 nt, Mycobacterium tuberculosis H37Rv
acuugcaggcgucccagc

SEQ ID NO: 3291576 - RNA, 18 nt, Mycobacterium tuberculosis H37Rv
acuugccacggcccgguu

SEQ ID NO: 3291577 - RNA, 17 nt, Mycobacterium tuberculosis H37Rv
acuugcccgucggcgcc

SEQ ID NO: 3291578 - RNA, 14 nt, Mycobacterium tuberculosis H37Rv
acuugccgccgcac

SEQ ID NO: 3291579 - RNA, 21 nt, Mycobacterium tuberculosis H37Rv
acuugccgggcaaucgcucug

SEQ ID NO: 3291580 - RNA, 14 nt, Mycobacterium tuberculosis H37Rv
acuugcucacccgu

SEQ ID NO: 3291581 - RNA, 12 nt, Mycobacterium tuberculosis H37Rv
acuugcugcucc

SEQ ID NO: 3291582 - RNA, 14 nt, Mycobacterium tuberculosis H37Rv
acuuggacccggcc

SEQ ID NO: 3291583 - RNA, 17 nt, Mycobacterium tuberculosis H37Rv
acuuggcaucgcgagcc

SEQ ID NO: 3291584 - RNA, 19 nt, Mycobacterium tuberculosis H37Rv
acuuggcggccagccgcuc

SEQ ID NO: 3291585 - RNA, 23 nt, Mycobacterium tuberculosis H37Rv
acuuggcggucgguuccggugua

SEQ ID NO: 3291586 - RNA, 22 nt, Mycobacterium tuberculosis H37Rv
acuuggugauccgagaccaugc

SEQ ID NO: 3291587 - RNA, 16 nt, Mycobacterium tuberculosis H37Rv
acuuguacgcaucgcc

SEQ ID NO: 3291588 - RNA, 17 nt, Mycobacterium tuberculosis H37Rv
acuuguugaccuccucc

SEQ ID NO: 3291589 - RNA, 16 nt, Mycobacterium tuberculosis H37Rv
acuuguugggcgcgaa

SEQ ID NO: 3291590 - RNA, 15 nt, Mycobacterium tuberculosis H37Rv
acuuucgaagaaccg

SEQ ID NO: 3291591 - RNA, 19 nt, Mycobacterium tuberculosis H37Rv
acuuucgcccagucgccgc

SEQ ID NO: 3291592 - RNA, 19 nt, Mycobacterium tuberculosis H37Rv
acuuuuccagugugaacug

SEQ ID NO: 3291593 - RNA, 22 nt, Mycobacterium tuberculosis H37Rv
acuuuucgguggcggcagcagc

SEQ ID NO: 3291594 - RNA, 21 nt, Mycobacterium tuberculosis H37Rv
agaaaacauugcggcccucga

SEQ ID NO: 3291595 - RNA, 17 nt, Mycobacterium tuberculosis H37Rv
agaaacacgacagccag

SEQ ID NO: 3291596 - RNA, 23 nt, Mycobacterium tuberculosis H37Rv
agaaacccucggggguccaguuc

SEQ ID NO: 3291597 - RNA, 14 nt, Mycobacterium tuberculosis H37Rv
agaaacccugcugc

SEQ ID NO: 3291598 - RNA, 15 nt, Mycobacterium tuberculosis H37Rv
agaaacccugcugcg

SEQ ID NO: 3291599 - RNA, 22 nt, Mycobacterium tuberculosis H37Rv
agaaacgcgaugguggccgcca

SEQ ID NO: 3291600 - RNA, 16 nt, Mycobacterium tuberculosis H37Rv
agaaacggcgacucga

SEQ ID NO: 3291601 - RNA, 15 nt, Mycobacterium tuberculosis H37Rv
agaaauccuuugaga

SEQ ID NO: 3291602 - RNA, 14 nt, Mycobacterium tuberculosis H37Rv
agaacaacggcgcg

SEQ ID NO: 3291603 - RNA, 16 nt, Mycobacterium tuberculosis H37Rv
agaacaccggccaggc

SEQ ID NO: 3291604 - RNA, 22 nt, Mycobacterium tuberculosis H37Rv
agaacacguuauucaugcccau

SEQ ID NO: 3291605 - RNA, 15 nt, Mycobacterium tuberculosis H37Rv
agaacccacgcaugc

SEQ ID NO: 3291606 - RNA, 17 nt, Mycobacterium tuberculosis H37Rv
agaaccgacggccagca

SEQ ID NO: 3291607 - RNA, 17 nt, Mycobacterium tuberculosis H37Rv
agaaccggucgcagugc

SEQ ID NO: 3291608 - RNA, 18 nt, Mycobacterium tuberculosis H37Rv
agaaccggucgcagugca

SEQ ID NO: 3291609 - RNA, 15 nt, Mycobacterium tuberculosis H37Rv
agaaccuggagccgu

SEQ ID NO: 3291610 - RNA, 17 nt, Mycobacterium tuberculosis H37Rv
agaacgauguccgcgcg

SEQ ID NO: 3291611 - RNA, 22 nt, Mycobacterium tuberculosis H37Rv
agaacgcaucggucccacugcc

SEQ ID NO: 3291612 - RNA, 16 nt, Mycobacterium tuberculosis H37Rv
agaacgcgucgcgcgc

SEQ ID NO: 3291613 - RNA, 16 nt, Mycobacterium tuberculosis H37Rv
agaacgcgucguagcg

SEQ ID NO: 3291614 - RNA, 19 nt, Mycobacterium tuberculosis H37Rv
agaacggaugccggucggc

SEQ ID NO: 3291615 - RNA, 14 nt, Mycobacterium tuberculosis H37Rv
agaacggcgaucac

SEQ ID NO: 3291616 - RNA, 18 nt, Mycobacterium tuberculosis H37Rv
agaacggcguugcggaau

SEQ ID NO: 3291617 - RNA, 20 nt, Mycobacterium tuberculosis H37Rv
agaacgucaaacccagcgac

SEQ ID NO: 3291618 - RNA, 20 nt, Mycobacterium tuberculosis H37Rv
agaacgucgagacuucggug

SEQ ID NO: 3291619 - RNA, 13 nt, Mycobacterium tuberculosis H37Rv
agaacgugcuggu

SEQ ID NO: 3291620 - RNA, 12 nt, Mycobacterium tuberculosis H37Rv
agaacucguuga

SEQ ID NO: 3291621 - RNA, 12 nt, Mycobacterium tuberculosis H37Rv
agaacuggcugc

SEQ ID NO: 3291622 - RNA, 13 nt, Mycobacterium tuberculosis H37Rv
agaacuggcugcu

SEQ ID NO: 3291623 - RNA, 16 nt, Mycobacterium tuberculosis H37Rv
agaacuggcugcuguu

SEQ ID NO: 3291624 - RNA, 15 nt, Mycobacterium tuberculosis H37Rv
agaacuucgccagcg

SEQ ID NO: 3291625 - RNA, 14 nt, Mycobacterium tuberculosis H37Rv
agaagaagcccagg

SEQ ID NO: 3291626 - RNA, 17 nt, Mycobacterium tuberculosis H37Rv
agaagauggcaccgccc

SEQ ID NO: 3291627 - RNA, 21 nt, Mycobacterium tuberculosis H37Rv
agaagcagggauucuggaugc

SEQ ID NO: 3291628 - RNA, 14 nt, Mycobacterium tuberculosis H37Rv
agaagcccaggacg

SEQ ID NO: 3291629 - RNA, 21 nt, Mycobacterium tuberculosis H37Rv
agaagcccaggacggcuacca

SEQ ID NO: 3291630 - RNA, 15 nt, Mycobacterium tuberculosis H37Rv
agaagcccccaaacc

SEQ ID NO: 3291631 - RNA, 12 nt, Mycobacterium tuberculosis H37Rv
agaagcccgaag

SEQ ID NO: 3291632 - RNA, 19 nt, Mycobacterium tuberculosis H37Rv
agaagcccgacuggucacu

SEQ ID NO: 3291633 - RNA, 14 nt, Mycobacterium tuberculosis H37Rv
agaaggaccgcucg

SEQ ID NO: 3291634 - RNA, 15 nt, Mycobacterium tuberculosis H37Rv
agaaggaucagcgca

SEQ ID NO: 3291635 - RNA, 20 nt, Mycobacterium tuberculosis H37Rv
agaaggaucagcgcacuggc

SEQ ID NO: 3291636 - RNA, 13 nt, Mycobacterium tuberculosis H37Rv
agaaggccgcacc

SEQ ID NO: 3291637 - RNA, 17 nt, Mycobacterium tuberculosis H37Rv
agaaguaggcggcgacg

SEQ ID NO: 3291638 - RNA, 17 nt, Mycobacterium tuberculosis H37Rv
agaagucgcagcgagga

SEQ ID NO: 3291639 - RNA, 19 nt, Mycobacterium tuberculosis H37Rv
agaagugcucacauccggu

SEQ ID NO: 3291640 - RNA, 16 nt, Mycobacterium tuberculosis H37Rv
agaaguucgugagcga

SEQ ID NO: 3291641 - RNA, 14 nt, Mycobacterium tuberculosis H37Rv
agaaucacggucau

SEQ ID NO: 3291642 - RNA, 13 nt, Mycobacterium tuberculosis H37Rv
agaaucagcagca

SEQ ID NO: 3291643 - RNA, 15 nt, Mycobacterium tuberculosis H37Rv
agaaucaggcucgcc

SEQ ID NO: 3291644 - RNA, 13 nt, Mycobacterium tuberculosis H37Rv
agaauccaggugg

SEQ ID NO: 3291645 - RNA, 18 nt, Mycobacterium tuberculosis H37Rv
agaaucccgcucccauga

SEQ ID NO: 3291646 - RNA, 16 nt, Mycobacterium tuberculosis H37Rv
agaauccggcaaccac

SEQ ID NO: 3291647 - RNA, 15 nt, Mycobacterium tuberculosis H37Rv
agaauccggcccacc

SEQ ID NO: 3291648 - RNA, 16 nt, Mycobacterium tuberculosis H37Rv
agaaucgaagcggcug

SEQ ID NO: 3291649 - RNA, 19 nt, Mycobacterium tuberculosis H37Rv
agaaucgaagcggcugcug

SEQ ID NO: 3291650 - RNA, 16 nt, Mycobacterium tuberculosis H37Rv
agaaucucgccgggcu

SEQ ID NO: 3291651 - RNA, 13 nt, Mycobacterium tuberculosis H37Rv
agaaucugccucu

SEQ ID NO: 3291652 - RNA, 20 nt, Mycobacterium tuberculosis H37Rv
agaaugcugacggugcagga

SEQ ID NO: 3291653 - RNA, 20 nt, Mycobacterium tuberculosis H37Rv
agaauggacugaacaccaaa

SEQ ID NO: 3291654 - RNA, 22 nt, Mycobacterium tuberculosis H37Rv
agaauggccgccuugaggcccu

SEQ ID NO: 3291655 - RNA, 19 nt, Mycobacterium tuberculosis H37Rv
agaaugggauggcaccacc

SEQ ID NO: 3291656 - RNA, 15 nt, Mycobacterium tuberculosis H37Rv
agaauucgccaaggc

SEQ ID NO: 3291657 - RNA, 22 nt, Mycobacterium tuberculosis H37Rv
agaauucguucagcgccagcgc

SEQ ID NO: 3291658 - RNA, 11 nt, Mycobacterium tuberculosis H37Rv
agaauuggccc

SEQ ID NO: 3291659 - RNA, 15 nt, Mycobacterium tuberculosis H37Rv
agacaacaacacggg

SEQ ID NO: 3291660 - RNA, 20 nt, Mycobacterium tuberculosis H37Rv
agacacagaaucgcccauuu

SEQ ID NO: 3291661 - RNA, 13 nt, Mycobacterium tuberculosis H37Rv
agacaccccacca

SEQ ID NO: 3291662 - RNA, 21 nt, Mycobacterium tuberculosis H37Rv
agacaccgcgaucaccaccgg

SEQ ID NO: 3291663 - RNA, 18 nt, Mycobacterium tuberculosis H37Rv
agacaccggcuauauccc

SEQ ID NO: 3291664 - RNA, 17 nt, Mycobacterium tuberculosis H37Rv
agagcacgucaacagcc

SEQ ID NO: 3291665 - RNA, 12 nt, Mycobacterium tuberculosis H37Rv
agagcagcagcg

SEQ ID NO: 3291666 - RNA, 21 nt, Mycobacterium tuberculosis H37Rv
agagcauucgggcgcccucau

SEQ ID NO: 3291667 - RNA, 13 nt, Mycobacterium tuberculosis H37Rv
agagccaacgcgc

SEQ ID NO: 3291668 - RNA, 16 nt, Mycobacterium tuberculosis H37Rv
agagccaacgcgcgac

SEQ ID NO: 3291669 - RNA, 17 nt, Mycobacterium tuberculosis H37Rv
agagccaacgcgcgacc

SEQ ID NO: 3291670 - RNA, 12 nt, Mycobacterium tuberculosis H37Rv
agagccagcaac

SEQ ID NO: 3291671 - RNA, 17 nt, Mycobacterium tuberculosis H37Rv
agagccccgaccagcag

SEQ ID NO: 3291672 - RNA, 11 nt, Mycobacterium tuberculosis H37Rv
agagccgccgu

SEQ ID NO: 3291673 - RNA, 13 nt, Mycobacterium tuberculosis H37Rv
agagccugcucgc

SEQ ID NO: 3291674 - RNA, 14 nt, Mycobacterium tuberculosis H37Rv
agagcgcaccgcga

SEQ ID NO: 3291675 - RNA, 15 nt, Mycobacterium tuberculosis H37Rv
agagcggcaccagau

SEQ ID NO: 3291676 - RNA, 13 nt, Mycobacterium tuberculosis H37Rv
agagcuccgucgc

SEQ ID NO: 3291677 - RNA, 23 nt, Mycobacterium tuberculosis H37Rv
agagcucgaaguuggcuuucggu

SEQ ID NO: 3291678 - RNA, 14 nt, Mycobacterium tuberculosis H37Rv
agagcucgccggug

SEQ ID NO: 3291679 - RNA, 18 nt, Mycobacterium tuberculosis H37Rv
agaggauggucagcagcu

SEQ ID NO: 3291680 - RNA, 12 nt, Mycobacterium tuberculosis H37Rv
agaggcccgaaa

SEQ ID NO: 3291681 - RNA, 12 nt, Mycobacterium tuberculosis H37Rv
agaggcccgcgg

SEQ ID NO: 3291682 - RNA, 18 nt, Mycobacterium tuberculosis H37Rv
agaggcgcaccuccugcg

SEQ ID NO: 3291683 - RNA, 23 nt, Mycobacterium tuberculosis H37Rv
agaguaucgaauccgucccaggu

SEQ ID NO: 3291684 - RNA, 14 nt, Mycobacterium tuberculosis H37Rv
agagucaacaucag

SEQ ID NO: 3291685 - RNA, 16 nt, Mycobacterium tuberculosis H37Rv
agagucaacaucagca

SEQ ID NO: 3291686 - RNA, 15 nt, Mycobacterium tuberculosis H37Rv
agaguucgcgcgccg

SEQ ID NO: 3291687 - RNA, 19 nt, Mycobacterium tuberculosis H37Rv
agaguuggggcacaaccgg

SEQ ID NO: 3291688 - RNA, 17 nt, Mycobacterium tuberculosis H37Rv
agauaccaccgccgcug

SEQ ID NO: 3291689 - RNA, 13 nt, Mycobacterium tuberculosis H37Rv
agauacgagcugu

SEQ ID NO: 3291690 - RNA, 18 nt, Mycobacterium tuberculosis H37Rv
agauacgcguguggcaga

SEQ ID NO: 3291691 - RNA, 13 nt, Mycobacterium tuberculosis H37Rv
agauacggccacc

SEQ ID NO: 3291692 - RNA, 14 nt, Mycobacterium tuberculosis H37Rv
agauacggccacca

SEQ ID NO: 3291693 - RNA, 12 nt, Mycobacterium tuberculosis H37Rv
agauagucgccg

SEQ ID NO: 3291694 - RNA, 16 nt, Mycobacterium tuberculosis H37Rv
agauauggaccgccgc

SEQ ID NO: 3291695 - RNA, 24 nt, Mycobacterium tuberculosis H37Rv
agaucaccgccaccaccagggcaa

SEQ ID NO: 3291696 - RNA, 13 nt, Mycobacterium tuberculosis H37Rv
agaucaccgccag

SEQ ID NO: 3291697 - RNA, 18 nt, Mycobacterium tuberculosis H37Rv
agaucaccucccgcggca

SEQ ID NO: 3291698 - RNA, 14 nt, Mycobacterium tuberculosis H37Rv
agaucacgcgucgu

SEQ ID NO: 3291699 - RNA, 21 nt, Mycobacterium tuberculosis H37Rv
agaucagcaccgacagcccga

SEQ ID NO: 3291700 - RNA, 23 nt, Mycobacterium tuberculosis H37Rv
agaucagcaccgugacagcggca

SEQ ID NO: 3291701 - RNA, 19 nt, Mycobacterium tuberculosis H37Rv
agaucagcagcggcgaccg

SEQ ID NO: 3291702 - RNA, 23 nt, Mycobacterium tuberculosis H37Rv
agaucagcaugccuucggccaac

SEQ ID NO: 3291703 - RNA, 22 nt, Mycobacterium tuberculosis H37Rv
agaucagcaugguccacagccg

SEQ ID NO: 3291704 - RNA, 18 nt, Mycobacterium tuberculosis H37Rv
agaucagccucgcgggca

SEQ ID NO: 3291705 - RNA, 19 nt, Mycobacterium tuberculosis H37Rv
agaucagcgccugguccuc

SEQ ID NO: 3291706 - RNA, 14 nt, Mycobacterium tuberculosis H37Rv
agaucaugccggcg

SEQ ID NO: 3291707 - RNA, 22 nt, Mycobacterium tuberculosis H37Rv
agaucauuucgguaauggccgc

SEQ ID NO: 3291708 - RNA, 19 nt, Mycobacterium tuberculosis H37Rv
agauccgcagcgucuugau

SEQ ID NO: 3291709 - RNA, 20 nt, Mycobacterium tuberculosis H37Rv
agauccgccacgcucaaccc

SEQ ID NO: 3291710 - RNA, 14 nt, Mycobacterium tuberculosis H37Rv
agauccgguccacc

SEQ ID NO: 3291711 - RNA, 17 nt, Mycobacterium tuberculosis H37Rv
agauccgguccaccgcc

SEQ ID NO: 3291712 - RNA, 23 nt, Mycobacterium tuberculosis H37Rv
agauccguccgcugguggucagc

SEQ ID NO: 3291713 - RNA, 20 nt, Mycobacterium tuberculosis H37Rv
agaucgaacgcagccagcgc

SEQ ID NO: 3291714 - RNA, 16 nt, Mycobacterium tuberculosis H37Rv
agaucgagggggacgc

SEQ ID NO: 3291715 - RNA, 22 nt, Mycobacterium tuberculosis H37Rv
agaucgcacaccaacaccgcgg

SEQ ID NO: 3291716 - RNA, 12 nt, Mycobacterium tuberculosis H37Rv
agaucgcccgag

SEQ ID NO: 3291717 - RNA, 20 nt, Mycobacterium tuberculosis H37Rv
agaucgcccgaguugaagaa

SEQ ID NO: 3291718 - RNA, 12 nt, Mycobacterium tuberculosis H37Rv
agaucgccgagc

SEQ ID NO: 3291719 - RNA, 15 nt, Mycobacterium tuberculosis H37Rv
agaucgccugggggu

SEQ ID NO: 3291720 - RNA, 16 nt, Mycobacterium tuberculosis H37Rv
agaucgccugggggua

SEQ ID NO: 3291721 - RNA, 21 nt, Mycobacterium tuberculosis H37Rv
agaucgcguggaucgcgcuca

SEQ ID NO: 3291722 - RNA, 18 nt, Mycobacterium tuberculosis H37Rv
agaucgcuaggaccgcgg

SEQ ID NO: 3291723 - RNA, 13 nt, Mycobacterium tuberculosis H37Rv
agaucgcugcgaa

SEQ ID NO: 3291724 - RNA, 20 nt, Mycobacterium tuberculosis H37Rv
agaucggcgaaucgggcaaa

SEQ ID NO: 3291725 - RNA, 14 nt, Mycobacterium tuberculosis H37Rv
agaucggcgccccu

SEQ ID NO: 3291726 - RNA, 20 nt, Mycobacterium tuberculosis H37Rv
agaucggguggcgggucagc

SEQ ID NO: 3291727 - RNA, 14 nt, Mycobacterium tuberculosis H37Rv
agaucggugccagc

SEQ ID NO: 3291728 - RNA, 21 nt, Mycobacterium tuberculosis H37Rv
agaucgucgacccaccaugug

SEQ ID NO: 3291729 - RNA, 14 nt, Mycobacterium tuberculosis H37Rv
agaucgucgccaug

SEQ ID NO: 3291730 - RNA, 22 nt, Mycobacterium tuberculosis H37Rv
agaucgugaaaguaagccgcgc

SEQ ID NO: 3291731 - RNA, 14 nt, Mycobacterium tuberculosis H37Rv
agaucguuccaggc

SEQ ID NO: 3291732 - RNA, 22 nt, Mycobacterium tuberculosis H37Rv
agaucguugaugacguugcagc

SEQ ID NO: 3291733 - RNA, 22 nt, Mycobacterium tuberculosis H37Rv
agaucguugccucgucgccgcg

SEQ ID NO: 3291734 - RNA, 20 nt, Mycobacterium tuberculosis H37Rv
agaucucacgugcccgcgcg

SEQ ID NO: 3291735 - RNA, 20 nt, Mycobacterium tuberculosis H37Rv
agaucucuucggagccgaug

SEQ ID NO: 3291736 - RNA, 19 nt, Mycobacterium tuberculosis H37Rv
agaucuucgagcgcaucag

SEQ ID NO: 3291737 - RNA, 15 nt, Mycobacterium tuberculosis H37Rv
agaucuucgccgaga

SEQ ID NO: 3291738 - RNA, 13 nt, Mycobacterium tuberculosis H37Rv
agaucuugcagug

SEQ ID NO: 3291739 - RNA, 17 nt, Mycobacterium tuberculosis H37Rv
agaucuugugccaggcg

SEQ ID NO: 3291740 - RNA, 20 nt, Mycobacterium tuberculosis H37Rv
agaugcaccugcgaggugcc

SEQ ID NO: 3291741 - RNA, 19 nt, Mycobacterium tuberculosis H37Rv
agaugcacgucgagcaggc

SEQ ID NO: 3291742 - RNA, 21 nt, Mycobacterium tuberculosis H37Rv
agaugcacgucgagcaggcug

SEQ ID NO: 3291743 - RNA, 18 nt, Mycobacterium tuberculosis H37Rv
agaugcauccagcugcug

SEQ ID NO: 3291744 - RNA, 16 nt, Mycobacterium tuberculosis H37Rv
agaugcccagcaggaa

SEQ ID NO: 3291745 - RNA, 16 nt, Mycobacterium tuberculosis H37Rv
agaugcccgcgaucau

SEQ ID NO: 3291746 - RNA, 21 nt, Mycobacterium tuberculosis H37Rv
agaugccgcgaucgugcaggu

SEQ ID NO: 3291747 - RNA, 12 nt, Mycobacterium tuberculosis H37Rv
agaugccgggcu

SEQ ID NO: 3291748 - RNA, 23 nt, Mycobacterium tuberculosis H37Rv
agaugccguaguaaggagccggg

SEQ ID NO: 3291749 - RNA, 18 nt, Mycobacterium tuberculosis H37Rv
agaugccugcuagcagca

SEQ ID NO: 3291750 - RNA, 19 nt, Mycobacterium tuberculosis H37Rv
agaugccugcuagcagcag

SEQ ID NO: 3291751 - RNA, 20 nt, Mycobacterium tuberculosis H37Rv
agaugccugcuagcagcagc

SEQ ID NO: 3291752 - RNA, 20 nt, Mycobacterium tuberculosis H37Rv
agaugcgcccggcgugguga

SEQ ID NO: 3291753 - RNA, 14 nt, Mycobacterium tuberculosis H37Rv
agaugcugcacccg

SEQ ID NO: 3291754 - RNA, 22 nt, Mycobacterium tuberculosis H37Rv
agauggcucucggugguccagc

SEQ ID NO: 3291755 - RNA, 14 nt, Mycobacterium tuberculosis H37Rv
agaugggccuccac

SEQ ID NO: 3291756 - RNA, 20 nt, Mycobacterium tuberculosis H37Rv
agauggguacccgaucacuc

SEQ ID NO: 3291757 - RNA, 15 nt, Mycobacterium tuberculosis H37Rv
agauggucgggcggc

SEQ ID NO: 3291758 - RNA, 18 nt, Mycobacterium tuberculosis H37Rv
agaugguggucaccacca

SEQ ID NO: 3291759 - RNA, 22 nt, Mycobacterium tuberculosis H37Rv
agauguccucccauucccaaca

SEQ ID NO: 3291760 - RNA, 16 nt, Mycobacterium tuberculosis H37Rv
agcacccgcuggucga

SEQ ID NO: 3291761 - RNA, 14 nt, Mycobacterium tuberculosis H37Rv
agcacccggccacc

SEQ ID NO: 3291762 - RNA, 15 nt, Mycobacterium tuberculosis H37Rv
agcacccggccaccg

SEQ ID NO: 3291763 - RNA, 21 nt, Mycobacterium tuberculosis H37Rv
agcacccguugaucgcggaca

SEQ ID NO: 3291764 - RNA, 15 nt, Mycobacterium tuberculosis H37Rv
agcacccugauguga

SEQ ID NO: 3291765 - RNA, 20 nt, Mycobacterium tuberculosis H37Rv
agcacccugaugugagucca

SEQ ID NO: 3291766 - RNA, 22 nt, Mycobacterium tuberculosis H37Rv
agcaccgacaccggccgcgacg

SEQ ID NO: 3291767 - RNA, 19 nt, Mycobacterium tuberculosis H37Rv
agcaccgaccagggccgcc

SEQ ID NO: 3291768 - RNA, 12 nt, Mycobacterium tuberculosis H37Rv
agcaccgaugcu

SEQ ID NO: 3291769 - RNA, 14 nt, Mycobacterium tuberculosis H37Rv
agcaccgaugcuga

SEQ ID NO: 3291770 - RNA, 18 nt, Mycobacterium tuberculosis H37Rv
agcaccgcaaccacgccc

SEQ ID NO: 3291771 - RNA, 16 nt, Mycobacterium tuberculosis H37Rv
agcaccgcgacgacga

SEQ ID NO: 3291772 - RNA, 20 nt, Mycobacterium tuberculosis H37Rv
agcaccgcgacgacgagguc

SEQ ID NO: 3291773 - RNA, 18 nt, Mycobacterium tuberculosis H37Rv
agcaccggauacagccac

SEQ ID NO: 3291774 - RNA, 19 nt, Mycobacterium tuberculosis H37Rv
agcaccggauacagccacg

SEQ ID NO: 3291775 - RNA, 17 nt, Mycobacterium tuberculosis H37Rv
agcaccggcucgacugc

SEQ ID NO: 3291776 - RNA, 22 nt, Mycobacterium tuberculosis H37Rv
agcaccgggcucagacuuucgc

SEQ ID NO: 3291777 - RNA, 16 nt, Mycobacterium tuberculosis H37Rv
agcaccggucccugcg

SEQ ID NO: 3291778 - RNA, 22 nt, Mycobacterium tuberculosis H37Rv
agcaccggucccugcgccguca

SEQ ID NO: 3291779 - RNA, 19 nt, Mycobacterium tuberculosis H37Rv
agcaccgucgggcccagcc

SEQ ID NO: 3291780 - RNA, 14 nt, Mycobacterium tuberculosis H37Rv
agcaccgugcccug

SEQ ID NO: 3291781 - RNA, 15 nt, Mycobacterium tuberculosis H37Rv
agcaccucgaagugc

SEQ ID NO: 3291782 - RNA, 18 nt, Mycobacterium tuberculosis H37Rv
agcaccucuaccguggca

SEQ ID NO: 3291783 - RNA, 23 nt, Mycobacterium tuberculosis H37Rv
agcaccugccguuccggcugcuu

SEQ ID NO: 3291784 - RNA, 18 nt, Mycobacterium tuberculosis H37Rv
agcaccugggcgcgcugg

SEQ ID NO: 3291785 - RNA, 15 nt, Mycobacterium tuberculosis H37Rv
agcacgaaagucaau

SEQ ID NO: 3291786 - RNA, 21 nt, Mycobacterium tuberculosis H37Rv
agcacgaaagucaaucgcguc

SEQ ID NO: 3291787 - RNA, 15 nt, Mycobacterium tuberculosis H37Rv
agcacgaagcuggcg

SEQ ID NO: 3291788 - RNA, 19 nt, Mycobacterium tuberculosis H37Rv
agcacgacugcggcaaacg

SEQ ID NO: 3291789 - RNA, 23 nt, Mycobacterium tuberculosis H37Rv
agcacgagcggcuugguguauuc

SEQ ID NO: 3291790 - RNA, 20 nt, Mycobacterium tuberculosis H37Rv
agcacgaugucgaugccgug

SEQ ID NO: 3291791 - RNA, 16 nt, Mycobacterium tuberculosis H37Rv
agcacgccaggcaugc

SEQ ID NO: 3291792 - RNA, 20 nt, Mycobacterium tuberculosis H37Rv
agcacgccgccggccgccag

SEQ ID NO: 3291793 - RNA, 15 nt, Mycobacterium tuberculosis H37Rv
agcacgccguccagg

SEQ ID NO: 3291794 - RNA, 16 nt, Mycobacterium tuberculosis H37Rv
agcacgcgugguucgg

SEQ ID NO: 3291795 - RNA, 15 nt, Mycobacterium tuberculosis H37Rv
agcacgcugaccaca

SEQ ID NO: 3291796 - RNA, 20 nt, Mycobacterium tuberculosis H37Rv
agcacgcuggcguuguugac

SEQ ID NO: 3291797 - RNA, 20 nt, Mycobacterium tuberculosis H37Rv
agcacggcgcggcggagugc

SEQ ID NO: 3291798 - RNA, 23 nt, Mycobacterium tuberculosis H37Rv
agcacgggcucgcugcaccagcu

SEQ ID NO: 3291799 - RNA, 24 nt, Mycobacterium tuberculosis H37Rv
agcacgggcucgcugcaccagcug

SEQ ID NO: 3291800 - RNA, 20 nt, Mycobacterium tuberculosis H37Rv
agcacgguggcuucgacggc

SEQ ID NO: 3291801 - RNA, 15 nt, Mycobacterium tuberculosis H37Rv
agcacguaacgccgc

SEQ ID NO: 3291802 - RNA, 14 nt, Mycobacterium tuberculosis H37Rv
agcacguacauggu

SEQ ID NO: 3291803 - RNA, 16 nt, Mycobacterium tuberculosis H37Rv
agcacguaucgaagcu

SEQ ID NO: 3291804 - RNA, 13 nt, Mycobacterium tuberculosis H37Rv
agcacgucacgcg

SEQ ID NO: 3291805 - RNA, 11 nt, Mycobacterium tuberculosis H37Rv
agcacguccgc

SEQ ID NO: 3291806 - RNA, 16 nt, Mycobacterium tuberculosis H37Rv
agcacguccucgaccc

SEQ ID NO: 3291807 - RNA, 22 nt, Mycobacterium tuberculosis H37Rv
agcacguccugaaucgguucgg

SEQ ID NO: 3291808 - RNA, 15 nt, Mycobacterium tuberculosis H37Rv
agcacgucgaacucg

SEQ ID NO: 3291809 - RNA, 22 nt, Mycobacterium tuberculosis H37Rv
agcacgucgcggccguggaugu

SEQ ID NO: 3291810 - RNA, 18 nt, Mycobacterium tuberculosis H37Rv
agcacgucgucgcgggaa

SEQ ID NO: 3291811 - RNA, 20 nt, Mycobacterium tuberculosis H37Rv
agcacgugccccaugcgcag

SEQ ID NO: 3291812 - RNA, 15 nt, Mycobacterium tuberculosis H37Rv
agcacguugacgucc

SEQ ID NO: 3291813 - RNA, 15 nt, Mycobacterium tuberculosis H37Rv
agcacuaaucggcca

SEQ ID NO: 3291814 - RNA, 12 nt, Mycobacterium tuberculosis H37Rv
agcacuccaccg

SEQ ID NO: 3291815 - RNA, 17 nt, Mycobacterium tuberculosis H37Rv
agcacucccugguucgg

SEQ ID NO: 3291816 - RNA, 20 nt, Mycobacterium tuberculosis H37Rv
agcacuccggagcccacacg

SEQ ID NO: 3291817 - RNA, 13 nt, Mycobacterium tuberculosis H37Rv
agcacuccgucgu

SEQ ID NO: 3291818 - RNA, 18 nt, Mycobacterium tuberculosis H37Rv
agcacuccgucguaguug

SEQ ID NO: 3291819 - RNA, 15 nt, Mycobacterium tuberculosis H37Rv
agcacucgcccaagc

SEQ ID NO: 3291820 - RNA, 21 nt, Mycobacterium tuberculosis H37Rv
agcacucgggauucggcagcg

SEQ ID NO: 3291821 - RNA, 17 nt, Mycobacterium tuberculosis H37Rv
agcacucggugucggcc

SEQ ID NO: 3291822 - RNA, 21 nt, Mycobacterium tuberculosis H37Rv
agcacucuucgaugaagcugg

SEQ ID NO: 3291823 - RNA, 12 nt, Mycobacterium tuberculosis H37Rv
agcacugacggg

SEQ ID NO: 3291824 - RNA, 16 nt, Mycobacterium tuberculosis H37Rv
agcagaaacggcgacu

SEQ ID NO: 3291825 - RNA, 20 nt, Mycobacterium tuberculosis H37Rv
agcagaauccugcgcugcac

SEQ ID NO: 3291826 - RNA, 19 nt, Mycobacterium tuberculosis H37Rv
agcagacacagaaucgcac

SEQ ID NO: 3291827 - RNA, 19 nt, Mycobacterium tuberculosis H37Rv
agcagacacuaaagcccuc

SEQ ID NO: 3291828 - RNA, 19 nt, Mycobacterium tuberculosis H37Rv
agcagacgacgaucagccc

SEQ ID NO: 3291829 - RNA, 21 nt, Mycobacterium tuberculosis H37Rv
agcagacgacgaucagcccca

SEQ ID NO: 3291830 - RNA, 20 nt, Mycobacterium tuberculosis H37Rv
agcagacgcaaaagccaccg

SEQ ID NO: 3291831 - RNA, 19 nt, Mycobacterium tuberculosis H37Rv
agcagacgcaaaaucgccc

SEQ ID NO: 3291832 - RNA, 20 nt, Mycobacterium tuberculosis H37Rv
agcagacgcaaaaucgccca

SEQ ID NO: 3291833 - RNA, 21 nt, Mycobacterium tuberculosis H37Rv
agcagacgcaaaaucgcccaa

SEQ ID NO: 3291834 - RNA, 21 nt, Mycobacterium tuberculosis H37Rv
agcagacgcaaaaucgcccau

SEQ ID NO: 3291835 - RNA, 20 nt, Mycobacterium tuberculosis H37Rv
agcagacgcagaagccccca

SEQ ID NO: 3291836 - RNA, 18 nt, Mycobacterium tuberculosis H37Rv
agcagacgcagaaucgca

SEQ ID NO: 3291837 - RNA, 19 nt, Mycobacterium tuberculosis H37Rv
agcagacgcagaaucgcac

SEQ ID NO: 3291838 - RNA, 20 nt, Mycobacterium tuberculosis H37Rv
agcagacgcagaaucgcaca

SEQ ID NO: 3291839 - RNA, 20 nt, Mycobacterium tuberculosis H37Rv
agcagacgcagaaucgcaug

SEQ ID NO: 3291840 - RNA, 19 nt, Mycobacterium tuberculosis H37Rv
agcagacgcagaaucgccc

SEQ ID NO: 3291841 - RNA, 21 nt, Mycobacterium tuberculosis H37Rv
agcagacgcagaaucgcccaa

SEQ ID NO: 3291842 - RNA, 20 nt, Mycobacterium tuberculosis H37Rv
agcagacgcagaaucgccua

SEQ ID NO: 3291843 - RNA, 20 nt, Mycobacterium tuberculosis H37Rv
agcagacgcauaagcccccg

SEQ ID NO: 3291844 - RNA, 22 nt, Mycobacterium tuberculosis H37Rv
agcagacgcauaagcccccgca

SEQ ID NO: 3291845 - RNA, 18 nt, Mycobacterium tuberculosis H37Rv
agcagacgcggaaucgca

SEQ ID NO: 3291846 - RNA, 20 nt, Mycobacterium tuberculosis H37Rv
agcagacgcggaaucgcauc

SEQ ID NO: 3291847 - RNA, 16 nt, Mycobacterium tuberculosis H37Rv
agcagagccaacgcgc

SEQ ID NO: 3291848 - RNA, 13 nt, Mycobacterium tuberculosis H37Rv
agcagagccccgg

SEQ ID NO: 3291849 - RNA, 21 nt, Mycobacterium tuberculosis H37Rv
agcagagccccggcaagcgca

SEQ ID NO: 3291850 - RNA, 19 nt, Mycobacterium tuberculosis H37Rv
agcagagcggcacgcacgc

SEQ ID NO: 3291851 - RNA, 19 nt, Mycobacterium tuberculosis H37Rv
agcagaggaucaucgacgc

SEQ ID NO: 3291852 - RNA, 18 nt, Mycobacterium tuberculosis H37Rv
agcagaucgcgggcgcgu

SEQ ID NO: 3291853 - RNA, 14 nt, Mycobacterium tuberculosis H37Rv
agcagauuaccgag

SEQ ID NO: 3291854 - RNA, 16 nt, Mycobacterium tuberculosis H37Rv
agcagcaacgacccga

SEQ ID NO: 3291855 - RNA, 12 nt, Mycobacterium tuberculosis H37Rv
agcauugaagaa

SEQ ID NO: 3291856 - RNA, 15 nt, Mycobacterium tuberculosis H37Rv
agcauugaagaagcc

SEQ ID NO: 3291857 - RNA, 16 nt, Mycobacterium tuberculosis H37Rv
agcauugaagaagccc

SEQ ID NO: 3291858 - RNA, 20 nt, Mycobacterium tuberculosis H37Rv
agcauugaccaauccacuga

SEQ ID NO: 3291859 - RNA, 20 nt, Mycobacterium tuberculosis H37Rv
agcauugaguucggccacca

SEQ ID NO: 3291860 - RNA, 15 nt, Mycobacterium tuberculosis H37Rv
agcauugucgccgga

SEQ ID NO: 3291861 - RNA, 21 nt, Mycobacterium tuberculosis H37Rv
agccaacccgucuuaucggcg

SEQ ID NO: 3291862 - RNA, 20 nt, Mycobacterium tuberculosis H37Rv
agccaaccguguaggccaug

SEQ ID NO: 3291863 - RNA, 17 nt, Mycobacterium tuberculosis H37Rv
agccaaccugaagccag

SEQ ID NO: 3291864 - RNA, 19 nt, Mycobacterium tuberculosis H37Rv
agccaaccugaagccagcg

SEQ ID NO: 3291865 - RNA, 22 nt, Mycobacterium tuberculosis H37Rv
agccaacgcgucccgccgcacc

SEQ ID NO: 3291866 - RNA, 18 nt, Mycobacterium tuberculosis H37Rv
agccaaggcuuccuccga

SEQ ID NO: 3291867 - RNA, 22 nt, Mycobacterium tuberculosis H37Rv
agccaaugcccuuggccagcag

SEQ ID NO: 3291868 - RNA, 19 nt, Mycobacterium tuberculosis H37Rv
agccaccgcgaaaauucgu

SEQ ID NO: 3291869 - RNA, 16 nt, Mycobacterium tuberculosis H37Rv
agccaccgcgcgucau

SEQ ID NO: 3291870 - RNA, 15 nt, Mycobacterium tuberculosis H37Rv
agccaccgucaugcc

SEQ ID NO: 3291871 - RNA, 21 nt, Mycobacterium tuberculosis H37Rv
agccacgaacugaucgaccgc

SEQ ID NO: 3291872 - RNA, 14 nt, Mycobacterium tuberculosis H37Rv
agccacgacccagc

SEQ ID NO: 3291873 - RNA, 22 nt, Mycobacterium tuberculosis H37Rv
agccacgcacaauacggucagc

SEQ ID NO: 3291874 - RNA, 17 nt, Mycobacterium tuberculosis H37Rv
agccacgcaugggccag

SEQ ID NO: 3291875 - RNA, 21 nt, Mycobacterium tuberculosis H37Rv
agccacgcaugggccagguca

SEQ ID NO: 3291876 - RNA, 17 nt, Mycobacterium tuberculosis H37Rv
agccacgccacguccaa

SEQ ID NO: 3291877 - RNA, 18 nt, Mycobacterium tuberculosis H37Rv
agccacgcugucccgcgg

SEQ ID NO: 3291878 - RNA, 15 nt, Mycobacterium tuberculosis H37Rv
agccacggcugccca

SEQ ID NO: 3291879 - RNA, 23 nt, Mycobacterium tuberculosis H37Rv
agccacguucgcggccaacccau

SEQ ID NO: 3291880 - RNA, 14 nt, Mycobacterium tuberculosis H37Rv
agccacucgaucac

SEQ ID NO: 3291881 - RNA, 14 nt, Mycobacterium tuberculosis H37Rv
agccacucgcgcac

SEQ ID NO: 3291882 - RNA, 18 nt, Mycobacterium tuberculosis H37Rv
agccagaccaacaugaac

SEQ ID NO: 3291883 - RNA, 22 nt, Mycobacterium tuberculosis H37Rv
agccagaccaacaugaacguca

SEQ ID NO: 3291884 - RNA, 16 nt, Mycobacterium tuberculosis H37Rv
agccagagguggauca

SEQ ID NO: 3291885 - RNA, 18 nt, Mycobacterium tuberculosis H37Rv
agccagcaacaccagaug

SEQ ID NO: 3291886 - RNA, 17 nt, Mycobacterium tuberculosis H37Rv
agccagcaagcgguagc

SEQ ID NO: 3291887 - RNA, 14 nt, Mycobacterium tuberculosis H37Rv
agccagcagcacau

SEQ ID NO: 3291888 - RNA, 20 nt, Mycobacterium tuberculosis H37Rv
agccagcagcggcgagccaa

SEQ ID NO: 3291889 - RNA, 22 nt, Mycobacterium tuberculosis H37Rv
agccagccaccggggaagaucu

SEQ ID NO: 3291890 - RNA, 15 nt, Mycobacterium tuberculosis H37Rv
agccagcgcagccag

SEQ ID NO: 3291891 - RNA, 15 nt, Mycobacterium tuberculosis H37Rv
agccagcggagcagc

SEQ ID NO: 3291892 - RNA, 13 nt, Mycobacterium tuberculosis H37Rv
agccagcgggcga

SEQ ID NO: 3291893 - RNA, 22 nt, Mycobacterium tuberculosis H37Rv
agccagcgggcgaugagcgcga

SEQ ID NO: 3291894 - RNA, 20 nt, Mycobacterium tuberculosis H37Rv
agccagcgguagcugcccag

SEQ ID NO: 3291895 - RNA, 22 nt, Mycobacterium tuberculosis H37Rv
agccagcgguagcugcccagcg

SEQ ID NO: 3291896 - RNA, 17 nt, Mycobacterium tuberculosis H37Rv
agccagcguccaugguc

SEQ ID NO: 3291897 - RNA, 22 nt, Mycobacterium tuberculosis H37Rv
agccagcugaacacgaauccgg

SEQ ID NO: 3291898 - RNA, 18 nt, Mycobacterium tuberculosis H37Rv
agccagcuugcgcaacgu

SEQ ID NO: 3291899 - RNA, 16 nt, Mycobacterium tuberculosis H37Rv
agccaggagccgauca

SEQ ID NO: 3291900 - RNA, 17 nt, Mycobacterium tuberculosis H37Rv
agccaggauugccgccg

SEQ ID NO: 3291901 - RNA, 16 nt, Mycobacterium tuberculosis H37Rv
agccaggcacguccga

SEQ ID NO: 3291902 - RNA, 19 nt, Mycobacterium tuberculosis H37Rv
agccaggccagugccaccu

SEQ ID NO: 3291903 - RNA, 13 nt, Mycobacterium tuberculosis H37Rv
agccaggccgcaa

SEQ ID NO: 3291904 - RNA, 17 nt, Mycobacterium tuberculosis H37Rv
agccaggcggcaaggac

SEQ ID NO: 3291905 - RNA, 22 nt, Mycobacterium tuberculosis H37Rv
agccaggucgauaccggcgugc

SEQ ID NO: 3291906 - RNA, 22 nt, Mycobacterium tuberculosis H37Rv
agccaguaaaaaggcaggacug

SEQ ID NO: 3291907 - RNA, 16 nt, Mycobacterium tuberculosis H37Rv
agccaguaccagguac

SEQ ID NO: 3291908 - RNA, 21 nt, Mycobacterium tuberculosis H37Rv
agccaguaccagguacgggag

SEQ ID NO: 3291909 - RNA, 10 nt, Mycobacterium tuberculosis H37Rv
agccagucca

SEQ ID NO: 3291910 - RNA, 20 nt, Mycobacterium tuberculosis H37Rv
agccaguguugcaguggcga

SEQ ID NO: 3291911 - RNA, 15 nt, Mycobacterium tuberculosis H37Rv
agccauacgcgcuga

SEQ ID NO: 3291912 - RNA, 19 nt, Mycobacterium tuberculosis H37Rv
agccaugccgcucggcaac

SEQ ID NO: 3291913 - RNA, 18 nt, Mycobacterium tuberculosis H37Rv
agccaugcugcucgagga

SEQ ID NO: 3291914 - RNA, 18 nt, Mycobacterium tuberculosis H37Rv
agccaugggauucggcca

SEQ ID NO: 3291915 - RNA, 19 nt, Mycobacterium tuberculosis H37Rv
agccauucaaguucgccga

SEQ ID NO: 3291916 - RNA, 17 nt, Mycobacterium tuberculosis H37Rv
agccauuuccuuggcgc

SEQ ID NO: 3291917 - RNA, 18 nt, Mycobacterium tuberculosis H37Rv
agcccaaaaagaccgccg

SEQ ID NO: 3291918 - RNA, 16 nt, Mycobacterium tuberculosis H37Rv
agcccaaaucccagag

SEQ ID NO: 3291919 - RNA, 20 nt, Mycobacterium tuberculosis H37Rv
agcccaaaucccagagcauc

SEQ ID NO: 3291920 - RNA, 18 nt, Mycobacterium tuberculosis H37Rv
agcccacccauggccucc

SEQ ID NO: 3291921 - RNA, 20 nt, Mycobacterium tuberculosis H37Rv
agcccacccauggccuccca

SEQ ID NO: 3291922 - RNA, 12 nt, Mycobacterium tuberculosis H37Rv
agcccaccgucg

SEQ ID NO: 3291923 - RNA, 17 nt, Mycobacterium tuberculosis H37Rv
agcccacgacgaagucg

SEQ ID NO: 3291924 - RNA, 14 nt, Mycobacterium tuberculosis H37Rv
agcccagaucuugc

SEQ ID NO: 3291925 - RNA, 22 nt, Mycobacterium tuberculosis H37Rv
agcccagcagguuccacggcca

SEQ ID NO: 3291926 - RNA, 14 nt, Mycobacterium tuberculosis H37Rv
agcccagccgggca

SEQ ID NO: 3291927 - RNA, 13 nt, Mycobacterium tuberculosis H37Rv
agcccagcugcgc

SEQ ID NO: 3291928 - RNA, 15 nt, Mycobacterium tuberculosis H37Rv
agcccaggacggcua

SEQ ID NO: 3291929 - RNA, 16 nt, Mycobacterium tuberculosis H37Rv
agcccaucggcagcag

SEQ ID NO: 3291930 - RNA, 18 nt, Mycobacterium tuberculosis H37Rv
agcccaucuaccagcuca

SEQ ID NO: 3291931 - RNA, 19 nt, Mycobacterium tuberculosis H37Rv
agcccaugccgaugcccau

SEQ ID NO: 3291932 - RNA, 17 nt, Mycobacterium tuberculosis H37Rv
agcccaugucgagcacg

SEQ ID NO: 3291933 - RNA, 16 nt, Mycobacterium tuberculosis H37Rv
agccccagcgacgucg

SEQ ID NO: 3291934 - RNA, 17 nt, Mycobacterium tuberculosis H37Rv
agccccagcguucccgc

SEQ ID NO: 3291935 - RNA, 14 nt, Mycobacterium tuberculosis H37Rv
agccccccgagccc

SEQ ID NO: 3291936 - RNA, 18 nt, Mycobacterium tuberculosis H37Rv
agcccccgacacgccgug

SEQ ID NO: 3291937 - RNA, 14 nt, Mycobacterium tuberculosis H37Rv
agccccgaagccgg

SEQ ID NO: 3291938 - RNA, 15 nt, Mycobacterium tuberculosis H37Rv
agccccgaccagcag

SEQ ID NO: 3291939 - RNA, 16 nt, Mycobacterium tuberculosis H37Rv
agccccgaccagcaga

SEQ ID NO: 3291940 - RNA, 19 nt, Mycobacterium tuberculosis H37Rv
agccccgcgcccaccccgg

SEQ ID NO: 3291941 - RNA, 15 nt, Mycobacterium tuberculosis H37Rv
agccccgcuggucga

SEQ ID NO: 3291942 - RNA, 14 nt, Mycobacterium tuberculosis H37Rv
agccccgucgaccu

SEQ ID NO: 3291943 - RNA, 17 nt, Mycobacterium tuberculosis H37Rv
agccccguuucgccaga

SEQ ID NO: 3291944 - RNA, 12 nt, Mycobacterium tuberculosis H37Rv
agccccucaccu

SEQ ID NO: 3291945 - RNA, 18 nt, Mycobacterium tuberculosis H37Rv
agccccucaccucggcuu

SEQ ID NO: 3291946 - RNA, 17 nt, Mycobacterium tuberculosis H37Rv
agccccuccgcgccgau

SEQ ID NO: 3291947 - RNA, 21 nt, Mycobacterium tuberculosis H37Rv
agccccugaaggccagccaac

SEQ ID NO: 3291948 - RNA, 12 nt, Mycobacterium tuberculosis H37Rv
agccccugccga

SEQ ID NO: 3291949 - RNA, 16 nt, Mycobacterium tuberculosis H37Rv
agcccgacagcagguu

SEQ ID NO: 3291950 - RNA, 15 nt, Mycobacterium tuberculosis H37Rv
agcccgagcgcuuga

SEQ ID NO: 3291951 - RNA, 20 nt, Mycobacterium tuberculosis H37Rv
agccgaucggugccagaaug

SEQ ID NO: 3291952 - RNA, 20 nt, Mycobacterium tuberculosis H37Rv
agccgaugcucgucccagaa

SEQ ID NO: 3291953 - RNA, 18 nt, Mycobacterium tuberculosis H37Rv
agccgauguccgacgcca

SEQ ID NO: 3291954 - RNA, 23 nt, Mycobacterium tuberculosis H37Rv
agccgauuuuuccacaccagcuu

SEQ ID NO: 3291955 - RNA, 18 nt, Mycobacterium tuberculosis H37Rv
agccgcaccagaucgucg

SEQ ID NO: 3291956 - RNA, 20 nt, Mycobacterium tuberculosis H37Rv
agccgcaccaguggcgccca

SEQ ID NO: 3291957 - RNA, 21 nt, Mycobacterium tuberculosis H37Rv
agccgcaccaguggcgcccau

SEQ ID NO: 3291958 - RNA, 19 nt, Mycobacterium tuberculosis H37Rv
agccgcaccccgcccgacg

SEQ ID NO: 3291959 - RNA, 13 nt, Mycobacterium tuberculosis H37Rv
agccgcacgaugc

SEQ ID NO: 3291960 - RNA, 13 nt, Mycobacterium tuberculosis H37Rv
agccgcagaugca

SEQ ID NO: 3291961 - RNA, 12 nt, Mycobacterium tuberculosis H37Rv
agccgcagcacc

SEQ ID NO: 3291962 - RNA, 13 nt, Mycobacterium tuberculosis H37Rv
agccgcagcaccu

SEQ ID NO: 3291963 - RNA, 19 nt, Mycobacterium tuberculosis H37Rv
agccgcagcaccucgucga

SEQ ID NO: 3291964 - RNA, 23 nt, Mycobacterium tuberculosis H37Rv
agccgcagcaccucgucgaucgc

SEQ ID NO: 3291965 - RNA, 22 nt, Mycobacterium tuberculosis H37Rv
agccgcagcccgugacugguga

SEQ ID NO: 3291966 - RNA, 16 nt, Mycobacterium tuberculosis H37Rv
agccgcagcuuggccu

SEQ ID NO: 3291967 - RNA, 21 nt, Mycobacterium tuberculosis H37Rv
agccgcagcuuggccucagcc

SEQ ID NO: 3291968 - RNA, 18 nt, Mycobacterium tuberculosis H37Rv
agccgcauaggccccgcc

SEQ ID NO: 3291969 - RNA, 22 nt, Mycobacterium tuberculosis H37Rv
agccgcauaggccccgccagcg

SEQ ID NO: 3291970 - RNA, 16 nt, Mycobacterium tuberculosis H37Rv
agccgccagcccguca

SEQ ID NO: 3291971 - RNA, 12 nt, Mycobacterium tuberculosis H37Rv
agccgccaggac

SEQ ID NO: 3291972 - RNA, 20 nt, Mycobacterium tuberculosis H37Rv
agccgccaggugcucgucga

SEQ ID NO: 3291973 - RNA, 23 nt, Mycobacterium tuberculosis H37Rv
agccgcccgcccaccucgaucgc

SEQ ID NO: 3291974 - RNA, 16 nt, Mycobacterium tuberculosis H37Rv
agccgcccgcccggac

SEQ ID NO: 3291975 - RNA, 13 nt, Mycobacterium tuberculosis H37Rv
agccgcccuugcc

SEQ ID NO: 3291976 - RNA, 19 nt, Mycobacterium tuberculosis H37Rv
agccgccgacuuccgcguc

SEQ ID NO: 3291977 - RNA, 13 nt, Mycobacterium tuberculosis H37Rv
agccgccgcgacg

SEQ ID NO: 3291978 - RNA, 13 nt, Mycobacterium tuberculosis H37Rv
agccgccggacga

SEQ ID NO: 3291979 - RNA, 13 nt, Mycobacterium tuberculosis H37Rv
agccgccggcccc

SEQ ID NO: 3291980 - RNA, 17 nt, Mycobacterium tuberculosis H37Rv
agccgccggugccgccg

SEQ ID NO: 3291981 - RNA, 23 nt, Mycobacterium tuberculosis H37Rv
agccgccuaggacuucggugagc

SEQ ID NO: 3291982 - RNA, 17 nt, Mycobacterium tuberculosis H37Rv
agccgcgaaaucaccgc

SEQ ID NO: 3291983 - RNA, 19 nt, Mycobacterium tuberculosis H37Rv
agccgcgaaaucaccgcug

SEQ ID NO: 3291984 - RNA, 15 nt, Mycobacterium tuberculosis H37Rv
agccgcgacauccgc

SEQ ID NO: 3291985 - RNA, 17 nt, Mycobacterium tuberculosis H37Rv
agccgcgaccagaggcg

SEQ ID NO: 3291986 - RNA, 17 nt, Mycobacterium tuberculosis H37Rv
agccgcgacgcggcguc

SEQ ID NO: 3291987 - RNA, 20 nt, Mycobacterium tuberculosis H37Rv
agccgcgaguccaggcugau

SEQ ID NO: 3291988 - RNA, 16 nt, Mycobacterium tuberculosis H37Rv
agccgcgcaucugucg

SEQ ID NO: 3291989 - RNA, 23 nt, Mycobacterium tuberculosis H37Rv
agccgcgccgaccucaucggcac

SEQ ID NO: 3291990 - RNA, 19 nt, Mycobacterium tuberculosis H37Rv
agccgcgcgccaucgccuc

SEQ ID NO: 3291991 - RNA, 22 nt, Mycobacterium tuberculosis H37Rv
agccgcgcgggucacgaccugc

SEQ ID NO: 3291992 - RNA, 19 nt, Mycobacterium tuberculosis H37Rv
agccgcgcguccgggcagc

SEQ ID NO: 3291993 - RNA, 19 nt, Mycobacterium tuberculosis H37Rv
agccgcggcaccgccgagc

SEQ ID NO: 3291994 - RNA, 15 nt, Mycobacterium tuberculosis H37Rv
agccgcggccacaau

SEQ ID NO: 3291995 - RNA, 13 nt, Mycobacterium tuberculosis H37Rv
agccgcggccacg

SEQ ID NO: 3291996 - RNA, 17 nt, Mycobacterium tuberculosis H37Rv
agccgcggcccucgaug

SEQ ID NO: 3291997 - RNA, 20 nt, Mycobacterium tuberculosis H37Rv
agccgcggcggcagcaccca

SEQ ID NO: 3291998 - RNA, 21 nt, Mycobacterium tuberculosis H37Rv
agccgcggcuaggccagcacg

SEQ ID NO: 3291999 - RNA, 24 nt, Mycobacterium tuberculosis H37Rv
agccgcggcuaggccagcacggcg

SEQ ID NO: 3292000 - RNA, 17 nt, Mycobacterium tuberculosis H37Rv
agccgcgggcaccuucc

SEQ ID NO: 3292001 - RNA, 22 nt, Mycobacterium tuberculosis H37Rv
agccgcggggcccacaccgagu

SEQ ID NO: 3292002 - RNA, 22 nt, Mycobacterium tuberculosis H37Rv
agccgcggggcgaaguggaucu

SEQ ID NO: 3292003 - RNA, 23 nt, Mycobacterium tuberculosis H37Rv
agccgcggucggcgugcaggguc

SEQ ID NO: 3292004 - RNA, 18 nt, Mycobacterium tuberculosis H37Rv
agccgcguucgcgcaaau

SEQ ID NO: 3292005 - RNA, 21 nt, Mycobacterium tuberculosis H37Rv
agccgcuacguuacgccgaga

SEQ ID NO: 3292006 - RNA, 20 nt, Mycobacterium tuberculosis H37Rv
agccgcuaggaucggauggc

SEQ ID NO: 3292007 - RNA, 16 nt, Mycobacterium tuberculosis H37Rv
agccgcuccgcccauu

SEQ ID NO: 3292008 - RNA, 14 nt, Mycobacterium tuberculosis H37Rv
agccgcucggcgua

SEQ ID NO: 3292009 - RNA, 16 nt, Mycobacterium tuberculosis H37Rv
agccgcugaucgccga

SEQ ID NO: 3292010 - RNA, 18 nt, Mycobacterium tuberculosis H37Rv
agccgcugaucgccgaca

SEQ ID NO: 3292011 - RNA, 17 nt, Mycobacterium tuberculosis H37Rv
agccgcugaucugccgc

SEQ ID NO: 3292012 - RNA, 11 nt, Mycobacterium tuberculosis H37Rv
agccgcugcac

SEQ ID NO: 3292013 - RNA, 17 nt, Mycobacterium tuberculosis H37Rv
agccgcugcacguggcc

SEQ ID NO: 3292014 - RNA, 23 nt, Mycobacterium tuberculosis H37Rv
agccgcugcacguggccacggca

SEQ ID NO: 3292015 - RNA, 13 nt, Mycobacterium tuberculosis H37Rv
agccgcugccaca

SEQ ID NO: 3292016 - RNA, 21 nt, Mycobacterium tuberculosis H37Rv
agccgcuggaagucggucugc

SEQ ID NO: 3292017 - RNA, 18 nt, Mycobacterium tuberculosis H37Rv
agccgcuuucccggcugg

SEQ ID NO: 3292018 - RNA, 22 nt, Mycobacterium tuberculosis H37Rv
agccggacagaucaacgcgaac

SEQ ID NO: 3292019 - RNA, 17 nt, Mycobacterium tuberculosis H37Rv
agccggacguucuggau

SEQ ID NO: 3292020 - RNA, 22 nt, Mycobacterium tuberculosis H37Rv
agccggaugcgcuuccaucgcc

SEQ ID NO: 3292021 - RNA, 21 nt, Mycobacterium tuberculosis H37Rv
agccggaugcggccgaacucg

SEQ ID NO: 3292022 - RNA, 22 nt, Mycobacterium tuberculosis H37Rv
agccggauucggcugccaccgc

SEQ ID NO: 3292023 - RNA, 15 nt, Mycobacterium tuberculosis H37Rv
agccggcagcagcgg

SEQ ID NO: 3292024 - RNA, 21 nt, Mycobacterium tuberculosis H37Rv
agccggccaauggccugcagc

SEQ ID NO: 3292025 - RNA, 14 nt, Mycobacterium tuberculosis H37Rv
agccggccacuacg

SEQ ID NO: 3292026 - RNA, 22 nt, Mycobacterium tuberculosis H37Rv
agccggccacuacggccuggcc

SEQ ID NO: 3292027 - RNA, 18 nt, Mycobacterium tuberculosis H37Rv
agccggccgcgaccgcga

SEQ ID NO: 3292028 - RNA, 12 nt, Mycobacterium tuberculosis H37Rv
agccggccgcuu

SEQ ID NO: 3292029 - RNA, 17 nt, Mycobacterium tuberculosis H37Rv
agccggccgcuuggccg

SEQ ID NO: 3292030 - RNA, 14 nt, Mycobacterium tuberculosis H37Rv
agccggccgugaug

SEQ ID NO: 3292031 - RNA, 14 nt, Mycobacterium tuberculosis H37Rv
agccggcgaagugc

SEQ ID NO: 3292032 - RNA, 17 nt, Mycobacterium tuberculosis H37Rv
agccggcgacaccgcag

SEQ ID NO: 3292033 - RNA, 19 nt, Mycobacterium tuberculosis H37Rv
agccggcgcgccccaccgc

SEQ ID NO: 3292034 - RNA, 19 nt, Mycobacterium tuberculosis H37Rv
agccggcgcgccggaugua

SEQ ID NO: 3292035 - RNA, 13 nt, Mycobacterium tuberculosis H37Rv
agccggcgguggg

SEQ ID NO: 3292036 - RNA, 14 nt, Mycobacterium tuberculosis H37Rv
agccggcgugcacu

SEQ ID NO: 3292037 - RNA, 15 nt, Mycobacterium tuberculosis H37Rv
agccggcgugcacuc

SEQ ID NO: 3292038 - RNA, 17 nt, Mycobacterium tuberculosis H37Rv
agccggcucaucgcagc

SEQ ID NO: 3292039 - RNA, 23 nt, Mycobacterium tuberculosis H37Rv
agccggcucaucgcagccggucc

SEQ ID NO: 3292040 - RNA, 20 nt, Mycobacterium tuberculosis H37Rv
agccggcugcauccuccucg

SEQ ID NO: 3292041 - RNA, 22 nt, Mycobacterium tuberculosis H37Rv
agccggcugcauccuccucguc

SEQ ID NO: 3292042 - RNA, 23 nt, Mycobacterium tuberculosis H37Rv
agccgggagucgucggcaugggc

SEQ ID NO: 3292043 - RNA, 22 nt, Mycobacterium tuberculosis H37Rv
agccgggcaaccagcagcaggu

SEQ ID NO: 3292044 - RNA, 12 nt, Mycobacterium tuberculosis H37Rv
agccgggcccca

SEQ ID NO: 3292045 - RNA, 15 nt, Mycobacterium tuberculosis H37Rv
agccgggcggccucg

SEQ ID NO: 3292046 - RNA, 23 nt, Mycobacterium tuberculosis H37Rv
agcgaccgucccagcgccgcagu

SEQ ID NO: 3292047 - RNA, 21 nt, Mycobacterium tuberculosis H37Rv
agcgaccucacugcggcgcca

SEQ ID NO: 3292048 - RNA, 22 nt, Mycobacterium tuberculosis H37Rv
agcgaccucacugcggcgccau

SEQ ID NO: 3292049 - RNA, 15 nt, Mycobacterium tuberculosis H37Rv
agcgaccuggguuuc

SEQ ID NO: 3292050 - RNA, 14 nt, Mycobacterium tuberculosis H37Rv
agcgacgagcagca

SEQ ID NO: 3292051 - RNA, 15 nt, Mycobacterium tuberculosis H37Rv
agcgacgagcagcaa

SEQ ID NO: 3292052 - RNA, 15 nt, Mycobacterium tuberculosis H37Rv
agcgacgcacgcagu

SEQ ID NO: 3292053 - RNA, 19 nt, Mycobacterium tuberculosis H37Rv
agcgacgcauaaccggcgc

SEQ ID NO: 3292054 - RNA, 23 nt, Mycobacterium tuberculosis H37Rv
agcgacgcauaaccggcgcgccc

SEQ ID NO: 3292055 - RNA, 16 nt, Mycobacterium tuberculosis H37Rv
agcgacgcggccagcg

SEQ ID NO: 3292056 - RNA, 12 nt, Mycobacterium tuberculosis H37Rv
agcgacggcaaa

SEQ ID NO: 3292057 - RNA, 22 nt, Mycobacterium tuberculosis H37Rv
agcgacgguaccccaacgaccg

SEQ ID NO: 3292058 - RNA, 17 nt, Mycobacterium tuberculosis H37Rv
agcgacuccagcgcccg

SEQ ID NO: 3292059 - RNA, 18 nt, Mycobacterium tuberculosis H37Rv
agcgacuccagcgcccgg

SEQ ID NO: 3292060 - RNA, 17 nt, Mycobacterium tuberculosis H37Rv
agcgacucgccggcgaa

SEQ ID NO: 3292061 - RNA, 15 nt, Mycobacterium tuberculosis H37Rv
agcgacuugcggugc

SEQ ID NO: 3292062 - RNA, 16 nt, Mycobacterium tuberculosis H37Rv
agcgagaaucacgguc

SEQ ID NO: 3292063 - RNA, 15 nt, Mycobacterium tuberculosis H37Rv
agcgagcaccgcggu

SEQ ID NO: 3292064 - RNA, 14 nt, Mycobacterium tuberculosis H37Rv
agcgagcccagcug

SEQ ID NO: 3292065 - RNA, 20 nt, Mycobacterium tuberculosis H37Rv
agcgagcccagcugcgccga

SEQ ID NO: 3292066 - RNA, 20 nt, Mycobacterium tuberculosis H37Rv
agcgagcgcaaaucgauugc

SEQ ID NO: 3292067 - RNA, 12 nt, Mycobacterium tuberculosis H37Rv
agcgagcgcaca

SEQ ID NO: 3292068 - RNA, 22 nt, Mycobacterium tuberculosis H37Rv
agcgagcgcgcguagcggggga

SEQ ID NO: 3292069 - RNA, 20 nt, Mycobacterium tuberculosis H37Rv
agcgagcucagcgaugcggc

SEQ ID NO: 3292070 - RNA, 19 nt, Mycobacterium tuberculosis H37Rv
agcgaggaauuccgcuacc

SEQ ID NO: 3292071 - RNA, 12 nt, Mycobacterium tuberculosis H37Rv
agcgaggccagc

SEQ ID NO: 3292072 - RNA, 13 nt, Mycobacterium tuberculosis H37Rv
agcgaggccagcg

SEQ ID NO: 3292073 - RNA, 21 nt, Mycobacterium tuberculosis H37Rv
agcgaggugauggucgucauc

SEQ ID NO: 3292074 - RNA, 16 nt, Mycobacterium tuberculosis H37Rv
agcgagucgaacccgc

SEQ ID NO: 3292075 - RNA, 22 nt, Mycobacterium tuberculosis H37Rv
agcgagucgacgaacgccucac

SEQ ID NO: 3292076 - RNA, 15 nt, Mycobacterium tuberculosis H37Rv
agcgagucgacgucg

SEQ ID NO: 3292077 - RNA, 20 nt, Mycobacterium tuberculosis H37Rv
agcgagucgacgucgaucac

SEQ ID NO: 3292078 - RNA, 16 nt, Mycobacterium tuberculosis H37Rv
agcgauccucgccggg

SEQ ID NO: 3292079 - RNA, 12 nt, Mycobacterium tuberculosis H37Rv
agcgaucgccgg

SEQ ID NO: 3292080 - RNA, 13 nt, Mycobacterium tuberculosis H37Rv
agcgaucggggcg

SEQ ID NO: 3292081 - RNA, 19 nt, Mycobacterium tuberculosis H37Rv
agcgaucgugcugcccgca

SEQ ID NO: 3292082 - RNA, 20 nt, Mycobacterium tuberculosis H37Rv
agcgaucgugcugcccgcaa

SEQ ID NO: 3292083 - RNA, 17 nt, Mycobacterium tuberculosis H37Rv
agcgaucuugguggccu

SEQ ID NO: 3292084 - RNA, 21 nt, Mycobacterium tuberculosis H37Rv
agcgaucuugguggccucauc

SEQ ID NO: 3292085 - RNA, 21 nt, Mycobacterium tuberculosis H37Rv
agcgaugcaccccaugaccgg

SEQ ID NO: 3292086 - RNA, 18 nt, Mycobacterium tuberculosis H37Rv
agcgaugcggugucgggc

SEQ ID NO: 3292087 - RNA, 24 nt, Mycobacterium tuberculosis H37Rv
agcgaugucccaucgcgucggcga

SEQ ID NO: 3292088 - RNA, 15 nt, Mycobacterium tuberculosis H37Rv
agcgauuccacggca

SEQ ID NO: 3292089 - RNA, 17 nt, Mycobacterium tuberculosis H37Rv
agcgauuccacggcagc

SEQ ID NO: 3292090 - RNA, 22 nt, Mycobacterium tuberculosis H37Rv
agcgauuccacggcagcaccgg

SEQ ID NO: 3292091 - RNA, 21 nt, Mycobacterium tuberculosis H37Rv
agcgauuccaggauggccauc

SEQ ID NO: 3292092 - RNA, 24 nt, Mycobacterium tuberculosis H37Rv
agcgauucugggcuucaucggcga

SEQ ID NO: 3292093 - RNA, 17 nt, Mycobacterium tuberculosis H37Rv
agcgcaaagcccuccuc

SEQ ID NO: 3292094 - RNA, 15 nt, Mycobacterium tuberculosis H37Rv
agcgcaaaugcgggc

SEQ ID NO: 3292095 - RNA, 12 nt, Mycobacterium tuberculosis H37Rv
agcgcaacaucg

SEQ ID NO: 3292096 - RNA, 18 nt, Mycobacterium tuberculosis H37Rv
agcgcaacccguuguggc

SEQ ID NO: 3292097 - RNA, 15 nt, Mycobacterium tuberculosis H37Rv
agcgcaaccgaccgg

SEQ ID NO: 3292098 - RNA, 13 nt, Mycobacterium tuberculosis H37Rv
agcgcaaccgcgc

SEQ ID NO: 3292099 - RNA, 17 nt, Mycobacterium tuberculosis H37Rv
agcgcaaccuccgcgag

SEQ ID NO: 3292100 - RNA, 20 nt, Mycobacterium tuberculosis H37Rv
agcgcaaccuccgcgagcag

SEQ ID NO: 3292101 - RNA, 15 nt, Mycobacterium tuberculosis H37Rv
agcgcaacggccagc

SEQ ID NO: 3292102 - RNA, 16 nt, Mycobacterium tuberculosis H37Rv
agcgcaacggccagcg

SEQ ID NO: 3292103 - RNA, 14 nt, Mycobacterium tuberculosis H37Rv
agcgcaagguugcc

SEQ ID NO: 3292104 - RNA, 22 nt, Mycobacterium tuberculosis H37Rv
agcgcaagguugccaacgccuu

SEQ ID NO: 3292105 - RNA, 12 nt, Mycobacterium tuberculosis H37Rv
agcgcaaugcgc

SEQ ID NO: 3292106 - RNA, 20 nt, Mycobacterium tuberculosis H37Rv
agcgcaaugcgcgacgguca

SEQ ID NO: 3292107 - RNA, 21 nt, Mycobacterium tuberculosis H37Rv
agcgcaccacggcggucaacg

SEQ ID NO: 3292108 - RNA, 12 nt, Mycobacterium tuberculosis H37Rv
agcgcaccgcga

SEQ ID NO: 3292109 - RNA, 14 nt, Mycobacterium tuberculosis H37Rv
agcgcaccgcgaaa

SEQ ID NO: 3292110 - RNA, 19 nt, Mycobacterium tuberculosis H37Rv
agcgcaccgcugaccgcaa

SEQ ID NO: 3292111 - RNA, 21 nt, Mycobacterium tuberculosis H37Rv
agcgcacgauagccaccgacg

SEQ ID NO: 3292112 - RNA, 14 nt, Mycobacterium tuberculosis H37Rv
agcgcacgcagccg

SEQ ID NO: 3292113 - RNA, 16 nt, Mycobacterium tuberculosis H37Rv
agcgcacgcagccgau

SEQ ID NO: 3292114 - RNA, 21 nt, Mycobacterium tuberculosis H37Rv
agcgcacgcugaguccccagg

SEQ ID NO: 3292115 - RNA, 15 nt, Mycobacterium tuberculosis H37Rv
agcgcacugccgggu

SEQ ID NO: 3292116 - RNA, 13 nt, Mycobacterium tuberculosis H37Rv
agcgcacugggga

SEQ ID NO: 3292117 - RNA, 21 nt, Mycobacterium tuberculosis H37Rv
agcgcagcaacugggcggccu

SEQ ID NO: 3292118 - RNA, 15 nt, Mycobacterium tuberculosis H37Rv
agcgcagcagcggca

SEQ ID NO: 3292119 - RNA, 18 nt, Mycobacterium tuberculosis H37Rv
agcgcagcaucgucgcca

SEQ ID NO: 3292120 - RNA, 21 nt, Mycobacterium tuberculosis H37Rv
agcgcagcaucgucgccacga

SEQ ID NO: 3292121 - RNA, 23 nt, Mycobacterium tuberculosis H37Rv
agcgcagcaucgucgccacgaug

SEQ ID NO: 3292122 - RNA, 21 nt, Mycobacterium tuberculosis H37Rv
agcgcagcauugaccaaucca

SEQ ID NO: 3292123 - RNA, 16 nt, Mycobacterium tuberculosis H37Rv
agcgcagcgccggcag

SEQ ID NO: 3292124 - RNA, 15 nt, Mycobacterium tuberculosis H37Rv
agcgcagcgccuccu

SEQ ID NO: 3292125 - RNA, 12 nt, Mycobacterium tuberculosis H37Rv
agcgcagcgugu

SEQ ID NO: 3292126 - RNA, 21 nt, Mycobacterium tuberculosis H37Rv
agcgcagcguguugagggcug

SEQ ID NO: 3292127 - RNA, 19 nt, Mycobacterium tuberculosis H37Rv
agcgcaucagggugggcga

SEQ ID NO: 3292128 - RNA, 18 nt, Mycobacterium tuberculosis H37Rv
agcgcauccacaaucaca

SEQ ID NO: 3292129 - RNA, 14 nt, Mycobacterium tuberculosis H37Rv
agcgcaucgagcac

SEQ ID NO: 3292130 - RNA, 16 nt, Mycobacterium tuberculosis H37Rv
agcgcaucgagcccgg

SEQ ID NO: 3292131 - RNA, 17 nt, Mycobacterium tuberculosis H37Rv
agcgcaucgagcccgga

SEQ ID NO: 3292132 - RNA, 15 nt, Mycobacterium tuberculosis H37Rv
agcgcaucgcacagc

SEQ ID NO: 3292133 - RNA, 18 nt, Mycobacterium tuberculosis H37Rv
agcgcaucgcacagcgcc

SEQ ID NO: 3292134 - RNA, 12 nt, Mycobacterium tuberculosis H37Rv
agcgcaucgcca

SEQ ID NO: 3292135 - RNA, 21 nt, Mycobacterium tuberculosis H37Rv
agcgcaucgccgcuggccagc

SEQ ID NO: 3292136 - RNA, 22 nt, Mycobacterium tuberculosis H37Rv
agcgcaucgccgcuggccagca

SEQ ID NO: 3292137 - RNA, 13 nt, Mycobacterium tuberculosis H37Rv
agcgcaucggcca

SEQ ID NO: 3292138 - RNA, 18 nt, Mycobacterium tuberculosis H37Rv
agcgcaucggccagcagc

SEQ ID NO: 3292139 - RNA, 19 nt, Mycobacterium tuberculosis H37Rv
agcgcaucggucaccaacu

SEQ ID NO: 3292140 - RNA, 19 nt, Mycobacterium tuberculosis H37Rv
agcgcaucguugccgcaga

SEQ ID NO: 3292141 - RNA, 16 nt, Mycobacterium tuberculosis H37Rv
agcgcauguugcaggc

SEQ ID NO: 3292142 - RNA, 12 nt, Mycobacterium tuberculosis H37Rv
agcgcgaucacc

SEQ ID NO: 3292143 - RNA, 19 nt, Mycobacterium tuberculosis H37Rv
agcgcgaucgauuccgcuc

SEQ ID NO: 3292144 - RNA, 17 nt, Mycobacterium tuberculosis H37Rv
agcgcgaucgcggucaa

SEQ ID NO: 3292145 - RNA, 22 nt, Mycobacterium tuberculosis H37Rv
agcgcgaucgggccggcgcggu

SEQ ID NO: 3292146 - RNA, 21 nt, Mycobacterium tuberculosis H37Rv
agcgcgaucugcucgccccau

SEQ ID NO: 3292147 - RNA, 14 nt, Mycobacterium tuberculosis H37Rv
agcgcgaugaccuc

SEQ ID NO: 3292148 - RNA, 16 nt, Mycobacterium tuberculosis H37Rv
agcgcgaugcagugcg

SEQ ID NO: 3292149 - RNA, 13 nt, Mycobacterium tuberculosis H37Rv
agcgcgcaacgua

SEQ ID NO: 3292150 - RNA, 21 nt, Mycobacterium tuberculosis H37Rv
agcgcgcaacguacgcacgca

SEQ ID NO: 3292151 - RNA, 18 nt, Mycobacterium tuberculosis H37Rv
agcgcgcauagggcuggu

SEQ ID NO: 3292152 - RNA, 15 nt, Mycobacterium tuberculosis H37Rv
agcgcgccaaucgcc

SEQ ID NO: 3292153 - RNA, 16 nt, Mycobacterium tuberculosis H37Rv
agcgcgccaaucgccc

SEQ ID NO: 3292154 - RNA, 19 nt, Mycobacterium tuberculosis H37Rv
agcgcgccaaucgcccagu

SEQ ID NO: 3292155 - RNA, 17 nt, Mycobacterium tuberculosis H37Rv
agcgcgccacccagcac

SEQ ID NO: 3292156 - RNA, 12 nt, Mycobacterium tuberculosis H37Rv
agcgcgccacga

SEQ ID NO: 3292157 - RNA, 13 nt, Mycobacterium tuberculosis H37Rv
agcgcgccacgag

SEQ ID NO: 3292158 - RNA, 14 nt, Mycobacterium tuberculosis H37Rv
agcgcgccggccau

SEQ ID NO: 3292159 - RNA, 14 nt, Mycobacterium tuberculosis H37Rv
agcgcgccggcguc

SEQ ID NO: 3292160 - RNA, 20 nt, Mycobacterium tuberculosis H37Rv
agcgcgccucgcccagcaag

SEQ ID NO: 3292161 - RNA, 22 nt, Mycobacterium tuberculosis H37Rv
agcgcgcgcaguuguacggcac

SEQ ID NO: 3292162 - RNA, 14 nt, Mycobacterium tuberculosis H37Rv
agcgcgcgccgcag

SEQ ID NO: 3292163 - RNA, 19 nt, Mycobacterium tuberculosis H37Rv
agcgcgcgccgcuggguga

SEQ ID NO: 3292164 - RNA, 20 nt, Mycobacterium tuberculosis H37Rv
agcgcgcgcgggugcaaccg

SEQ ID NO: 3292165 - RNA, 20 nt, Mycobacterium tuberculosis H37Rv
agcgcgcgcucgggcccagc

SEQ ID NO: 3292166 - RNA, 18 nt, Mycobacterium tuberculosis H37Rv
agcgcgcguagcggggga

SEQ ID NO: 3292167 - RNA, 22 nt, Mycobacterium tuberculosis H37Rv
agcgcgcuacagcaucaaccgu

SEQ ID NO: 3292168 - RNA, 16 nt, Mycobacterium tuberculosis H37Rv
agcgcgcuacgcggcc

SEQ ID NO: 3292169 - RNA, 19 nt, Mycobacterium tuberculosis H37Rv
agcgcgcuggccagcccgg

SEQ ID NO: 3292170 - RNA, 22 nt, Mycobacterium tuberculosis H37Rv
agcgcgcuggcuacccaccggc

SEQ ID NO: 3292171 - RNA, 18 nt, Mycobacterium tuberculosis H37Rv
agcgcggagacgaugccg

SEQ ID NO: 3292172 - RNA, 18 nt, Mycobacterium tuberculosis H37Rv
agcgcggaugucggcauc

SEQ ID NO: 3292173 - RNA, 21 nt, Mycobacterium tuberculosis H37Rv
agcgcggcaaaguuggccgcc

SEQ ID NO: 3292174 - RNA, 21 nt, Mycobacterium tuberculosis H37Rv
agcgcggccaccagaucgcac

SEQ ID NO: 3292175 - RNA, 14 nt, Mycobacterium tuberculosis H37Rv
agcgcggccacccg

SEQ ID NO: 3292176 - RNA, 22 nt, Mycobacterium tuberculosis H37Rv
agcgcggccacgccgaucaaca

SEQ ID NO: 3292177 - RNA, 19 nt, Mycobacterium tuberculosis H37Rv
agcgcggccagugcucgca

SEQ ID NO: 3292178 - RNA, 15 nt, Mycobacterium tuberculosis H37Rv
agcgcggccgauacg

SEQ ID NO: 3292179 - RNA, 16 nt, Mycobacterium tuberculosis H37Rv
agcgcggcgaagccgg

SEQ ID NO: 3292180 - RNA, 19 nt, Mycobacterium tuberculosis H37Rv
agcgcggcgacggcgguca

SEQ ID NO: 3292181 - RNA, 16 nt, Mycobacterium tuberculosis H37Rv
agcgcggcgcgacaga

SEQ ID NO: 3292182 - RNA, 21 nt, Mycobacterium tuberculosis H37Rv
agcgcggcgucuagcccgcca

SEQ ID NO: 3292183 - RNA, 18 nt, Mycobacterium tuberculosis H37Rv
agcgcggcguguacgucg

SEQ ID NO: 3292184 - RNA, 17 nt, Mycobacterium tuberculosis H37Rv
agcgcggcuacggucgc

SEQ ID NO: 3292185 - RNA, 14 nt, Mycobacterium tuberculosis H37Rv
agcgcgggcucaca

SEQ ID NO: 3292186 - RNA, 19 nt, Mycobacterium tuberculosis H37Rv
agcgcggguggcagcggcg

SEQ ID NO: 3292187 - RNA, 16 nt, Mycobacterium tuberculosis H37Rv
agcgcggugccgccac

SEQ ID NO: 3292188 - RNA, 22 nt, Mycobacterium tuberculosis H37Rv
agcgcgguggucgcgaccgacc

SEQ ID NO: 3292189 - RNA, 18 nt, Mycobacterium tuberculosis H37Rv
agcgcguaguccgcaucc

SEQ ID NO: 3292190 - RNA, 19 nt, Mycobacterium tuberculosis H37Rv
agcgcguauggcucacccc

SEQ ID NO: 3292191 - RNA, 14 nt, Mycobacterium tuberculosis H37Rv
agcgcgucgccguc

SEQ ID NO: 3292192 - RNA, 16 nt, Mycobacterium tuberculosis H37Rv
agcgcgucgccgucga

SEQ ID NO: 3292193 - RNA, 18 nt, Mycobacterium tuberculosis H37Rv
agcgcgucgccgucgaug

SEQ ID NO: 3292194 - RNA, 15 nt, Mycobacterium tuberculosis H37Rv
agcgcgucggucacc

SEQ ID NO: 3292195 - RNA, 17 nt, Mycobacterium tuberculosis H37Rv
agcgcgucggucaccga

SEQ ID NO: 3292196 - RNA, 15 nt, Mycobacterium tuberculosis H37Rv
agcgcgucucguuga

SEQ ID NO: 3292197 - RNA, 18 nt, Mycobacterium tuberculosis H37Rv
agcgcgugcuguggaugc

SEQ ID NO: 3292198 - RNA, 18 nt, Mycobacterium tuberculosis H37Rv
agcgcguucggcaccugg

SEQ ID NO: 3292199 - RNA, 21 nt, Mycobacterium tuberculosis H37Rv
agcgcuacguaaucagccccg

SEQ ID NO: 3292200 - RNA, 17 nt, Mycobacterium tuberculosis H37Rv
agcgcuauaggccgcau

SEQ ID NO: 3292201 - RNA, 18 nt, Mycobacterium tuberculosis H37Rv
agcgcuauaggccgcaug

SEQ ID NO: 3292202 - RNA, 17 nt, Mycobacterium tuberculosis H37Rv
agcgcucagcugagaug

SEQ ID NO: 3292203 - RNA, 13 nt, Mycobacterium tuberculosis H37Rv
agcgcuccagcac

SEQ ID NO: 3292204 - RNA, 15 nt, Mycobacterium tuberculosis H37Rv
agcgcuccagccgcg

SEQ ID NO: 3292205 - RNA, 20 nt, Mycobacterium tuberculosis H37Rv
agcgcuccagcugagcggcc

SEQ ID NO: 3292206 - RNA, 16 nt, Mycobacterium tuberculosis H37Rv
agcgcucgcgucaugc

SEQ ID NO: 3292207 - RNA, 15 nt, Mycobacterium tuberculosis H37Rv
agcgcugagccgcuc

SEQ ID NO: 3292208 - RNA, 17 nt, Mycobacterium tuberculosis H37Rv
agcgcugccaccgcggu

SEQ ID NO: 3292209 - RNA, 13 nt, Mycobacterium tuberculosis H37Rv
agcgcugcucccg

SEQ ID NO: 3292210 - RNA, 18 nt, Mycobacterium tuberculosis H37Rv
agcgcuggcaggccgggc

SEQ ID NO: 3292211 - RNA, 16 nt, Mycobacterium tuberculosis H37Rv
agcgcuggcuacgccu

SEQ ID NO: 3292212 - RNA, 21 nt, Mycobacterium tuberculosis H37Rv
agcgcugucguaccgcggauc

SEQ ID NO: 3292213 - RNA, 21 nt, Mycobacterium tuberculosis H37Rv
agcgcuucgucggccggcacc

SEQ ID NO: 3292214 - RNA, 20 nt, Mycobacterium tuberculosis H37Rv
agcgcuugaccccgccgaac

SEQ ID NO: 3292215 - RNA, 23 nt, Mycobacterium tuberculosis H37Rv
agcgcuuggucaaaaagcucggc

SEQ ID NO: 3292216 - RNA, 22 nt, Mycobacterium tuberculosis H37Rv
agcggaaaacccagaucggcga

SEQ ID NO: 3292217 - RNA, 18 nt, Mycobacterium tuberculosis H37Rv
agcggaacgucacugcga

SEQ ID NO: 3292218 - RNA, 20 nt, Mycobacterium tuberculosis H37Rv
agcggaauggaggccgccga

SEQ ID NO: 3292219 - RNA, 16 nt, Mycobacterium tuberculosis H37Rv
agcggacagcucgcgg

SEQ ID NO: 3292220 - RNA, 19 nt, Mycobacterium tuberculosis H37Rv
agcggaccaccgcucgcca

SEQ ID NO: 3292221 - RNA, 17 nt, Mycobacterium tuberculosis H37Rv
agcggacccgaccgucg

SEQ ID NO: 3292222 - RNA, 21 nt, Mycobacterium tuberculosis H37Rv
agcggacucgagucugcgcag

SEQ ID NO: 3292223 - RNA, 15 nt, Mycobacterium tuberculosis H37Rv
agcggagacugguug

SEQ ID NO: 3292224 - RNA, 19 nt, Mycobacterium tuberculosis H37Rv
agcggagccacucggcccg

SEQ ID NO: 3292225 - RNA, 16 nt, Mycobacterium tuberculosis H37Rv
agcggauccaggccuc

SEQ ID NO: 3292226 - RNA, 12 nt, Mycobacterium tuberculosis H37Rv
agcggaucccgc

SEQ ID NO: 3292227 - RNA, 19 nt, Mycobacterium tuberculosis H37Rv
agcggauccgugucgcaga

SEQ ID NO: 3292228 - RNA, 13 nt, Mycobacterium tuberculosis H37Rv
agcggaucgcggu

SEQ ID NO: 3292229 - RNA, 16 nt, Mycobacterium tuberculosis H37Rv
agcggaucgcggucag

SEQ ID NO: 3292230 - RNA, 11 nt, Mycobacterium tuberculosis H37Rv
agcggaucugg

SEQ ID NO: 3292231 - RNA, 15 nt, Mycobacterium tuberculosis H37Rv
agcggauguccccga

SEQ ID NO: 3292232 - RNA, 17 nt, Mycobacterium tuberculosis H37Rv
agcggcaacaugucacc

SEQ ID NO: 3292233 - RNA, 18 nt, Mycobacterium tuberculosis H37Rv
agcggcaacgaucgacac

SEQ ID NO: 3292234 - RNA, 19 nt, Mycobacterium tuberculosis H37Rv
agcggcaacgccuccggag

SEQ ID NO: 3292235 - RNA, 14 nt, Mycobacterium tuberculosis H37Rv
agcggcaaucgggu

SEQ ID NO: 3292236 - RNA, 15 nt, Mycobacterium tuberculosis H37Rv
agcggcaaucggguc

SEQ ID NO: 3292237 - RNA, 17 nt, Mycobacterium tuberculosis H37Rv
agcggcaaucgggucug

SEQ ID NO: 3292238 - RNA, 19 nt, Mycobacterium tuberculosis H37Rv
agcggcaauggccagcacc

SEQ ID NO: 3292239 - RNA, 24 nt, Mycobacterium tuberculosis H37Rv
agcggcacaucaugggcgcugcca

SEQ ID NO: 3292240 - RNA, 16 nt, Mycobacterium tuberculosis H37Rv
agcggcaccgcgccgg

SEQ ID NO: 3292241 - RNA, 21 nt, Mycobacterium tuberculosis H37Rv
agcggcaccgcgccggcggaa

SEQ ID NO: 3292242 - RNA, 18 nt, Mycobacterium tuberculosis H37Rv
agcggcacgaucggcagu

SEQ ID NO: 3292243 - RNA, 19 nt, Mycobacterium tuberculosis H37Rv
agcggcacgucggcgccga

SEQ ID NO: 3292244 - RNA, 21 nt, Mycobacterium tuberculosis H37Rv
agcggcagaugaauugccggg

SEQ ID NO: 3292245 - RNA, 15 nt, Mycobacterium tuberculosis H37Rv
agcggcagcaccgca

SEQ ID NO: 3292246 - RNA, 13 nt, Mycobacterium tuberculosis H37Rv
agcggcagccaag

SEQ ID NO: 3292247 - RNA, 19 nt, Mycobacterium tuberculosis H37Rv
agcggcagcgaguggccga

SEQ ID NO: 3292248 - RNA, 18 nt, Mycobacterium tuberculosis H37Rv
agcggcagcggcgucguc

SEQ ID NO: 3292249 - RNA, 23 nt, Mycobacterium tuberculosis H37Rv
agcggcagcggcgucgucgucga

SEQ ID NO: 3292250 - RNA, 23 nt, Mycobacterium tuberculosis H37Rv
agcggcauccacaccgaccgcgg

SEQ ID NO: 3292251 - RNA, 14 nt, Mycobacterium tuberculosis H37Rv
agcggcaucgcggg

SEQ ID NO: 3292252 - RNA, 12 nt, Mycobacterium tuberculosis H37Rv
agcggcaucggc

SEQ ID NO: 3292253 - RNA, 15 nt, Mycobacterium tuberculosis H37Rv
agcggcaucggccag

SEQ ID NO: 3292254 - RNA, 18 nt, Mycobacterium tuberculosis H37Rv
agcggcaucggccagccg

SEQ ID NO: 3292255 - RNA, 10 nt, Mycobacterium tuberculosis H37Rv
agcggccacc

SEQ ID NO: 3292256 - RNA, 13 nt, Mycobacterium tuberculosis H37Rv
agcggccaccgcc

SEQ ID NO: 3292257 - RNA, 21 nt, Mycobacterium tuberculosis H37Rv
agcggccaccguagccagcag

SEQ ID NO: 3292258 - RNA, 13 nt, Mycobacterium tuberculosis H37Rv
agcggccagcagu

SEQ ID NO: 3292259 - RNA, 18 nt, Mycobacterium tuberculosis H37Rv
agcggccagcagugcggu

SEQ ID NO: 3292260 - RNA, 12 nt, Mycobacterium tuberculosis H37Rv
agcggccagcau

SEQ ID NO: 3292261 - RNA, 16 nt, Mycobacterium tuberculosis H37Rv
agcggccagcccagcc

SEQ ID NO: 3292262 - RNA, 20 nt, Mycobacterium tuberculosis H37Rv
agcggccauaucgcccacca

SEQ ID NO: 3292263 - RNA, 22 nt, Mycobacterium tuberculosis H37Rv
agcggccauaucgcccaccacg

SEQ ID NO: 3292264 - RNA, 23 nt, Mycobacterium tuberculosis H37Rv
agcggccaucgggauggacacca

SEQ ID NO: 3292265 - RNA, 19 nt, Mycobacterium tuberculosis H37Rv
agcggcccgcugcgcggcc

SEQ ID NO: 3292266 - RNA, 21 nt, Mycobacterium tuberculosis H37Rv
agcggcccuaucuggcggccg

SEQ ID NO: 3292267 - RNA, 19 nt, Mycobacterium tuberculosis H37Rv
agcggcccuucgacgagga

SEQ ID NO: 3292268 - RNA, 13 nt, Mycobacterium tuberculosis H37Rv
agcggccgcgaug

SEQ ID NO: 3292269 - RNA, 20 nt, Mycobacterium tuberculosis H37Rv
agcggccgggcggccaggcg

SEQ ID NO: 3292270 - RNA, 23 nt, Mycobacterium tuberculosis H37Rv
agcggccuaacgaguaggcggcu

SEQ ID NO: 3292271 - RNA, 14 nt, Mycobacterium tuberculosis H37Rv
agcggccuccagca

SEQ ID NO: 3292272 - RNA, 15 nt, Mycobacterium tuberculosis H37Rv
agcggccuccagcac

SEQ ID NO: 3292273 - RNA, 16 nt, Mycobacterium tuberculosis H37Rv
agcggccuccagcacc

SEQ ID NO: 3292274 - RNA, 20 nt, Mycobacterium tuberculosis H37Rv
agcggccucgaccucuucgg

SEQ ID NO: 3292275 - RNA, 24 nt, Mycobacterium tuberculosis H37Rv
agcggccugcucgggggccgacca

SEQ ID NO: 3292276 - RNA, 23 nt, Mycobacterium tuberculosis H37Rv
agcggcgaacucgggcgacugga

SEQ ID NO: 3292277 - RNA, 20 nt, Mycobacterium tuberculosis H37Rv
agcggcgaaggucuggccug

SEQ ID NO: 3292278 - RNA, 18 nt, Mycobacterium tuberculosis H37Rv
agcggcgacacaucgccc

SEQ ID NO: 3292279 - RNA, 16 nt, Mycobacterium tuberculosis H37Rv
agcggcgagccaaacu

SEQ ID NO: 3292280 - RNA, 22 nt, Mycobacterium tuberculosis H37Rv
agcggcgaguuggccguggcga

SEQ ID NO: 3292281 - RNA, 12 nt, Mycobacterium tuberculosis H37Rv
agcggcgaucag

SEQ ID NO: 3292282 - RNA, 22 nt, Mycobacterium tuberculosis H37Rv
agcggcgaucggaggcccgcca

SEQ ID NO: 3292283 - RNA, 19 nt, Mycobacterium tuberculosis H37Rv
agcggcgcagcgugagugc

SEQ ID NO: 3292284 - RNA, 20 nt, Mycobacterium tuberculosis H37Rv
agcggcgcagcgugagugca

SEQ ID NO: 3292285 - RNA, 19 nt, Mycobacterium tuberculosis H37Rv
agcggcgccacguggucga

SEQ ID NO: 3292286 - RNA, 23 nt, Mycobacterium tuberculosis H37Rv
agcggcgccacguggucgagcag

SEQ ID NO: 3292287 - RNA, 20 nt, Mycobacterium tuberculosis H37Rv
agcggcgccaguauggccgc

SEQ ID NO: 3292288 - RNA, 18 nt, Mycobacterium tuberculosis H37Rv
agcggcgcccgccaccgg

SEQ ID NO: 3292289 - RNA, 12 nt, Mycobacterium tuberculosis H37Rv
agcggcgccgcc

SEQ ID NO: 3292290 - RNA, 21 nt, Mycobacterium tuberculosis H37Rv
agcggcgccgcccuaaggggc

SEQ ID NO: 3292291 - RNA, 15 nt, Mycobacterium tuberculosis H37Rv
agcggcgccgccugg

SEQ ID NO: 3292292 - RNA, 20 nt, Mycobacterium tuberculosis H37Rv
agcggcgcgaggaacgccgg

SEQ ID NO: 3292293 - RNA, 15 nt, Mycobacterium tuberculosis H37Rv
agcggcgcgggggug

SEQ ID NO: 3292294 - RNA, 18 nt, Mycobacterium tuberculosis H37Rv
agcggcggccacggccau

SEQ ID NO: 3292295 - RNA, 12 nt, Mycobacterium tuberculosis H37Rv
agcggcgggcac

SEQ ID NO: 3292296 - RNA, 16 nt, Mycobacterium tuberculosis H37Rv
agcggcgggccguaca

SEQ ID NO: 3292297 - RNA, 22 nt, Mycobacterium tuberculosis H37Rv
agcggcgggccguacacaccga

SEQ ID NO: 3292298 - RNA, 24 nt, Mycobacterium tuberculosis H37Rv
agcggcggguagauccgccgggua

SEQ ID NO: 3292299 - RNA, 17 nt, Mycobacterium tuberculosis H37Rv
agcggcgucgucgucga

SEQ ID NO: 3292300 - RNA, 18 nt, Mycobacterium tuberculosis H37Rv
agcggcguuccgggccga

SEQ ID NO: 3292301 - RNA, 23 nt, Mycobacterium tuberculosis H37Rv
agcggcguuccgggccgaucacc

SEQ ID NO: 3292302 - RNA, 14 nt, Mycobacterium tuberculosis H37Rv
agcggcucaccgcg

SEQ ID NO: 3292303 - RNA, 19 nt, Mycobacterium tuberculosis H37Rv
agcggcuccgaaggccgcc

SEQ ID NO: 3292304 - RNA, 22 nt, Mycobacterium tuberculosis H37Rv
agcggcucgccuaucgacucag

SEQ ID NO: 3292305 - RNA, 21 nt, Mycobacterium tuberculosis H37Rv
agcggcucgcgcgggaagucc

SEQ ID NO: 3292306 - RNA, 13 nt, Mycobacterium tuberculosis H37Rv
agcggcucggcgg

SEQ ID NO: 3292307 - RNA, 22 nt, Mycobacterium tuberculosis H37Rv
agcggcucggcgggggaccccg

SEQ ID NO: 3292308 - RNA, 22 nt, Mycobacterium tuberculosis H37Rv
agcggcugaggcuuuuggagcg

SEQ ID NO: 3292309 - RNA, 18 nt, Mycobacterium tuberculosis H37Rv
agcggcugcccgagaucg

SEQ ID NO: 3292310 - RNA, 20 nt, Mycobacterium tuberculosis H37Rv
agcggcugcccgagaucgcg

SEQ ID NO: 3292311 - RNA, 21 nt, Mycobacterium tuberculosis H37Rv
agcggcugcccgagaucgcgu

SEQ ID NO: 3292312 - RNA, 21 nt, Mycobacterium tuberculosis H37Rv
agcggcugcggcaacgagguc

SEQ ID NO: 3292313 - RNA, 17 nt, Mycobacterium tuberculosis H37Rv
agcggcugcugcgcggu

SEQ ID NO: 3292314 - RNA, 20 nt, Mycobacterium tuberculosis H37Rv
agcggcugggacgucuccac

SEQ ID NO: 3292315 - RNA, 22 nt, Mycobacterium tuberculosis H37Rv
agcggcuugguguauucgcgga

SEQ ID NO: 3292316 - RNA, 18 nt, Mycobacterium tuberculosis H37Rv
agcgggaaggcucaccac

SEQ ID NO: 3292317 - RNA, 21 nt, Mycobacterium tuberculosis H37Rv
agcgggaaggguggaccgggg

SEQ ID NO: 3292318 - RNA, 20 nt, Mycobacterium tuberculosis H37Rv
agcgggaucugacccagcag

SEQ ID NO: 3292319 - RNA, 14 nt, Mycobacterium tuberculosis H37Rv
agcgggauugccga

SEQ ID NO: 3292320 - RNA, 16 nt, Mycobacterium tuberculosis H37Rv
agcgggcaaacgaacg

SEQ ID NO: 3292321 - RNA, 13 nt, Mycobacterium tuberculosis H37Rv
agcgggcaacugc

SEQ ID NO: 3292322 - RNA, 19 nt, Mycobacterium tuberculosis H37Rv
agcgggcaacugcagcaug

SEQ ID NO: 3292323 - RNA, 15 nt, Mycobacterium tuberculosis H37Rv
agcgggcaagucgcc

SEQ ID NO: 3292324 - RNA, 15 nt, Mycobacterium tuberculosis H37Rv
agcgggcacgccgcc

SEQ ID NO: 3292325 - RNA, 13 nt, Mycobacterium tuberculosis H37Rv
agcgggccagcac

SEQ ID NO: 3292326 - RNA, 17 nt, Mycobacterium tuberculosis H37Rv
agcgggccagcacccgc

SEQ ID NO: 3292327 - RNA, 13 nt, Mycobacterium tuberculosis H37Rv
agcgggcccgcag

SEQ ID NO: 3292328 - RNA, 19 nt, Mycobacterium tuberculosis H37Rv
agcgggcgaugagcgcgau

SEQ ID NO: 3292329 - RNA, 14 nt, Mycobacterium tuberculosis H37Rv
agcgggcgucgcgg

SEQ ID NO: 3292330 - RNA, 16 nt, Mycobacterium tuberculosis H37Rv
agcgggcuccggcucg

SEQ ID NO: 3292331 - RNA, 20 nt, Mycobacterium tuberculosis H37Rv
agcgggcuguaggcgaucac

SEQ ID NO: 3292332 - RNA, 16 nt, Mycobacterium tuberculosis H37Rv
agcgggggagcgaacg

SEQ ID NO: 3292333 - RNA, 20 nt, Mycobacterium tuberculosis H37Rv
agcguguggagcucgcggcg

SEQ ID NO: 3292334 - RNA, 22 nt, Mycobacterium tuberculosis H37Rv
agcguguggagcucgcggcgca

SEQ ID NO: 3292335 - RNA, 14 nt, Mycobacterium tuberculosis H37Rv
agcguucaaggucu

SEQ ID NO: 3292336 - RNA, 13 nt, Mycobacterium tuberculosis H37Rv
agcguugaccgcg

SEQ ID NO: 3292337 - RNA, 18 nt, Mycobacterium tuberculosis H37Rv
agcguugccaggugcugu

SEQ ID NO: 3292338 - RNA, 14 nt, Mycobacterium tuberculosis H37Rv
agcuaaacccccac

SEQ ID NO: 3292339 - RNA, 15 nt, Mycobacterium tuberculosis H37Rv
agcuaaacccccacc

SEQ ID NO: 3292340 - RNA, 14 nt, Mycobacterium tuberculosis H37Rv
agcuagcccggcag

SEQ ID NO: 3292341 - RNA, 22 nt, Mycobacterium tuberculosis H37Rv
agcuagcccggcagcacgugga

SEQ ID NO: 3292342 - RNA, 23 nt, Mycobacterium tuberculosis H37Rv
agcuagcccucagcuagcgcggg

SEQ ID NO: 3292343 - RNA, 21 nt, Mycobacterium tuberculosis H37Rv
agcuaucccaggggcaccgag

SEQ ID NO: 3292344 - RNA, 21 nt, Mycobacterium tuberculosis H37Rv
agcuaugucaccugggccagc

SEQ ID NO: 3292345 - RNA, 22 nt, Mycobacterium tuberculosis H37Rv
agcucaauggcuucgaagcgau

SEQ ID NO: 3292346 - RNA, 15 nt, Mycobacterium tuberculosis H37Rv
agcucaauuccaugc

SEQ ID NO: 3292347 - RNA, 14 nt, Mycobacterium tuberculosis H37Rv
agcucaccacccgc

SEQ ID NO: 3292348 - RNA, 13 nt, Mycobacterium tuberculosis H37Rv
agcucaccgacgg

SEQ ID NO: 3292349 - RNA, 13 nt, Mycobacterium tuberculosis H37Rv
agcucaccgcaca

SEQ ID NO: 3292350 - RNA, 20 nt, Mycobacterium tuberculosis H37Rv
agcucacgcugaagccgcug

SEQ ID NO: 3292351 - RNA, 22 nt, Mycobacterium tuberculosis H37Rv
agcucacgugcugccgauagcg

SEQ ID NO: 3292352 - RNA, 14 nt, Mycobacterium tuberculosis H37Rv
agcucagcugcgga

SEQ ID NO: 3292353 - RNA, 22 nt, Mycobacterium tuberculosis H37Rv
agcucaucgauccucgcccgca

SEQ ID NO: 3292354 - RNA, 13 nt, Mycobacterium tuberculosis H37Rv
agcucaucgccgc

SEQ ID NO: 3292355 - RNA, 14 nt, Mycobacterium tuberculosis H37Rv
agcucaucgccgcu

SEQ ID NO: 3292356 - RNA, 19 nt, Mycobacterium tuberculosis H37Rv
agcuccaaccaugcgguua

SEQ ID NO: 3292357 - RNA, 14 nt, Mycobacterium tuberculosis H37Rv
agcucccacaggac

SEQ ID NO: 3292358 - RNA, 24 nt, Mycobacterium tuberculosis H37Rv
agcuccccgccggaacugcgcaac

SEQ ID NO: 3292359 - RNA, 17 nt, Mycobacterium tuberculosis H37Rv
agcucccgccacgucgc

SEQ ID NO: 3292360 - RNA, 21 nt, Mycobacterium tuberculosis H37Rv
agcucccgccacgucgccggc

SEQ ID NO: 3292361 - RNA, 20 nt, Mycobacterium tuberculosis H37Rv
agcucccgcggcgccacccg

SEQ ID NO: 3292362 - RNA, 17 nt, Mycobacterium tuberculosis H37Rv
agcucccugggcgucga

SEQ ID NO: 3292363 - RNA, 20 nt, Mycobacterium tuberculosis H37Rv
agcucccugggcgucgacca

SEQ ID NO: 3292364 - RNA, 21 nt, Mycobacterium tuberculosis H37Rv
agcucccugggcgucgaccac

SEQ ID NO: 3292365 - RNA, 16 nt, Mycobacterium tuberculosis H37Rv
agcuccgccugccgcu

SEQ ID NO: 3292366 - RNA, 21 nt, Mycobacterium tuberculosis H37Rv
agcuccgggucgacgacgucg

SEQ ID NO: 3292367 - RNA, 15 nt, Mycobacterium tuberculosis H37Rv
agcuccgucgcggcc

SEQ ID NO: 3292368 - RNA, 23 nt, Mycobacterium tuberculosis H37Rv
agcuccguggugcuagcgccgcc

SEQ ID NO: 3292369 - RNA, 22 nt, Mycobacterium tuberculosis H37Rv
agcuccgugucggacaaggacu

SEQ ID NO: 3292370 - RNA, 13 nt, Mycobacterium tuberculosis H37Rv
agcuccucagcca

SEQ ID NO: 3292371 - RNA, 17 nt, Mycobacterium tuberculosis H37Rv
agcuccucagccaccgc

SEQ ID NO: 3292372 - RNA, 15 nt, Mycobacterium tuberculosis H37Rv
agcuccugcaugccg

SEQ ID NO: 3292373 - RNA, 20 nt, Mycobacterium tuberculosis H37Rv
agcuccuguaacugcuccug

SEQ ID NO: 3292374 - RNA, 20 nt, Mycobacterium tuberculosis H37Rv
agcucgaacagcucgaucag

SEQ ID NO: 3292375 - RNA, 14 nt, Mycobacterium tuberculosis H37Rv
agcucgaagcccgg

SEQ ID NO: 3292376 - RNA, 15 nt, Mycobacterium tuberculosis H37Rv
agcucgaagcccgga

SEQ ID NO: 3292377 - RNA, 12 nt, Mycobacterium tuberculosis H37Rv
agcucgaaguug

SEQ ID NO: 3292378 - RNA, 17 nt, Mycobacterium tuberculosis H37Rv
agcucgacaacugcccg

SEQ ID NO: 3292379 - RNA, 20 nt, Mycobacterium tuberculosis H37Rv
agcucgaccccggugcccau

SEQ ID NO: 3292380 - RNA, 11 nt, Mycobacterium tuberculosis H37Rv
agcucgaccug

SEQ ID NO: 3292381 - RNA, 20 nt, Mycobacterium tuberculosis H37Rv
agcucgaccugaggcaccuc

SEQ ID NO: 3292382 - RNA, 15 nt, Mycobacterium tuberculosis H37Rv
agcucgaggaccacc

SEQ ID NO: 3292383 - RNA, 16 nt, Mycobacterium tuberculosis H37Rv
agcucgaggaccaccu

SEQ ID NO: 3292384 - RNA, 14 nt, Mycobacterium tuberculosis H37Rv
agcucgauccgcag

SEQ ID NO: 3292385 - RNA, 13 nt, Mycobacterium tuberculosis H37Rv
agcucgaugccgu

SEQ ID NO: 3292386 - RNA, 16 nt, Mycobacterium tuberculosis H37Rv
agcucgcacucguugc

SEQ ID NO: 3292387 - RNA, 13 nt, Mycobacterium tuberculosis H37Rv
agcucgccagccu

SEQ ID NO: 3292388 - RNA, 13 nt, Mycobacterium tuberculosis H37Rv
agcucgccagggu

SEQ ID NO: 3292389 - RNA, 16 nt, Mycobacterium tuberculosis H37Rv
agcucgccggcacgca

SEQ ID NO: 3292390 - RNA, 14 nt, Mycobacterium tuberculosis H37Rv
agcucgccggugcg

SEQ ID NO: 3292391 - RNA, 16 nt, Mycobacterium tuberculosis H37Rv
agcucgccgugaccag

SEQ ID NO: 3292392 - RNA, 22 nt, Mycobacterium tuberculosis H37Rv
agcucgcgcacccagcccagcc

SEQ ID NO: 3292393 - RNA, 18 nt, Mycobacterium tuberculosis H37Rv
agcucgcgcucgcucacg

SEQ ID NO: 3292394 - RNA, 18 nt, Mycobacterium tuberculosis H37Rv
agcucgcggugggcuucc

SEQ ID NO: 3292395 - RNA, 21 nt, Mycobacterium tuberculosis H37Rv
agcucgcggugggcuuccaac

SEQ ID NO: 3292396 - RNA, 20 nt, Mycobacterium tuberculosis H37Rv
agcucgcugacggcaaacga

SEQ ID NO: 3292397 - RNA, 13 nt, Mycobacterium tuberculosis H37Rv
agcucgcugcgcg

SEQ ID NO: 3292398 - RNA, 12 nt, Mycobacterium tuberculosis H37Rv
agcucggccacc

SEQ ID NO: 3292399 - RNA, 16 nt, Mycobacterium tuberculosis H37Rv
agcucggccaccagcg

SEQ ID NO: 3292400 - RNA, 15 nt, Mycobacterium tuberculosis H37Rv
agcucggccagcacg

SEQ ID NO: 3292401 - RNA, 16 nt, Mycobacterium tuberculosis H37Rv
agcucggcccuguucg

SEQ ID NO: 3292402 - RNA, 20 nt, Mycobacterium tuberculosis H37Rv
agcucggcgcccagcucguc

SEQ ID NO: 3292403 - RNA, 14 nt, Mycobacterium tuberculosis H37Rv
agcucggcugcucg

SEQ ID NO: 3292404 - RNA, 15 nt, Mycobacterium tuberculosis H37Rv
agcucggcugcucga

SEQ ID NO: 3292405 - RNA, 18 nt, Mycobacterium tuberculosis H37Rv
agcucgggcagggaccgc

SEQ ID NO: 3292406 - RNA, 16 nt, Mycobacterium tuberculosis H37Rv
agcucggggcgaugag

SEQ ID NO: 3292407 - RNA, 15 nt, Mycobacterium tuberculosis H37Rv
agcucggucagcguc

SEQ ID NO: 3292408 - RNA, 17 nt, Mycobacterium tuberculosis H37Rv
agcucggucagcgucag

SEQ ID NO: 3292409 - RNA, 18 nt, Mycobacterium tuberculosis H37Rv
agcucguaggugaagagc

SEQ ID NO: 3292410 - RNA, 15 nt, Mycobacterium tuberculosis H37Rv
agcucgucgacgucg

SEQ ID NO: 3292411 - RNA, 16 nt, Mycobacterium tuberculosis H37Rv
agcucgucgagcgcgu

SEQ ID NO: 3292412 - RNA, 21 nt, Mycobacterium tuberculosis H37Rv
agcucgucgaggaagaucacc

SEQ ID NO: 3292413 - RNA, 20 nt, Mycobacterium tuberculosis H37Rv
agcucguugaucuuggucgg

SEQ ID NO: 3292414 - RNA, 18 nt, Mycobacterium tuberculosis H37Rv
agcucguugaugcggcua

SEQ ID NO: 3292415 - RNA, 21 nt, Mycobacterium tuberculosis H37Rv
agcucguugcuggcggccagc

SEQ ID NO: 3292416 - RNA, 14 nt, Mycobacterium tuberculosis H37Rv
agcucucgcggcgu

SEQ ID NO: 3292417 - RNA, 18 nt, Mycobacterium tuberculosis H37Rv
agcucuucggacacagcc

SEQ ID NO: 3292418 - RNA, 18 nt, Mycobacterium tuberculosis H37Rv
agcucuugcgggcagccg

SEQ ID NO: 3292419 - RNA, 19 nt, Mycobacterium tuberculosis H37Rv
agcugaaaauaggccgggc

SEQ ID NO: 3292420 - RNA, 20 nt, Mycobacterium tuberculosis H37Rv
agcugaaaauaggccgggca

SEQ ID NO: 3292421 - RNA, 23 nt, Mycobacterium tuberculosis H37Rv
agcugaacacgaauccggccacu

SEQ ID NO: 3292422 - RNA, 22 nt, Mycobacterium tuberculosis H37Rv
agcugaacuacugcgaucgcga

SEQ ID NO: 3292423 - RNA, 24 nt, Mycobacterium tuberculosis H37Rv
agcugacaccgaaccgccgcugcc

SEQ ID NO: 3292424 - RNA, 14 nt, Mycobacterium tuberculosis H37Rv
agcugacacgacga

SEQ ID NO: 3292425 - RNA, 19 nt, Mycobacterium tuberculosis H37Rv
agcugaccagcguccagcc

SEQ ID NO: 3292426 - RNA, 13 nt, Mycobacterium tuberculosis H37Rv
agcugaccgccag

SEQ ID NO: 3292427 - RNA, 13 nt, Mycobacterium tuberculosis H37Rv
agcugacgcugcu

SEQ ID NO: 3292428 - RNA, 17 nt, Mycobacterium tuberculosis H37Rv
agcugacgugucggcug

SEQ ID NO: 3292429 - RNA, 20 nt, Mycobacterium tuberculosis H37Rv
aggaaguagaugagcagacc

SEQ ID NO: 3292430 - RNA, 18 nt, Mycobacterium tuberculosis H37Rv
aggaagucccgggcaccg

SEQ ID NO: 3292431 - RNA, 22 nt, Mycobacterium tuberculosis H37Rv
aggaauacagcuugaucgccga

SEQ ID NO: 3292432 - RNA, 18 nt, Mycobacterium tuberculosis H37Rv
aggaaugauggccagcac

SEQ ID NO: 3292433 - RNA, 21 nt, Mycobacterium tuberculosis H37Rv
aggaauucgccauagcgggcg

SEQ ID NO: 3292434 - RNA, 16 nt, Mycobacterium tuberculosis H37Rv
aggacaauggacacca

SEQ ID NO: 3292435 - RNA, 12 nt, Mycobacterium tuberculosis H37Rv
aggacaccaccg

SEQ ID NO: 3292436 - RNA, 15 nt, Mycobacterium tuberculosis H37Rv
aggacaccagcugga

SEQ ID NO: 3292437 - RNA, 14 nt, Mycobacterium tuberculosis H37Rv
aggacaccggcacc

SEQ ID NO: 3292438 - RNA, 15 nt, Mycobacterium tuberculosis H37Rv
aggacaucacgaagg

SEQ ID NO: 3292439 - RNA, 15 nt, Mycobacterium tuberculosis H37Rv
aggaccagagcucga

SEQ ID NO: 3292440 - RNA, 13 nt, Mycobacterium tuberculosis H37Rv
aggaccagcaccg

SEQ ID NO: 3292441 - RNA, 13 nt, Mycobacterium tuberculosis H37Rv
aggaccgcgccga

SEQ ID NO: 3292442 - RNA, 11 nt, Mycobacterium tuberculosis H37Rv
aggaccgcucu

SEQ ID NO: 3292443 - RNA, 16 nt, Mycobacterium tuberculosis H37Rv
aggaccgcucugcggc

SEQ ID NO: 3292444 - RNA, 17 nt, Mycobacterium tuberculosis H37Rv
aggaccgcucugcggcc

SEQ ID NO: 3292445 - RNA, 19 nt, Mycobacterium tuberculosis H37Rv
aggaccggcaccuggucca

SEQ ID NO: 3292446 - RNA, 23 nt, Mycobacterium tuberculosis H37Rv
aggaccgggaucgucaggcccau

SEQ ID NO: 3292447 - RNA, 21 nt, Mycobacterium tuberculosis H37Rv
aggaccggugggucugcucag

SEQ ID NO: 3292448 - RNA, 23 nt, Mycobacterium tuberculosis H37Rv
aggaccggugggucugcucagcg

SEQ ID NO: 3292449 - RNA, 14 nt, Mycobacterium tuberculosis H37Rv
aggaccucgucacc

SEQ ID NO: 3292450 - RNA, 21 nt, Mycobacterium tuberculosis H37Rv
aggaccucgucaccggucagc

SEQ ID NO: 3292451 - RNA, 20 nt, Mycobacterium tuberculosis H37Rv
aggaccuucugucccugcag

SEQ ID NO: 3292452 - RNA, 22 nt, Mycobacterium tuberculosis H37Rv
aggaccuucugucccugcaguc

SEQ ID NO: 3292453 - RNA, 16 nt, Mycobacterium tuberculosis H37Rv
aggacgaacaacgcga

SEQ ID NO: 3292454 - RNA, 21 nt, Mycobacterium tuberculosis H37Rv
aggacgacuggaaggcgggca

SEQ ID NO: 3292455 - RNA, 13 nt, Mycobacterium tuberculosis H37Rv
aggacgcaccgcc

SEQ ID NO: 3292456 - RNA, 16 nt, Mycobacterium tuberculosis H37Rv
aggacgcaccgccagu

SEQ ID NO: 3292457 - RNA, 20 nt, Mycobacterium tuberculosis H37Rv
aggacgcccacaugcucagg

SEQ ID NO: 3292458 - RNA, 22 nt, Mycobacterium tuberculosis H37Rv
aggacggagcccaaaaccgcga

SEQ ID NO: 3292459 - RNA, 16 nt, Mycobacterium tuberculosis H37Rv
aggacggcagccacca

SEQ ID NO: 3292460 - RNA, 13 nt, Mycobacterium tuberculosis H37Rv
aggacggcggcca

SEQ ID NO: 3292461 - RNA, 14 nt, Mycobacterium tuberculosis H37Rv
aggacggcggccag

SEQ ID NO: 3292462 - RNA, 16 nt, Mycobacterium tuberculosis H37Rv
aggacggcggccagga

SEQ ID NO: 3292463 - RNA, 17 nt, Mycobacterium tuberculosis H37Rv
aggacggcggccaggac

SEQ ID NO: 3292464 - RNA, 13 nt, Mycobacterium tuberculosis H37Rv
aggacggcugccg

SEQ ID NO: 3292465 - RNA, 18 nt, Mycobacterium tuberculosis H37Rv
aggacggcugccgucagc

SEQ ID NO: 3292466 - RNA, 12 nt, Mycobacterium tuberculosis H37Rv
aggacgguucau

SEQ ID NO: 3292467 - RNA, 22 nt, Mycobacterium tuberculosis H37Rv
aggacgguugguccgccgucga

SEQ ID NO: 3292468 - RNA, 16 nt, Mycobacterium tuberculosis H37Rv
aggacgucaccgucag

SEQ ID NO: 3292469 - RNA, 19 nt, Mycobacterium tuberculosis H37Rv
aggacguuucagccgggug

SEQ ID NO: 3292470 - RNA, 15 nt, Mycobacterium tuberculosis H37Rv
aggacucacgcagcg

SEQ ID NO: 3292471 - RNA, 18 nt, Mycobacterium tuberculosis H37Rv
aggacucacgcagcgcca

SEQ ID NO: 3292472 - RNA, 17 nt, Mycobacterium tuberculosis H37Rv
aggacucuucggucagg

SEQ ID NO: 3292473 - RNA, 15 nt, Mycobacterium tuberculosis H37Rv
aggacuggcaccgcc

SEQ ID NO: 3292474 - RNA, 18 nt, Mycobacterium tuberculosis H37Rv
aggacuucggugagcagg

SEQ ID NO: 3292475 - RNA, 14 nt, Mycobacterium tuberculosis H37Rv
aggacuucugcugc

SEQ ID NO: 3292476 - RNA, 20 nt, Mycobacterium tuberculosis H37Rv
aggacuugcacgucggcugc

SEQ ID NO: 3292477 - RNA, 19 nt, Mycobacterium tuberculosis H37Rv
aggacuuguccaucacauc

SEQ ID NO: 3292478 - RNA, 13 nt, Mycobacterium tuberculosis H37Rv
aggagaccacggc

SEQ ID NO: 3292479 - RNA, 15 nt, Mycobacterium tuberculosis H37Rv
aggagaccacggcgu

SEQ ID NO: 3292480 - RNA, 21 nt, Mycobacterium tuberculosis H37Rv
aggagaucaacauccugggca

SEQ ID NO: 3292481 - RNA, 13 nt, Mycobacterium tuberculosis H37Rv
aggagaucagcac

SEQ ID NO: 3292482 - RNA, 15 nt, Mycobacterium tuberculosis H37Rv
aggagaucagcaccg

SEQ ID NO: 3292483 - RNA, 16 nt, Mycobacterium tuberculosis H37Rv
aggagaucagcaccgu

SEQ ID NO: 3292484 - RNA, 18 nt, Mycobacterium tuberculosis H37Rv
aggagauccuuaucgcuc

SEQ ID NO: 3292485 - RNA, 12 nt, Mycobacterium tuberculosis H37Rv
aggagaugccga

SEQ ID NO: 3292486 - RNA, 19 nt, Mycobacterium tuberculosis H37Rv
aggagcccguccaggcccg

SEQ ID NO: 3292487 - RNA, 12 nt, Mycobacterium tuberculosis H37Rv
aggagccgggcc

SEQ ID NO: 3292488 - RNA, 17 nt, Mycobacterium tuberculosis H37Rv
aggagcggauagcggca

SEQ ID NO: 3292489 - RNA, 16 nt, Mycobacterium tuberculosis H37Rv
aggagcuccaugcgga

SEQ ID NO: 3292490 - RNA, 16 nt, Mycobacterium tuberculosis H37Rv
aggaggcggucgauca

SEQ ID NO: 3292491 - RNA, 18 nt, Mycobacterium tuberculosis H37Rv
aggaggcuuacaugcccu

SEQ ID NO: 3292492 - RNA, 17 nt, Mycobacterium tuberculosis H37Rv
aggagguuguagucaga

SEQ ID NO: 3292493 - RNA, 16 nt, Mycobacterium tuberculosis H37Rv
aggagugauucggcga

SEQ ID NO: 3292494 - RNA, 17 nt, Mycobacterium tuberculosis H37Rv
aggagugcgggcaugcc

SEQ ID NO: 3292495 - RNA, 13 nt, Mycobacterium tuberculosis H37Rv
aggaguggccggg

SEQ ID NO: 3292496 - RNA, 22 nt, Mycobacterium tuberculosis H37Rv
aggagugguacggcucggcgcu

SEQ ID NO: 3292497 - RNA, 18 nt, Mycobacterium tuberculosis H37Rv
aggagugguugcccgcac

SEQ ID NO: 3292498 - RNA, 15 nt, Mycobacterium tuberculosis H37Rv
aggauaucgccgaga

SEQ ID NO: 3292499 - RNA, 16 nt, Mycobacterium tuberculosis H37Rv
aggaucauggcgucga

SEQ ID NO: 3292500 - RNA, 19 nt, Mycobacterium tuberculosis H37Rv
aggaucccgguggcagcac

SEQ ID NO: 3292501 - RNA, 15 nt, Mycobacterium tuberculosis H37Rv
aggauccguggccaa

SEQ ID NO: 3292502 - RNA, 18 nt, Mycobacterium tuberculosis H37Rv
aggaucgcgccuauccaa

SEQ ID NO: 3292503 - RNA, 15 nt, Mycobacterium tuberculosis H37Rv
aggaucgcugguugg

SEQ ID NO: 3292504 - RNA, 20 nt, Mycobacterium tuberculosis H37Rv
aggaucggcgauugcaccau

SEQ ID NO: 3292505 - RNA, 21 nt, Mycobacterium tuberculosis H37Rv
aggaucgguuucugcggcccc

SEQ ID NO: 3292506 - RNA, 19 nt, Mycobacterium tuberculosis H37Rv
aggaucuguuugggcaucu

SEQ ID NO: 3292507 - RNA, 23 nt, Mycobacterium tuberculosis H37Rv
aggaugaucugcgcggcccgcug

SEQ ID NO: 3292508 - RNA, 13 nt, Mycobacterium tuberculosis H37Rv
aggaugaugaccg

SEQ ID NO: 3292509 - RNA, 13 nt, Mycobacterium tuberculosis H37Rv
aggaugcggcccc

SEQ ID NO: 3292510 - RNA, 22 nt, Mycobacterium tuberculosis H37Rv
aggaugcugagcgccaggccgc

SEQ ID NO: 3292511 - RNA, 14 nt, Mycobacterium tuberculosis H37Rv
aggauggccaucag

SEQ ID NO: 3292512 - RNA, 16 nt, Mycobacterium tuberculosis H37Rv
aggauggucagcagcu

SEQ ID NO: 3292513 - RNA, 14 nt, Mycobacterium tuberculosis H37Rv
aggauugccgagcg

SEQ ID NO: 3292514 - RNA, 22 nt, Mycobacterium tuberculosis H37Rv
aggauuuucucggggugguggu

SEQ ID NO: 3292515 - RNA, 18 nt, Mycobacterium tuberculosis H37Rv
aggcaaagcgagcaccgc

SEQ ID NO: 3292516 - RNA, 23 nt, Mycobacterium tuberculosis H37Rv
aggcaacccagaaguagguuuuc

SEQ ID NO: 3292517 - RNA, 15 nt, Mycobacterium tuberculosis H37Rv
aggcaagcaaccggu

SEQ ID NO: 3292518 - RNA, 15 nt, Mycobacterium tuberculosis H37Rv
aggcaagccagcacu

SEQ ID NO: 3292519 - RNA, 22 nt, Mycobacterium tuberculosis H37Rv
aggcaaugcccgaccggucugg

SEQ ID NO: 3292520 - RNA, 20 nt, Mycobacterium tuberculosis H37Rv
aggcacaacaucgccgcagu

SEQ ID NO: 3292521 - RNA, 13 nt, Mycobacterium tuberculosis H37Rv
aggcacccgugcc

SEQ ID NO: 3292522 - RNA, 16 nt, Mycobacterium tuberculosis H37Rv
aggcacccuguacgaa

SEQ ID NO: 3292523 - RNA, 19 nt, Mycobacterium tuberculosis H37Rv
aggcaccgaaaaacaccag

SEQ ID NO: 3292524 - RNA, 21 nt, Mycobacterium tuberculosis H37Rv
aggcaccgaaaaacaccagcg

SEQ ID NO: 3292525 - RNA, 13 nt, Mycobacterium tuberculosis H37Rv
aggcaccgacauc

SEQ ID NO: 3292526 - RNA, 21 nt, Mycobacterium tuberculosis H37Rv
aggccggugacggggcugacc

SEQ ID NO: 3292527 - RNA, 15 nt, Mycobacterium tuberculosis H37Rv
aggccguacucgaug

SEQ ID NO: 3292528 - RNA, 16 nt, Mycobacterium tuberculosis H37Rv
aggccguacucgauga

SEQ ID NO: 3292529 - RNA, 18 nt, Mycobacterium tuberculosis H37Rv
aggccguagcccacgacg

SEQ ID NO: 3292530 - RNA, 13 nt, Mycobacterium tuberculosis H37Rv
aggccgucaggcg

SEQ ID NO: 3292531 - RNA, 14 nt, Mycobacterium tuberculosis H37Rv
aggccgucaggcgu

SEQ ID NO: 3292532 - RNA, 23 nt, Mycobacterium tuberculosis H37Rv
aggccgucgaacgguagcacggu

SEQ ID NO: 3292533 - RNA, 16 nt, Mycobacterium tuberculosis H37Rv
aggccgucgacccagc

SEQ ID NO: 3292534 - RNA, 19 nt, Mycobacterium tuberculosis H37Rv
aggccgucgaguuccggcc

SEQ ID NO: 3292535 - RNA, 21 nt, Mycobacterium tuberculosis H37Rv
aggccgucgcgccucaucggc

SEQ ID NO: 3292536 - RNA, 16 nt, Mycobacterium tuberculosis H37Rv
aggccgucggcgucga

SEQ ID NO: 3292537 - RNA, 19 nt, Mycobacterium tuberculosis H37Rv
aggccgugaugccacggcg

SEQ ID NO: 3292538 - RNA, 15 nt, Mycobacterium tuberculosis H37Rv
aggccgugguagacc

SEQ ID NO: 3292539 - RNA, 14 nt, Mycobacterium tuberculosis H37Rv
aggccguugaucgu

SEQ ID NO: 3292540 - RNA, 14 nt, Mycobacterium tuberculosis H37Rv
aggccuaccaggcg

SEQ ID NO: 3292541 - RNA, 22 nt, Mycobacterium tuberculosis H37Rv
aggccuaguccggcacugcggc

SEQ ID NO: 3292542 - RNA, 17 nt, Mycobacterium tuberculosis H37Rv
aggccucagaaccgggu

SEQ ID NO: 3292543 - RNA, 13 nt, Mycobacterium tuberculosis H37Rv
aggccuccacaua

SEQ ID NO: 3292544 - RNA, 21 nt, Mycobacterium tuberculosis H37Rv
aggccugagcgugucuggcga

SEQ ID NO: 3292545 - RNA, 21 nt, Mycobacterium tuberculosis H37Rv
aggccuuuuggcgaaccgcag

SEQ ID NO: 3292546 - RNA, 20 nt, Mycobacterium tuberculosis H37Rv
aggcgaaaauugcuccacca

SEQ ID NO: 3292547 - RNA, 14 nt, Mycobacterium tuberculosis H37Rv
aggcgaaagauggc

SEQ ID NO: 3292548 - RNA, 18 nt, Mycobacterium tuberculosis H37Rv
aggcgaaagauggccuca

SEQ ID NO: 3292549 - RNA, 15 nt, Mycobacterium tuberculosis H37Rv
aggcgaacagggcug

SEQ ID NO: 3292550 - RNA, 14 nt, Mycobacterium tuberculosis H37Rv
aggcgaagcgguga

SEQ ID NO: 3292551 - RNA, 19 nt, Mycobacterium tuberculosis H37Rv
aggcgacccgcugggucga

SEQ ID NO: 3292552 - RNA, 15 nt, Mycobacterium tuberculosis H37Rv
aggcgacgguuccca

SEQ ID NO: 3292553 - RNA, 15 nt, Mycobacterium tuberculosis H37Rv
aggcgagaagcgucg

SEQ ID NO: 3292554 - RNA, 15 nt, Mycobacterium tuberculosis H37Rv
aggcgagccgccacc

SEQ ID NO: 3292555 - RNA, 16 nt, Mycobacterium tuberculosis H37Rv
aggcgagucaccgggu

SEQ ID NO: 3292556 - RNA, 16 nt, Mycobacterium tuberculosis H37Rv
aggcgauccagacggu

SEQ ID NO: 3292557 - RNA, 13 nt, Mycobacterium tuberculosis H37Rv
aggcgaucgcauc

SEQ ID NO: 3292558 - RNA, 14 nt, Mycobacterium tuberculosis H37Rv
aggcgaucgcaucc

SEQ ID NO: 3292559 - RNA, 21 nt, Mycobacterium tuberculosis H37Rv
aggcgaucgcccggccccgca

SEQ ID NO: 3292560 - RNA, 11 nt, Mycobacterium tuberculosis H37Rv
aggcgaugagc

SEQ ID NO: 3292561 - RNA, 20 nt, Mycobacterium tuberculosis H37Rv
aggcgaugagcgugccgcag

SEQ ID NO: 3292562 - RNA, 18 nt, Mycobacterium tuberculosis H37Rv
aggcgaugcgccaggcug

SEQ ID NO: 3292563 - RNA, 22 nt, Mycobacterium tuberculosis H37Rv
aggcgauggucuccucggucac

SEQ ID NO: 3292564 - RNA, 19 nt, Mycobacterium tuberculosis H37Rv
aggcgauucugcgucugcu

SEQ ID NO: 3292565 - RNA, 20 nt, Mycobacterium tuberculosis H37Rv
aggcgauucugcgucugcuc

SEQ ID NO: 3292566 - RNA, 23 nt, Mycobacterium tuberculosis H37Rv
aggcgauugcagcuucggccagc

SEQ ID NO: 3292567 - RNA, 14 nt, Mycobacterium tuberculosis H37Rv
aggcgcaccaggcg

SEQ ID NO: 3292568 - RNA, 22 nt, Mycobacterium tuberculosis H37Rv
aggcgcagauuccucuucaggc

SEQ ID NO: 3292569 - RNA, 23 nt, Mycobacterium tuberculosis H37Rv
aggcgcagauuccucuucaggcc

SEQ ID NO: 3292570 - RNA, 16 nt, Mycobacterium tuberculosis H37Rv
aggcgcagcgccagcg

SEQ ID NO: 3292571 - RNA, 14 nt, Mycobacterium tuberculosis H37Rv
aggcgcagcugggu

SEQ ID NO: 3292572 - RNA, 14 nt, Mycobacterium tuberculosis H37Rv
aggcgcagcugguu

SEQ ID NO: 3292573 - RNA, 22 nt, Mycobacterium tuberculosis H37Rv
aggcgcagcugguuugcggugc

SEQ ID NO: 3292574 - RNA, 23 nt, Mycobacterium tuberculosis H37Rv
aggcgccacgguguacgcgaacc

SEQ ID NO: 3292575 - RNA, 22 nt, Mycobacterium tuberculosis H37Rv
aggcgccacugcuuccggaaca

SEQ ID NO: 3292576 - RNA, 16 nt, Mycobacterium tuberculosis H37Rv
aggcgcccaacaggcg

SEQ ID NO: 3292577 - RNA, 17 nt, Mycobacterium tuberculosis H37Rv
aggcgcccaacaggcgg

SEQ ID NO: 3292578 - RNA, 22 nt, Mycobacterium tuberculosis H37Rv
aggcgcccagcacccuguucca

SEQ ID NO: 3292579 - RNA, 14 nt, Mycobacterium tuberculosis H37Rv
aggcgccgcagggc

SEQ ID NO: 3292580 - RNA, 15 nt, Mycobacterium tuberculosis H37Rv
aggcgccgcagggcc

SEQ ID NO: 3292581 - RNA, 22 nt, Mycobacterium tuberculosis H37Rv
aggcgccgcagggccgcgcgca

SEQ ID NO: 3292582 - RNA, 23 nt, Mycobacterium tuberculosis H37Rv
aggcgccgcgacaaaucggucga

SEQ ID NO: 3292583 - RNA, 14 nt, Mycobacterium tuberculosis H37Rv
aggcgccgcuaucg

SEQ ID NO: 3292584 - RNA, 17 nt, Mycobacterium tuberculosis H37Rv
aggcgccgucucgcggu

SEQ ID NO: 3292585 - RNA, 15 nt, Mycobacterium tuberculosis H37Rv
aggcgcgcaccaccg

SEQ ID NO: 3292586 - RNA, 15 nt, Mycobacterium tuberculosis H37Rv
aggcgcggcccaggu

SEQ ID NO: 3292587 - RNA, 12 nt, Mycobacterium tuberculosis H37Rv
aggcgcgggcga

SEQ ID NO: 3292588 - RNA, 13 nt, Mycobacterium tuberculosis H37Rv
aggcgcggucacc

SEQ ID NO: 3292589 - RNA, 15 nt, Mycobacterium tuberculosis H37Rv
aggcgcuaggaacgc

SEQ ID NO: 3292590 - RNA, 14 nt, Mycobacterium tuberculosis H37Rv
aggcgcugaacgcg

SEQ ID NO: 3292591 - RNA, 18 nt, Mycobacterium tuberculosis H37Rv
aggcgcugaacgcgagca

SEQ ID NO: 3292592 - RNA, 19 nt, Mycobacterium tuberculosis H37Rv
aggcgcugaacgcgagcaa

SEQ ID NO: 3292593 - RNA, 14 nt, Mycobacterium tuberculosis H37Rv
aggcgcugcagcau

SEQ ID NO: 3292594 - RNA, 17 nt, Mycobacterium tuberculosis H37Rv
aggcgcuggugcgcggu

SEQ ID NO: 3292595 - RNA, 15 nt, Mycobacterium tuberculosis H37Rv
aggcgcuucgccaca

SEQ ID NO: 3292596 - RNA, 16 nt, Mycobacterium tuberculosis H37Rv
aggcgcuucgccacac

SEQ ID NO: 3292597 - RNA, 13 nt, Mycobacterium tuberculosis H37Rv
aggcggcaaggac

SEQ ID NO: 3292598 - RNA, 12 nt, Mycobacterium tuberculosis H37Rv
aggcggcagguu

SEQ ID NO: 3292599 - RNA, 13 nt, Mycobacterium tuberculosis H37Rv
aggcggccagcau

SEQ ID NO: 3292600 - RNA, 15 nt, Mycobacterium tuberculosis H37Rv
aggcggccagcgcgc

SEQ ID NO: 3292601 - RNA, 12 nt, Mycobacterium tuberculosis H37Rv
aggcggccaggu

SEQ ID NO: 3292602 - RNA, 17 nt, Mycobacterium tuberculosis H37Rv
aggcggccaggugcagg

SEQ ID NO: 3292603 - RNA, 17 nt, Mycobacterium tuberculosis H37Rv
aggcggcccccggcagc

SEQ ID NO: 3292604 - RNA, 24 nt, Mycobacterium tuberculosis H37Rv
aggcggccgcgucgucgagaaucg

SEQ ID NO: 3292605 - RNA, 18 nt, Mycobacterium tuberculosis H37Rv
aggcggcgccgcacccac

SEQ ID NO: 3292606 - RNA, 21 nt, Mycobacterium tuberculosis H37Rv
aggcggcgcgggucggcgacc

SEQ ID NO: 3292607 - RNA, 14 nt, Mycobacterium tuberculosis H37Rv
aggcggcggccagc

SEQ ID NO: 3292608 - RNA, 12 nt, Mycobacterium tuberculosis H37Rv
aggcggcggccc

SEQ ID NO: 3292609 - RNA, 16 nt, Mycobacterium tuberculosis H37Rv
aggcggcggcccgcag

SEQ ID NO: 3292610 - RNA, 13 nt, Mycobacterium tuberculosis H37Rv
aggcggcugaacg

SEQ ID NO: 3292611 - RNA, 18 nt, Mycobacterium tuberculosis H37Rv
aggcggcugaacggcagc

SEQ ID NO: 3292612 - RNA, 20 nt, Mycobacterium tuberculosis H37Rv
aggcggcugaacggcagccg

SEQ ID NO: 3292613 - RNA, 16 nt, Mycobacterium tuberculosis H37Rv
aggcgggggagcccag

SEQ ID NO: 3292614 - RNA, 20 nt, Mycobacterium tuberculosis H37Rv
aggcgguacgggucgccgga

SEQ ID NO: 3292615 - RNA, 11 nt, Mycobacterium tuberculosis H37Rv
aggcggucacc

SEQ ID NO: 3292616 - RNA, 21 nt, Mycobacterium tuberculosis H37Rv
aggcggucgaucauggcggca

SEQ ID NO: 3292617 - RNA, 18 nt, Mycobacterium tuberculosis H37Rv
aggcggucuuguccagga

SEQ ID NO: 3292618 - RNA, 14 nt, Mycobacterium tuberculosis H37Rv
aggcggugacgugg

SEQ ID NO: 3292619 - RNA, 22 nt, Mycobacterium tuberculosis H37Rv
aggcggugacguggugggcuug

SEQ ID NO: 3292620 - RNA, 18 nt, Mycobacterium tuberculosis H37Rv
aggcguaaucaagcagcg

SEQ ID NO: 3292621 - RNA, 15 nt, Mycobacterium tuberculosis H37Rv
aggcguccaucagag

SEQ ID NO: 3292622 - RNA, 19 nt, Mycobacterium tuberculosis H37Rv
aggcgugcacugaccgcgg

SEQ ID NO: 3292623 - RNA, 21 nt, Mycobacterium tuberculosis H37Rv
agggcuuucgcuuccugggca

SEQ ID NO: 3292624 - RNA, 14 nt, Mycobacterium tuberculosis H37Rv
aggggacgggcggc

SEQ ID NO: 3292625 - RNA, 22 nt, Mycobacterium tuberculosis H37Rv
aggggaguugcgacgauacacg

SEQ ID NO: 3292626 - RNA, 20 nt, Mycobacterium tuberculosis H37Rv
aggggaucaccggcugcuga

SEQ ID NO: 3292627 - RNA, 20 nt, Mycobacterium tuberculosis H37Rv
aggggaucccccgcgcgaac

SEQ ID NO: 3292628 - RNA, 15 nt, Mycobacterium tuberculosis H37Rv
aggggaucugagugg

SEQ ID NO: 3292629 - RNA, 18 nt, Mycobacterium tuberculosis H37Rv
aggggaucugaguggacg

SEQ ID NO: 3292630 - RNA, 15 nt, Mycobacterium tuberculosis H37Rv
aggggcaacagggga

SEQ ID NO: 3292631 - RNA, 18 nt, Mycobacterium tuberculosis H37Rv
aggggcgcagcgcggcaa

SEQ ID NO: 3292632 - RNA, 18 nt, Mycobacterium tuberculosis H37Rv
aggggcgucgcaacgcga

SEQ ID NO: 3292633 - RNA, 21 nt, Mycobacterium tuberculosis H37Rv
aggggcuuuugcgucugcucg

SEQ ID NO: 3292634 - RNA, 22 nt, Mycobacterium tuberculosis H37Rv
aggggcuuuugcgucugcucgc

SEQ ID NO: 3292635 - RNA, 20 nt, Mycobacterium tuberculosis H37Rv
agggguggcgcgggccggcg

SEQ ID NO: 3292636 - RNA, 23 nt, Mycobacterium tuberculosis H37Rv
aggguagacggggcgagcaugcc

SEQ ID NO: 3292637 - RNA, 22 nt, Mycobacterium tuberculosis H37Rv
aggguaucgaaaaguagaccga

SEQ ID NO: 3292638 - RNA, 15 nt, Mycobacterium tuberculosis H37Rv
agggucaucgccagc

SEQ ID NO: 3292639 - RNA, 16 nt, Mycobacterium tuberculosis H37Rv
agggucaucgccagcg

SEQ ID NO: 3292640 - RNA, 16 nt, Mycobacterium tuberculosis H37Rv
agggucgacguaggac

SEQ ID NO: 3292641 - RNA, 19 nt, Mycobacterium tuberculosis H37Rv
agggucugcgccgccggcg

SEQ ID NO: 3292642 - RNA, 19 nt, Mycobacterium tuberculosis H37Rv
agggugcccgcguugccaa

SEQ ID NO: 3292643 - RNA, 13 nt, Mycobacterium tuberculosis H37Rv
agggugccgguca

SEQ ID NO: 3292644 - RNA, 13 nt, Mycobacterium tuberculosis H37Rv
agggugcugaucu

SEQ ID NO: 3292645 - RNA, 16 nt, Mycobacterium tuberculosis H37Rv
aggguggaccggucga

SEQ ID NO: 3292646 - RNA, 18 nt, Mycobacterium tuberculosis H37Rv
aggguggaccggucgaca

SEQ ID NO: 3292647 - RNA, 14 nt, Mycobacterium tuberculosis H37Rv
aggguggccagcag

SEQ ID NO: 3292648 - RNA, 15 nt, Mycobacterium tuberculosis H37Rv
aggguggccagcagg

SEQ ID NO: 3292649 - RNA, 14 nt, Mycobacterium tuberculosis H37Rv
aggguggccggucc

SEQ ID NO: 3292650 - RNA, 16 nt, Mycobacterium tuberculosis H37Rv
aggguggcgcgguacc

SEQ ID NO: 3292651 - RNA, 21 nt, Mycobacterium tuberculosis H37Rv
aggguggggcgguggccggcg

SEQ ID NO: 3292652 - RNA, 23 nt, Mycobacterium tuberculosis H37Rv
agggugucgaagagcaggcccau

SEQ ID NO: 3292653 - RNA, 13 nt, Mycobacterium tuberculosis H37Rv
aggguguugcggc

SEQ ID NO: 3292654 - RNA, 20 nt, Mycobacterium tuberculosis H37Rv
aggguguugcggcugaccuc

SEQ ID NO: 3292655 - RNA, 20 nt, Mycobacterium tuberculosis H37Rv
aggguucggacggcugguag

SEQ ID NO: 3292656 - RNA, 20 nt, Mycobacterium tuberculosis H37Rv
aggguuuccaagucggagcg

SEQ ID NO: 3292657 - RNA, 21 nt, Mycobacterium tuberculosis H37Rv
aggguuuccaagucggagcgg

SEQ ID NO: 3292658 - RNA, 13 nt, Mycobacterium tuberculosis H37Rv
agguaagcagcca

SEQ ID NO: 3292659 - RNA, 16 nt, Mycobacterium tuberculosis H37Rv
agguaagcagccagca

SEQ ID NO: 3292660 - RNA, 23 nt, Mycobacterium tuberculosis H37Rv
agguaagcgaacggguagucggg

SEQ ID NO: 3292661 - RNA, 21 nt, Mycobacterium tuberculosis H37Rv
agguaauugccgaccgccuga

SEQ ID NO: 3292662 - RNA, 15 nt, Mycobacterium tuberculosis H37Rv
agguacaucaccacg

SEQ ID NO: 3292663 - RNA, 15 nt, Mycobacterium tuberculosis H37Rv
agguacccggucggg

SEQ ID NO: 3292664 - RNA, 14 nt, Mycobacterium tuberculosis H37Rv
agguacgccaggug

SEQ ID NO: 3292665 - RNA, 13 nt, Mycobacterium tuberculosis H37Rv
agguacgccucga

SEQ ID NO: 3292666 - RNA, 22 nt, Mycobacterium tuberculosis H37Rv
agguacgucuuggaucacgcga

SEQ ID NO: 3292667 - RNA, 21 nt, Mycobacterium tuberculosis H37Rv
agguacucaguguuccgccac

SEQ ID NO: 3292668 - RNA, 20 nt, Mycobacterium tuberculosis H37Rv
agguacuuugcgcccggcac

SEQ ID NO: 3292669 - RNA, 15 nt, Mycobacterium tuberculosis H37Rv
agguaggacucacgc

SEQ ID NO: 3292670 - RNA, 23 nt, Mycobacterium tuberculosis H37Rv
agguaggucugggcaagaccgcg

SEQ ID NO: 3292671 - RNA, 22 nt, Mycobacterium tuberculosis H37Rv
agguagucgucgacuugcaggc

SEQ ID NO: 3292672 - RNA, 22 nt, Mycobacterium tuberculosis H37Rv
agguaguucgacugaaucaugg

SEQ ID NO: 3292673 - RNA, 17 nt, Mycobacterium tuberculosis H37Rv
agguauaaacgcggcgc

SEQ ID NO: 3292674 - RNA, 13 nt, Mycobacterium tuberculosis H37Rv
agguaugcgguug

SEQ ID NO: 3292675 - RNA, 21 nt, Mycobacterium tuberculosis H37Rv
aggucaacgggaggugguuca

SEQ ID NO: 3292676 - RNA, 19 nt, Mycobacterium tuberculosis H37Rv
aggucaaggucgucgugga

SEQ ID NO: 3292677 - RNA, 11 nt, Mycobacterium tuberculosis H37Rv
aggucacccau

SEQ ID NO: 3292678 - RNA, 15 nt, Mycobacterium tuberculosis H37Rv
aggucaccggccgcc

SEQ ID NO: 3292679 - RNA, 15 nt, Mycobacterium tuberculosis H37Rv
aggucaccggucacc

SEQ ID NO: 3292680 - RNA, 20 nt, Mycobacterium tuberculosis H37Rv
aggucaccggucaccgcgca

SEQ ID NO: 3292681 - RNA, 21 nt, Mycobacterium tuberculosis H37Rv
aggucacuccaugauccagcc

SEQ ID NO: 3292682 - RNA, 16 nt, Mycobacterium tuberculosis H37Rv
aggucagcgggcuugc

SEQ ID NO: 3292683 - RNA, 19 nt, Mycobacterium tuberculosis H37Rv
agguccccacauggcccgg

SEQ ID NO: 3292684 - RNA, 15 nt, Mycobacterium tuberculosis H37Rv
aggucccggcuggga

SEQ ID NO: 3292685 - RNA, 23 nt, Mycobacterium tuberculosis H37Rv
aggucccgugcgcgcgcagcuga

SEQ ID NO: 3292686 - RNA, 22 nt, Mycobacterium tuberculosis H37Rv
agguccgcacgaucugcaggcc

SEQ ID NO: 3292687 - RNA, 22 nt, Mycobacterium tuberculosis H37Rv
agguccgccccguugugucacc

SEQ ID NO: 3292688 - RNA, 19 nt, Mycobacterium tuberculosis H37Rv
agguccgcggccgcgguga

SEQ ID NO: 3292689 - RNA, 21 nt, Mycobacterium tuberculosis H37Rv
agguccgugccgaugccggcg

SEQ ID NO: 3292690 - RNA, 20 nt, Mycobacterium tuberculosis H37Rv
agguccucgagguccucguc

SEQ ID NO: 3292691 - RNA, 21 nt, Mycobacterium tuberculosis H37Rv
agguccuggguguagcaaguc

SEQ ID NO: 3292692 - RNA, 19 nt, Mycobacterium tuberculosis H37Rv
agguccuugaugcgcccca

SEQ ID NO: 3292693 - RNA, 14 nt, Mycobacterium tuberculosis H37Rv
aggucgacauaggc

SEQ ID NO: 3292694 - RNA, 17 nt, Mycobacterium tuberculosis H37Rv
aggucgacauaggccac

SEQ ID NO: 3292695 - RNA, 23 nt, Mycobacterium tuberculosis H37Rv
aggucgacauaggccaccuccga

SEQ ID NO: 3292696 - RNA, 22 nt, Mycobacterium tuberculosis H37Rv
aggucgacccaacgcagaucag

SEQ ID NO: 3292697 - RNA, 18 nt, Mycobacterium tuberculosis H37Rv
aggucgacgccgaccacc

SEQ ID NO: 3292698 - RNA, 18 nt, Mycobacterium tuberculosis H37Rv
aggucgacggaaucgucg

SEQ ID NO: 3292699 - RNA, 18 nt, Mycobacterium tuberculosis H37Rv
aggucgacgggcacgcgg

SEQ ID NO: 3292700 - RNA, 21 nt, Mycobacterium tuberculosis H37Rv
aggucgagcgccuuugcccga

SEQ ID NO: 3292701 - RNA, 23 nt, Mycobacterium tuberculosis H37Rv
aggucgauaccggcgugcaguac

SEQ ID NO: 3292702 - RNA, 16 nt, Mycobacterium tuberculosis H37Rv
aggucgaucugcgcca

SEQ ID NO: 3292703 - RNA, 12 nt, Mycobacterium tuberculosis H37Rv
aggucgaugccg

SEQ ID NO: 3292704 - RNA, 17 nt, Mycobacterium tuberculosis H37Rv
aggucgaugcgggcgac

SEQ ID NO: 3292705 - RNA, 20 nt, Mycobacterium tuberculosis H37Rv
aggucgcauucugcugccag

SEQ ID NO: 3292706 - RNA, 20 nt, Mycobacterium tuberculosis H37Rv
aggucgccgcaacaugggug

SEQ ID NO: 3292707 - RNA, 16 nt, Mycobacterium tuberculosis H37Rv
aggucgccggcacacc

SEQ ID NO: 3292708 - RNA, 17 nt, Mycobacterium tuberculosis H37Rv
aggucgcggucgagcag

SEQ ID NO: 3292709 - RNA, 20 nt, Mycobacterium tuberculosis H37Rv
aggucggccagcagcagugc

SEQ ID NO: 3292710 - RNA, 21 nt, Mycobacterium tuberculosis H37Rv
aggucggcgggcgcggguggc

SEQ ID NO: 3292711 - RNA, 16 nt, Mycobacterium tuberculosis H37Rv
aggucgguaccccagc

SEQ ID NO: 3292712 - RNA, 17 nt, Mycobacterium tuberculosis H37Rv
aggucggucaggucgag

SEQ ID NO: 3292713 - RNA, 17 nt, Mycobacterium tuberculosis H37Rv
aggucggugcggucauc

SEQ ID NO: 3292714 - RNA, 22 nt, Mycobacterium tuberculosis H37Rv
aggucgucacgccccucacgug

SEQ ID NO: 3292715 - RNA, 23 nt, Mycobacterium tuberculosis H37Rv
aggucguggacuuuauggcuagu

SEQ ID NO: 3292716 - RNA, 12 nt, Mycobacterium tuberculosis H37Rv
aggucuccggca

SEQ ID NO: 3292717 - RNA, 23 nt, Mycobacterium tuberculosis H37Rv
aggucuccggcaagccgauugcu

SEQ ID NO: 3292718 - RNA, 18 nt, Mycobacterium tuberculosis H37Rv
agucaacaccgcggccga

SEQ ID NO: 3292719 - RNA, 19 nt, Mycobacterium tuberculosis H37Rv
agucaacagggccaggaca

SEQ ID NO: 3292720 - RNA, 17 nt, Mycobacterium tuberculosis H37Rv
agucaacgaacgauggg

SEQ ID NO: 3292721 - RNA, 18 nt, Mycobacterium tuberculosis H37Rv
agucaagauugaccgcgg

SEQ ID NO: 3292722 - RNA, 21 nt, Mycobacterium tuberculosis H37Rv
agucaaucgcgucaucaacgu

SEQ ID NO: 3292723 - RNA, 14 nt, Mycobacterium tuberculosis H37Rv
agucacagcucacc

SEQ ID NO: 3292724 - RNA, 20 nt, Mycobacterium tuberculosis H37Rv
agucaccgcgcuggucagcc

SEQ ID NO: 3292725 - RNA, 15 nt, Mycobacterium tuberculosis H37Rv
agucacgcacccggc

SEQ ID NO: 3292726 - RNA, 21 nt, Mycobacterium tuberculosis H37Rv
agucacgcagccgcgcgguga

SEQ ID NO: 3292727 - RNA, 21 nt, Mycobacterium tuberculosis H37Rv
agucacggaugcggccgguga

SEQ ID NO: 3292728 - RNA, 12 nt, Mycobacterium tuberculosis H37Rv
agucacggucgu

SEQ ID NO: 3292729 - RNA, 18 nt, Mycobacterium tuberculosis H37Rv
agucacggucguggugca

SEQ ID NO: 3292730 - RNA, 11 nt, Mycobacterium tuberculosis H37Rv
agucagaaccg

SEQ ID NO: 3292731 - RNA, 21 nt, Mycobacterium tuberculosis H37Rv
agucauccaggucgccuuccc

SEQ ID NO: 3292732 - RNA, 22 nt, Mycobacterium tuberculosis H37Rv
agucauccaggucgccuuccca

SEQ ID NO: 3292733 - RNA, 22 nt, Mycobacterium tuberculosis H37Rv
agucauucgcuccggucggguu

SEQ ID NO: 3292734 - RNA, 17 nt, Mycobacterium tuberculosis H37Rv
aguccaacucggccaac

SEQ ID NO: 3292735 - RNA, 22 nt, Mycobacterium tuberculosis H37Rv
aguccaaucuucucgagccgcc

SEQ ID NO: 3292736 - RNA, 14 nt, Mycobacterium tuberculosis H37Rv
aguccaccaccugg

SEQ ID NO: 3292737 - RNA, 21 nt, Mycobacterium tuberculosis H37Rv
aguccaccaccuggccggcca

SEQ ID NO: 3292738 - RNA, 13 nt, Mycobacterium tuberculosis H37Rv
aguccaccgcgcg

SEQ ID NO: 3292739 - RNA, 18 nt, Mycobacterium tuberculosis H37Rv
aguccagcucgcugcgcg

SEQ ID NO: 3292740 - RNA, 14 nt, Mycobacterium tuberculosis H37Rv
aguccaggcagcuu

SEQ ID NO: 3292741 - RNA, 16 nt, Mycobacterium tuberculosis H37Rv
aguccaggcagcuugc

SEQ ID NO: 3292742 - RNA, 18 nt, Mycobacterium tuberculosis H37Rv
aguccaggcagcuugcca

SEQ ID NO: 3292743 - RNA, 16 nt, Mycobacterium tuberculosis H37Rv
aguccaggccggcagc

SEQ ID NO: 3292744 - RNA, 20 nt, Mycobacterium tuberculosis H37Rv
aguccaggccggcagcuugc

SEQ ID NO: 3292745 - RNA, 15 nt, Mycobacterium tuberculosis H37Rv
agucccacugccacu

SEQ ID NO: 3292746 - RNA, 18 nt, Mycobacterium tuberculosis H37Rv
agucccacugccacuccu

SEQ ID NO: 3292747 - RNA, 15 nt, Mycobacterium tuberculosis H37Rv
agucccacugggccg

SEQ ID NO: 3292748 - RNA, 18 nt, Mycobacterium tuberculosis H37Rv
aguccccaggugggcagc

SEQ ID NO: 3292749 - RNA, 17 nt, Mycobacterium tuberculosis H37Rv
aguccccgaaccgagcg

SEQ ID NO: 3292750 - RNA, 18 nt, Mycobacterium tuberculosis H37Rv
aguccccgaaccgagcgg

SEQ ID NO: 3292751 - RNA, 20 nt, Mycobacterium tuberculosis H37Rv
aguccccgcuuggcgagcca

SEQ ID NO: 3292752 - RNA, 19 nt, Mycobacterium tuberculosis H37Rv
agucccgguagaccaugaa

SEQ ID NO: 3292753 - RNA, 16 nt, Mycobacterium tuberculosis H37Rv
aguccgagcuuggccg

SEQ ID NO: 3292754 - RNA, 15 nt, Mycobacterium tuberculosis H37Rv
aguccgagggcgucg

SEQ ID NO: 3292755 - RNA, 21 nt, Mycobacterium tuberculosis H37Rv
aguccgaucacccgcacucca

SEQ ID NO: 3292756 - RNA, 18 nt, Mycobacterium tuberculosis H37Rv
aguccgaugggaaucagu

SEQ ID NO: 3292757 - RNA, 19 nt, Mycobacterium tuberculosis H37Rv
aguccgcacgcggcaaugg

SEQ ID NO: 3292758 - RNA, 14 nt, Mycobacterium tuberculosis H37Rv
aguccgccgccugc

SEQ ID NO: 3292759 - RNA, 17 nt, Mycobacterium tuberculosis H37Rv
aguccgccgccugcgca

SEQ ID NO: 3292760 - RNA, 20 nt, Mycobacterium tuberculosis H37Rv
aguccgcgccgacggccagc

SEQ ID NO: 3292761 - RNA, 20 nt, Mycobacterium tuberculosis H37Rv
aguccgcgcucagcuccggc

SEQ ID NO: 3292762 - RNA, 23 nt, Mycobacterium tuberculosis H37Rv
aguccgcugcuucuccgagauca

SEQ ID NO: 3292763 - RNA, 13 nt, Mycobacterium tuberculosis H37Rv
aguccggcccccc

SEQ ID NO: 3292764 - RNA, 14 nt, Mycobacterium tuberculosis H37Rv
aguccggccgaccc

SEQ ID NO: 3292765 - RNA, 18 nt, Mycobacterium tuberculosis H37Rv
aguccggccgacccggau

SEQ ID NO: 3292766 - RNA, 21 nt, Mycobacterium tuberculosis H37Rv
aguccggcucauccgacggga

SEQ ID NO: 3292767 - RNA, 14 nt, Mycobacterium tuberculosis H37Rv
aguccgguagcagc

SEQ ID NO: 3292768 - RNA, 20 nt, Mycobacterium tuberculosis H37Rv
aguccggucgcggagaacgc

SEQ ID NO: 3292769 - RNA, 21 nt, Mycobacterium tuberculosis H37Rv
aguccgucgacaccgcggacc

SEQ ID NO: 3292770 - RNA, 13 nt, Mycobacterium tuberculosis H37Rv
aguccguggagcg

SEQ ID NO: 3292771 - RNA, 19 nt, Mycobacterium tuberculosis H37Rv
aguccucgacguggccgac

SEQ ID NO: 3292772 - RNA, 13 nt, Mycobacterium tuberculosis H37Rv
agucgaacaagac

SEQ ID NO: 3292773 - RNA, 18 nt, Mycobacterium tuberculosis H37Rv
agucgaacaagaccgcgg

SEQ ID NO: 3292774 - RNA, 21 nt, Mycobacterium tuberculosis H37Rv
agucgaagaaccugagcacca

SEQ ID NO: 3292775 - RNA, 14 nt, Mycobacterium tuberculosis H37Rv
agucgaagaagacc

SEQ ID NO: 3292776 - RNA, 19 nt, Mycobacterium tuberculosis H37Rv
agucgaagucguaccuaag

SEQ ID NO: 3292777 - RNA, 16 nt, Mycobacterium tuberculosis H37Rv
agucgacgacguccuc

SEQ ID NO: 3292778 - RNA, 15 nt, Mycobacterium tuberculosis H37Rv
agucgacgacguggc

SEQ ID NO: 3292779 - RNA, 18 nt, Mycobacterium tuberculosis H37Rv
agucgacgacguggcugc

SEQ ID NO: 3292780 - RNA, 16 nt, Mycobacterium tuberculosis H37Rv
agucgacgccgcagcg

SEQ ID NO: 3292781 - RNA, 16 nt, Mycobacterium tuberculosis H37Rv
agucgaucuccgucgg

SEQ ID NO: 3292782 - RNA, 16 nt, Mycobacterium tuberculosis H37Rv
agucgaugaccccggu

SEQ ID NO: 3292783 - RNA, 20 nt, Mycobacterium tuberculosis H37Rv
agucgauuggcugcgccgau

SEQ ID NO: 3292784 - RNA, 18 nt, Mycobacterium tuberculosis H37Rv
agucgauuucggcggcga

SEQ ID NO: 3292785 - RNA, 18 nt, Mycobacterium tuberculosis H37Rv
agucgcacggugccgccg

SEQ ID NO: 3292786 - RNA, 13 nt, Mycobacterium tuberculosis H37Rv
agucgcacugcgc

SEQ ID NO: 3292787 - RNA, 13 nt, Mycobacterium tuberculosis H37Rv
agucgccagaccg

SEQ ID NO: 3292788 - RNA, 16 nt, Mycobacterium tuberculosis H37Rv
agucgccgaucgagac

SEQ ID NO: 3292789 - RNA, 14 nt, Mycobacterium tuberculosis H37Rv
agucgccggucagg

SEQ ID NO: 3292790 - RNA, 22 nt, Mycobacterium tuberculosis H37Rv
agucgccgucgugccaccguug

SEQ ID NO: 3292791 - RNA, 22 nt, Mycobacterium tuberculosis H37Rv
agucgcgaacucaugcccgacg

SEQ ID NO: 3292792 - RNA, 23 nt, Mycobacterium tuberculosis H37Rv
agucgcgaacucaugcccgacga

SEQ ID NO: 3292793 - RNA, 17 nt, Mycobacterium tuberculosis H37Rv
agucgcgcgccaagacg

SEQ ID NO: 3292794 - RNA, 15 nt, Mycobacterium tuberculosis H37Rv
agucgcggacgucgc

SEQ ID NO: 3292795 - RNA, 15 nt, Mycobacterium tuberculosis H37Rv
agucgcgggccaagc

SEQ ID NO: 3292796 - RNA, 19 nt, Mycobacterium tuberculosis H37Rv
agucgcgggugcggacacc

SEQ ID NO: 3292797 - RNA, 18 nt, Mycobacterium tuberculosis H37Rv
agucgcgguaccaucacc

SEQ ID NO: 3292798 - RNA, 13 nt, Mycobacterium tuberculosis H37Rv
agucgcugggugg

SEQ ID NO: 3292799 - RNA, 16 nt, Mycobacterium tuberculosis H37Rv
agucgcugucggcaug

SEQ ID NO: 3292800 - RNA, 19 nt, Mycobacterium tuberculosis H37Rv
agucggccuccucgucgcu

SEQ ID NO: 3292801 - RNA, 19 nt, Mycobacterium tuberculosis H37Rv
agucggcgcuggccgucga

SEQ ID NO: 3292802 - RNA, 13 nt, Mycobacterium tuberculosis H37Rv
agucgggcaaggc

SEQ ID NO: 3292803 - RNA, 23 nt, Mycobacterium tuberculosis H37Rv
agucgggccgguacuugaggguc

SEQ ID NO: 3292804 - RNA, 17 nt, Mycobacterium tuberculosis H37Rv
agucggggugggacagg

SEQ ID NO: 3292805 - RNA, 22 nt, Mycobacterium tuberculosis H37Rv
agucgguagcugaccgugcuga

SEQ ID NO: 3292806 - RNA, 17 nt, Mycobacterium tuberculosis H37Rv
agucguagacggcgaaa

SEQ ID NO: 3292807 - RNA, 19 nt, Mycobacterium tuberculosis H37Rv
agucgucgacuugcaggcg

SEQ ID NO: 3292808 - RNA, 14 nt, Mycobacterium tuberculosis H37Rv
agucgucggcaugg

SEQ ID NO: 3292809 - RNA, 22 nt, Mycobacterium tuberculosis H37Rv
agucgucuucgucauggccggc

SEQ ID NO: 3292810 - RNA, 18 nt, Mycobacterium tuberculosis H37Rv
agucgugcuugcccgguu

SEQ ID NO: 3292811 - RNA, 13 nt, Mycobacterium tuberculosis H37Rv
agucgugggcugu

SEQ ID NO: 3292812 - RNA, 20 nt, Mycobacterium tuberculosis H37Rv
agucuccggaaccacucgcu

SEQ ID NO: 3292813 - RNA, 15 nt, Mycobacterium tuberculosis H37Rv
agucuccggcgucgg

SEQ ID NO: 3292814 - RNA, 19 nt, Mycobacterium tuberculosis H37Rv
aguguugcaguggcgacga

SEQ ID NO: 3292815 - RNA, 21 nt, Mycobacterium tuberculosis H37Rv
aguuagccaccuuggacacca

SEQ ID NO: 3292816 - RNA, 15 nt, Mycobacterium tuberculosis H37Rv
aguuaggccgccagc

SEQ ID NO: 3292817 - RNA, 17 nt, Mycobacterium tuberculosis H37Rv
aguuaggccgccagccg

SEQ ID NO: 3292818 - RNA, 18 nt, Mycobacterium tuberculosis H37Rv
aguuaggccgccagccgg

SEQ ID NO: 3292819 - RNA, 13 nt, Mycobacterium tuberculosis H37Rv
aguucaccgcgcu

SEQ ID NO: 3292820 - RNA, 21 nt, Mycobacterium tuberculosis H37Rv
aguucagcgccguccuagcgu

SEQ ID NO: 3292821 - RNA, 19 nt, Mycobacterium tuberculosis H37Rv
aguuccaaaucgguggcaa

SEQ ID NO: 3292822 - RNA, 21 nt, Mycobacterium tuberculosis H37Rv
aguuccacggguggugccagg

SEQ ID NO: 3292823 - RNA, 22 nt, Mycobacterium tuberculosis H37Rv
aguucccuacacccauuacuga

SEQ ID NO: 3292824 - RNA, 20 nt, Mycobacterium tuberculosis H37Rv
aguuccggucgacuccagca

SEQ ID NO: 3292825 - RNA, 11 nt, Mycobacterium tuberculosis H37Rv
aguuccucuac

SEQ ID NO: 3292826 - RNA, 22 nt, Mycobacterium tuberculosis H37Rv
aguuccuugccgaucgccgagu

SEQ ID NO: 3292827 - RNA, 22 nt, Mycobacterium tuberculosis H37Rv
aguucgacggcgucaaaggccu

SEQ ID NO: 3292828 - RNA, 21 nt, Mycobacterium tuberculosis H37Rv
aguucgacggugccgucugcg

SEQ ID NO: 3292829 - RNA, 15 nt, Mycobacterium tuberculosis H37Rv
aguucgagcugccag

SEQ ID NO: 3292830 - RNA, 20 nt, Mycobacterium tuberculosis H37Rv
aguucgcacccguucgugag

SEQ ID NO: 3292831 - RNA, 15 nt, Mycobacterium tuberculosis H37Rv
aguucgccagcaacg

SEQ ID NO: 3292832 - RNA, 15 nt, Mycobacterium tuberculosis H37Rv
aguucgcgccacgca

SEQ ID NO: 3292833 - RNA, 14 nt, Mycobacterium tuberculosis H37Rv
aguucgcgcuggca

SEQ ID NO: 3292834 - RNA, 18 nt, Mycobacterium tuberculosis H37Rv
aguucgcggcugcguugu

SEQ ID NO: 3292835 - RNA, 18 nt, Mycobacterium tuberculosis H37Rv
aguucggcccgcaaacag

SEQ ID NO: 3292836 - RNA, 21 nt, Mycobacterium tuberculosis H37Rv
aguucggccgucauggcccga

SEQ ID NO: 3292837 - RNA, 16 nt, Mycobacterium tuberculosis H37Rv
aguucggcgagcacau

SEQ ID NO: 3292838 - RNA, 18 nt, Mycobacterium tuberculosis H37Rv
aguucgggcaacggcagc

SEQ ID NO: 3292839 - RNA, 20 nt, Mycobacterium tuberculosis H37Rv
aguucgguguagaucagcaa

SEQ ID NO: 3292840 - RNA, 22 nt, Mycobacterium tuberculosis H37Rv
aguucgucaccguuggccgcgc

SEQ ID NO: 3292841 - RNA, 22 nt, Mycobacterium tuberculosis H37Rv
aguucgucggcggugcgcugau

SEQ ID NO: 3292842 - RNA, 19 nt, Mycobacterium tuberculosis H37Rv
aguucuccucgugcagcac

SEQ ID NO: 3292843 - RNA, 21 nt, Mycobacterium tuberculosis H37Rv
aguugaacaauccgguguuga

SEQ ID NO: 3292844 - RNA, 14 nt, Mycobacterium tuberculosis H37Rv
aguugaagaagccc

SEQ ID NO: 3292845 - RNA, 19 nt, Mycobacterium tuberculosis H37Rv
aguugaccgccgugggugu

SEQ ID NO: 3292846 - RNA, 11 nt, Mycobacterium tuberculosis H37Rv
aguugaggccg

SEQ ID NO: 3292847 - RNA, 16 nt, Mycobacterium tuberculosis H37Rv
aguugcacaccggcac

SEQ ID NO: 3292848 - RNA, 15 nt, Mycobacterium tuberculosis H37Rv
aguugccggucaggc

SEQ ID NO: 3292849 - RNA, 16 nt, Mycobacterium tuberculosis H37Rv
aguugccggucaggca

SEQ ID NO: 3292850 - RNA, 14 nt, Mycobacterium tuberculosis H37Rv
aguugcucggccga

SEQ ID NO: 3292851 - RNA, 22 nt, Mycobacterium tuberculosis H37Rv
aguugcucggcuucccuaggcu

SEQ ID NO: 3292852 - RNA, 16 nt, Mycobacterium tuberculosis H37Rv
aguuggcaccagccgg

SEQ ID NO: 3292853 - RNA, 19 nt, Mycobacterium tuberculosis H37Rv
aguuggccaguaugcggug

SEQ ID NO: 3292854 - RNA, 18 nt, Mycobacterium tuberculosis H37Rv
aguuggccaugcaccgau

SEQ ID NO: 3292855 - RNA, 23 nt, Mycobacterium tuberculosis H37Rv
aguuggcgcccgaagccgggccc

SEQ ID NO: 3292856 - RNA, 15 nt, Mycobacterium tuberculosis H37Rv
aguugggcguucagg

SEQ ID NO: 3292857 - RNA, 15 nt, Mycobacterium tuberculosis H37Rv
aguugggugggugca

SEQ ID NO: 3292858 - RNA, 15 nt, Mycobacterium tuberculosis H37Rv
aguuguagacgucga

SEQ ID NO: 3292859 - RNA, 21 nt, Mycobacterium tuberculosis H37Rv
aguugugcgcacucuuuccuu

SEQ ID NO: 3292860 - RNA, 16 nt, Mycobacterium tuberculosis H37Rv
aguugugcggccaggc

SEQ ID NO: 3292861 - RNA, 15 nt, Mycobacterium tuberculosis H37Rv
aguuguuggccagac

SEQ ID NO: 3292862 - RNA, 16 nt, Mycobacterium tuberculosis H37Rv
aguuuccccuaccaga

SEQ ID NO: 3292863 - RNA, 17 nt, Mycobacterium tuberculosis H37Rv
auaaaccgcacaucgcu

SEQ ID NO: 3292864 - RNA, 13 nt, Mycobacterium tuberculosis H37Rv
auaacccagcacc

SEQ ID NO: 3292865 - RNA, 13 nt, Mycobacterium tuberculosis H37Rv
auaacccuggccg

SEQ ID NO: 3292866 - RNA, 23 nt, Mycobacterium tuberculosis H37Rv
auaacgcuucaugaacagccggu

SEQ ID NO: 3292867 - RNA, 17 nt, Mycobacterium tuberculosis H37Rv
auaagcccccgacacgc

SEQ ID NO: 3292868 - RNA, 11 nt, Mycobacterium tuberculosis H37Rv
auaagguauuc

SEQ ID NO: 3292869 - RNA, 23 nt, Mycobacterium tuberculosis H37Rv
auaauucaacagcaccgcgacga

SEQ ID NO: 3292870 - RNA, 15 nt, Mycobacterium tuberculosis H37Rv
auacaccugcuggaa

SEQ ID NO: 3292871 - RNA, 20 nt, Mycobacterium tuberculosis H37Rv
auacaccugcuggaagccgu

SEQ ID NO: 3292872 - RNA, 23 nt, Mycobacterium tuberculosis H37Rv
auacacugaaucguuggcgaucg

SEQ ID NO: 3292873 - RNA, 13 nt, Mycobacterium tuberculosis H37Rv
auacagccgccga

SEQ ID NO: 3292874 - RNA, 21 nt, Mycobacterium tuberculosis H37Rv
auacaggccacgcaccgggug

SEQ ID NO: 3292875 - RNA, 23 nt, Mycobacterium tuberculosis H37Rv
auacaggccacgcaccgggugca

SEQ ID NO: 3292876 - RNA, 20 nt, Mycobacterium tuberculosis H37Rv
auacaggcccgccagcaggg

SEQ ID NO: 3292877 - RNA, 18 nt, Mycobacterium tuberculosis H37Rv
auacaggcccggcaccgc

SEQ ID NO: 3292878 - RNA, 19 nt, Mycobacterium tuberculosis H37Rv
auacauccaggcuguggcc

SEQ ID NO: 3292879 - RNA, 17 nt, Mycobacterium tuberculosis H37Rv
auacaucgccuugccca

SEQ ID NO: 3292880 - RNA, 23 nt, Mycobacterium tuberculosis H37Rv
auacauuucgucgucgcagugca

SEQ ID NO: 3292881 - RNA, 16 nt, Mycobacterium tuberculosis H37Rv
auaccaagcgcggugg

SEQ ID NO: 3292882 - RNA, 23 nt, Mycobacterium tuberculosis H37Rv
auaccagaccggccgacgugaca

SEQ ID NO: 3292883 - RNA, 18 nt, Mycobacterium tuberculosis H37Rv
auaccgaaaucaccucac

SEQ ID NO: 3292884 - RNA, 13 nt, Mycobacterium tuberculosis H37Rv
auaccgcaccaaa

SEQ ID NO: 3292885 - RNA, 18 nt, Mycobacterium tuberculosis H37Rv
auaccggcaucgaagugc

SEQ ID NO: 3292886 - RNA, 17 nt, Mycobacterium tuberculosis H37Rv
auaccggcgugcaguac

SEQ ID NO: 3292887 - RNA, 23 nt, Mycobacterium tuberculosis H37Rv
auaccgguugcggucaucggcgc

SEQ ID NO: 3292888 - RNA, 17 nt, Mycobacterium tuberculosis H37Rv
auaccucgccgcccugu

SEQ ID NO: 3292889 - RNA, 20 nt, Mycobacterium tuberculosis H37Rv
auaccugaaugucguugaga

SEQ ID NO: 3292890 - RNA, 15 nt, Mycobacterium tuberculosis H37Rv
auacgaacucaccgc

SEQ ID NO: 3292891 - RNA, 22 nt, Mycobacterium tuberculosis H37Rv
auacgauguucagguugcugau

SEQ ID NO: 3292892 - RNA, 19 nt, Mycobacterium tuberculosis H37Rv
auacgcccacuccagcagc

SEQ ID NO: 3292893 - RNA, 14 nt, Mycobacterium tuberculosis H37Rv
auacggccggccgu

SEQ ID NO: 3292894 - RNA, 15 nt, Mycobacterium tuberculosis H37Rv
auacuccgcgagccc

SEQ ID NO: 3292895 - RNA, 15 nt, Mycobacterium tuberculosis H37Rv
auagaacaacgucgc

SEQ ID NO: 3292896 - RNA, 19 nt, Mycobacterium tuberculosis H37Rv
auagaacucgccgcuggca

SEQ ID NO: 3292897 - RNA, 20 nt, Mycobacterium tuberculosis H37Rv
auagacagggccgcucgccu

SEQ ID NO: 3292898 - RNA, 19 nt, Mycobacterium tuberculosis H37Rv
auagacgaccccggugagc

SEQ ID NO: 3292899 - RNA, 21 nt, Mycobacterium tuberculosis H37Rv
auagacuagccgauccagcag

SEQ ID NO: 3292900 - RNA, 16 nt, Mycobacterium tuberculosis H37Rv
auagcaacucgaucgc

SEQ ID NO: 3292901 - RNA, 20 nt, Mycobacterium tuberculosis H37Rv
auagccaagugagcgaucgg

SEQ ID NO: 3292902 - RNA, 17 nt, Mycobacterium tuberculosis H37Rv
auagccaccgacgacau

SEQ ID NO: 3292903 - RNA, 14 nt, Mycobacterium tuberculosis H37Rv
auagccgaacagcg

SEQ ID NO: 3292904 - RNA, 19 nt, Mycobacterium tuberculosis H37Rv
auagccggugucugggugg

SEQ ID NO: 3292905 - RNA, 21 nt, Mycobacterium tuberculosis H37Rv
auagcgcaccaccgucucgcc

SEQ ID NO: 3292906 - RNA, 12 nt, Mycobacterium tuberculosis H37Rv
auagcgcacugc

SEQ ID NO: 3292907 - RNA, 14 nt, Mycobacterium tuberculosis H37Rv
auagcgcacugccg

SEQ ID NO: 3292908 - RNA, 16 nt, Mycobacterium tuberculosis H37Rv
auagcgcggcaccagc

SEQ ID NO: 3292909 - RNA, 21 nt, Mycobacterium tuberculosis H37Rv
auagcgcggcaccagcaccgu

SEQ ID NO: 3292910 - RNA, 19 nt, Mycobacterium tuberculosis H37Rv
aucagcaagagccgcagcc

SEQ ID NO: 3292911 - RNA, 16 nt, Mycobacterium tuberculosis H37Rv
aucagcaccccauggc

SEQ ID NO: 3292912 - RNA, 14 nt, Mycobacterium tuberculosis H37Rv
aucagcaccgacgg

SEQ ID NO: 3292913 - RNA, 21 nt, Mycobacterium tuberculosis H37Rv
aucagcacguaacgccgcuca

SEQ ID NO: 3292914 - RNA, 14 nt, Mycobacterium tuberculosis H37Rv
aucagcagcccccc

SEQ ID NO: 3292915 - RNA, 14 nt, Mycobacterium tuberculosis H37Rv
aucagcagcgccag

SEQ ID NO: 3292916 - RNA, 13 nt, Mycobacterium tuberculosis H37Rv
aucagcaugcccu

SEQ ID NO: 3292917 - RNA, 18 nt, Mycobacterium tuberculosis H37Rv
aucagcaugguccacagc

SEQ ID NO: 3292918 - RNA, 19 nt, Mycobacterium tuberculosis H37Rv
aucagcaugguccacagcc

SEQ ID NO: 3292919 - RNA, 19 nt, Mycobacterium tuberculosis H37Rv
aucagccagaccaacauga

SEQ ID NO: 3292920 - RNA, 13 nt, Mycobacterium tuberculosis H37Rv
aucagcccucggc

SEQ ID NO: 3292921 - RNA, 19 nt, Mycobacterium tuberculosis H37Rv
aucagccguggcagucgca

SEQ ID NO: 3292922 - RNA, 21 nt, Mycobacterium tuberculosis H37Rv
aucagccguggcagucgcacg

SEQ ID NO: 3292923 - RNA, 15 nt, Mycobacterium tuberculosis H37Rv
aucagcgacagcgga

SEQ ID NO: 3292924 - RNA, 13 nt, Mycobacterium tuberculosis H37Rv
aucagcgacccgu

SEQ ID NO: 3292925 - RNA, 20 nt, Mycobacterium tuberculosis H37Rv
aucagcgacuugcuggcgua

SEQ ID NO: 3292926 - RNA, 16 nt, Mycobacterium tuberculosis H37Rv
aucagcgcaucgccgc

SEQ ID NO: 3292927 - RNA, 14 nt, Mycobacterium tuberculosis H37Rv
aucagcgcgaacgc

SEQ ID NO: 3292928 - RNA, 21 nt, Mycobacterium tuberculosis H37Rv
aucagcgguacguaaucgagc

SEQ ID NO: 3292929 - RNA, 23 nt, Mycobacterium tuberculosis H37Rv
aucagcgguacguaaucgagcgc

SEQ ID NO: 3292930 - RNA, 16 nt, Mycobacterium tuberculosis H37Rv
aucagcgugucgccga

SEQ ID NO: 3292931 - RNA, 15 nt, Mycobacterium tuberculosis H37Rv
aucagcucgaugccg

SEQ ID NO: 3292932 - RNA, 18 nt, Mycobacterium tuberculosis H37Rv
aucagcucgaugccgugu

SEQ ID NO: 3292933 - RNA, 19 nt, Mycobacterium tuberculosis H37Rv
aucagcugcgcaucgccac

SEQ ID NO: 3292934 - RNA, 18 nt, Mycobacterium tuberculosis H37Rv
aucagcuugugggcgacg

SEQ ID NO: 3292935 - RNA, 18 nt, Mycobacterium tuberculosis H37Rv
aucaggaaccgcucguca

SEQ ID NO: 3292936 - RNA, 21 nt, Mycobacterium tuberculosis H37Rv
aucaggacgcgaucggcguca

SEQ ID NO: 3292937 - RNA, 19 nt, Mycobacterium tuberculosis H37Rv
aucaggccgacgucgacca

SEQ ID NO: 3292938 - RNA, 20 nt, Mycobacterium tuberculosis H37Rv
aucaggccgaugacgaugcc

SEQ ID NO: 3292939 - RNA, 17 nt, Mycobacterium tuberculosis H37Rv
aucaggcugggcagacc

SEQ ID NO: 3292940 - RNA, 16 nt, Mycobacterium tuberculosis H37Rv
aucagggcucgcucgc

SEQ ID NO: 3292941 - RNA, 23 nt, Mycobacterium tuberculosis H37Rv
aucagguccuaggugugcgacga

SEQ ID NO: 3292942 - RNA, 17 nt, Mycobacterium tuberculosis H37Rv
aucaggucgccgagacc

SEQ ID NO: 3292943 - RNA, 13 nt, Mycobacterium tuberculosis H37Rv
aucaggucggcga

SEQ ID NO: 3292944 - RNA, 17 nt, Mycobacterium tuberculosis H37Rv
aucaggucgucacgccc

SEQ ID NO: 3292945 - RNA, 15 nt, Mycobacterium tuberculosis H37Rv
aucaggucgucgucc

SEQ ID NO: 3292946 - RNA, 20 nt, Mycobacterium tuberculosis H37Rv
aucaggugagaccagguucu

SEQ ID NO: 3292947 - RNA, 23 nt, Mycobacterium tuberculosis H37Rv
aucaggugcgccuggcuggccag

SEQ ID NO: 3292948 - RNA, 21 nt, Mycobacterium tuberculosis H37Rv
aucagucugggcgaucgcuuc

SEQ ID NO: 3292949 - RNA, 15 nt, Mycobacterium tuberculosis H37Rv
aucagugcagcgugg

SEQ ID NO: 3292950 - RNA, 16 nt, Mycobacterium tuberculosis H37Rv
aucaguucccgaaccc

SEQ ID NO: 3292951 - RNA, 18 nt, Mycobacterium tuberculosis H37Rv
aucaguucccgaaccccg

SEQ ID NO: 3292952 - RNA, 14 nt, Mycobacterium tuberculosis H37Rv
aucauagacagggc

SEQ ID NO: 3292953 - RNA, 17 nt, Mycobacterium tuberculosis H37Rv
aucaucaugucggcgca

SEQ ID NO: 3292954 - RNA, 21 nt, Mycobacterium tuberculosis H37Rv
aucaucucgguggacggcagg

SEQ ID NO: 3292955 - RNA, 22 nt, Mycobacterium tuberculosis H37Rv
aucaucucgguggacggcaggc

SEQ ID NO: 3292956 - RNA, 16 nt, Mycobacterium tuberculosis H37Rv
aucaucuggucgacca

SEQ ID NO: 3292957 - RNA, 23 nt, Mycobacterium tuberculosis H37Rv
aucaucuuugcguacaacgccgg

SEQ ID NO: 3292958 - RNA, 15 nt, Mycobacterium tuberculosis H37Rv
aucaugaacgccagc

SEQ ID NO: 3292959 - RNA, 18 nt, Mycobacterium tuberculosis H37Rv
aucaugaacgccagcagc

SEQ ID NO: 3292960 - RNA, 14 nt, Mycobacterium tuberculosis H37Rv
aucaugaccaccga

SEQ ID NO: 3292961 - RNA, 20 nt, Mycobacterium tuberculosis H37Rv
aucauggugaaggcaaacac

SEQ ID NO: 3292962 - RNA, 14 nt, Mycobacterium tuberculosis H37Rv
aucaugucgaagaa

SEQ ID NO: 3292963 - RNA, 13 nt, Mycobacterium tuberculosis H37Rv
aucaugucggccg

SEQ ID NO: 3292964 - RNA, 14 nt, Mycobacterium tuberculosis H37Rv
aucaugucggcgca

SEQ ID NO: 3292965 - RNA, 14 nt, Mycobacterium tuberculosis H37Rv
aucaugugcgcgac

SEQ ID NO: 3292966 - RNA, 16 nt, Mycobacterium tuberculosis H37Rv
aucaugugguggcgcc

SEQ ID NO: 3292967 - RNA, 23 nt, Mycobacterium tuberculosis H37Rv
aucauguucuuuugcgucugcug

SEQ ID NO: 3292968 - RNA, 18 nt, Mycobacterium tuberculosis H37Rv
auccaaggcucagcagcg

SEQ ID NO: 3292969 - RNA, 14 nt, Mycobacterium tuberculosis H37Rv
auccacaaucacau

SEQ ID NO: 3292970 - RNA, 21 nt, Mycobacterium tuberculosis H37Rv
auccacaccggauaggugguc

SEQ ID NO: 3292971 - RNA, 13 nt, Mycobacterium tuberculosis H37Rv
auccaccgcagau

SEQ ID NO: 3292972 - RNA, 18 nt, Mycobacterium tuberculosis H37Rv
auccaccucgauggcguc

SEQ ID NO: 3292973 - RNA, 15 nt, Mycobacterium tuberculosis H37Rv
auccacucggcgauc

SEQ ID NO: 3292974 - RNA, 23 nt, Mycobacterium tuberculosis H37Rv
auccacugccgcgcgcccgccuc

SEQ ID NO: 3292975 - RNA, 17 nt, Mycobacterium tuberculosis H37Rv
auccacuugaaguucuu

SEQ ID NO: 3292976 - RNA, 15 nt, Mycobacterium tuberculosis H37Rv
auccagaaguaggcg

SEQ ID NO: 3292977 - RNA, 18 nt, Mycobacterium tuberculosis H37Rv
auccagaaguaggcgacc

SEQ ID NO: 3292978 - RNA, 15 nt, Mycobacterium tuberculosis H37Rv
auccagagacauguc

SEQ ID NO: 3292979 - RNA, 19 nt, Mycobacterium tuberculosis H37Rv
auccagaugcccagcagga

SEQ ID NO: 3292980 - RNA, 20 nt, Mycobacterium tuberculosis H37Rv
auccagcagccaggagccga

SEQ ID NO: 3292981 - RNA, 13 nt, Mycobacterium tuberculosis H37Rv
auccagccagcaa

SEQ ID NO: 3292982 - RNA, 22 nt, Mycobacterium tuberculosis H37Rv
auccagcccuguuugacugcga

SEQ ID NO: 3292983 - RNA, 16 nt, Mycobacterium tuberculosis H37Rv
auccagccgucggcgc

SEQ ID NO: 3292984 - RNA, 23 nt, Mycobacterium tuberculosis H37Rv
auccagcgaggugauggucguca

SEQ ID NO: 3292985 - RNA, 15 nt, Mycobacterium tuberculosis H37Rv
auccaggagugauuc

SEQ ID NO: 3292986 - RNA, 15 nt, Mycobacterium tuberculosis H37Rv
auccaggcgugcauc

SEQ ID NO: 3292987 - RNA, 20 nt, Mycobacterium tuberculosis H37Rv
auccaggcgugcaucgcgau

SEQ ID NO: 3292988 - RNA, 19 nt, Mycobacterium tuberculosis H37Rv
auccaggcuguggccagca

SEQ ID NO: 3292989 - RNA, 22 nt, Mycobacterium tuberculosis H37Rv
auccaggcuguggccagcauca

SEQ ID NO: 3292990 - RNA, 19 nt, Mycobacterium tuberculosis H37Rv
auccagggugccggucacg

SEQ ID NO: 3292991 - RNA, 19 nt, Mycobacterium tuberculosis H37Rv
auccagugcgguggccagu

SEQ ID NO: 3292992 - RNA, 20 nt, Mycobacterium tuberculosis H37Rv
auccauccgggccgcggcca

SEQ ID NO: 3292993 - RNA, 20 nt, Mycobacterium tuberculosis H37Rv
auccaugauggccgucagcc

SEQ ID NO: 3292994 - RNA, 15 nt, Mycobacterium tuberculosis H37Rv
aucccaacgcccggg

SEQ ID NO: 3292995 - RNA, 14 nt, Mycobacterium tuberculosis H37Rv
aucccaacuccucc

SEQ ID NO: 3292996 - RNA, 16 nt, Mycobacterium tuberculosis H37Rv
aucccagcccgaaggu

SEQ ID NO: 3292997 - RNA, 12 nt, Mycobacterium tuberculosis H37Rv
aucccagcggga

SEQ ID NO: 3292998 - RNA, 21 nt, Mycobacterium tuberculosis H37Rv
aucccaggggcaccgagcuga

SEQ ID NO: 3292999 - RNA, 15 nt, Mycobacterium tuberculosis H37Rv
aucccaucggggcua

SEQ ID NO: 3293000 - RNA, 13 nt, Mycobacterium tuberculosis H37Rv
auccccagcacaa

SEQ ID NO: 3293001 - RNA, 17 nt, Mycobacterium tuberculosis H37Rv
auccccauugcgcccca

SEQ ID NO: 3293002 - RNA, 14 nt, Mycobacterium tuberculosis H37Rv
aucccccaggcgaa

SEQ ID NO: 3293003 - RNA, 22 nt, Mycobacterium tuberculosis H37Rv
auccccgaccacugaucggcau

SEQ ID NO: 3293004 - RNA, 13 nt, Mycobacterium tuberculosis H37Rv
auccccgcagcgu

SEQ ID NO: 3293005 - RNA, 15 nt, Mycobacterium tuberculosis H37Rv
auccccgguacgucg

SEQ ID NO: 3293006 - RNA, 16 nt, Mycobacterium tuberculosis H37Rv
auccugcgguugaguu

SEQ ID NO: 3293007 - RNA, 24 nt, Mycobacterium tuberculosis H37Rv
auccugcgguugaguugcagaccg

SEQ ID NO: 3293008 - RNA, 19 nt, Mycobacterium tuberculosis H37Rv
auccuggccacucccagcc

SEQ ID NO: 3293009 - RNA, 19 nt, Mycobacterium tuberculosis H37Rv
auccugguggcagacaugg

SEQ ID NO: 3293010 - RNA, 17 nt, Mycobacterium tuberculosis H37Rv
auccugguugaggacuu

SEQ ID NO: 3293011 - RNA, 22 nt, Mycobacterium tuberculosis H37Rv
auccuucgccggcgccagcaga

SEQ ID NO: 3293012 - RNA, 18 nt, Mycobacterium tuberculosis H37Rv
auccuucgcgcucauugc

SEQ ID NO: 3293013 - RNA, 13 nt, Mycobacterium tuberculosis H37Rv
auccuucggcgug

SEQ ID NO: 3293014 - RNA, 16 nt, Mycobacterium tuberculosis H37Rv
auccuugacgcggcca

SEQ ID NO: 3293015 - RNA, 18 nt, Mycobacterium tuberculosis H37Rv
auccuugccaaucgccgu

SEQ ID NO: 3293016 - RNA, 18 nt, Mycobacterium tuberculosis H37Rv
auccuugcgacguucuug

SEQ ID NO: 3293017 - RNA, 19 nt, Mycobacterium tuberculosis H37Rv
aucgaaagccaacucgacc

SEQ ID NO: 3293018 - RNA, 14 nt, Mycobacterium tuberculosis H37Rv
aucgaaccgcugcu

SEQ ID NO: 3293019 - RNA, 15 nt, Mycobacterium tuberculosis H37Rv
aucgaaccgcugcuc

SEQ ID NO: 3293020 - RNA, 21 nt, Mycobacterium tuberculosis H37Rv
aucgaacgucucggccagcuc

SEQ ID NO: 3293021 - RNA, 21 nt, Mycobacterium tuberculosis H37Rv
aucgaauugcguucgccgccc

SEQ ID NO: 3293022 - RNA, 11 nt, Mycobacterium tuberculosis H37Rv
aucgacaccga

SEQ ID NO: 3293023 - RNA, 18 nt, Mycobacterium tuberculosis H37Rv
aucgacaccgagccacga

SEQ ID NO: 3293024 - RNA, 17 nt, Mycobacterium tuberculosis H37Rv
aucgacaccgugaccgc

SEQ ID NO: 3293025 - RNA, 13 nt, Mycobacterium tuberculosis H37Rv
aucgacagcagcg

SEQ ID NO: 3293026 - RNA, 22 nt, Mycobacterium tuberculosis H37Rv
aucgacagccccgcggccagca

SEQ ID NO: 3293027 - RNA, 13 nt, Mycobacterium tuberculosis H37Rv
aucgaccaugguc

SEQ ID NO: 3293028 - RNA, 16 nt, Mycobacterium tuberculosis H37Rv
aucgacccgaugaccc

SEQ ID NO: 3293029 - RNA, 14 nt, Mycobacterium tuberculosis H37Rv
aucgacccgcccau

SEQ ID NO: 3293030 - RNA, 17 nt, Mycobacterium tuberculosis H37Rv
aucgacccggucgacgg

SEQ ID NO: 3293031 - RNA, 17 nt, Mycobacterium tuberculosis H37Rv
aucgacccuccagcacg

SEQ ID NO: 3293032 - RNA, 21 nt, Mycobacterium tuberculosis H37Rv
aucgacccuccagcacgccgu

SEQ ID NO: 3293033 - RNA, 11 nt, Mycobacterium tuberculosis H37Rv
aucgaccgcgg

SEQ ID NO: 3293034 - RNA, 22 nt, Mycobacterium tuberculosis H37Rv
aucgaccguccgggucaccagc

SEQ ID NO: 3293035 - RNA, 14 nt, Mycobacterium tuberculosis H37Rv
aucgaccuggccac

SEQ ID NO: 3293036 - RNA, 15 nt, Mycobacterium tuberculosis H37Rv
aucgaccuggccacg

SEQ ID NO: 3293037 - RNA, 14 nt, Mycobacterium tuberculosis H37Rv
aucgacgaccguca

SEQ ID NO: 3293038 - RNA, 22 nt, Mycobacterium tuberculosis H37Rv
aucgacgagcgauacgucguca

SEQ ID NO: 3293039 - RNA, 16 nt, Mycobacterium tuberculosis H37Rv
aucgacgccgccaccc

SEQ ID NO: 3293040 - RNA, 20 nt, Mycobacterium tuberculosis H37Rv
aucgacgccugcggcgguua

SEQ ID NO: 3293041 - RNA, 16 nt, Mycobacterium tuberculosis H37Rv
aucgacggcggccuuc

SEQ ID NO: 3293042 - RNA, 17 nt, Mycobacterium tuberculosis H37Rv
aucgacguuccagcagu

SEQ ID NO: 3293043 - RNA, 16 nt, Mycobacterium tuberculosis H37Rv
aucgacucacacaccg

SEQ ID NO: 3293044 - RNA, 15 nt, Mycobacterium tuberculosis H37Rv
aucgacugaucgcca

SEQ ID NO: 3293045 - RNA, 19 nt, Mycobacterium tuberculosis H37Rv
aucgagacuucuucgacgc

SEQ ID NO: 3293046 - RNA, 16 nt, Mycobacterium tuberculosis H37Rv
aucgagaguugaaucc

SEQ ID NO: 3293047 - RNA, 22 nt, Mycobacterium tuberculosis H37Rv
aucgagaugccaucggugauga

SEQ ID NO: 3293048 - RNA, 13 nt, Mycobacterium tuberculosis H37Rv
aucgagcaccgca

SEQ ID NO: 3293049 - RNA, 20 nt, Mycobacterium tuberculosis H37Rv
aucgagcagggugaccagga

SEQ ID NO: 3293050 - RNA, 15 nt, Mycobacterium tuberculosis H37Rv
aucgagcccggagcg

SEQ ID NO: 3293051 - RNA, 14 nt, Mycobacterium tuberculosis H37Rv
aucgagcgccagcc

SEQ ID NO: 3293052 - RNA, 17 nt, Mycobacterium tuberculosis H37Rv
aucgagcgggaucgggc

SEQ ID NO: 3293053 - RNA, 18 nt, Mycobacterium tuberculosis H37Rv
aucgagcgggaucgggcc

SEQ ID NO: 3293054 - RNA, 17 nt, Mycobacterium tuberculosis H37Rv
aucgaggaacucggacc

SEQ ID NO: 3293055 - RNA, 16 nt, Mycobacterium tuberculosis H37Rv
aucgaggagaugccga

SEQ ID NO: 3293056 - RNA, 19 nt, Mycobacterium tuberculosis H37Rv
aucgaggagaugccgacga

SEQ ID NO: 3293057 - RNA, 14 nt, Mycobacterium tuberculosis H37Rv
aucgaggccagcag

SEQ ID NO: 3293058 - RNA, 17 nt, Mycobacterium tuberculosis H37Rv
aucgaggccagcagcug

SEQ ID NO: 3293059 - RNA, 19 nt, Mycobacterium tuberculosis H37Rv
aucgaguagcugaccgagc

SEQ ID NO: 3293060 - RNA, 19 nt, Mycobacterium tuberculosis H37Rv
aucgaguuccgcaucggcc

SEQ ID NO: 3293061 - RNA, 20 nt, Mycobacterium tuberculosis H37Rv
aucgaguugcggugcccgca

SEQ ID NO: 3293062 - RNA, 22 nt, Mycobacterium tuberculosis H37Rv
aucgaguugucucgcaucggcc

SEQ ID NO: 3293063 - RNA, 21 nt, Mycobacterium tuberculosis H37Rv
aucgaucaacaccaaucgggu

SEQ ID NO: 3293064 - RNA, 22 nt, Mycobacterium tuberculosis H37Rv
aucgaucaacaccaaucggguc

SEQ ID NO: 3293065 - RNA, 22 nt, Mycobacterium tuberculosis H37Rv
aucgaucagcaacucggccacg

SEQ ID NO: 3293066 - RNA, 23 nt, Mycobacterium tuberculosis H37Rv
aucgaucagcaacucggccacgg

SEQ ID NO: 3293067 - RNA, 22 nt, Mycobacterium tuberculosis H37Rv
aucgauccggcuccacccccac

SEQ ID NO: 3293068 - RNA, 12 nt, Mycobacterium tuberculosis H37Rv
aucgaucggauc

SEQ ID NO: 3293069 - RNA, 20 nt, Mycobacterium tuberculosis H37Rv
aucgaucguguacugcuccu

SEQ ID NO: 3293070 - RNA, 23 nt, Mycobacterium tuberculosis H37Rv
aucgauucgucgcggaucagccc

SEQ ID NO: 3293071 - RNA, 21 nt, Mycobacterium tuberculosis H37Rv
aucgcaagcgcggcgaagccg

SEQ ID NO: 3293072 - RNA, 22 nt, Mycobacterium tuberculosis H37Rv
aucgcaagcgcggcgaagccgg

SEQ ID NO: 3293073 - RNA, 18 nt, Mycobacterium tuberculosis H37Rv
aucgcaaugaccugcagc

SEQ ID NO: 3293074 - RNA, 17 nt, Mycobacterium tuberculosis H37Rv
aucgcaaugggcucaca

SEQ ID NO: 3293075 - RNA, 20 nt, Mycobacterium tuberculosis H37Rv
aucgcacaacugcgccagca

SEQ ID NO: 3293076 - RNA, 23 nt, Mycobacterium tuberculosis H37Rv
aucgcacagcgcgaucaacgcgu

SEQ ID NO: 3293077 - RNA, 19 nt, Mycobacterium tuberculosis H37Rv
aucgcacgacgcgacacgc

SEQ ID NO: 3293078 - RNA, 17 nt, Mycobacterium tuberculosis H37Rv
aucgcacggaugaugcc

SEQ ID NO: 3293079 - RNA, 19 nt, Mycobacterium tuberculosis H37Rv
aucgcacggaugaugccgg

SEQ ID NO: 3293080 - RNA, 15 nt, Mycobacterium tuberculosis H37Rv
aucgcagaacggacc

SEQ ID NO: 3293081 - RNA, 24 nt, Mycobacterium tuberculosis H37Rv
aucgcagaacggaccucggcgguc

SEQ ID NO: 3293082 - RNA, 19 nt, Mycobacterium tuberculosis H37Rv
aucgcagacacugcugcgg

SEQ ID NO: 3293083 - RNA, 17 nt, Mycobacterium tuberculosis H37Rv
aucgcagauggcgaggu

SEQ ID NO: 3293084 - RNA, 13 nt, Mycobacterium tuberculosis H37Rv
aucgcagccgguc

SEQ ID NO: 3293085 - RNA, 21 nt, Mycobacterium tuberculosis H37Rv
aucgcagggaucaccccggcc

SEQ ID NO: 3293086 - RNA, 13 nt, Mycobacterium tuberculosis H37Rv
aucgcauccccag

SEQ ID NO: 3293087 - RNA, 12 nt, Mycobacterium tuberculosis H37Rv
aucgcauccgcg

SEQ ID NO: 3293088 - RNA, 17 nt, Mycobacterium tuberculosis H37Rv
aucgcauugggcgggcu

SEQ ID NO: 3293089 - RNA, 22 nt, Mycobacterium tuberculosis H37Rv
aucgccaaauccggugcccgca

SEQ ID NO: 3293090 - RNA, 18 nt, Mycobacterium tuberculosis H37Rv
aucgccacaacgcgcggu

SEQ ID NO: 3293091 - RNA, 18 nt, Mycobacterium tuberculosis H37Rv
aucgccacacccaaaccg

SEQ ID NO: 3293092 - RNA, 21 nt, Mycobacterium tuberculosis H37Rv
aucgccacagucgucgagcgc

SEQ ID NO: 3293093 - RNA, 13 nt, Mycobacterium tuberculosis H37Rv
aucgccacccggu

SEQ ID NO: 3293094 - RNA, 15 nt, Mycobacterium tuberculosis H37Rv
aucgccaccgcguca

SEQ ID NO: 3293095 - RNA, 19 nt, Mycobacterium tuberculosis H37Rv
aucgccacgacaggucgcc

SEQ ID NO: 3293096 - RNA, 22 nt, Mycobacterium tuberculosis H37Rv
aucgccacuguugaagaagccc

SEQ ID NO: 3293097 - RNA, 11 nt, Mycobacterium tuberculosis H37Rv
aucgccagcag

SEQ ID NO: 3293098 - RNA, 14 nt, Mycobacterium tuberculosis H37Rv
aucgccagcggcaa

SEQ ID NO: 3293099 - RNA, 13 nt, Mycobacterium tuberculosis H37Rv
aucgccaggccga

SEQ ID NO: 3293100 - RNA, 15 nt, Mycobacterium tuberculosis H37Rv
aucgcccaacaacgc

SEQ ID NO: 3293101 - RNA, 21 nt, Mycobacterium tuberculosis H37Rv
aucgcccaauuucgugccgaa

SEQ ID NO: 3293102 - RNA, 22 nt, Mycobacterium tuberculosis H37Rv
aucggccgugaauucgccgaac

SEQ ID NO: 3293103 - RNA, 22 nt, Mycobacterium tuberculosis H37Rv
aucggccuguccaccgaugcca

SEQ ID NO: 3293104 - RNA, 17 nt, Mycobacterium tuberculosis H37Rv
aucggcgaaucgggcaa

SEQ ID NO: 3293105 - RNA, 13 nt, Mycobacterium tuberculosis H37Rv
aucggcgacagga

SEQ ID NO: 3293106 - RNA, 16 nt, Mycobacterium tuberculosis H37Rv
aucggcgacaggagac

SEQ ID NO: 3293107 - RNA, 14 nt, Mycobacterium tuberculosis H37Rv
aucggcgccgcaua

SEQ ID NO: 3293108 - RNA, 17 nt, Mycobacterium tuberculosis H37Rv
aucggcgccuugguccg

SEQ ID NO: 3293109 - RNA, 15 nt, Mycobacterium tuberculosis H37Rv
aucggcgcuagccag

SEQ ID NO: 3293110 - RNA, 15 nt, Mycobacterium tuberculosis H37Rv
aucggcggaccgcag

SEQ ID NO: 3293111 - RNA, 16 nt, Mycobacterium tuberculosis H37Rv
aucggcggcgcgccga

SEQ ID NO: 3293112 - RNA, 17 nt, Mycobacterium tuberculosis H37Rv
aucggcggcguccagca

SEQ ID NO: 3293113 - RNA, 18 nt, Mycobacterium tuberculosis H37Rv
aucggcggcguccagcag

SEQ ID NO: 3293114 - RNA, 17 nt, Mycobacterium tuberculosis H37Rv
aucggcggcgucgacgu

SEQ ID NO: 3293115 - RNA, 19 nt, Mycobacterium tuberculosis H37Rv
aucggcggcgucuucgucg

SEQ ID NO: 3293116 - RNA, 13 nt, Mycobacterium tuberculosis H37Rv
aucggcgucacga

SEQ ID NO: 3293117 - RNA, 22 nt, Mycobacterium tuberculosis H37Rv
aucggcgucaggcacaacgcga

SEQ ID NO: 3293118 - RNA, 16 nt, Mycobacterium tuberculosis H37Rv
aucggcguuaucgaag

SEQ ID NO: 3293119 - RNA, 16 nt, Mycobacterium tuberculosis H37Rv
aucggcucaccgaacg

SEQ ID NO: 3293120 - RNA, 23 nt, Mycobacterium tuberculosis H37Rv
aucggcugguuacucaccaaccg

SEQ ID NO: 3293121 - RNA, 18 nt, Mycobacterium tuberculosis H37Rv
aucgggaaguacggcagg

SEQ ID NO: 3293122 - RNA, 13 nt, Mycobacterium tuberculosis H37Rv
aucgggaaugacc

SEQ ID NO: 3293123 - RNA, 20 nt, Mycobacterium tuberculosis H37Rv
aucgggagcggcugcggcaa

SEQ ID NO: 3293124 - RNA, 14 nt, Mycobacterium tuberculosis H37Rv
aucgggaucgacgu

SEQ ID NO: 3293125 - RNA, 15 nt, Mycobacterium tuberculosis H37Rv
aucgggaucgacguc

SEQ ID NO: 3293126 - RNA, 14 nt, Mycobacterium tuberculosis H37Rv
aucgggaucgcugc

SEQ ID NO: 3293127 - RNA, 17 nt, Mycobacterium tuberculosis H37Rv
aucgggaucgcugccag

SEQ ID NO: 3293128 - RNA, 21 nt, Mycobacterium tuberculosis H37Rv
aucgggcccaccgcugcggca

SEQ ID NO: 3293129 - RNA, 13 nt, Mycobacterium tuberculosis H37Rv
aucgggcccagca

SEQ ID NO: 3293130 - RNA, 22 nt, Mycobacterium tuberculosis H37Rv
aucgggcccccuggaucgcgcc

SEQ ID NO: 3293131 - RNA, 15 nt, Mycobacterium tuberculosis H37Rv
aucgggccgccgagc

SEQ ID NO: 3293132 - RNA, 22 nt, Mycobacterium tuberculosis H37Rv
aucgggcgcgguaaccacgcgg

SEQ ID NO: 3293133 - RNA, 16 nt, Mycobacterium tuberculosis H37Rv
aucgggcucacucgcc

SEQ ID NO: 3293134 - RNA, 17 nt, Mycobacterium tuberculosis H37Rv
aucgggcuucggccaga

SEQ ID NO: 3293135 - RNA, 13 nt, Mycobacterium tuberculosis H37Rv
aucggggcgacga

SEQ ID NO: 3293136 - RNA, 19 nt, Mycobacterium tuberculosis H37Rv
aucggggcggugacuccgc

SEQ ID NO: 3293137 - RNA, 17 nt, Mycobacterium tuberculosis H37Rv
aucgggggcguugacga

SEQ ID NO: 3293138 - RNA, 21 nt, Mycobacterium tuberculosis H37Rv
aucgggucacccccggccagc

SEQ ID NO: 3293139 - RNA, 17 nt, Mycobacterium tuberculosis H37Rv
aucggucaacucgaacg

SEQ ID NO: 3293140 - RNA, 15 nt, Mycobacterium tuberculosis H37Rv
aucggucagcgccga

SEQ ID NO: 3293141 - RNA, 16 nt, Mycobacterium tuberculosis H37Rv
aucggucagcgggcac

SEQ ID NO: 3293142 - RNA, 13 nt, Mycobacterium tuberculosis H37Rv
aucggucaugucc

SEQ ID NO: 3293143 - RNA, 15 nt, Mycobacterium tuberculosis H37Rv
aucgguccaaagcac

SEQ ID NO: 3293144 - RNA, 12 nt, Mycobacterium tuberculosis H37Rv
aucggucgaucg

SEQ ID NO: 3293145 - RNA, 21 nt, Mycobacterium tuberculosis H37Rv
aucggucggcaccagguugcc

SEQ ID NO: 3293146 - RNA, 20 nt, Mycobacterium tuberculosis H37Rv
aucggugaaucgucugacga

SEQ ID NO: 3293147 - RNA, 20 nt, Mycobacterium tuberculosis H37Rv
aucggugaccguggcgggga

SEQ ID NO: 3293148 - RNA, 16 nt, Mycobacterium tuberculosis H37Rv
aucgguggcgccgaac

SEQ ID NO: 3293149 - RNA, 23 nt, Mycobacterium tuberculosis H37Rv
aucgguggcgccgaacgccagca

SEQ ID NO: 3293150 - RNA, 13 nt, Mycobacterium tuberculosis H37Rv
aucggugguaaca

SEQ ID NO: 3293151 - RNA, 21 nt, Mycobacterium tuberculosis H37Rv
aucgguggucguaggugacga

SEQ ID NO: 3293152 - RNA, 22 nt, Mycobacterium tuberculosis H37Rv
aucggugucuuccuccucgacc

SEQ ID NO: 3293153 - RNA, 17 nt, Mycobacterium tuberculosis H37Rv
aucgguucagcugcgcc

SEQ ID NO: 3293154 - RNA, 17 nt, Mycobacterium tuberculosis H37Rv
aucgguucgggacgcga

SEQ ID NO: 3293155 - RNA, 16 nt, Mycobacterium tuberculosis H37Rv
aucgguugaucggcca

SEQ ID NO: 3293156 - RNA, 18 nt, Mycobacterium tuberculosis H37Rv
aucguacgggucggcgac

SEQ ID NO: 3293157 - RNA, 17 nt, Mycobacterium tuberculosis H37Rv
aucgucaacgacgacga

SEQ ID NO: 3293158 - RNA, 13 nt, Mycobacterium tuberculosis H37Rv
aucgucaggaacc

SEQ ID NO: 3293159 - RNA, 19 nt, Mycobacterium tuberculosis H37Rv
aucgucaggaaccacccac

SEQ ID NO: 3293160 - RNA, 17 nt, Mycobacterium tuberculosis H37Rv
aucgucgaaagccugga

SEQ ID NO: 3293161 - RNA, 18 nt, Mycobacterium tuberculosis H37Rv
aucgucgaauccucgcga

SEQ ID NO: 3293162 - RNA, 18 nt, Mycobacterium tuberculosis H37Rv
aucgucgacgccgaucgc

SEQ ID NO: 3293163 - RNA, 16 nt, Mycobacterium tuberculosis H37Rv
aucgucgacgcgucgu

SEQ ID NO: 3293164 - RNA, 19 nt, Mycobacterium tuberculosis H37Rv
aucgucgagccgaucgccc

SEQ ID NO: 3293165 - RNA, 16 nt, Mycobacterium tuberculosis H37Rv
aucgucgccaagccca

SEQ ID NO: 3293166 - RNA, 16 nt, Mycobacterium tuberculosis H37Rv
aucgucgccgaccguc

SEQ ID NO: 3293167 - RNA, 21 nt, Mycobacterium tuberculosis H37Rv
aucgucgccgaccgucacuga

SEQ ID NO: 3293168 - RNA, 14 nt, Mycobacterium tuberculosis H37Rv
aucgucggccagca

SEQ ID NO: 3293169 - RNA, 21 nt, Mycobacterium tuberculosis H37Rv
aucgucggguaccagcaccga

SEQ ID NO: 3293170 - RNA, 12 nt, Mycobacterium tuberculosis H37Rv
aucgucggguca

SEQ ID NO: 3293171 - RNA, 16 nt, Mycobacterium tuberculosis H37Rv
aucgucgugucgccgc

SEQ ID NO: 3293172 - RNA, 17 nt, Mycobacterium tuberculosis H37Rv
aucgucgugucgccgcc

SEQ ID NO: 3293173 - RNA, 19 nt, Mycobacterium tuberculosis H37Rv
aucgucgugucgccgccgu

SEQ ID NO: 3293174 - RNA, 23 nt, Mycobacterium tuberculosis H37Rv
aucgucguugucagcgaacggcc

SEQ ID NO: 3293175 - RNA, 13 nt, Mycobacterium tuberculosis H37Rv
aucgucucgguga

SEQ ID NO: 3293176 - RNA, 14 nt, Mycobacterium tuberculosis H37Rv
aucgucugguggca

SEQ ID NO: 3293177 - RNA, 18 nt, Mycobacterium tuberculosis H37Rv
aucgugaaaguaagccgc

SEQ ID NO: 3293178 - RNA, 19 nt, Mycobacterium tuberculosis H37Rv
aucgugaaaguaagccgcg

SEQ ID NO: 3293179 - RNA, 19 nt, Mycobacterium tuberculosis H37Rv
aucgugaacacgucgcggu

SEQ ID NO: 3293180 - RNA, 20 nt, Mycobacterium tuberculosis H37Rv
aucgugagcuuuaucugcau

SEQ ID NO: 3293181 - RNA, 15 nt, Mycobacterium tuberculosis H37Rv
aucgugcagguugcc

SEQ ID NO: 3293182 - RNA, 13 nt, Mycobacterium tuberculosis H37Rv
aucgugccggcga

SEQ ID NO: 3293183 - RNA, 15 nt, Mycobacterium tuberculosis H37Rv
aucgugccggcgaac

SEQ ID NO: 3293184 - RNA, 16 nt, Mycobacterium tuberculosis H37Rv
aucgugccggcgaacc

SEQ ID NO: 3293185 - RNA, 23 nt, Mycobacterium tuberculosis H37Rv
aucgugcuggugguaucggcgug

SEQ ID NO: 3293186 - RNA, 15 nt, Mycobacterium tuberculosis H37Rv
aucguggcgcccguc

SEQ ID NO: 3293187 - RNA, 14 nt, Mycobacterium tuberculosis H37Rv
aucguggcggcguc

SEQ ID NO: 3293188 - RNA, 18 nt, Mycobacterium tuberculosis H37Rv
aucguggcggcgucgaca

SEQ ID NO: 3293189 - RNA, 13 nt, Mycobacterium tuberculosis H37Rv
aucgugguaacca

SEQ ID NO: 3293190 - RNA, 16 nt, Mycobacterium tuberculosis H37Rv
aucgugguucggcguc

SEQ ID NO: 3293191 - RNA, 16 nt, Mycobacterium tuberculosis H37Rv
aucguguugucaggac

SEQ ID NO: 3293192 - RNA, 20 nt, Mycobacterium tuberculosis H37Rv
aucguucaugaucggcagaa

SEQ ID NO: 3293193 - RNA, 22 nt, Mycobacterium tuberculosis H37Rv
aucguucaugaucggcagaauc

SEQ ID NO: 3293194 - RNA, 21 nt, Mycobacterium tuberculosis H37Rv
aucguuccacgagucgucguc

SEQ ID NO: 3293195 - RNA, 16 nt, Mycobacterium tuberculosis H37Rv
aucguuccaggccgcg

SEQ ID NO: 3293196 - RNA, 18 nt, Mycobacterium tuberculosis H37Rv
aucguucgggguggugga

SEQ ID NO: 3293197 - RNA, 16 nt, Mycobacterium tuberculosis H37Rv
aucguugccgaccgug

SEQ ID NO: 3293198 - RNA, 20 nt, Mycobacterium tuberculosis H37Rv
augaacgcaaccgagggcau

SEQ ID NO: 3293199 - RNA, 13 nt, Mycobacterium tuberculosis H37Rv
augaacgccagca

SEQ ID NO: 3293200 - RNA, 14 nt, Mycobacterium tuberculosis H37Rv
augaacgccagcag

SEQ ID NO: 3293201 - RNA, 16 nt, Mycobacterium tuberculosis H37Rv
augaacgccagcagcg

SEQ ID NO: 3293202 - RNA, 19 nt, Mycobacterium tuberculosis H37Rv
augaacgccagcagcgcga

SEQ ID NO: 3293203 - RNA, 20 nt, Mycobacterium tuberculosis H37Rv
augaacgccagcagcgcgau

SEQ ID NO: 3293204 - RNA, 13 nt, Mycobacterium tuberculosis H37Rv
augaacucggcga

SEQ ID NO: 3293205 - RNA, 13 nt, Mycobacterium tuberculosis H37Rv
augaagaacuggc

SEQ ID NO: 3293206 - RNA, 22 nt, Mycobacterium tuberculosis H37Rv
augaagcuggugaucagcucag

SEQ ID NO: 3293207 - RNA, 18 nt, Mycobacterium tuberculosis H37Rv
augaauucauguggcgcg

SEQ ID NO: 3293208 - RNA, 21 nt, Mycobacterium tuberculosis H37Rv
augaauuuggugaagugaacc

SEQ ID NO: 3293209 - RNA, 15 nt, Mycobacterium tuberculosis H37Rv
augacaaaccugcau

SEQ ID NO: 3293210 - RNA, 16 nt, Mycobacterium tuberculosis H37Rv
augacaaaccugcaug

SEQ ID NO: 3293211 - RNA, 22 nt, Mycobacterium tuberculosis H37Rv
augacaaaccugcaugcccaga

SEQ ID NO: 3293212 - RNA, 15 nt, Mycobacterium tuberculosis H37Rv
augacaaagaagugg

SEQ ID NO: 3293213 - RNA, 15 nt, Mycobacterium tuberculosis H37Rv
augacaccggccacc

SEQ ID NO: 3293214 - RNA, 17 nt, Mycobacterium tuberculosis H37Rv
augaccacauuggugau

SEQ ID NO: 3293215 - RNA, 19 nt, Mycobacterium tuberculosis H37Rv
augaccaccgaaauaccca

SEQ ID NO: 3293216 - RNA, 13 nt, Mycobacterium tuberculosis H37Rv
augaccaccgguu

SEQ ID NO: 3293217 - RNA, 20 nt, Mycobacterium tuberculosis H37Rv
augaccagggucugcucauc

SEQ ID NO: 3293218 - RNA, 21 nt, Mycobacterium tuberculosis H37Rv
augaccaucgaggcgaucacc

SEQ ID NO: 3293219 - RNA, 14 nt, Mycobacterium tuberculosis H37Rv
augacccacacacc

SEQ ID NO: 3293220 - RNA, 22 nt, Mycobacterium tuberculosis H37Rv
augaccccggcguugccgccgu

SEQ ID NO: 3293221 - RNA, 17 nt, Mycobacterium tuberculosis H37Rv
augacccgcgggugaug

SEQ ID NO: 3293222 - RNA, 19 nt, Mycobacterium tuberculosis H37Rv
augaccgaaccuggucuug

SEQ ID NO: 3293223 - RNA, 20 nt, Mycobacterium tuberculosis H37Rv
augaccgcucgugcaaucgc

SEQ ID NO: 3293224 - RNA, 22 nt, Mycobacterium tuberculosis H37Rv
augaccgguauuaccgccgugg

SEQ ID NO: 3293225 - RNA, 15 nt, Mycobacterium tuberculosis H37Rv
augaccugauccggc

SEQ ID NO: 3293226 - RNA, 22 nt, Mycobacterium tuberculosis H37Rv
augaccuguagaucagcagcgg

SEQ ID NO: 3293227 - RNA, 18 nt, Mycobacterium tuberculosis H37Rv
augacgaccgaucggcgc

SEQ ID NO: 3293228 - RNA, 13 nt, Mycobacterium tuberculosis H37Rv
augacgacgccgu

SEQ ID NO: 3293229 - RNA, 19 nt, Mycobacterium tuberculosis H37Rv
augacgagccgagccucgc

SEQ ID NO: 3293230 - RNA, 22 nt, Mycobacterium tuberculosis H37Rv
augacgauggccgccgcgagga

SEQ ID NO: 3293231 - RNA, 17 nt, Mycobacterium tuberculosis H37Rv
augacgcagucgcccac

SEQ ID NO: 3293232 - RNA, 17 nt, Mycobacterium tuberculosis H37Rv
augacgcccagggcguc

SEQ ID NO: 3293233 - RNA, 14 nt, Mycobacterium tuberculosis H37Rv
augacggccugcac

SEQ ID NO: 3293234 - RNA, 20 nt, Mycobacterium tuberculosis H37Rv
augacggcuccgaugcaucg

SEQ ID NO: 3293235 - RNA, 23 nt, Mycobacterium tuberculosis H37Rv
augacgguggggucgccgucgaa

SEQ ID NO: 3293236 - RNA, 16 nt, Mycobacterium tuberculosis H37Rv
augacguuuggauggc

SEQ ID NO: 3293237 - RNA, 19 nt, Mycobacterium tuberculosis H37Rv
augacucggccgcaccagc

SEQ ID NO: 3293238 - RNA, 16 nt, Mycobacterium tuberculosis H37Rv
augacuugcgacccgu

SEQ ID NO: 3293239 - RNA, 13 nt, Mycobacterium tuberculosis H37Rv
augagaucgggac

SEQ ID NO: 3293240 - RNA, 20 nt, Mycobacterium tuberculosis H37Rv
augagauggucguaugcgca

SEQ ID NO: 3293241 - RNA, 12 nt, Mycobacterium tuberculosis H37Rv
augagcaugccc

SEQ ID NO: 3293242 - RNA, 17 nt, Mycobacterium tuberculosis H37Rv
augagcaugcccagcgc

SEQ ID NO: 3293243 - RNA, 18 nt, Mycobacterium tuberculosis H37Rv
augagcaugcccagcgca

SEQ ID NO: 3293244 - RNA, 16 nt, Mycobacterium tuberculosis H37Rv
augagccggcgccgcc

SEQ ID NO: 3293245 - RNA, 21 nt, Mycobacterium tuberculosis H37Rv
augagcgcgaaguacgacgac

SEQ ID NO: 3293246 - RNA, 16 nt, Mycobacterium tuberculosis H37Rv
augagcggcgcggcaa

SEQ ID NO: 3293247 - RNA, 16 nt, Mycobacterium tuberculosis H37Rv
augagcggucagcguc

SEQ ID NO: 3293248 - RNA, 18 nt, Mycobacterium tuberculosis H37Rv
augagcgugccgcagcgg

SEQ ID NO: 3293249 - RNA, 14 nt, Mycobacterium tuberculosis H37Rv
augagcucggccau

SEQ ID NO: 3293250 - RNA, 14 nt, Mycobacterium tuberculosis H37Rv
augaggcccaucau

SEQ ID NO: 3293251 - RNA, 23 nt, Mycobacterium tuberculosis H37Rv
augaggcugccgaaguugaagaa

SEQ ID NO: 3293252 - RNA, 17 nt, Mycobacterium tuberculosis H37Rv
augagggcuugugguga

SEQ ID NO: 3293253 - RNA, 13 nt, Mycobacterium tuberculosis H37Rv
augaggucaacgc

SEQ ID NO: 3293254 - RNA, 23 nt, Mycobacterium tuberculosis H37Rv
augagguucaucgccggcgcgcc

SEQ ID NO: 3293255 - RNA, 18 nt, Mycobacterium tuberculosis H37Rv
augaguggcaaucccgcc

SEQ ID NO: 3293256 - RNA, 13 nt, Mycobacterium tuberculosis H37Rv
augauaauuccag

SEQ ID NO: 3293257 - RNA, 15 nt, Mycobacterium tuberculosis H37Rv
augaucacaccgagc

SEQ ID NO: 3293258 - RNA, 13 nt, Mycobacterium tuberculosis H37Rv
augaucaugaacg

SEQ ID NO: 3293259 - RNA, 15 nt, Mycobacterium tuberculosis H37Rv
augaucccgccaccg

SEQ ID NO: 3293260 - RNA, 19 nt, Mycobacterium tuberculosis H37Rv
augaucccgcugaccuggg

SEQ ID NO: 3293261 - RNA, 11 nt, Mycobacterium tuberculosis H37Rv
augaucgccga

SEQ ID NO: 3293262 - RNA, 23 nt, Mycobacterium tuberculosis H37Rv
augaucgcgaacaucgccagcgc

SEQ ID NO: 3293263 - RNA, 15 nt, Mycobacterium tuberculosis H37Rv
augaucgcgccgggc

SEQ ID NO: 3293264 - RNA, 16 nt, Mycobacterium tuberculosis H37Rv
augaucgcggcggcga

SEQ ID NO: 3293265 - RNA, 15 nt, Mycobacterium tuberculosis H37Rv
augaucucacccagc

SEQ ID NO: 3293266 - RNA, 17 nt, Mycobacterium tuberculosis H37Rv
augaucucggcaaggac

SEQ ID NO: 3293267 - RNA, 20 nt, Mycobacterium tuberculosis H37Rv
augaucucggcgaacgcgaa

SEQ ID NO: 3293268 - RNA, 20 nt, Mycobacterium tuberculosis H37Rv
augaucuugccgcggcgcaa

SEQ ID NO: 3293269 - RNA, 17 nt, Mycobacterium tuberculosis H37Rv
augaugaccacauuggu

SEQ ID NO: 3293270 - RNA, 19 nt, Mycobacterium tuberculosis H37Rv
augaugaccggcaauuccg

SEQ ID NO: 3293271 - RNA, 10 nt, Mycobacterium tuberculosis H37Rv
augaugccgg

SEQ ID NO: 3293272 - RNA, 18 nt, Mycobacterium tuberculosis H37Rv
augauggacaccagccag

SEQ ID NO: 3293273 - RNA, 13 nt, Mycobacterium tuberculosis H37Rv
augauggccagca

SEQ ID NO: 3293274 - RNA, 21 nt, Mycobacterium tuberculosis H37Rv
augauggccgucagccaggug

SEQ ID NO: 3293275 - RNA, 21 nt, Mycobacterium tuberculosis H37Rv
augauguagcggcguuccggg

SEQ ID NO: 3293276 - RNA, 23 nt, Mycobacterium tuberculosis H37Rv
augauguggugugccugcgucuc

SEQ ID NO: 3293277 - RNA, 16 nt, Mycobacterium tuberculosis H37Rv
augauguugaaacacc

SEQ ID NO: 3293278 - RNA, 18 nt, Mycobacterium tuberculosis H37Rv
augauguuuuccccgccc

SEQ ID NO: 3293279 - RNA, 20 nt, Mycobacterium tuberculosis H37Rv
augauugccaggaccgcgcc

SEQ ID NO: 3293280 - RNA, 14 nt, Mycobacterium tuberculosis H37Rv
augcaacaccgcac

SEQ ID NO: 3293281 - RNA, 16 nt, Mycobacterium tuberculosis H37Rv
augcaacgccaaaaug

SEQ ID NO: 3293282 - RNA, 20 nt, Mycobacterium tuberculosis H37Rv
augcaacgcggcgaagugca

SEQ ID NO: 3293283 - RNA, 16 nt, Mycobacterium tuberculosis H37Rv
augcaacucggcagau

SEQ ID NO: 3293284 - RNA, 20 nt, Mycobacterium tuberculosis H37Rv
augcaaggaaaagccuggcc

SEQ ID NO: 3293285 - RNA, 22 nt, Mycobacterium tuberculosis H37Rv
augcaagucaaacgccgucacg

SEQ ID NO: 3293286 - RNA, 10 nt, Mycobacterium tuberculosis H37Rv
augcaaugcu

SEQ ID NO: 3293287 - RNA, 21 nt, Mycobacterium tuberculosis H37Rv
augcacaaaaaccgaccgcgc

SEQ ID NO: 3293288 - RNA, 16 nt, Mycobacterium tuberculosis H37Rv
augcaccccaugaccg

SEQ ID NO: 3293289 - RNA, 19 nt, Mycobacterium tuberculosis H37Rv
augcaccccaugaccggga

SEQ ID NO: 3293290 - RNA, 12 nt, Mycobacterium tuberculosis H37Rv
augcacccggua

SEQ ID NO: 3293291 - RNA, 15 nt, Mycobacterium tuberculosis H37Rv
augcaccgaugccga

SEQ ID NO: 3293292 - RNA, 20 nt, Mycobacterium tuberculosis H37Rv
augcaccucgcccugcagac

SEQ ID NO: 3293293 - RNA, 23 nt, Mycobacterium tuberculosis H37Rv
augcagcgguccagacaucagug

SEQ ID NO: 3293294 - RNA, 21 nt, Mycobacterium tuberculosis H37Rv
augcgccccaugaugaacagc

SEQ ID NO: 3293295 - RNA, 12 nt, Mycobacterium tuberculosis H37Rv
augcgccccgga

SEQ ID NO: 3293296 - RNA, 21 nt, Mycobacterium tuberculosis H37Rv
augcgcguuacccaucgccac

SEQ ID NO: 3293297 - RNA, 14 nt, Mycobacterium tuberculosis H37Rv
augcgcuaggugcg

SEQ ID NO: 3293298 - RNA, 16 nt, Mycobacterium tuberculosis H37Rv
augcgcuaggugcgaa

SEQ ID NO: 3293299 - RNA, 18 nt, Mycobacterium tuberculosis H37Rv
augcgcucacugcagcgc

SEQ ID NO: 3293300 - RNA, 18 nt, Mycobacterium tuberculosis H37Rv
augcgcuuccaucgccac

SEQ ID NO: 3293301 - RNA, 23 nt, Mycobacterium tuberculosis H37Rv
augcggaaagccccuccggccgu

SEQ ID NO: 3293302 - RNA, 19 nt, Mycobacterium tuberculosis H37Rv
augcggaugucgucgacca

SEQ ID NO: 3293303 - RNA, 22 nt, Mycobacterium tuberculosis H37Rv
augcggaugucgucgaccaggc

SEQ ID NO: 3293304 - RNA, 17 nt, Mycobacterium tuberculosis H37Rv
augcgggaaacccaugc

SEQ ID NO: 3293305 - RNA, 14 nt, Mycobacterium tuberculosis H37Rv
augcgggcagcgau

SEQ ID NO: 3293306 - RNA, 17 nt, Mycobacterium tuberculosis H37Rv
augcgggccgccaggcg

SEQ ID NO: 3293307 - RNA, 12 nt, Mycobacterium tuberculosis H37Rv
augcgggcuggg

SEQ ID NO: 3293308 - RNA, 20 nt, Mycobacterium tuberculosis H37Rv
augcggggcaauccccugga

SEQ ID NO: 3293309 - RNA, 21 nt, Mycobacterium tuberculosis H37Rv
augcgggucugacaucggcca

SEQ ID NO: 3293310 - RNA, 21 nt, Mycobacterium tuberculosis H37Rv
augcgggucugcggucaucgc

SEQ ID NO: 3293311 - RNA, 16 nt, Mycobacterium tuberculosis H37Rv
augcggucccugauca

SEQ ID NO: 3293312 - RNA, 15 nt, Mycobacterium tuberculosis H37Rv
augcgguccucgauc

SEQ ID NO: 3293313 - RNA, 17 nt, Mycobacterium tuberculosis H37Rv
augcgguccucgaucgg

SEQ ID NO: 3293314 - RNA, 18 nt, Mycobacterium tuberculosis H37Rv
augcgguccucgaucggu

SEQ ID NO: 3293315 - RNA, 15 nt, Mycobacterium tuberculosis H37Rv
augcggucggccaca

SEQ ID NO: 3293316 - RNA, 19 nt, Mycobacterium tuberculosis H37Rv
augcgguucucgagcucgg

SEQ ID NO: 3293317 - RNA, 20 nt, Mycobacterium tuberculosis H37Rv
augcgguucucgagcucggc

SEQ ID NO: 3293318 - RNA, 15 nt, Mycobacterium tuberculosis H37Rv
augcguccaggcgag

SEQ ID NO: 3293319 - RNA, 14 nt, Mycobacterium tuberculosis H37Rv
augcgucugcucgc

SEQ ID NO: 3293320 - RNA, 21 nt, Mycobacterium tuberculosis H37Rv
augcgucugcucgcccucaga

SEQ ID NO: 3293321 - RNA, 16 nt, Mycobacterium tuberculosis H37Rv
augcgugccgacccgc

SEQ ID NO: 3293322 - RNA, 18 nt, Mycobacterium tuberculosis H37Rv
augcguugacgucgagca

SEQ ID NO: 3293323 - RNA, 21 nt, Mycobacterium tuberculosis H37Rv
augcuaggcaugccacacacu

SEQ ID NO: 3293324 - RNA, 23 nt, Mycobacterium tuberculosis H37Rv
augcucaccgaaacgaugcggcc

SEQ ID NO: 3293325 - RNA, 20 nt, Mycobacterium tuberculosis H37Rv
augcucagcuggucggcuuc

SEQ ID NO: 3293326 - RNA, 11 nt, Mycobacterium tuberculosis H37Rv
augcucagguc

SEQ ID NO: 3293327 - RNA, 21 nt, Mycobacterium tuberculosis H37Rv
augcucgauccacugccgcgc

SEQ ID NO: 3293328 - RNA, 15 nt, Mycobacterium tuberculosis H37Rv
augcucggaaacagc

SEQ ID NO: 3293329 - RNA, 20 nt, Mycobacterium tuberculosis H37Rv
augcucgucuugggccggga

SEQ ID NO: 3293330 - RNA, 14 nt, Mycobacterium tuberculosis H37Rv
augcucuugaugcc

SEQ ID NO: 3293331 - RNA, 15 nt, Mycobacterium tuberculosis H37Rv
augcugagccgguca

SEQ ID NO: 3293332 - RNA, 13 nt, Mycobacterium tuberculosis H37Rv
augcugccagcca

SEQ ID NO: 3293333 - RNA, 20 nt, Mycobacterium tuberculosis H37Rv
augcugccagccauggccgc

SEQ ID NO: 3293334 - RNA, 21 nt, Mycobacterium tuberculosis H37Rv
augcugccagccauggccgcc

SEQ ID NO: 3293335 - RNA, 13 nt, Mycobacterium tuberculosis H37Rv
augcugcccggca

SEQ ID NO: 3293336 - RNA, 20 nt, Mycobacterium tuberculosis H37Rv
augcugcccggcaaccugga

SEQ ID NO: 3293337 - RNA, 15 nt, Mycobacterium tuberculosis H37Rv
augcugccgcugcga

SEQ ID NO: 3293338 - RNA, 23 nt, Mycobacterium tuberculosis H37Rv
augcuggagaaaccacuggaugg

SEQ ID NO: 3293339 - RNA, 19 nt, Mycobacterium tuberculosis H37Rv
augcuggcaaaguaucgca

SEQ ID NO: 3293340 - RNA, 15 nt, Mycobacterium tuberculosis H37Rv
augcuggcagcucgg

SEQ ID NO: 3293341 - RNA, 19 nt, Mycobacterium tuberculosis H37Rv
augcuggcgaucgcgacga

SEQ ID NO: 3293342 - RNA, 17 nt, Mycobacterium tuberculosis H37Rv
augcuggcggcgcgaca

SEQ ID NO: 3293343 - RNA, 23 nt, Mycobacterium tuberculosis H37Rv
augcuggcggcgcgacaggugcu

SEQ ID NO: 3293344 - RNA, 16 nt, Mycobacterium tuberculosis H37Rv
augcugggauguucuu

SEQ ID NO: 3293345 - RNA, 13 nt, Mycobacterium tuberculosis H37Rv
augcugggcgaga

SEQ ID NO: 3293346 - RNA, 14 nt, Mycobacterium tuberculosis H37Rv
augcuggucggcga

SEQ ID NO: 3293347 - RNA, 17 nt, Mycobacterium tuberculosis H37Rv
augcugucguagcgcga

SEQ ID NO: 3293348 - RNA, 13 nt, Mycobacterium tuberculosis H37Rv
augcuuccagcau

SEQ ID NO: 3293349 - RNA, 12 nt, Mycobacterium tuberculosis H37Rv
augcuucccgga

SEQ ID NO: 3293350 - RNA, 13 nt, Mycobacterium tuberculosis H37Rv
augcuucggcguc

SEQ ID NO: 3293351 - RNA, 20 nt, Mycobacterium tuberculosis H37Rv
augcuuguguucgugguugu

SEQ ID NO: 3293352 - RNA, 19 nt, Mycobacterium tuberculosis H37Rv
auggaaaacgccaugccgg

SEQ ID NO: 3293353 - RNA, 14 nt, Mycobacterium tuberculosis H37Rv
auggaaggcggcca

SEQ ID NO: 3293354 - RNA, 17 nt, Mycobacterium tuberculosis H37Rv
auggaaugaucggcguc

SEQ ID NO: 3293355 - RNA, 15 nt, Mycobacterium tuberculosis H37Rv
auggacaacagcuug

SEQ ID NO: 3293356 - RNA, 14 nt, Mycobacterium tuberculosis H37Rv
auggacaccaaccc

SEQ ID NO: 3293357 - RNA, 17 nt, Mycobacterium tuberculosis H37Rv
auggacaccagccagau

SEQ ID NO: 3293358 - RNA, 16 nt, Mycobacterium tuberculosis H37Rv
auggaccgccgccgac

SEQ ID NO: 3293359 - RNA, 22 nt, Mycobacterium tuberculosis H37Rv
auggacgcuuggguagccugac

SEQ ID NO: 3293360 - RNA, 20 nt, Mycobacterium tuberculosis H37Rv
auggacggcagccagccacc

SEQ ID NO: 3293361 - RNA, 21 nt, Mycobacterium tuberculosis H37Rv
auggauuggcgucagcagcaa

SEQ ID NO: 3293362 - RNA, 13 nt, Mycobacterium tuberculosis H37Rv
auggcaagccguu

SEQ ID NO: 3293363 - RNA, 22 nt, Mycobacterium tuberculosis H37Rv
auggcaccgcccccgucggccu

SEQ ID NO: 3293364 - RNA, 14 nt, Mycobacterium tuberculosis H37Rv
auggcaucggccug

SEQ ID NO: 3293365 - RNA, 21 nt, Mycobacterium tuberculosis H37Rv
auggcauuaccacuucggcgu

SEQ ID NO: 3293366 - RNA, 22 nt, Mycobacterium tuberculosis H37Rv
auggcauuaccacuucggcguc

SEQ ID NO: 3293367 - RNA, 23 nt, Mycobacterium tuberculosis H37Rv
auggcauuccguuuuuguugacc

SEQ ID NO: 3293368 - RNA, 20 nt, Mycobacterium tuberculosis H37Rv
auggccacccgguggcguuu

SEQ ID NO: 3293369 - RNA, 22 nt, Mycobacterium tuberculosis H37Rv
auggccaccgaacgcggccacc

SEQ ID NO: 3293370 - RNA, 11 nt, Mycobacterium tuberculosis H37Rv
auggccagcac

SEQ ID NO: 3293371 - RNA, 16 nt, Mycobacterium tuberculosis H37Rv
auggccagcacggugu

SEQ ID NO: 3293372 - RNA, 12 nt, Mycobacterium tuberculosis H37Rv
auggccagcauc

SEQ ID NO: 3293373 - RNA, 15 nt, Mycobacterium tuberculosis H37Rv
auggccagcaucagc

SEQ ID NO: 3293374 - RNA, 17 nt, Mycobacterium tuberculosis H37Rv
auggccagcaucagcgc

SEQ ID NO: 3293375 - RNA, 17 nt, Mycobacterium tuberculosis H37Rv
auggccaggcuggcguc

SEQ ID NO: 3293376 - RNA, 19 nt, Mycobacterium tuberculosis H37Rv
auggccaucagcucgccag

SEQ ID NO: 3293377 - RNA, 17 nt, Mycobacterium tuberculosis H37Rv
auggccccgggcgguga

SEQ ID NO: 3293378 - RNA, 17 nt, Mycobacterium tuberculosis H37Rv
auggcccgaucgaccgc

SEQ ID NO: 3293379 - RNA, 22 nt, Mycobacterium tuberculosis H37Rv
auggcccggcucacagcacagc

SEQ ID NO: 3293380 - RNA, 20 nt, Mycobacterium tuberculosis H37Rv
auggcccguuggcagcacag

SEQ ID NO: 3293381 - RNA, 15 nt, Mycobacterium tuberculosis H37Rv
auggcccuggcgacc

SEQ ID NO: 3293382 - RNA, 21 nt, Mycobacterium tuberculosis H37Rv
auggccgaaccguucggcgac

SEQ ID NO: 3293383 - RNA, 21 nt, Mycobacterium tuberculosis H37Rv
auggccgaccagccgaucauc

SEQ ID NO: 3293384 - RNA, 19 nt, Mycobacterium tuberculosis H37Rv
auggccgaguccggcaaga

SEQ ID NO: 3293385 - RNA, 21 nt, Mycobacterium tuberculosis H37Rv
auggccgcauuggcgaccgcu

SEQ ID NO: 3293386 - RNA, 13 nt, Mycobacterium tuberculosis H37Rv
auggccgccgaca

SEQ ID NO: 3293387 - RNA, 14 nt, Mycobacterium tuberculosis H37Rv
auggccgccgacaa

SEQ ID NO: 3293388 - RNA, 21 nt, Mycobacterium tuberculosis H37Rv
auggccguugccaacaacauc

SEQ ID NO: 3293389 - RNA, 15 nt, Mycobacterium tuberculosis H37Rv
auggccuugcugcgc

SEQ ID NO: 3293390 - RNA, 17 nt, Mycobacterium tuberculosis H37Rv
auguauuuggugaugca

SEQ ID NO: 3293391 - RNA, 21 nt, Mycobacterium tuberculosis H37Rv
augucaaccaagugaccggcc

SEQ ID NO: 3293392 - RNA, 18 nt, Mycobacterium tuberculosis H37Rv
augucaacgcccagcucg

SEQ ID NO: 3293393 - RNA, 20 nt, Mycobacterium tuberculosis H37Rv
augucaacgugucccaagcc

SEQ ID NO: 3293394 - RNA, 18 nt, Mycobacterium tuberculosis H37Rv
augucaaguucgccagca

SEQ ID NO: 3293395 - RNA, 20 nt, Mycobacterium tuberculosis H37Rv
augucacggaugugcucagg

SEQ ID NO: 3293396 - RNA, 16 nt, Mycobacterium tuberculosis H37Rv
augucagccaccaucu

SEQ ID NO: 3293397 - RNA, 17 nt, Mycobacterium tuberculosis H37Rv
augucagcggccugcuc

SEQ ID NO: 3293398 - RNA, 15 nt, Mycobacterium tuberculosis H37Rv
auguccauagccggc

SEQ ID NO: 3293399 - RNA, 18 nt, Mycobacterium tuberculosis H37Rv
auguccauagccggcauu

SEQ ID NO: 3293400 - RNA, 21 nt, Mycobacterium tuberculosis H37Rv
auguccauguuuugcugcaug

SEQ ID NO: 3293401 - RNA, 23 nt, Mycobacterium tuberculosis H37Rv
auguccgacgccaccgccaccac

SEQ ID NO: 3293402 - RNA, 14 nt, Mycobacterium tuberculosis H37Rv
auguccgcggccac

SEQ ID NO: 3293403 - RNA, 22 nt, Mycobacterium tuberculosis H37Rv
auguccuauuugcagccuucga

SEQ ID NO: 3293404 - RNA, 17 nt, Mycobacterium tuberculosis H37Rv
auguccugggccgccgc

SEQ ID NO: 3293405 - RNA, 17 nt, Mycobacterium tuberculosis H37Rv
augucgaacaggaucag

SEQ ID NO: 3293406 - RNA, 16 nt, Mycobacterium tuberculosis H37Rv
augucgaagaaccggc

SEQ ID NO: 3293407 - RNA, 13 nt, Mycobacterium tuberculosis H37Rv
augucgacgacaa

SEQ ID NO: 3293408 - RNA, 18 nt, Mycobacterium tuberculosis H37Rv
augucgagcacaccgucg

SEQ ID NO: 3293409 - RNA, 19 nt, Mycobacterium tuberculosis H37Rv
augucgagcgcgaucgggc

SEQ ID NO: 3293410 - RNA, 18 nt, Mycobacterium tuberculosis H37Rv
augucgaucagcgcgacg

SEQ ID NO: 3293411 - RNA, 14 nt, Mycobacterium tuberculosis H37Rv
augucgaugacgaa

SEQ ID NO: 3293412 - RNA, 12 nt, Mycobacterium tuberculosis H37Rv
augucgaugccg

SEQ ID NO: 3293413 - RNA, 13 nt, Mycobacterium tuberculosis H37Rv
augucgaugccgu

SEQ ID NO: 3293414 - RNA, 15 nt, Mycobacterium tuberculosis H37Rv
augucgaugccgugu

SEQ ID NO: 3293415 - RNA, 14 nt, Mycobacterium tuberculosis H37Rv
augucgauguccac

SEQ ID NO: 3293416 - RNA, 21 nt, Mycobacterium tuberculosis H37Rv
augucgccgcccacaugaacg

SEQ ID NO: 3293417 - RNA, 22 nt, Mycobacterium tuberculosis H37Rv
augucgccgcccacaugaacga

SEQ ID NO: 3293418 - RNA, 12 nt, Mycobacterium tuberculosis H37Rv
augucggccacc

SEQ ID NO: 3293419 - RNA, 13 nt, Mycobacterium tuberculosis H37Rv
augucggccaccg

SEQ ID NO: 3293420 - RNA, 13 nt, Mycobacterium tuberculosis H37Rv
augucggccaggu

SEQ ID NO: 3293421 - RNA, 22 nt, Mycobacterium tuberculosis H37Rv
augucggggccgucgucgguca

SEQ ID NO: 3293422 - RNA, 20 nt, Mycobacterium tuberculosis H37Rv
augucguaguagcggaucag

SEQ ID NO: 3293423 - RNA, 13 nt, Mycobacterium tuberculosis H37Rv
augucgucgacca

SEQ ID NO: 3293424 - RNA, 13 nt, Mycobacterium tuberculosis H37Rv
augucgucgauga

SEQ ID NO: 3293425 - RNA, 22 nt, Mycobacterium tuberculosis H37Rv
augucgugcgggcgcaccaggg

SEQ ID NO: 3293426 - RNA, 15 nt, Mycobacterium tuberculosis H37Rv
augucguugucugcc

SEQ ID NO: 3293427 - RNA, 20 nt, Mycobacterium tuberculosis H37Rv
augucuaccaacaccgcccg

SEQ ID NO: 3293428 - RNA, 21 nt, Mycobacterium tuberculosis H37Rv
augucuaccaacaccgcccgc

SEQ ID NO: 3293429 - RNA, 19 nt, Mycobacterium tuberculosis H37Rv
augucuccaguagccggug

SEQ ID NO: 3293430 - RNA, 23 nt, Mycobacterium tuberculosis H37Rv
augucuccgacauuggccgucau

SEQ ID NO: 3293431 - RNA, 23 nt, Mycobacterium tuberculosis H37Rv
augucugcgcagguggucgauca

SEQ ID NO: 3293432 - RNA, 21 nt, Mycobacterium tuberculosis H37Rv
augucuugcaguaacuucacc

SEQ ID NO: 3293433 - RNA, 20 nt, Mycobacterium tuberculosis H37Rv
augucuugcgaugugcauuc

SEQ ID NO: 3293434 - RNA, 15 nt, Mycobacterium tuberculosis H37Rv
augucuuguggugga

SEQ ID NO: 3293435 - RNA, 19 nt, Mycobacterium tuberculosis H37Rv
augugaaagacaacccgcu

SEQ ID NO: 3293436 - RNA, 20 nt, Mycobacterium tuberculosis H37Rv
augugacaucgggccgccga

SEQ ID NO: 3293437 - RNA, 20 nt, Mycobacterium tuberculosis H37Rv
augugaucacccgcaucggc

SEQ ID NO: 3293438 - RNA, 20 nt, Mycobacterium tuberculosis H37Rv
augugccaggugcggugauc

SEQ ID NO: 3293439 - RNA, 18 nt, Mycobacterium tuberculosis H37Rv
augugcccggcucucagc

SEQ ID NO: 3293440 - RNA, 18 nt, Mycobacterium tuberculosis H37Rv
augugcgagaagcaggga

SEQ ID NO: 3293441 - RNA, 15 nt, Mycobacterium tuberculosis H37Rv
augugcggcugcacc

SEQ ID NO: 3293442 - RNA, 15 nt, Mycobacterium tuberculosis H37Rv
auguggauagcuuuu

SEQ ID NO: 3293443 - RNA, 13 nt, Mycobacterium tuberculosis H37Rv
auguggccgccgu

SEQ ID NO: 3293444 - RNA, 16 nt, Mycobacterium tuberculosis H37Rv
auguggccggcgaugg

SEQ ID NO: 3293445 - RNA, 22 nt, Mycobacterium tuberculosis H37Rv
auguggcgucgcucgucgucac

SEQ ID NO: 3293446 - RNA, 16 nt, Mycobacterium tuberculosis H37Rv
augugugagucccacg

SEQ ID NO: 3293447 - RNA, 16 nt, Mycobacterium tuberculosis H37Rv
auguguugccagauca

SEQ ID NO: 3293448 - RNA, 18 nt, Mycobacterium tuberculosis H37Rv
auguguugcgggugguuu

SEQ ID NO: 3293449 - RNA, 14 nt, Mycobacterium tuberculosis H37Rv
auguucauccgcag

SEQ ID NO: 3293450 - RNA, 17 nt, Mycobacterium tuberculosis H37Rv
auguucaucgcagucau

SEQ ID NO: 3293451 - RNA, 21 nt, Mycobacterium tuberculosis H37Rv
auguucgaaagcaccgaugcu

SEQ ID NO: 3293452 - RNA, 20 nt, Mycobacterium tuberculosis H37Rv
auguucgccgcgcggaacac

SEQ ID NO: 3293453 - RNA, 24 nt, Mycobacterium tuberculosis H37Rv
auguucggccaccagaaccagcga

SEQ ID NO: 3293454 - RNA, 14 nt, Mycobacterium tuberculosis H37Rv
auguugcagaacuc

SEQ ID NO: 3293455 - RNA, 17 nt, Mycobacterium tuberculosis H37Rv
auguugcgacggccggc

SEQ ID NO: 3293456 - RNA, 18 nt, Mycobacterium tuberculosis H37Rv
auguugcgacggccggca

SEQ ID NO: 3293457 - RNA, 14 nt, Mycobacterium tuberculosis H37Rv
auguuggccggcgc

SEQ ID NO: 3293458 - RNA, 18 nt, Mycobacterium tuberculosis H37Rv
auguuggccggcgccacc

SEQ ID NO: 3293459 - RNA, 11 nt, Mycobacterium tuberculosis H37Rv
auguuggugau

SEQ ID NO: 3293460 - RNA, 15 nt, Mycobacterium tuberculosis H37Rv
auguuggugaucaaa

SEQ ID NO: 3293461 - RNA, 23 nt, Mycobacterium tuberculosis H37Rv
auguuggugucaaugacaccggg

SEQ ID NO: 3293462 - RNA, 19 nt, Mycobacterium tuberculosis H37Rv
auguugugccgaucggcca

SEQ ID NO: 3293463 - RNA, 14 nt, Mycobacterium tuberculosis H37Rv
auguuguucagcag

SEQ ID NO: 3293464 - RNA, 22 nt, Mycobacterium tuberculosis H37Rv
auguuugaaacguaugacgccc

SEQ ID NO: 3293465 - RNA, 16 nt, Mycobacterium tuberculosis H37Rv
auguuuugcugcaugc

SEQ ID NO: 3293466 - RNA, 15 nt, Mycobacterium tuberculosis H37Rv
auuaaagccaccaga

SEQ ID NO: 3293467 - RNA, 23 nt, Mycobacterium tuberculosis H37Rv
auuaagggucaucgccagcggca

SEQ ID NO: 3293468 - RNA, 16 nt, Mycobacterium tuberculosis H37Rv
auuaaggugaccacgg

SEQ ID NO: 3293469 - RNA, 14 nt, Mycobacterium tuberculosis H37Rv
auuacuucggccac

SEQ ID NO: 3293470 - RNA, 19 nt, Mycobacterium tuberculosis H37Rv
auuagccauuaaugcggcc

SEQ ID NO: 3293471 - RNA, 19 nt, Mycobacterium tuberculosis H37Rv
auuagcccacccauggccu

SEQ ID NO: 3293472 - RNA, 21 nt, Mycobacterium tuberculosis H37Rv
auuaguuucguccccagaccg

SEQ ID NO: 3293473 - RNA, 14 nt, Mycobacterium tuberculosis H37Rv
auucacgagccgcu

SEQ ID NO: 3293474 - RNA, 17 nt, Mycobacterium tuberculosis H37Rv
auucagcgccccaugca

SEQ ID NO: 3293475 - RNA, 20 nt, Mycobacterium tuberculosis H37Rv
auucaggccgaggaaggagc

SEQ ID NO: 3293476 - RNA, 19 nt, Mycobacterium tuberculosis H37Rv
auucauccaccccugagcu

SEQ ID NO: 3293477 - RNA, 21 nt, Mycobacterium tuberculosis H37Rv
auucaugccgguguugccgaa

SEQ ID NO: 3293478 - RNA, 14 nt, Mycobacterium tuberculosis H37Rv
auucauggccgcga

SEQ ID NO: 3293479 - RNA, 13 nt, Mycobacterium tuberculosis H37Rv
auucauggcggca

SEQ ID NO: 3293480 - RNA, 17 nt, Mycobacterium tuberculosis H37Rv
auuccaccuuggccaga

SEQ ID NO: 3293481 - RNA, 17 nt, Mycobacterium tuberculosis H37Rv
auuccacggcagcaccg

SEQ ID NO: 3293482 - RNA, 15 nt, Mycobacterium tuberculosis H37Rv
auuccacugggccug

SEQ ID NO: 3293483 - RNA, 19 nt, Mycobacterium tuberculosis H37Rv
auuccagcggaagcgguug

SEQ ID NO: 3293484 - RNA, 17 nt, Mycobacterium tuberculosis H37Rv
auuccaucgcgcaccgc

SEQ ID NO: 3293485 - RNA, 13 nt, Mycobacterium tuberculosis H37Rv
auucccacugcau

SEQ ID NO: 3293486 - RNA, 11 nt, Mycobacterium tuberculosis H37Rv
auuucgccgga

SEQ ID NO: 3293487 - RNA, 17 nt, Mycobacterium tuberculosis H37Rv
auuucgcgucugcucgc

SEQ ID NO: 3293488 - RNA, 21 nt, Mycobacterium tuberculosis H37Rv
auuucgcgucugcucgccagc

SEQ ID NO: 3293489 - RNA, 14 nt, Mycobacterium tuberculosis H37Rv
auuucggaucucga

SEQ ID NO: 3293490 - RNA, 15 nt, Mycobacterium tuberculosis H37Rv
auuucggaucucgac

SEQ ID NO: 3293491 - RNA, 13 nt, Mycobacterium tuberculosis H37Rv
auuucggcccacu

SEQ ID NO: 3293492 - RNA, 13 nt, Mycobacterium tuberculosis H37Rv
auuucgucgaucg

SEQ ID NO: 3293493 - RNA, 15 nt, Mycobacterium tuberculosis H37Rv
auuucgucgucgcag

SEQ ID NO: 3293494 - RNA, 22 nt, Mycobacterium tuberculosis H37Rv
auuucgucgucgcugagcagcg

SEQ ID NO: 3293495 - RNA, 17 nt, Mycobacterium tuberculosis H37Rv
auuucgugccgaaaugg

SEQ ID NO: 3293496 - RNA, 19 nt, Mycobacterium tuberculosis H37Rv
auuucgugucgcugcggcg

SEQ ID NO: 3293497 - RNA, 16 nt, Mycobacterium tuberculosis H37Rv
auuucguugagaacau

SEQ ID NO: 3293498 - RNA, 20 nt, Mycobacterium tuberculosis H37Rv
auuucuagguggacgugcag

SEQ ID NO: 3293499 - RNA, 13 nt, Mycobacterium tuberculosis H37Rv
auuugaugagcaa

SEQ ID NO: 3293500 - RNA, 20 nt, Mycobacterium tuberculosis H37Rv
auuuggccgauguuguugac

SEQ ID NO: 3293501 - RNA, 19 nt, Mycobacterium tuberculosis H37Rv
auuuucacugugccgcugc

SEQ ID NO: 3293502 - RNA, 15 nt, Mycobacterium tuberculosis H37Rv
auuuucggcacggau

SEQ ID NO: 3293503 - RNA, 19 nt, Mycobacterium tuberculosis H37Rv
auuuucucggggugguggu

SEQ ID NO: 3293504 - RNA, 12 nt, Mycobacterium tuberculosis H37Rv
auuuugcgucug

SEQ ID NO: 3293505 - RNA, 19 nt, Mycobacterium tuberculosis H37Rv
auuuugcgucugcucggca

SEQ ID NO: 3293506 - RNA, 20 nt, Mycobacterium tuberculosis H37Rv
auuuugcgucugcucggcgg

SEQ ID NO: 3293507 - RNA, 21 nt, Mycobacterium tuberculosis H37Rv
caaaaacccggugaccagcaa

SEQ ID NO: 3293508 - RNA, 19 nt, Mycobacterium tuberculosis H37Rv
caaaaagcucggcccuguu

SEQ ID NO: 3293509 - RNA, 20 nt, Mycobacterium tuberculosis H37Rv
caaaaaucgucggaaucauc

SEQ ID NO: 3293510 - RNA, 16 nt, Mycobacterium tuberculosis H37Rv
caaaacccgagccugg

SEQ ID NO: 3293511 - RNA, 15 nt, Mycobacterium tuberculosis H37Rv
caaaacgagcuucca

SEQ ID NO: 3293512 - RNA, 17 nt, Mycobacterium tuberculosis H37Rv
caaaaggaucaacgugc

SEQ ID NO: 3293513 - RNA, 22 nt, Mycobacterium tuberculosis H37Rv
caaaaucgcacgguuugcgguu

SEQ ID NO: 3293514 - RNA, 18 nt, Mycobacterium tuberculosis H37Rv
caaaaucgcccaauucgg

SEQ ID NO: 3293515 - RNA, 20 nt, Mycobacterium tuberculosis H37Rv
caaaaucgcccaauucggca

SEQ ID NO: 3293516 - RNA, 17 nt, Mycobacterium tuberculosis H37Rv
caaaaucgucagcgccg

SEQ ID NO: 3293517 - RNA, 21 nt, Mycobacterium tuberculosis H37Rv
caaaaugccuuggcagcccag

SEQ ID NO: 3293518 - RNA, 14 nt, Mycobacterium tuberculosis H37Rv
caaacaacgacucc

SEQ ID NO: 3293519 - RNA, 17 nt, Mycobacterium tuberculosis H37Rv
caaacaagaucagaccc

SEQ ID NO: 3293520 - RNA, 16 nt, Mycobacterium tuberculosis H37Rv
caaacaccccacacag

SEQ ID NO: 3293521 - RNA, 23 nt, Mycobacterium tuberculosis H37Rv
caaacaccccggccuugccaccg

SEQ ID NO: 3293522 - RNA, 15 nt, Mycobacterium tuberculosis H37Rv
caaacaucgcaccca

SEQ ID NO: 3293523 - RNA, 16 nt, Mycobacterium tuberculosis H37Rv
caaacaucgcacccac

SEQ ID NO: 3293524 - RNA, 19 nt, Mycobacterium tuberculosis H37Rv
caaacaucgcacccaccac

SEQ ID NO: 3293525 - RNA, 21 nt, Mycobacterium tuberculosis H37Rv
caaacauggguuucgaguagc

SEQ ID NO: 3293526 - RNA, 14 nt, Mycobacterium tuberculosis H37Rv
caaaccacagacug

SEQ ID NO: 3293527 - RNA, 23 nt, Mycobacterium tuberculosis H37Rv
caaaccuucaacaacgauguggc

SEQ ID NO: 3293528 - RNA, 18 nt, Mycobacterium tuberculosis H37Rv
caaacggaauguagccga

SEQ ID NO: 3293529 - RNA, 14 nt, Mycobacterium tuberculosis H37Rv
caaacggcgaccca

SEQ ID NO: 3293530 - RNA, 22 nt, Mycobacterium tuberculosis H37Rv
caaacggcuuggcugccuccau

SEQ ID NO: 3293531 - RNA, 19 nt, Mycobacterium tuberculosis H37Rv
caaacguaccgucauggcg

SEQ ID NO: 3293532 - RNA, 21 nt, Mycobacterium tuberculosis H37Rv
caaacuaacggcagccaccgu

SEQ ID NO: 3293533 - RNA, 17 nt, Mycobacterium tuberculosis H37Rv
caaacucagacucugcc

SEQ ID NO: 3293534 - RNA, 15 nt, Mycobacterium tuberculosis H37Rv
caaacuccugcagga

SEQ ID NO: 3293535 - RNA, 18 nt, Mycobacterium tuberculosis H37Rv
caaacuccugcaggauca

SEQ ID NO: 3293536 - RNA, 14 nt, Mycobacterium tuberculosis H37Rv
caaacugggcaccg

SEQ ID NO: 3293537 - RNA, 22 nt, Mycobacterium tuberculosis H37Rv
caaagacccgacgccacgcguc

SEQ ID NO: 3293538 - RNA, 17 nt, Mycobacterium tuberculosis H37Rv
caaagacccggcaccca

SEQ ID NO: 3293539 - RNA, 11 nt, Mycobacterium tuberculosis H37Rv
caaagcagcgc

SEQ ID NO: 3293540 - RNA, 13 nt, Mycobacterium tuberculosis H37Rv
caaagcagcgcac

SEQ ID NO: 3293541 - RNA, 17 nt, Mycobacterium tuberculosis H37Rv
caaagccagcgcagcca

SEQ ID NO: 3293542 - RNA, 18 nt, Mycobacterium tuberculosis H37Rv
caaagcccuccucgauga

SEQ ID NO: 3293543 - RNA, 18 nt, Mycobacterium tuberculosis H37Rv
caaagccgaacgacagca

SEQ ID NO: 3293544 - RNA, 20 nt, Mycobacterium tuberculosis H37Rv
caaagccgggauugccgcca

SEQ ID NO: 3293545 - RNA, 22 nt, Mycobacterium tuberculosis H37Rv
caaagccgucagcucaccaccc

SEQ ID NO: 3293546 - RNA, 14 nt, Mycobacterium tuberculosis H37Rv
caaagcgacagcgc

SEQ ID NO: 3293547 - RNA, 17 nt, Mycobacterium tuberculosis H37Rv
caaagcgccagcagcca

SEQ ID NO: 3293548 - RNA, 13 nt, Mycobacterium tuberculosis H37Rv
caaagcggccucg

SEQ ID NO: 3293549 - RNA, 15 nt, Mycobacterium tuberculosis H37Rv
caaagcggccucgac

SEQ ID NO: 3293550 - RNA, 21 nt, Mycobacterium tuberculosis H37Rv
caaagcguauugcaccgcggc

SEQ ID NO: 3293551 - RNA, 18 nt, Mycobacterium tuberculosis H37Rv
caaagcugcucgucggcg

SEQ ID NO: 3293552 - RNA, 23 nt, Mycobacterium tuberculosis H37Rv
caaagcugcucgucggcgccggc

SEQ ID NO: 3293553 - RNA, 16 nt, Mycobacterium tuberculosis H37Rv
caaaggauucgcgcga

SEQ ID NO: 3293554 - RNA, 16 nt, Mycobacterium tuberculosis H37Rv
caaaggccuugacgua

SEQ ID NO: 3293555 - RNA, 19 nt, Mycobacterium tuberculosis H37Rv
caaaggcgccgggucacgu

SEQ ID NO: 3293556 - RNA, 21 nt, Mycobacterium tuberculosis H37Rv
caaaggcuugcggaacgaaag

SEQ ID NO: 3293557 - RNA, 16 nt, Mycobacterium tuberculosis H37Rv
caaaggugcacugccg

SEQ ID NO: 3293558 - RNA, 16 nt, Mycobacterium tuberculosis H37Rv
caaaguagacgugcca

SEQ ID NO: 3293559 - RNA, 15 nt, Mycobacterium tuberculosis H37Rv
caaaguaucgcagca

SEQ ID NO: 3293560 - RNA, 22 nt, Mycobacterium tuberculosis H37Rv
caaagucggcgucacgguggac

SEQ ID NO: 3293561 - RNA, 23 nt, Mycobacterium tuberculosis H37Rv
caaaguucgacgagaagacaccg

SEQ ID NO: 3293562 - RNA, 13 nt, Mycobacterium tuberculosis H37Rv
caaaucaagcaca

SEQ ID NO: 3293563 - RNA, 15 nt, Mycobacterium tuberculosis H37Rv
caaaucaagcacagc

SEQ ID NO: 3293564 - RNA, 17 nt, Mycobacterium tuberculosis H37Rv
caaaucaagcacagccc

SEQ ID NO: 3293565 - RNA, 22 nt, Mycobacterium tuberculosis H37Rv
caaaucaagcacagcccggcga

SEQ ID NO: 3293566 - RNA, 14 nt, Mycobacterium tuberculosis H37Rv
caaaucccagagca

SEQ ID NO: 3293567 - RNA, 17 nt, Mycobacterium tuberculosis H37Rv
caaaucgaugaccgucg

SEQ ID NO: 3293568 - RNA, 15 nt, Mycobacterium tuberculosis H37Rv
caaaucggucgacga

SEQ ID NO: 3293569 - RNA, 23 nt, Mycobacterium tuberculosis H37Rv
caaaucggucgacgaucucgccg

SEQ ID NO: 3293570 - RNA, 14 nt, Mycobacterium tuberculosis H37Rv
caaaucgguggcaa

SEQ ID NO: 3293571 - RNA, 15 nt, Mycobacterium tuberculosis H37Rv
caaaugccugcuggu

SEQ ID NO: 3293572 - RNA, 14 nt, Mycobacterium tuberculosis H37Rv
caaaugcgcugucg

SEQ ID NO: 3293573 - RNA, 18 nt, Mycobacterium tuberculosis H37Rv
caaaugucguaggccgca

SEQ ID NO: 3293574 - RNA, 15 nt, Mycobacterium tuberculosis H37Rv
caacaacgcauuugg

SEQ ID NO: 3293575 - RNA, 16 nt, Mycobacterium tuberculosis H37Rv
caacaacgcuucggcg

SEQ ID NO: 3293576 - RNA, 14 nt, Mycobacterium tuberculosis H37Rv
caacaacuccagca

SEQ ID NO: 3293577 - RNA, 17 nt, Mycobacterium tuberculosis H37Rv
caacaaggggcagcacg

SEQ ID NO: 3293578 - RNA, 21 nt, Mycobacterium tuberculosis H37Rv
caacaaggggcagcacgucac

SEQ ID NO: 3293579 - RNA, 16 nt, Mycobacterium tuberculosis H37Rv
caacacagccgucgca

SEQ ID NO: 3293580 - RNA, 13 nt, Mycobacterium tuberculosis H37Rv
caacacagcugau

SEQ ID NO: 3293581 - RNA, 17 nt, Mycobacterium tuberculosis H37Rv
caacaccaacgaacugg

SEQ ID NO: 3293582 - RNA, 19 nt, Mycobacterium tuberculosis H37Rv
caaccgcggccccgacugc

SEQ ID NO: 3293583 - RNA, 17 nt, Mycobacterium tuberculosis H37Rv
caaccgcgugcgucagc

SEQ ID NO: 3293584 - RNA, 16 nt, Mycobacterium tuberculosis H37Rv
caaccgcugucaccgu

SEQ ID NO: 3293585 - RNA, 23 nt, Mycobacterium tuberculosis H37Rv
caaccgcuuugaauugcgcgccc

SEQ ID NO: 3293586 - RNA, 19 nt, Mycobacterium tuberculosis H37Rv
caaccggacgaccggaacg

SEQ ID NO: 3293587 - RNA, 19 nt, Mycobacterium tuberculosis H37Rv
caaccggacgcccucacgc

SEQ ID NO: 3293588 - RNA, 14 nt, Mycobacterium tuberculosis H37Rv
caaccggccgguga

SEQ ID NO: 3293589 - RNA, 14 nt, Mycobacterium tuberculosis H37Rv
caaccggccgucca

SEQ ID NO: 3293590 - RNA, 15 nt, Mycobacterium tuberculosis H37Rv
caaccggcgaucggu

SEQ ID NO: 3293591 - RNA, 21 nt, Mycobacterium tuberculosis H37Rv
caaccggcgcaguagccgacc

SEQ ID NO: 3293592 - RNA, 15 nt, Mycobacterium tuberculosis H37Rv
caaccggcggacacc

SEQ ID NO: 3293593 - RNA, 15 nt, Mycobacterium tuberculosis H37Rv
caaccggcgugucga

SEQ ID NO: 3293594 - RNA, 18 nt, Mycobacterium tuberculosis H37Rv
caaccgggacaaccccuu

SEQ ID NO: 3293595 - RNA, 17 nt, Mycobacterium tuberculosis H37Rv
caaccgggccgccugga

SEQ ID NO: 3293596 - RNA, 22 nt, Mycobacterium tuberculosis H37Rv
caaccgggucguucgggugagc

SEQ ID NO: 3293597 - RNA, 24 nt, Mycobacterium tuberculosis H37Rv
caaccgggucguucgggugagcac

SEQ ID NO: 3293598 - RNA, 16 nt, Mycobacterium tuberculosis H37Rv
caaccgguacuccugg

SEQ ID NO: 3293599 - RNA, 17 nt, Mycobacterium tuberculosis H37Rv
caaccgguaucgccgcu

SEQ ID NO: 3293600 - RNA, 20 nt, Mycobacterium tuberculosis H37Rv
caaccggucaaacgcgcgcg

SEQ ID NO: 3293601 - RNA, 22 nt, Mycobacterium tuberculosis H37Rv
caaccggucgguguagcaacgg

SEQ ID NO: 3293602 - RNA, 22 nt, Mycobacterium tuberculosis H37Rv
caaccgguguaauugccgacgc

SEQ ID NO: 3293603 - RNA, 23 nt, Mycobacterium tuberculosis H37Rv
caaccgucggugaaauucgcggc

SEQ ID NO: 3293604 - RNA, 22 nt, Mycobacterium tuberculosis H37Rv
caaccgugaacucgcgcgucgu

SEQ ID NO: 3293605 - RNA, 16 nt, Mycobacterium tuberculosis H37Rv
caaccgugagcaccag

SEQ ID NO: 3293606 - RNA, 17 nt, Mycobacterium tuberculosis H37Rv
caaccgugagcaccagc

SEQ ID NO: 3293607 - RNA, 19 nt, Mycobacterium tuberculosis H37Rv
caaccgugccgcaucaccc

SEQ ID NO: 3293608 - RNA, 14 nt, Mycobacterium tuberculosis H37Rv
caaccguucccggc

SEQ ID NO: 3293609 - RNA, 16 nt, Mycobacterium tuberculosis H37Rv
caaccucaugcacgcc

SEQ ID NO: 3293610 - RNA, 15 nt, Mycobacterium tuberculosis H37Rv
caaccucccucuagc

SEQ ID NO: 3293611 - RNA, 21 nt, Mycobacterium tuberculosis H37Rv
caaccuccgcgagcagucgcu

SEQ ID NO: 3293612 - RNA, 18 nt, Mycobacterium tuberculosis H37Rv
caaccucgccacgcucgg

SEQ ID NO: 3293613 - RNA, 18 nt, Mycobacterium tuberculosis H37Rv
caaccucgccgucgucga

SEQ ID NO: 3293614 - RNA, 19 nt, Mycobacterium tuberculosis H37Rv
caaccucgucgucaucgag

SEQ ID NO: 3293615 - RNA, 23 nt, Mycobacterium tuberculosis H37Rv
caaccucgucgucaucgaguugc

SEQ ID NO: 3293616 - RNA, 21 nt, Mycobacterium tuberculosis H37Rv
caaccugagcaucuccucgcc

SEQ ID NO: 3293617 - RNA, 15 nt, Mycobacterium tuberculosis H37Rv
caaccugccgggcca

SEQ ID NO: 3293618 - RNA, 19 nt, Mycobacterium tuberculosis H37Rv
caaccugccgggccacggc

SEQ ID NO: 3293619 - RNA, 23 nt, Mycobacterium tuberculosis H37Rv
caaccugcgaccaggcgcggcga

SEQ ID NO: 3293620 - RNA, 20 nt, Mycobacterium tuberculosis H37Rv
caaccugcgcaucaccacug

SEQ ID NO: 3293621 - RNA, 14 nt, Mycobacterium tuberculosis H37Rv
caaccugcgcggcg

SEQ ID NO: 3293622 - RNA, 16 nt, Mycobacterium tuberculosis H37Rv
caaccugcgcggcgau

SEQ ID NO: 3293623 - RNA, 23 nt, Mycobacterium tuberculosis H37Rv
caaccuggacugggucgccuccu

SEQ ID NO: 3293624 - RNA, 22 nt, Mycobacterium tuberculosis H37Rv
caaccugggccaucacggucag

SEQ ID NO: 3293625 - RNA, 13 nt, Mycobacterium tuberculosis H37Rv
caaccuggggcca

SEQ ID NO: 3293626 - RNA, 15 nt, Mycobacterium tuberculosis H37Rv
caaccuggggccacc

SEQ ID NO: 3293627 - RNA, 17 nt, Mycobacterium tuberculosis H37Rv
caaccuggggccaccag

SEQ ID NO: 3293628 - RNA, 23 nt, Mycobacterium tuberculosis H37Rv
caaccuguuccagcgugccuggu

SEQ ID NO: 3293629 - RNA, 14 nt, Mycobacterium tuberculosis H37Rv
caaccuugaccggg

SEQ ID NO: 3293630 - RNA, 12 nt, Mycobacterium tuberculosis H37Rv
caaccuuuggcc

SEQ ID NO: 3293631 - RNA, 19 nt, Mycobacterium tuberculosis H37Rv
caacgaagagggcgccgcg

SEQ ID NO: 3293632 - RNA, 23 nt, Mycobacterium tuberculosis H37Rv
caacgaagagggcgccgcgcgca

SEQ ID NO: 3293633 - RNA, 18 nt, Mycobacterium tuberculosis H37Rv
caacgacaggcgcccaca

SEQ ID NO: 3293634 - RNA, 16 nt, Mycobacterium tuberculosis H37Rv
caacgacccgccgccc

SEQ ID NO: 3293635 - RNA, 19 nt, Mycobacterium tuberculosis H37Rv
caacgacgacgacaagugc

SEQ ID NO: 3293636 - RNA, 16 nt, Mycobacterium tuberculosis H37Rv
caacgacggcugaccu

SEQ ID NO: 3293637 - RNA, 18 nt, Mycobacterium tuberculosis H37Rv
caacgacgucgccgaccc

SEQ ID NO: 3293638 - RNA, 23 nt, Mycobacterium tuberculosis H37Rv
caacgacuguggcgccgccggca

SEQ ID NO: 3293639 - RNA, 18 nt, Mycobacterium tuberculosis H37Rv
caacgacuuucaucgcga

SEQ ID NO: 3293640 - RNA, 21 nt, Mycobacterium tuberculosis H37Rv
caacgaucgcgccgucgucga

SEQ ID NO: 3293641 - RNA, 23 nt, Mycobacterium tuberculosis H37Rv
caacgaucugcuggccgaaccgg

SEQ ID NO: 3293642 - RNA, 15 nt, Mycobacterium tuberculosis H37Rv
caacgaugaugauga

SEQ ID NO: 3293643 - RNA, 17 nt, Mycobacterium tuberculosis H37Rv
caacgauugcgaagggc

SEQ ID NO: 3293644 - RNA, 21 nt, Mycobacterium tuberculosis H37Rv
caacgauugcgaagggcaccg

SEQ ID NO: 3293645 - RNA, 19 nt, Mycobacterium tuberculosis H37Rv
caacgcaaucgucgccuuc

SEQ ID NO: 3293646 - RNA, 17 nt, Mycobacterium tuberculosis H37Rv
caacgcauccgacaccc

SEQ ID NO: 3293647 - RNA, 21 nt, Mycobacterium tuberculosis H37Rv
caacgcauuuggugucggcgc

SEQ ID NO: 3293648 - RNA, 18 nt, Mycobacterium tuberculosis H37Rv
caacgccaaaacggucga

SEQ ID NO: 3293649 - RNA, 14 nt, Mycobacterium tuberculosis H37Rv
caacgccaaaaugg

SEQ ID NO: 3293650 - RNA, 14 nt, Mycobacterium tuberculosis H37Rv
caacgccacgccga

SEQ ID NO: 3293651 - RNA, 16 nt, Mycobacterium tuberculosis H37Rv
caacgccagcaccagc

SEQ ID NO: 3293652 - RNA, 21 nt, Mycobacterium tuberculosis H37Rv
caacgccagcaccagcgucgc

SEQ ID NO: 3293653 - RNA, 15 nt, Mycobacterium tuberculosis H37Rv
caacgcccaccacgc

SEQ ID NO: 3293654 - RNA, 15 nt, Mycobacterium tuberculosis H37Rv
caacgcccgcaucgc

SEQ ID NO: 3293655 - RNA, 20 nt, Mycobacterium tuberculosis H37Rv
caacgcccgcaucgccucga

SEQ ID NO: 3293656 - RNA, 13 nt, Mycobacterium tuberculosis H37Rv
caacgccgauggc

SEQ ID NO: 3293657 - RNA, 20 nt, Mycobacterium tuberculosis H37Rv
caacgccgauggcuuggugc

SEQ ID NO: 3293658 - RNA, 23 nt, Mycobacterium tuberculosis H37Rv
caacgccucgauggcgguggcga

SEQ ID NO: 3293659 - RNA, 20 nt, Mycobacterium tuberculosis H37Rv
caacgccucgccauccauga

SEQ ID NO: 3293660 - RNA, 14 nt, Mycobacterium tuberculosis H37Rv
caacgccucugcuc

SEQ ID NO: 3293661 - RNA, 15 nt, Mycobacterium tuberculosis H37Rv
caacgcgacgccgcu

SEQ ID NO: 3293662 - RNA, 21 nt, Mycobacterium tuberculosis H37Rv
caacgcgacgccgcucccgca

SEQ ID NO: 3293663 - RNA, 14 nt, Mycobacterium tuberculosis H37Rv
caacgcgaguccgc

SEQ ID NO: 3293664 - RNA, 18 nt, Mycobacterium tuberculosis H37Rv
caacgcgauaguugccga

SEQ ID NO: 3293665 - RNA, 18 nt, Mycobacterium tuberculosis H37Rv
caacgcgcaaccagccuu

SEQ ID NO: 3293666 - RNA, 15 nt, Mycobacterium tuberculosis H37Rv
caacgcgcaggccga

SEQ ID NO: 3293667 - RNA, 17 nt, Mycobacterium tuberculosis H37Rv
caacgcgcauucgggau

SEQ ID NO: 3293668 - RNA, 11 nt, Mycobacterium tuberculosis H37Rv
caacgcggcga

SEQ ID NO: 3293669 - RNA, 22 nt, Mycobacterium tuberculosis H37Rv
caacgcggggaugucgaccgcg

SEQ ID NO: 3293670 - RNA, 16 nt, Mycobacterium tuberculosis H37Rv
caacgcgggugccggg

SEQ ID NO: 3293671 - RNA, 18 nt, Mycobacterium tuberculosis H37Rv
caacgcgguaaagccccg

SEQ ID NO: 3293672 - RNA, 20 nt, Mycobacterium tuberculosis H37Rv
caacgcggucugcuccaggc

SEQ ID NO: 3293673 - RNA, 19 nt, Mycobacterium tuberculosis H37Rv
caacgcgguggaccgcucg

SEQ ID NO: 3293674 - RNA, 15 nt, Mycobacterium tuberculosis H37Rv
caacgcgucgucggu

SEQ ID NO: 3293675 - RNA, 21 nt, Mycobacterium tuberculosis H37Rv
caacgcguugcacagcagcgg

SEQ ID NO: 3293676 - RNA, 13 nt, Mycobacterium tuberculosis H37Rv
caacgcugcagca

SEQ ID NO: 3293677 - RNA, 17 nt, Mycobacterium tuberculosis H37Rv
caagauccgccacgcuc

SEQ ID NO: 3293678 - RNA, 20 nt, Mycobacterium tuberculosis H37Rv
caagauggcccgucgugacc

SEQ ID NO: 3293679 - RNA, 21 nt, Mycobacterium tuberculosis H37Rv
caagauuaccgaagcccgacu

SEQ ID NO: 3293680 - RNA, 17 nt, Mycobacterium tuberculosis H37Rv
caagcaaccggugcgca

SEQ ID NO: 3293681 - RNA, 12 nt, Mycobacterium tuberculosis H37Rv
caagcacaccgc

SEQ ID NO: 3293682 - RNA, 18 nt, Mycobacterium tuberculosis H37Rv
caagcacaccgccagcgg

SEQ ID NO: 3293683 - RNA, 15 nt, Mycobacterium tuberculosis H37Rv
caagcacagcccggc

SEQ ID NO: 3293684 - RNA, 16 nt, Mycobacterium tuberculosis H37Rv
caagcacagcccggcg

SEQ ID NO: 3293685 - RNA, 21 nt, Mycobacterium tuberculosis H37Rv
caagcacagcccggcgacgac

SEQ ID NO: 3293686 - RNA, 16 nt, Mycobacterium tuberculosis H37Rv
caagcacagcccggcu

SEQ ID NO: 3293687 - RNA, 14 nt, Mycobacterium tuberculosis H37Rv
caagcacgcgacgg

SEQ ID NO: 3293688 - RNA, 19 nt, Mycobacterium tuberculosis H37Rv
caagcagacgcagaaucgc

SEQ ID NO: 3293689 - RNA, 20 nt, Mycobacterium tuberculosis H37Rv
caagcagacgcagaaucgca

SEQ ID NO: 3293690 - RNA, 18 nt, Mycobacterium tuberculosis H37Rv
caagccaaccagcccggc

SEQ ID NO: 3293691 - RNA, 11 nt, Mycobacterium tuberculosis H37Rv
caagccaagcg

SEQ ID NO: 3293692 - RNA, 15 nt, Mycobacterium tuberculosis H37Rv
caagccacgccgguc

SEQ ID NO: 3293693 - RNA, 19 nt, Mycobacterium tuberculosis H37Rv
caagccagcaucggcagca

SEQ ID NO: 3293694 - RNA, 12 nt, Mycobacterium tuberculosis H37Rv
caagcccaaaaa

SEQ ID NO: 3293695 - RNA, 21 nt, Mycobacterium tuberculosis H37Rv
caagcccaaaaagaccgccgc

SEQ ID NO: 3293696 - RNA, 23 nt, Mycobacterium tuberculosis H37Rv
caagcccaaaaagaccgccgcug

SEQ ID NO: 3293697 - RNA, 23 nt, Mycobacterium tuberculosis H37Rv
caagcccgccggacccgccgggu

SEQ ID NO: 3293698 - RNA, 19 nt, Mycobacterium tuberculosis H37Rv
caagcccucgggacggccg

SEQ ID NO: 3293699 - RNA, 21 nt, Mycobacterium tuberculosis H37Rv
caagcccucgggacggccgcc

SEQ ID NO: 3293700 - RNA, 18 nt, Mycobacterium tuberculosis H37Rv
caagcccuuaucuccggc

SEQ ID NO: 3293701 - RNA, 13 nt, Mycobacterium tuberculosis H37Rv
caagccgaccugc

SEQ ID NO: 3293702 - RNA, 16 nt, Mycobacterium tuberculosis H37Rv
caagccgccggcgcca

SEQ ID NO: 3293703 - RNA, 17 nt, Mycobacterium tuberculosis H37Rv
caagccgccggugcgca

SEQ ID NO: 3293704 - RNA, 20 nt, Mycobacterium tuberculosis H37Rv
caagccgcggcuaggccagc

SEQ ID NO: 3293705 - RNA, 13 nt, Mycobacterium tuberculosis H37Rv
caagccggacaga

SEQ ID NO: 3293706 - RNA, 22 nt, Mycobacterium tuberculosis H37Rv
caagccggccacgcauuccagc

SEQ ID NO: 3293707 - RNA, 18 nt, Mycobacterium tuberculosis H37Rv
caagccggcgcccgccgc

SEQ ID NO: 3293708 - RNA, 14 nt, Mycobacterium tuberculosis H37Rv
caagccggggaacu

SEQ ID NO: 3293709 - RNA, 20 nt, Mycobacterium tuberculosis H37Rv
caagccggggaacuuaccga

SEQ ID NO: 3293710 - RNA, 19 nt, Mycobacterium tuberculosis H37Rv
caagccgggugggagcagc

SEQ ID NO: 3293711 - RNA, 20 nt, Mycobacterium tuberculosis H37Rv
caagccgggugggagcagcc

SEQ ID NO: 3293712 - RNA, 14 nt, Mycobacterium tuberculosis H37Rv
caagccguagacca

SEQ ID NO: 3293713 - RNA, 18 nt, Mycobacterium tuberculosis H37Rv
caagccguagaccaggcc

SEQ ID NO: 3293714 - RNA, 19 nt, Mycobacterium tuberculosis H37Rv
caagccguguucgaccgca

SEQ ID NO: 3293715 - RNA, 20 nt, Mycobacterium tuberculosis H37Rv
caagccguguucgaccgcag

SEQ ID NO: 3293716 - RNA, 17 nt, Mycobacterium tuberculosis H37Rv
caagccguucugucccg

SEQ ID NO: 3293717 - RNA, 23 nt, Mycobacterium tuberculosis H37Rv
caagccucgauaggugagcgcgg

SEQ ID NO: 3293718 - RNA, 13 nt, Mycobacterium tuberculosis H37Rv
caagccugcgcug

SEQ ID NO: 3293719 - RNA, 18 nt, Mycobacterium tuberculosis H37Rv
caagcgaagagcgcacug

SEQ ID NO: 3293720 - RNA, 12 nt, Mycobacterium tuberculosis H37Rv
caagcgauccga

SEQ ID NO: 3293721 - RNA, 22 nt, Mycobacterium tuberculosis H37Rv
caagcgauccgagaccgcgugc

SEQ ID NO: 3293722 - RNA, 17 nt, Mycobacterium tuberculosis H37Rv
caagcgcagacacgacc

SEQ ID NO: 3293723 - RNA, 14 nt, Mycobacterium tuberculosis H37Rv
caagcgcagccugg

SEQ ID NO: 3293724 - RNA, 21 nt, Mycobacterium tuberculosis H37Rv
caagcgcaucgcacagcgccg

SEQ ID NO: 3293725 - RNA, 16 nt, Mycobacterium tuberculosis H37Rv
caagcgccgcgcuugc

SEQ ID NO: 3293726 - RNA, 19 nt, Mycobacterium tuberculosis H37Rv
caagcgcgcgaaccccagc

SEQ ID NO: 3293727 - RNA, 13 nt, Mycobacterium tuberculosis H37Rv
caagcggacccga

SEQ ID NO: 3293728 - RNA, 19 nt, Mycobacterium tuberculosis H37Rv
caagcggacccgaccgucg

SEQ ID NO: 3293729 - RNA, 17 nt, Mycobacterium tuberculosis H37Rv
caagcggguuguggcac

SEQ ID NO: 3293730 - RNA, 22 nt, Mycobacterium tuberculosis H37Rv
caagcggguuguggcacccggc

SEQ ID NO: 3293731 - RNA, 17 nt, Mycobacterium tuberculosis H37Rv
caagcuaagcgccugau

SEQ ID NO: 3293732 - RNA, 15 nt, Mycobacterium tuberculosis H37Rv
caagcuaccggcccg

SEQ ID NO: 3293733 - RNA, 14 nt, Mycobacterium tuberculosis H37Rv
caagcucgacaacu

SEQ ID NO: 3293734 - RNA, 22 nt, Mycobacterium tuberculosis H37Rv
caagcucgccggauucgaugac

SEQ ID NO: 3293735 - RNA, 21 nt, Mycobacterium tuberculosis H37Rv
caagcucggccaccagcgccc

SEQ ID NO: 3293736 - RNA, 18 nt, Mycobacterium tuberculosis H37Rv
caagcucggccagcacgc

SEQ ID NO: 3293737 - RNA, 15 nt, Mycobacterium tuberculosis H37Rv
caagcucggcccagc

SEQ ID NO: 3293738 - RNA, 15 nt, Mycobacterium tuberculosis H37Rv
caagcucugcgucgu

SEQ ID NO: 3293739 - RNA, 23 nt, Mycobacterium tuberculosis H37Rv
caagcucuuccauuaggcucucg

SEQ ID NO: 3293740 - RNA, 15 nt, Mycobacterium tuberculosis H37Rv
caagcugaccgccag

SEQ ID NO: 3293741 - RNA, 19 nt, Mycobacterium tuberculosis H37Rv
caagcugccccgccaccuc

SEQ ID NO: 3293742 - RNA, 17 nt, Mycobacterium tuberculosis H37Rv
caagcuggggaacagca

SEQ ID NO: 3293743 - RNA, 16 nt, Mycobacterium tuberculosis H37Rv
caaggaacggcgucgu

SEQ ID NO: 3293744 - RNA, 15 nt, Mycobacterium tuberculosis H37Rv
caaggaccgcucugc

SEQ ID NO: 3293745 - RNA, 13 nt, Mycobacterium tuberculosis H37Rv
caaggacgcaccg

SEQ ID NO: 3293746 - RNA, 17 nt, Mycobacterium tuberculosis H37Rv
caaggacucggacgcgc

SEQ ID NO: 3293747 - RNA, 14 nt, Mycobacterium tuberculosis H37Rv
caaggauggucgcc

SEQ ID NO: 3293748 - RNA, 23 nt, Mycobacterium tuberculosis H37Rv
caaggaugucggggcgaagcuug

SEQ ID NO: 3293749 - RNA, 15 nt, Mycobacterium tuberculosis H37Rv
caaggccgucgaccc

SEQ ID NO: 3293750 - RNA, 21 nt, Mycobacterium tuberculosis H37Rv
caaggccgucgacccagcaug

SEQ ID NO: 3293751 - RNA, 22 nt, Mycobacterium tuberculosis H37Rv
caaggcgauugucggggccgca

SEQ ID NO: 3293752 - RNA, 14 nt, Mycobacterium tuberculosis H37Rv
caaggcggcggcca

SEQ ID NO: 3293753 - RNA, 17 nt, Mycobacterium tuberculosis H37Rv
caaggcggcggccagcc

SEQ ID NO: 3293754 - RNA, 16 nt, Mycobacterium tuberculosis H37Rv
caaggcggucaccacc

SEQ ID NO: 3293755 - RNA, 22 nt, Mycobacterium tuberculosis H37Rv
caaggcucagcagcgccgcgcg

SEQ ID NO: 3293756 - RNA, 17 nt, Mycobacterium tuberculosis H37Rv
caagggauccgaagagc

SEQ ID NO: 3293757 - RNA, 17 nt, Mycobacterium tuberculosis H37Rv
caagggcaaccgccccu

SEQ ID NO: 3293758 - RNA, 17 nt, Mycobacterium tuberculosis H37Rv
caagggcauacagcaug

SEQ ID NO: 3293759 - RNA, 18 nt, Mycobacterium tuberculosis H37Rv
caagggcaucaaccaacu

SEQ ID NO: 3293760 - RNA, 16 nt, Mycobacterium tuberculosis H37Rv
caagggccgacgucgu

SEQ ID NO: 3293761 - RNA, 13 nt, Mycobacterium tuberculosis H37Rv
caaggggcgucgc

SEQ ID NO: 3293762 - RNA, 23 nt, Mycobacterium tuberculosis H37Rv
caagguacuugcgcaaccggugg

SEQ ID NO: 3293763 - RNA, 16 nt, Mycobacterium tuberculosis H37Rv
caagguauccaacgcg

SEQ ID NO: 3293764 - RNA, 16 nt, Mycobacterium tuberculosis H37Rv
caaggucggccaggcu

SEQ ID NO: 3293765 - RNA, 22 nt, Mycobacterium tuberculosis H37Rv
caaggucugccgggcgcgcgua

SEQ ID NO: 3293766 - RNA, 15 nt, Mycobacterium tuberculosis H37Rv
caagguggcaugcga

SEQ ID NO: 3293767 - RNA, 16 nt, Mycobacterium tuberculosis H37Rv
caagguggcaugcgac

SEQ ID NO: 3293768 - RNA, 14 nt, Mycobacterium tuberculosis H37Rv
caagguguccagca

SEQ ID NO: 3293769 - RNA, 18 nt, Mycobacterium tuberculosis H37Rv
caagguguccagcaccug

SEQ ID NO: 3293770 - RNA, 15 nt, Mycobacterium tuberculosis H37Rv
caagguguggugaca

SEQ ID NO: 3293771 - RNA, 15 nt, Mycobacterium tuberculosis H37Rv
caagguguugcggug

SEQ ID NO: 3293772 - RNA, 18 nt, Mycobacterium tuberculosis H37Rv
caaguacgcgucggugac

SEQ ID NO: 3293773 - RNA, 14 nt, Mycobacterium tuberculosis H37Rv
caauggccagcacc

SEQ ID NO: 3293774 - RNA, 17 nt, Mycobacterium tuberculosis H37Rv
caauggccagcaccacg

SEQ ID NO: 3293775 - RNA, 20 nt, Mycobacterium tuberculosis H37Rv
caauggccagcaccacggcc

SEQ ID NO: 3293776 - RNA, 14 nt, Mycobacterium tuberculosis H37Rv
caauggccugcagc

SEQ ID NO: 3293777 - RNA, 17 nt, Mycobacterium tuberculosis H37Rv
caauggccugcagcgcg

SEQ ID NO: 3293778 - RNA, 18 nt, Mycobacterium tuberculosis H37Rv
caauggcggaccgggcca

SEQ ID NO: 3293779 - RNA, 21 nt, Mycobacterium tuberculosis H37Rv
caauucaacacacggcgcguu

SEQ ID NO: 3293780 - RNA, 19 nt, Mycobacterium tuberculosis H37Rv
caauuccacgaucggcuca

SEQ ID NO: 3293781 - RNA, 12 nt, Mycobacterium tuberculosis H37Rv
caauuccagccc

SEQ ID NO: 3293782 - RNA, 18 nt, Mycobacterium tuberculosis H37Rv
caauuccgcuugcucucg

SEQ ID NO: 3293783 - RNA, 17 nt, Mycobacterium tuberculosis H37Rv
caauuccggugaucgcg

SEQ ID NO: 3293784 - RNA, 18 nt, Mycobacterium tuberculosis H37Rv
caauuccguuaggcucca

SEQ ID NO: 3293785 - RNA, 21 nt, Mycobacterium tuberculosis H37Rv
caauucgggauaggacaccgu

SEQ ID NO: 3293786 - RNA, 19 nt, Mycobacterium tuberculosis H37Rv
caauucgggcauggucgcc

SEQ ID NO: 3293787 - RNA, 23 nt, Mycobacterium tuberculosis H37Rv
caauucggugcgcuggcggcgca

SEQ ID NO: 3293788 - RNA, 18 nt, Mycobacterium tuberculosis H37Rv
caauugcucguagcccag

SEQ ID NO: 3293789 - RNA, 13 nt, Mycobacterium tuberculosis H37Rv
caauuggcgucgu

SEQ ID NO: 3293790 - RNA, 13 nt, Mycobacterium tuberculosis H37Rv
caauuucacugcg

SEQ ID NO: 3293791 - RNA, 17 nt, Mycobacterium tuberculosis H37Rv
caauuugccguagaaac

SEQ ID NO: 3293792 - RNA, 17 nt, Mycobacterium tuberculosis H37Rv
cacaaaauacuccgcga

SEQ ID NO: 3293793 - RNA, 18 nt, Mycobacterium tuberculosis H37Rv
cacaaacauacgccaccc

SEQ ID NO: 3293794 - RNA, 13 nt, Mycobacterium tuberculosis H37Rv
cacaaacccagca

SEQ ID NO: 3293795 - RNA, 14 nt, Mycobacterium tuberculosis H37Rv
cacaaacgccgccg

SEQ ID NO: 3293796 - RNA, 12 nt, Mycobacterium tuberculosis H37Rv
cacaacaccggc

SEQ ID NO: 3293797 - RNA, 17 nt, Mycobacterium tuberculosis H37Rv
cacaacagcccguagca

SEQ ID NO: 3293798 - RNA, 14 nt, Mycobacterium tuberculosis H37Rv
cacaaccaacgaca

SEQ ID NO: 3293799 - RNA, 15 nt, Mycobacterium tuberculosis H37Rv
cacaaccgcugcugc

SEQ ID NO: 3293800 - RNA, 16 nt, Mycobacterium tuberculosis H37Rv
cacaaccgcugcugcu

SEQ ID NO: 3293801 - RNA, 18 nt, Mycobacterium tuberculosis H37Rv
cacaaccgugagcaccag

SEQ ID NO: 3293802 - RNA, 17 nt, Mycobacterium tuberculosis H37Rv
cacaacgacgaauaagu

SEQ ID NO: 3293803 - RNA, 20 nt, Mycobacterium tuberculosis H37Rv
cacaacgccucgccauccau

SEQ ID NO: 3293804 - RNA, 13 nt, Mycobacterium tuberculosis H37Rv
cacaacgcgacgc

SEQ ID NO: 3293805 - RNA, 15 nt, Mycobacterium tuberculosis H37Rv
cacaacgcgugacca

SEQ ID NO: 3293806 - RNA, 16 nt, Mycobacterium tuberculosis H37Rv
cacaacggcggcgccg

SEQ ID NO: 3293807 - RNA, 14 nt, Mycobacterium tuberculosis H37Rv
cacaacgucuucac

SEQ ID NO: 3293808 - RNA, 22 nt, Mycobacterium tuberculosis H37Rv
cacaacugauggcgcgcaacga

SEQ ID NO: 3293809 - RNA, 13 nt, Mycobacterium tuberculosis H37Rv
cacaagccgugca

SEQ ID NO: 3293810 - RNA, 23 nt, Mycobacterium tuberculosis H37Rv
cacaagcgauggcaccacuacau

SEQ ID NO: 3293811 - RNA, 20 nt, Mycobacterium tuberculosis H37Rv
cacaagcugacacgacgaac

SEQ ID NO: 3293812 - RNA, 21 nt, Mycobacterium tuberculosis H37Rv
cacaaguagccgacuaucggc

SEQ ID NO: 3293813 - RNA, 17 nt, Mycobacterium tuberculosis H37Rv
cacaauccacgucgcgg

SEQ ID NO: 3293814 - RNA, 23 nt, Mycobacterium tuberculosis H37Rv
cacacaauucgggcgugaguggc

SEQ ID NO: 3293815 - RNA, 23 nt, Mycobacterium tuberculosis H37Rv
cacacagaggucggucagccacc

SEQ ID NO: 3293816 - RNA, 17 nt, Mycobacterium tuberculosis H37Rv
cacacagucacggaccg

SEQ ID NO: 3293817 - RNA, 17 nt, Mycobacterium tuberculosis H37Rv
cacacauagcgauucgc

SEQ ID NO: 3293818 - RNA, 17 nt, Mycobacterium tuberculosis H37Rv
cacaccaaggccgagcg

SEQ ID NO: 3293819 - RNA, 13 nt, Mycobacterium tuberculosis H37Rv
cacaccagcgguc

SEQ ID NO: 3293820 - RNA, 15 nt, Mycobacterium tuberculosis H37Rv
cacaccagcggucgg

SEQ ID NO: 3293821 - RNA, 13 nt, Mycobacterium tuberculosis H37Rv
cacaccaggccga

SEQ ID NO: 3293822 - RNA, 13 nt, Mycobacterium tuberculosis H37Rv
cacacccagaugc

SEQ ID NO: 3293823 - RNA, 14 nt, Mycobacterium tuberculosis H37Rv
cacacccagcgcgc

SEQ ID NO: 3293824 - RNA, 16 nt, Mycobacterium tuberculosis H37Rv
cacaccccaggcaccc

SEQ ID NO: 3293825 - RNA, 18 nt, Mycobacterium tuberculosis H37Rv
cacaccccaggcacccug

SEQ ID NO: 3293826 - RNA, 14 nt, Mycobacterium tuberculosis H37Rv
cacacccccgucug

SEQ ID NO: 3293827 - RNA, 14 nt, Mycobacterium tuberculosis H37Rv
cacacccgcaccgg

SEQ ID NO: 3293828 - RNA, 16 nt, Mycobacterium tuberculosis H37Rv
cacaccgaacagucgc

SEQ ID NO: 3293829 - RNA, 17 nt, Mycobacterium tuberculosis H37Rv
cacaccgagcacgggua

SEQ ID NO: 3293830 - RNA, 14 nt, Mycobacterium tuberculosis H37Rv
cacaccgagcgcaa

SEQ ID NO: 3293831 - RNA, 14 nt, Mycobacterium tuberculosis H37Rv
cacaccgccagcgg

SEQ ID NO: 3293832 - RNA, 21 nt, Mycobacterium tuberculosis H37Rv
cacaccgccagcggcaauggc

SEQ ID NO: 3293833 - RNA, 13 nt, Mycobacterium tuberculosis H37Rv
cacaccgccgcca

SEQ ID NO: 3293834 - RNA, 19 nt, Mycobacterium tuberculosis H37Rv
cacaccggauagguggucu

SEQ ID NO: 3293835 - RNA, 13 nt, Mycobacterium tuberculosis H37Rv
cacaccggcacug

SEQ ID NO: 3293836 - RNA, 19 nt, Mycobacterium tuberculosis H37Rv
cacaccggcacugcccagc

SEQ ID NO: 3293837 - RNA, 14 nt, Mycobacterium tuberculosis H37Rv
cacaccgggcacca

SEQ ID NO: 3293838 - RNA, 23 nt, Mycobacterium tuberculosis H37Rv
cacaccgguggacccggcggugc

SEQ ID NO: 3293839 - RNA, 19 nt, Mycobacterium tuberculosis H37Rv
cacaccgguugacagcucc

SEQ ID NO: 3293840 - RNA, 13 nt, Mycobacterium tuberculosis H37Rv
cacaccguaccga

SEQ ID NO: 3293841 - RNA, 19 nt, Mycobacterium tuberculosis H37Rv
cacaccguccgucggcgcu

SEQ ID NO: 3293842 - RNA, 17 nt, Mycobacterium tuberculosis H37Rv
cacaccgucgcgcucgc

SEQ ID NO: 3293843 - RNA, 20 nt, Mycobacterium tuberculosis H37Rv
cacaccgugaccagccggug

SEQ ID NO: 3293844 - RNA, 16 nt, Mycobacterium tuberculosis H37Rv
cacaccuaccguacgc

SEQ ID NO: 3293845 - RNA, 13 nt, Mycobacterium tuberculosis H37Rv
cacaccuccucga

SEQ ID NO: 3293846 - RNA, 19 nt, Mycobacterium tuberculosis H37Rv
cacaccuuggccgccggcc

SEQ ID NO: 3293847 - RNA, 22 nt, Mycobacterium tuberculosis H37Rv
cacacgaugacguugacgucgg

SEQ ID NO: 3293848 - RNA, 15 nt, Mycobacterium tuberculosis H37Rv
cacacggggccgcca

SEQ ID NO: 3293849 - RNA, 18 nt, Mycobacterium tuberculosis H37Rv
cacacggggccgccagcu

SEQ ID NO: 3293850 - RNA, 16 nt, Mycobacterium tuberculosis H37Rv
cacacggucgucgcga

SEQ ID NO: 3293851 - RNA, 16 nt, Mycobacterium tuberculosis H37Rv
cacacguuggcagccc

SEQ ID NO: 3293852 - RNA, 18 nt, Mycobacterium tuberculosis H37Rv
cacacguuggcagcccuc

SEQ ID NO: 3293853 - RNA, 22 nt, Mycobacterium tuberculosis H37Rv
cacacguuggcagcccucuggu

SEQ ID NO: 3293854 - RNA, 17 nt, Mycobacterium tuberculosis H37Rv
cacacucccgcgcccga

SEQ ID NO: 3293855 - RNA, 15 nt, Mycobacterium tuberculosis H37Rv
cacacuccuagccaa

SEQ ID NO: 3293856 - RNA, 21 nt, Mycobacterium tuberculosis H37Rv
cacacuccuagccaacgagcg

SEQ ID NO: 3293857 - RNA, 19 nt, Mycobacterium tuberculosis H37Rv
cacacugaagaucgcgccc

SEQ ID NO: 3293858 - RNA, 18 nt, Mycobacterium tuberculosis H37Rv
cacacugaccccgccgcc

SEQ ID NO: 3293859 - RNA, 22 nt, Mycobacterium tuberculosis H37Rv
cacacugccggacagccacgca

SEQ ID NO: 3293860 - RNA, 18 nt, Mycobacterium tuberculosis H37Rv
cacacuggccugcucaac

SEQ ID NO: 3293861 - RNA, 18 nt, Mycobacterium tuberculosis H37Rv
cacacuggcuuugacggg

SEQ ID NO: 3293862 - RNA, 20 nt, Mycobacterium tuberculosis H37Rv
cacacuguuacuccgacggc

SEQ ID NO: 3293863 - RNA, 16 nt, Mycobacterium tuberculosis H37Rv
cacacuugcaacucgc

SEQ ID NO: 3293864 - RNA, 16 nt, Mycobacterium tuberculosis H37Rv
cacagaacucaccgac

SEQ ID NO: 3293865 - RNA, 17 nt, Mycobacterium tuberculosis H37Rv
cacagaacucaccgacg

SEQ ID NO: 3293866 - RNA, 22 nt, Mycobacterium tuberculosis H37Rv
cacagaacucaccgacggauga

SEQ ID NO: 3293867 - RNA, 21 nt, Mycobacterium tuberculosis H37Rv
cacagaaucgcacgaaaucag

SEQ ID NO: 3293868 - RNA, 13 nt, Mycobacterium tuberculosis H37Rv
cacagacacggca

SEQ ID NO: 3293869 - RNA, 13 nt, Mycobacterium tuberculosis H37Rv
cacagacagacag

SEQ ID NO: 3293870 - RNA, 24 nt, Mycobacterium tuberculosis H37Rv
caccacauuggcgaucagcagccg

SEQ ID NO: 3293871 - RNA, 14 nt, Mycobacterium tuberculosis H37Rv
caccaccaccgccg

SEQ ID NO: 3293872 - RNA, 13 nt, Mycobacterium tuberculosis H37Rv
caccaccacgccg

SEQ ID NO: 3293873 - RNA, 14 nt, Mycobacterium tuberculosis H37Rv
caccaccacgccga

SEQ ID NO: 3293874 - RNA, 15 nt, Mycobacterium tuberculosis H37Rv
caccaccacgugauc

SEQ ID NO: 3293875 - RNA, 22 nt, Mycobacterium tuberculosis H37Rv
caccaccacugcggccgcgccg

SEQ ID NO: 3293876 - RNA, 12 nt, Mycobacterium tuberculosis H37Rv
caccaccagguc

SEQ ID NO: 3293877 - RNA, 14 nt, Mycobacterium tuberculosis H37Rv
caccacccaggcca

SEQ ID NO: 3293878 - RNA, 13 nt, Mycobacterium tuberculosis H37Rv
caccaccccagcg

SEQ ID NO: 3293879 - RNA, 15 nt, Mycobacterium tuberculosis H37Rv
caccaccccagcggc

SEQ ID NO: 3293880 - RNA, 21 nt, Mycobacterium tuberculosis H37Rv
caccaccccagcggccaccga

SEQ ID NO: 3293881 - RNA, 12 nt, Mycobacterium tuberculosis H37Rv
caccacccgauu

SEQ ID NO: 3293882 - RNA, 17 nt, Mycobacterium tuberculosis H37Rv
caccacccgauuggcca

SEQ ID NO: 3293883 - RNA, 21 nt, Mycobacterium tuberculosis H37Rv
caccacccggcgaacccagcg

SEQ ID NO: 3293884 - RNA, 22 nt, Mycobacterium tuberculosis H37Rv
caccacccgggccucggcgccg

SEQ ID NO: 3293885 - RNA, 14 nt, Mycobacterium tuberculosis H37Rv
caccacccgucggc

SEQ ID NO: 3293886 - RNA, 22 nt, Mycobacterium tuberculosis H37Rv
caccacccgucggcccgcucau

SEQ ID NO: 3293887 - RNA, 21 nt, Mycobacterium tuberculosis H37Rv
caccacccuguuguugccccg

SEQ ID NO: 3293888 - RNA, 14 nt, Mycobacterium tuberculosis H37Rv
caccaccgacagca

SEQ ID NO: 3293889 - RNA, 17 nt, Mycobacterium tuberculosis H37Rv
caccaccgacagcaccc

SEQ ID NO: 3293890 - RNA, 21 nt, Mycobacterium tuberculosis H37Rv
caccaccgacagcacccggcc

SEQ ID NO: 3293891 - RNA, 12 nt, Mycobacterium tuberculosis H37Rv
caccaccgaccu

SEQ ID NO: 3293892 - RNA, 14 nt, Mycobacterium tuberculosis H37Rv
caccaccgaccugg

SEQ ID NO: 3293893 - RNA, 22 nt, Mycobacterium tuberculosis H37Rv
caccaccgaccuggacgcggcc

SEQ ID NO: 3293894 - RNA, 14 nt, Mycobacterium tuberculosis H37Rv
caccaccgcacggg

SEQ ID NO: 3293895 - RNA, 13 nt, Mycobacterium tuberculosis H37Rv
caccaccgccccg

SEQ ID NO: 3293896 - RNA, 15 nt, Mycobacterium tuberculosis H37Rv
caccaccgccgccgg

SEQ ID NO: 3293897 - RNA, 16 nt, Mycobacterium tuberculosis H37Rv
caccaccgccgccggc

SEQ ID NO: 3293898 - RNA, 17 nt, Mycobacterium tuberculosis H37Rv
caccaccgccgccggca

SEQ ID NO: 3293899 - RNA, 12 nt, Mycobacterium tuberculosis H37Rv
caccaccgccgg

SEQ ID NO: 3293900 - RNA, 14 nt, Mycobacterium tuberculosis H37Rv
caccaccgcgaccu

SEQ ID NO: 3293901 - RNA, 14 nt, Mycobacterium tuberculosis H37Rv
caccaccgcucguc

SEQ ID NO: 3293902 - RNA, 14 nt, Mycobacterium tuberculosis H37Rv
caccaccggaacca

SEQ ID NO: 3293903 - RNA, 21 nt, Mycobacterium tuberculosis H37Rv
caccaccggaucgcucccguc

SEQ ID NO: 3293904 - RNA, 18 nt, Mycobacterium tuberculosis H37Rv
caccaccggcaacaucag

SEQ ID NO: 3293905 - RNA, 21 nt, Mycobacterium tuberculosis H37Rv
caccaccggcaacaucagcag

SEQ ID NO: 3293906 - RNA, 14 nt, Mycobacterium tuberculosis H37Rv
caccaccggcaccg

SEQ ID NO: 3293907 - RNA, 11 nt, Mycobacterium tuberculosis H37Rv
caccaccggcc

SEQ ID NO: 3293908 - RNA, 12 nt, Mycobacterium tuberculosis H37Rv
caccaccggccc

SEQ ID NO: 3293909 - RNA, 13 nt, Mycobacterium tuberculosis H37Rv
caccaccggcccc

SEQ ID NO: 3293910 - RNA, 20 nt, Mycobacterium tuberculosis H37Rv
caccaccggccccaccggca

SEQ ID NO: 3293911 - RNA, 14 nt, Mycobacterium tuberculosis H37Rv
caccaccggcgccu

SEQ ID NO: 3293912 - RNA, 21 nt, Mycobacterium tuberculosis H37Rv
caccaccgucgagccggacag

SEQ ID NO: 3293913 - RNA, 14 nt, Mycobacterium tuberculosis H37Rv
caccaccguggcgc

SEQ ID NO: 3293914 - RNA, 17 nt, Mycobacterium tuberculosis H37Rv
caccaccguugccgccg

SEQ ID NO: 3293915 - RNA, 20 nt, Mycobacterium tuberculosis H37Rv
caccaccguugccgccguca

SEQ ID NO: 3293916 - RNA, 19 nt, Mycobacterium tuberculosis H37Rv
caccaccuccccgaucugc

SEQ ID NO: 3293917 - RNA, 18 nt, Mycobacterium tuberculosis H37Rv
caccaccuccgcgucgga

SEQ ID NO: 3293918 - RNA, 14 nt, Mycobacterium tuberculosis H37Rv
caccaccucgacga

SEQ ID NO: 3293919 - RNA, 16 nt, Mycobacterium tuberculosis H37Rv
caccaccuggugcaac

SEQ ID NO: 3293920 - RNA, 21 nt, Mycobacterium tuberculosis H37Rv
caccaccuggugcaaccgugc

SEQ ID NO: 3293921 - RNA, 13 nt, Mycobacterium tuberculosis H37Rv
caccaccuuggau

SEQ ID NO: 3293922 - RNA, 16 nt, Mycobacterium tuberculosis H37Rv
caccacgacgcgaugg

SEQ ID NO: 3293923 - RNA, 22 nt, Mycobacterium tuberculosis H37Rv
caccacgacgcgauggccgcca

SEQ ID NO: 3293924 - RNA, 14 nt, Mycobacterium tuberculosis H37Rv
caccacgaucgcga

SEQ ID NO: 3293925 - RNA, 13 nt, Mycobacterium tuberculosis H37Rv
caccacgauggcg

SEQ ID NO: 3293926 - RNA, 20 nt, Mycobacterium tuberculosis H37Rv
caccacgauggcggccaccg

SEQ ID NO: 3293927 - RNA, 20 nt, Mycobacterium tuberculosis H37Rv
caccacgcaugcgcgcgccg

SEQ ID NO: 3293928 - RNA, 15 nt, Mycobacterium tuberculosis H37Rv
caccacgcccgacga

SEQ ID NO: 3293929 - RNA, 21 nt, Mycobacterium tuberculosis H37Rv
caccacgcgcguuuagucucc

SEQ ID NO: 3293930 - RNA, 21 nt, Mycobacterium tuberculosis H37Rv
caccacgcuggccucgucgcu

SEQ ID NO: 3293931 - RNA, 15 nt, Mycobacterium tuberculosis H37Rv
caccacggaccagcg

SEQ ID NO: 3293932 - RNA, 20 nt, Mycobacterium tuberculosis H37Rv
caccacggaccagcgccgga

SEQ ID NO: 3293933 - RNA, 12 nt, Mycobacterium tuberculosis H37Rv
caccacggccag

SEQ ID NO: 3293934 - RNA, 14 nt, Mycobacterium tuberculosis H37Rv
caccacggccagaa

SEQ ID NO: 3293935 - RNA, 15 nt, Mycobacterium tuberculosis H37Rv
caccacggccagcgg

SEQ ID NO: 3293936 - RNA, 19 nt, Mycobacterium tuberculosis H37Rv
caccacggcgcgcgcgccg

SEQ ID NO: 3293937 - RNA, 19 nt, Mycobacterium tuberculosis H37Rv
caccacggcgcgcucggag

SEQ ID NO: 3293938 - RNA, 14 nt, Mycobacterium tuberculosis H37Rv
caccacggcggcca

SEQ ID NO: 3293939 - RNA, 17 nt, Mycobacterium tuberculosis H37Rv
caccacggcggccaccu

SEQ ID NO: 3293940 - RNA, 20 nt, Mycobacterium tuberculosis H37Rv
caccacggugccgacgauga

SEQ ID NO: 3293941 - RNA, 23 nt, Mycobacterium tuberculosis H37Rv
caccacgguggccgcugccagcc

SEQ ID NO: 3293942 - RNA, 18 nt, Mycobacterium tuberculosis H37Rv
caccacgguuggccacca

SEQ ID NO: 3293943 - RNA, 19 nt, Mycobacterium tuberculosis H37Rv
caccacgguuuuacagcgu

SEQ ID NO: 3293944 - RNA, 14 nt, Mycobacterium tuberculosis H37Rv
caccacgucccgga

SEQ ID NO: 3293945 - RNA, 14 nt, Mycobacterium tuberculosis H37Rv
caccacgucgaccg

SEQ ID NO: 3293946 - RNA, 16 nt, Mycobacterium tuberculosis H37Rv
caccacgucgacgaug

SEQ ID NO: 3293947 - RNA, 16 nt, Mycobacterium tuberculosis H37Rv
caccacgucgucgggg

SEQ ID NO: 3293948 - RNA, 20 nt, Mycobacterium tuberculosis H37Rv
caccacuaggucgccggcca

SEQ ID NO: 3293949 - RNA, 14 nt, Mycobacterium tuberculosis H37Rv
caccacucggucgu

SEQ ID NO: 3293950 - RNA, 18 nt, Mycobacterium tuberculosis H37Rv
caccacugcgcccgccac

SEQ ID NO: 3293951 - RNA, 14 nt, Mycobacterium tuberculosis H37Rv
caccacuucggcgc

SEQ ID NO: 3293952 - RNA, 22 nt, Mycobacterium tuberculosis H37Rv
caccacuucggcgccgcgccgu

SEQ ID NO: 3293953 - RNA, 22 nt, Mycobacterium tuberculosis H37Rv
caccacuuggguggcgccguug

SEQ ID NO: 3293954 - RNA, 12 nt, Mycobacterium tuberculosis H37Rv
caccagaaacac

SEQ ID NO: 3293955 - RNA, 17 nt, Mycobacterium tuberculosis H37Rv
caccagaaacaccgacg

SEQ ID NO: 3293956 - RNA, 20 nt, Mycobacterium tuberculosis H37Rv
caccagaaaugguucgcaca

SEQ ID NO: 3293957 - RNA, 18 nt, Mycobacterium tuberculosis H37Rv
caccagaaccagcgaccu

SEQ ID NO: 3293958 - RNA, 15 nt, Mycobacterium tuberculosis H37Rv
caccagaauccugcu

SEQ ID NO: 3293959 - RNA, 17 nt, Mycobacterium tuberculosis H37Rv
caccagaauccugcuuu

SEQ ID NO: 3293960 - RNA, 15 nt, Mycobacterium tuberculosis H37Rv
caccagacaacgccg

SEQ ID NO: 3293961 - RNA, 18 nt, Mycobacterium tuberculosis H37Rv
caccagacaacgccgucg

SEQ ID NO: 3293962 - RNA, 20 nt, Mycobacterium tuberculosis H37Rv
caccagaucgcacaccaaca

SEQ ID NO: 3293963 - RNA, 18 nt, Mycobacterium tuberculosis H37Rv
caccagaucuucgagcgc

SEQ ID NO: 3293964 - RNA, 16 nt, Mycobacterium tuberculosis H37Rv
caccagauggcucucg

SEQ ID NO: 3293965 - RNA, 21 nt, Mycobacterium tuberculosis H37Rv
caccagcaagugugagcagac

SEQ ID NO: 3293966 - RNA, 22 nt, Mycobacterium tuberculosis H37Rv
caccagcaagugugagcagacc

SEQ ID NO: 3293967 - RNA, 16 nt, Mycobacterium tuberculosis H37Rv
caccauggcgccgcgc

SEQ ID NO: 3293968 - RNA, 17 nt, Mycobacterium tuberculosis H37Rv
caccauggcgccgcgcc

SEQ ID NO: 3293969 - RNA, 19 nt, Mycobacterium tuberculosis H37Rv
caccaugguggugaugcca

SEQ ID NO: 3293970 - RNA, 21 nt, Mycobacterium tuberculosis H37Rv
caccauguacaggcuguccag

SEQ ID NO: 3293971 - RNA, 15 nt, Mycobacterium tuberculosis H37Rv
caccauguauuucuc

SEQ ID NO: 3293972 - RNA, 21 nt, Mycobacterium tuberculosis H37Rv
caccauuggccuaggacaccg

SEQ ID NO: 3293973 - RNA, 21 nt, Mycobacterium tuberculosis H37Rv
cacccaaaccggcccgcagca

SEQ ID NO: 3293974 - RNA, 14 nt, Mycobacterium tuberculosis H37Rv
cacccaacccggcg

SEQ ID NO: 3293975 - RNA, 23 nt, Mycobacterium tuberculosis H37Rv
cacccaacggugggugggcgccg

SEQ ID NO: 3293976 - RNA, 17 nt, Mycobacterium tuberculosis H37Rv
cacccaacuccaucagc

SEQ ID NO: 3293977 - RNA, 17 nt, Mycobacterium tuberculosis H37Rv
cacccaauccggcgcca

SEQ ID NO: 3293978 - RNA, 14 nt, Mycobacterium tuberculosis H37Rv
cacccaaugccacc

SEQ ID NO: 3293979 - RNA, 16 nt, Mycobacterium tuberculosis H37Rv
cacccaaugccaccgc

SEQ ID NO: 3293980 - RNA, 16 nt, Mycobacterium tuberculosis H37Rv
cacccaauggagccgc

SEQ ID NO: 3293981 - RNA, 20 nt, Mycobacterium tuberculosis H37Rv
cacccaauggagccgcgacc

SEQ ID NO: 3293982 - RNA, 23 nt, Mycobacterium tuberculosis H37Rv
cacccaauucacgacgccgagca

SEQ ID NO: 3293983 - RNA, 15 nt, Mycobacterium tuberculosis H37Rv
cacccacacccagcg

SEQ ID NO: 3293984 - RNA, 23 nt, Mycobacterium tuberculosis H37Rv
cacccacaugacgaucgcggcgg

SEQ ID NO: 3293985 - RNA, 12 nt, Mycobacterium tuberculosis H37Rv
cacccaccaaca

SEQ ID NO: 3293986 - RNA, 18 nt, Mycobacterium tuberculosis H37Rv
cacccaccaacacccggg

SEQ ID NO: 3293987 - RNA, 17 nt, Mycobacterium tuberculosis H37Rv
cacccaccacaccaagg

SEQ ID NO: 3293988 - RNA, 14 nt, Mycobacterium tuberculosis H37Rv
cacccaccagugca

SEQ ID NO: 3293989 - RNA, 14 nt, Mycobacterium tuberculosis H37Rv
cacccacccgcacc

SEQ ID NO: 3293990 - RNA, 15 nt, Mycobacterium tuberculosis H37Rv
cacccacccgcggua

SEQ ID NO: 3293991 - RNA, 22 nt, Mycobacterium tuberculosis H37Rv
cacccacccguucggcugcgcu

SEQ ID NO: 3293992 - RNA, 14 nt, Mycobacterium tuberculosis H37Rv
cacccaccggccac

SEQ ID NO: 3293993 - RNA, 15 nt, Mycobacterium tuberculosis H37Rv
cacccaccggccacc

SEQ ID NO: 3293994 - RNA, 16 nt, Mycobacterium tuberculosis H37Rv
cacccaccggccacca

SEQ ID NO: 3293995 - RNA, 13 nt, Mycobacterium tuberculosis H37Rv
cacccacgccgac

SEQ ID NO: 3293996 - RNA, 17 nt, Mycobacterium tuberculosis H37Rv
cacccacgucgagcagg

SEQ ID NO: 3293997 - RNA, 15 nt, Mycobacterium tuberculosis H37Rv
cacccacgugcugcc

SEQ ID NO: 3293998 - RNA, 18 nt, Mycobacterium tuberculosis H37Rv
cacccacuggaccaccgc

SEQ ID NO: 3293999 - RNA, 20 nt, Mycobacterium tuberculosis H37Rv
cacccacuggaccaccgccg

SEQ ID NO: 3294000 - RNA, 21 nt, Mycobacterium tuberculosis H37Rv
cacccacuggaccaccgccga

SEQ ID NO: 3294001 - RNA, 20 nt, Mycobacterium tuberculosis H37Rv
cacccacuuuucgguggcgg

SEQ ID NO: 3294002 - RNA, 15 nt, Mycobacterium tuberculosis H37Rv
cacccagacaccggc

SEQ ID NO: 3294003 - RNA, 18 nt, Mycobacterium tuberculosis H37Rv
cacccagaccgccgaaga

SEQ ID NO: 3294004 - RNA, 18 nt, Mycobacterium tuberculosis H37Rv
cacccagacgauggccag

SEQ ID NO: 3294005 - RNA, 14 nt, Mycobacterium tuberculosis H37Rv
cacccagaugcagc

SEQ ID NO: 3294006 - RNA, 17 nt, Mycobacterium tuberculosis H37Rv
cacccagauugccuggg

SEQ ID NO: 3294007 - RNA, 14 nt, Mycobacterium tuberculosis H37Rv
cacccagcacgcgc

SEQ ID NO: 3294008 - RNA, 13 nt, Mycobacterium tuberculosis H37Rv
cacccagcccagc

SEQ ID NO: 3294009 - RNA, 14 nt, Mycobacterium tuberculosis H37Rv
cacccagccgcagc

SEQ ID NO: 3294010 - RNA, 13 nt, Mycobacterium tuberculosis H37Rv
cacccagcggcgc

SEQ ID NO: 3294011 - RNA, 19 nt, Mycobacterium tuberculosis H37Rv
cacccagcggcgcgggcag

SEQ ID NO: 3294012 - RNA, 22 nt, Mycobacterium tuberculosis H37Rv
cacccagcggcgugacgucguc

SEQ ID NO: 3294013 - RNA, 22 nt, Mycobacterium tuberculosis H37Rv
cacccagcucgcgcacccagcc

SEQ ID NO: 3294014 - RNA, 19 nt, Mycobacterium tuberculosis H37Rv
cacccaggcaucggugagc

SEQ ID NO: 3294015 - RNA, 12 nt, Mycobacterium tuberculosis H37Rv
cacccaggccau

SEQ ID NO: 3294016 - RNA, 12 nt, Mycobacterium tuberculosis H37Rv
cacccaggccga

SEQ ID NO: 3294017 - RNA, 14 nt, Mycobacterium tuberculosis H37Rv
cacccaggugucgc

SEQ ID NO: 3294018 - RNA, 18 nt, Mycobacterium tuberculosis H37Rv
cacccaggugucgcugcu

SEQ ID NO: 3294019 - RNA, 19 nt, Mycobacterium tuberculosis H37Rv
cacccaggugucgcugcug

SEQ ID NO: 3294020 - RNA, 22 nt, Mycobacterium tuberculosis H37Rv
cacccaggugucgcugcugaac

SEQ ID NO: 3294021 - RNA, 16 nt, Mycobacterium tuberculosis H37Rv
cacccagugccacgcc

SEQ ID NO: 3294022 - RNA, 17 nt, Mycobacterium tuberculosis H37Rv
cacccaguuccacccgg

SEQ ID NO: 3294023 - RNA, 15 nt, Mycobacterium tuberculosis H37Rv
cacccaucaacgccg

SEQ ID NO: 3294024 - RNA, 20 nt, Mycobacterium tuberculosis H37Rv
cacccaucaacgccggcgac

SEQ ID NO: 3294025 - RNA, 23 nt, Mycobacterium tuberculosis H37Rv
cacccaucaacgccggcgacggc

SEQ ID NO: 3294026 - RNA, 14 nt, Mycobacterium tuberculosis H37Rv
cacccaucaccgcc

SEQ ID NO: 3294027 - RNA, 18 nt, Mycobacterium tuberculosis H37Rv
cacccaucaccgccagcc

SEQ ID NO: 3294028 - RNA, 15 nt, Mycobacterium tuberculosis H37Rv
cacccaucgaccgcc

SEQ ID NO: 3294029 - RNA, 18 nt, Mycobacterium tuberculosis H37Rv
cacccaucgaccgcccgc

SEQ ID NO: 3294030 - RNA, 20 nt, Mycobacterium tuberculosis H37Rv
cacccaucgaccgcccgcca

SEQ ID NO: 3294031 - RNA, 12 nt, Mycobacterium tuberculosis H37Rv
cacccaucucga

SEQ ID NO: 3294032 - RNA, 13 nt, Mycobacterium tuberculosis H37Rv
cacccaugauccc

SEQ ID NO: 3294033 - RNA, 19 nt, Mycobacterium tuberculosis H37Rv
caccccacagucgugagcc

SEQ ID NO: 3294034 - RNA, 11 nt, Mycobacterium tuberculosis H37Rv
caccccaccac

SEQ ID NO: 3294035 - RNA, 22 nt, Mycobacterium tuberculosis H37Rv
caccccacccagcgacucggcc

SEQ ID NO: 3294036 - RNA, 15 nt, Mycobacterium tuberculosis H37Rv
caccccagcggccac

SEQ ID NO: 3294037 - RNA, 19 nt, Mycobacterium tuberculosis H37Rv
caccccauacucggcggcu

SEQ ID NO: 3294038 - RNA, 19 nt, Mycobacterium tuberculosis H37Rv
caccccaugaccgggaggc

SEQ ID NO: 3294039 - RNA, 18 nt, Mycobacterium tuberculosis H37Rv
caccccauggccaccgaa

SEQ ID NO: 3294040 - RNA, 15 nt, Mycobacterium tuberculosis H37Rv
cacccccaaccgccg

SEQ ID NO: 3294041 - RNA, 16 nt, Mycobacterium tuberculosis H37Rv
cacccccaccgaagcg

SEQ ID NO: 3294042 - RNA, 14 nt, Mycobacterium tuberculosis H37Rv
caccccccagcgcc

SEQ ID NO: 3294043 - RNA, 20 nt, Mycobacterium tuberculosis H37Rv
caccccccagcgccgccgcg

SEQ ID NO: 3294044 - RNA, 13 nt, Mycobacterium tuberculosis H37Rv
caccccccccacc

SEQ ID NO: 3294045 - RNA, 18 nt, Mycobacterium tuberculosis H37Rv
caccccccccacccacca

SEQ ID NO: 3294046 - RNA, 14 nt, Mycobacterium tuberculosis H37Rv
cacccccgauagcg

SEQ ID NO: 3294047 - RNA, 13 nt, Mycobacterium tuberculosis H37Rv
cacccccggccag

SEQ ID NO: 3294048 - RNA, 18 nt, Mycobacterium tuberculosis H37Rv
cacccccggugccggcgg

SEQ ID NO: 3294049 - RNA, 17 nt, Mycobacterium tuberculosis H37Rv
cacccccgucgccaccg

SEQ ID NO: 3294050 - RNA, 14 nt, Mycobacterium tuberculosis H37Rv
cacccccugcaccg

SEQ ID NO: 3294051 - RNA, 15 nt, Mycobacterium tuberculosis H37Rv
caccccgacaccacg

SEQ ID NO: 3294052 - RNA, 17 nt, Mycobacterium tuberculosis H37Rv
caccccgaccaccagag

SEQ ID NO: 3294053 - RNA, 15 nt, Mycobacterium tuberculosis H37Rv
caccccgacguucgu

SEQ ID NO: 3294054 - RNA, 13 nt, Mycobacterium tuberculosis H37Rv
caccccgagcggc

SEQ ID NO: 3294055 - RNA, 16 nt, Mycobacterium tuberculosis H37Rv
caccccgagcucacca

SEQ ID NO: 3294056 - RNA, 14 nt, Mycobacterium tuberculosis H37Rv
caccccgccaugcg

SEQ ID NO: 3294057 - RNA, 18 nt, Mycobacterium tuberculosis H37Rv
caccccgccaugcggcgc

SEQ ID NO: 3294058 - RNA, 15 nt, Mycobacterium tuberculosis H37Rv
caccccgccgaucac

SEQ ID NO: 3294059 - RNA, 21 nt, Mycobacterium tuberculosis H37Rv
caccccgcgaaccucacagcu

SEQ ID NO: 3294060 - RNA, 13 nt, Mycobacterium tuberculosis H37Rv
caccccggcggcc

SEQ ID NO: 3294061 - RNA, 14 nt, Mycobacterium tuberculosis H37Rv
caccccggguacgc

SEQ ID NO: 3294062 - RNA, 17 nt, Mycobacterium tuberculosis H37Rv
caccccggugcccgcgg

SEQ ID NO: 3294063 - RNA, 22 nt, Mycobacterium tuberculosis H37Rv
caccccguucgaggucggcgau

SEQ ID NO: 3294064 - RNA, 14 nt, Mycobacterium tuberculosis H37Rv
caccgacaccgugu

SEQ ID NO: 3294065 - RNA, 16 nt, Mycobacterium tuberculosis H37Rv
caccgacagcacccgg

SEQ ID NO: 3294066 - RNA, 15 nt, Mycobacterium tuberculosis H37Rv
caccgacaugacgcg

SEQ ID NO: 3294067 - RNA, 17 nt, Mycobacterium tuberculosis H37Rv
caccgacauuggugugg

SEQ ID NO: 3294068 - RNA, 14 nt, Mycobacterium tuberculosis H37Rv
caccgaccagggcc

SEQ ID NO: 3294069 - RNA, 23 nt, Mycobacterium tuberculosis H37Rv
caccgaccccggaacgaccccac

SEQ ID NO: 3294070 - RNA, 22 nt, Mycobacterium tuberculosis H37Rv
caccgacccgcugccacccauc

SEQ ID NO: 3294071 - RNA, 15 nt, Mycobacterium tuberculosis H37Rv
caccgaccgcgggcu

SEQ ID NO: 3294072 - RNA, 16 nt, Mycobacterium tuberculosis H37Rv
caccgaccuaccgucg

SEQ ID NO: 3294073 - RNA, 21 nt, Mycobacterium tuberculosis H37Rv
caccgaccuaccgucgaccac

SEQ ID NO: 3294074 - RNA, 14 nt, Mycobacterium tuberculosis H37Rv
caccgacgacacca

SEQ ID NO: 3294075 - RNA, 20 nt, Mycobacterium tuberculosis H37Rv
caccgacgacaccagagcga

SEQ ID NO: 3294076 - RNA, 18 nt, Mycobacterium tuberculosis H37Rv
caccgacgacgcgcgcga

SEQ ID NO: 3294077 - RNA, 16 nt, Mycobacterium tuberculosis H37Rv
caccgacgaugccgcg

SEQ ID NO: 3294078 - RNA, 13 nt, Mycobacterium tuberculosis H37Rv
caccgacgccgau

SEQ ID NO: 3294079 - RNA, 14 nt, Mycobacterium tuberculosis H37Rv
caccgacgccgcca

SEQ ID NO: 3294080 - RNA, 20 nt, Mycobacterium tuberculosis H37Rv
caccgacgcgaacgcggcca

SEQ ID NO: 3294081 - RNA, 14 nt, Mycobacterium tuberculosis H37Rv
caccgacgcgucgg

SEQ ID NO: 3294082 - RNA, 15 nt, Mycobacterium tuberculosis H37Rv
caccgacgcugacca

SEQ ID NO: 3294083 - RNA, 16 nt, Mycobacterium tuberculosis H37Rv
caccgacgcugaccaa

SEQ ID NO: 3294084 - RNA, 19 nt, Mycobacterium tuberculosis H37Rv
caccgacggaaugucagcc

SEQ ID NO: 3294085 - RNA, 21 nt, Mycobacterium tuberculosis H37Rv
caccgacggaaugucagccgg

SEQ ID NO: 3294086 - RNA, 12 nt, Mycobacterium tuberculosis H37Rv
caccgacgucgc

SEQ ID NO: 3294087 - RNA, 15 nt, Mycobacterium tuberculosis H37Rv
caccgacugcuguca

SEQ ID NO: 3294088 - RNA, 19 nt, Mycobacterium tuberculosis H37Rv
caccgacugcugucaccgc

SEQ ID NO: 3294089 - RNA, 19 nt, Mycobacterium tuberculosis H37Rv
caccgagaagcugugccuu

SEQ ID NO: 3294090 - RNA, 23 nt, Mycobacterium tuberculosis H37Rv
caccgagaucggacagguaacgc

SEQ ID NO: 3294091 - RNA, 21 nt, Mycobacterium tuberculosis H37Rv
caccgagcaaacacgccucgc

SEQ ID NO: 3294092 - RNA, 13 nt, Mycobacterium tuberculosis H37Rv
caccgagcaucuc

SEQ ID NO: 3294093 - RNA, 20 nt, Mycobacterium tuberculosis H37Rv
caccgagccacgacccagca

SEQ ID NO: 3294094 - RNA, 22 nt, Mycobacterium tuberculosis H37Rv
caccgagcccuccagggcccug

SEQ ID NO: 3294095 - RNA, 12 nt, Mycobacterium tuberculosis H37Rv
caccgagccgau

SEQ ID NO: 3294096 - RNA, 13 nt, Mycobacterium tuberculosis H37Rv
caccgagccgucg

SEQ ID NO: 3294097 - RNA, 15 nt, Mycobacterium tuberculosis H37Rv
caccgagccgucguc

SEQ ID NO: 3294098 - RNA, 17 nt, Mycobacterium tuberculosis H37Rv
caccgagccgucgucga

SEQ ID NO: 3294099 - RNA, 16 nt, Mycobacterium tuberculosis H37Rv
caccgagcgcaaucga

SEQ ID NO: 3294100 - RNA, 22 nt, Mycobacterium tuberculosis H37Rv
caccgagcggugaauucggcga

SEQ ID NO: 3294101 - RNA, 21 nt, Mycobacterium tuberculosis H37Rv
caccgagcugagcggccagca

SEQ ID NO: 3294102 - RNA, 17 nt, Mycobacterium tuberculosis H37Rv
caccgaggaccucguca

SEQ ID NO: 3294103 - RNA, 19 nt, Mycobacterium tuberculosis H37Rv
caccgaggaccucgucacc

SEQ ID NO: 3294104 - RNA, 14 nt, Mycobacterium tuberculosis H37Rv
caccgaggccgccg

SEQ ID NO: 3294105 - RNA, 20 nt, Mycobacterium tuberculosis H37Rv
caccgaggccgccgagauga

SEQ ID NO: 3294106 - RNA, 21 nt, Mycobacterium tuberculosis H37Rv
caccgaggccgccgagaugau

SEQ ID NO: 3294107 - RNA, 20 nt, Mycobacterium tuberculosis H37Rv
caccgaggugccgcgcagcu

SEQ ID NO: 3294108 - RNA, 17 nt, Mycobacterium tuberculosis H37Rv
caccgagucgacggcca

SEQ ID NO: 3294109 - RNA, 13 nt, Mycobacterium tuberculosis H37Rv
caccgaguuccuc

SEQ ID NO: 3294110 - RNA, 14 nt, Mycobacterium tuberculosis H37Rv
caccgaguuccucu

SEQ ID NO: 3294111 - RNA, 19 nt, Mycobacterium tuberculosis H37Rv
caccgaucgacugcagccc

SEQ ID NO: 3294112 - RNA, 15 nt, Mycobacterium tuberculosis H37Rv
caccgaugcacucca

SEQ ID NO: 3294113 - RNA, 17 nt, Mycobacterium tuberculosis H37Rv
caccgauggcgcgcuca

SEQ ID NO: 3294114 - RNA, 21 nt, Mycobacterium tuberculosis H37Rv
caccgauggcgguggugccgc

SEQ ID NO: 3294115 - RNA, 17 nt, Mycobacterium tuberculosis H37Rv
caccgaugugaccgaac

SEQ ID NO: 3294116 - RNA, 23 nt, Mycobacterium tuberculosis H37Rv
caccgaugugaccgaacaacagc

SEQ ID NO: 3294117 - RNA, 13 nt, Mycobacterium tuberculosis H37Rv
caccgauuccagc

SEQ ID NO: 3294118 - RNA, 15 nt, Mycobacterium tuberculosis H37Rv
caccgauucggcgac

SEQ ID NO: 3294119 - RNA, 18 nt, Mycobacterium tuberculosis H37Rv
caccgauucggcgacgaa

SEQ ID NO: 3294120 - RNA, 15 nt, Mycobacterium tuberculosis H37Rv
caccgcaaccaaagc

SEQ ID NO: 3294121 - RNA, 15 nt, Mycobacterium tuberculosis H37Rv
caccgcaacgcgugc

SEQ ID NO: 3294122 - RNA, 18 nt, Mycobacterium tuberculosis H37Rv
caccgcaacucgccgaaa

SEQ ID NO: 3294123 - RNA, 14 nt, Mycobacterium tuberculosis H37Rv
caccgcacgcuggc

SEQ ID NO: 3294124 - RNA, 22 nt, Mycobacterium tuberculosis H37Rv
caccgcacggaugucgcccaac

SEQ ID NO: 3294125 - RNA, 17 nt, Mycobacterium tuberculosis H37Rv
caccgcacguucggcgu

SEQ ID NO: 3294126 - RNA, 18 nt, Mycobacterium tuberculosis H37Rv
caccgcagacgccgucug

SEQ ID NO: 3294127 - RNA, 21 nt, Mycobacterium tuberculosis H37Rv
caccgcagauccccgccaccg

SEQ ID NO: 3294128 - RNA, 19 nt, Mycobacterium tuberculosis H37Rv
caccgcauaacgccagucc

SEQ ID NO: 3294129 - RNA, 22 nt, Mycobacterium tuberculosis H37Rv
caccgcauaacgcgaacccgcg

SEQ ID NO: 3294130 - RNA, 23 nt, Mycobacterium tuberculosis H37Rv
caccgcaucgggcuugcgcagca

SEQ ID NO: 3294131 - RNA, 22 nt, Mycobacterium tuberculosis H37Rv
caccgcauucguggagccggcc

SEQ ID NO: 3294132 - RNA, 13 nt, Mycobacterium tuberculosis H37Rv
caccgccaccacc

SEQ ID NO: 3294133 - RNA, 22 nt, Mycobacterium tuberculosis H37Rv
caccgccagcaugacaccggcc

SEQ ID NO: 3294134 - RNA, 14 nt, Mycobacterium tuberculosis H37Rv
caccgccagccacc

SEQ ID NO: 3294135 - RNA, 13 nt, Mycobacterium tuberculosis H37Rv
caccgccagcggc

SEQ ID NO: 3294136 - RNA, 21 nt, Mycobacterium tuberculosis H37Rv
caccgccagcgucgacacacc

SEQ ID NO: 3294137 - RNA, 19 nt, Mycobacterium tuberculosis H37Rv
caccgccagcugggcagcc

SEQ ID NO: 3294138 - RNA, 12 nt, Mycobacterium tuberculosis H37Rv
caccgccccgcc

SEQ ID NO: 3294139 - RNA, 20 nt, Mycobacterium tuberculosis H37Rv
caccgcccuugccgccguug

SEQ ID NO: 3294140 - RNA, 16 nt, Mycobacterium tuberculosis H37Rv
caccgccgaacagugu

SEQ ID NO: 3294141 - RNA, 16 nt, Mycobacterium tuberculosis H37Rv
caccgccgacaccccc

SEQ ID NO: 3294142 - RNA, 14 nt, Mycobacterium tuberculosis H37Rv
caccgccgacgccc

SEQ ID NO: 3294143 - RNA, 20 nt, Mycobacterium tuberculosis H37Rv
caccgccgagcagacgcgga

SEQ ID NO: 3294144 - RNA, 20 nt, Mycobacterium tuberculosis H37Rv
caccgccgauacaacgcggc

SEQ ID NO: 3294145 - RNA, 20 nt, Mycobacterium tuberculosis H37Rv
caccgccgccaccaccgcug

SEQ ID NO: 3294146 - RNA, 22 nt, Mycobacterium tuberculosis H37Rv
caccgccgcccaaaacgucacc

SEQ ID NO: 3294147 - RNA, 17 nt, Mycobacterium tuberculosis H37Rv
caccgccgcccccgccg

SEQ ID NO: 3294148 - RNA, 19 nt, Mycobacterium tuberculosis H37Rv
caccgccgcccccgccggc

SEQ ID NO: 3294149 - RNA, 13 nt, Mycobacterium tuberculosis H37Rv
caccgccgccgaa

SEQ ID NO: 3294150 - RNA, 14 nt, Mycobacterium tuberculosis H37Rv
caccgccgccgaag

SEQ ID NO: 3294151 - RNA, 14 nt, Mycobacterium tuberculosis H37Rv
caccgccgccgcca

SEQ ID NO: 3294152 - RNA, 15 nt, Mycobacterium tuberculosis H37Rv
caccgccgccgccac

SEQ ID NO: 3294153 - RNA, 19 nt, Mycobacterium tuberculosis H37Rv
caccgccgccgccaccggc

SEQ ID NO: 3294154 - RNA, 22 nt, Mycobacterium tuberculosis H37Rv
caccgccgccgccaccggcgcc

SEQ ID NO: 3294155 - RNA, 14 nt, Mycobacterium tuberculosis H37Rv
caccgccgccgccc

SEQ ID NO: 3294156 - RNA, 22 nt, Mycobacterium tuberculosis H37Rv
caccgccgccgccgacgccgcc

SEQ ID NO: 3294157 - RNA, 18 nt, Mycobacterium tuberculosis H37Rv
caccgccgccggcaccgc

SEQ ID NO: 3294158 - RNA, 19 nt, Mycobacterium tuberculosis H37Rv
caccgccgccugcccggcc

SEQ ID NO: 3294159 - RNA, 21 nt, Mycobacterium tuberculosis H37Rv
caccgccgccugcccggcccg

SEQ ID NO: 3294160 - RNA, 14 nt, Mycobacterium tuberculosis H37Rv
caccggagccgaac

SEQ ID NO: 3294161 - RNA, 14 nt, Mycobacterium tuberculosis H37Rv
caccggagcgccga

SEQ ID NO: 3294162 - RNA, 22 nt, Mycobacterium tuberculosis H37Rv
caccggaggccgccgcgccggu

SEQ ID NO: 3294163 - RNA, 18 nt, Mycobacterium tuberculosis H37Rv
caccggagucggcgucga

SEQ ID NO: 3294164 - RNA, 17 nt, Mycobacterium tuberculosis H37Rv
caccggauacagccacg

SEQ ID NO: 3294165 - RNA, 19 nt, Mycobacterium tuberculosis H37Rv
caccggauacagccacgca

SEQ ID NO: 3294166 - RNA, 14 nt, Mycobacterium tuberculosis H37Rv
caccggauccacgg

SEQ ID NO: 3294167 - RNA, 15 nt, Mycobacterium tuberculosis H37Rv
caccggauccacgga

SEQ ID NO: 3294168 - RNA, 13 nt, Mycobacterium tuberculosis H37Rv
caccggaucgacc

SEQ ID NO: 3294169 - RNA, 17 nt, Mycobacterium tuberculosis H37Rv
caccggaucgcucccgu

SEQ ID NO: 3294170 - RNA, 20 nt, Mycobacterium tuberculosis H37Rv
caccggaucgucgaacagca

SEQ ID NO: 3294171 - RNA, 23 nt, Mycobacterium tuberculosis H37Rv
caccggaucgucgaacagcaccg

SEQ ID NO: 3294172 - RNA, 19 nt, Mycobacterium tuberculosis H37Rv
caccggcaacaucagcagg

SEQ ID NO: 3294173 - RNA, 18 nt, Mycobacterium tuberculosis H37Rv
caccggcaaucggcggca

SEQ ID NO: 3294174 - RNA, 13 nt, Mycobacterium tuberculosis H37Rv
caccggcaccacg

SEQ ID NO: 3294175 - RNA, 18 nt, Mycobacterium tuberculosis H37Rv
caccggcaccacgaucaa

SEQ ID NO: 3294176 - RNA, 16 nt, Mycobacterium tuberculosis H37Rv
caccggcacccccguc

SEQ ID NO: 3294177 - RNA, 13 nt, Mycobacterium tuberculosis H37Rv
caccggcacccgc

SEQ ID NO: 3294178 - RNA, 15 nt, Mycobacterium tuberculosis H37Rv
caccggcacccgcac

SEQ ID NO: 3294179 - RNA, 13 nt, Mycobacterium tuberculosis H37Rv
caccggcaccgcu

SEQ ID NO: 3294180 - RNA, 14 nt, Mycobacterium tuberculosis H37Rv
caccggcaccgcug

SEQ ID NO: 3294181 - RNA, 14 nt, Mycobacterium tuberculosis H37Rv
caccggcaccggcc

SEQ ID NO: 3294182 - RNA, 14 nt, Mycobacterium tuberculosis H37Rv
caccggcacugccc

SEQ ID NO: 3294183 - RNA, 18 nt, Mycobacterium tuberculosis H37Rv
caccggcagcgcgaucga

SEQ ID NO: 3294184 - RNA, 14 nt, Mycobacterium tuberculosis H37Rv
caccggcaggcggg

SEQ ID NO: 3294185 - RNA, 16 nt, Mycobacterium tuberculosis H37Rv
caccggccaccagccc

SEQ ID NO: 3294186 - RNA, 16 nt, Mycobacterium tuberculosis H37Rv
caccggccaccagggc

SEQ ID NO: 3294187 - RNA, 21 nt, Mycobacterium tuberculosis H37Rv
caccggccaccagggccaccg

SEQ ID NO: 3294188 - RNA, 17 nt, Mycobacterium tuberculosis H37Rv
caccggccacucgggac

SEQ ID NO: 3294189 - RNA, 15 nt, Mycobacterium tuberculosis H37Rv
caccggccaggccgg

SEQ ID NO: 3294190 - RNA, 14 nt, Mycobacterium tuberculosis H37Rv
caccggccccaccg

SEQ ID NO: 3294191 - RNA, 18 nt, Mycobacterium tuberculosis H37Rv
caccggccccaccggcac

SEQ ID NO: 3294192 - RNA, 16 nt, Mycobacterium tuberculosis H37Rv
caccggcccucgccag

SEQ ID NO: 3294193 - RNA, 18 nt, Mycobacterium tuberculosis H37Rv
caccggcccucgccagag

SEQ ID NO: 3294194 - RNA, 12 nt, Mycobacterium tuberculosis H37Rv
caccggccgccg

SEQ ID NO: 3294195 - RNA, 14 nt, Mycobacterium tuberculosis H37Rv
caccggccgcgcag

SEQ ID NO: 3294196 - RNA, 22 nt, Mycobacterium tuberculosis H37Rv
caccggccgugccgccgacacc

SEQ ID NO: 3294197 - RNA, 22 nt, Mycobacterium tuberculosis H37Rv
caccggccugcgcgaccgacca

SEQ ID NO: 3294198 - RNA, 14 nt, Mycobacterium tuberculosis H37Rv
caccggcgaucacc

SEQ ID NO: 3294199 - RNA, 14 nt, Mycobacterium tuberculosis H37Rv
caccggcgauccgg

SEQ ID NO: 3294200 - RNA, 19 nt, Mycobacterium tuberculosis H37Rv
caccggcgcaccgucgcgg

SEQ ID NO: 3294201 - RNA, 13 nt, Mycobacterium tuberculosis H37Rv
caccggcgccacc

SEQ ID NO: 3294202 - RNA, 21 nt, Mycobacterium tuberculosis H37Rv
caccggcgcccagcgccucga

SEQ ID NO: 3294203 - RNA, 13 nt, Mycobacterium tuberculosis H37Rv
caccggcgccccu

SEQ ID NO: 3294204 - RNA, 11 nt, Mycobacterium tuberculosis H37Rv
caccggcgccg

SEQ ID NO: 3294205 - RNA, 20 nt, Mycobacterium tuberculosis H37Rv
caccggcgccgcccgcgcca

SEQ ID NO: 3294206 - RNA, 15 nt, Mycobacterium tuberculosis H37Rv
caccggcgccgccgg

SEQ ID NO: 3294207 - RNA, 16 nt, Mycobacterium tuberculosis H37Rv
caccggcgccgccguc

SEQ ID NO: 3294208 - RNA, 20 nt, Mycobacterium tuberculosis H37Rv
caccggcgccgugucaccgg

SEQ ID NO: 3294209 - RNA, 17 nt, Mycobacterium tuberculosis H37Rv
caccggcgcgaccgcgg

SEQ ID NO: 3294210 - RNA, 17 nt, Mycobacterium tuberculosis H37Rv
caccggcggcgccgaaa

SEQ ID NO: 3294211 - RNA, 12 nt, Mycobacterium tuberculosis H37Rv
caccggcgucgc

SEQ ID NO: 3294212 - RNA, 18 nt, Mycobacterium tuberculosis H37Rv
caccggcgucgcugccuu

SEQ ID NO: 3294213 - RNA, 14 nt, Mycobacterium tuberculosis H37Rv
caccggcgucugcc

SEQ ID NO: 3294214 - RNA, 14 nt, Mycobacterium tuberculosis H37Rv
caccggcgugcugu

SEQ ID NO: 3294215 - RNA, 13 nt, Mycobacterium tuberculosis H37Rv
caccggcucgacu

SEQ ID NO: 3294216 - RNA, 15 nt, Mycobacterium tuberculosis H37Rv
caccggcucgacugc

SEQ ID NO: 3294217 - RNA, 14 nt, Mycobacterium tuberculosis H37Rv
caccggcucgucga

SEQ ID NO: 3294218 - RNA, 18 nt, Mycobacterium tuberculosis H37Rv
caccggcugaccgacccg

SEQ ID NO: 3294219 - RNA, 21 nt, Mycobacterium tuberculosis H37Rv
caccggcugaccgacccggac

SEQ ID NO: 3294220 - RNA, 21 nt, Mycobacterium tuberculosis H37Rv
caccggcugauucgagccaca

SEQ ID NO: 3294221 - RNA, 14 nt, Mycobacterium tuberculosis H37Rv
caccggcugcaacc

SEQ ID NO: 3294222 - RNA, 16 nt, Mycobacterium tuberculosis H37Rv
caccggcugcugagga

SEQ ID NO: 3294223 - RNA, 18 nt, Mycobacterium tuberculosis H37Rv
caccggcugcugaggaga

SEQ ID NO: 3294224 - RNA, 17 nt, Mycobacterium tuberculosis H37Rv
caccggcuggugccaac

SEQ ID NO: 3294225 - RNA, 20 nt, Mycobacterium tuberculosis H37Rv
caccggcuggugccaacugc

SEQ ID NO: 3294226 - RNA, 17 nt, Mycobacterium tuberculosis H37Rv
caccggcuucuccucca

SEQ ID NO: 3294227 - RNA, 19 nt, Mycobacterium tuberculosis H37Rv
caccggcuucuccuccaga

SEQ ID NO: 3294228 - RNA, 21 nt, Mycobacterium tuberculosis H37Rv
caccggcuuggugaaccgcgc

SEQ ID NO: 3294229 - RNA, 15 nt, Mycobacterium tuberculosis H37Rv
caccgggcaccaguc

SEQ ID NO: 3294230 - RNA, 15 nt, Mycobacterium tuberculosis H37Rv
caccgggcccgacgc

SEQ ID NO: 3294231 - RNA, 21 nt, Mycobacterium tuberculosis H37Rv
caccgggccgacagcacgcca

SEQ ID NO: 3294232 - RNA, 14 nt, Mycobacterium tuberculosis H37Rv
caccgggcgcugcu

SEQ ID NO: 3294233 - RNA, 17 nt, Mycobacterium tuberculosis H37Rv
caccgggcggcggcgac

SEQ ID NO: 3294234 - RNA, 21 nt, Mycobacterium tuberculosis H37Rv
caccgggcgucgucggugauc

SEQ ID NO: 3294235 - RNA, 17 nt, Mycobacterium tuberculosis H37Rv
caccggggccgucggca

SEQ ID NO: 3294236 - RNA, 14 nt, Mycobacterium tuberculosis H37Rv
caccggggucaccu

SEQ ID NO: 3294237 - RNA, 15 nt, Mycobacterium tuberculosis H37Rv
caccgggguugcccg

SEQ ID NO: 3294238 - RNA, 14 nt, Mycobacterium tuberculosis H37Rv
caccggguucaccg

SEQ ID NO: 3294239 - RNA, 19 nt, Mycobacterium tuberculosis H37Rv
caccggguugagccgccgc

SEQ ID NO: 3294240 - RNA, 19 nt, Mycobacterium tuberculosis H37Rv
caccggguuggaagccgca

SEQ ID NO: 3294241 - RNA, 12 nt, Mycobacterium tuberculosis H37Rv
caccgguaccga

SEQ ID NO: 3294242 - RNA, 15 nt, Mycobacterium tuberculosis H37Rv
caccgguaccgauca

SEQ ID NO: 3294243 - RNA, 16 nt, Mycobacterium tuberculosis H37Rv
caccgguaccgccacu

SEQ ID NO: 3294244 - RNA, 21 nt, Mycobacterium tuberculosis H37Rv
caccgguacgcaaccaaccgu

SEQ ID NO: 3294245 - RNA, 20 nt, Mycobacterium tuberculosis H37Rv
caccggucagcgacgcacgc

SEQ ID NO: 3294246 - RNA, 16 nt, Mycobacterium tuberculosis H37Rv
caccggucgccgcgaa

SEQ ID NO: 3294247 - RNA, 17 nt, Mycobacterium tuberculosis H37Rv
caccggucggcagcuuc

SEQ ID NO: 3294248 - RNA, 21 nt, Mycobacterium tuberculosis H37Rv
caccggugauggugaccagca

SEQ ID NO: 3294249 - RNA, 14 nt, Mycobacterium tuberculosis H37Rv
caccggugcccacc

SEQ ID NO: 3294250 - RNA, 22 nt, Mycobacterium tuberculosis H37Rv
caccggugccgcccgcgccgcc

SEQ ID NO: 3294251 - RNA, 14 nt, Mycobacterium tuberculosis H37Rv
caccggugccgccg

SEQ ID NO: 3294252 - RNA, 23 nt, Mycobacterium tuberculosis H37Rv
caccgguucggugagcgggagga

SEQ ID NO: 3294253 - RNA, 21 nt, Mycobacterium tuberculosis H37Rv
caccgguuuggagcucaucga

SEQ ID NO: 3294254 - RNA, 17 nt, Mycobacterium tuberculosis H37Rv
caccguacgacagucgc

SEQ ID NO: 3294255 - RNA, 14 nt, Mycobacterium tuberculosis H37Rv
caccguacgggacg

SEQ ID NO: 3294256 - RNA, 17 nt, Mycobacterium tuberculosis H37Rv
caccguaggcgaucuca

SEQ ID NO: 3294257 - RNA, 18 nt, Mycobacterium tuberculosis H37Rv
caccucgaugccgccccg

SEQ ID NO: 3294258 - RNA, 19 nt, Mycobacterium tuberculosis H37Rv
caccucgaugccgccccgc

SEQ ID NO: 3294259 - RNA, 23 nt, Mycobacterium tuberculosis H37Rv
caccucgaugccgccccgcagcu

SEQ ID NO: 3294260 - RNA, 20 nt, Mycobacterium tuberculosis H37Rv
caccucgccaacaucccaac

SEQ ID NO: 3294261 - RNA, 22 nt, Mycobacterium tuberculosis H37Rv
caccucgccaacaucccaacac

SEQ ID NO: 3294262 - RNA, 16 nt, Mycobacterium tuberculosis H37Rv
caccucgcccucccgg

SEQ ID NO: 3294263 - RNA, 11 nt, Mycobacterium tuberculosis H37Rv
caccucggcga

SEQ ID NO: 3294264 - RNA, 14 nt, Mycobacterium tuberculosis H37Rv
caccucgggcgccc

SEQ ID NO: 3294265 - RNA, 19 nt, Mycobacterium tuberculosis H37Rv
caccucgguacuugccacg

SEQ ID NO: 3294266 - RNA, 22 nt, Mycobacterium tuberculosis H37Rv
caccucggugaccaggccggcc

SEQ ID NO: 3294267 - RNA, 18 nt, Mycobacterium tuberculosis H37Rv
caccucggugccggccgc

SEQ ID NO: 3294268 - RNA, 21 nt, Mycobacterium tuberculosis H37Rv
caccucgucacaguucugccu

SEQ ID NO: 3294269 - RNA, 23 nt, Mycobacterium tuberculosis H37Rv
caccucgucgacaaaccacagac

SEQ ID NO: 3294270 - RNA, 24 nt, Mycobacterium tuberculosis H37Rv
caccucgucgacaaaccacagacu

SEQ ID NO: 3294271 - RNA, 21 nt, Mycobacterium tuberculosis H37Rv
caccucgucgaucgccgcgcc

SEQ ID NO: 3294272 - RNA, 23 nt, Mycobacterium tuberculosis H37Rv
caccucguguccggggaccucgg

SEQ ID NO: 3294273 - RNA, 23 nt, Mycobacterium tuberculosis H37Rv
caccucuucgaucuguuccugca

SEQ ID NO: 3294274 - RNA, 17 nt, Mycobacterium tuberculosis H37Rv
caccugacgugcggcgc

SEQ ID NO: 3294275 - RNA, 18 nt, Mycobacterium tuberculosis H37Rv
caccugacgugcggcgcg

SEQ ID NO: 3294276 - RNA, 22 nt, Mycobacterium tuberculosis H37Rv
caccugacgugcggcgcggcga

SEQ ID NO: 3294277 - RNA, 17 nt, Mycobacterium tuberculosis H37Rv
caccugcacgugacccu

SEQ ID NO: 3294278 - RNA, 19 nt, Mycobacterium tuberculosis H37Rv
caccugcacgugacccugg

SEQ ID NO: 3294279 - RNA, 22 nt, Mycobacterium tuberculosis H37Rv
caccugccgacucaucggccgc

SEQ ID NO: 3294280 - RNA, 23 nt, Mycobacterium tuberculosis H37Rv
caccugccgacucaucggccgcg

SEQ ID NO: 3294281 - RNA, 24 nt, Mycobacterium tuberculosis H37Rv
caccugcgaugaugugcgaccaca

SEQ ID NO: 3294282 - RNA, 17 nt, Mycobacterium tuberculosis H37Rv
caccugcgcgcggccgc

SEQ ID NO: 3294283 - RNA, 20 nt, Mycobacterium tuberculosis H37Rv
caccugcgcgcggccgcgcu

SEQ ID NO: 3294284 - RNA, 21 nt, Mycobacterium tuberculosis H37Rv
caccugcggcugcuuggucgc

SEQ ID NO: 3294285 - RNA, 13 nt, Mycobacterium tuberculosis H37Rv
caccugcgggccc

SEQ ID NO: 3294286 - RNA, 16 nt, Mycobacterium tuberculosis H37Rv
caccuggaaggucagc

SEQ ID NO: 3294287 - RNA, 20 nt, Mycobacterium tuberculosis H37Rv
caccuggaaggucagcgccc

SEQ ID NO: 3294288 - RNA, 22 nt, Mycobacterium tuberculosis H37Rv
caccuggaguccagcucgggca

SEQ ID NO: 3294289 - RNA, 13 nt, Mycobacterium tuberculosis H37Rv
caccuggaucagc

SEQ ID NO: 3294290 - RNA, 20 nt, Mycobacterium tuberculosis H37Rv
caccuggcgcagcaacucga

SEQ ID NO: 3294291 - RNA, 16 nt, Mycobacterium tuberculosis H37Rv
caccuggcgugucgcc

SEQ ID NO: 3294292 - RNA, 16 nt, Mycobacterium tuberculosis H37Rv
caccuggucggccgca

SEQ ID NO: 3294293 - RNA, 19 nt, Mycobacterium tuberculosis H37Rv
caccugguuccagaggccc

SEQ ID NO: 3294294 - RNA, 16 nt, Mycobacterium tuberculosis H37Rv
caccugguuuacccgc

SEQ ID NO: 3294295 - RNA, 19 nt, Mycobacterium tuberculosis H37Rv
caccuguuggcaugccgcc

SEQ ID NO: 3294296 - RNA, 22 nt, Mycobacterium tuberculosis H37Rv
caccuuagcgcuugccgcugag

SEQ ID NO: 3294297 - RNA, 19 nt, Mycobacterium tuberculosis H37Rv
caccuucgacguugcggac

SEQ ID NO: 3294298 - RNA, 17 nt, Mycobacterium tuberculosis H37Rv
caccuucugguccagca

SEQ ID NO: 3294299 - RNA, 23 nt, Mycobacterium tuberculosis H37Rv
caccuugaccgggucgaugacgc

SEQ ID NO: 3294300 - RNA, 19 nt, Mycobacterium tuberculosis H37Rv
caccuugacgcccaucuca

SEQ ID NO: 3294301 - RNA, 19 nt, Mycobacterium tuberculosis H37Rv
caccuugccgaacacucgc

SEQ ID NO: 3294302 - RNA, 21 nt, Mycobacterium tuberculosis H37Rv
caccuugccgaacacucgcag

SEQ ID NO: 3294303 - RNA, 18 nt, Mycobacterium tuberculosis H37Rv
caccuugccuagccgcag

SEQ ID NO: 3294304 - RNA, 14 nt, Mycobacterium tuberculosis H37Rv
caccuugcuccaca

SEQ ID NO: 3294305 - RNA, 14 nt, Mycobacterium tuberculosis H37Rv
caccuuggacacca

SEQ ID NO: 3294306 - RNA, 21 nt, Mycobacterium tuberculosis H37Rv
caccuuggccaggaagucccg

SEQ ID NO: 3294307 - RNA, 13 nt, Mycobacterium tuberculosis H37Rv
caccuuggccggg

SEQ ID NO: 3294308 - RNA, 23 nt, Mycobacterium tuberculosis H37Rv
caccuuggcggucggcagaccga

SEQ ID NO: 3294309 - RNA, 18 nt, Mycobacterium tuberculosis H37Rv
caccuugucaaaggugca

SEQ ID NO: 3294310 - RNA, 14 nt, Mycobacterium tuberculosis H37Rv
cacgaaacccaguc

SEQ ID NO: 3294311 - RNA, 22 nt, Mycobacterium tuberculosis H37Rv
cacgaacccucagccgcgccgg

SEQ ID NO: 3294312 - RNA, 23 nt, Mycobacterium tuberculosis H37Rv
cacgaaccgggugccggauugac

SEQ ID NO: 3294313 - RNA, 13 nt, Mycobacterium tuberculosis H37Rv
cacgaacgccugc

SEQ ID NO: 3294314 - RNA, 16 nt, Mycobacterium tuberculosis H37Rv
cacgaacgcgcgcagc

SEQ ID NO: 3294315 - RNA, 23 nt, Mycobacterium tuberculosis H37Rv
cacgaacugaucgaccgccuccu

SEQ ID NO: 3294316 - RNA, 18 nt, Mycobacterium tuberculosis H37Rv
cacgaagaccaggccggu

SEQ ID NO: 3294317 - RNA, 17 nt, Mycobacterium tuberculosis H37Rv
cacgaagaccgcgucgg

SEQ ID NO: 3294318 - RNA, 14 nt, Mycobacterium tuberculosis H37Rv
cacgaagcuggcgu

SEQ ID NO: 3294319 - RNA, 14 nt, Mycobacterium tuberculosis H37Rv
cacgaaggucgcgg

SEQ ID NO: 3294320 - RNA, 13 nt, Mycobacterium tuberculosis H37Rv
cacgaagugaccc

SEQ ID NO: 3294321 - RNA, 14 nt, Mycobacterium tuberculosis H37Rv
cacgaauccggcca

SEQ ID NO: 3294322 - RNA, 14 nt, Mycobacterium tuberculosis H37Rv
cacgacaacuucgc

SEQ ID NO: 3294323 - RNA, 16 nt, Mycobacterium tuberculosis H37Rv
cacgacaacuucgccg

SEQ ID NO: 3294324 - RNA, 14 nt, Mycobacterium tuberculosis H37Rv
cacgacagccagug

SEQ ID NO: 3294325 - RNA, 20 nt, Mycobacterium tuberculosis H37Rv
cacgacaucguaggccggca

SEQ ID NO: 3294326 - RNA, 19 nt, Mycobacterium tuberculosis H37Rv
cacgacaucgucgcgacga

SEQ ID NO: 3294327 - RNA, 22 nt, Mycobacterium tuberculosis H37Rv
cacgaccccggcgguaccgccg

SEQ ID NO: 3294328 - RNA, 14 nt, Mycobacterium tuberculosis H37Rv
cacgaccgccgaua

SEQ ID NO: 3294329 - RNA, 16 nt, Mycobacterium tuberculosis H37Rv
cacgaccgcggcggca

SEQ ID NO: 3294330 - RNA, 12 nt, Mycobacterium tuberculosis H37Rv
cacgaccucuug

SEQ ID NO: 3294331 - RNA, 19 nt, Mycobacterium tuberculosis H37Rv
cacgaccugcucauccacc

SEQ ID NO: 3294332 - RNA, 16 nt, Mycobacterium tuberculosis H37Rv
cacgacgaacaccagc

SEQ ID NO: 3294333 - RNA, 17 nt, Mycobacterium tuberculosis H37Rv
cacgacgaacaccagcg

SEQ ID NO: 3294334 - RNA, 20 nt, Mycobacterium tuberculosis H37Rv
cacgacgaagucguugggaa

SEQ ID NO: 3294335 - RNA, 21 nt, Mycobacterium tuberculosis H37Rv
cacgacgacaaccggccagau

SEQ ID NO: 3294336 - RNA, 18 nt, Mycobacterium tuberculosis H37Rv
cacgacgacaucgagcca

SEQ ID NO: 3294337 - RNA, 13 nt, Mycobacterium tuberculosis H37Rv
cacgacgacgaca

SEQ ID NO: 3294338 - RNA, 21 nt, Mycobacterium tuberculosis H37Rv
cacgacgacuggacaggucgc

SEQ ID NO: 3294339 - RNA, 13 nt, Mycobacterium tuberculosis H37Rv
cacgacgcgacac

SEQ ID NO: 3294340 - RNA, 15 nt, Mycobacterium tuberculosis H37Rv
cacgacggcacgcca

SEQ ID NO: 3294341 - RNA, 20 nt, Mycobacterium tuberculosis H37Rv
cacgacgggggagcacuacc

SEQ ID NO: 3294342 - RNA, 14 nt, Mycobacterium tuberculosis H37Rv
cacgacgucaucgu

SEQ ID NO: 3294343 - RNA, 17 nt, Mycobacterium tuberculosis H37Rv
cacgacguccgaucggu

SEQ ID NO: 3294344 - RNA, 15 nt, Mycobacterium tuberculosis H37Rv
cacgacgucggugaa

SEQ ID NO: 3294345 - RNA, 16 nt, Mycobacterium tuberculosis H37Rv
cacgacgucggugaac

SEQ ID NO: 3294346 - RNA, 23 nt, Mycobacterium tuberculosis H37Rv
cacgacgugcgucggcccggugc

SEQ ID NO: 3294347 - RNA, 17 nt, Mycobacterium tuberculosis H37Rv
cacgacguucgacgaca

SEQ ID NO: 3294348 - RNA, 15 nt, Mycobacterium tuberculosis H37Rv
cacgacuggcgccca

SEQ ID NO: 3294349 - RNA, 17 nt, Mycobacterium tuberculosis H37Rv
cacgagcagccgaugcu

SEQ ID NO: 3294350 - RNA, 18 nt, Mycobacterium tuberculosis H37Rv
cacgagccaacaagucga

SEQ ID NO: 3294351 - RNA, 17 nt, Mycobacterium tuberculosis H37Rv
cacgagcgcauguugca

SEQ ID NO: 3294352 - RNA, 16 nt, Mycobacterium tuberculosis H37Rv
cacgccgucaccgcug

SEQ ID NO: 3294353 - RNA, 17 nt, Mycobacterium tuberculosis H37Rv
cacgccgucaccgcuga

SEQ ID NO: 3294354 - RNA, 16 nt, Mycobacterium tuberculosis H37Rv
cacgccgucgacaaca

SEQ ID NO: 3294355 - RNA, 19 nt, Mycobacterium tuberculosis H37Rv
cacgccguggcccgcuccc

SEQ ID NO: 3294356 - RNA, 20 nt, Mycobacterium tuberculosis H37Rv
cacgccguuugggccguaca

SEQ ID NO: 3294357 - RNA, 19 nt, Mycobacterium tuberculosis H37Rv
cacgccugaacgacccgcu

SEQ ID NO: 3294358 - RNA, 19 nt, Mycobacterium tuberculosis H37Rv
cacgccuggcuacgcgcgc

SEQ ID NO: 3294359 - RNA, 17 nt, Mycobacterium tuberculosis H37Rv
cacgccuugagccgagg

SEQ ID NO: 3294360 - RNA, 16 nt, Mycobacterium tuberculosis H37Rv
cacgcgaaaugccugc

SEQ ID NO: 3294361 - RNA, 17 nt, Mycobacterium tuberculosis H37Rv
cacgcgaaaugccugcg

SEQ ID NO: 3294362 - RNA, 22 nt, Mycobacterium tuberculosis H37Rv
cacgcgaaugacgauccagccc

SEQ ID NO: 3294363 - RNA, 16 nt, Mycobacterium tuberculosis H37Rv
cacgcgaccaccgccg

SEQ ID NO: 3294364 - RNA, 16 nt, Mycobacterium tuberculosis H37Rv
cacgcgacgcggggcu

SEQ ID NO: 3294365 - RNA, 19 nt, Mycobacterium tuberculosis H37Rv
cacgcgacuugcaccccgu

SEQ ID NO: 3294366 - RNA, 22 nt, Mycobacterium tuberculosis H37Rv
cacgcgacuugcaccccgucuc

SEQ ID NO: 3294367 - RNA, 16 nt, Mycobacterium tuberculosis H37Rv
cacgcgaggcgaagcg

SEQ ID NO: 3294368 - RNA, 17 nt, Mycobacterium tuberculosis H37Rv
cacgcgauggccaucau

SEQ ID NO: 3294369 - RNA, 14 nt, Mycobacterium tuberculosis H37Rv
cacgcgcaacucgc

SEQ ID NO: 3294370 - RNA, 15 nt, Mycobacterium tuberculosis H37Rv
cacgcgcaacucgcc

SEQ ID NO: 3294371 - RNA, 17 nt, Mycobacterium tuberculosis H37Rv
cacgcgcccgcaccacc

SEQ ID NO: 3294372 - RNA, 18 nt, Mycobacterium tuberculosis H37Rv
cacgcgcccgcaccaccg

SEQ ID NO: 3294373 - RNA, 23 nt, Mycobacterium tuberculosis H37Rv
cacgcgcgcgaccucgcuggccg

SEQ ID NO: 3294374 - RNA, 17 nt, Mycobacterium tuberculosis H37Rv
cacgcgcucaccgacgc

SEQ ID NO: 3294375 - RNA, 18 nt, Mycobacterium tuberculosis H37Rv
cacgcgcucaccgacgcu

SEQ ID NO: 3294376 - RNA, 13 nt, Mycobacterium tuberculosis H37Rv
cacgcggaccucg

SEQ ID NO: 3294377 - RNA, 17 nt, Mycobacterium tuberculosis H37Rv
cacgcggaccucgaagc

SEQ ID NO: 3294378 - RNA, 18 nt, Mycobacterium tuberculosis H37Rv
cacgcggaccucgaagcc

SEQ ID NO: 3294379 - RNA, 13 nt, Mycobacterium tuberculosis H37Rv
cacgcggcaaugg

SEQ ID NO: 3294380 - RNA, 18 nt, Mycobacterium tuberculosis H37Rv
cacgcggcgaugauggcg

SEQ ID NO: 3294381 - RNA, 13 nt, Mycobacterium tuberculosis H37Rv
cacgcgggcguug

SEQ ID NO: 3294382 - RNA, 22 nt, Mycobacterium tuberculosis H37Rv
cacgcgggucguuaccaggcgu

SEQ ID NO: 3294383 - RNA, 14 nt, Mycobacterium tuberculosis H37Rv
cacgcgggugccga

SEQ ID NO: 3294384 - RNA, 21 nt, Mycobacterium tuberculosis H37Rv
cacgcgugacucggccgacga

SEQ ID NO: 3294385 - RNA, 15 nt, Mycobacterium tuberculosis H37Rv
cacgcguuccacugg

SEQ ID NO: 3294386 - RNA, 17 nt, Mycobacterium tuberculosis H37Rv
cacgcguuccuccagca

SEQ ID NO: 3294387 - RNA, 17 nt, Mycobacterium tuberculosis H37Rv
cacgcguugacgaucuc

SEQ ID NO: 3294388 - RNA, 15 nt, Mycobacterium tuberculosis H37Rv
cacgcuagccgacag

SEQ ID NO: 3294389 - RNA, 17 nt, Mycobacterium tuberculosis H37Rv
cacgcucaacccgugcg

SEQ ID NO: 3294390 - RNA, 18 nt, Mycobacterium tuberculosis H37Rv
cacgcucacccggcgucu

SEQ ID NO: 3294391 - RNA, 15 nt, Mycobacterium tuberculosis H37Rv
cacgcuccagcucgg

SEQ ID NO: 3294392 - RNA, 17 nt, Mycobacterium tuberculosis H37Rv
cacgcuccagcucggcc

SEQ ID NO: 3294393 - RNA, 23 nt, Mycobacterium tuberculosis H37Rv
cacgcuccagcucggccagugcc

SEQ ID NO: 3294394 - RNA, 13 nt, Mycobacterium tuberculosis H37Rv
cacgcucggcgcc

SEQ ID NO: 3294395 - RNA, 14 nt, Mycobacterium tuberculosis H37Rv
cacgcucggcgccg

SEQ ID NO: 3294396 - RNA, 15 nt, Mycobacterium tuberculosis H37Rv
cacgcucggcgccgu

SEQ ID NO: 3294397 - RNA, 20 nt, Mycobacterium tuberculosis H37Rv
cacgcucggcggccagcucc

SEQ ID NO: 3294398 - RNA, 20 nt, Mycobacterium tuberculosis H37Rv
cacgcucggcguccgcccag

SEQ ID NO: 3294399 - RNA, 19 nt, Mycobacterium tuberculosis H37Rv
cacgcucgggggauccggc

SEQ ID NO: 3294400 - RNA, 21 nt, Mycobacterium tuberculosis H37Rv
cacgcucggugaaggucaccg

SEQ ID NO: 3294401 - RNA, 20 nt, Mycobacterium tuberculosis H37Rv
cacgcucgugacgaucagcg

SEQ ID NO: 3294402 - RNA, 20 nt, Mycobacterium tuberculosis H37Rv
cacgcucguuugcgagcagg

SEQ ID NO: 3294403 - RNA, 22 nt, Mycobacterium tuberculosis H37Rv
cacgcucguuugcgagcagggg

SEQ ID NO: 3294404 - RNA, 18 nt, Mycobacterium tuberculosis H37Rv
cacgcucugcgccacagc

SEQ ID NO: 3294405 - RNA, 17 nt, Mycobacterium tuberculosis H37Rv
cacgcugcagauggaac

SEQ ID NO: 3294406 - RNA, 15 nt, Mycobacterium tuberculosis H37Rv
cacgcugcccacggg

SEQ ID NO: 3294407 - RNA, 13 nt, Mycobacterium tuberculosis H37Rv
cacgcugccccgc

SEQ ID NO: 3294408 - RNA, 13 nt, Mycobacterium tuberculosis H37Rv
cacgcugcugcgg

SEQ ID NO: 3294409 - RNA, 18 nt, Mycobacterium tuberculosis H37Rv
cacgcuggccuccagcuu

SEQ ID NO: 3294410 - RNA, 14 nt, Mycobacterium tuberculosis H37Rv
cacgcuggcgcccc

SEQ ID NO: 3294411 - RNA, 22 nt, Mycobacterium tuberculosis H37Rv
cacgcugucccgcgggccagca

SEQ ID NO: 3294412 - RNA, 16 nt, Mycobacterium tuberculosis H37Rv
cacgcuguccgcguga

SEQ ID NO: 3294413 - RNA, 15 nt, Mycobacterium tuberculosis H37Rv
cacgcuucggccugu

SEQ ID NO: 3294414 - RNA, 22 nt, Mycobacterium tuberculosis H37Rv
cacgcuucggccugugcgggca

SEQ ID NO: 3294415 - RNA, 20 nt, Mycobacterium tuberculosis H37Rv
cacgcuucuuccgcgcgccg

SEQ ID NO: 3294416 - RNA, 20 nt, Mycobacterium tuberculosis H37Rv
cacgcuugcggcugcccacc

SEQ ID NO: 3294417 - RNA, 21 nt, Mycobacterium tuberculosis H37Rv
cacgcuuguacaagucgacca

SEQ ID NO: 3294418 - RNA, 16 nt, Mycobacterium tuberculosis H37Rv
cacggaaguaucgccg

SEQ ID NO: 3294419 - RNA, 15 nt, Mycobacterium tuberculosis H37Rv
cacggacaguucccc

SEQ ID NO: 3294420 - RNA, 21 nt, Mycobacterium tuberculosis H37Rv
cacggaccagcgccggaccgu

SEQ ID NO: 3294421 - RNA, 13 nt, Mycobacterium tuberculosis H37Rv
cacggaccgccac

SEQ ID NO: 3294422 - RNA, 18 nt, Mycobacterium tuberculosis H37Rv
cacggacggucgggcgga

SEQ ID NO: 3294423 - RNA, 21 nt, Mycobacterium tuberculosis H37Rv
cacggagaccggccgggugaa

SEQ ID NO: 3294424 - RNA, 14 nt, Mycobacterium tuberculosis H37Rv
cacggagaccgugg

SEQ ID NO: 3294425 - RNA, 22 nt, Mycobacterium tuberculosis H37Rv
cacggagcccgacucuccggca

SEQ ID NO: 3294426 - RNA, 12 nt, Mycobacterium tuberculosis H37Rv
cacggagcucuu

SEQ ID NO: 3294427 - RNA, 20 nt, Mycobacterium tuberculosis H37Rv
cacggaggccuccacauacg

SEQ ID NO: 3294428 - RNA, 14 nt, Mycobacterium tuberculosis H37Rv
cacggaugcgaugg

SEQ ID NO: 3294429 - RNA, 24 nt, Mycobacterium tuberculosis H37Rv
cacggaugucgcccaaccgaaccg

SEQ ID NO: 3294430 - RNA, 13 nt, Mycobacterium tuberculosis H37Rv
cacggauucgggc

SEQ ID NO: 3294431 - RNA, 16 nt, Mycobacterium tuberculosis H37Rv
cacggauucgggcgaa

SEQ ID NO: 3294432 - RNA, 17 nt, Mycobacterium tuberculosis H37Rv
cacggcaagcgugaccc

SEQ ID NO: 3294433 - RNA, 22 nt, Mycobacterium tuberculosis H37Rv
cacggcaccaccaagcucggcc

SEQ ID NO: 3294434 - RNA, 19 nt, Mycobacterium tuberculosis H37Rv
cacggcagccuugaucucg

SEQ ID NO: 3294435 - RNA, 13 nt, Mycobacterium tuberculosis H37Rv
cacggcagcgccc

SEQ ID NO: 3294436 - RNA, 20 nt, Mycobacterium tuberculosis H37Rv
cacggcaggcagggcagccc

SEQ ID NO: 3294437 - RNA, 15 nt, Mycobacterium tuberculosis H37Rv
cacggcaucggccac

SEQ ID NO: 3294438 - RNA, 17 nt, Mycobacterium tuberculosis H37Rv
cacggcaucggccaccu

SEQ ID NO: 3294439 - RNA, 12 nt, Mycobacterium tuberculosis H37Rv
cacggccagcgg

SEQ ID NO: 3294440 - RNA, 15 nt, Mycobacterium tuberculosis H37Rv
cacggccaggucgac

SEQ ID NO: 3294441 - RNA, 15 nt, Mycobacterium tuberculosis H37Rv
cacggccaugaucac

SEQ ID NO: 3294442 - RNA, 18 nt, Mycobacterium tuberculosis H37Rv
cacggccccugccacgac

SEQ ID NO: 3294443 - RNA, 23 nt, Mycobacterium tuberculosis H37Rv
cacggccccugccacgacgaaca

SEQ ID NO: 3294444 - RNA, 19 nt, Mycobacterium tuberculosis H37Rv
cacggccggauacggcgac

SEQ ID NO: 3294445 - RNA, 14 nt, Mycobacterium tuberculosis H37Rv
cacggccggccgcu

SEQ ID NO: 3294446 - RNA, 17 nt, Mycobacterium tuberculosis H37Rv
cacggccgucauuucca

SEQ ID NO: 3294447 - RNA, 12 nt, Mycobacterium tuberculosis H37Rv
cacggccgucga

SEQ ID NO: 3294448 - RNA, 20 nt, Mycobacterium tuberculosis H37Rv
cacguauccacggucgacca

SEQ ID NO: 3294449 - RNA, 17 nt, Mycobacterium tuberculosis H37Rv
cacgucaaacaacgcaa

SEQ ID NO: 3294450 - RNA, 15 nt, Mycobacterium tuberculosis H37Rv
cacgucaaccucgcc

SEQ ID NO: 3294451 - RNA, 21 nt, Mycobacterium tuberculosis H37Rv
cacgucaagaagaacucggug

SEQ ID NO: 3294452 - RNA, 20 nt, Mycobacterium tuberculosis H37Rv
cacgucagcggaugggcuga

SEQ ID NO: 3294453 - RNA, 22 nt, Mycobacterium tuberculosis H37Rv
cacgucauaucucgagcccucg

SEQ ID NO: 3294454 - RNA, 21 nt, Mycobacterium tuberculosis H37Rv
cacguccaacucggcccgggu

SEQ ID NO: 3294455 - RNA, 22 nt, Mycobacterium tuberculosis H37Rv
cacguccaguggcagccagcgg

SEQ ID NO: 3294456 - RNA, 12 nt, Mycobacterium tuberculosis H37Rv
cacgucccagag

SEQ ID NO: 3294457 - RNA, 12 nt, Mycobacterium tuberculosis H37Rv
cacguccgcgga

SEQ ID NO: 3294458 - RNA, 17 nt, Mycobacterium tuberculosis H37Rv
cacguccgcggagcuca

SEQ ID NO: 3294459 - RNA, 16 nt, Mycobacterium tuberculosis H37Rv
cacguccggcgaugac

SEQ ID NO: 3294460 - RNA, 20 nt, Mycobacterium tuberculosis H37Rv
cacguccggcgaugaccaga

SEQ ID NO: 3294461 - RNA, 17 nt, Mycobacterium tuberculosis H37Rv
cacgucgaaaucggugc

SEQ ID NO: 3294462 - RNA, 23 nt, Mycobacterium tuberculosis H37Rv
cacgucgaacucguugaagaauc

SEQ ID NO: 3294463 - RNA, 17 nt, Mycobacterium tuberculosis H37Rv
cacgucgacaccgagga

SEQ ID NO: 3294464 - RNA, 20 nt, Mycobacterium tuberculosis H37Rv
cacgucgacaccgaggaccu

SEQ ID NO: 3294465 - RNA, 23 nt, Mycobacterium tuberculosis H37Rv
cacgucgacaccgaggaccucgu

SEQ ID NO: 3294466 - RNA, 18 nt, Mycobacterium tuberculosis H37Rv
cacgucgacccccugcca

SEQ ID NO: 3294467 - RNA, 21 nt, Mycobacterium tuberculosis H37Rv
cacgucgacggcggccgccac

SEQ ID NO: 3294468 - RNA, 13 nt, Mycobacterium tuberculosis H37Rv
cacgucgagcacc

SEQ ID NO: 3294469 - RNA, 22 nt, Mycobacterium tuberculosis H37Rv
cacgucgaucucccagugagca

SEQ ID NO: 3294470 - RNA, 18 nt, Mycobacterium tuberculosis H37Rv
cacgucgcccaggguguc

SEQ ID NO: 3294471 - RNA, 18 nt, Mycobacterium tuberculosis H37Rv
cacgucggauccgcccgc

SEQ ID NO: 3294472 - RNA, 16 nt, Mycobacterium tuberculosis H37Rv
cacgucgucgcccagg

SEQ ID NO: 3294473 - RNA, 23 nt, Mycobacterium tuberculosis H37Rv
cacgucgucgggguuguccucgg

SEQ ID NO: 3294474 - RNA, 17 nt, Mycobacterium tuberculosis H37Rv
cacgucuaacacgcggu

SEQ ID NO: 3294475 - RNA, 17 nt, Mycobacterium tuberculosis H37Rv
cacgucuccuucggcga

SEQ ID NO: 3294476 - RNA, 23 nt, Mycobacterium tuberculosis H37Rv
cacgucuccuucggcgacugcgc

SEQ ID NO: 3294477 - RNA, 22 nt, Mycobacterium tuberculosis H37Rv
cacgucuugcugcacgcucugc

SEQ ID NO: 3294478 - RNA, 17 nt, Mycobacterium tuberculosis H37Rv
cacgugaucagaucggg

SEQ ID NO: 3294479 - RNA, 16 nt, Mycobacterium tuberculosis H37Rv
cacgugaucgacgacc

SEQ ID NO: 3294480 - RNA, 17 nt, Mycobacterium tuberculosis H37Rv
cacgugaucgacgaccg

SEQ ID NO: 3294481 - RNA, 16 nt, Mycobacterium tuberculosis H37Rv
cacgugaugcccuggg

SEQ ID NO: 3294482 - RNA, 17 nt, Mycobacterium tuberculosis H37Rv
cacgugcccgcgcggcg

SEQ ID NO: 3294483 - RNA, 16 nt, Mycobacterium tuberculosis H37Rv
cacgugggccaugcua

SEQ ID NO: 3294484 - RNA, 13 nt, Mycobacterium tuberculosis H37Rv
cacguggucggca

SEQ ID NO: 3294485 - RNA, 17 nt, Mycobacterium tuberculosis H37Rv
cacguggucggccaccc

SEQ ID NO: 3294486 - RNA, 19 nt, Mycobacterium tuberculosis H37Rv
cacguggucggccacccca

SEQ ID NO: 3294487 - RNA, 15 nt, Mycobacterium tuberculosis H37Rv
cacguggugggcgca

SEQ ID NO: 3294488 - RNA, 14 nt, Mycobacterium tuberculosis H37Rv
cacguuacgcucgc

SEQ ID NO: 3294489 - RNA, 19 nt, Mycobacterium tuberculosis H37Rv
cacguuauucaugcccaug

SEQ ID NO: 3294490 - RNA, 13 nt, Mycobacterium tuberculosis H37Rv
cacguucacgcgc

SEQ ID NO: 3294491 - RNA, 17 nt, Mycobacterium tuberculosis H37Rv
cacguucagcccaugcc

SEQ ID NO: 3294492 - RNA, 12 nt, Mycobacterium tuberculosis H37Rv
cacguucgcggc

SEQ ID NO: 3294493 - RNA, 19 nt, Mycobacterium tuberculosis H37Rv
cacguucggcgcacagcga

SEQ ID NO: 3294494 - RNA, 12 nt, Mycobacterium tuberculosis H37Rv
cacguucggcgu

SEQ ID NO: 3294495 - RNA, 14 nt, Mycobacterium tuberculosis H37Rv
cacguucggcugcg

SEQ ID NO: 3294496 - RNA, 19 nt, Mycobacterium tuberculosis H37Rv
cacguucgguggagggcga

SEQ ID NO: 3294497 - RNA, 16 nt, Mycobacterium tuberculosis H37Rv
cacguucucaccacca

SEQ ID NO: 3294498 - RNA, 19 nt, Mycobacterium tuberculosis H37Rv
cacguugaugaugccggcg

SEQ ID NO: 3294499 - RNA, 14 nt, Mycobacterium tuberculosis H37Rv
cacguugauucggg

SEQ ID NO: 3294500 - RNA, 17 nt, Mycobacterium tuberculosis H37Rv
cacguugauucgggagg

SEQ ID NO: 3294501 - RNA, 22 nt, Mycobacterium tuberculosis H37Rv
cacguuggccccgcggagcgca

SEQ ID NO: 3294502 - RNA, 22 nt, Mycobacterium tuberculosis H37Rv
cacguuggcggccagcgcaccg

SEQ ID NO: 3294503 - RNA, 14 nt, Mycobacterium tuberculosis H37Rv
cacguugugagcca

SEQ ID NO: 3294504 - RNA, 20 nt, Mycobacterium tuberculosis H37Rv
cacguuguucaccgacgcga

SEQ ID NO: 3294505 - RNA, 23 nt, Mycobacterium tuberculosis H37Rv
cacguuuacauagaccaccggca

SEQ ID NO: 3294506 - RNA, 12 nt, Mycobacterium tuberculosis H37Rv
cacuaauaggca

SEQ ID NO: 3294507 - RNA, 18 nt, Mycobacterium tuberculosis H37Rv
cacuacccgcaacgaggc

SEQ ID NO: 3294508 - RNA, 15 nt, Mycobacterium tuberculosis H37Rv
cacuaccgaucacau

SEQ ID NO: 3294509 - RNA, 14 nt, Mycobacterium tuberculosis H37Rv
cacuacggccuggc

SEQ ID NO: 3294510 - RNA, 19 nt, Mycobacterium tuberculosis H37Rv
cacuacggccuggccaccu

SEQ ID NO: 3294511 - RNA, 21 nt, Mycobacterium tuberculosis H37Rv
cacuacggccuggccaccugg

SEQ ID NO: 3294512 - RNA, 19 nt, Mycobacterium tuberculosis H37Rv
cacuacuccggucccgcau

SEQ ID NO: 3294513 - RNA, 19 nt, Mycobacterium tuberculosis H37Rv
cacuagcagggggacccgg

SEQ ID NO: 3294514 - RNA, 17 nt, Mycobacterium tuberculosis H37Rv
cacuaggaagguggccc

SEQ ID NO: 3294515 - RNA, 19 nt, Mycobacterium tuberculosis H37Rv
cacuaguucgagcugccag

SEQ ID NO: 3294516 - RNA, 21 nt, Mycobacterium tuberculosis H37Rv
cacucacauuggccaggucgg

SEQ ID NO: 3294517 - RNA, 16 nt, Mycobacterium tuberculosis H37Rv
cacucacguaauccuc

SEQ ID NO: 3294518 - RNA, 12 nt, Mycobacterium tuberculosis H37Rv
cacucagcaggg

SEQ ID NO: 3294519 - RNA, 23 nt, Mycobacterium tuberculosis H37Rv
cacucagcaggggaucguccggc

SEQ ID NO: 3294520 - RNA, 16 nt, Mycobacterium tuberculosis H37Rv
cacucauuccccggaa

SEQ ID NO: 3294521 - RNA, 18 nt, Mycobacterium tuberculosis H37Rv
cacuccaccgcuggcccg

SEQ ID NO: 3294522 - RNA, 15 nt, Mycobacterium tuberculosis H37Rv
cacuccacgaucggc

SEQ ID NO: 3294523 - RNA, 17 nt, Mycobacterium tuberculosis H37Rv
cacuccaggagccgagg

SEQ ID NO: 3294524 - RNA, 14 nt, Mycobacterium tuberculosis H37Rv
cacucccauccgcc

SEQ ID NO: 3294525 - RNA, 23 nt, Mycobacterium tuberculosis H37Rv
cacucccggcucggccagccagc

SEQ ID NO: 3294526 - RNA, 13 nt, Mycobacterium tuberculosis H37Rv
cacuccgcggggu

SEQ ID NO: 3294527 - RNA, 17 nt, Mycobacterium tuberculosis H37Rv
cacuccggagcccacac

SEQ ID NO: 3294528 - RNA, 17 nt, Mycobacterium tuberculosis H37Rv
cacuccgggcucggcgu

SEQ ID NO: 3294529 - RNA, 14 nt, Mycobacterium tuberculosis H37Rv
cacuccgguggcca

SEQ ID NO: 3294530 - RNA, 23 nt, Mycobacterium tuberculosis H37Rv
cacuccuagccaacgagcgcgcu

SEQ ID NO: 3294531 - RNA, 18 nt, Mycobacterium tuberculosis H37Rv
cacuccugagaugcggcc

SEQ ID NO: 3294532 - RNA, 21 nt, Mycobacterium tuberculosis H37Rv
cacuccugcacacaggacuug

SEQ ID NO: 3294533 - RNA, 18 nt, Mycobacterium tuberculosis H37Rv
cacucgauccggauucag

SEQ ID NO: 3294534 - RNA, 16 nt, Mycobacterium tuberculosis H37Rv
cacucgccagggccau

SEQ ID NO: 3294535 - RNA, 19 nt, Mycobacterium tuberculosis H37Rv
cacucgcccaagcgcagcc

SEQ ID NO: 3294536 - RNA, 15 nt, Mycobacterium tuberculosis H37Rv
cacucgcccgauccg

SEQ ID NO: 3294537 - RNA, 17 nt, Mycobacterium tuberculosis H37Rv
cacucgcgccagugugg

SEQ ID NO: 3294538 - RNA, 21 nt, Mycobacterium tuberculosis H37Rv
cacucgcggauccgggcgugg

SEQ ID NO: 3294539 - RNA, 16 nt, Mycobacterium tuberculosis H37Rv
cacucgcucaggaaca

SEQ ID NO: 3294540 - RNA, 12 nt, Mycobacterium tuberculosis H37Rv
cacucggaaucg

SEQ ID NO: 3294541 - RNA, 15 nt, Mycobacterium tuberculosis H37Rv
cacucggcccggcag

SEQ ID NO: 3294542 - RNA, 18 nt, Mycobacterium tuberculosis H37Rv
cacucggggacggcgaau

SEQ ID NO: 3294543 - RNA, 22 nt, Mycobacterium tuberculosis H37Rv
cacucggggcugucggcgaugg

SEQ ID NO: 3294544 - RNA, 17 nt, Mycobacterium tuberculosis H37Rv
cacuuggucacccaauu

SEQ ID NO: 3294545 - RNA, 18 nt, Mycobacterium tuberculosis H37Rv
cacuuuccgaggagggcc

SEQ ID NO: 3294546 - RNA, 13 nt, Mycobacterium tuberculosis H37Rv
cacuuuccggccg

SEQ ID NO: 3294547 - RNA, 12 nt, Mycobacterium tuberculosis H37Rv
cacuuucuuccu

SEQ ID NO: 3294548 - RNA, 19 nt, Mycobacterium tuberculosis H37Rv
cacuuuuccgccggccagg

SEQ ID NO: 3294549 - RNA, 15 nt, Mycobacterium tuberculosis H37Rv
cagaaacaacgucgc

SEQ ID NO: 3294550 - RNA, 14 nt, Mycobacterium tuberculosis H37Rv
cagaaaccggguag

SEQ ID NO: 3294551 - RNA, 15 nt, Mycobacterium tuberculosis H37Rv
cagaaaccggguagc

SEQ ID NO: 3294552 - RNA, 14 nt, Mycobacterium tuberculosis H37Rv
cagaacaccaccgc

SEQ ID NO: 3294553 - RNA, 17 nt, Mycobacterium tuberculosis H37Rv
cagaacaccaccgccag

SEQ ID NO: 3294554 - RNA, 14 nt, Mycobacterium tuberculosis H37Rv
cagaaccagcgacc

SEQ ID NO: 3294555 - RNA, 19 nt, Mycobacterium tuberculosis H37Rv
cagaaccggugcgguuuca

SEQ ID NO: 3294556 - RNA, 23 nt, Mycobacterium tuberculosis H37Rv
cagaacggcguugcggaaucagc

SEQ ID NO: 3294557 - RNA, 20 nt, Mycobacterium tuberculosis H37Rv
cagaaggaucagcgcacugg

SEQ ID NO: 3294558 - RNA, 23 nt, Mycobacterium tuberculosis H37Rv
cagaaguagguuuucggcggcuc

SEQ ID NO: 3294559 - RNA, 16 nt, Mycobacterium tuberculosis H37Rv
cagaaucaggcucgcc

SEQ ID NO: 3294560 - RNA, 18 nt, Mycobacterium tuberculosis H37Rv
cagaaucaggcucgccga

SEQ ID NO: 3294561 - RNA, 22 nt, Mycobacterium tuberculosis H37Rv
cagaaucaggcucgccgaugcu

SEQ ID NO: 3294562 - RNA, 20 nt, Mycobacterium tuberculosis H37Rv
cagaaucccaacuccuccaa

SEQ ID NO: 3294563 - RNA, 18 nt, Mycobacterium tuberculosis H37Rv
cagaaucccgcucccaug

SEQ ID NO: 3294564 - RNA, 18 nt, Mycobacterium tuberculosis H37Rv
cagaauccugcgcugcac

SEQ ID NO: 3294565 - RNA, 20 nt, Mycobacterium tuberculosis H37Rv
cagaauccugcgcugcacca

SEQ ID NO: 3294566 - RNA, 17 nt, Mycobacterium tuberculosis H37Rv
cagaaucgaccgccgcu

SEQ ID NO: 3294567 - RNA, 13 nt, Mycobacterium tuberculosis H37Rv
cagaaucgcacgc

SEQ ID NO: 3294568 - RNA, 20 nt, Mycobacterium tuberculosis H37Rv
cagaaucgcccauuucggca

SEQ ID NO: 3294569 - RNA, 15 nt, Mycobacterium tuberculosis H37Rv
cagaaucucgccggg

SEQ ID NO: 3294570 - RNA, 18 nt, Mycobacterium tuberculosis H37Rv
cagaaucugccucucagc

SEQ ID NO: 3294571 - RNA, 15 nt, Mycobacterium tuberculosis H37Rv
cagaauguucuccac

SEQ ID NO: 3294572 - RNA, 17 nt, Mycobacterium tuberculosis H37Rv
cagaauucggcgcgaca

SEQ ID NO: 3294573 - RNA, 12 nt, Mycobacterium tuberculosis H37Rv
cagacaacaaca

SEQ ID NO: 3294574 - RNA, 15 nt, Mycobacterium tuberculosis H37Rv
cagacacagaaucgc

SEQ ID NO: 3294575 - RNA, 19 nt, Mycobacterium tuberculosis H37Rv
cagacacagaaucgcccau

SEQ ID NO: 3294576 - RNA, 14 nt, Mycobacterium tuberculosis H37Rv
cagacacagcaccg

SEQ ID NO: 3294577 - RNA, 23 nt, Mycobacterium tuberculosis H37Rv
cagacaccggcuauaucccgccc

SEQ ID NO: 3294578 - RNA, 14 nt, Mycobacterium tuberculosis H37Rv
cagacacgcgcgcu

SEQ ID NO: 3294579 - RNA, 18 nt, Mycobacterium tuberculosis H37Rv
cagacacuaaagcccucg

SEQ ID NO: 3294580 - RNA, 16 nt, Mycobacterium tuberculosis H37Rv
cagacacugcugcggc

SEQ ID NO: 3294581 - RNA, 20 nt, Mycobacterium tuberculosis H37Rv
cagacacugcugcggcagcg

SEQ ID NO: 3294582 - RNA, 14 nt, Mycobacterium tuberculosis H37Rv
cagacagcugcaca

SEQ ID NO: 3294583 - RNA, 14 nt, Mycobacterium tuberculosis H37Rv
cagacaggauugcc

SEQ ID NO: 3294584 - RNA, 23 nt, Mycobacterium tuberculosis H37Rv
cagacaggcggcggccuggcacc

SEQ ID NO: 3294585 - RNA, 16 nt, Mycobacterium tuberculosis H37Rv
cagacaucggagauca

SEQ ID NO: 3294586 - RNA, 23 nt, Mycobacterium tuberculosis H37Rv
cagaccaagcccgucgucgugca

SEQ ID NO: 3294587 - RNA, 14 nt, Mycobacterium tuberculosis H37Rv
cagaccaaggcgaa

SEQ ID NO: 3294588 - RNA, 22 nt, Mycobacterium tuberculosis H37Rv
cagaccaaugaccgccagcagc

SEQ ID NO: 3294589 - RNA, 12 nt, Mycobacterium tuberculosis H37Rv
cagaccacaacg

SEQ ID NO: 3294590 - RNA, 14 nt, Mycobacterium tuberculosis H37Rv
cagaccaccgccug

SEQ ID NO: 3294591 - RNA, 16 nt, Mycobacterium tuberculosis H37Rv
cagaccaccgccugga

SEQ ID NO: 3294592 - RNA, 18 nt, Mycobacterium tuberculosis H37Rv
cagaccaccgugaccgag

SEQ ID NO: 3294593 - RNA, 17 nt, Mycobacterium tuberculosis H37Rv
cagaccagggcagcggc

SEQ ID NO: 3294594 - RNA, 18 nt, Mycobacterium tuberculosis H37Rv
cagaccagggcagcggcc

SEQ ID NO: 3294595 - RNA, 19 nt, Mycobacterium tuberculosis H37Rv
cagaccagggcagcggcca

SEQ ID NO: 3294596 - RNA, 14 nt, Mycobacterium tuberculosis H37Rv
cagacccaccaccg

SEQ ID NO: 3294597 - RNA, 15 nt, Mycobacterium tuberculosis H37Rv
cagacccaccaccgc

SEQ ID NO: 3294598 - RNA, 13 nt, Mycobacterium tuberculosis H37Rv
cagacccacgaug

SEQ ID NO: 3294599 - RNA, 22 nt, Mycobacterium tuberculosis H37Rv
cagacccaguccgguagcagcg

SEQ ID NO: 3294600 - RNA, 17 nt, Mycobacterium tuberculosis H37Rv
cagacccgagcgcucga

SEQ ID NO: 3294601 - RNA, 16 nt, Mycobacterium tuberculosis H37Rv
cagacccgugccguca

SEQ ID NO: 3294602 - RNA, 12 nt, Mycobacterium tuberculosis H37Rv
cagaccgacugc

SEQ ID NO: 3294603 - RNA, 13 nt, Mycobacterium tuberculosis H37Rv
cagaccgaucggc

SEQ ID NO: 3294604 - RNA, 17 nt, Mycobacterium tuberculosis H37Rv
cagaccgaucggcaggc

SEQ ID NO: 3294605 - RNA, 14 nt, Mycobacterium tuberculosis H37Rv
cagaccgcaccauu

SEQ ID NO: 3294606 - RNA, 19 nt, Mycobacterium tuberculosis H37Rv
cagaccgccgacgccguug

SEQ ID NO: 3294607 - RNA, 16 nt, Mycobacterium tuberculosis H37Rv
cagaccgcgaacagcg

SEQ ID NO: 3294608 - RNA, 15 nt, Mycobacterium tuberculosis H37Rv
cagaccggccgacgu

SEQ ID NO: 3294609 - RNA, 16 nt, Mycobacterium tuberculosis H37Rv
cagaccggcucgucgg

SEQ ID NO: 3294610 - RNA, 17 nt, Mycobacterium tuberculosis H37Rv
cagaccggcucgucggg

SEQ ID NO: 3294611 - RNA, 11 nt, Mycobacterium tuberculosis H37Rv
cagaccggugc

SEQ ID NO: 3294612 - RNA, 16 nt, Mycobacterium tuberculosis H37Rv
cagaccggugcugucg

SEQ ID NO: 3294613 - RNA, 16 nt, Mycobacterium tuberculosis H37Rv
cagaccuagcaccgcg

SEQ ID NO: 3294614 - RNA, 21 nt, Mycobacterium tuberculosis H37Rv
cagaccuagcaccgcgccgaa

SEQ ID NO: 3294615 - RNA, 18 nt, Mycobacterium tuberculosis H37Rv
cagacgaaguagccgacc

SEQ ID NO: 3294616 - RNA, 13 nt, Mycobacterium tuberculosis H37Rv
cagacgaccaggg

SEQ ID NO: 3294617 - RNA, 16 nt, Mycobacterium tuberculosis H37Rv
cagacgacgaucagcc

SEQ ID NO: 3294618 - RNA, 11 nt, Mycobacterium tuberculosis H37Rv
cagacgacguc

SEQ ID NO: 3294619 - RNA, 13 nt, Mycobacterium tuberculosis H37Rv
cagacgacgucgg

SEQ ID NO: 3294620 - RNA, 14 nt, Mycobacterium tuberculosis H37Rv
cagacgacgucggc

SEQ ID NO: 3294621 - RNA, 13 nt, Mycobacterium tuberculosis H37Rv
cagacgauggcca

SEQ ID NO: 3294622 - RNA, 16 nt, Mycobacterium tuberculosis H37Rv
cagacgauggccaggu

SEQ ID NO: 3294623 - RNA, 18 nt, Mycobacterium tuberculosis H37Rv
cagacgauggccagguug

SEQ ID NO: 3294624 - RNA, 15 nt, Mycobacterium tuberculosis H37Rv
cagacgauucggcgg

SEQ ID NO: 3294625 - RNA, 14 nt, Mycobacterium tuberculosis H37Rv
cagacgcaaaaucc

SEQ ID NO: 3294626 - RNA, 18 nt, Mycobacterium tuberculosis H37Rv
cagacgcaaaaucgccca

SEQ ID NO: 3294627 - RNA, 19 nt, Mycobacterium tuberculosis H37Rv
cagacgcaaaaucgcccaa

SEQ ID NO: 3294628 - RNA, 20 nt, Mycobacterium tuberculosis H37Rv
cagacgcaaaaucgcccaau

SEQ ID NO: 3294629 - RNA, 19 nt, Mycobacterium tuberculosis H37Rv
cagacgcaaaaucgcccau

SEQ ID NO: 3294630 - RNA, 20 nt, Mycobacterium tuberculosis H37Rv
cagacgcaacggcacccaau

SEQ ID NO: 3294631 - RNA, 17 nt, Mycobacterium tuberculosis H37Rv
cagacgcagaagccccc

SEQ ID NO: 3294632 - RNA, 19 nt, Mycobacterium tuberculosis H37Rv
cagacgcagaaucgcccaa

SEQ ID NO: 3294633 - RNA, 20 nt, Mycobacterium tuberculosis H37Rv
cagacgcagaaucgcccaau

SEQ ID NO: 3294634 - RNA, 16 nt, Mycobacterium tuberculosis H37Rv
cagacgcagagucgca

SEQ ID NO: 3294635 - RNA, 20 nt, Mycobacterium tuberculosis H37Rv
cagacgcagagucgcacugc

SEQ ID NO: 3294636 - RNA, 22 nt, Mycobacterium tuberculosis H37Rv
cagacgcauaagcccccgacac

SEQ ID NO: 3294637 - RNA, 15 nt, Mycobacterium tuberculosis H37Rv
cagacgccccuuccc

SEQ ID NO: 3294638 - RNA, 16 nt, Mycobacterium tuberculosis H37Rv
cagacgccgacuccgc

SEQ ID NO: 3294639 - RNA, 18 nt, Mycobacterium tuberculosis H37Rv
cagacgccgcguuucccg

SEQ ID NO: 3294640 - RNA, 17 nt, Mycobacterium tuberculosis H37Rv
cagacgccggccgccga

SEQ ID NO: 3294641 - RNA, 21 nt, Mycobacterium tuberculosis H37Rv
cagauguccgacgcaccaacg

SEQ ID NO: 3294642 - RNA, 23 nt, Mycobacterium tuberculosis H37Rv
cagauugaggcuggucugcaggc

SEQ ID NO: 3294643 - RNA, 18 nt, Mycobacterium tuberculosis H37Rv
cagauugcucggugguga

SEQ ID NO: 3294644 - RNA, 21 nt, Mycobacterium tuberculosis H37Rv
cagauuggaagacgccggcga

SEQ ID NO: 3294645 - RNA, 17 nt, Mycobacterium tuberculosis H37Rv
cagauugucgacgguca

SEQ ID NO: 3294646 - RNA, 15 nt, Mycobacterium tuberculosis H37Rv
cagauuucauugucc

SEQ ID NO: 3294647 - RNA, 15 nt, Mycobacterium tuberculosis H37Rv
cagauuugcuccagc

SEQ ID NO: 3294648 - RNA, 16 nt, Mycobacterium tuberculosis H37Rv
cagcaaaaaccagcgu

SEQ ID NO: 3294649 - RNA, 18 nt, Mycobacterium tuberculosis H37Rv
cagcaaaaaccagcgucc

SEQ ID NO: 3294650 - RNA, 16 nt, Mycobacterium tuberculosis H37Rv
cagcaaaaacgcugcc

SEQ ID NO: 3294651 - RNA, 23 nt, Mycobacterium tuberculosis H37Rv
cagcaaaaacgcugccgccguuc

SEQ ID NO: 3294652 - RNA, 18 nt, Mycobacterium tuberculosis H37Rv
cagcaaaggggugugugc

SEQ ID NO: 3294653 - RNA, 22 nt, Mycobacterium tuberculosis H37Rv
cagcaaaggggugugugcugcc

SEQ ID NO: 3294654 - RNA, 16 nt, Mycobacterium tuberculosis H37Rv
cagcaaaugcggcgcg

SEQ ID NO: 3294655 - RNA, 17 nt, Mycobacterium tuberculosis H37Rv
cagcaacaacgucugca

SEQ ID NO: 3294656 - RNA, 23 nt, Mycobacterium tuberculosis H37Rv
cagcaacaacgucugcagccucg

SEQ ID NO: 3294657 - RNA, 13 nt, Mycobacterium tuberculosis H37Rv
cagcaacaggccc

SEQ ID NO: 3294658 - RNA, 21 nt, Mycobacterium tuberculosis H37Rv
cagcaacgacccgaagccgac

SEQ ID NO: 3294659 - RNA, 15 nt, Mycobacterium tuberculosis H37Rv
cagcaacgcggugcc

SEQ ID NO: 3294660 - RNA, 18 nt, Mycobacterium tuberculosis H37Rv
cagcaacgcggugccggg

SEQ ID NO: 3294661 - RNA, 13 nt, Mycobacterium tuberculosis H37Rv
cagcaacggcagc

SEQ ID NO: 3294662 - RNA, 15 nt, Mycobacterium tuberculosis H37Rv
cagcaacucggccac

SEQ ID NO: 3294663 - RNA, 20 nt, Mycobacterium tuberculosis H37Rv
cagcaacugccgcacccggu

SEQ ID NO: 3294664 - RNA, 18 nt, Mycobacterium tuberculosis H37Rv
cagcaacugggcggccug

SEQ ID NO: 3294665 - RNA, 16 nt, Mycobacterium tuberculosis H37Rv
cagcaagaucggcagc

SEQ ID NO: 3294666 - RNA, 23 nt, Mycobacterium tuberculosis H37Rv
cagcaagccagcaucggcagcag

SEQ ID NO: 3294667 - RNA, 11 nt, Mycobacterium tuberculosis H37Rv
cagcaagccgc

SEQ ID NO: 3294668 - RNA, 21 nt, Mycobacterium tuberculosis H37Rv
cagcaagugugagcagaccca

SEQ ID NO: 3294669 - RNA, 16 nt, Mycobacterium tuberculosis H37Rv
cagcaaguucgucggg

SEQ ID NO: 3294670 - RNA, 22 nt, Mycobacterium tuberculosis H37Rv
cagcaauccaaggcucagcagc

SEQ ID NO: 3294671 - RNA, 14 nt, Mycobacterium tuberculosis H37Rv
cagcaauccgcaaa

SEQ ID NO: 3294672 - RNA, 23 nt, Mycobacterium tuberculosis H37Rv
cagcaaugcgguaccaaccugcg

SEQ ID NO: 3294673 - RNA, 22 nt, Mycobacterium tuberculosis H37Rv
cagcaauuuuccgucgauggac

SEQ ID NO: 3294674 - RNA, 15 nt, Mycobacterium tuberculosis H37Rv
cagcacaaacccagu

SEQ ID NO: 3294675 - RNA, 16 nt, Mycobacterium tuberculosis H37Rv
cagcacaaacccaguu

SEQ ID NO: 3294676 - RNA, 13 nt, Mycobacterium tuberculosis H37Rv
cagcacaccgucg

SEQ ID NO: 3294677 - RNA, 17 nt, Mycobacterium tuberculosis H37Rv
cagcacaccgucgacga

SEQ ID NO: 3294678 - RNA, 14 nt, Mycobacterium tuberculosis H37Rv
cagcacagcgcagc

SEQ ID NO: 3294679 - RNA, 14 nt, Mycobacterium tuberculosis H37Rv
cagcacaggcuggc

SEQ ID NO: 3294680 - RNA, 16 nt, Mycobacterium tuberculosis H37Rv
cagcacaggcuggcga

SEQ ID NO: 3294681 - RNA, 17 nt, Mycobacterium tuberculosis H37Rv
cagcacauucugcagcg

SEQ ID NO: 3294682 - RNA, 18 nt, Mycobacterium tuberculosis H37Rv
cagcaccaacugaauggc

SEQ ID NO: 3294683 - RNA, 17 nt, Mycobacterium tuberculosis H37Rv
cagcaccacaacgucgg

SEQ ID NO: 3294684 - RNA, 12 nt, Mycobacterium tuberculosis H37Rv
cagcaccaccac

SEQ ID NO: 3294685 - RNA, 14 nt, Mycobacterium tuberculosis H37Rv
cagcaccaccagca

SEQ ID NO: 3294686 - RNA, 14 nt, Mycobacterium tuberculosis H37Rv
cagcaccaccgcgg

SEQ ID NO: 3294687 - RNA, 17 nt, Mycobacterium tuberculosis H37Rv
cagcaccaccgcggugu

SEQ ID NO: 3294688 - RNA, 19 nt, Mycobacterium tuberculosis H37Rv
cagcaccacggccagcggg

SEQ ID NO: 3294689 - RNA, 17 nt, Mycobacterium tuberculosis H37Rv
cagcaccagcacggcaa

SEQ ID NO: 3294690 - RNA, 14 nt, Mycobacterium tuberculosis H37Rv
cagcaccagcgccu

SEQ ID NO: 3294691 - RNA, 16 nt, Mycobacterium tuberculosis H37Rv
cagcaccagcgccuug

SEQ ID NO: 3294692 - RNA, 17 nt, Mycobacterium tuberculosis H37Rv
cagcaccagcgccuuga

SEQ ID NO: 3294693 - RNA, 19 nt, Mycobacterium tuberculosis H37Rv
cagcaccagggcgcggauc

SEQ ID NO: 3294694 - RNA, 22 nt, Mycobacterium tuberculosis H37Rv
cagcaccaguguggcgaugacc

SEQ ID NO: 3294695 - RNA, 18 nt, Mycobacterium tuberculosis H37Rv
cagcacccaaugccaccg

SEQ ID NO: 3294696 - RNA, 20 nt, Mycobacterium tuberculosis H37Rv
cagcacccaaugccaccgcg

SEQ ID NO: 3294697 - RNA, 16 nt, Mycobacterium tuberculosis H37Rv
cagcacccacaucagc

SEQ ID NO: 3294698 - RNA, 22 nt, Mycobacterium tuberculosis H37Rv
cagcacccacaucagccgcacc

SEQ ID NO: 3294699 - RNA, 18 nt, Mycobacterium tuberculosis H37Rv
cagcacccagacgauggc

SEQ ID NO: 3294700 - RNA, 19 nt, Mycobacterium tuberculosis H37Rv
cagcaccccauggccaccg

SEQ ID NO: 3294701 - RNA, 13 nt, Mycobacterium tuberculosis H37Rv
cagcaccccgauc

SEQ ID NO: 3294702 - RNA, 17 nt, Mycobacterium tuberculosis H37Rv
cagcacccgagcgaugc

SEQ ID NO: 3294703 - RNA, 22 nt, Mycobacterium tuberculosis H37Rv
cagcacccgagcgaugcgaccg

SEQ ID NO: 3294704 - RNA, 20 nt, Mycobacterium tuberculosis H37Rv
cagcacccgcacgguguauc

SEQ ID NO: 3294705 - RNA, 14 nt, Mycobacterium tuberculosis H37Rv
cagcacccgcgcca

SEQ ID NO: 3294706 - RNA, 16 nt, Mycobacterium tuberculosis H37Rv
cagcacccgcuccagc

SEQ ID NO: 3294707 - RNA, 17 nt, Mycobacterium tuberculosis H37Rv
cagcacccgcuccagcu

SEQ ID NO: 3294708 - RNA, 19 nt, Mycobacterium tuberculosis H37Rv
cagcacccgcuccagcucg

SEQ ID NO: 3294709 - RNA, 23 nt, Mycobacterium tuberculosis H37Rv
cagcacccgcuccagcucggcgg

SEQ ID NO: 3294710 - RNA, 17 nt, Mycobacterium tuberculosis H37Rv
cagcacccgcucggccg

SEQ ID NO: 3294711 - RNA, 11 nt, Mycobacterium tuberculosis H37Rv
cagcacccggc

SEQ ID NO: 3294712 - RNA, 16 nt, Mycobacterium tuberculosis H37Rv
cagcacccggccaccg

SEQ ID NO: 3294713 - RNA, 20 nt, Mycobacterium tuberculosis H37Rv
cagcacccucaggcaaucgc

SEQ ID NO: 3294714 - RNA, 21 nt, Mycobacterium tuberculosis H37Rv
cagcacccugaugugagucca

SEQ ID NO: 3294715 - RNA, 15 nt, Mycobacterium tuberculosis H37Rv
cagcacccugcgggc

SEQ ID NO: 3294716 - RNA, 20 nt, Mycobacterium tuberculosis H37Rv
cagcacccugcgggccgaga

SEQ ID NO: 3294717 - RNA, 16 nt, Mycobacterium tuberculosis H37Rv
cagcaccgaacccgcc

SEQ ID NO: 3294718 - RNA, 18 nt, Mycobacterium tuberculosis H37Rv
cagcaccgaacccgccac

SEQ ID NO: 3294719 - RNA, 20 nt, Mycobacterium tuberculosis H37Rv
cagcaccgaacccgccaccg

SEQ ID NO: 3294720 - RNA, 13 nt, Mycobacterium tuberculosis H37Rv
cagcaccgacggc

SEQ ID NO: 3294721 - RNA, 14 nt, Mycobacterium tuberculosis H37Rv
cagcaccgccgcug

SEQ ID NO: 3294722 - RNA, 16 nt, Mycobacterium tuberculosis H37Rv
cagcaccgccgcugcc

SEQ ID NO: 3294723 - RNA, 16 nt, Mycobacterium tuberculosis H37Rv
cagcaccgcuggcagc

SEQ ID NO: 3294724 - RNA, 18 nt, Mycobacterium tuberculosis H37Rv
cagcaccggaucgaccaa

SEQ ID NO: 3294725 - RNA, 22 nt, Mycobacterium tuberculosis H37Rv
cagcaccgggaugugcggcugc

SEQ ID NO: 3294726 - RNA, 13 nt, Mycobacterium tuberculosis H37Rv
cagcaccggugac

SEQ ID NO: 3294727 - RNA, 16 nt, Mycobacterium tuberculosis H37Rv
cagcaccgguggcgcu

SEQ ID NO: 3294728 - RNA, 14 nt, Mycobacterium tuberculosis H37Rv
cagcaccguacggc

SEQ ID NO: 3294729 - RNA, 16 nt, Mycobacterium tuberculosis H37Rv
cagcaccguaguccac

SEQ ID NO: 3294730 - RNA, 14 nt, Mycobacterium tuberculosis H37Rv
cagcaccguccucg

SEQ ID NO: 3294731 - RNA, 23 nt, Mycobacterium tuberculosis H37Rv
cagcaccguccucggucacgauc

SEQ ID NO: 3294732 - RNA, 18 nt, Mycobacterium tuberculosis H37Rv
cagcaccgucggcaccag

SEQ ID NO: 3294733 - RNA, 20 nt, Mycobacterium tuberculosis H37Rv
cagcaccgucggcaccagca

SEQ ID NO: 3294734 - RNA, 22 nt, Mycobacterium tuberculosis H37Rv
cagcaccgucggcaccagcagc

SEQ ID NO: 3294735 - RNA, 13 nt, Mycobacterium tuberculosis H37Rv
cagcaccgucggg

SEQ ID NO: 3294736 - RNA, 22 nt, Mycobacterium tuberculosis H37Rv
cagcaccgucgggcccagccgg

SEQ ID NO: 3294737 - RNA, 16 nt, Mycobacterium tuberculosis H37Rv
cagcagcgggcgcgcu

SEQ ID NO: 3294738 - RNA, 17 nt, Mycobacterium tuberculosis H37Rv
cagcagcgggcgcgcua

SEQ ID NO: 3294739 - RNA, 15 nt, Mycobacterium tuberculosis H37Rv
cagcagcgggcuggc

SEQ ID NO: 3294740 - RNA, 15 nt, Mycobacterium tuberculosis H37Rv
cagcagcgucaucag

SEQ ID NO: 3294741 - RNA, 14 nt, Mycobacterium tuberculosis H37Rv
cagcagcgugacca

SEQ ID NO: 3294742 - RNA, 16 nt, Mycobacterium tuberculosis H37Rv
cagcagcucgccggca

SEQ ID NO: 3294743 - RNA, 19 nt, Mycobacterium tuberculosis H37Rv
cagcagcucguugaugcgg

SEQ ID NO: 3294744 - RNA, 20 nt, Mycobacterium tuberculosis H37Rv
cagcagcuucggacuggggc

SEQ ID NO: 3294745 - RNA, 20 nt, Mycobacterium tuberculosis H37Rv
cagcagcuugacaucgguca

SEQ ID NO: 3294746 - RNA, 21 nt, Mycobacterium tuberculosis H37Rv
cagcagcuugacccacauucc

SEQ ID NO: 3294747 - RNA, 23 nt, Mycobacterium tuberculosis H37Rv
cagcagcuuguuuuccaccagcg

SEQ ID NO: 3294748 - RNA, 18 nt, Mycobacterium tuberculosis H37Rv
cagcaggaagccgaagau

SEQ ID NO: 3294749 - RNA, 21 nt, Mycobacterium tuberculosis H37Rv
cagcaggaaguaccccuugga

SEQ ID NO: 3294750 - RNA, 23 nt, Mycobacterium tuberculosis H37Rv
cagcaggaaguagccgagccagu

SEQ ID NO: 3294751 - RNA, 13 nt, Mycobacterium tuberculosis H37Rv
cagcaggacaccu

SEQ ID NO: 3294752 - RNA, 20 nt, Mycobacterium tuberculosis H37Rv
cagcaggaucggcagcagag

SEQ ID NO: 3294753 - RNA, 23 nt, Mycobacterium tuberculosis H37Rv
cagcaggaucggcagcagaguuc

SEQ ID NO: 3294754 - RNA, 14 nt, Mycobacterium tuberculosis H37Rv
cagcaggaugauga

SEQ ID NO: 3294755 - RNA, 14 nt, Mycobacterium tuberculosis H37Rv
cagcaggcccaccc

SEQ ID NO: 3294756 - RNA, 15 nt, Mycobacterium tuberculosis H37Rv
cagcaggcccagcgg

SEQ ID NO: 3294757 - RNA, 20 nt, Mycobacterium tuberculosis H37Rv
cagcaggcccuggccaccca

SEQ ID NO: 3294758 - RNA, 20 nt, Mycobacterium tuberculosis H37Rv
cagcaggccgcgcucgucga

SEQ ID NO: 3294759 - RNA, 11 nt, Mycobacterium tuberculosis H37Rv
cagcaggccgg

SEQ ID NO: 3294760 - RNA, 16 nt, Mycobacterium tuberculosis H37Rv
cagcaggccgggacag

SEQ ID NO: 3294761 - RNA, 16 nt, Mycobacterium tuberculosis H37Rv
cagcaggccgggcgca

SEQ ID NO: 3294762 - RNA, 17 nt, Mycobacterium tuberculosis H37Rv
cagcaggccgggcgcaa

SEQ ID NO: 3294763 - RNA, 14 nt, Mycobacterium tuberculosis H37Rv
cagcaggcggcuga

SEQ ID NO: 3294764 - RNA, 20 nt, Mycobacterium tuberculosis H37Rv
cagcaggcucgaaccgacgc

SEQ ID NO: 3294765 - RNA, 14 nt, Mycobacterium tuberculosis H37Rv
cagcagggccacca

SEQ ID NO: 3294766 - RNA, 17 nt, Mycobacterium tuberculosis H37Rv
cagcagggccaccacca

SEQ ID NO: 3294767 - RNA, 22 nt, Mycobacterium tuberculosis H37Rv
cagcagggccaccaccacggcc

SEQ ID NO: 3294768 - RNA, 14 nt, Mycobacterium tuberculosis H37Rv
cagcagggcgcgca

SEQ ID NO: 3294769 - RNA, 16 nt, Mycobacterium tuberculosis H37Rv
cagcaggggacgggcg

SEQ ID NO: 3294770 - RNA, 20 nt, Mycobacterium tuberculosis H37Rv
cagcaggggacgggcggcca

SEQ ID NO: 3294771 - RNA, 22 nt, Mycobacterium tuberculosis H37Rv
cagcaggggaucguccggccgg

SEQ ID NO: 3294772 - RNA, 17 nt, Mycobacterium tuberculosis H37Rv
cagcagguccgccaccg

SEQ ID NO: 3294773 - RNA, 18 nt, Mycobacterium tuberculosis H37Rv
cagcagguccgccaccgc

SEQ ID NO: 3294774 - RNA, 22 nt, Mycobacterium tuberculosis H37Rv
cagcaggucgaugcugccagcc

SEQ ID NO: 3294775 - RNA, 17 nt, Mycobacterium tuberculosis H37Rv
cagcaggucgucggcgu

SEQ ID NO: 3294776 - RNA, 16 nt, Mycobacterium tuberculosis H37Rv
cagcagguuccacggc

SEQ ID NO: 3294777 - RNA, 20 nt, Mycobacterium tuberculosis H37Rv
cagcagguuggucaccaccu

SEQ ID NO: 3294778 - RNA, 19 nt, Mycobacterium tuberculosis H37Rv
cagcagguuuucgaucugg

SEQ ID NO: 3294779 - RNA, 16 nt, Mycobacterium tuberculosis H37Rv
cagcaguacaccgccc

SEQ ID NO: 3294780 - RNA, 17 nt, Mycobacterium tuberculosis H37Rv
cagcaguacaccgcccg

SEQ ID NO: 3294781 - RNA, 15 nt, Mycobacterium tuberculosis H37Rv
cagcagugccaccgg

SEQ ID NO: 3294782 - RNA, 16 nt, Mycobacterium tuberculosis H37Rv
cagcagugccgugcug

SEQ ID NO: 3294783 - RNA, 21 nt, Mycobacterium tuberculosis H37Rv
cagcaguucggcgaugcgcgg

SEQ ID NO: 3294784 - RNA, 20 nt, Mycobacterium tuberculosis H37Rv
cagcaucaaccguccccggc

SEQ ID NO: 3294785 - RNA, 16 nt, Mycobacterium tuberculosis H37Rv
cagcaucacgcccacg

SEQ ID NO: 3294786 - RNA, 13 nt, Mycobacterium tuberculosis H37Rv
cagcaucagcgcc

SEQ ID NO: 3294787 - RNA, 20 nt, Mycobacterium tuberculosis H37Rv
cagcaucagcgccagcgagc

SEQ ID NO: 3294788 - RNA, 18 nt, Mycobacterium tuberculosis H37Rv
cagcaucagcucgaugcc

SEQ ID NO: 3294789 - RNA, 15 nt, Mycobacterium tuberculosis H37Rv
cagcauccccgcagc

SEQ ID NO: 3294790 - RNA, 19 nt, Mycobacterium tuberculosis H37Rv
cagcauccccgcagcgucc

SEQ ID NO: 3294791 - RNA, 21 nt, Mycobacterium tuberculosis H37Rv
cagcauccggccgucaucugg

SEQ ID NO: 3294792 - RNA, 13 nt, Mycobacterium tuberculosis H37Rv
cagcauccuucgc

SEQ ID NO: 3294793 - RNA, 17 nt, Mycobacterium tuberculosis H37Rv
cagcaucgccagcagga

SEQ ID NO: 3294794 - RNA, 13 nt, Mycobacterium tuberculosis H37Rv
cagcaucgcggug

SEQ ID NO: 3294795 - RNA, 17 nt, Mycobacterium tuberculosis H37Rv
cagcaucggcagcagcg

SEQ ID NO: 3294796 - RNA, 14 nt, Mycobacterium tuberculosis H37Rv
cagcaucggucaca

SEQ ID NO: 3294797 - RNA, 17 nt, Mycobacterium tuberculosis H37Rv
cagcaucgucgccacga

SEQ ID NO: 3294798 - RNA, 16 nt, Mycobacterium tuberculosis H37Rv
cagcaucuccgucggc

SEQ ID NO: 3294799 - RNA, 21 nt, Mycobacterium tuberculosis H37Rv
cagcaucuccgucggccaggc

SEQ ID NO: 3294800 - RNA, 14 nt, Mycobacterium tuberculosis H37Rv
cagcaucucggcgg

SEQ ID NO: 3294801 - RNA, 13 nt, Mycobacterium tuberculosis H37Rv
cagcaucugcggg

SEQ ID NO: 3294802 - RNA, 22 nt, Mycobacterium tuberculosis H37Rv
cagcaucugcgggucggcaucg

SEQ ID NO: 3294803 - RNA, 16 nt, Mycobacterium tuberculosis H37Rv
cagcaucuuuggcggc

SEQ ID NO: 3294804 - RNA, 17 nt, Mycobacterium tuberculosis H37Rv
cagcaugacaccggcca

SEQ ID NO: 3294805 - RNA, 18 nt, Mycobacterium tuberculosis H37Rv
cagcaugacaccggccac

SEQ ID NO: 3294806 - RNA, 20 nt, Mycobacterium tuberculosis H37Rv
cagcaugacaccggccacca

SEQ ID NO: 3294807 - RNA, 22 nt, Mycobacterium tuberculosis H37Rv
cagcaugacaccggccaccagc

SEQ ID NO: 3294808 - RNA, 14 nt, Mycobacterium tuberculosis H37Rv
cagcaugcccgcca

SEQ ID NO: 3294809 - RNA, 19 nt, Mycobacterium tuberculosis H37Rv
cagcaugcccgccauccga

SEQ ID NO: 3294810 - RNA, 20 nt, Mycobacterium tuberculosis H37Rv
cagcaugcccucgcuguugg

SEQ ID NO: 3294811 - RNA, 14 nt, Mycobacterium tuberculosis H37Rv
cagcaugccuucgg

SEQ ID NO: 3294812 - RNA, 22 nt, Mycobacterium tuberculosis H37Rv
cagcauggcccuggcgaccagc

SEQ ID NO: 3294813 - RNA, 23 nt, Mycobacterium tuberculosis H37Rv
cagcaugggguagaucucuucgg

SEQ ID NO: 3294814 - RNA, 15 nt, Mycobacterium tuberculosis H37Rv
cagcauggggucagc

SEQ ID NO: 3294815 - RNA, 19 nt, Mycobacterium tuberculosis H37Rv
cagcauggggucagcucgc

SEQ ID NO: 3294816 - RNA, 22 nt, Mycobacterium tuberculosis H37Rv
cagcaugguccacagccggcgg

SEQ ID NO: 3294817 - RNA, 15 nt, Mycobacterium tuberculosis H37Rv
cagcaugguggacga

SEQ ID NO: 3294818 - RNA, 23 nt, Mycobacterium tuberculosis H37Rv
cagcaugucgacggucagauggc

SEQ ID NO: 3294819 - RNA, 21 nt, Mycobacterium tuberculosis H37Rv
cagcaugucucgggcgcgggu

SEQ ID NO: 3294820 - RNA, 16 nt, Mycobacterium tuberculosis H37Rv
cagcauugaagaagcc

SEQ ID NO: 3294821 - RNA, 17 nt, Mycobacterium tuberculosis H37Rv
cagccaaaucagccagg

SEQ ID NO: 3294822 - RNA, 22 nt, Mycobacterium tuberculosis H37Rv
cagccaaccggcgcaguagccg

SEQ ID NO: 3294823 - RNA, 15 nt, Mycobacterium tuberculosis H37Rv
cagccaacgcguccc

SEQ ID NO: 3294824 - RNA, 21 nt, Mycobacterium tuberculosis H37Rv
cagccaacucaggccgguacc

SEQ ID NO: 3294825 - RNA, 15 nt, Mycobacterium tuberculosis H37Rv
cagccaagcgagcgg

SEQ ID NO: 3294826 - RNA, 16 nt, Mycobacterium tuberculosis H37Rv
cagccaaguccgcccg

SEQ ID NO: 3294827 - RNA, 18 nt, Mycobacterium tuberculosis H37Rv
cagccacagcccggcggc

SEQ ID NO: 3294828 - RNA, 14 nt, Mycobacterium tuberculosis H37Rv
cagccacagccgac

SEQ ID NO: 3294829 - RNA, 17 nt, Mycobacterium tuberculosis H37Rv
cagccacagccgaccuc

SEQ ID NO: 3294830 - RNA, 21 nt, Mycobacterium tuberculosis H37Rv
cagccaccacaucgcgggcgu

SEQ ID NO: 3294831 - RNA, 13 nt, Mycobacterium tuberculosis H37Rv
cagccaccaccag

SEQ ID NO: 3294832 - RNA, 15 nt, Mycobacterium tuberculosis H37Rv
cagccaccagccggg

SEQ ID NO: 3294833 - RNA, 13 nt, Mycobacterium tuberculosis H37Rv
cagccggagucac

SEQ ID NO: 3294834 - RNA, 15 nt, Mycobacterium tuberculosis H37Rv
cagccggcagcagcg

SEQ ID NO: 3294835 - RNA, 15 nt, Mycobacterium tuberculosis H37Rv
cagccggcagcgaga

SEQ ID NO: 3294836 - RNA, 23 nt, Mycobacterium tuberculosis H37Rv
cagccggccaauggccugcagcg

SEQ ID NO: 3294837 - RNA, 18 nt, Mycobacterium tuberculosis H37Rv
cagccggccauacgcgcg

SEQ ID NO: 3294838 - RNA, 20 nt, Mycobacterium tuberculosis H37Rv
cagccggccauacgcgcgcg

SEQ ID NO: 3294839 - RNA, 20 nt, Mycobacterium tuberculosis H37Rv
cagccggcccugcggccaau

SEQ ID NO: 3294840 - RNA, 14 nt, Mycobacterium tuberculosis H37Rv
cagccggccgcgac

SEQ ID NO: 3294841 - RNA, 15 nt, Mycobacterium tuberculosis H37Rv
cagccggccgcgacc

SEQ ID NO: 3294842 - RNA, 16 nt, Mycobacterium tuberculosis H37Rv
cagccggccugucccg

SEQ ID NO: 3294843 - RNA, 17 nt, Mycobacterium tuberculosis H37Rv
cagccggccugucccgc

SEQ ID NO: 3294844 - RNA, 18 nt, Mycobacterium tuberculosis H37Rv
cagccggcgcacucccgg

SEQ ID NO: 3294845 - RNA, 22 nt, Mycobacterium tuberculosis H37Rv
cagccggcggagagggcgacca

SEQ ID NO: 3294846 - RNA, 13 nt, Mycobacterium tuberculosis H37Rv
cagccgggcacca

SEQ ID NO: 3294847 - RNA, 18 nt, Mycobacterium tuberculosis H37Rv
cagccgggcaccacccuu

SEQ ID NO: 3294848 - RNA, 14 nt, Mycobacterium tuberculosis H37Rv
cagccgggcacccu

SEQ ID NO: 3294849 - RNA, 17 nt, Mycobacterium tuberculosis H37Rv
cagccgggcacccuugc

SEQ ID NO: 3294850 - RNA, 14 nt, Mycobacterium tuberculosis H37Rv
cagccgggcgucgc

SEQ ID NO: 3294851 - RNA, 15 nt, Mycobacterium tuberculosis H37Rv
cagccgggcgucgcu

SEQ ID NO: 3294852 - RNA, 19 nt, Mycobacterium tuberculosis H37Rv
cagccgggucuacagcguu

SEQ ID NO: 3294853 - RNA, 18 nt, Mycobacterium tuberculosis H37Rv
cagccgggugcgcacccg

SEQ ID NO: 3294854 - RNA, 16 nt, Mycobacterium tuberculosis H37Rv
cagccgguccagaccc

SEQ ID NO: 3294855 - RNA, 17 nt, Mycobacterium tuberculosis H37Rv
cagccgguccagcagcu

SEQ ID NO: 3294856 - RNA, 14 nt, Mycobacterium tuberculosis H37Rv
cagccggucgucgc

SEQ ID NO: 3294857 - RNA, 14 nt, Mycobacterium tuberculosis H37Rv
cagccggugccgcc

SEQ ID NO: 3294858 - RNA, 15 nt, Mycobacterium tuberculosis H37Rv
cagccguacgccgua

SEQ ID NO: 3294859 - RNA, 17 nt, Mycobacterium tuberculosis H37Rv
cagccguagcugggcac

SEQ ID NO: 3294860 - RNA, 16 nt, Mycobacterium tuberculosis H37Rv
cagccgucaccgcgac

SEQ ID NO: 3294861 - RNA, 22 nt, Mycobacterium tuberculosis H37Rv
cagccgucaccgcgaccccugg

SEQ ID NO: 3294862 - RNA, 20 nt, Mycobacterium tuberculosis H37Rv
cagccgucagcgcgggcggg

SEQ ID NO: 3294863 - RNA, 12 nt, Mycobacterium tuberculosis H37Rv
cagccguccggg

SEQ ID NO: 3294864 - RNA, 23 nt, Mycobacterium tuberculosis H37Rv
cagccguccgggcggccucccgg

SEQ ID NO: 3294865 - RNA, 18 nt, Mycobacterium tuberculosis H37Rv
cagccgucgccaccagag

SEQ ID NO: 3294866 - RNA, 14 nt, Mycobacterium tuberculosis H37Rv
cagccgucggcgcu

SEQ ID NO: 3294867 - RNA, 22 nt, Mycobacterium tuberculosis H37Rv
cagccgucggcgcugcgcgcga

SEQ ID NO: 3294868 - RNA, 18 nt, Mycobacterium tuberculosis H37Rv
cagccgucguccgcugac

SEQ ID NO: 3294869 - RNA, 21 nt, Mycobacterium tuberculosis H37Rv
cagccgucguccgcugacccg

SEQ ID NO: 3294870 - RNA, 14 nt, Mycobacterium tuberculosis H37Rv
cagccgugcccagg

SEQ ID NO: 3294871 - RNA, 17 nt, Mycobacterium tuberculosis H37Rv
cagccgugcccaggcca

SEQ ID NO: 3294872 - RNA, 20 nt, Mycobacterium tuberculosis H37Rv
cagccgugcccaggccaccg

SEQ ID NO: 3294873 - RNA, 22 nt, Mycobacterium tuberculosis H37Rv
cagccgugcggcggcugccggu

SEQ ID NO: 3294874 - RNA, 22 nt, Mycobacterium tuberculosis H37Rv
cagccguucccggugaccacuu

SEQ ID NO: 3294875 - RNA, 15 nt, Mycobacterium tuberculosis H37Rv
cagccguucgcagcu

SEQ ID NO: 3294876 - RNA, 13 nt, Mycobacterium tuberculosis H37Rv
cagccguucucgc

SEQ ID NO: 3294877 - RNA, 13 nt, Mycobacterium tuberculosis H37Rv
cagccuccaccag

SEQ ID NO: 3294878 - RNA, 23 nt, Mycobacterium tuberculosis H37Rv
cagccucgaguucgaccggcggg

SEQ ID NO: 3294879 - RNA, 17 nt, Mycobacterium tuberculosis H37Rv
cagccucgcgggcaggg

SEQ ID NO: 3294880 - RNA, 16 nt, Mycobacterium tuberculosis H37Rv
cagccugaaccgcccc

SEQ ID NO: 3294881 - RNA, 18 nt, Mycobacterium tuberculosis H37Rv
cagccugauauccgcgga

SEQ ID NO: 3294882 - RNA, 23 nt, Mycobacterium tuberculosis H37Rv
cagccugcagcgaaacaccggcc

SEQ ID NO: 3294883 - RNA, 14 nt, Mycobacterium tuberculosis H37Rv
cagccugcgccgcg

SEQ ID NO: 3294884 - RNA, 24 nt, Mycobacterium tuberculosis H37Rv
cagccugcuggccgcggccucgua

SEQ ID NO: 3294885 - RNA, 15 nt, Mycobacterium tuberculosis H37Rv
cagccuggagauggc

SEQ ID NO: 3294886 - RNA, 13 nt, Mycobacterium tuberculosis H37Rv
cagccuggccucg

SEQ ID NO: 3294887 - RNA, 14 nt, Mycobacterium tuberculosis H37Rv
cagccuggccucgc

SEQ ID NO: 3294888 - RNA, 19 nt, Mycobacterium tuberculosis H37Rv
cagccuggccucgccauug

SEQ ID NO: 3294889 - RNA, 14 nt, Mycobacterium tuberculosis H37Rv
cagccugugcugcc

SEQ ID NO: 3294890 - RNA, 21 nt, Mycobacterium tuberculosis H37Rv
cagccuugaucucgucccacu

SEQ ID NO: 3294891 - RNA, 21 nt, Mycobacterium tuberculosis H37Rv
cagccuuggacgugcgcgcca

SEQ ID NO: 3294892 - RNA, 18 nt, Mycobacterium tuberculosis H37Rv
cagcgaaacaccggccag

SEQ ID NO: 3294893 - RNA, 20 nt, Mycobacterium tuberculosis H37Rv
cagcgaaacaccggccagcg

SEQ ID NO: 3294894 - RNA, 17 nt, Mycobacterium tuberculosis H37Rv
cagcgaaacgagccggu

SEQ ID NO: 3294895 - RNA, 22 nt, Mycobacterium tuberculosis H37Rv
cagcgaaaugcccaucaccaga

SEQ ID NO: 3294896 - RNA, 19 nt, Mycobacterium tuberculosis H37Rv
cagcgaaaugccggugccg

SEQ ID NO: 3294897 - RNA, 13 nt, Mycobacterium tuberculosis H37Rv
cagcgaaccgccg

SEQ ID NO: 3294898 - RNA, 14 nt, Mycobacterium tuberculosis H37Rv
cagcgaaccgccgg

SEQ ID NO: 3294899 - RNA, 16 nt, Mycobacterium tuberculosis H37Rv
cagcgaaccgccggca

SEQ ID NO: 3294900 - RNA, 17 nt, Mycobacterium tuberculosis H37Rv
cagcgaaccgccggcac

SEQ ID NO: 3294901 - RNA, 19 nt, Mycobacterium tuberculosis H37Rv
cagcgaaccgccggcaccg

SEQ ID NO: 3294902 - RNA, 13 nt, Mycobacterium tuberculosis H37Rv
cagcgaaccggcu

SEQ ID NO: 3294903 - RNA, 21 nt, Mycobacterium tuberculosis H37Rv
cagcgaaccggcugggcgcca

SEQ ID NO: 3294904 - RNA, 10 nt, Mycobacterium tuberculosis H37Rv
cagcgaacgg

SEQ ID NO: 3294905 - RNA, 13 nt, Mycobacterium tuberculosis H37Rv
cagcgaacggcca

SEQ ID NO: 3294906 - RNA, 14 nt, Mycobacterium tuberculosis H37Rv
cagcgaacggccag

SEQ ID NO: 3294907 - RNA, 13 nt, Mycobacterium tuberculosis H37Rv
cagcgaagccggg

SEQ ID NO: 3294908 - RNA, 16 nt, Mycobacterium tuberculosis H37Rv
cagcgaaggcgccgaa

SEQ ID NO: 3294909 - RNA, 20 nt, Mycobacterium tuberculosis H37Rv
cagcgaaggcgccgaacacc

SEQ ID NO: 3294910 - RNA, 15 nt, Mycobacterium tuberculosis H37Rv
cagcgacaacaccac

SEQ ID NO: 3294911 - RNA, 22 nt, Mycobacterium tuberculosis H37Rv
cagcgacagcgugccgaacagg

SEQ ID NO: 3294912 - RNA, 19 nt, Mycobacterium tuberculosis H37Rv
cagcgacaugcccgccaau

SEQ ID NO: 3294913 - RNA, 20 nt, Mycobacterium tuberculosis H37Rv
cagcgaccaaugcagugcga

SEQ ID NO: 3294914 - RNA, 17 nt, Mycobacterium tuberculosis H37Rv
cagcgacccggccagcg

SEQ ID NO: 3294915 - RNA, 12 nt, Mycobacterium tuberculosis H37Rv
cagcgacccguu

SEQ ID NO: 3294916 - RNA, 12 nt, Mycobacterium tuberculosis H37Rv
cagcgaccggua

SEQ ID NO: 3294917 - RNA, 17 nt, Mycobacterium tuberculosis H37Rv
cagcgaccgucguccag

SEQ ID NO: 3294918 - RNA, 14 nt, Mycobacterium tuberculosis H37Rv
cagcgaccucacga

SEQ ID NO: 3294919 - RNA, 20 nt, Mycobacterium tuberculosis H37Rv
cagcgaccucacugcggcgc

SEQ ID NO: 3294920 - RNA, 15 nt, Mycobacterium tuberculosis H37Rv
cagcgacgaagucgc

SEQ ID NO: 3294921 - RNA, 22 nt, Mycobacterium tuberculosis H37Rv
cagcgacgaagucgcagcugcc

SEQ ID NO: 3294922 - RNA, 19 nt, Mycobacterium tuberculosis H37Rv
cagcgacgaccacaccacg

SEQ ID NO: 3294923 - RNA, 17 nt, Mycobacterium tuberculosis H37Rv
cagcgacgagaucagcc

SEQ ID NO: 3294924 - RNA, 13 nt, Mycobacterium tuberculosis H37Rv
cagcgacgcacgc

SEQ ID NO: 3294925 - RNA, 13 nt, Mycobacterium tuberculosis H37Rv
cagcgacgccggc

SEQ ID NO: 3294926 - RNA, 16 nt, Mycobacterium tuberculosis H37Rv
cagcgacgccggcccg

SEQ ID NO: 3294927 - RNA, 21 nt, Mycobacterium tuberculosis H37Rv
cagcgacgcggucaucgagcu

SEQ ID NO: 3294928 - RNA, 14 nt, Mycobacterium tuberculosis H37Rv
cagcgacgcuagga

SEQ ID NO: 3294929 - RNA, 18 nt, Mycobacterium tuberculosis H37Rv
cagcgacgcuaggacggc

SEQ ID NO: 3294930 - RNA, 13 nt, Mycobacterium tuberculosis H37Rv
cagcgccgccacc

SEQ ID NO: 3294931 - RNA, 14 nt, Mycobacterium tuberculosis H37Rv
cagcgccgccaccg

SEQ ID NO: 3294932 - RNA, 17 nt, Mycobacterium tuberculosis H37Rv
cagcgccgccggcaccu

SEQ ID NO: 3294933 - RNA, 15 nt, Mycobacterium tuberculosis H37Rv
cagcgccgcgcccca

SEQ ID NO: 3294934 - RNA, 13 nt, Mycobacterium tuberculosis H37Rv
cagcgccgcgcgc

SEQ ID NO: 3294935 - RNA, 14 nt, Mycobacterium tuberculosis H37Rv
cagcgccgcgcgcg

SEQ ID NO: 3294936 - RNA, 17 nt, Mycobacterium tuberculosis H37Rv
cagcgccgcgcgggugc

SEQ ID NO: 3294937 - RNA, 19 nt, Mycobacterium tuberculosis H37Rv
cagcgccgcggcccgcucg

SEQ ID NO: 3294938 - RNA, 14 nt, Mycobacterium tuberculosis H37Rv
cagcgccgcguggc

SEQ ID NO: 3294939 - RNA, 22 nt, Mycobacterium tuberculosis H37Rv
cagcgccgcugacuccugcggc

SEQ ID NO: 3294940 - RNA, 14 nt, Mycobacterium tuberculosis H37Rv
cagcgccggcagca

SEQ ID NO: 3294941 - RNA, 17 nt, Mycobacterium tuberculosis H37Rv
cagcgccggcagcagca

SEQ ID NO: 3294942 - RNA, 20 nt, Mycobacterium tuberculosis H37Rv
cagcgccggccaagaccgcg

SEQ ID NO: 3294943 - RNA, 23 nt, Mycobacterium tuberculosis H37Rv
cagcgccggccaagaccgcggcc

SEQ ID NO: 3294944 - RNA, 21 nt, Mycobacterium tuberculosis H37Rv
cagcgccggccauaccgcucg

SEQ ID NO: 3294945 - RNA, 18 nt, Mycobacterium tuberculosis H37Rv
cagcgccuaccagcaccg

SEQ ID NO: 3294946 - RNA, 19 nt, Mycobacterium tuberculosis H37Rv
cagcgccucauccuccagu

SEQ ID NO: 3294947 - RNA, 17 nt, Mycobacterium tuberculosis H37Rv
cagcgccuccacucuuc

SEQ ID NO: 3294948 - RNA, 19 nt, Mycobacterium tuberculosis H37Rv
cagcgccuccacucuucgg

SEQ ID NO: 3294949 - RNA, 18 nt, Mycobacterium tuberculosis H37Rv
cagcgccuccagcaccac

SEQ ID NO: 3294950 - RNA, 19 nt, Mycobacterium tuberculosis H37Rv
cagcgccuccagcaccacg

SEQ ID NO: 3294951 - RNA, 13 nt, Mycobacterium tuberculosis H37Rv
cagcgccucgacc

SEQ ID NO: 3294952 - RNA, 17 nt, Mycobacterium tuberculosis H37Rv
cagcgccugcgcccagc

SEQ ID NO: 3294953 - RNA, 15 nt, Mycobacterium tuberculosis H37Rv
cagcgccugcgcgca

SEQ ID NO: 3294954 - RNA, 16 nt, Mycobacterium tuberculosis H37Rv
cagcgccugcggcagc

SEQ ID NO: 3294955 - RNA, 18 nt, Mycobacterium tuberculosis H37Rv
cagcgccuuguggcacac

SEQ ID NO: 3294956 - RNA, 21 nt, Mycobacterium tuberculosis H37Rv
cagcgccuuguggcacacccg

SEQ ID NO: 3294957 - RNA, 22 nt, Mycobacterium tuberculosis H37Rv
cagcgccuuguggcacacccgc

SEQ ID NO: 3294958 - RNA, 23 nt, Mycobacterium tuberculosis H37Rv
cagcgccuuguggcacacccgca

SEQ ID NO: 3294959 - RNA, 21 nt, Mycobacterium tuberculosis H37Rv
cagcgcgaacaccaugaucag

SEQ ID NO: 3294960 - RNA, 22 nt, Mycobacterium tuberculosis H37Rv
cagcgcgaacaccaugaucagg

SEQ ID NO: 3294961 - RNA, 16 nt, Mycobacterium tuberculosis H37Rv
cagcgcgaacgccugc

SEQ ID NO: 3294962 - RNA, 16 nt, Mycobacterium tuberculosis H37Rv
cagcgcgaccaaugcg

SEQ ID NO: 3294963 - RNA, 23 nt, Mycobacterium tuberculosis H37Rv
cagcgcgacccguagcuuggcga

SEQ ID NO: 3294964 - RNA, 17 nt, Mycobacterium tuberculosis H37Rv
cagcgcgacguccacca

SEQ ID NO: 3294965 - RNA, 20 nt, Mycobacterium tuberculosis H37Rv
cagcgcgacguccaccagcc

SEQ ID NO: 3294966 - RNA, 22 nt, Mycobacterium tuberculosis H37Rv
cagcgcgacguccaccagccgg

SEQ ID NO: 3294967 - RNA, 16 nt, Mycobacterium tuberculosis H37Rv
cagcgcgagaucagcc

SEQ ID NO: 3294968 - RNA, 22 nt, Mycobacterium tuberculosis H37Rv
cagcgcgagcccgaaccaccgc

SEQ ID NO: 3294969 - RNA, 16 nt, Mycobacterium tuberculosis H37Rv
cagcgcgaucaacgcg

SEQ ID NO: 3294970 - RNA, 19 nt, Mycobacterium tuberculosis H37Rv
cagcgcgaucaacgcguug

SEQ ID NO: 3294971 - RNA, 13 nt, Mycobacterium tuberculosis H37Rv
cagcgcgaucacc

SEQ ID NO: 3294972 - RNA, 14 nt, Mycobacterium tuberculosis H37Rv
cagcgcgaucaccg

SEQ ID NO: 3294973 - RNA, 22 nt, Mycobacterium tuberculosis H37Rv
cagcgcgaucaccgagucgacg

SEQ ID NO: 3294974 - RNA, 13 nt, Mycobacterium tuberculosis H37Rv
cagcgcgaucgau

SEQ ID NO: 3294975 - RNA, 20 nt, Mycobacterium tuberculosis H37Rv
cagcgcgaucugcucgcccc

SEQ ID NO: 3294976 - RNA, 13 nt, Mycobacterium tuberculosis H37Rv
cagcgcgccagcu

SEQ ID NO: 3294977 - RNA, 19 nt, Mycobacterium tuberculosis H37Rv
cagcgcgcccgacacccgu

SEQ ID NO: 3294978 - RNA, 14 nt, Mycobacterium tuberculosis H37Rv
cagcgcgccgcguu

SEQ ID NO: 3294979 - RNA, 12 nt, Mycobacterium tuberculosis H37Rv
cagcgcgccgua

SEQ ID NO: 3294980 - RNA, 14 nt, Mycobacterium tuberculosis H37Rv
cagcgcgcgccgcu

SEQ ID NO: 3294981 - RNA, 15 nt, Mycobacterium tuberculosis H37Rv
cagcgcgcgccgcug

SEQ ID NO: 3294982 - RNA, 20 nt, Mycobacterium tuberculosis H37Rv
cagcgcgcgccgcuggguga

SEQ ID NO: 3294983 - RNA, 18 nt, Mycobacterium tuberculosis H37Rv
cagcgcgcgcucgggccc

SEQ ID NO: 3294984 - RNA, 14 nt, Mycobacterium tuberculosis H37Rv
cagcgcgcugcagu

SEQ ID NO: 3294985 - RNA, 21 nt, Mycobacterium tuberculosis H37Rv
cagcgcggaugucggcaucga

SEQ ID NO: 3294986 - RNA, 22 nt, Mycobacterium tuberculosis H37Rv
cagcgcggauucgguuagcgcg

SEQ ID NO: 3294987 - RNA, 20 nt, Mycobacterium tuberculosis H37Rv
cagcgcggcaaaguuggccg

SEQ ID NO: 3294988 - RNA, 12 nt, Mycobacterium tuberculosis H37Rv
cagcgcggcacg

SEQ ID NO: 3294989 - RNA, 19 nt, Mycobacterium tuberculosis H37Rv
cagcgcggccaccaccgag

SEQ ID NO: 3294990 - RNA, 14 nt, Mycobacterium tuberculosis H37Rv
cagcgcggccaccc

SEQ ID NO: 3294991 - RNA, 15 nt, Mycobacterium tuberculosis H37Rv
cagcgcggccacccg

SEQ ID NO: 3294992 - RNA, 17 nt, Mycobacterium tuberculosis H37Rv
cagcgcggccacccgcg

SEQ ID NO: 3294993 - RNA, 20 nt, Mycobacterium tuberculosis H37Rv
cagcgcggccauuagcagca

SEQ ID NO: 3294994 - RNA, 18 nt, Mycobacterium tuberculosis H37Rv
cagcgcggcgcacaaccc

SEQ ID NO: 3294995 - RNA, 14 nt, Mycobacterium tuberculosis H37Rv
cagcgcggcgcccu

SEQ ID NO: 3294996 - RNA, 22 nt, Mycobacterium tuberculosis H37Rv
cagcgcggcgcccuggccgccc

SEQ ID NO: 3294997 - RNA, 13 nt, Mycobacterium tuberculosis H37Rv
cagcgcggcgcga

SEQ ID NO: 3294998 - RNA, 15 nt, Mycobacterium tuberculosis H37Rv
cagcgcggcgcgaca

SEQ ID NO: 3294999 - RNA, 18 nt, Mycobacterium tuberculosis H37Rv
cagcgcgggacacgucgc

SEQ ID NO: 3295000 - RNA, 22 nt, Mycobacterium tuberculosis H37Rv
cagcgcgggacacgucgcgcca

SEQ ID NO: 3295001 - RNA, 23 nt, Mycobacterium tuberculosis H37Rv
cagcgcgguggucagcaccggcg

SEQ ID NO: 3295002 - RNA, 18 nt, Mycobacterium tuberculosis H37Rv
cagcgcguaguccgcauc

SEQ ID NO: 3295003 - RNA, 20 nt, Mycobacterium tuberculosis H37Rv
cagcgcgucgccgaaagccu

SEQ ID NO: 3295004 - RNA, 14 nt, Mycobacterium tuberculosis H37Rv
cagcgcgucgccgu

SEQ ID NO: 3295005 - RNA, 20 nt, Mycobacterium tuberculosis H37Rv
cagcgcgucguccagggcga

SEQ ID NO: 3295006 - RNA, 13 nt, Mycobacterium tuberculosis H37Rv
cagcgcguggaac

SEQ ID NO: 3295007 - RNA, 14 nt, Mycobacterium tuberculosis H37Rv
cagcgcguggaacu

SEQ ID NO: 3295008 - RNA, 19 nt, Mycobacterium tuberculosis H37Rv
cagcgcgugguaccgcuug

SEQ ID NO: 3295009 - RNA, 17 nt, Mycobacterium tuberculosis H37Rv
cagcgcguucggcaccu

SEQ ID NO: 3295010 - RNA, 20 nt, Mycobacterium tuberculosis H37Rv
cagcgcguucggcaccuggu

SEQ ID NO: 3295011 - RNA, 13 nt, Mycobacterium tuberculosis H37Rv
cagcgcuagccgg

SEQ ID NO: 3295012 - RNA, 13 nt, Mycobacterium tuberculosis H37Rv
cagcgcucaccgg

SEQ ID NO: 3295013 - RNA, 16 nt, Mycobacterium tuberculosis H37Rv
cagcgcuccagcaccc

SEQ ID NO: 3295014 - RNA, 17 nt, Mycobacterium tuberculosis H37Rv
cagcgcuccagcacccg

SEQ ID NO: 3295015 - RNA, 13 nt, Mycobacterium tuberculosis H37Rv
cagcgcuccagcc

SEQ ID NO: 3295016 - RNA, 15 nt, Mycobacterium tuberculosis H37Rv
cagcgcuccagccgc

SEQ ID NO: 3295017 - RNA, 15 nt, Mycobacterium tuberculosis H37Rv
cagcgcugccaccgc

SEQ ID NO: 3295018 - RNA, 18 nt, Mycobacterium tuberculosis H37Rv
cagcgcugccaccgcggu

SEQ ID NO: 3295019 - RNA, 20 nt, Mycobacterium tuberculosis H37Rv
cagcgcuggcaggccgggca

SEQ ID NO: 3295020 - RNA, 22 nt, Mycobacterium tuberculosis H37Rv
cagcgcugucguaccgcggauc

SEQ ID NO: 3295021 - RNA, 18 nt, Mycobacterium tuberculosis H37Rv
cagcgcuucgucggccgg

SEQ ID NO: 3295022 - RNA, 22 nt, Mycobacterium tuberculosis H37Rv
cagcggaaccgagggccgucac

SEQ ID NO: 3295023 - RNA, 21 nt, Mycobacterium tuberculosis H37Rv
cagcggaacugggcccccaau

SEQ ID NO: 3295024 - RNA, 19 nt, Mycobacterium tuberculosis H37Rv
cagcggaauuagucgccgc

SEQ ID NO: 3295025 - RNA, 16 nt, Mycobacterium tuberculosis H37Rv
cagcggagacgaucgc

SEQ ID NO: 3295026 - RNA, 17 nt, Mycobacterium tuberculosis H37Rv
cagcgucaccucaccga

SEQ ID NO: 3295027 - RNA, 22 nt, Mycobacterium tuberculosis H37Rv
cagcgucagcuguuugccggcu

SEQ ID NO: 3295028 - RNA, 13 nt, Mycobacterium tuberculosis H37Rv
cagcgucaggugc

SEQ ID NO: 3295029 - RNA, 18 nt, Mycobacterium tuberculosis H37Rv
cagcgucauccucgucgu

SEQ ID NO: 3295030 - RNA, 19 nt, Mycobacterium tuberculosis H37Rv
cagcguccaaaccuucaac

SEQ ID NO: 3295031 - RNA, 13 nt, Mycobacterium tuberculosis H37Rv
cagcguccaaccc

SEQ ID NO: 3295032 - RNA, 21 nt, Mycobacterium tuberculosis H37Rv
cagcguccagccgcccucggg

SEQ ID NO: 3295033 - RNA, 17 nt, Mycobacterium tuberculosis H37Rv
cagcguccagcgccugc

SEQ ID NO: 3295034 - RNA, 14 nt, Mycobacterium tuberculosis H37Rv
cagcgucccgaugu

SEQ ID NO: 3295035 - RNA, 21 nt, Mycobacterium tuberculosis H37Rv
cagcguccuggcguagugcag

SEQ ID NO: 3295036 - RNA, 21 nt, Mycobacterium tuberculosis H37Rv
cagcgucgacugaacgguuuc

SEQ ID NO: 3295037 - RNA, 21 nt, Mycobacterium tuberculosis H37Rv
cagcgucgcaaggcccgcacc

SEQ ID NO: 3295038 - RNA, 16 nt, Mycobacterium tuberculosis H37Rv
cagcgucgcggccacg

SEQ ID NO: 3295039 - RNA, 23 nt, Mycobacterium tuberculosis H37Rv
cagcgucgcggccacggucagcc

SEQ ID NO: 3295040 - RNA, 20 nt, Mycobacterium tuberculosis H37Rv
cagcgucgguggcagcggug

SEQ ID NO: 3295041 - RNA, 14 nt, Mycobacterium tuberculosis H37Rv
cagcgucuccuuga

SEQ ID NO: 3295042 - RNA, 14 nt, Mycobacterium tuberculosis H37Rv
cagcgucucgccgg

SEQ ID NO: 3295043 - RNA, 17 nt, Mycobacterium tuberculosis H37Rv
cagcgucucggaggcga

SEQ ID NO: 3295044 - RNA, 22 nt, Mycobacterium tuberculosis H37Rv
cagcgucucggaggcgaccacg

SEQ ID NO: 3295045 - RNA, 16 nt, Mycobacterium tuberculosis H37Rv
cagcgucugugucccg

SEQ ID NO: 3295046 - RNA, 20 nt, Mycobacterium tuberculosis H37Rv
cagcgucugugucccgucga

SEQ ID NO: 3295047 - RNA, 13 nt, Mycobacterium tuberculosis H37Rv
cagcgugaacuga

SEQ ID NO: 3295048 - RNA, 16 nt, Mycobacterium tuberculosis H37Rv
cagcgugagugcagca

SEQ ID NO: 3295049 - RNA, 21 nt, Mycobacterium tuberculosis H37Rv
cagcgugagugcagcacgauc

SEQ ID NO: 3295050 - RNA, 18 nt, Mycobacterium tuberculosis H37Rv
cagcgugaucuggccacg

SEQ ID NO: 3295051 - RNA, 20 nt, Mycobacterium tuberculosis H37Rv
cagcgugcagcggcgggcga

SEQ ID NO: 3295052 - RNA, 20 nt, Mycobacterium tuberculosis H37Rv
cagcgugcccgccaccggcg

SEQ ID NO: 3295053 - RNA, 21 nt, Mycobacterium tuberculosis H37Rv
cagcgugccgguggcgccgcc

SEQ ID NO: 3295054 - RNA, 15 nt, Mycobacterium tuberculosis H37Rv
cagcgugcgcuggcu

SEQ ID NO: 3295055 - RNA, 19 nt, Mycobacterium tuberculosis H37Rv
cagcgugcgcuggcugaca

SEQ ID NO: 3295056 - RNA, 23 nt, Mycobacterium tuberculosis H37Rv
cagcgugcggggcgccugaugcg

SEQ ID NO: 3295057 - RNA, 19 nt, Mycobacterium tuberculosis H37Rv
cagcguggacgcccgcccg

SEQ ID NO: 3295058 - RNA, 23 nt, Mycobacterium tuberculosis H37Rv
cagcguggacguacugucgucgc

SEQ ID NO: 3295059 - RNA, 20 nt, Mycobacterium tuberculosis H37Rv
cagcguggagcgcaaguuga

SEQ ID NO: 3295060 - RNA, 13 nt, Mycobacterium tuberculosis H37Rv
cagcguggcuggc

SEQ ID NO: 3295061 - RNA, 22 nt, Mycobacterium tuberculosis H37Rv
cagcguggcuggcaccucccgg

SEQ ID NO: 3295062 - RNA, 19 nt, Mycobacterium tuberculosis H37Rv
cagcgugggcagcgcgauc

SEQ ID NO: 3295063 - RNA, 16 nt, Mycobacterium tuberculosis H37Rv
cagcgugggcauuccc

SEQ ID NO: 3295064 - RNA, 19 nt, Mycobacterium tuberculosis H37Rv
cagcguggggccgccacca

SEQ ID NO: 3295065 - RNA, 20 nt, Mycobacterium tuberculosis H37Rv
cagcguggugaagucggugc

SEQ ID NO: 3295066 - RNA, 14 nt, Mycobacterium tuberculosis H37Rv
cagcguggugaucc

SEQ ID NO: 3295067 - RNA, 14 nt, Mycobacterium tuberculosis H37Rv
cagcgugucgccga

SEQ ID NO: 3295068 - RNA, 22 nt, Mycobacterium tuberculosis H37Rv
cagcgugucuugucgcgcagca

SEQ ID NO: 3295069 - RNA, 22 nt, Mycobacterium tuberculosis H37Rv
cagcguguugcguucggugauc

SEQ ID NO: 3295070 - RNA, 19 nt, Mycobacterium tuberculosis H37Rv
cagcguuaggucgccggcu

SEQ ID NO: 3295071 - RNA, 17 nt, Mycobacterium tuberculosis H37Rv
cagcguucccgccggcu

SEQ ID NO: 3295072 - RNA, 23 nt, Mycobacterium tuberculosis H37Rv
cagcguucccgccggcuccgcca

SEQ ID NO: 3295073 - RNA, 21 nt, Mycobacterium tuberculosis H37Rv
cagcguucgguugaacgaccu

SEQ ID NO: 3295074 - RNA, 14 nt, Mycobacterium tuberculosis H37Rv
cagcguuggccgcu

SEQ ID NO: 3295075 - RNA, 15 nt, Mycobacterium tuberculosis H37Rv
cagcguuggcggcga

SEQ ID NO: 3295076 - RNA, 15 nt, Mycobacterium tuberculosis H37Rv
cagcguugucgggug

SEQ ID NO: 3295077 - RNA, 21 nt, Mycobacterium tuberculosis H37Rv
cagcguugucggguggcugcu

SEQ ID NO: 3295078 - RNA, 23 nt, Mycobacterium tuberculosis H37Rv
cagcguugucggguggcugcugg

SEQ ID NO: 3295079 - RNA, 15 nt, Mycobacterium tuberculosis H37Rv
cagcguuugaacgca

SEQ ID NO: 3295080 - RNA, 18 nt, Mycobacterium tuberculosis H37Rv
cagcguuugaacgcaugc

SEQ ID NO: 3295081 - RNA, 15 nt, Mycobacterium tuberculosis H37Rv
cagcuaacccgccac

SEQ ID NO: 3295082 - RNA, 22 nt, Mycobacterium tuberculosis H37Rv
cagcuacggggcggucgagcca

SEQ ID NO: 3295083 - RNA, 17 nt, Mycobacterium tuberculosis H37Rv
cagcuagaccgaucacc

SEQ ID NO: 3295084 - RNA, 13 nt, Mycobacterium tuberculosis H37Rv
cagcuagcccggc

SEQ ID NO: 3295085 - RNA, 20 nt, Mycobacterium tuberculosis H37Rv
cagcuagcccggcagcacgu

SEQ ID NO: 3295086 - RNA, 23 nt, Mycobacterium tuberculosis H37Rv
cagcucaccacccgcacuccaag

SEQ ID NO: 3295087 - RNA, 20 nt, Mycobacterium tuberculosis H37Rv
cagcucacccggagcacccg

SEQ ID NO: 3295088 - RNA, 22 nt, Mycobacterium tuberculosis H37Rv
cagcucacccggagcacccggg

SEQ ID NO: 3295089 - RNA, 14 nt, Mycobacterium tuberculosis H37Rv
cagcucacgacugg

SEQ ID NO: 3295090 - RNA, 15 nt, Mycobacterium tuberculosis H37Rv
cagcucacgacuggc

SEQ ID NO: 3295091 - RNA, 14 nt, Mycobacterium tuberculosis H37Rv
cagcucagcugcgg

SEQ ID NO: 3295092 - RNA, 22 nt, Mycobacterium tuberculosis H37Rv
cagcucagugaugcgccccgga

SEQ ID NO: 3295093 - RNA, 17 nt, Mycobacterium tuberculosis H37Rv
cagcuccacuggcgucu

SEQ ID NO: 3295094 - RNA, 15 nt, Mycobacterium tuberculosis H37Rv
cagcuccccgccgga

SEQ ID NO: 3295095 - RNA, 18 nt, Mycobacterium tuberculosis H37Rv
cagcucccgccacgucgc

SEQ ID NO: 3295096 - RNA, 15 nt, Mycobacterium tuberculosis H37Rv
cagcucccgcggcgc

SEQ ID NO: 3295097 - RNA, 17 nt, Mycobacterium tuberculosis H37Rv
cagcucccgcggcgcca

SEQ ID NO: 3295098 - RNA, 23 nt, Mycobacterium tuberculosis H37Rv
cagcucccgcggcgccacccgcg

SEQ ID NO: 3295099 - RNA, 13 nt, Mycobacterium tuberculosis H37Rv
cagcuccgccugc

SEQ ID NO: 3295100 - RNA, 14 nt, Mycobacterium tuberculosis H37Rv
cagcuccggcgcuc

SEQ ID NO: 3295101 - RNA, 19 nt, Mycobacterium tuberculosis H37Rv
cagcuccggcgcuccacug

SEQ ID NO: 3295102 - RNA, 17 nt, Mycobacterium tuberculosis H37Rv
cagcuccgggucgacga

SEQ ID NO: 3295103 - RNA, 23 nt, Mycobacterium tuberculosis H37Rv
cagcuccgggucgacgacgucgc

SEQ ID NO: 3295104 - RNA, 14 nt, Mycobacterium tuberculosis H37Rv
cagcuccucagcca

SEQ ID NO: 3295105 - RNA, 19 nt, Mycobacterium tuberculosis H37Rv
cagcuccucagccaccgcg

SEQ ID NO: 3295106 - RNA, 21 nt, Mycobacterium tuberculosis H37Rv
cagcuccucagccaccgcggu

SEQ ID NO: 3295107 - RNA, 21 nt, Mycobacterium tuberculosis H37Rv
cagcuccuguaacugcuccug

SEQ ID NO: 3295108 - RNA, 22 nt, Mycobacterium tuberculosis H37Rv
cagcuccuguaacugcuccugg

SEQ ID NO: 3295109 - RNA, 15 nt, Mycobacterium tuberculosis H37Rv
cagcuccuugagguc

SEQ ID NO: 3295110 - RNA, 23 nt, Mycobacterium tuberculosis H37Rv
cagcuccuuggcuaacaccgcag

SEQ ID NO: 3295111 - RNA, 14 nt, Mycobacterium tuberculosis H37Rv
cagcucgaccagga

SEQ ID NO: 3295112 - RNA, 18 nt, Mycobacterium tuberculosis H37Rv
cagcucgaccugaggcac

SEQ ID NO: 3295113 - RNA, 21 nt, Mycobacterium tuberculosis H37Rv
cagcucgaggaccaccugguc

SEQ ID NO: 3295114 - RNA, 19 nt, Mycobacterium tuberculosis H37Rv
cagcucgagguccucagcg

SEQ ID NO: 3295115 - RNA, 16 nt, Mycobacterium tuberculosis H37Rv
cagcucgauacccaga

SEQ ID NO: 3295116 - RNA, 22 nt, Mycobacterium tuberculosis H37Rv
cagcucgauacccaggaugugu

SEQ ID NO: 3295117 - RNA, 18 nt, Mycobacterium tuberculosis H37Rv
cagcucgaucacgccggc

SEQ ID NO: 3295118 - RNA, 16 nt, Mycobacterium tuberculosis H37Rv
cagcucgaucagccgg

SEQ ID NO: 3295119 - RNA, 16 nt, Mycobacterium tuberculosis H37Rv
cagcucgcacucguug

SEQ ID NO: 3295120 - RNA, 23 nt, Mycobacterium tuberculosis H37Rv
cagcucgcacucguugccgacca

SEQ ID NO: 3295121 - RNA, 15 nt, Mycobacterium tuberculosis H37Rv
cagcuugcugcgcac

SEQ ID NO: 3295122 - RNA, 16 nt, Mycobacterium tuberculosis H37Rv
cagcuugcugcgcacc

SEQ ID NO: 3295123 - RNA, 20 nt, Mycobacterium tuberculosis H37Rv
cagcuugcugcgcaccaagg

SEQ ID NO: 3295124 - RNA, 16 nt, Mycobacterium tuberculosis H37Rv
cagcuuggacccugcg

SEQ ID NO: 3295125 - RNA, 21 nt, Mycobacterium tuberculosis H37Rv
cagcuuggacccugcgccgcc

SEQ ID NO: 3295126 - RNA, 22 nt, Mycobacterium tuberculosis H37Rv
cagcuuggacccugcgccgcca

SEQ ID NO: 3295127 - RNA, 24 nt, Mycobacterium tuberculosis H37Rv
cagcuuggagaggcggugcagcuc

SEQ ID NO: 3295128 - RNA, 18 nt, Mycobacterium tuberculosis H37Rv
cagcuuggcaaccuguuc

SEQ ID NO: 3295129 - RNA, 14 nt, Mycobacterium tuberculosis H37Rv
cagcuuggccagcc

SEQ ID NO: 3295130 - RNA, 19 nt, Mycobacterium tuberculosis H37Rv
cagcuuggcgucgaugcgg

SEQ ID NO: 3295131 - RNA, 20 nt, Mycobacterium tuberculosis H37Rv
cagcuugguggcguggcccu

SEQ ID NO: 3295132 - RNA, 19 nt, Mycobacterium tuberculosis H37Rv
cagcuugucgggcaccggu

SEQ ID NO: 3295133 - RNA, 21 nt, Mycobacterium tuberculosis H37Rv
cagcuuugacgcccucggcga

SEQ ID NO: 3295134 - RNA, 15 nt, Mycobacterium tuberculosis H37Rv
cagcuuugagucccg

SEQ ID NO: 3295135 - RNA, 20 nt, Mycobacterium tuberculosis H37Rv
cagcuuugguaccgagcaca

SEQ ID NO: 3295136 - RNA, 20 nt, Mycobacterium tuberculosis H37Rv
caggaaaaccccggccacca

SEQ ID NO: 3295137 - RNA, 23 nt, Mycobacterium tuberculosis H37Rv
caggaacaaguagccgucgucgu

SEQ ID NO: 3295138 - RNA, 16 nt, Mycobacterium tuberculosis H37Rv
caggaacaaugagauc

SEQ ID NO: 3295139 - RNA, 20 nt, Mycobacterium tuberculosis H37Rv
caggaaccacccaccggcca

SEQ ID NO: 3295140 - RNA, 20 nt, Mycobacterium tuberculosis H37Rv
caggaaccaguccucgacgu

SEQ ID NO: 3295141 - RNA, 12 nt, Mycobacterium tuberculosis H37Rv
caggaacgccgu

SEQ ID NO: 3295142 - RNA, 19 nt, Mycobacterium tuberculosis H37Rv
caggaacucggcccacacg

SEQ ID NO: 3295143 - RNA, 15 nt, Mycobacterium tuberculosis H37Rv
caggaagaagccgaa

SEQ ID NO: 3295144 - RNA, 12 nt, Mycobacterium tuberculosis H37Rv
caggaagcccac

SEQ ID NO: 3295145 - RNA, 16 nt, Mycobacterium tuberculosis H37Rv
caggaagcccacgauc

SEQ ID NO: 3295146 - RNA, 15 nt, Mycobacterium tuberculosis H37Rv
caggaagccggcgug

SEQ ID NO: 3295147 - RNA, 14 nt, Mycobacterium tuberculosis H37Rv
caggaagucccggg

SEQ ID NO: 3295148 - RNA, 13 nt, Mycobacterium tuberculosis H37Rv
caggaagucgcgg

SEQ ID NO: 3295149 - RNA, 22 nt, Mycobacterium tuberculosis H37Rv
caggaaucgggucagcaccacc

SEQ ID NO: 3295150 - RNA, 23 nt, Mycobacterium tuberculosis H37Rv
caggaaugaucguuccgauccgg

SEQ ID NO: 3295151 - RNA, 14 nt, Mycobacterium tuberculosis H37Rv
caggaaugccgcgg

SEQ ID NO: 3295152 - RNA, 19 nt, Mycobacterium tuberculosis H37Rv
caggaaugccgcggggauc

SEQ ID NO: 3295153 - RNA, 11 nt, Mycobacterium tuberculosis H37Rv
caggaauugcc

SEQ ID NO: 3295154 - RNA, 24 nt, Mycobacterium tuberculosis H37Rv
caggacaccuaccgagaucaccgc

SEQ ID NO: 3295155 - RNA, 22 nt, Mycobacterium tuberculosis H37Rv
caggacaccuugcguccguagc

SEQ ID NO: 3295156 - RNA, 14 nt, Mycobacterium tuberculosis H37Rv
caggaccagcaccg

SEQ ID NO: 3295157 - RNA, 17 nt, Mycobacterium tuberculosis H37Rv
caggaccagcaccgccg

SEQ ID NO: 3295158 - RNA, 16 nt, Mycobacterium tuberculosis H37Rv
caggaccggcugcagg

SEQ ID NO: 3295159 - RNA, 22 nt, Mycobacterium tuberculosis H37Rv
caggaccgggaucgucaggccc

SEQ ID NO: 3295160 - RNA, 21 nt, Mycobacterium tuberculosis H37Rv
caggacgaacgcgucggucga

SEQ ID NO: 3295161 - RNA, 22 nt, Mycobacterium tuberculosis H37Rv
caggacgacuggaaggcgggca

SEQ ID NO: 3295162 - RNA, 18 nt, Mycobacterium tuberculosis H37Rv
caggacgcccacaugcuc

SEQ ID NO: 3295163 - RNA, 15 nt, Mycobacterium tuberculosis H37Rv
caggacgcgaucggc

SEQ ID NO: 3295164 - RNA, 14 nt, Mycobacterium tuberculosis H37Rv
caggacgcgggcua

SEQ ID NO: 3295165 - RNA, 22 nt, Mycobacterium tuberculosis H37Rv
caggacgcgggcuaucgguuca

SEQ ID NO: 3295166 - RNA, 15 nt, Mycobacterium tuberculosis H37Rv
caggacgcugccggu

SEQ ID NO: 3295167 - RNA, 16 nt, Mycobacterium tuberculosis H37Rv
caggacggaucgucgu

SEQ ID NO: 3295168 - RNA, 17 nt, Mycobacterium tuberculosis H37Rv
caggacggcuaccaccg

SEQ ID NO: 3295169 - RNA, 23 nt, Mycobacterium tuberculosis H37Rv
caggacggugaucuugccggcca

SEQ ID NO: 3295170 - RNA, 16 nt, Mycobacterium tuberculosis H37Rv
caggacgucggcgaau

SEQ ID NO: 3295171 - RNA, 23 nt, Mycobacterium tuberculosis H37Rv
caggacgugucgguacugacagu

SEQ ID NO: 3295172 - RNA, 16 nt, Mycobacterium tuberculosis H37Rv
caggacuccggccgca

SEQ ID NO: 3295173 - RNA, 18 nt, Mycobacterium tuberculosis H37Rv
caggacuggcaccgccag

SEQ ID NO: 3295174 - RNA, 23 nt, Mycobacterium tuberculosis H37Rv
caggacuggcaccgccagccacc

SEQ ID NO: 3295175 - RNA, 19 nt, Mycobacterium tuberculosis H37Rv
caggagaacacauccgcuu

SEQ ID NO: 3295176 - RNA, 21 nt, Mycobacterium tuberculosis H37Rv
caggagaauuaguuucguccc

SEQ ID NO: 3295177 - RNA, 11 nt, Mycobacterium tuberculosis H37Rv
caggagcagca

SEQ ID NO: 3295178 - RNA, 15 nt, Mycobacterium tuberculosis H37Rv
caggagccuccagcg

SEQ ID NO: 3295179 - RNA, 20 nt, Mycobacterium tuberculosis H37Rv
caggagcgccgucaucgcag

SEQ ID NO: 3295180 - RNA, 14 nt, Mycobacterium tuberculosis H37Rv
caggagugcgggca

SEQ ID NO: 3295181 - RNA, 20 nt, Mycobacterium tuberculosis H37Rv
caggaguuugaccaccuggu

SEQ ID NO: 3295182 - RNA, 19 nt, Mycobacterium tuberculosis H37Rv
caggaucacacuggccugc

SEQ ID NO: 3295183 - RNA, 21 nt, Mycobacterium tuberculosis H37Rv
caggaucacacuggccugcuc

SEQ ID NO: 3295184 - RNA, 23 nt, Mycobacterium tuberculosis H37Rv
caggaucacacuggccugcucaa

SEQ ID NO: 3295185 - RNA, 22 nt, Mycobacterium tuberculosis H37Rv
caggaucagcccggacguaggc

SEQ ID NO: 3295186 - RNA, 18 nt, Mycobacterium tuberculosis H37Rv
caggaucccgguggcagc

SEQ ID NO: 3295187 - RNA, 16 nt, Mycobacterium tuberculosis H37Rv
caggauccguggccaa

SEQ ID NO: 3295188 - RNA, 17 nt, Mycobacterium tuberculosis H37Rv
caggaucgaggcgucgg

SEQ ID NO: 3295189 - RNA, 21 nt, Mycobacterium tuberculosis H37Rv
caggaucgccugagcgccgcg

SEQ ID NO: 3295190 - RNA, 22 nt, Mycobacterium tuberculosis H37Rv
caggaucgccugagcgccgcgg

SEQ ID NO: 3295191 - RNA, 15 nt, Mycobacterium tuberculosis H37Rv
caggaucggcggaua

SEQ ID NO: 3295192 - RNA, 17 nt, Mycobacterium tuberculosis H37Rv
caggaucucuucucggc

SEQ ID NO: 3295193 - RNA, 20 nt, Mycobacterium tuberculosis H37Rv
caggaucuguuugggcaucu

SEQ ID NO: 3295194 - RNA, 16 nt, Mycobacterium tuberculosis H37Rv
caggaugaagacgcgg

SEQ ID NO: 3295195 - RNA, 19 nt, Mycobacterium tuberculosis H37Rv
caggaugaugaccgccauc

SEQ ID NO: 3295196 - RNA, 20 nt, Mycobacterium tuberculosis H37Rv
caggaugccugccacccguu

SEQ ID NO: 3295197 - RNA, 23 nt, Mycobacterium tuberculosis H37Rv
caggauggacucgacaauucgca

SEQ ID NO: 3295198 - RNA, 14 nt, Mycobacterium tuberculosis H37Rv
caggauggccauca

SEQ ID NO: 3295199 - RNA, 19 nt, Mycobacterium tuberculosis H37Rv
caggauggugcggccgcgg

SEQ ID NO: 3295200 - RNA, 22 nt, Mycobacterium tuberculosis H37Rv
caggauggugcggccgcggcga

SEQ ID NO: 3295201 - RNA, 21 nt, Mycobacterium tuberculosis H37Rv
caggauguguugccagaucag

SEQ ID NO: 3295202 - RNA, 14 nt, Mycobacterium tuberculosis H37Rv
caggauucccaguc

SEQ ID NO: 3295203 - RNA, 17 nt, Mycobacterium tuberculosis H37Rv
caggauugccgccguug

SEQ ID NO: 3295204 - RNA, 13 nt, Mycobacterium tuberculosis H37Rv
caggauuucgcag

SEQ ID NO: 3295205 - RNA, 20 nt, Mycobacterium tuberculosis H37Rv
caggcaagccagcacugcca

SEQ ID NO: 3295206 - RNA, 22 nt, Mycobacterium tuberculosis H37Rv
caggcaaguugugagggaggcc

SEQ ID NO: 3295207 - RNA, 20 nt, Mycobacterium tuberculosis H37Rv
caggcacguccgaucggcgc

SEQ ID NO: 3295208 - RNA, 13 nt, Mycobacterium tuberculosis H37Rv
caggcacuccagc

SEQ ID NO: 3295209 - RNA, 16 nt, Mycobacterium tuberculosis H37Rv
caggcagcggcgacac

SEQ ID NO: 3295210 - RNA, 14 nt, Mycobacterium tuberculosis H37Rv
caggcagcuccgcc

SEQ ID NO: 3295211 - RNA, 16 nt, Mycobacterium tuberculosis H37Rv
caggcagcucggcaac

SEQ ID NO: 3295212 - RNA, 18 nt, Mycobacterium tuberculosis H37Rv
caggcagcucggcaacgu

SEQ ID NO: 3295213 - RNA, 15 nt, Mycobacterium tuberculosis H37Rv
caggcagggcagccc

SEQ ID NO: 3295214 - RNA, 17 nt, Mycobacterium tuberculosis H37Rv
caggcagguuggccacc

SEQ ID NO: 3295215 - RNA, 17 nt, Mycobacterium tuberculosis H37Rv
caggcaguccaccgcgc

SEQ ID NO: 3295216 - RNA, 17 nt, Mycobacterium tuberculosis H37Rv
caggcgcgcaccaccgc

SEQ ID NO: 3295217 - RNA, 15 nt, Mycobacterium tuberculosis H37Rv
caggcgcgccgcacc

SEQ ID NO: 3295218 - RNA, 17 nt, Mycobacterium tuberculosis H37Rv
caggcgcgccgcacccg

SEQ ID NO: 3295219 - RNA, 16 nt, Mycobacterium tuberculosis H37Rv
caggcgcggcccaggu

SEQ ID NO: 3295220 - RNA, 16 nt, Mycobacterium tuberculosis H37Rv
caggcgcucaucaccc

SEQ ID NO: 3295221 - RNA, 20 nt, Mycobacterium tuberculosis H37Rv
caggcgcucaucacccagcg

SEQ ID NO: 3295222 - RNA, 19 nt, Mycobacterium tuberculosis H37Rv
caggcgcucgaaggccgca

SEQ ID NO: 3295223 - RNA, 14 nt, Mycobacterium tuberculosis H37Rv
caggcgcugccggu

SEQ ID NO: 3295224 - RNA, 14 nt, Mycobacterium tuberculosis H37Rv
caggcggacgccgc

SEQ ID NO: 3295225 - RNA, 17 nt, Mycobacterium tuberculosis H37Rv
caggcggacgggacgca

SEQ ID NO: 3295226 - RNA, 13 nt, Mycobacterium tuberculosis H37Rv
caggcggccagcg

SEQ ID NO: 3295227 - RNA, 20 nt, Mycobacterium tuberculosis H37Rv
caggcggccgucgucggcca

SEQ ID NO: 3295228 - RNA, 17 nt, Mycobacterium tuberculosis H37Rv
caggcggccuugccggg

SEQ ID NO: 3295229 - RNA, 19 nt, Mycobacterium tuberculosis H37Rv
caggcggcggacccgcucg

SEQ ID NO: 3295230 - RNA, 22 nt, Mycobacterium tuberculosis H37Rv
caggcggcggccuggcacccgg

SEQ ID NO: 3295231 - RNA, 23 nt, Mycobacterium tuberculosis H37Rv
caggcggcggccuggcacccggg

SEQ ID NO: 3295232 - RNA, 22 nt, Mycobacterium tuberculosis H37Rv
caggcggcugaacggcagccga

SEQ ID NO: 3295233 - RNA, 20 nt, Mycobacterium tuberculosis H37Rv
caggcggcuggcccgcaugc

SEQ ID NO: 3295234 - RNA, 20 nt, Mycobacterium tuberculosis H37Rv
caggcgggaacgaucgauga

SEQ ID NO: 3295235 - RNA, 16 nt, Mycobacterium tuberculosis H37Rv
caggcgggggaucucg

SEQ ID NO: 3295236 - RNA, 21 nt, Mycobacterium tuberculosis H37Rv
caggcgguacgggucgccgga

SEQ ID NO: 3295237 - RNA, 22 nt, Mycobacterium tuberculosis H37Rv
caggcguagguccuugucggcc

SEQ ID NO: 3295238 - RNA, 13 nt, Mycobacterium tuberculosis H37Rv
caggcguaucccg

SEQ ID NO: 3295239 - RNA, 16 nt, Mycobacterium tuberculosis H37Rv
caggcguccaucagag

SEQ ID NO: 3295240 - RNA, 21 nt, Mycobacterium tuberculosis H37Rv
caggcguccaucagagacagc

SEQ ID NO: 3295241 - RNA, 16 nt, Mycobacterium tuberculosis H37Rv
caggcguccaucgcca

SEQ ID NO: 3295242 - RNA, 19 nt, Mycobacterium tuberculosis H37Rv
caggcguccaucgccaccg

SEQ ID NO: 3295243 - RNA, 22 nt, Mycobacterium tuberculosis H37Rv
caggcguccaucgccaccgcgu

SEQ ID NO: 3295244 - RNA, 14 nt, Mycobacterium tuberculosis H37Rv
caggcgucccagcc

SEQ ID NO: 3295245 - RNA, 16 nt, Mycobacterium tuberculosis H37Rv
caggcgucccagccga

SEQ ID NO: 3295246 - RNA, 18 nt, Mycobacterium tuberculosis H37Rv
caggcgucccagccgauc

SEQ ID NO: 3295247 - RNA, 20 nt, Mycobacterium tuberculosis H37Rv
caggcgucccagccgaucac

SEQ ID NO: 3295248 - RNA, 12 nt, Mycobacterium tuberculosis H37Rv
caggcgugcaca

SEQ ID NO: 3295249 - RNA, 16 nt, Mycobacterium tuberculosis H37Rv
caggcgugcacagguc

SEQ ID NO: 3295250 - RNA, 19 nt, Mycobacterium tuberculosis H37Rv
caggcgugcacaggucagc

SEQ ID NO: 3295251 - RNA, 23 nt, Mycobacterium tuberculosis H37Rv
caggcgugcaucgcgauuccggc

SEQ ID NO: 3295252 - RNA, 19 nt, Mycobacterium tuberculosis H37Rv
caggcguuggaucccagcc

SEQ ID NO: 3295253 - RNA, 22 nt, Mycobacterium tuberculosis H37Rv
caggcuaaucagccaggccagu

SEQ ID NO: 3295254 - RNA, 23 nt, Mycobacterium tuberculosis H37Rv
caggcucauccgccgggccaggc

SEQ ID NO: 3295255 - RNA, 23 nt, Mycobacterium tuberculosis H37Rv
caggcucgagguguagcccuccg

SEQ ID NO: 3295256 - RNA, 17 nt, Mycobacterium tuberculosis H37Rv
caggcucgccgaugcug

SEQ ID NO: 3295257 - RNA, 22 nt, Mycobacterium tuberculosis H37Rv
caggcugaaaccuugcggcaga

SEQ ID NO: 3295258 - RNA, 16 nt, Mycobacterium tuberculosis H37Rv
caggcugaaggacggc

SEQ ID NO: 3295259 - RNA, 23 nt, Mycobacterium tuberculosis H37Rv
caggcugaaggacggcagcuugg

SEQ ID NO: 3295260 - RNA, 22 nt, Mycobacterium tuberculosis H37Rv
caggcugaucccgaugcuggca

SEQ ID NO: 3295261 - RNA, 19 nt, Mycobacterium tuberculosis H37Rv
caggcugccuccggaaggc

SEQ ID NO: 3295262 - RNA, 20 nt, Mycobacterium tuberculosis H37Rv
caggcugcggauacuguucu

SEQ ID NO: 3295263 - RNA, 21 nt, Mycobacterium tuberculosis H37Rv
caggcugcggauacuguucug

SEQ ID NO: 3295264 - RNA, 18 nt, Mycobacterium tuberculosis H37Rv
caggcuggcgagggcuga

SEQ ID NO: 3295265 - RNA, 21 nt, Mycobacterium tuberculosis H37Rv
caggcugucaauccgcccuaa

SEQ ID NO: 3295266 - RNA, 15 nt, Mycobacterium tuberculosis H37Rv
caggcugucgcgggc

SEQ ID NO: 3295267 - RNA, 15 nt, Mycobacterium tuberculosis H37Rv
caggcuguggccagc

SEQ ID NO: 3295268 - RNA, 23 nt, Mycobacterium tuberculosis H37Rv
caggcuguggccagcaucaucaa

SEQ ID NO: 3295269 - RNA, 15 nt, Mycobacterium tuberculosis H37Rv
caggcuuagcuuccg

SEQ ID NO: 3295270 - RNA, 18 nt, Mycobacterium tuberculosis H37Rv
caggcuuccagccacagc

SEQ ID NO: 3295271 - RNA, 15 nt, Mycobacterium tuberculosis H37Rv
caggcuugacugcac

SEQ ID NO: 3295272 - RNA, 16 nt, Mycobacterium tuberculosis H37Rv
caggcuugacugcaca

SEQ ID NO: 3295273 - RNA, 13 nt, Mycobacterium tuberculosis H37Rv
caggcuugcggca

SEQ ID NO: 3295274 - RNA, 15 nt, Mycobacterium tuberculosis H37Rv
caggcuugcggcacc

SEQ ID NO: 3295275 - RNA, 15 nt, Mycobacterium tuberculosis H37Rv
caggcuuggcaugcg

SEQ ID NO: 3295276 - RNA, 20 nt, Mycobacterium tuberculosis H37Rv
cagggaagcaagggcgaugg

SEQ ID NO: 3295277 - RNA, 12 nt, Mycobacterium tuberculosis H37Rv
cagggacccgag

SEQ ID NO: 3295278 - RNA, 13 nt, Mycobacterium tuberculosis H37Rv
cagggacccgaga

SEQ ID NO: 3295279 - RNA, 18 nt, Mycobacterium tuberculosis H37Rv
cagggacccgagaucacc

SEQ ID NO: 3295280 - RNA, 22 nt, Mycobacterium tuberculosis H37Rv
cagggacccgagaucaccggua

SEQ ID NO: 3295281 - RNA, 17 nt, Mycobacterium tuberculosis H37Rv
cagggagcgcagcgccg

SEQ ID NO: 3295282 - RNA, 13 nt, Mycobacterium tuberculosis H37Rv
cagggaggggccg

SEQ ID NO: 3295283 - RNA, 21 nt, Mycobacterium tuberculosis H37Rv
cagggagugccgcacgauggc

SEQ ID NO: 3295284 - RNA, 18 nt, Mycobacterium tuberculosis H37Rv
cagggaucagccgugcgg

SEQ ID NO: 3295285 - RNA, 15 nt, Mycobacterium tuberculosis H37Rv
cagggauucuggaug

SEQ ID NO: 3295286 - RNA, 15 nt, Mycobacterium tuberculosis H37Rv
cagggcaacacuugu

SEQ ID NO: 3295287 - RNA, 17 nt, Mycobacterium tuberculosis H37Rv
cagggcacaucgggcgu

SEQ ID NO: 3295288 - RNA, 15 nt, Mycobacterium tuberculosis H37Rv
cagggcacguucggc

SEQ ID NO: 3295289 - RNA, 20 nt, Mycobacterium tuberculosis H37Rv
cagggcacguucggcgcaca

SEQ ID NO: 3295290 - RNA, 22 nt, Mycobacterium tuberculosis H37Rv
cagggcacguucggcgcacagc

SEQ ID NO: 3295291 - RNA, 12 nt, Mycobacterium tuberculosis H37Rv
cagggcagcggc

SEQ ID NO: 3295292 - RNA, 23 nt, Mycobacterium tuberculosis H37Rv
cagggccaauuccaugacgggua

SEQ ID NO: 3295293 - RNA, 12 nt, Mycobacterium tuberculosis H37Rv
cagggccaccgc

SEQ ID NO: 3295294 - RNA, 14 nt, Mycobacterium tuberculosis H37Rv
cagggccagcggca

SEQ ID NO: 3295295 - RNA, 16 nt, Mycobacterium tuberculosis H37Rv
cagggccagcggcagc

SEQ ID NO: 3295296 - RNA, 17 nt, Mycobacterium tuberculosis H37Rv
cagggccagcggcagcc

SEQ ID NO: 3295297 - RNA, 15 nt, Mycobacterium tuberculosis H37Rv
cagggcccuagccgg

SEQ ID NO: 3295298 - RNA, 17 nt, Mycobacterium tuberculosis H37Rv
cagggcccuagccggcg

SEQ ID NO: 3295299 - RNA, 21 nt, Mycobacterium tuberculosis H37Rv
cagggcccuagccggcgcgcc

SEQ ID NO: 3295300 - RNA, 22 nt, Mycobacterium tuberculosis H37Rv
cagggcccuagccggcgcgccc

SEQ ID NO: 3295301 - RNA, 12 nt, Mycobacterium tuberculosis H37Rv
cagggcccugcu

SEQ ID NO: 3295302 - RNA, 15 nt, Mycobacterium tuberculosis H37Rv
cagggcccugcuggc

SEQ ID NO: 3295303 - RNA, 18 nt, Mycobacterium tuberculosis H37Rv
cagggcccugcuggccca

SEQ ID NO: 3295304 - RNA, 23 nt, Mycobacterium tuberculosis H37Rv
cagggcccugcuggcccaacauc

SEQ ID NO: 3295305 - RNA, 16 nt, Mycobacterium tuberculosis H37Rv
cagggccgccgaagcu

SEQ ID NO: 3295306 - RNA, 20 nt, Mycobacterium tuberculosis H37Rv
cagggccgccgcgaacgggu

SEQ ID NO: 3295307 - RNA, 14 nt, Mycobacterium tuberculosis H37Rv
cagggccgcgcgca

SEQ ID NO: 3295308 - RNA, 14 nt, Mycobacterium tuberculosis H37Rv
cagggccgcucgcc

SEQ ID NO: 3295309 - RNA, 22 nt, Mycobacterium tuberculosis H37Rv
cagggccgcucgccucgauggc

SEQ ID NO: 3295310 - RNA, 22 nt, Mycobacterium tuberculosis H37Rv
cagggccucgaccgccagccgc

SEQ ID NO: 3295311 - RNA, 19 nt, Mycobacterium tuberculosis H37Rv
cagggcgacgagaucugcg

SEQ ID NO: 3295312 - RNA, 15 nt, Mycobacterium tuberculosis H37Rv
caggucgaucugcgc

SEQ ID NO: 3295313 - RNA, 14 nt, Mycobacterium tuberculosis H37Rv
caggucgaugcugc

SEQ ID NO: 3295314 - RNA, 13 nt, Mycobacterium tuberculosis H37Rv
caggucgcaccac

SEQ ID NO: 3295315 - RNA, 14 nt, Mycobacterium tuberculosis H37Rv
caggucgcagacca

SEQ ID NO: 3295316 - RNA, 16 nt, Mycobacterium tuberculosis H37Rv
caggucgcagaccaga

SEQ ID NO: 3295317 - RNA, 20 nt, Mycobacterium tuberculosis H37Rv
caggucgccaccuucgacga

SEQ ID NO: 3295318 - RNA, 16 nt, Mycobacterium tuberculosis H37Rv
caggucgcccaacacc

SEQ ID NO: 3295319 - RNA, 15 nt, Mycobacterium tuberculosis H37Rv
caggucgccuuccca

SEQ ID NO: 3295320 - RNA, 16 nt, Mycobacterium tuberculosis H37Rv
caggucgccuucccag

SEQ ID NO: 3295321 - RNA, 22 nt, Mycobacterium tuberculosis H37Rv
caggucgccuucuucgcggcgg

SEQ ID NO: 3295322 - RNA, 20 nt, Mycobacterium tuberculosis H37Rv
caggucgcgauagccgccgc

SEQ ID NO: 3295323 - RNA, 19 nt, Mycobacterium tuberculosis H37Rv
caggucggaacuagccagu

SEQ ID NO: 3295324 - RNA, 20 nt, Mycobacterium tuberculosis H37Rv
caggucggaacuagccaguu

SEQ ID NO: 3295325 - RNA, 15 nt, Mycobacterium tuberculosis H37Rv
caggucggccgccuc

SEQ ID NO: 3295326 - RNA, 17 nt, Mycobacterium tuberculosis H37Rv
caggucggccgccucgu

SEQ ID NO: 3295327 - RNA, 22 nt, Mycobacterium tuberculosis H37Rv
caggucggcgaacaaccgccgc

SEQ ID NO: 3295328 - RNA, 19 nt, Mycobacterium tuberculosis H37Rv
caggucggcggacgcgggu

SEQ ID NO: 3295329 - RNA, 20 nt, Mycobacterium tuberculosis H37Rv
caggucggcgggcgcgggug

SEQ ID NO: 3295330 - RNA, 21 nt, Mycobacterium tuberculosis H37Rv
caggucggcuucgacaaccuc

SEQ ID NO: 3295331 - RNA, 16 nt, Mycobacterium tuberculosis H37Rv
caggucgggcagcacu

SEQ ID NO: 3295332 - RNA, 20 nt, Mycobacterium tuberculosis H37Rv
caggucggugacgaagagca

SEQ ID NO: 3295333 - RNA, 15 nt, Mycobacterium tuberculosis H37Rv
caggucggugcgguc

SEQ ID NO: 3295334 - RNA, 23 nt, Mycobacterium tuberculosis H37Rv
caggucggugugcaucgccggca

SEQ ID NO: 3295335 - RNA, 15 nt, Mycobacterium tuberculosis H37Rv
caggucgucggcguc

SEQ ID NO: 3295336 - RNA, 17 nt, Mycobacterium tuberculosis H37Rv
caggucgucguaccggc

SEQ ID NO: 3295337 - RNA, 20 nt, Mycobacterium tuberculosis H37Rv
caggucguuuacggcaaguu

SEQ ID NO: 3295338 - RNA, 22 nt, Mycobacterium tuberculosis H37Rv
caggucguuugugaacaccccu

SEQ ID NO: 3295339 - RNA, 16 nt, Mycobacterium tuberculosis H37Rv
caggucuucgcugucg

SEQ ID NO: 3295340 - RNA, 17 nt, Mycobacterium tuberculosis H37Rv
caggucuucgcugucga

SEQ ID NO: 3295341 - RNA, 18 nt, Mycobacterium tuberculosis H37Rv
caggugaacaacagcgcu

SEQ ID NO: 3295342 - RNA, 20 nt, Mycobacterium tuberculosis H37Rv
caggugaccgagaucgucgc

SEQ ID NO: 3295343 - RNA, 17 nt, Mycobacterium tuberculosis H37Rv
caggugacgaucagguc

SEQ ID NO: 3295344 - RNA, 15 nt, Mycobacterium tuberculosis H37Rv
caggugagaccaggu

SEQ ID NO: 3295345 - RNA, 20 nt, Mycobacterium tuberculosis H37Rv
caggugagccaguuggccag

SEQ ID NO: 3295346 - RNA, 15 nt, Mycobacterium tuberculosis H37Rv
caggugagcgacgcu

SEQ ID NO: 3295347 - RNA, 13 nt, Mycobacterium tuberculosis H37Rv
caggugaucgcga

SEQ ID NO: 3295348 - RNA, 12 nt, Mycobacterium tuberculosis H37Rv
caggugaugccg

SEQ ID NO: 3295349 - RNA, 20 nt, Mycobacterium tuberculosis H37Rv
caggugauucgcgcagcgcg

SEQ ID NO: 3295350 - RNA, 15 nt, Mycobacterium tuberculosis H37Rv
caggugcagcaccag

SEQ ID NO: 3295351 - RNA, 19 nt, Mycobacterium tuberculosis H37Rv
caggugcagcaccagccac

SEQ ID NO: 3295352 - RNA, 14 nt, Mycobacterium tuberculosis H37Rv
caggugcccgcccc

SEQ ID NO: 3295353 - RNA, 20 nt, Mycobacterium tuberculosis H37Rv
caggugcccggccaaaaugg

SEQ ID NO: 3295354 - RNA, 18 nt, Mycobacterium tuberculosis H37Rv
caggugccuuucggcaga

SEQ ID NO: 3295355 - RNA, 21 nt, Mycobacterium tuberculosis H37Rv
caggugcgccuggcuggccag

SEQ ID NO: 3295356 - RNA, 22 nt, Mycobacterium tuberculosis H37Rv
caggugcggugaucgauccggc

SEQ ID NO: 3295357 - RNA, 19 nt, Mycobacterium tuberculosis H37Rv
caggugcguccaggccagg

SEQ ID NO: 3295358 - RNA, 20 nt, Mycobacterium tuberculosis H37Rv
caggugcucgucauccaucc

SEQ ID NO: 3295359 - RNA, 14 nt, Mycobacterium tuberculosis H37Rv
caggugcucgucga

SEQ ID NO: 3295360 - RNA, 17 nt, Mycobacterium tuberculosis H37Rv
cagguggaagugcaccu

SEQ ID NO: 3295361 - RNA, 13 nt, Mycobacterium tuberculosis H37Rv
cagguggccaggc

SEQ ID NO: 3295362 - RNA, 15 nt, Mycobacterium tuberculosis H37Rv
cagguggccaggccg

SEQ ID NO: 3295363 - RNA, 14 nt, Mycobacterium tuberculosis H37Rv
cagguggccgucgc

SEQ ID NO: 3295364 - RNA, 12 nt, Mycobacterium tuberculosis H37Rv
caggugggcagc

SEQ ID NO: 3295365 - RNA, 13 nt, Mycobacterium tuberculosis H37Rv
caggugggcagca

SEQ ID NO: 3295366 - RNA, 15 nt, Mycobacterium tuberculosis H37Rv
caggugggcagcagg

SEQ ID NO: 3295367 - RNA, 14 nt, Mycobacterium tuberculosis H37Rv
caggugggugaacg

SEQ ID NO: 3295368 - RNA, 17 nt, Mycobacterium tuberculosis H37Rv
cagguggucaucgccac

SEQ ID NO: 3295369 - RNA, 20 nt, Mycobacterium tuberculosis H37Rv
cagguggugacacgacgugc

SEQ ID NO: 3295370 - RNA, 23 nt, Mycobacterium tuberculosis H37Rv
cagguguccccgcccggccagcu

SEQ ID NO: 3295371 - RNA, 17 nt, Mycobacterium tuberculosis H37Rv
caggugucgcugcugaa

SEQ ID NO: 3295372 - RNA, 20 nt, Mycobacterium tuberculosis H37Rv
caggugucgcugcugaacaa

SEQ ID NO: 3295373 - RNA, 22 nt, Mycobacterium tuberculosis H37Rv
caggugucgcugcugaacaacc

SEQ ID NO: 3295374 - RNA, 17 nt, Mycobacterium tuberculosis H37Rv
caggugugugccucagu

SEQ ID NO: 3295375 - RNA, 23 nt, Mycobacterium tuberculosis H37Rv
cagguguugcacgagcaucauug

SEQ ID NO: 3295376 - RNA, 18 nt, Mycobacterium tuberculosis H37Rv
cagguuaggcaauagccg

SEQ ID NO: 3295377 - RNA, 21 nt, Mycobacterium tuberculosis H37Rv
cagguucaugcaaaagccgcg

SEQ ID NO: 3295378 - RNA, 19 nt, Mycobacterium tuberculosis H37Rv
cagguuccacggacggucg

SEQ ID NO: 3295379 - RNA, 15 nt, Mycobacterium tuberculosis H37Rv
cagguuccgcugucg

SEQ ID NO: 3295380 - RNA, 16 nt, Mycobacterium tuberculosis H37Rv
cagguuccgcugucga

SEQ ID NO: 3295381 - RNA, 19 nt, Mycobacterium tuberculosis H37Rv
cagguucggcgacucugcg

SEQ ID NO: 3295382 - RNA, 20 nt, Mycobacterium tuberculosis H37Rv
cagguucuucuccaccaccg

SEQ ID NO: 3295383 - RNA, 17 nt, Mycobacterium tuberculosis H37Rv
cagguucuugaccagca

SEQ ID NO: 3295384 - RNA, 17 nt, Mycobacterium tuberculosis H37Rv
cagguugauccagugcu

SEQ ID NO: 3295385 - RNA, 20 nt, Mycobacterium tuberculosis H37Rv
cagguugcccucaccgaugu

SEQ ID NO: 3295386 - RNA, 19 nt, Mycobacterium tuberculosis H37Rv
cagguuggauacggugcga

SEQ ID NO: 3295387 - RNA, 13 nt, Mycobacterium tuberculosis H37Rv
cagguuggcaagc

SEQ ID NO: 3295388 - RNA, 13 nt, Mycobacterium tuberculosis H37Rv
cagguuggcacgc

SEQ ID NO: 3295389 - RNA, 14 nt, Mycobacterium tuberculosis H37Rv
cagguuggcacgcu

SEQ ID NO: 3295390 - RNA, 20 nt, Mycobacterium tuberculosis H37Rv
cagguuggcggcugcacgcu

SEQ ID NO: 3295391 - RNA, 14 nt, Mycobacterium tuberculosis H37Rv
cagguuuccggccu

SEQ ID NO: 3295392 - RNA, 14 nt, Mycobacterium tuberculosis H37Rv
cagguuuucgaucu

SEQ ID NO: 3295393 - RNA, 20 nt, Mycobacterium tuberculosis H37Rv
caguaauacugccguucggg

SEQ ID NO: 3295394 - RNA, 18 nt, Mycobacterium tuberculosis H37Rv
caguacaccgcccggccc

SEQ ID NO: 3295395 - RNA, 13 nt, Mycobacterium tuberculosis H37Rv
caguacaccggcg

SEQ ID NO: 3295396 - RNA, 14 nt, Mycobacterium tuberculosis H37Rv
caguacaccggcgu

SEQ ID NO: 3295397 - RNA, 14 nt, Mycobacterium tuberculosis H37Rv
caguaccaccggca

SEQ ID NO: 3295398 - RNA, 20 nt, Mycobacterium tuberculosis H37Rv
caguaccaccggcaccggcc

SEQ ID NO: 3295399 - RNA, 16 nt, Mycobacterium tuberculosis H37Rv
caguacgguccggcgu

SEQ ID NO: 3295400 - RNA, 22 nt, Mycobacterium tuberculosis H37Rv
caguacggugguaagacgccga

SEQ ID NO: 3295401 - RNA, 23 nt, Mycobacterium tuberculosis H37Rv
caguacgucgaucaacaggucua

SEQ ID NO: 3295402 - RNA, 19 nt, Mycobacterium tuberculosis H37Rv
caguacuaacaacaccacc

SEQ ID NO: 3295403 - RNA, 19 nt, Mycobacterium tuberculosis H37Rv
caguacucggccagcgccu

SEQ ID NO: 3295404 - RNA, 15 nt, Mycobacterium tuberculosis H37Rv
caguagccacgccca

SEQ ID NO: 3295405 - RNA, 16 nt, Mycobacterium tuberculosis H37Rv
caguagcuguggcccg

SEQ ID NO: 3295406 - RNA, 20 nt, Mycobacterium tuberculosis H37Rv
caguaggugucgggcucgca

SEQ ID NO: 3295407 - RNA, 17 nt, Mycobacterium tuberculosis H37Rv
caguaugcggugcccgc

SEQ ID NO: 3295408 - RNA, 21 nt, Mycobacterium tuberculosis H37Rv
cagugccgcacccagaccgcc

SEQ ID NO: 3295409 - RNA, 22 nt, Mycobacterium tuberculosis H37Rv
cagugccgcccaccacacagcc

SEQ ID NO: 3295410 - RNA, 12 nt, Mycobacterium tuberculosis H37Rv
cagugccgugcu

SEQ ID NO: 3295411 - RNA, 20 nt, Mycobacterium tuberculosis H37Rv
cagugcgacguaaagggcgu

SEQ ID NO: 3295412 - RNA, 21 nt, Mycobacterium tuberculosis H37Rv
cagugcgacucugcgucugcu

SEQ ID NO: 3295413 - RNA, 17 nt, Mycobacterium tuberculosis H37Rv
cagugcgcaacccagcc

SEQ ID NO: 3295414 - RNA, 19 nt, Mycobacterium tuberculosis H37Rv
cagugcgcaacccagccgc

SEQ ID NO: 3295415 - RNA, 14 nt, Mycobacterium tuberculosis H37Rv
cagugcgcagaaca

SEQ ID NO: 3295416 - RNA, 16 nt, Mycobacterium tuberculosis H37Rv
cagugcgcagaacacc

SEQ ID NO: 3295417 - RNA, 21 nt, Mycobacterium tuberculosis H37Rv
cagugcgcagaacaccaccgc

SEQ ID NO: 3295418 - RNA, 20 nt, Mycobacterium tuberculosis H37Rv
cagugcgcggaucaacaggc

SEQ ID NO: 3295419 - RNA, 23 nt, Mycobacterium tuberculosis H37Rv
cagugcggccuuggcgacgucgc

SEQ ID NO: 3295420 - RNA, 16 nt, Mycobacterium tuberculosis H37Rv
cagugcggucucgacc

SEQ ID NO: 3295421 - RNA, 18 nt, Mycobacterium tuberculosis H37Rv
cagugcgguggcagguga

SEQ ID NO: 3295422 - RNA, 11 nt, Mycobacterium tuberculosis H37Rv
cagugcucgca

SEQ ID NO: 3295423 - RNA, 20 nt, Mycobacterium tuberculosis H37Rv
cagugcugcaccgauucggg

SEQ ID NO: 3295424 - RNA, 18 nt, Mycobacterium tuberculosis H37Rv
cagugcugcagacccguu

SEQ ID NO: 3295425 - RNA, 12 nt, Mycobacterium tuberculosis H37Rv
cagugcugccuu

SEQ ID NO: 3295426 - RNA, 15 nt, Mycobacterium tuberculosis H37Rv
caguggauccggcag

SEQ ID NO: 3295427 - RNA, 17 nt, Mycobacterium tuberculosis H37Rv
caguggaugcauacacg

SEQ ID NO: 3295428 - RNA, 20 nt, Mycobacterium tuberculosis H37Rv
caguggcaagcugucgucgc

SEQ ID NO: 3295429 - RNA, 17 nt, Mycobacterium tuberculosis H37Rv
caguggcagccagcggc

SEQ ID NO: 3295430 - RNA, 22 nt, Mycobacterium tuberculosis H37Rv
caguggccaccaucaccucgca

SEQ ID NO: 3295431 - RNA, 13 nt, Mycobacterium tuberculosis H37Rv
caguggcgacgag

SEQ ID NO: 3295432 - RNA, 17 nt, Mycobacterium tuberculosis H37Rv
caguggcgcgugcagcg

SEQ ID NO: 3295433 - RNA, 17 nt, Mycobacterium tuberculosis H37Rv
caguggcguuacgcucg

SEQ ID NO: 3295434 - RNA, 20 nt, Mycobacterium tuberculosis H37Rv
caguggcguuacgcucggcg

SEQ ID NO: 3295435 - RNA, 21 nt, Mycobacterium tuberculosis H37Rv
caguggcguuacgcucggcga

SEQ ID NO: 3295436 - RNA, 20 nt, Mycobacterium tuberculosis H37Rv
cagugggacaaagacgccgu

SEQ ID NO: 3295437 - RNA, 12 nt, Mycobacterium tuberculosis H37Rv
caguggugcacc

SEQ ID NO: 3295438 - RNA, 17 nt, Mycobacterium tuberculosis H37Rv
cagugguuacagaugaa

SEQ ID NO: 3295439 - RNA, 13 nt, Mycobacterium tuberculosis H37Rv
cagugugcgccgu

SEQ ID NO: 3295440 - RNA, 19 nt, Mycobacterium tuberculosis H37Rv
caguguggcgaugaccacg

SEQ ID NO: 3295441 - RNA, 21 nt, Mycobacterium tuberculosis H37Rv
caguguggcgaugaccacgcc

SEQ ID NO: 3295442 - RNA, 17 nt, Mycobacterium tuberculosis H37Rv
caguguugcaguggcga

SEQ ID NO: 3295443 - RNA, 18 nt, Mycobacterium tuberculosis H37Rv
caguguuguucgggcugc

SEQ ID NO: 3295444 - RNA, 19 nt, Mycobacterium tuberculosis H37Rv
caguuagccggguuggccg

SEQ ID NO: 3295445 - RNA, 17 nt, Mycobacterium tuberculosis H37Rv
caguuauccgguguccu

SEQ ID NO: 3295446 - RNA, 14 nt, Mycobacterium tuberculosis H37Rv
caguucaccgcgcu

SEQ ID NO: 3295447 - RNA, 15 nt, Mycobacterium tuberculosis H37Rv
caguucacgccggug

SEQ ID NO: 3295448 - RNA, 17 nt, Mycobacterium tuberculosis H37Rv
caguuccaccgcgcagg

SEQ ID NO: 3295449 - RNA, 14 nt, Mycobacterium tuberculosis H37Rv
caguucccagacca

SEQ ID NO: 3295450 - RNA, 13 nt, Mycobacterium tuberculosis H37Rv
caguucccggcca

SEQ ID NO: 3295451 - RNA, 19 nt, Mycobacterium tuberculosis H37Rv
caguucccggccauagccc

SEQ ID NO: 3295452 - RNA, 15 nt, Mycobacterium tuberculosis H37Rv
caguucggauccgga

SEQ ID NO: 3295453 - RNA, 20 nt, Mycobacterium tuberculosis H37Rv
caguucggcggccgccgcgu

SEQ ID NO: 3295454 - RNA, 19 nt, Mycobacterium tuberculosis H37Rv
caguucggcgggcgcgggu

SEQ ID NO: 3295455 - RNA, 15 nt, Mycobacterium tuberculosis H37Rv
caguucgugacgugc

SEQ ID NO: 3295456 - RNA, 14 nt, Mycobacterium tuberculosis H37Rv
caguucguggcugg

SEQ ID NO: 3295457 - RNA, 23 nt, Mycobacterium tuberculosis H37Rv
caguucguugguguuggaagcgc

SEQ ID NO: 3295458 - RNA, 20 nt, Mycobacterium tuberculosis H37Rv
caguucuugauuagccauua

SEQ ID NO: 3295459 - RNA, 15 nt, Mycobacterium tuberculosis H37Rv
caguugaacucgacc

SEQ ID NO: 3295460 - RNA, 16 nt, Mycobacterium tuberculosis H37Rv
caguugaacucgacca

SEQ ID NO: 3295461 - RNA, 20 nt, Mycobacterium tuberculosis H37Rv
caguugaucaggccgaugcg

SEQ ID NO: 3295462 - RNA, 17 nt, Mycobacterium tuberculosis H37Rv
caguugcacaccgaucg

SEQ ID NO: 3295463 - RNA, 20 nt, Mycobacterium tuberculosis H37Rv
caguugcacaccggcacugc

SEQ ID NO: 3295464 - RNA, 18 nt, Mycobacterium tuberculosis H37Rv
caguugccgguugccacc

SEQ ID NO: 3295465 - RNA, 15 nt, Mycobacterium tuberculosis H37Rv
caguugcgcuccaac

SEQ ID NO: 3295466 - RNA, 16 nt, Mycobacterium tuberculosis H37Rv
caguugcgcuccaaca

SEQ ID NO: 3295467 - RNA, 15 nt, Mycobacterium tuberculosis H37Rv
caguuggaacugccc

SEQ ID NO: 3295468 - RNA, 13 nt, Mycobacterium tuberculosis H37Rv
caguuggcaccag

SEQ ID NO: 3295469 - RNA, 15 nt, Mycobacterium tuberculosis H37Rv
caguuggcaccagcc

SEQ ID NO: 3295470 - RNA, 14 nt, Mycobacterium tuberculosis H37Rv
caguuggcagcgcu

SEQ ID NO: 3295471 - RNA, 20 nt, Mycobacterium tuberculosis H37Rv
caguuggccaugcaccgaug

SEQ ID NO: 3295472 - RNA, 19 nt, Mycobacterium tuberculosis H37Rv
caguugguagccgcccucc

SEQ ID NO: 3295473 - RNA, 17 nt, Mycobacterium tuberculosis H37Rv
cauaaaugcgcguucga

SEQ ID NO: 3295474 - RNA, 15 nt, Mycobacterium tuberculosis H37Rv
cauaacccgcaccgg

SEQ ID NO: 3295475 - RNA, 21 nt, Mycobacterium tuberculosis H37Rv
cauaaccggcgcgccccgccg

SEQ ID NO: 3295476 - RNA, 15 nt, Mycobacterium tuberculosis H37Rv
cauaagcccccgaca

SEQ ID NO: 3295477 - RNA, 23 nt, Mycobacterium tuberculosis H37Rv
cauaagcccccgcacgcacggcg

SEQ ID NO: 3295478 - RNA, 24 nt, Mycobacterium tuberculosis H37Rv
cauaagcccccgcacgcacggcgu

SEQ ID NO: 3295479 - RNA, 18 nt, Mycobacterium tuberculosis H37Rv
cauaaggaaugauggcca

SEQ ID NO: 3295480 - RNA, 16 nt, Mycobacterium tuberculosis H37Rv
cauacaaccccgcgcu

SEQ ID NO: 3295481 - RNA, 12 nt, Mycobacterium tuberculosis H37Rv
cauacacgguag

SEQ ID NO: 3295482 - RNA, 15 nt, Mycobacterium tuberculosis H37Rv
cauacagcgcccgga

SEQ ID NO: 3295483 - RNA, 21 nt, Mycobacterium tuberculosis H37Rv
cauacaggcccgccagcaggg

SEQ ID NO: 3295484 - RNA, 21 nt, Mycobacterium tuberculosis H37Rv
cauaccaguaccgucaucgcg

SEQ ID NO: 3295485 - RNA, 17 nt, Mycobacterium tuberculosis H37Rv
cauacccagcucgucgc

SEQ ID NO: 3295486 - RNA, 14 nt, Mycobacterium tuberculosis H37Rv
cauaccccgaacau

SEQ ID NO: 3295487 - RNA, 16 nt, Mycobacterium tuberculosis H37Rv
cauaccccgaacauug

SEQ ID NO: 3295488 - RNA, 19 nt, Mycobacterium tuberculosis H37Rv
cauaccgaugguggugcca

SEQ ID NO: 3295489 - RNA, 23 nt, Mycobacterium tuberculosis H37Rv
cauaccgaugguggugccaaccu

SEQ ID NO: 3295490 - RNA, 17 nt, Mycobacterium tuberculosis H37Rv
cauaccgcaauggcggc

SEQ ID NO: 3295491 - RNA, 22 nt, Mycobacterium tuberculosis H37Rv
cauaccguucacccagcggaac

SEQ ID NO: 3295492 - RNA, 20 nt, Mycobacterium tuberculosis H37Rv
cauaccuaacgagccgucca

SEQ ID NO: 3295493 - RNA, 13 nt, Mycobacterium tuberculosis H37Rv
cauaccugaaugu

SEQ ID NO: 3295494 - RNA, 17 nt, Mycobacterium tuberculosis H37Rv
cauaccugccggaccac

SEQ ID NO: 3295495 - RNA, 15 nt, Mycobacterium tuberculosis H37Rv
cauacgaaacaugcg

SEQ ID NO: 3295496 - RNA, 16 nt, Mycobacterium tuberculosis H37Rv
cauacgauuucgacga

SEQ ID NO: 3295497 - RNA, 17 nt, Mycobacterium tuberculosis H37Rv
cauacgauuucgacgac

SEQ ID NO: 3295498 - RNA, 22 nt, Mycobacterium tuberculosis H37Rv
cauacgcccacuccagcagcuc

SEQ ID NO: 3295499 - RNA, 15 nt, Mycobacterium tuberculosis H37Rv
cauacgccggccgcg

SEQ ID NO: 3295500 - RNA, 16 nt, Mycobacterium tuberculosis H37Rv
cauacgcgcugacccg

SEQ ID NO: 3295501 - RNA, 18 nt, Mycobacterium tuberculosis H37Rv
cauacgcggcuuugacgc

SEQ ID NO: 3295502 - RNA, 15 nt, Mycobacterium tuberculosis H37Rv
cauacgucgccucga

SEQ ID NO: 3295503 - RNA, 15 nt, Mycobacterium tuberculosis H37Rv
cauacucgacaccga

SEQ ID NO: 3295504 - RNA, 15 nt, Mycobacterium tuberculosis H37Rv
cauccagcgcuucgg

SEQ ID NO: 3295505 - RNA, 16 nt, Mycobacterium tuberculosis H37Rv
cauccagcgcuucggc

SEQ ID NO: 3295506 - RNA, 14 nt, Mycobacterium tuberculosis H37Rv
cauccagcugcugc

SEQ ID NO: 3295507 - RNA, 21 nt, Mycobacterium tuberculosis H37Rv
cauccagcugcugccgauaca

SEQ ID NO: 3295508 - RNA, 17 nt, Mycobacterium tuberculosis H37Rv
cauccaggcugucgcgg

SEQ ID NO: 3295509 - RNA, 21 nt, Mycobacterium tuberculosis H37Rv
cauccauccgggccgcggcca

SEQ ID NO: 3295510 - RNA, 15 nt, Mycobacterium tuberculosis H37Rv
cauccaugauggccg

SEQ ID NO: 3295511 - RNA, 22 nt, Mycobacterium tuberculosis H37Rv
cauccaugauggccgucagcca

SEQ ID NO: 3295512 - RNA, 20 nt, Mycobacterium tuberculosis H37Rv
cauccauucggcggcggcgu

SEQ ID NO: 3295513 - RNA, 15 nt, Mycobacterium tuberculosis H37Rv
caucccaacgagaug

SEQ ID NO: 3295514 - RNA, 16 nt, Mycobacterium tuberculosis H37Rv
cauccccuggccagca

SEQ ID NO: 3295515 - RNA, 16 nt, Mycobacterium tuberculosis H37Rv
caucccgaucccggcc

SEQ ID NO: 3295516 - RNA, 22 nt, Mycobacterium tuberculosis H37Rv
caucccgaucccggccagcucc

SEQ ID NO: 3295517 - RNA, 13 nt, Mycobacterium tuberculosis H37Rv
caucccgccgccc

SEQ ID NO: 3295518 - RNA, 15 nt, Mycobacterium tuberculosis H37Rv
caucccggcgccgcg

SEQ ID NO: 3295519 - RNA, 22 nt, Mycobacterium tuberculosis H37Rv
caucccggcgcguuggguugaa

SEQ ID NO: 3295520 - RNA, 15 nt, Mycobacterium tuberculosis H37Rv
caucccgggcagucc

SEQ ID NO: 3295521 - RNA, 21 nt, Mycobacterium tuberculosis H37Rv
caucccucgguguacaccgcg

SEQ ID NO: 3295522 - RNA, 18 nt, Mycobacterium tuberculosis H37Rv
caucccuuucgcgccgcg

SEQ ID NO: 3295523 - RNA, 20 nt, Mycobacterium tuberculosis H37Rv
caucccuuucgcgccgcgag

SEQ ID NO: 3295524 - RNA, 15 nt, Mycobacterium tuberculosis H37Rv
cauccgacacugcgg

SEQ ID NO: 3295525 - RNA, 16 nt, Mycobacterium tuberculosis H37Rv
cauccgacgggauaga

SEQ ID NO: 3295526 - RNA, 24 nt, Mycobacterium tuberculosis H37Rv
cauccgacgggauagacgaccccg

SEQ ID NO: 3295527 - RNA, 19 nt, Mycobacterium tuberculosis H37Rv
cauccgagcgggaacgagc

SEQ ID NO: 3295528 - RNA, 13 nt, Mycobacterium tuberculosis H37Rv
cauccgccccgcc

SEQ ID NO: 3295529 - RNA, 21 nt, Mycobacterium tuberculosis H37Rv
cauccgccccgcccgcaccca

SEQ ID NO: 3295530 - RNA, 14 nt, Mycobacterium tuberculosis H37Rv
cauccgccgccccc

SEQ ID NO: 3295531 - RNA, 19 nt, Mycobacterium tuberculosis H37Rv
cauccgccgggccaggccg

SEQ ID NO: 3295532 - RNA, 15 nt, Mycobacterium tuberculosis H37Rv
cauccgcgacggcgc

SEQ ID NO: 3295533 - RNA, 16 nt, Mycobacterium tuberculosis H37Rv
cauccgcgacggcgcc

SEQ ID NO: 3295534 - RNA, 12 nt, Mycobacterium tuberculosis H37Rv
cauccgcggcag

SEQ ID NO: 3295535 - RNA, 16 nt, Mycobacterium tuberculosis H37Rv
cauccgcggcaugcaa

SEQ ID NO: 3295536 - RNA, 20 nt, Mycobacterium tuberculosis H37Rv
cauccggccgucggcgggca

SEQ ID NO: 3295537 - RNA, 21 nt, Mycobacterium tuberculosis H37Rv
cauccgggcaaccgaugacgc

SEQ ID NO: 3295538 - RNA, 15 nt, Mycobacterium tuberculosis H37Rv
cauccgggccgagcg

SEQ ID NO: 3295539 - RNA, 20 nt, Mycobacterium tuberculosis H37Rv
cauccgggccgagcgcacca

SEQ ID NO: 3295540 - RNA, 22 nt, Mycobacterium tuberculosis H37Rv
cauccgggccgagcgcaccacg

SEQ ID NO: 3295541 - RNA, 16 nt, Mycobacterium tuberculosis H37Rv
cauccgggcgaccacc

SEQ ID NO: 3295542 - RNA, 18 nt, Mycobacterium tuberculosis H37Rv
cauccggucgcucgaugg

SEQ ID NO: 3295543 - RNA, 21 nt, Mycobacterium tuberculosis H37Rv
cauccgguggugcucgucggu

SEQ ID NO: 3295544 - RNA, 22 nt, Mycobacterium tuberculosis H37Rv
cauccgguuuggucgccgcguc

SEQ ID NO: 3295545 - RNA, 19 nt, Mycobacterium tuberculosis H37Rv
cauccgucaaguggcaacc

SEQ ID NO: 3295546 - RNA, 18 nt, Mycobacterium tuberculosis H37Rv
cauccuccucgucgacgu

SEQ ID NO: 3295547 - RNA, 15 nt, Mycobacterium tuberculosis H37Rv
cauccuccugcgccg

SEQ ID NO: 3295548 - RNA, 16 nt, Mycobacterium tuberculosis H37Rv
cauccucgagcugcug

SEQ ID NO: 3295549 - RNA, 21 nt, Mycobacterium tuberculosis H37Rv
cauccucugaaccugcugagc

SEQ ID NO: 3295550 - RNA, 19 nt, Mycobacterium tuberculosis H37Rv
cauccugcagcucgggcag

SEQ ID NO: 3295551 - RNA, 21 nt, Mycobacterium tuberculosis H37Rv
cauccugccuuacacgccugg

SEQ ID NO: 3295552 - RNA, 18 nt, Mycobacterium tuberculosis H37Rv
cauccuggcggcugcagc

SEQ ID NO: 3295553 - RNA, 19 nt, Mycobacterium tuberculosis H37Rv
cauccuggcggcugcagcc

SEQ ID NO: 3295554 - RNA, 14 nt, Mycobacterium tuberculosis H37Rv
cauccuggucacca

SEQ ID NO: 3295555 - RNA, 21 nt, Mycobacterium tuberculosis H37Rv
cauccuggucaccagccaccg

SEQ ID NO: 3295556 - RNA, 22 nt, Mycobacterium tuberculosis H37Rv
cauccuggucaccagccaccgc

SEQ ID NO: 3295557 - RNA, 19 nt, Mycobacterium tuberculosis H37Rv
cauccuuaugcgcggugac

SEQ ID NO: 3295558 - RNA, 12 nt, Mycobacterium tuberculosis H37Rv
cauccuucacca

SEQ ID NO: 3295559 - RNA, 21 nt, Mycobacterium tuberculosis H37Rv
cauccuucgccggcgccagca

SEQ ID NO: 3295560 - RNA, 17 nt, Mycobacterium tuberculosis H37Rv
cauccuugccaaucgcc

SEQ ID NO: 3295561 - RNA, 19 nt, Mycobacterium tuberculosis H37Rv
caucgaaaaaccucgacgc

SEQ ID NO: 3295562 - RNA, 15 nt, Mycobacterium tuberculosis H37Rv
caucgaaggugcugg

SEQ ID NO: 3295563 - RNA, 17 nt, Mycobacterium tuberculosis H37Rv
caucgaaggugcuggug

SEQ ID NO: 3295564 - RNA, 16 nt, Mycobacterium tuberculosis H37Rv
caucgaccgcccgcca

SEQ ID NO: 3295565 - RNA, 17 nt, Mycobacterium tuberculosis H37Rv
caucgacggugaucagg

SEQ ID NO: 3295566 - RNA, 16 nt, Mycobacterium tuberculosis H37Rv
caucgacguuccagca

SEQ ID NO: 3295567 - RNA, 18 nt, Mycobacterium tuberculosis H37Rv
caucgacugccagcgccg

SEQ ID NO: 3295568 - RNA, 20 nt, Mycobacterium tuberculosis H37Rv
caucgacuugccgccgcaca

SEQ ID NO: 3295569 - RNA, 22 nt, Mycobacterium tuberculosis H37Rv
caucgagcccggacgagugcac

SEQ ID NO: 3295570 - RNA, 14 nt, Mycobacterium tuberculosis H37Rv
caucgagcgggauc

SEQ ID NO: 3295571 - RNA, 17 nt, Mycobacterium tuberculosis H37Rv
caucgagcgggaucggg

SEQ ID NO: 3295572 - RNA, 19 nt, Mycobacterium tuberculosis H37Rv
caucgaggcgaucaccgcg

SEQ ID NO: 3295573 - RNA, 14 nt, Mycobacterium tuberculosis H37Rv
caucgaguccacca

SEQ ID NO: 3295574 - RNA, 15 nt, Mycobacterium tuberculosis H37Rv
caucgaguccaccac

SEQ ID NO: 3295575 - RNA, 17 nt, Mycobacterium tuberculosis H37Rv
caucgaguccaccaccu

SEQ ID NO: 3295576 - RNA, 20 nt, Mycobacterium tuberculosis H37Rv
caucgaguccaccaccuggc

SEQ ID NO: 3295577 - RNA, 17 nt, Mycobacterium tuberculosis H37Rv
caucgaguucggcccgc

SEQ ID NO: 3295578 - RNA, 22 nt, Mycobacterium tuberculosis H37Rv
caucgaguucggcccgcaaaca

SEQ ID NO: 3295579 - RNA, 23 nt, Mycobacterium tuberculosis H37Rv
caucgauaaccgaaacucgacgu

SEQ ID NO: 3295580 - RNA, 14 nt, Mycobacterium tuberculosis H37Rv
caucgaucaccgcu

SEQ ID NO: 3295581 - RNA, 15 nt, Mycobacterium tuberculosis H37Rv
caucgaugcggugaa

SEQ ID NO: 3295582 - RNA, 17 nt, Mycobacterium tuberculosis H37Rv
caucgaugucagugauc

SEQ ID NO: 3295583 - RNA, 21 nt, Mycobacterium tuberculosis H37Rv
caucgaugucggcucggcccc

SEQ ID NO: 3295584 - RNA, 14 nt, Mycobacterium tuberculosis H37Rv
caucgcacaacugc

SEQ ID NO: 3295585 - RNA, 12 nt, Mycobacterium tuberculosis H37Rv
caucgcacagcg

SEQ ID NO: 3295586 - RNA, 14 nt, Mycobacterium tuberculosis H37Rv
caucgcacccacca

SEQ ID NO: 3295587 - RNA, 13 nt, Mycobacterium tuberculosis H37Rv
caucgcaggcacc

SEQ ID NO: 3295588 - RNA, 23 nt, Mycobacterium tuberculosis H37Rv
caucgcauccccagcacaaccag

SEQ ID NO: 3295589 - RNA, 15 nt, Mycobacterium tuberculosis H37Rv
caucgccaacaccaa

SEQ ID NO: 3295590 - RNA, 18 nt, Mycobacterium tuberculosis H37Rv
caucgccaacaccaacca

SEQ ID NO: 3295591 - RNA, 15 nt, Mycobacterium tuberculosis H37Rv
caucgccagccugug

SEQ ID NO: 3295592 - RNA, 21 nt, Mycobacterium tuberculosis H37Rv
caucgccagcgccggccaggc

SEQ ID NO: 3295593 - RNA, 13 nt, Mycobacterium tuberculosis H37Rv
caucgccagcggc

SEQ ID NO: 3295594 - RNA, 13 nt, Mycobacterium tuberculosis H37Rv
caucgccaggccc

SEQ ID NO: 3295595 - RNA, 17 nt, Mycobacterium tuberculosis H37Rv
caucgccauaccggccg

SEQ ID NO: 3295596 - RNA, 21 nt, Mycobacterium tuberculosis H37Rv
caucgccauaccggccgccau

SEQ ID NO: 3295597 - RNA, 23 nt, Mycobacterium tuberculosis H37Rv
caucgccauaggagaacuccggg

SEQ ID NO: 3295598 - RNA, 17 nt, Mycobacterium tuberculosis H37Rv
caucgccaugauggaca

SEQ ID NO: 3295599 - RNA, 16 nt, Mycobacterium tuberculosis H37Rv
caucgcccaacaacgc

SEQ ID NO: 3295600 - RNA, 14 nt, Mycobacterium tuberculosis H37Rv
caucguggcgucgu

SEQ ID NO: 3295601 - RNA, 17 nt, Mycobacterium tuberculosis H37Rv
caucguggggaucgacc

SEQ ID NO: 3295602 - RNA, 21 nt, Mycobacterium tuberculosis H37Rv
caucguggggaucgaccaugg

SEQ ID NO: 3295603 - RNA, 23 nt, Mycobacterium tuberculosis H37Rv
caucguggggaucgaccaugguc

SEQ ID NO: 3295604 - RNA, 12 nt, Mycobacterium tuberculosis H37Rv
caucgugguaac

SEQ ID NO: 3295605 - RNA, 18 nt, Mycobacterium tuberculosis H37Rv
caucguucaugaucggca

SEQ ID NO: 3295606 - RNA, 18 nt, Mycobacterium tuberculosis H37Rv
caucguucugacggcuug

SEQ ID NO: 3295607 - RNA, 19 nt, Mycobacterium tuberculosis H37Rv
caucguugccgaccgucac

SEQ ID NO: 3295608 - RNA, 18 nt, Mycobacterium tuberculosis H37Rv
caucguuggccgggcacg

SEQ ID NO: 3295609 - RNA, 21 nt, Mycobacterium tuberculosis H37Rv
caucuaccagcucacccugcu

SEQ ID NO: 3295610 - RNA, 15 nt, Mycobacterium tuberculosis H37Rv
caucucaccgggccc

SEQ ID NO: 3295611 - RNA, 16 nt, Mycobacterium tuberculosis H37Rv
caucucaugcaucugc

SEQ ID NO: 3295612 - RNA, 14 nt, Mycobacterium tuberculosis H37Rv
caucuccaccgucg

SEQ ID NO: 3295613 - RNA, 20 nt, Mycobacterium tuberculosis H37Rv
caucuccaccgucgccgccg

SEQ ID NO: 3295614 - RNA, 19 nt, Mycobacterium tuberculosis H37Rv
caucucccgaccgccgagc

SEQ ID NO: 3295615 - RNA, 20 nt, Mycobacterium tuberculosis H37Rv
caucucccgaccgccgagcg

SEQ ID NO: 3295616 - RNA, 21 nt, Mycobacterium tuberculosis H37Rv
caucucccgaccgccgagcgg

SEQ ID NO: 3295617 - RNA, 16 nt, Mycobacterium tuberculosis H37Rv
caucuccgccgguccc

SEQ ID NO: 3295618 - RNA, 16 nt, Mycobacterium tuberculosis H37Rv
caucuccgucggccag

SEQ ID NO: 3295619 - RNA, 15 nt, Mycobacterium tuberculosis H37Rv
caucucgacggugac

SEQ ID NO: 3295620 - RNA, 19 nt, Mycobacterium tuberculosis H37Rv
caucucgagcaugcccagc

SEQ ID NO: 3295621 - RNA, 14 nt, Mycobacterium tuberculosis H37Rv
caucucggaccaca

SEQ ID NO: 3295622 - RNA, 13 nt, Mycobacterium tuberculosis H37Rv
caucucggcggcc

SEQ ID NO: 3295623 - RNA, 22 nt, Mycobacterium tuberculosis H37Rv
caucucggcggccaacagcacc

SEQ ID NO: 3295624 - RNA, 19 nt, Mycobacterium tuberculosis H37Rv
caucucggcuacgccucgg

SEQ ID NO: 3295625 - RNA, 22 nt, Mycobacterium tuberculosis H37Rv
caucucggcuacgccucggcgu

SEQ ID NO: 3295626 - RNA, 20 nt, Mycobacterium tuberculosis H37Rv
caucucgggcgaagccgcug

SEQ ID NO: 3295627 - RNA, 14 nt, Mycobacterium tuberculosis H37Rv
caucucgucgguga

SEQ ID NO: 3295628 - RNA, 21 nt, Mycobacterium tuberculosis H37Rv
caucucgucgucgcggccgcu

SEQ ID NO: 3295629 - RNA, 19 nt, Mycobacterium tuberculosis H37Rv
caucucuugcaaccuggac

SEQ ID NO: 3295630 - RNA, 22 nt, Mycobacterium tuberculosis H37Rv
caucucuugcaaccuggacugc

SEQ ID NO: 3295631 - RNA, 15 nt, Mycobacterium tuberculosis H37Rv
caucugacagcuggg

SEQ ID NO: 3295632 - RNA, 16 nt, Mycobacterium tuberculosis H37Rv
caucugauccgguguc

SEQ ID NO: 3295633 - RNA, 19 nt, Mycobacterium tuberculosis H37Rv
caucugauccggugucgcg

SEQ ID NO: 3295634 - RNA, 23 nt, Mycobacterium tuberculosis H37Rv
caucugaucgggcccguccugcg

SEQ ID NO: 3295635 - RNA, 24 nt, Mycobacterium tuberculosis H37Rv
caucugccaaucugcacgcgcucg

SEQ ID NO: 3295636 - RNA, 17 nt, Mycobacterium tuberculosis H37Rv
caucugccacaggcguu

SEQ ID NO: 3295637 - RNA, 16 nt, Mycobacterium tuberculosis H37Rv
caucugcccaccgcag

SEQ ID NO: 3295638 - RNA, 14 nt, Mycobacterium tuberculosis H37Rv
caucugccugccug

SEQ ID NO: 3295639 - RNA, 16 nt, Mycobacterium tuberculosis H37Rv
caucugccugccugcg

SEQ ID NO: 3295640 - RNA, 19 nt, Mycobacterium tuberculosis H37Rv
caucugcgaaaagccuuga

SEQ ID NO: 3295641 - RNA, 12 nt, Mycobacterium tuberculosis H37Rv
caucugcucgcg

SEQ ID NO: 3295642 - RNA, 13 nt, Mycobacterium tuberculosis H37Rv
caucuggcgccgu

SEQ ID NO: 3295643 - RNA, 19 nt, Mycobacterium tuberculosis H37Rv
caucuggcgccguuagcgu

SEQ ID NO: 3295644 - RNA, 14 nt, Mycobacterium tuberculosis H37Rv
caucuggcgcgcca

SEQ ID NO: 3295645 - RNA, 15 nt, Mycobacterium tuberculosis H37Rv
caucuggcgcgccac

SEQ ID NO: 3295646 - RNA, 17 nt, Mycobacterium tuberculosis H37Rv
caucuggcgcugcuggc

SEQ ID NO: 3295647 - RNA, 18 nt, Mycobacterium tuberculosis H37Rv
caucuggcgcugcuggca

SEQ ID NO: 3295648 - RNA, 23 nt, Mycobacterium tuberculosis H37Rv
caucuggcugagcagacugcccu

SEQ ID NO: 3295649 - RNA, 20 nt, Mycobacterium tuberculosis H37Rv
caucugguauggguccucga

SEQ ID NO: 3295650 - RNA, 22 nt, Mycobacterium tuberculosis H37Rv
caucugguauggguccucgagc

SEQ ID NO: 3295651 - RNA, 14 nt, Mycobacterium tuberculosis H37Rv
caucuggucgacca

SEQ ID NO: 3295652 - RNA, 15 nt, Mycobacterium tuberculosis H37Rv
caucuggucgaccau

SEQ ID NO: 3295653 - RNA, 22 nt, Mycobacterium tuberculosis H37Rv
caucuguuccgugccagcugcc

SEQ ID NO: 3295654 - RNA, 19 nt, Mycobacterium tuberculosis H37Rv
caucuucggacgccagcuc

SEQ ID NO: 3295655 - RNA, 12 nt, Mycobacterium tuberculosis H37Rv
caucuugaccaa

SEQ ID NO: 3295656 - RNA, 12 nt, Mycobacterium tuberculosis H37Rv
caucuugccacc

SEQ ID NO: 3295657 - RNA, 13 nt, Mycobacterium tuberculosis H37Rv
caucuugccaccg

SEQ ID NO: 3295658 - RNA, 13 nt, Mycobacterium tuberculosis H37Rv
caucuugcggcag

SEQ ID NO: 3295659 - RNA, 18 nt, Mycobacterium tuberculosis H37Rv
caucuugucgaucugccc

SEQ ID NO: 3295660 - RNA, 17 nt, Mycobacterium tuberculosis H37Rv
caucuuuggcggccgca

SEQ ID NO: 3295661 - RNA, 14 nt, Mycobacterium tuberculosis H37Rv
caugaaaucgauga

SEQ ID NO: 3295662 - RNA, 20 nt, Mycobacterium tuberculosis H37Rv
caugaaaucgaugaccgcag

SEQ ID NO: 3295663 - RNA, 15 nt, Mycobacterium tuberculosis H37Rv
caugaacaucggccg

SEQ ID NO: 3295664 - RNA, 17 nt, Mycobacterium tuberculosis H37Rv
caugaacaucggccggg

SEQ ID NO: 3295665 - RNA, 19 nt, Mycobacterium tuberculosis H37Rv
caugaaccggucgaucccc

SEQ ID NO: 3295666 - RNA, 16 nt, Mycobacterium tuberculosis H37Rv
caugaacgccagcagc

SEQ ID NO: 3295667 - RNA, 18 nt, Mycobacterium tuberculosis H37Rv
caugaacgccagcagcgc

SEQ ID NO: 3295668 - RNA, 19 nt, Mycobacterium tuberculosis H37Rv
caugaacgccagcagcgcg

SEQ ID NO: 3295669 - RNA, 18 nt, Mycobacterium tuberculosis H37Rv
caugaagaacuggcugcu

SEQ ID NO: 3295670 - RNA, 13 nt, Mycobacterium tuberculosis H37Rv
caugaagauccag

SEQ ID NO: 3295671 - RNA, 15 nt, Mycobacterium tuberculosis H37Rv
caugaauccacugaa

SEQ ID NO: 3295672 - RNA, 19 nt, Mycobacterium tuberculosis H37Rv
caugacagccccgccgccc

SEQ ID NO: 3295673 - RNA, 21 nt, Mycobacterium tuberculosis H37Rv
caugaccaccgaaauacccag

SEQ ID NO: 3295674 - RNA, 23 nt, Mycobacterium tuberculosis H37Rv
caugaccgggcuggccagcgcgc

SEQ ID NO: 3295675 - RNA, 21 nt, Mycobacterium tuberculosis H37Rv
caugagcgaccgcgagggcca

SEQ ID NO: 3295676 - RNA, 22 nt, Mycobacterium tuberculosis H37Rv
caugagcuugguggccaccacg

SEQ ID NO: 3295677 - RNA, 18 nt, Mycobacterium tuberculosis H37Rv
caugagggcaucgagacg

SEQ ID NO: 3295678 - RNA, 21 nt, Mycobacterium tuberculosis H37Rv
caugaguacaaaccucgguuu

SEQ ID NO: 3295679 - RNA, 14 nt, Mycobacterium tuberculosis H37Rv
caugaucacaccga

SEQ ID NO: 3295680 - RNA, 17 nt, Mycobacterium tuberculosis H37Rv
caugaucccaugaaguc

SEQ ID NO: 3295681 - RNA, 21 nt, Mycobacterium tuberculosis H37Rv
caugauccccguugacccaga

SEQ ID NO: 3295682 - RNA, 13 nt, Mycobacterium tuberculosis H37Rv
caugaucggcaga

SEQ ID NO: 3295683 - RNA, 15 nt, Mycobacterium tuberculosis H37Rv
caugaugaacagcuc

SEQ ID NO: 3295684 - RNA, 17 nt, Mycobacterium tuberculosis H37Rv
caugaugaacagcucac

SEQ ID NO: 3295685 - RNA, 17 nt, Mycobacterium tuberculosis H37Rv
caugauugccaggaccg

SEQ ID NO: 3295686 - RNA, 14 nt, Mycobacterium tuberculosis H37Rv
caugcaacacaccg

SEQ ID NO: 3295687 - RNA, 18 nt, Mycobacterium tuberculosis H37Rv
caugcaacacaccgcgga

SEQ ID NO: 3295688 - RNA, 20 nt, Mycobacterium tuberculosis H37Rv
caugcaagucaaacgccguc

SEQ ID NO: 3295689 - RNA, 16 nt, Mycobacterium tuberculosis H37Rv
caugcacgccguagca

SEQ ID NO: 3295690 - RNA, 21 nt, Mycobacterium tuberculosis H37Rv
caugcacgucaucggcuggcc

SEQ ID NO: 3295691 - RNA, 22 nt, Mycobacterium tuberculosis H37Rv
caugcacguugccgaacgucgc

SEQ ID NO: 3295692 - RNA, 21 nt, Mycobacterium tuberculosis H37Rv
caugcaucugaucaggccaca

SEQ ID NO: 3295693 - RNA, 18 nt, Mycobacterium tuberculosis H37Rv
caugccaagcuccaacca

SEQ ID NO: 3295694 - RNA, 15 nt, Mycobacterium tuberculosis H37Rv
caugccacacacugc

SEQ ID NO: 3295695 - RNA, 14 nt, Mycobacterium tuberculosis H37Rv
caugccacagcggc

SEQ ID NO: 3295696 - RNA, 14 nt, Mycobacterium tuberculosis H37Rv
caugucgaugucca

SEQ ID NO: 3295697 - RNA, 21 nt, Mycobacterium tuberculosis H37Rv
caugucgccgaacgccaccac

SEQ ID NO: 3295698 - RNA, 15 nt, Mycobacterium tuberculosis H37Rv
caugucgcgccaggc

SEQ ID NO: 3295699 - RNA, 16 nt, Mycobacterium tuberculosis H37Rv
caugucgcggacccgc

SEQ ID NO: 3295700 - RNA, 16 nt, Mycobacterium tuberculosis H37Rv
caugucggccacccgg

SEQ ID NO: 3295701 - RNA, 20 nt, Mycobacterium tuberculosis H37Rv
caugucggccggggccaccc

SEQ ID NO: 3295702 - RNA, 23 nt, Mycobacterium tuberculosis H37Rv
caugucggccggggccacccgca

SEQ ID NO: 3295703 - RNA, 15 nt, Mycobacterium tuberculosis H37Rv
caugucggcgcgccg

SEQ ID NO: 3295704 - RNA, 20 nt, Mycobacterium tuberculosis H37Rv
caugucggugaccguucggc

SEQ ID NO: 3295705 - RNA, 13 nt, Mycobacterium tuberculosis H37Rv
caugucggugagg

SEQ ID NO: 3295706 - RNA, 19 nt, Mycobacterium tuberculosis H37Rv
caugucgguuuccucgagc

SEQ ID NO: 3295707 - RNA, 21 nt, Mycobacterium tuberculosis H37Rv
caugugcccaggucuccauca

SEQ ID NO: 3295708 - RNA, 17 nt, Mycobacterium tuberculosis H37Rv
caugugcgcgucgcgcg

SEQ ID NO: 3295709 - RNA, 21 nt, Mycobacterium tuberculosis H37Rv
caugugguggcgccggccggu

SEQ ID NO: 3295710 - RNA, 15 nt, Mycobacterium tuberculosis H37Rv
cauguuccacccggu

SEQ ID NO: 3295711 - RNA, 23 nt, Mycobacterium tuberculosis H37Rv
cauguuccuugcggccgcugauc

SEQ ID NO: 3295712 - RNA, 15 nt, Mycobacterium tuberculosis H37Rv
cauguucggccacca

SEQ ID NO: 3295713 - RNA, 21 nt, Mycobacterium tuberculosis H37Rv
cauguucggccaccagaacca

SEQ ID NO: 3295714 - RNA, 12 nt, Mycobacterium tuberculosis H37Rv
cauguugaccuc

SEQ ID NO: 3295715 - RNA, 20 nt, Mycobacterium tuberculosis H37Rv
cauguugaccucgcgcaccg

SEQ ID NO: 3295716 - RNA, 14 nt, Mycobacterium tuberculosis H37Rv
cauguugcccugca

SEQ ID NO: 3295717 - RNA, 21 nt, Mycobacterium tuberculosis H37Rv
cauguugcccugcaacccggu

SEQ ID NO: 3295718 - RNA, 22 nt, Mycobacterium tuberculosis H37Rv
cauguugcccugcaacccgguc

SEQ ID NO: 3295719 - RNA, 20 nt, Mycobacterium tuberculosis H37Rv
cauuaaugcggccccgcgca

SEQ ID NO: 3295720 - RNA, 15 nt, Mycobacterium tuberculosis H37Rv
cauuagcagcacccg

SEQ ID NO: 3295721 - RNA, 16 nt, Mycobacterium tuberculosis H37Rv
cauuagcagcacccgg

SEQ ID NO: 3295722 - RNA, 17 nt, Mycobacterium tuberculosis H37Rv
cauuagcagcacccggg

SEQ ID NO: 3295723 - RNA, 19 nt, Mycobacterium tuberculosis H37Rv
cauuaggcucucguagcgc

SEQ ID NO: 3295724 - RNA, 14 nt, Mycobacterium tuberculosis H37Rv
cauucaccgcgcac

SEQ ID NO: 3295725 - RNA, 17 nt, Mycobacterium tuberculosis H37Rv
cauuccagaucaacgcg

SEQ ID NO: 3295726 - RNA, 13 nt, Mycobacterium tuberculosis H37Rv
cauuccagcaggc

SEQ ID NO: 3295727 - RNA, 13 nt, Mycobacterium tuberculosis H37Rv
cauucccagaggc

SEQ ID NO: 3295728 - RNA, 17 nt, Mycobacterium tuberculosis H37Rv
cauucccgcucgcaggc

SEQ ID NO: 3295729 - RNA, 13 nt, Mycobacterium tuberculosis H37Rv
cauuccggcaccu

SEQ ID NO: 3295730 - RNA, 16 nt, Mycobacterium tuberculosis H37Rv
cauuccggcaccuccg

SEQ ID NO: 3295731 - RNA, 20 nt, Mycobacterium tuberculosis H37Rv
cauuccguuuuuguugaccc

SEQ ID NO: 3295732 - RNA, 14 nt, Mycobacterium tuberculosis H37Rv
cauucgccccaccc

SEQ ID NO: 3295733 - RNA, 13 nt, Mycobacterium tuberculosis H37Rv
cauucgcccggcc

SEQ ID NO: 3295734 - RNA, 21 nt, Mycobacterium tuberculosis H37Rv
cauucgcccggccgcagcggc

SEQ ID NO: 3295735 - RNA, 17 nt, Mycobacterium tuberculosis H37Rv
cauucgcgacaacucgc

SEQ ID NO: 3295736 - RNA, 13 nt, Mycobacterium tuberculosis H37Rv
cauucgggcgccc

SEQ ID NO: 3295737 - RNA, 14 nt, Mycobacterium tuberculosis H37Rv
cauucgugcccggg

SEQ ID NO: 3295738 - RNA, 17 nt, Mycobacterium tuberculosis H37Rv
cauucgugggaaccacc

SEQ ID NO: 3295739 - RNA, 20 nt, Mycobacterium tuberculosis H37Rv
cauucguugaugaugcccaa

SEQ ID NO: 3295740 - RNA, 20 nt, Mycobacterium tuberculosis H37Rv
cauucucggccggcggcgcc

SEQ ID NO: 3295741 - RNA, 11 nt, Mycobacterium tuberculosis H37Rv
cauucugcggc

SEQ ID NO: 3295742 - RNA, 18 nt, Mycobacterium tuberculosis H37Rv
cauucuucgaucagcggc

SEQ ID NO: 3295743 - RNA, 13 nt, Mycobacterium tuberculosis H37Rv
cauugaccaggug

SEQ ID NO: 3295744 - RNA, 18 nt, Mycobacterium tuberculosis H37Rv
cauugaguucggccacca

SEQ ID NO: 3295745 - RNA, 20 nt, Mycobacterium tuberculosis H37Rv
cauugaucgacggccagccc

SEQ ID NO: 3295746 - RNA, 15 nt, Mycobacterium tuberculosis H37Rv
cauugcaucugccaa

SEQ ID NO: 3295747 - RNA, 10 nt, Mycobacterium tuberculosis H37Rv
cauugccaua

SEQ ID NO: 3295748 - RNA, 21 nt, Mycobacterium tuberculosis H37Rv
cauugccauacagcaccccgc

SEQ ID NO: 3295749 - RNA, 19 nt, Mycobacterium tuberculosis H37Rv
cauugcccgagcccagcgc

SEQ ID NO: 3295750 - RNA, 20 nt, Mycobacterium tuberculosis H37Rv
cauugcccgagcccagcgcc

SEQ ID NO: 3295751 - RNA, 11 nt, Mycobacterium tuberculosis H37Rv
cauugcccuug

SEQ ID NO: 3295752 - RNA, 20 nt, Mycobacterium tuberculosis H37Rv
cauugccgacgcgcggccag

SEQ ID NO: 3295753 - RNA, 15 nt, Mycobacterium tuberculosis H37Rv
cauugccgaugguca

SEQ ID NO: 3295754 - RNA, 20 nt, Mycobacterium tuberculosis H37Rv
cauugccgcaugcucagcau

SEQ ID NO: 3295755 - RNA, 18 nt, Mycobacterium tuberculosis H37Rv
cauugccguucucgucga

SEQ ID NO: 3295756 - RNA, 22 nt, Mycobacterium tuberculosis H37Rv
cauugccugggcgaccggcucg

SEQ ID NO: 3295757 - RNA, 15 nt, Mycobacterium tuberculosis H37Rv
cauugcgcaggaugu

SEQ ID NO: 3295758 - RNA, 23 nt, Mycobacterium tuberculosis H37Rv
cauugcugcccaauggcguucgu

SEQ ID NO: 3295759 - RNA, 19 nt, Mycobacterium tuberculosis H37Rv
cauuggaugccauaggaca

SEQ ID NO: 3295760 - RNA, 19 nt, Mycobacterium tuberculosis H37Rv
cauuggccaggucggccac

SEQ ID NO: 3295761 - RNA, 22 nt, Mycobacterium tuberculosis H37Rv
cauuggccaggucggccaccgu

SEQ ID NO: 3295762 - RNA, 18 nt, Mycobacterium tuberculosis H37Rv
cauuggccuaggacaccg

SEQ ID NO: 3295763 - RNA, 18 nt, Mycobacterium tuberculosis H37Rv
cauuggcgaucagcagcc

SEQ ID NO: 3295764 - RNA, 13 nt, Mycobacterium tuberculosis H37Rv
cauuggcgccgcc

SEQ ID NO: 3295765 - RNA, 23 nt, Mycobacterium tuberculosis H37Rv
cauuggcgucgacaacacgccgu

SEQ ID NO: 3295766 - RNA, 16 nt, Mycobacterium tuberculosis H37Rv
cauugggguggcaucg

SEQ ID NO: 3295767 - RNA, 17 nt, Mycobacterium tuberculosis H37Rv
cauuggguaaccagcgc

SEQ ID NO: 3295768 - RNA, 18 nt, Mycobacterium tuberculosis H37Rv
cauuggguaaccagcgcc

SEQ ID NO: 3295769 - RNA, 19 nt, Mycobacterium tuberculosis H37Rv
cauuggugagguggucagc

SEQ ID NO: 3295770 - RNA, 22 nt, Mycobacterium tuberculosis H37Rv
cauugguguggaauacgcugcu

SEQ ID NO: 3295771 - RNA, 13 nt, Mycobacterium tuberculosis H37Rv
cauugugcucgcc

SEQ ID NO: 3295772 - RNA, 22 nt, Mycobacterium tuberculosis H37Rv
cauuguugaagaaagcgaccgu

SEQ ID NO: 3295773 - RNA, 21 nt, Mycobacterium tuberculosis H37Rv
cauuucaacguauccccgacc

SEQ ID NO: 3295774 - RNA, 20 nt, Mycobacterium tuberculosis H37Rv
cauuucgagggcaacggcac

SEQ ID NO: 3295775 - RNA, 20 nt, Mycobacterium tuberculosis H37Rv
cauuucgucgucgcagugca

SEQ ID NO: 3295776 - RNA, 14 nt, Mycobacterium tuberculosis H37Rv
ccaaaaacggcagc

SEQ ID NO: 3295777 - RNA, 23 nt, Mycobacterium tuberculosis H37Rv
ccaaaauccuucgcgcucauugc

SEQ ID NO: 3295778 - RNA, 23 nt, Mycobacterium tuberculosis H37Rv
ccaaaaugccuuggcagcccagu

SEQ ID NO: 3295779 - RNA, 21 nt, Mycobacterium tuberculosis H37Rv
ccaaaauuuugucggccgccu

SEQ ID NO: 3295780 - RNA, 18 nt, Mycobacterium tuberculosis H37Rv
ccaaacaccccggccuug

SEQ ID NO: 3295781 - RNA, 21 nt, Mycobacterium tuberculosis H37Rv
ccaaacacccuugcccacggc

SEQ ID NO: 3295782 - RNA, 22 nt, Mycobacterium tuberculosis H37Rv
ccaaaccggagucgucggcaac

SEQ ID NO: 3295783 - RNA, 21 nt, Mycobacterium tuberculosis H37Rv
ccaaaccggcccgcagcagca

SEQ ID NO: 3295784 - RNA, 16 nt, Mycobacterium tuberculosis H37Rv
ccaaacgcugcuggca

SEQ ID NO: 3295785 - RNA, 21 nt, Mycobacterium tuberculosis H37Rv
ccaaacuaacggcagccaccg

SEQ ID NO: 3295786 - RNA, 22 nt, Mycobacterium tuberculosis H37Rv
ccaaagcacuucacgaguagcg

SEQ ID NO: 3295787 - RNA, 15 nt, Mycobacterium tuberculosis H37Rv
ccaaagcgacgagca

SEQ ID NO: 3295788 - RNA, 20 nt, Mycobacterium tuberculosis H37Rv
ccaaagcgccagcagccacc

SEQ ID NO: 3295789 - RNA, 15 nt, Mycobacterium tuberculosis H37Rv
ccaaaggacgacacc

SEQ ID NO: 3295790 - RNA, 16 nt, Mycobacterium tuberculosis H37Rv
ccaaaggacgacaccg

SEQ ID NO: 3295791 - RNA, 21 nt, Mycobacterium tuberculosis H37Rv
ccaaaggacgacaccgcgaau

SEQ ID NO: 3295792 - RNA, 21 nt, Mycobacterium tuberculosis H37Rv
ccaagccgugccgcacagcgg

SEQ ID NO: 3295793 - RNA, 19 nt, Mycobacterium tuberculosis H37Rv
ccaagcgacucgccggcga

SEQ ID NO: 3295794 - RNA, 18 nt, Mycobacterium tuberculosis H37Rv
ccaagcgagcggcgaacu

SEQ ID NO: 3295795 - RNA, 18 nt, Mycobacterium tuberculosis H37Rv
ccaagcgcgguggucgcg

SEQ ID NO: 3295796 - RNA, 14 nt, Mycobacterium tuberculosis H37Rv
ccaagcguccgcug

SEQ ID NO: 3295797 - RNA, 17 nt, Mycobacterium tuberculosis H37Rv
ccaagcuaacucgaccc

SEQ ID NO: 3295798 - RNA, 19 nt, Mycobacterium tuberculosis H37Rv
ccaagcuaacucgacccgu

SEQ ID NO: 3295799 - RNA, 14 nt, Mycobacterium tuberculosis H37Rv
ccaagcucagggug

SEQ ID NO: 3295800 - RNA, 14 nt, Mycobacterium tuberculosis H37Rv
ccaagcucgacaac

SEQ ID NO: 3295801 - RNA, 16 nt, Mycobacterium tuberculosis H37Rv
ccaagcucggccacca

SEQ ID NO: 3295802 - RNA, 13 nt, Mycobacterium tuberculosis H37Rv
ccaagcucggccc

SEQ ID NO: 3295803 - RNA, 15 nt, Mycobacterium tuberculosis H37Rv
ccaagcucggcccag

SEQ ID NO: 3295804 - RNA, 16 nt, Mycobacterium tuberculosis H37Rv
ccaagcucggcccagc

SEQ ID NO: 3295805 - RNA, 20 nt, Mycobacterium tuberculosis H37Rv
ccaagcugucaagcgggcug

SEQ ID NO: 3295806 - RNA, 18 nt, Mycobacterium tuberculosis H37Rv
ccaaggacgaacgcgccg

SEQ ID NO: 3295807 - RNA, 19 nt, Mycobacterium tuberculosis H37Rv
ccaaggccgagcgcgauga

SEQ ID NO: 3295808 - RNA, 16 nt, Mycobacterium tuberculosis H37Rv
ccaaggccgucgaccc

SEQ ID NO: 3295809 - RNA, 21 nt, Mycobacterium tuberculosis H37Rv
ccaaggcgacgaaucggcaac

SEQ ID NO: 3295810 - RNA, 21 nt, Mycobacterium tuberculosis H37Rv
ccaaggcguugguagccaggg

SEQ ID NO: 3295811 - RNA, 17 nt, Mycobacterium tuberculosis H37Rv
ccaaggcucagcagcgc

SEQ ID NO: 3295812 - RNA, 18 nt, Mycobacterium tuberculosis H37Rv
ccaaggcucagcagcgcc

SEQ ID NO: 3295813 - RNA, 20 nt, Mycobacterium tuberculosis H37Rv
ccaagggauccgaagagcca

SEQ ID NO: 3295814 - RNA, 14 nt, Mycobacterium tuberculosis H37Rv
ccaagggcuguguc

SEQ ID NO: 3295815 - RNA, 15 nt, Mycobacterium tuberculosis H37Rv
ccaagguaguucgac

SEQ ID NO: 3295816 - RNA, 15 nt, Mycobacterium tuberculosis H37Rv
ccaagguccgcacga

SEQ ID NO: 3295817 - RNA, 18 nt, Mycobacterium tuberculosis H37Rv
ccaaggucuucaggccgc

SEQ ID NO: 3295818 - RNA, 21 nt, Mycobacterium tuberculosis H37Rv
ccaaggucuucaggccgcgca

SEQ ID NO: 3295819 - RNA, 22 nt, Mycobacterium tuberculosis H37Rv
ccaagguggcggccaguucggc

SEQ ID NO: 3295820 - RNA, 15 nt, Mycobacterium tuberculosis H37Rv
ccaaguacugggcca

SEQ ID NO: 3295821 - RNA, 14 nt, Mycobacterium tuberculosis H37Rv
ccaagucacagcuc

SEQ ID NO: 3295822 - RNA, 22 nt, Mycobacterium tuberculosis H37Rv
ccaagucagaacggcggcagcg

SEQ ID NO: 3295823 - RNA, 23 nt, Mycobacterium tuberculosis H37Rv
ccaagucgacgguggcgccgucg

SEQ ID NO: 3295824 - RNA, 15 nt, Mycobacterium tuberculosis H37Rv
ccaagucggagcggg

SEQ ID NO: 3295825 - RNA, 18 nt, Mycobacterium tuberculosis H37Rv
ccaagucucgggcuuacu

SEQ ID NO: 3295826 - RNA, 19 nt, Mycobacterium tuberculosis H37Rv
ccaagugagcgaucgggug

SEQ ID NO: 3295827 - RNA, 14 nt, Mycobacterium tuberculosis H37Rv
ccaagugcagggcu

SEQ ID NO: 3295828 - RNA, 17 nt, Mycobacterium tuberculosis H37Rv
ccaaguucuaagcguuu

SEQ ID NO: 3295829 - RNA, 22 nt, Mycobacterium tuberculosis H37Rv
ccaaguugcagcgggccacuga

SEQ ID NO: 3295830 - RNA, 14 nt, Mycobacterium tuberculosis H37Rv
ccaauacgugaugu

SEQ ID NO: 3295831 - RNA, 19 nt, Mycobacterium tuberculosis H37Rv
ccaauacgugauguagcug

SEQ ID NO: 3295832 - RNA, 22 nt, Mycobacterium tuberculosis H37Rv
ccaauaggcgaaaauugcucca

SEQ ID NO: 3295833 - RNA, 23 nt, Mycobacterium tuberculosis H37Rv
ccaauaggcgaaaauugcuccac

SEQ ID NO: 3295834 - RNA, 22 nt, Mycobacterium tuberculosis H37Rv
ccaauaguccuugcgccagcgg

SEQ ID NO: 3295835 - RNA, 22 nt, Mycobacterium tuberculosis H37Rv
ccaaucaccguaauuucuucac

SEQ ID NO: 3295836 - RNA, 19 nt, Mycobacterium tuberculosis H37Rv
ccaauccaccgauucggcg

SEQ ID NO: 3295837 - RNA, 23 nt, Mycobacterium tuberculosis H37Rv
ccaauccggaauagcaacgcugc

SEQ ID NO: 3295838 - RNA, 20 nt, Mycobacterium tuberculosis H37Rv
ccaauccggcgccagcagug

SEQ ID NO: 3295839 - RNA, 12 nt, Mycobacterium tuberculosis H37Rv
ccaaucgcacgc

SEQ ID NO: 3295840 - RNA, 20 nt, Mycobacterium tuberculosis H37Rv
ccaaucgccgucagcaccgc

SEQ ID NO: 3295841 - RNA, 17 nt, Mycobacterium tuberculosis H37Rv
ccaaucgggaucgcugc

SEQ ID NO: 3295842 - RNA, 18 nt, Mycobacterium tuberculosis H37Rv
ccaaucgggaucgcugcc

SEQ ID NO: 3295843 - RNA, 15 nt, Mycobacterium tuberculosis H37Rv
ccaaucgucggccag

SEQ ID NO: 3295844 - RNA, 17 nt, Mycobacterium tuberculosis H37Rv
ccaaucgucggccagca

SEQ ID NO: 3295845 - RNA, 18 nt, Mycobacterium tuberculosis H37Rv
ccaaugacuuggccagca

SEQ ID NO: 3295846 - RNA, 17 nt, Mycobacterium tuberculosis H37Rv
ccaaugcccuuggccag

SEQ ID NO: 3295847 - RNA, 20 nt, Mycobacterium tuberculosis H37Rv
ccaaugcccuuggccagcag

SEQ ID NO: 3295848 - RNA, 22 nt, Mycobacterium tuberculosis H37Rv
ccaaugccgcggaggcggccag

SEQ ID NO: 3295849 - RNA, 13 nt, Mycobacterium tuberculosis H37Rv
ccaaugccuugag

SEQ ID NO: 3295850 - RNA, 20 nt, Mycobacterium tuberculosis H37Rv
ccaauggccgcggcacccag

SEQ ID NO: 3295851 - RNA, 15 nt, Mycobacterium tuberculosis H37Rv
ccaaugucagugccc

SEQ ID NO: 3295852 - RNA, 22 nt, Mycobacterium tuberculosis H37Rv
ccaaugucagugccccgcccgg

SEQ ID NO: 3295853 - RNA, 16 nt, Mycobacterium tuberculosis H37Rv
ccaauugcgccgagcu

SEQ ID NO: 3295854 - RNA, 15 nt, Mycobacterium tuberculosis H37Rv
ccaauugcgccgcca

SEQ ID NO: 3295855 - RNA, 15 nt, Mycobacterium tuberculosis H37Rv
ccacaaacccgauga

SEQ ID NO: 3295856 - RNA, 15 nt, Mycobacterium tuberculosis H37Rv
ccacaaguagccgac

SEQ ID NO: 3295857 - RNA, 13 nt, Mycobacterium tuberculosis H37Rv
ccacaauccacgc

SEQ ID NO: 3295858 - RNA, 13 nt, Mycobacterium tuberculosis H37Rv
ccacaauccgcuc

SEQ ID NO: 3295859 - RNA, 15 nt, Mycobacterium tuberculosis H37Rv
ccacaauccgcucgg

SEQ ID NO: 3295860 - RNA, 13 nt, Mycobacterium tuberculosis H37Rv
ccacaaugcggcc

SEQ ID NO: 3295861 - RNA, 18 nt, Mycobacterium tuberculosis H37Rv
ccacacaccgagcacggg

SEQ ID NO: 3295862 - RNA, 13 nt, Mycobacterium tuberculosis H37Rv
ccacacacugccg

SEQ ID NO: 3295863 - RNA, 14 nt, Mycobacterium tuberculosis H37Rv
ccacacacugugcu

SEQ ID NO: 3295864 - RNA, 23 nt, Mycobacterium tuberculosis H37Rv
ccacacagaucuugugccaggcg

SEQ ID NO: 3295865 - RNA, 15 nt, Mycobacterium tuberculosis H37Rv
ccacaccacgauggc

SEQ ID NO: 3295866 - RNA, 11 nt, Mycobacterium tuberculosis H37Rv
ccacaccagcg

SEQ ID NO: 3295867 - RNA, 15 nt, Mycobacterium tuberculosis H37Rv
ccacaccagcgcagc

SEQ ID NO: 3295868 - RNA, 14 nt, Mycobacterium tuberculosis H37Rv
ccacaccaggccga

SEQ ID NO: 3295869 - RNA, 15 nt, Mycobacterium tuberculosis H37Rv
ccacacccaguugau

SEQ ID NO: 3295870 - RNA, 18 nt, Mycobacterium tuberculosis H37Rv
ccacacccaguugaugcg

SEQ ID NO: 3295871 - RNA, 15 nt, Mycobacterium tuberculosis H37Rv
ccacaccggagccga

SEQ ID NO: 3295872 - RNA, 16 nt, Mycobacterium tuberculosis H37Rv
ccacaccggggcggcc

SEQ ID NO: 3295873 - RNA, 22 nt, Mycobacterium tuberculosis H37Rv
ccacaccuaccguacgcagcgu

SEQ ID NO: 3295874 - RNA, 16 nt, Mycobacterium tuberculosis H37Rv
ccacaccugcggcugc

SEQ ID NO: 3295875 - RNA, 15 nt, Mycobacterium tuberculosis H37Rv
ccacaccuuggccgc

SEQ ID NO: 3295876 - RNA, 16 nt, Mycobacterium tuberculosis H37Rv
ccacaccuuggccgcc

SEQ ID NO: 3295877 - RNA, 20 nt, Mycobacterium tuberculosis H37Rv
ccacacgcccucgacgccgc

SEQ ID NO: 3295878 - RNA, 14 nt, Mycobacterium tuberculosis H37Rv
ccacacggugcgau

SEQ ID NO: 3295879 - RNA, 22 nt, Mycobacterium tuberculosis H37Rv
ccacacggugcgauuccgcguc

SEQ ID NO: 3295880 - RNA, 14 nt, Mycobacterium tuberculosis H37Rv
ccacacuggcagug

SEQ ID NO: 3295881 - RNA, 19 nt, Mycobacterium tuberculosis H37Rv
ccacagacgacgucggcgu

SEQ ID NO: 3295882 - RNA, 14 nt, Mycobacterium tuberculosis H37Rv
ccacagcgacagcg

SEQ ID NO: 3295883 - RNA, 11 nt, Mycobacterium tuberculosis H37Rv
ccacagcgcca

SEQ ID NO: 3295884 - RNA, 19 nt, Mycobacterium tuberculosis H37Rv
ccacagcgccaucagacca

SEQ ID NO: 3295885 - RNA, 13 nt, Mycobacterium tuberculosis H37Rv
ccacagcucgccg

SEQ ID NO: 3295886 - RNA, 21 nt, Mycobacterium tuberculosis H37Rv
ccacagcuugcccgagcccag

SEQ ID NO: 3295887 - RNA, 22 nt, Mycobacterium tuberculosis H37Rv
ccacaggggcagcgcggccacc

SEQ ID NO: 3295888 - RNA, 20 nt, Mycobacterium tuberculosis H37Rv
ccaccccgcguaugccagga

SEQ ID NO: 3295889 - RNA, 15 nt, Mycobacterium tuberculosis H37Rv
ccacccgagcacuga

SEQ ID NO: 3295890 - RNA, 18 nt, Mycobacterium tuberculosis H37Rv
ccacccgauuggccaacc

SEQ ID NO: 3295891 - RNA, 19 nt, Mycobacterium tuberculosis H37Rv
ccacccgcaccaccggccc

SEQ ID NO: 3295892 - RNA, 13 nt, Mycobacterium tuberculosis H37Rv
ccacccgcaccgc

SEQ ID NO: 3295893 - RNA, 23 nt, Mycobacterium tuberculosis H37Rv
ccacccgcacuccaagucacagc

SEQ ID NO: 3295894 - RNA, 14 nt, Mycobacterium tuberculosis H37Rv
ccacccgccacggu

SEQ ID NO: 3295895 - RNA, 21 nt, Mycobacterium tuberculosis H37Rv
ccacccgcgccgccagcgccg

SEQ ID NO: 3295896 - RNA, 22 nt, Mycobacterium tuberculosis H37Rv
ccacccgcgccgccagcgccgc

SEQ ID NO: 3295897 - RNA, 15 nt, Mycobacterium tuberculosis H37Rv
ccacccgcgccgccc

SEQ ID NO: 3295898 - RNA, 13 nt, Mycobacterium tuberculosis H37Rv
ccacccgcggcgc

SEQ ID NO: 3295899 - RNA, 23 nt, Mycobacterium tuberculosis H37Rv
ccacccggcgggcggugggcagc

SEQ ID NO: 3295900 - RNA, 15 nt, Mycobacterium tuberculosis H37Rv
ccacccgggugggcc

SEQ ID NO: 3295901 - RNA, 14 nt, Mycobacterium tuberculosis H37Rv
ccacccggugccgc

SEQ ID NO: 3295902 - RNA, 17 nt, Mycobacterium tuberculosis H37Rv
ccacccggugccgcagc

SEQ ID NO: 3295903 - RNA, 12 nt, Mycobacterium tuberculosis H37Rv
ccacccgguggc

SEQ ID NO: 3295904 - RNA, 16 nt, Mycobacterium tuberculosis H37Rv
ccacccguucggcugc

SEQ ID NO: 3295905 - RNA, 23 nt, Mycobacterium tuberculosis H37Rv
ccacccuaaucguuccgcagucu

SEQ ID NO: 3295906 - RNA, 15 nt, Mycobacterium tuberculosis H37Rv
ccacccucgggucca

SEQ ID NO: 3295907 - RNA, 20 nt, Mycobacterium tuberculosis H37Rv
ccacccuguuguugccccgg

SEQ ID NO: 3295908 - RNA, 13 nt, Mycobacterium tuberculosis H37Rv
ccaccgaaaaguc

SEQ ID NO: 3295909 - RNA, 19 nt, Mycobacterium tuberculosis H37Rv
ccaccgaaaccggucagca

SEQ ID NO: 3295910 - RNA, 23 nt, Mycobacterium tuberculosis H37Rv
ccaccgaacgcggccaccgaccg

SEQ ID NO: 3295911 - RNA, 20 nt, Mycobacterium tuberculosis H37Rv
ccaccgaacgugugggccau

SEQ ID NO: 3295912 - RNA, 12 nt, Mycobacterium tuberculosis H37Rv
ccaccgacagca

SEQ ID NO: 3295913 - RNA, 22 nt, Mycobacterium tuberculosis H37Rv
ccaccgacagcacccggccacc

SEQ ID NO: 3295914 - RNA, 23 nt, Mycobacterium tuberculosis H37Rv
ccaccgacagcacccggccaccg

SEQ ID NO: 3295915 - RNA, 14 nt, Mycobacterium tuberculosis H37Rv
ccaccgacagcccc

SEQ ID NO: 3295916 - RNA, 22 nt, Mycobacterium tuberculosis H37Rv
ccaccgacauguguggcagccc

SEQ ID NO: 3295917 - RNA, 15 nt, Mycobacterium tuberculosis H37Rv
ccaccgaccgcacga

SEQ ID NO: 3295918 - RNA, 15 nt, Mycobacterium tuberculosis H37Rv
ccaccgaccgcguaa

SEQ ID NO: 3295919 - RNA, 20 nt, Mycobacterium tuberculosis H37Rv
ccaccgaccgcguaaaggcc

SEQ ID NO: 3295920 - RNA, 20 nt, Mycobacterium tuberculosis H37Rv
ccaccgacgacaucgguggc

SEQ ID NO: 3295921 - RNA, 23 nt, Mycobacterium tuberculosis H37Rv
ccaccgacggaaugucagccggu

SEQ ID NO: 3295922 - RNA, 17 nt, Mycobacterium tuberculosis H37Rv
ccaccgacguggccagc

SEQ ID NO: 3295923 - RNA, 19 nt, Mycobacterium tuberculosis H37Rv
ccaccgacguggccagccc

SEQ ID NO: 3295924 - RNA, 21 nt, Mycobacterium tuberculosis H37Rv
ccaccgagaucaugccggcga

SEQ ID NO: 3295925 - RNA, 13 nt, Mycobacterium tuberculosis H37Rv
ccaccgagcgcaa

SEQ ID NO: 3295926 - RNA, 21 nt, Mycobacterium tuberculosis H37Rv
ccaccgaguagaacuucgcca

SEQ ID NO: 3295927 - RNA, 22 nt, Mycobacterium tuberculosis H37Rv
ccaccgaguagaacuucgccag

SEQ ID NO: 3295928 - RNA, 16 nt, Mycobacterium tuberculosis H37Rv
ccaccgauaccgucag

SEQ ID NO: 3295929 - RNA, 21 nt, Mycobacterium tuberculosis H37Rv
ccaccgauaccgucagcgccg

SEQ ID NO: 3295930 - RNA, 15 nt, Mycobacterium tuberculosis H37Rv
ccaccgauucggcga

SEQ ID NO: 3295931 - RNA, 16 nt, Mycobacterium tuberculosis H37Rv
ccaccgcaagaaucag

SEQ ID NO: 3295932 - RNA, 13 nt, Mycobacterium tuberculosis H37Rv
ccaccgcaccugc

SEQ ID NO: 3295933 - RNA, 15 nt, Mycobacterium tuberculosis H37Rv
ccaccgcaccugcga

SEQ ID NO: 3295934 - RNA, 15 nt, Mycobacterium tuberculosis H37Rv
ccaccgcagcauccc

SEQ ID NO: 3295935 - RNA, 17 nt, Mycobacterium tuberculosis H37Rv
ccaccgcagcaucccug

SEQ ID NO: 3295936 - RNA, 21 nt, Mycobacterium tuberculosis H37Rv
ccaccgcauaacgccaguccc

SEQ ID NO: 3295937 - RNA, 15 nt, Mycobacterium tuberculosis H37Rv
ccaccgcaucgccga

SEQ ID NO: 3295938 - RNA, 14 nt, Mycobacterium tuberculosis H37Rv
ccaccgcaucggug

SEQ ID NO: 3295939 - RNA, 23 nt, Mycobacterium tuberculosis H37Rv
ccaccgcaucggugucuuccucc

SEQ ID NO: 3295940 - RNA, 19 nt, Mycobacterium tuberculosis H37Rv
ccaccgccaccacccaggc

SEQ ID NO: 3295941 - RNA, 13 nt, Mycobacterium tuberculosis H37Rv
ccaccgccgccac

SEQ ID NO: 3295942 - RNA, 12 nt, Mycobacterium tuberculosis H37Rv
ccaccgccgccg

SEQ ID NO: 3295943 - RNA, 13 nt, Mycobacterium tuberculosis H37Rv
ccaccgccgccga

SEQ ID NO: 3295944 - RNA, 14 nt, Mycobacterium tuberculosis H37Rv
ccaccgccgccgaa

SEQ ID NO: 3295945 - RNA, 16 nt, Mycobacterium tuberculosis H37Rv
ccaccgccgccgccac

SEQ ID NO: 3295946 - RNA, 22 nt, Mycobacterium tuberculosis H37Rv
ccaccgccgccgccgacgccgc

SEQ ID NO: 3295947 - RNA, 15 nt, Mycobacterium tuberculosis H37Rv
ccaccgccgccggag

SEQ ID NO: 3295948 - RNA, 15 nt, Mycobacterium tuberculosis H37Rv
ccaccgccgccggca

SEQ ID NO: 3295949 - RNA, 16 nt, Mycobacterium tuberculosis H37Rv
ccaccgccgccugccc

SEQ ID NO: 3295950 - RNA, 17 nt, Mycobacterium tuberculosis H37Rv
ccaccgccgccugcccg

SEQ ID NO: 3295951 - RNA, 14 nt, Mycobacterium tuberculosis H37Rv
ccaccgccgcugcc

SEQ ID NO: 3295952 - RNA, 12 nt, Mycobacterium tuberculosis H37Rv
ccaccgccggca

SEQ ID NO: 3295953 - RNA, 13 nt, Mycobacterium tuberculosis H37Rv
ccaccgccggccc

SEQ ID NO: 3295954 - RNA, 15 nt, Mycobacterium tuberculosis H37Rv
ccaccgccggcccgc

SEQ ID NO: 3295955 - RNA, 19 nt, Mycobacterium tuberculosis H37Rv
ccaccgccggugccgccau

SEQ ID NO: 3295956 - RNA, 13 nt, Mycobacterium tuberculosis H37Rv
ccaccgcgaccuc

SEQ ID NO: 3295957 - RNA, 17 nt, Mycobacterium tuberculosis H37Rv
ccaccgcgacgagcggc

SEQ ID NO: 3295958 - RNA, 15 nt, Mycobacterium tuberculosis H37Rv
ccaccgcgacuuugc

SEQ ID NO: 3295959 - RNA, 13 nt, Mycobacterium tuberculosis H37Rv
ccaccgcgagcag

SEQ ID NO: 3295960 - RNA, 15 nt, Mycobacterium tuberculosis H37Rv
ccaccgcgagcagag

SEQ ID NO: 3295961 - RNA, 13 nt, Mycobacterium tuberculosis H37Rv
ccaccgcgaugac

SEQ ID NO: 3295962 - RNA, 15 nt, Mycobacterium tuberculosis H37Rv
ccaccgcgccgagca

SEQ ID NO: 3295963 - RNA, 12 nt, Mycobacterium tuberculosis H37Rv
ccaccgcggcga

SEQ ID NO: 3295964 - RNA, 18 nt, Mycobacterium tuberculosis H37Rv
ccaccgcggcggcggcca

SEQ ID NO: 3295965 - RNA, 14 nt, Mycobacterium tuberculosis H37Rv
ccaccgcggcgucg

SEQ ID NO: 3295966 - RNA, 19 nt, Mycobacterium tuberculosis H37Rv
ccaccgcggucaccgacgc

SEQ ID NO: 3295967 - RNA, 14 nt, Mycobacterium tuberculosis H37Rv
ccaccgcggucagc

SEQ ID NO: 3295968 - RNA, 18 nt, Mycobacterium tuberculosis H37Rv
ccaccgcggucagcucgg

SEQ ID NO: 3295969 - RNA, 21 nt, Mycobacterium tuberculosis H37Rv
ccaccgcggucagcucggcag

SEQ ID NO: 3295970 - RNA, 17 nt, Mycobacterium tuberculosis H37Rv
ccaccgcguuggccaca

SEQ ID NO: 3295971 - RNA, 18 nt, Mycobacterium tuberculosis H37Rv
ccaccgcguuggccacac

SEQ ID NO: 3295972 - RNA, 21 nt, Mycobacterium tuberculosis H37Rv
ccaccgcucgucguccggcca

SEQ ID NO: 3295973 - RNA, 18 nt, Mycobacterium tuberculosis H37Rv
ccaccgcugccggcagcg

SEQ ID NO: 3295974 - RNA, 21 nt, Mycobacterium tuberculosis H37Rv
ccaccgcugccggcagcgucc

SEQ ID NO: 3295975 - RNA, 16 nt, Mycobacterium tuberculosis H37Rv
ccaccgcugccggcgc

SEQ ID NO: 3295976 - RNA, 13 nt, Mycobacterium tuberculosis H37Rv
ccaccgcuggauc

SEQ ID NO: 3295977 - RNA, 13 nt, Mycobacterium tuberculosis H37Rv
ccaccgcugucga

SEQ ID NO: 3295978 - RNA, 13 nt, Mycobacterium tuberculosis H37Rv
ccaccgcuuccag

SEQ ID NO: 3295979 - RNA, 16 nt, Mycobacterium tuberculosis H37Rv
ccaccgcuugaccccu

SEQ ID NO: 3295980 - RNA, 20 nt, Mycobacterium tuberculosis H37Rv
ccaccggaauccgggccgcc

SEQ ID NO: 3295981 - RNA, 19 nt, Mycobacterium tuberculosis H37Rv
ccaccggaccgaccaccgc

SEQ ID NO: 3295982 - RNA, 17 nt, Mycobacterium tuberculosis H37Rv
ccaccggcaacaucagc

SEQ ID NO: 3295983 - RNA, 17 nt, Mycobacterium tuberculosis H37Rv
ccaccggcacccccguc

SEQ ID NO: 3295984 - RNA, 19 nt, Mycobacterium tuberculosis H37Rv
ccaccggcacccccgucgc

SEQ ID NO: 3295985 - RNA, 22 nt, Mycobacterium tuberculosis H37Rv
ccacgcacaauacggucagcag

SEQ ID NO: 3295986 - RNA, 13 nt, Mycobacterium tuberculosis H37Rv
ccacgcacccggc

SEQ ID NO: 3295987 - RNA, 13 nt, Mycobacterium tuberculosis H37Rv
ccacgcacggugg

SEQ ID NO: 3295988 - RNA, 22 nt, Mycobacterium tuberculosis H37Rv
ccacgcacucgucgggguugau

SEQ ID NO: 3295989 - RNA, 16 nt, Mycobacterium tuberculosis H37Rv
ccacgcagcacggcac

SEQ ID NO: 3295990 - RNA, 22 nt, Mycobacterium tuberculosis H37Rv
ccacgcaugggccaggucagcc

SEQ ID NO: 3295991 - RNA, 14 nt, Mycobacterium tuberculosis H37Rv
ccacgccagcucgc

SEQ ID NO: 3295992 - RNA, 18 nt, Mycobacterium tuberculosis H37Rv
ccacgccagcucgccggc

SEQ ID NO: 3295993 - RNA, 18 nt, Mycobacterium tuberculosis H37Rv
ccacgccaucgagcagca

SEQ ID NO: 3295994 - RNA, 17 nt, Mycobacterium tuberculosis H37Rv
ccacgcccaauguccag

SEQ ID NO: 3295995 - RNA, 19 nt, Mycobacterium tuberculosis H37Rv
ccacgcccacaggggcagc

SEQ ID NO: 3295996 - RNA, 19 nt, Mycobacterium tuberculosis H37Rv
ccacgccgaccaucucacc

SEQ ID NO: 3295997 - RNA, 21 nt, Mycobacterium tuberculosis H37Rv
ccacgccgacuaguccgaggg

SEQ ID NO: 3295998 - RNA, 13 nt, Mycobacterium tuberculosis H37Rv
ccacgccgaucaa

SEQ ID NO: 3295999 - RNA, 11 nt, Mycobacterium tuberculosis H37Rv
ccacgccgccg

SEQ ID NO: 3296000 - RNA, 16 nt, Mycobacterium tuberculosis H37Rv
ccacgccgccggcgcu

SEQ ID NO: 3296001 - RNA, 23 nt, Mycobacterium tuberculosis H37Rv
ccacgccgccggcgcugaucgcg

SEQ ID NO: 3296002 - RNA, 22 nt, Mycobacterium tuberculosis H37Rv
ccacgccguagcgcagcgccuc

SEQ ID NO: 3296003 - RNA, 22 nt, Mycobacterium tuberculosis H37Rv
ccacgcgccgcacauugguguc

SEQ ID NO: 3296004 - RNA, 22 nt, Mycobacterium tuberculosis H37Rv
ccacgcggauaucuugcgcaug

SEQ ID NO: 3296005 - RNA, 17 nt, Mycobacterium tuberculosis H37Rv
ccacgcgucgcuguugg

SEQ ID NO: 3296006 - RNA, 20 nt, Mycobacterium tuberculosis H37Rv
ccacgcgucgcuguuggcga

SEQ ID NO: 3296007 - RNA, 14 nt, Mycobacterium tuberculosis H37Rv
ccacgcguugacga

SEQ ID NO: 3296008 - RNA, 23 nt, Mycobacterium tuberculosis H37Rv
ccacgcguugacgaucuccgcca

SEQ ID NO: 3296009 - RNA, 18 nt, Mycobacterium tuberculosis H37Rv
ccacgcguuucgaaccgc

SEQ ID NO: 3296010 - RNA, 16 nt, Mycobacterium tuberculosis H37Rv
ccacgcucaacccgug

SEQ ID NO: 3296011 - RNA, 18 nt, Mycobacterium tuberculosis H37Rv
ccacgcucggcggccagc

SEQ ID NO: 3296012 - RNA, 18 nt, Mycobacterium tuberculosis H37Rv
ccacgcucggugcugcgc

SEQ ID NO: 3296013 - RNA, 16 nt, Mycobacterium tuberculosis H37Rv
ccacgcugcagaugga

SEQ ID NO: 3296014 - RNA, 22 nt, Mycobacterium tuberculosis H37Rv
ccacgcugcccacgggccggcc

SEQ ID NO: 3296015 - RNA, 15 nt, Mycobacterium tuberculosis H37Rv
ccacgcugccgcagu

SEQ ID NO: 3296016 - RNA, 20 nt, Mycobacterium tuberculosis H37Rv
ccacgcugccgcaguucauc

SEQ ID NO: 3296017 - RNA, 14 nt, Mycobacterium tuberculosis H37Rv
ccacgcugguguug

SEQ ID NO: 3296018 - RNA, 23 nt, Mycobacterium tuberculosis H37Rv
ccacgcugguguuguacuggcuc

SEQ ID NO: 3296019 - RNA, 23 nt, Mycobacterium tuberculosis H37Rv
ccacgcugugcucgacgaagauc

SEQ ID NO: 3296020 - RNA, 18 nt, Mycobacterium tuberculosis H37Rv
ccacggaaguaucgccgg

SEQ ID NO: 3296021 - RNA, 13 nt, Mycobacterium tuberculosis H37Rv
ccacggaccagcg

SEQ ID NO: 3296022 - RNA, 17 nt, Mycobacterium tuberculosis H37Rv
ccacggacgugacgucg

SEQ ID NO: 3296023 - RNA, 17 nt, Mycobacterium tuberculosis H37Rv
ccacggagaccggccgg

SEQ ID NO: 3296024 - RNA, 21 nt, Mycobacterium tuberculosis H37Rv
ccacggcaagcgugacccgcc

SEQ ID NO: 3296025 - RNA, 18 nt, Mycobacterium tuberculosis H37Rv
ccacggcaaucaacgcaa

SEQ ID NO: 3296026 - RNA, 16 nt, Mycobacterium tuberculosis H37Rv
ccacggcaccgaucaa

SEQ ID NO: 3296027 - RNA, 12 nt, Mycobacterium tuberculosis H37Rv
ccacggcagcca

SEQ ID NO: 3296028 - RNA, 14 nt, Mycobacterium tuberculosis H37Rv
ccacggcagcgccc

SEQ ID NO: 3296029 - RNA, 21 nt, Mycobacterium tuberculosis H37Rv
ccacggcaggcagggcagccc

SEQ ID NO: 3296030 - RNA, 20 nt, Mycobacterium tuberculosis H37Rv
ccacggccagaaacccggcg

SEQ ID NO: 3296031 - RNA, 15 nt, Mycobacterium tuberculosis H37Rv
ccacggccgccgcgu

SEQ ID NO: 3296032 - RNA, 14 nt, Mycobacterium tuberculosis H37Rv
ccacggccggccgc

SEQ ID NO: 3296033 - RNA, 19 nt, Mycobacterium tuberculosis H37Rv
ccacggcgaccaggagccu

SEQ ID NO: 3296034 - RNA, 19 nt, Mycobacterium tuberculosis H37Rv
ccacggcgauccggucggc

SEQ ID NO: 3296035 - RNA, 15 nt, Mycobacterium tuberculosis H37Rv
ccacggcgaugcagc

SEQ ID NO: 3296036 - RNA, 17 nt, Mycobacterium tuberculosis H37Rv
ccacggcgauuccuccg

SEQ ID NO: 3296037 - RNA, 20 nt, Mycobacterium tuberculosis H37Rv
ccacggcggcaucaccuggc

SEQ ID NO: 3296038 - RNA, 19 nt, Mycobacterium tuberculosis H37Rv
ccacggcggccaccugcug

SEQ ID NO: 3296039 - RNA, 19 nt, Mycobacterium tuberculosis H37Rv
ccacggcgggaacggugcc

SEQ ID NO: 3296040 - RNA, 13 nt, Mycobacterium tuberculosis H37Rv
ccacggcgggcga

SEQ ID NO: 3296041 - RNA, 19 nt, Mycobacterium tuberculosis H37Rv
ccacggcgggcgacccguu

SEQ ID NO: 3296042 - RNA, 17 nt, Mycobacterium tuberculosis H37Rv
ccacggcgggcgagcca

SEQ ID NO: 3296043 - RNA, 22 nt, Mycobacterium tuberculosis H37Rv
ccacggcgucggccacccgguc

SEQ ID NO: 3296044 - RNA, 15 nt, Mycobacterium tuberculosis H37Rv
ccacggcuucgccgc

SEQ ID NO: 3296045 - RNA, 19 nt, Mycobacterium tuberculosis H37Rv
ccacggcuucgccgcggga

SEQ ID NO: 3296046 - RNA, 17 nt, Mycobacterium tuberculosis H37Rv
ccacggcuuugcggcgc

SEQ ID NO: 3296047 - RNA, 17 nt, Mycobacterium tuberculosis H37Rv
ccacgggcggccaccgc

SEQ ID NO: 3296048 - RNA, 21 nt, Mycobacterium tuberculosis H37Rv
ccacgggcggccaccgcacgc

SEQ ID NO: 3296049 - RNA, 22 nt, Mycobacterium tuberculosis H37Rv
ccacgggcggccaccgcacgcu

SEQ ID NO: 3296050 - RNA, 14 nt, Mycobacterium tuberculosis H37Rv
ccacggggcagguc

SEQ ID NO: 3296051 - RNA, 14 nt, Mycobacterium tuberculosis H37Rv
ccacggggcugccg

SEQ ID NO: 3296052 - RNA, 21 nt, Mycobacterium tuberculosis H37Rv
ccacggggcuuggcgacgucg

SEQ ID NO: 3296053 - RNA, 13 nt, Mycobacterium tuberculosis H37Rv
ccacggguggugc

SEQ ID NO: 3296054 - RNA, 16 nt, Mycobacterium tuberculosis H37Rv
ccacggucagcacgcu

SEQ ID NO: 3296055 - RNA, 16 nt, Mycobacterium tuberculosis H37Rv
ccacggucauugggug

SEQ ID NO: 3296056 - RNA, 18 nt, Mycobacterium tuberculosis H37Rv
ccacggucauuggguguc

SEQ ID NO: 3296057 - RNA, 18 nt, Mycobacterium tuberculosis H37Rv
ccacgguccggcccacca

SEQ ID NO: 3296058 - RNA, 19 nt, Mycobacterium tuberculosis H37Rv
ccacgguccggcccaccag

SEQ ID NO: 3296059 - RNA, 14 nt, Mycobacterium tuberculosis H37Rv
ccacggucgaccag

SEQ ID NO: 3296060 - RNA, 15 nt, Mycobacterium tuberculosis H37Rv
ccacggucgaccagg

SEQ ID NO: 3296061 - RNA, 21 nt, Mycobacterium tuberculosis H37Rv
ccacggucgccgaccacucga

SEQ ID NO: 3296062 - RNA, 21 nt, Mycobacterium tuberculosis H37Rv
ccacggucgggaccggcuugc

SEQ ID NO: 3296063 - RNA, 20 nt, Mycobacterium tuberculosis H37Rv
ccacggugcggugauauccg

SEQ ID NO: 3296064 - RNA, 22 nt, Mycobacterium tuberculosis H37Rv
ccacgguggucccccgcagcca

SEQ ID NO: 3296065 - RNA, 13 nt, Mycobacterium tuberculosis H37Rv
ccacggugucgcg

SEQ ID NO: 3296066 - RNA, 12 nt, Mycobacterium tuberculosis H37Rv
ccacggugucgu

SEQ ID NO: 3296067 - RNA, 20 nt, Mycobacterium tuberculosis H37Rv
ccacgguucgggcagcaccc

SEQ ID NO: 3296068 - RNA, 22 nt, Mycobacterium tuberculosis H37Rv
ccacgguuggccaccagcuggc

SEQ ID NO: 3296069 - RNA, 22 nt, Mycobacterium tuberculosis H37Rv
ccacguacuccaccgcgccguc

SEQ ID NO: 3296070 - RNA, 21 nt, Mycobacterium tuberculosis H37Rv
ccacguacuuggacgacccgg

SEQ ID NO: 3296071 - RNA, 22 nt, Mycobacterium tuberculosis H37Rv
ccacguacuuggacgacccggg

SEQ ID NO: 3296072 - RNA, 14 nt, Mycobacterium tuberculosis H37Rv
ccacguagcagcag

SEQ ID NO: 3296073 - RNA, 20 nt, Mycobacterium tuberculosis H37Rv
ccacguagcagcgccggcac

SEQ ID NO: 3296074 - RNA, 22 nt, Mycobacterium tuberculosis H37Rv
ccacguagcagcgccggcaccg

SEQ ID NO: 3296075 - RNA, 20 nt, Mycobacterium tuberculosis H37Rv
ccacgucaaacccgacaucg

SEQ ID NO: 3296076 - RNA, 17 nt, Mycobacterium tuberculosis H37Rv
ccacgucaucuggcgcu

SEQ ID NO: 3296077 - RNA, 16 nt, Mycobacterium tuberculosis H37Rv
ccacguccaacucggc

SEQ ID NO: 3296078 - RNA, 23 nt, Mycobacterium tuberculosis H37Rv
ccacgucccaggacuccggccgc

SEQ ID NO: 3296079 - RNA, 21 nt, Mycobacterium tuberculosis H37Rv
ccacguccgcaaccucgccgu

SEQ ID NO: 3296080 - RNA, 13 nt, Mycobacterium tuberculosis H37Rv
ccagagcaucagg

SEQ ID NO: 3296081 - RNA, 13 nt, Mycobacterium tuberculosis H37Rv
ccagagccgcccu

SEQ ID NO: 3296082 - RNA, 22 nt, Mycobacterium tuberculosis H37Rv
ccagagccgcccuugccuccgg

SEQ ID NO: 3296083 - RNA, 13 nt, Mycobacterium tuberculosis H37Rv
ccagagccgcgcg

SEQ ID NO: 3296084 - RNA, 23 nt, Mycobacterium tuberculosis H37Rv
ccagagccgcgcgccgguuggcc

SEQ ID NO: 3296085 - RNA, 17 nt, Mycobacterium tuberculosis H37Rv
ccagagcgucgaacacg

SEQ ID NO: 3296086 - RNA, 15 nt, Mycobacterium tuberculosis H37Rv
ccagagcuucgccgc

SEQ ID NO: 3296087 - RNA, 17 nt, Mycobacterium tuberculosis H37Rv
ccagagcuucgccgcgc

SEQ ID NO: 3296088 - RNA, 22 nt, Mycobacterium tuberculosis H37Rv
ccagagcuucgccgcgcagccu

SEQ ID NO: 3296089 - RNA, 15 nt, Mycobacterium tuberculosis H37Rv
ccagaggcccgcggu

SEQ ID NO: 3296090 - RNA, 21 nt, Mycobacterium tuberculosis H37Rv
ccagaggccggcgggcucgcc

SEQ ID NO: 3296091 - RNA, 19 nt, Mycobacterium tuberculosis H37Rv
ccagaggcgcuucgccaca

SEQ ID NO: 3296092 - RNA, 21 nt, Mycobacterium tuberculosis H37Rv
ccagaggcgcuucgccacacc

SEQ ID NO: 3296093 - RNA, 20 nt, Mycobacterium tuberculosis H37Rv
ccagaggucacgcagcaccc

SEQ ID NO: 3296094 - RNA, 15 nt, Mycobacterium tuberculosis H37Rv
ccagaggucgagcgc

SEQ ID NO: 3296095 - RNA, 16 nt, Mycobacterium tuberculosis H37Rv
ccagagucggagaccc

SEQ ID NO: 3296096 - RNA, 16 nt, Mycobacterium tuberculosis H37Rv
ccagaguucccgaaac

SEQ ID NO: 3296097 - RNA, 15 nt, Mycobacterium tuberculosis H37Rv
ccagauaauccuggu

SEQ ID NO: 3296098 - RNA, 23 nt, Mycobacterium tuberculosis H37Rv
ccagauacaucgggaucugggcu

SEQ ID NO: 3296099 - RNA, 17 nt, Mycobacterium tuberculosis H37Rv
ccagauaccaccgccgc

SEQ ID NO: 3296100 - RNA, 13 nt, Mycobacterium tuberculosis H37Rv
ccagauacccgcg

SEQ ID NO: 3296101 - RNA, 18 nt, Mycobacterium tuberculosis H37Rv
ccagauaugcaggacucg

SEQ ID NO: 3296102 - RNA, 14 nt, Mycobacterium tuberculosis H37Rv
ccagauccacgccg

SEQ ID NO: 3296103 - RNA, 17 nt, Mycobacterium tuberculosis H37Rv
ccagauccacgccgacc

SEQ ID NO: 3296104 - RNA, 18 nt, Mycobacterium tuberculosis H37Rv
ccagauccgguccaccgc

SEQ ID NO: 3296105 - RNA, 21 nt, Mycobacterium tuberculosis H37Rv
ccagaucgaacgcagccagcg

SEQ ID NO: 3296106 - RNA, 18 nt, Mycobacterium tuberculosis H37Rv
ccagaucgaagcgcagca

SEQ ID NO: 3296107 - RNA, 15 nt, Mycobacterium tuberculosis H37Rv
ccagaucgacgccaa

SEQ ID NO: 3296108 - RNA, 17 nt, Mycobacterium tuberculosis H37Rv
ccagaucgcacaccaac

SEQ ID NO: 3296109 - RNA, 18 nt, Mycobacterium tuberculosis H37Rv
ccagaucgcuaggaccgc

SEQ ID NO: 3296110 - RNA, 13 nt, Mycobacterium tuberculosis H37Rv
ccagaucggccaa

SEQ ID NO: 3296111 - RNA, 13 nt, Mycobacterium tuberculosis H37Rv
ccagaucggcgac

SEQ ID NO: 3296112 - RNA, 18 nt, Mycobacterium tuberculosis H37Rv
ccagaucggcgacgccgu

SEQ ID NO: 3296113 - RNA, 17 nt, Mycobacterium tuberculosis H37Rv
ccagaucggcggguggc

SEQ ID NO: 3296114 - RNA, 22 nt, Mycobacterium tuberculosis H37Rv
ccagaucgguugaucggccacg

SEQ ID NO: 3296115 - RNA, 16 nt, Mycobacterium tuberculosis H37Rv
ccagaucgucgggcac

SEQ ID NO: 3296116 - RNA, 19 nt, Mycobacterium tuberculosis H37Rv
ccagaucguuccaggccgc

SEQ ID NO: 3296117 - RNA, 16 nt, Mycobacterium tuberculosis H37Rv
ccagaugcccagcagg

SEQ ID NO: 3296118 - RNA, 21 nt, Mycobacterium tuberculosis H37Rv
ccagaugccgguaacgaacag

SEQ ID NO: 3296119 - RNA, 18 nt, Mycobacterium tuberculosis H37Rv
ccagaugcugguguugau

SEQ ID NO: 3296120 - RNA, 22 nt, Mycobacterium tuberculosis H37Rv
ccagauugaggcuggucugcag

SEQ ID NO: 3296121 - RNA, 16 nt, Mycobacterium tuberculosis H37Rv
ccagauugccugggcg

SEQ ID NO: 3296122 - RNA, 20 nt, Mycobacterium tuberculosis H37Rv
ccagauuggcgcugcccgcc

SEQ ID NO: 3296123 - RNA, 14 nt, Mycobacterium tuberculosis H37Rv
ccagauugguugau

SEQ ID NO: 3296124 - RNA, 19 nt, Mycobacterium tuberculosis H37Rv
ccagauuuaggagcuuuug

SEQ ID NO: 3296125 - RNA, 19 nt, Mycobacterium tuberculosis H37Rv
ccagcaaaccuucgauaac

SEQ ID NO: 3296126 - RNA, 16 nt, Mycobacterium tuberculosis H37Rv
ccagcaaaugcggcgc

SEQ ID NO: 3296127 - RNA, 17 nt, Mycobacterium tuberculosis H37Rv
ccagcaacagcgagcgg

SEQ ID NO: 3296128 - RNA, 18 nt, Mycobacterium tuberculosis H37Rv
ccagcaacgcgguggacc

SEQ ID NO: 3296129 - RNA, 23 nt, Mycobacterium tuberculosis H37Rv
ccagcaacuaccuguugacacaa

SEQ ID NO: 3296130 - RNA, 14 nt, Mycobacterium tuberculosis H37Rv
ccagcaaggccagc

SEQ ID NO: 3296131 - RNA, 15 nt, Mycobacterium tuberculosis H37Rv
ccagcaaggccagca

SEQ ID NO: 3296132 - RNA, 16 nt, Mycobacterium tuberculosis H37Rv
ccagcaaggcccgaaa

SEQ ID NO: 3296133 - RNA, 13 nt, Mycobacterium tuberculosis H37Rv
ccagcaagugcgg

SEQ ID NO: 3296134 - RNA, 14 nt, Mycobacterium tuberculosis H37Rv
ccagcaaugccgac

SEQ ID NO: 3296135 - RNA, 15 nt, Mycobacterium tuberculosis H37Rv
ccagcaaugccgacu

SEQ ID NO: 3296136 - RNA, 13 nt, Mycobacterium tuberculosis H37Rv
ccagcacaaccag

SEQ ID NO: 3296137 - RNA, 18 nt, Mycobacterium tuberculosis H37Rv
ccagcacaaccaucgcga

SEQ ID NO: 3296138 - RNA, 23 nt, Mycobacterium tuberculosis H37Rv
ccagcacacccccgucugcgugg

SEQ ID NO: 3296139 - RNA, 12 nt, Mycobacterium tuberculosis H37Rv
ccagcacaccgu

SEQ ID NO: 3296140 - RNA, 18 nt, Mycobacterium tuberculosis H37Rv
ccagcacaccgucgacga

SEQ ID NO: 3296141 - RNA, 19 nt, Mycobacterium tuberculosis H37Rv
ccagcacaccgucgacgac

SEQ ID NO: 3296142 - RNA, 22 nt, Mycobacterium tuberculosis H37Rv
ccagcacauucugcagcgucuc

SEQ ID NO: 3296143 - RNA, 17 nt, Mycobacterium tuberculosis H37Rv
ccagcaccaccacccga

SEQ ID NO: 3296144 - RNA, 13 nt, Mycobacterium tuberculosis H37Rv
ccagcaccaccgc

SEQ ID NO: 3296145 - RNA, 15 nt, Mycobacterium tuberculosis H37Rv
ccagcaccaccggcu

SEQ ID NO: 3296146 - RNA, 19 nt, Mycobacterium tuberculosis H37Rv
ccagcaccacggccagcgg

SEQ ID NO: 3296147 - RNA, 18 nt, Mycobacterium tuberculosis H37Rv
ccagcaccacgucgacga

SEQ ID NO: 3296148 - RNA, 21 nt, Mycobacterium tuberculosis H37Rv
ccagcaccacgucgacgaugu

SEQ ID NO: 3296149 - RNA, 12 nt, Mycobacterium tuberculosis H37Rv
ccagcaccagcg

SEQ ID NO: 3296150 - RNA, 18 nt, Mycobacterium tuberculosis H37Rv
ccagcaccagcgucgcgg

SEQ ID NO: 3296151 - RNA, 23 nt, Mycobacterium tuberculosis H37Rv
ccagcaccagcgucgcggccacg

SEQ ID NO: 3296152 - RNA, 13 nt, Mycobacterium tuberculosis H37Rv
ccagcaccagggc

SEQ ID NO: 3296153 - RNA, 13 nt, Mycobacterium tuberculosis H37Rv
ccagcaccccgag

SEQ ID NO: 3296154 - RNA, 16 nt, Mycobacterium tuberculosis H37Rv
ccagcaccccgagguc

SEQ ID NO: 3296155 - RNA, 13 nt, Mycobacterium tuberculosis H37Rv
ccagcacccgagc

SEQ ID NO: 3296156 - RNA, 16 nt, Mycobacterium tuberculosis H37Rv
ccagcacccgagcgau

SEQ ID NO: 3296157 - RNA, 16 nt, Mycobacterium tuberculosis H37Rv
ccagcacccgcagccg

SEQ ID NO: 3296158 - RNA, 13 nt, Mycobacterium tuberculosis H37Rv
ccagcacccggcu

SEQ ID NO: 3296159 - RNA, 16 nt, Mycobacterium tuberculosis H37Rv
ccagcacccggucgau

SEQ ID NO: 3296160 - RNA, 20 nt, Mycobacterium tuberculosis H37Rv
ccagcacccuguuccagcgg

SEQ ID NO: 3296161 - RNA, 13 nt, Mycobacterium tuberculosis H37Rv
ccagcaccgccgc

SEQ ID NO: 3296162 - RNA, 23 nt, Mycobacterium tuberculosis H37Rv
ccagcaccgccgcugccaucugg

SEQ ID NO: 3296163 - RNA, 14 nt, Mycobacterium tuberculosis H37Rv
ccagcacgaccucg

SEQ ID NO: 3296164 - RNA, 14 nt, Mycobacterium tuberculosis H37Rv
ccagcacgcccucg

SEQ ID NO: 3296165 - RNA, 14 nt, Mycobacterium tuberculosis H37Rv
ccagcacgccgccg

SEQ ID NO: 3296166 - RNA, 15 nt, Mycobacterium tuberculosis H37Rv
ccagcacgcuggcgu

SEQ ID NO: 3296167 - RNA, 16 nt, Mycobacterium tuberculosis H37Rv
ccagcacggcaaccag

SEQ ID NO: 3296168 - RNA, 13 nt, Mycobacterium tuberculosis H37Rv
ccagcacggccac

SEQ ID NO: 3296169 - RNA, 22 nt, Mycobacterium tuberculosis H37Rv
ccagcacggucaacgugaugcg

SEQ ID NO: 3296170 - RNA, 18 nt, Mycobacterium tuberculosis H37Rv
ccagcacugccaucgcgg

SEQ ID NO: 3296171 - RNA, 14 nt, Mycobacterium tuberculosis H37Rv
ccagcagaccaagc

SEQ ID NO: 3296172 - RNA, 19 nt, Mycobacterium tuberculosis H37Rv
ccagcagaucagguccuag

SEQ ID NO: 3296173 - RNA, 15 nt, Mycobacterium tuberculosis H37Rv
ccagcagcaccaacu

SEQ ID NO: 3296174 - RNA, 14 nt, Mycobacterium tuberculosis H37Rv
ccagcagcaccgac

SEQ ID NO: 3296175 - RNA, 19 nt, Mycobacterium tuberculosis H37Rv
ccagcagcaccugcaccgc

SEQ ID NO: 3296176 - RNA, 22 nt, Mycobacterium tuberculosis H37Rv
ccagcagcaccugcaccgcauu

SEQ ID NO: 3296177 - RNA, 20 nt, Mycobacterium tuberculosis H37Rv
ccagccgguuggcugccggc

SEQ ID NO: 3296178 - RNA, 16 nt, Mycobacterium tuberculosis H37Rv
ccagccgucaccgcga

SEQ ID NO: 3296179 - RNA, 22 nt, Mycobacterium tuberculosis H37Rv
ccagccgucgucagguggccaa

SEQ ID NO: 3296180 - RNA, 12 nt, Mycobacterium tuberculosis H37Rv
ccagccguggcg

SEQ ID NO: 3296181 - RNA, 17 nt, Mycobacterium tuberculosis H37Rv
ccagccguggcggcggg

SEQ ID NO: 3296182 - RNA, 22 nt, Mycobacterium tuberculosis H37Rv
ccagccguggugguugaucagc

SEQ ID NO: 3296183 - RNA, 18 nt, Mycobacterium tuberculosis H37Rv
ccagccugaaccgccccg

SEQ ID NO: 3296184 - RNA, 12 nt, Mycobacterium tuberculosis H37Rv
ccagccugugcu

SEQ ID NO: 3296185 - RNA, 20 nt, Mycobacterium tuberculosis H37Rv
ccagccuuaugcagugacag

SEQ ID NO: 3296186 - RNA, 22 nt, Mycobacterium tuberculosis H37Rv
ccagccuuggacgugcgcgcca

SEQ ID NO: 3296187 - RNA, 17 nt, Mycobacterium tuberculosis H37Rv
ccagccuuuccggccgc

SEQ ID NO: 3296188 - RNA, 18 nt, Mycobacterium tuberculosis H37Rv
ccagccuuuccggccgcc

SEQ ID NO: 3296189 - RNA, 18 nt, Mycobacterium tuberculosis H37Rv
ccagccuuuuucgacaag

SEQ ID NO: 3296190 - RNA, 18 nt, Mycobacterium tuberculosis H37Rv
ccagcgaaucacccgcga

SEQ ID NO: 3296191 - RNA, 17 nt, Mycobacterium tuberculosis H37Rv
ccagcgaauccagccgc

SEQ ID NO: 3296192 - RNA, 18 nt, Mycobacterium tuberculosis H37Rv
ccagcgaauccagccgcg

SEQ ID NO: 3296193 - RNA, 20 nt, Mycobacterium tuberculosis H37Rv
ccagcgaauccagccgcgcg

SEQ ID NO: 3296194 - RNA, 16 nt, Mycobacterium tuberculosis H37Rv
ccagcgaauccaggcc

SEQ ID NO: 3296195 - RNA, 19 nt, Mycobacterium tuberculosis H37Rv
ccagcgaauggggcagcuc

SEQ ID NO: 3296196 - RNA, 23 nt, Mycobacterium tuberculosis H37Rv
ccagcgacaacaccacggugccg

SEQ ID NO: 3296197 - RNA, 19 nt, Mycobacterium tuberculosis H37Rv
ccagcgacaugucgaacgc

SEQ ID NO: 3296198 - RNA, 14 nt, Mycobacterium tuberculosis H37Rv
ccagcgaccagugg

SEQ ID NO: 3296199 - RNA, 14 nt, Mycobacterium tuberculosis H37Rv
ccagcgacccggcc

SEQ ID NO: 3296200 - RNA, 18 nt, Mycobacterium tuberculosis H37Rv
ccagcgaccuagcagcgc

SEQ ID NO: 3296201 - RNA, 17 nt, Mycobacterium tuberculosis H37Rv
ccagcgacgcggccagc

SEQ ID NO: 3296202 - RNA, 15 nt, Mycobacterium tuberculosis H37Rv
ccagcgacgcgguca

SEQ ID NO: 3296203 - RNA, 15 nt, Mycobacterium tuberculosis H37Rv
ccagcgacucggcca

SEQ ID NO: 3296204 - RNA, 16 nt, Mycobacterium tuberculosis H37Rv
ccagcgacucggccag

SEQ ID NO: 3296205 - RNA, 16 nt, Mycobacterium tuberculosis H37Rv
ccagcgagaucagcau

SEQ ID NO: 3296206 - RNA, 20 nt, Mycobacterium tuberculosis H37Rv
ccagcgagaucagcaugccc

SEQ ID NO: 3296207 - RNA, 19 nt, Mycobacterium tuberculosis H37Rv
ccagcgagcauaccgccgc

SEQ ID NO: 3296208 - RNA, 16 nt, Mycobacterium tuberculosis H37Rv
ccagcgagcccagcug

SEQ ID NO: 3296209 - RNA, 20 nt, Mycobacterium tuberculosis H37Rv
ccagcgagcccagcugcgcc

SEQ ID NO: 3296210 - RNA, 20 nt, Mycobacterium tuberculosis H37Rv
ccagcgagcgcaaaucgauu

SEQ ID NO: 3296211 - RNA, 17 nt, Mycobacterium tuberculosis H37Rv
ccagcgaguugagcaug

SEQ ID NO: 3296212 - RNA, 16 nt, Mycobacterium tuberculosis H37Rv
ccagcgauaucggcgg

SEQ ID NO: 3296213 - RNA, 18 nt, Mycobacterium tuberculosis H37Rv
ccagcgaucccggugagg

SEQ ID NO: 3296214 - RNA, 18 nt, Mycobacterium tuberculosis H37Rv
ccagcgauucagccugau

SEQ ID NO: 3296215 - RNA, 16 nt, Mycobacterium tuberculosis H37Rv
ccagcgcaaccuccgc

SEQ ID NO: 3296216 - RNA, 17 nt, Mycobacterium tuberculosis H37Rv
ccagcgcaaccuccgcg

SEQ ID NO: 3296217 - RNA, 12 nt, Mycobacterium tuberculosis H37Rv
ccagcgcaccgc

SEQ ID NO: 3296218 - RNA, 14 nt, Mycobacterium tuberculosis H37Rv
ccagcgcaccgccg

SEQ ID NO: 3296219 - RNA, 15 nt, Mycobacterium tuberculosis H37Rv
ccagcgcacgcucgg

SEQ ID NO: 3296220 - RNA, 18 nt, Mycobacterium tuberculosis H37Rv
ccagcgcacgcucggcac

SEQ ID NO: 3296221 - RNA, 15 nt, Mycobacterium tuberculosis H37Rv
ccagcgcacggacca

SEQ ID NO: 3296222 - RNA, 23 nt, Mycobacterium tuberculosis H37Rv
ccagcgcacuacucgaacaaccc

SEQ ID NO: 3296223 - RNA, 14 nt, Mycobacterium tuberculosis H37Rv
ccagcgcagcagcg

SEQ ID NO: 3296224 - RNA, 15 nt, Mycobacterium tuberculosis H37Rv
ccagcgcagcagcgg

SEQ ID NO: 3296225 - RNA, 12 nt, Mycobacterium tuberculosis H37Rv
ccagcgcagccg

SEQ ID NO: 3296226 - RNA, 14 nt, Mycobacterium tuberculosis H37Rv
ccagcgcagugccu

SEQ ID NO: 3296227 - RNA, 17 nt, Mycobacterium tuberculosis H37Rv
ccagcgcaucgagcccg

SEQ ID NO: 3296228 - RNA, 16 nt, Mycobacterium tuberculosis H37Rv
ccagcgccacgaugac

SEQ ID NO: 3296229 - RNA, 15 nt, Mycobacterium tuberculosis H37Rv
ccagcgccagugccu

SEQ ID NO: 3296230 - RNA, 15 nt, Mycobacterium tuberculosis H37Rv
ccagcgcccccagca

SEQ ID NO: 3296231 - RNA, 13 nt, Mycobacterium tuberculosis H37Rv
ccagcgccccggc

SEQ ID NO: 3296232 - RNA, 18 nt, Mycobacterium tuberculosis H37Rv
ccagcgccccggcgcguu

SEQ ID NO: 3296233 - RNA, 19 nt, Mycobacterium tuberculosis H37Rv
ccagcgcccgcgcggccac

SEQ ID NO: 3296234 - RNA, 13 nt, Mycobacterium tuberculosis H37Rv
ccagcgccgcagu

SEQ ID NO: 3296235 - RNA, 21 nt, Mycobacterium tuberculosis H37Rv
ccagcgccgccgccgacgaag

SEQ ID NO: 3296236 - RNA, 15 nt, Mycobacterium tuberculosis H37Rv
ccagcgccgccgcgu

SEQ ID NO: 3296237 - RNA, 20 nt, Mycobacterium tuberculosis H37Rv
ccagcgccgccggcaccucc

SEQ ID NO: 3296238 - RNA, 12 nt, Mycobacterium tuberculosis H37Rv
ccagcgccgcug

SEQ ID NO: 3296239 - RNA, 23 nt, Mycobacterium tuberculosis H37Rv
ccagcgccggccaagaccgcggc

SEQ ID NO: 3296240 - RNA, 16 nt, Mycobacterium tuberculosis H37Rv
ccagcgccggccaggc

SEQ ID NO: 3296241 - RNA, 16 nt, Mycobacterium tuberculosis H37Rv
ccagcgccggucaggg

SEQ ID NO: 3296242 - RNA, 16 nt, Mycobacterium tuberculosis H37Rv
ccagcgccucggcauc

SEQ ID NO: 3296243 - RNA, 21 nt, Mycobacterium tuberculosis H37Rv
ccagcgccucggcaucgccgc

SEQ ID NO: 3296244 - RNA, 15 nt, Mycobacterium tuberculosis H37Rv
ccagcgccucgguga

SEQ ID NO: 3296245 - RNA, 21 nt, Mycobacterium tuberculosis H37Rv
ccagcgccucggugagcugca

SEQ ID NO: 3296246 - RNA, 18 nt, Mycobacterium tuberculosis H37Rv
ccagcgccugcgcccagc

SEQ ID NO: 3296247 - RNA, 12 nt, Mycobacterium tuberculosis H37Rv
ccagcgccuuga

SEQ ID NO: 3296248 - RNA, 15 nt, Mycobacterium tuberculosis H37Rv
ccagcgccuugacgc

SEQ ID NO: 3296249 - RNA, 22 nt, Mycobacterium tuberculosis H37Rv
ccagcgccuugacgccaguugc

SEQ ID NO: 3296250 - RNA, 23 nt, Mycobacterium tuberculosis H37Rv
ccagcgcgacguccaccagccgg

SEQ ID NO: 3296251 - RNA, 23 nt, Mycobacterium tuberculosis H37Rv
ccagcgcgagcccgaaccaccgc

SEQ ID NO: 3296252 - RNA, 18 nt, Mycobacterium tuberculosis H37Rv
ccagcgcgccacccagca

SEQ ID NO: 3296253 - RNA, 22 nt, Mycobacterium tuberculosis H37Rv
ccagcgcgccgaucacgguggg

SEQ ID NO: 3296254 - RNA, 19 nt, Mycobacterium tuberculosis H37Rv
ccagcgcgcgcugagccgu

SEQ ID NO: 3296255 - RNA, 14 nt, Mycobacterium tuberculosis H37Rv
ccagcgcgcuggga

SEQ ID NO: 3296256 - RNA, 17 nt, Mycobacterium tuberculosis H37Rv
ccagcgcggcaacuccg

SEQ ID NO: 3296257 - RNA, 11 nt, Mycobacterium tuberculosis H37Rv
ccagcgcggcc

SEQ ID NO: 3296258 - RNA, 22 nt, Mycobacterium tuberculosis H37Rv
ccagcgcggccauuagcagcac

SEQ ID NO: 3296259 - RNA, 22 nt, Mycobacterium tuberculosis H37Rv
ccagcgcgguguagagcgcacc

SEQ ID NO: 3296260 - RNA, 17 nt, Mycobacterium tuberculosis H37Rv
ccagcgcgucucguuga

SEQ ID NO: 3296261 - RNA, 13 nt, Mycobacterium tuberculosis H37Rv
ccagcgcguggaa

SEQ ID NO: 3296262 - RNA, 16 nt, Mycobacterium tuberculosis H37Rv
ccagcgcguuguccuc

SEQ ID NO: 3296263 - RNA, 16 nt, Mycobacterium tuberculosis H37Rv
ccagcgcuagccgggc

SEQ ID NO: 3296264 - RNA, 17 nt, Mycobacterium tuberculosis H37Rv
ccagcgcuccagcaccc

SEQ ID NO: 3296265 - RNA, 17 nt, Mycobacterium tuberculosis H37Rv
ccagcgcuucgucggcc

SEQ ID NO: 3296266 - RNA, 18 nt, Mycobacterium tuberculosis H37Rv
ccagcgcuucgucggccg

SEQ ID NO: 3296267 - RNA, 17 nt, Mycobacterium tuberculosis H37Rv
ccagcggaagcgguuga

SEQ ID NO: 3296268 - RNA, 19 nt, Mycobacterium tuberculosis H37Rv
ccagcggaagcgguugacc

SEQ ID NO: 3296269 - RNA, 21 nt, Mycobacterium tuberculosis H37Rv
ccagcggaagcgguugaccca

SEQ ID NO: 3296270 - RNA, 19 nt, Mycobacterium tuberculosis H37Rv
ccagcggcaauggccagca

SEQ ID NO: 3296271 - RNA, 20 nt, Mycobacterium tuberculosis H37Rv
ccagcggcacacccaucacc

SEQ ID NO: 3296272 - RNA, 16 nt, Mycobacterium tuberculosis H37Rv
ccagcggcaccgcggc

SEQ ID NO: 3296273 - RNA, 20 nt, Mycobacterium tuberculosis H37Rv
ccaggacuggcaccgccagc

SEQ ID NO: 3296274 - RNA, 13 nt, Mycobacterium tuberculosis H37Rv
ccaggagcaccuc

SEQ ID NO: 3296275 - RNA, 18 nt, Mycobacterium tuberculosis H37Rv
ccaggagcaccucgaagu

SEQ ID NO: 3296276 - RNA, 20 nt, Mycobacterium tuberculosis H37Rv
ccaggagugcgggcaugccg

SEQ ID NO: 3296277 - RNA, 24 nt, Mycobacterium tuberculosis H37Rv
ccaggagugcgggcaugccggcga

SEQ ID NO: 3296278 - RNA, 19 nt, Mycobacterium tuberculosis H37Rv
ccaggaguuugaccaccug

SEQ ID NO: 3296279 - RNA, 21 nt, Mycobacterium tuberculosis H37Rv
ccaggaucucuucucggcuac

SEQ ID NO: 3296280 - RNA, 21 nt, Mycobacterium tuberculosis H37Rv
ccaggaugccugccacccguu

SEQ ID NO: 3296281 - RNA, 21 nt, Mycobacterium tuberculosis H37Rv
ccaggauggccaucagcucgc

SEQ ID NO: 3296282 - RNA, 17 nt, Mycobacterium tuberculosis H37Rv
ccaggcaaaccgaucaa

SEQ ID NO: 3296283 - RNA, 18 nt, Mycobacterium tuberculosis H37Rv
ccaggcaaccggucagcc

SEQ ID NO: 3296284 - RNA, 21 nt, Mycobacterium tuberculosis H37Rv
ccaggcaaccggucagccugc

SEQ ID NO: 3296285 - RNA, 22 nt, Mycobacterium tuberculosis H37Rv
ccaggcaaccggucagccugcc

SEQ ID NO: 3296286 - RNA, 19 nt, Mycobacterium tuberculosis H37Rv
ccaggcaagccagcacugc

SEQ ID NO: 3296287 - RNA, 20 nt, Mycobacterium tuberculosis H37Rv
ccaggcaagccagcacugcc

SEQ ID NO: 3296288 - RNA, 21 nt, Mycobacterium tuberculosis H37Rv
ccaggcaagccagcacugcca

SEQ ID NO: 3296289 - RNA, 19 nt, Mycobacterium tuberculosis H37Rv
ccaggcacaacaucgccgc

SEQ ID NO: 3296290 - RNA, 12 nt, Mycobacterium tuberculosis H37Rv
ccaggcaccacg

SEQ ID NO: 3296291 - RNA, 23 nt, Mycobacterium tuberculosis H37Rv
ccaggcacguccgaucggcgcgc

SEQ ID NO: 3296292 - RNA, 14 nt, Mycobacterium tuberculosis H37Rv
ccaggcacuccagc

SEQ ID NO: 3296293 - RNA, 16 nt, Mycobacterium tuberculosis H37Rv
ccaggcacuccagcgg

SEQ ID NO: 3296294 - RNA, 17 nt, Mycobacterium tuberculosis H37Rv
ccaggcacuccagcggc

SEQ ID NO: 3296295 - RNA, 20 nt, Mycobacterium tuberculosis H37Rv
ccaggcacuccagcggcggg

SEQ ID NO: 3296296 - RNA, 14 nt, Mycobacterium tuberculosis H37Rv
ccaggcauggccug

SEQ ID NO: 3296297 - RNA, 20 nt, Mycobacterium tuberculosis H37Rv
ccaggccaccggcugcaacc

SEQ ID NO: 3296298 - RNA, 19 nt, Mycobacterium tuberculosis H37Rv
ccaggccacguagcagcgc

SEQ ID NO: 3296299 - RNA, 17 nt, Mycobacterium tuberculosis H37Rv
ccaggccagagccgccc

SEQ ID NO: 3296300 - RNA, 22 nt, Mycobacterium tuberculosis H37Rv
ccaggccagggcgguggccacc

SEQ ID NO: 3296301 - RNA, 15 nt, Mycobacterium tuberculosis H37Rv
ccaggcccaagccgu

SEQ ID NO: 3296302 - RNA, 19 nt, Mycobacterium tuberculosis H37Rv
ccaggcccaagccguggcc

SEQ ID NO: 3296303 - RNA, 13 nt, Mycobacterium tuberculosis H37Rv
ccaggcccagccg

SEQ ID NO: 3296304 - RNA, 19 nt, Mycobacterium tuberculosis H37Rv
ccaggcccaucucgggcag

SEQ ID NO: 3296305 - RNA, 17 nt, Mycobacterium tuberculosis H37Rv
ccaggcccgacacggcg

SEQ ID NO: 3296306 - RNA, 14 nt, Mycobacterium tuberculosis H37Rv
ccaggcccggcggu

SEQ ID NO: 3296307 - RNA, 15 nt, Mycobacterium tuberculosis H37Rv
ccaggcccuggccag

SEQ ID NO: 3296308 - RNA, 16 nt, Mycobacterium tuberculosis H37Rv
ccaggccgaccgcgca

SEQ ID NO: 3296309 - RNA, 19 nt, Mycobacterium tuberculosis H37Rv
ccaggccgagcccggugcu

SEQ ID NO: 3296310 - RNA, 16 nt, Mycobacterium tuberculosis H37Rv
ccaggccgagccgccc

SEQ ID NO: 3296311 - RNA, 14 nt, Mycobacterium tuberculosis H37Rv
ccaggccgagcucg

SEQ ID NO: 3296312 - RNA, 16 nt, Mycobacterium tuberculosis H37Rv
ccaggccgagcucguu

SEQ ID NO: 3296313 - RNA, 17 nt, Mycobacterium tuberculosis H37Rv
ccaggccgagcucguug

SEQ ID NO: 3296314 - RNA, 13 nt, Mycobacterium tuberculosis H37Rv
ccaggccgccgcc

SEQ ID NO: 3296315 - RNA, 20 nt, Mycobacterium tuberculosis H37Rv
ccaggccgcgcgacaacccg

SEQ ID NO: 3296316 - RNA, 16 nt, Mycobacterium tuberculosis H37Rv
ccaggccgcgcgcacc

SEQ ID NO: 3296317 - RNA, 15 nt, Mycobacterium tuberculosis H37Rv
ccaggccgcuugccc

SEQ ID NO: 3296318 - RNA, 13 nt, Mycobacterium tuberculosis H37Rv
ccaggccggcccg

SEQ ID NO: 3296319 - RNA, 14 nt, Mycobacterium tuberculosis H37Rv
ccaggccggugacg

SEQ ID NO: 3296320 - RNA, 15 nt, Mycobacterium tuberculosis H37Rv
ccaggccggugacgg

SEQ ID NO: 3296321 - RNA, 17 nt, Mycobacterium tuberculosis H37Rv
ccaggccguagcccacg

SEQ ID NO: 3296322 - RNA, 13 nt, Mycobacterium tuberculosis H37Rv
ccaggccgucagg

SEQ ID NO: 3296323 - RNA, 14 nt, Mycobacterium tuberculosis H37Rv
ccaggccguugccc

SEQ ID NO: 3296324 - RNA, 22 nt, Mycobacterium tuberculosis H37Rv
ccaggccguugcuauucgccag

SEQ ID NO: 3296325 - RNA, 15 nt, Mycobacterium tuberculosis H37Rv
ccaggccucgcaccg

SEQ ID NO: 3296326 - RNA, 22 nt, Mycobacterium tuberculosis H37Rv
ccaggcgaagucgacucgccac

SEQ ID NO: 3296327 - RNA, 12 nt, Mycobacterium tuberculosis H37Rv
ccaggcgagccg

SEQ ID NO: 3296328 - RNA, 16 nt, Mycobacterium tuberculosis H37Rv
ccaggcgagccgccac

SEQ ID NO: 3296329 - RNA, 19 nt, Mycobacterium tuberculosis H37Rv
ccaggcgagccgccaccgu

SEQ ID NO: 3296330 - RNA, 15 nt, Mycobacterium tuberculosis H37Rv
ccaggcgagccggcg

SEQ ID NO: 3296331 - RNA, 20 nt, Mycobacterium tuberculosis H37Rv
ccaggcgauaaagccgcuga

SEQ ID NO: 3296332 - RNA, 21 nt, Mycobacterium tuberculosis H37Rv
ccaggcgaucgcccggccccg

SEQ ID NO: 3296333 - RNA, 13 nt, Mycobacterium tuberculosis H37Rv
ccaggcgcagcug

SEQ ID NO: 3296334 - RNA, 17 nt, Mycobacterium tuberculosis H37Rv
ccaggcgcccagcaccc

SEQ ID NO: 3296335 - RNA, 12 nt, Mycobacterium tuberculosis H37Rv
ccaggcgcgccg

SEQ ID NO: 3296336 - RNA, 15 nt, Mycobacterium tuberculosis H37Rv
ccaggcgcgccgcac

SEQ ID NO: 3296337 - RNA, 20 nt, Mycobacterium tuberculosis H37Rv
ccaggcgcucaucacccagc

SEQ ID NO: 3296338 - RNA, 20 nt, Mycobacterium tuberculosis H37Rv
ccaggcggcaauucgggcau

SEQ ID NO: 3296339 - RNA, 22 nt, Mycobacterium tuberculosis H37Rv
ccaggcggcgcgggucggcgac

SEQ ID NO: 3296340 - RNA, 21 nt, Mycobacterium tuberculosis H37Rv
ccaggcgguacgggucgccgg

SEQ ID NO: 3296341 - RNA, 15 nt, Mycobacterium tuberculosis H37Rv
ccaggcguccaucag

SEQ ID NO: 3296342 - RNA, 13 nt, Mycobacterium tuberculosis H37Rv
ccaggcguucgac

SEQ ID NO: 3296343 - RNA, 22 nt, Mycobacterium tuberculosis H37Rv
ccaggcucgagguguagcccuc

SEQ ID NO: 3296344 - RNA, 15 nt, Mycobacterium tuberculosis H37Rv
ccaggcugcgcagug

SEQ ID NO: 3296345 - RNA, 22 nt, Mycobacterium tuberculosis H37Rv
ccaggcugcgcagugacgccuc

SEQ ID NO: 3296346 - RNA, 14 nt, Mycobacterium tuberculosis H37Rv
ccaggcugguccgg

SEQ ID NO: 3296347 - RNA, 17 nt, Mycobacterium tuberculosis H37Rv
ccaggcugguccgggug

SEQ ID NO: 3296348 - RNA, 14 nt, Mycobacterium tuberculosis H37Rv
ccaggcugucgcgg

SEQ ID NO: 3296349 - RNA, 15 nt, Mycobacterium tuberculosis H37Rv
ccaggcuguggccag

SEQ ID NO: 3296350 - RNA, 17 nt, Mycobacterium tuberculosis H37Rv
ccaggcuguggccagca

SEQ ID NO: 3296351 - RNA, 15 nt, Mycobacterium tuberculosis H37Rv
ccagggagcgcagcg

SEQ ID NO: 3296352 - RNA, 22 nt, Mycobacterium tuberculosis H37Rv
ccagggagugccgcacgauggc

SEQ ID NO: 3296353 - RNA, 16 nt, Mycobacterium tuberculosis H37Rv
ccagggcaacggccgc

SEQ ID NO: 3296354 - RNA, 20 nt, Mycobacterium tuberculosis H37Rv
ccagggcacguggcgguaca

SEQ ID NO: 3296355 - RNA, 20 nt, Mycobacterium tuberculosis H37Rv
ccagggcacguucggcgcac

SEQ ID NO: 3296356 - RNA, 20 nt, Mycobacterium tuberculosis H37Rv
ccagggcaucagcagagccc

SEQ ID NO: 3296357 - RNA, 22 nt, Mycobacterium tuberculosis H37Rv
ccagggcaucagcagagccccg

SEQ ID NO: 3296358 - RNA, 17 nt, Mycobacterium tuberculosis H37Rv
ccagggccaccgcgccg

SEQ ID NO: 3296359 - RNA, 16 nt, Mycobacterium tuberculosis H37Rv
ccagggccgaguccga

SEQ ID NO: 3296360 - RNA, 11 nt, Mycobacterium tuberculosis H37Rv
ccagggccgcc

SEQ ID NO: 3296361 - RNA, 13 nt, Mycobacterium tuberculosis H37Rv
ccagggccgccgc

SEQ ID NO: 3296362 - RNA, 18 nt, Mycobacterium tuberculosis H37Rv
ccagggccuccacccgcc

SEQ ID NO: 3296363 - RNA, 19 nt, Mycobacterium tuberculosis H37Rv
ccagggccuccacccgcca

SEQ ID NO: 3296364 - RNA, 22 nt, Mycobacterium tuberculosis H37Rv
ccagggccucgaccgccagccg

SEQ ID NO: 3296365 - RNA, 16 nt, Mycobacterium tuberculosis H37Rv
ccagggccuuccugag

SEQ ID NO: 3296366 - RNA, 15 nt, Mycobacterium tuberculosis H37Rv
ccagggccuucgggc

SEQ ID NO: 3296367 - RNA, 17 nt, Mycobacterium tuberculosis H37Rv
ccagggccuucgggcca

SEQ ID NO: 3296368 - RNA, 15 nt, Mycobacterium tuberculosis H37Rv
ccagggcgacggcca

SEQ ID NO: 3296369 - RNA, 15 nt, Mycobacterium tuberculosis H37Rv
ccagucgcgcagcgu

SEQ ID NO: 3296370 - RNA, 12 nt, Mycobacterium tuberculosis H37Rv
ccagucggcgcc

SEQ ID NO: 3296371 - RNA, 22 nt, Mycobacterium tuberculosis H37Rv
ccagugaacgcgcgugcagcca

SEQ ID NO: 3296372 - RNA, 19 nt, Mycobacterium tuberculosis H37Rv
ccagugaacucgugacagc

SEQ ID NO: 3296373 - RNA, 16 nt, Mycobacterium tuberculosis H37Rv
ccagugaaucggaccg

SEQ ID NO: 3296374 - RNA, 22 nt, Mycobacterium tuberculosis H37Rv
ccagugaccgcagucccagcac

SEQ ID NO: 3296375 - RNA, 19 nt, Mycobacterium tuberculosis H37Rv
ccagugaccguauuucguc

SEQ ID NO: 3296376 - RNA, 22 nt, Mycobacterium tuberculosis H37Rv
ccagugauggcgcggucgcuga

SEQ ID NO: 3296377 - RNA, 14 nt, Mycobacterium tuberculosis H37Rv
ccagugcacgcucg

SEQ ID NO: 3296378 - RNA, 19 nt, Mycobacterium tuberculosis H37Rv
ccagugcacgcucggcgcc

SEQ ID NO: 3296379 - RNA, 19 nt, Mycobacterium tuberculosis H37Rv
ccagugcaucgaucaccgc

SEQ ID NO: 3296380 - RNA, 15 nt, Mycobacterium tuberculosis H37Rv
ccagugccaccuggg

SEQ ID NO: 3296381 - RNA, 16 nt, Mycobacterium tuberculosis H37Rv
ccagugccagcguccg

SEQ ID NO: 3296382 - RNA, 13 nt, Mycobacterium tuberculosis H37Rv
ccagugccccgcc

SEQ ID NO: 3296383 - RNA, 18 nt, Mycobacterium tuberculosis H37Rv
ccagugccccgccgagcg

SEQ ID NO: 3296384 - RNA, 19 nt, Mycobacterium tuberculosis H37Rv
ccagugcccgcacugccgc

SEQ ID NO: 3296385 - RNA, 15 nt, Mycobacterium tuberculosis H37Rv
ccagugccgcccacc

SEQ ID NO: 3296386 - RNA, 22 nt, Mycobacterium tuberculosis H37Rv
ccagugccguuucgaucugcac

SEQ ID NO: 3296387 - RNA, 19 nt, Mycobacterium tuberculosis H37Rv
ccagugcgcaacccagccg

SEQ ID NO: 3296388 - RNA, 21 nt, Mycobacterium tuberculosis H37Rv
ccagugcgcaacccagccgcg

SEQ ID NO: 3296389 - RNA, 20 nt, Mycobacterium tuberculosis H37Rv
ccagugcgcagaacaccacc

SEQ ID NO: 3296390 - RNA, 23 nt, Mycobacterium tuberculosis H37Rv
ccagugcgcagaacaccaccgcc

SEQ ID NO: 3296391 - RNA, 18 nt, Mycobacterium tuberculosis H37Rv
ccagugcgguggcaggug

SEQ ID NO: 3296392 - RNA, 20 nt, Mycobacterium tuberculosis H37Rv
ccagugcgguggccagugcg

SEQ ID NO: 3296393 - RNA, 12 nt, Mycobacterium tuberculosis H37Rv
ccaguggcagcc

SEQ ID NO: 3296394 - RNA, 20 nt, Mycobacterium tuberculosis H37Rv
ccaguggcgcccauggccac

SEQ ID NO: 3296395 - RNA, 22 nt, Mycobacterium tuberculosis H37Rv
ccaguggcgcccauggccacca

SEQ ID NO: 3296396 - RNA, 15 nt, Mycobacterium tuberculosis H37Rv
ccaguggcgcgugca

SEQ ID NO: 3296397 - RNA, 14 nt, Mycobacterium tuberculosis H37Rv
ccaguggugcaccg

SEQ ID NO: 3296398 - RNA, 15 nt, Mycobacterium tuberculosis H37Rv
ccagugucagcacga

SEQ ID NO: 3296399 - RNA, 19 nt, Mycobacterium tuberculosis H37Rv
ccaguguccggcgacgcgu

SEQ ID NO: 3296400 - RNA, 16 nt, Mycobacterium tuberculosis H37Rv
ccaguguguccugucg

SEQ ID NO: 3296401 - RNA, 15 nt, Mycobacterium tuberculosis H37Rv
ccaguguugcgcugc

SEQ ID NO: 3296402 - RNA, 19 nt, Mycobacterium tuberculosis H37Rv
ccaguguugcggacgugac

SEQ ID NO: 3296403 - RNA, 12 nt, Mycobacterium tuberculosis H37Rv
ccaguuacguug

SEQ ID NO: 3296404 - RNA, 19 nt, Mycobacterium tuberculosis H37Rv
ccaguuauucggugcgcgg

SEQ ID NO: 3296405 - RNA, 21 nt, Mycobacterium tuberculosis H37Rv
ccaguuccacccggugccgca

SEQ ID NO: 3296406 - RNA, 22 nt, Mycobacterium tuberculosis H37Rv
ccaguucgcgccacgcacccgg

SEQ ID NO: 3296407 - RNA, 17 nt, Mycobacterium tuberculosis H37Rv
ccaguucggcggccgcc

SEQ ID NO: 3296408 - RNA, 19 nt, Mycobacterium tuberculosis H37Rv
ccaguucggcggccgccgc

SEQ ID NO: 3296409 - RNA, 13 nt, Mycobacterium tuberculosis H37Rv
ccaguucggcguc

SEQ ID NO: 3296410 - RNA, 14 nt, Mycobacterium tuberculosis H37Rv
ccaguucugcagga

SEQ ID NO: 3296411 - RNA, 18 nt, Mycobacterium tuberculosis H37Rv
ccaguugaucaggccgau

SEQ ID NO: 3296412 - RNA, 13 nt, Mycobacterium tuberculosis H37Rv
ccaguugcacauc

SEQ ID NO: 3296413 - RNA, 21 nt, Mycobacterium tuberculosis H37Rv
ccaguugcguuguccaccauc

SEQ ID NO: 3296414 - RNA, 14 nt, Mycobacterium tuberculosis H37Rv
ccaguugguagccg

SEQ ID NO: 3296415 - RNA, 19 nt, Mycobacterium tuberculosis H37Rv
ccaguuucaucaugugguc

SEQ ID NO: 3296416 - RNA, 12 nt, Mycobacterium tuberculosis H37Rv
ccaguuucggcg

SEQ ID NO: 3296417 - RNA, 16 nt, Mycobacterium tuberculosis H37Rv
ccaguuugugccgccg

SEQ ID NO: 3296418 - RNA, 20 nt, Mycobacterium tuberculosis H37Rv
ccauaagcucguagagcacc

SEQ ID NO: 3296419 - RNA, 21 nt, Mycobacterium tuberculosis H37Rv
ccauaagcucguagagcaccg

SEQ ID NO: 3296420 - RNA, 15 nt, Mycobacterium tuberculosis H37Rv
ccauaaucacaucgc

SEQ ID NO: 3296421 - RNA, 14 nt, Mycobacterium tuberculosis H37Rv
ccauaauggucguc

SEQ ID NO: 3296422 - RNA, 18 nt, Mycobacterium tuberculosis H37Rv
ccauaauggucgucgcga

SEQ ID NO: 3296423 - RNA, 14 nt, Mycobacterium tuberculosis H37Rv
ccauacagcacccc

SEQ ID NO: 3296424 - RNA, 15 nt, Mycobacterium tuberculosis H37Rv
ccauaccggccgcca

SEQ ID NO: 3296425 - RNA, 20 nt, Mycobacterium tuberculosis H37Rv
ccauaccucggcgaccuccg

SEQ ID NO: 3296426 - RNA, 16 nt, Mycobacterium tuberculosis H37Rv
ccauaccuucggcgau

SEQ ID NO: 3296427 - RNA, 20 nt, Mycobacterium tuberculosis H37Rv
ccauagaugcccgcgaucau

SEQ ID NO: 3296428 - RNA, 19 nt, Mycobacterium tuberculosis H37Rv
ccauagcaccucgaugaug

SEQ ID NO: 3296429 - RNA, 17 nt, Mycobacterium tuberculosis H37Rv
ccauagccgcgacccgc

SEQ ID NO: 3296430 - RNA, 14 nt, Mycobacterium tuberculosis H37Rv
ccauagccugcgcc

SEQ ID NO: 3296431 - RNA, 23 nt, Mycobacterium tuberculosis H37Rv
ccauagcgccgcgcccaccauga

SEQ ID NO: 3296432 - RNA, 20 nt, Mycobacterium tuberculosis H37Rv
ccauaggcaaggucaacccg

SEQ ID NO: 3296433 - RNA, 18 nt, Mycobacterium tuberculosis H37Rv
ccauagugaggccgacca

SEQ ID NO: 3296434 - RNA, 20 nt, Mycobacterium tuberculosis H37Rv
ccauagugcggcagcggugg

SEQ ID NO: 3296435 - RNA, 13 nt, Mycobacterium tuberculosis H37Rv
ccauauagaucac

SEQ ID NO: 3296436 - RNA, 13 nt, Mycobacterium tuberculosis H37Rv
ccauaucgcccac

SEQ ID NO: 3296437 - RNA, 22 nt, Mycobacterium tuberculosis H37Rv
ccauaugggggaaagcuugacc

SEQ ID NO: 3296438 - RNA, 13 nt, Mycobacterium tuberculosis H37Rv
ccaucaaccccag

SEQ ID NO: 3296439 - RNA, 12 nt, Mycobacterium tuberculosis H37Rv
ccaucaaccgcg

SEQ ID NO: 3296440 - RNA, 16 nt, Mycobacterium tuberculosis H37Rv
ccaucaacugcaucac

SEQ ID NO: 3296441 - RNA, 20 nt, Mycobacterium tuberculosis H37Rv
ccaucaacugcaucaccacu

SEQ ID NO: 3296442 - RNA, 14 nt, Mycobacterium tuberculosis H37Rv
ccaucaagagcgcg

SEQ ID NO: 3296443 - RNA, 12 nt, Mycobacterium tuberculosis H37Rv
ccaucaaggcca

SEQ ID NO: 3296444 - RNA, 18 nt, Mycobacterium tuberculosis H37Rv
ccaucacaucggccucug

SEQ ID NO: 3296445 - RNA, 19 nt, Mycobacterium tuberculosis H37Rv
ccaucaccaccggcaccgc

SEQ ID NO: 3296446 - RNA, 13 nt, Mycobacterium tuberculosis H37Rv
ccaucaccagcgg

SEQ ID NO: 3296447 - RNA, 13 nt, Mycobacterium tuberculosis H37Rv
ccaucaccgccag

SEQ ID NO: 3296448 - RNA, 14 nt, Mycobacterium tuberculosis H37Rv
ccaucaccgccagc

SEQ ID NO: 3296449 - RNA, 21 nt, Mycobacterium tuberculosis H37Rv
ccaucaccgcgccagccucca

SEQ ID NO: 3296450 - RNA, 12 nt, Mycobacterium tuberculosis H37Rv
ccaucacgcccu

SEQ ID NO: 3296451 - RNA, 19 nt, Mycobacterium tuberculosis H37Rv
ccaucacgcccuguucucc

SEQ ID NO: 3296452 - RNA, 16 nt, Mycobacterium tuberculosis H37Rv
ccaucacggaccaggc

SEQ ID NO: 3296453 - RNA, 14 nt, Mycobacterium tuberculosis H37Rv
ccaucacggucagc

SEQ ID NO: 3296454 - RNA, 13 nt, Mycobacterium tuberculosis H37Rv
ccaucagcccggc

SEQ ID NO: 3296455 - RNA, 21 nt, Mycobacterium tuberculosis H37Rv
ccaucagccgcugcguagugu

SEQ ID NO: 3296456 - RNA, 16 nt, Mycobacterium tuberculosis H37Rv
ccaucagcucgccagg

SEQ ID NO: 3296457 - RNA, 15 nt, Mycobacterium tuberculosis H37Rv
ccaucaucaccucuc

SEQ ID NO: 3296458 - RNA, 21 nt, Mycobacterium tuberculosis H37Rv
ccaucaucaccucucgcuugc

SEQ ID NO: 3296459 - RNA, 14 nt, Mycobacterium tuberculosis H37Rv
ccaucaugguccgg

SEQ ID NO: 3296460 - RNA, 22 nt, Mycobacterium tuberculosis H37Rv
ccaucaugugcgcgaccacccg

SEQ ID NO: 3296461 - RNA, 20 nt, Mycobacterium tuberculosis H37Rv
ccaucauguucuuuugcguc

SEQ ID NO: 3296462 - RNA, 21 nt, Mycobacterium tuberculosis H37Rv
ccauccacaucgaugucggcu

SEQ ID NO: 3296463 - RNA, 20 nt, Mycobacterium tuberculosis H37Rv
ccaucccgaucccggccagc

SEQ ID NO: 3296464 - RNA, 19 nt, Mycobacterium tuberculosis H37Rv
ccaucccgauccuggccac

SEQ ID NO: 3296465 - RNA, 14 nt, Mycobacterium tuberculosis H37Rv
ccauggcccgcucg

SEQ ID NO: 3296466 - RNA, 14 nt, Mycobacterium tuberculosis H37Rv
ccauggcgccgcgc

SEQ ID NO: 3296467 - RNA, 18 nt, Mycobacterium tuberculosis H37Rv
ccauggcgcgaccuccgc

SEQ ID NO: 3296468 - RNA, 20 nt, Mycobacterium tuberculosis H37Rv
ccauggcgcgaccuccgcga

SEQ ID NO: 3296469 - RNA, 18 nt, Mycobacterium tuberculosis H37Rv
ccauggcgcgagcagacg

SEQ ID NO: 3296470 - RNA, 16 nt, Mycobacterium tuberculosis H37Rv
ccaugggauucggcca

SEQ ID NO: 3296471 - RNA, 17 nt, Mycobacterium tuberculosis H37Rv
ccaugggucuggcaggc

SEQ ID NO: 3296472 - RNA, 22 nt, Mycobacterium tuberculosis H37Rv
ccaugggucuggcaggccagca

SEQ ID NO: 3296473 - RNA, 12 nt, Mycobacterium tuberculosis H37Rv
ccauggucacca

SEQ ID NO: 3296474 - RNA, 16 nt, Mycobacterium tuberculosis H37Rv
ccauggucgauucguc

SEQ ID NO: 3296475 - RNA, 12 nt, Mycobacterium tuberculosis H37Rv
ccauggugggcc

SEQ ID NO: 3296476 - RNA, 21 nt, Mycobacterium tuberculosis H37Rv
ccauguagccguugccgccga

SEQ ID NO: 3296477 - RNA, 21 nt, Mycobacterium tuberculosis H37Rv
ccauguauuucucccagccca

SEQ ID NO: 3296478 - RNA, 15 nt, Mycobacterium tuberculosis H37Rv
ccaugucggccaccc

SEQ ID NO: 3296479 - RNA, 14 nt, Mycobacterium tuberculosis H37Rv
ccaugucggugacc

SEQ ID NO: 3296480 - RNA, 20 nt, Mycobacterium tuberculosis H37Rv
ccaugucggugaccguucgg

SEQ ID NO: 3296481 - RNA, 21 nt, Mycobacterium tuberculosis H37Rv
ccaugucggugaccguucggc

SEQ ID NO: 3296482 - RNA, 17 nt, Mycobacterium tuberculosis H37Rv
ccaugugucccggacca

SEQ ID NO: 3296483 - RNA, 17 nt, Mycobacterium tuberculosis H37Rv
ccauguguuugaucacc

SEQ ID NO: 3296484 - RNA, 22 nt, Mycobacterium tuberculosis H37Rv
ccauguugaagcgaagccagau

SEQ ID NO: 3296485 - RNA, 18 nt, Mycobacterium tuberculosis H37Rv
ccauguugcccugcaacc

SEQ ID NO: 3296486 - RNA, 19 nt, Mycobacterium tuberculosis H37Rv
ccauguuggggaugccgga

SEQ ID NO: 3296487 - RNA, 18 nt, Mycobacterium tuberculosis H37Rv
ccauguuuugcugcaugc

SEQ ID NO: 3296488 - RNA, 21 nt, Mycobacterium tuberculosis H37Rv
ccauuaaaaagcccagcgauu

SEQ ID NO: 3296489 - RNA, 17 nt, Mycobacterium tuberculosis H37Rv
ccauuagcagcacccgg

SEQ ID NO: 3296490 - RNA, 17 nt, Mycobacterium tuberculosis H37Rv
ccauucacgagccgcuc

SEQ ID NO: 3296491 - RNA, 14 nt, Mycobacterium tuberculosis H37Rv
ccauuccaucgcgc

SEQ ID NO: 3296492 - RNA, 21 nt, Mycobacterium tuberculosis H37Rv
ccauuccaucgcgcaccgcau

SEQ ID NO: 3296493 - RNA, 17 nt, Mycobacterium tuberculosis H37Rv
ccauucccaacacagcc

SEQ ID NO: 3296494 - RNA, 20 nt, Mycobacterium tuberculosis H37Rv
ccauucccaacacagccguc

SEQ ID NO: 3296495 - RNA, 11 nt, Mycobacterium tuberculosis H37Rv
ccauucgcggu

SEQ ID NO: 3296496 - RNA, 16 nt, Mycobacterium tuberculosis H37Rv
ccauucggcgagaaca

SEQ ID NO: 3296497 - RNA, 14 nt, Mycobacterium tuberculosis H37Rv
ccauugacgccguu

SEQ ID NO: 3296498 - RNA, 23 nt, Mycobacterium tuberculosis H37Rv
ccauugccauacagcaccccgcc

SEQ ID NO: 3296499 - RNA, 14 nt, Mycobacterium tuberculosis H37Rv
ccauugccgccguc

SEQ ID NO: 3296500 - RNA, 19 nt, Mycobacterium tuberculosis H37Rv
ccauugccgccgucgccga

SEQ ID NO: 3296501 - RNA, 22 nt, Mycobacterium tuberculosis H37Rv
ccauugcgggagccucgccugu

SEQ ID NO: 3296502 - RNA, 22 nt, Mycobacterium tuberculosis H37Rv
ccauuggaccgagacuugcugg

SEQ ID NO: 3296503 - RNA, 14 nt, Mycobacterium tuberculosis H37Rv
ccauuggcgccgcc

SEQ ID NO: 3296504 - RNA, 15 nt, Mycobacterium tuberculosis H37Rv
ccauuucgucagcga

SEQ ID NO: 3296505 - RNA, 17 nt, Mycobacterium tuberculosis H37Rv
ccauuucucguacccgg

SEQ ID NO: 3296506 - RNA, 16 nt, Mycobacterium tuberculosis H37Rv
ccauuuucgccaacuu

SEQ ID NO: 3296507 - RNA, 13 nt, Mycobacterium tuberculosis H37Rv
cccaaaaacggca

SEQ ID NO: 3296508 - RNA, 17 nt, Mycobacterium tuberculosis H37Rv
cccaaagcgccagcagc

SEQ ID NO: 3296509 - RNA, 15 nt, Mycobacterium tuberculosis H37Rv
cccaacaccgccaga

SEQ ID NO: 3296510 - RNA, 17 nt, Mycobacterium tuberculosis H37Rv
cccaacaucccggaccg

SEQ ID NO: 3296511 - RNA, 17 nt, Mycobacterium tuberculosis H37Rv
cccaaccgaaccgcguu

SEQ ID NO: 3296512 - RNA, 14 nt, Mycobacterium tuberculosis H37Rv
cccaacgaccacca

SEQ ID NO: 3296513 - RNA, 15 nt, Mycobacterium tuberculosis H37Rv
cccaacgaccggcac

SEQ ID NO: 3296514 - RNA, 19 nt, Mycobacterium tuberculosis H37Rv
cccaacgagaugugagcac

SEQ ID NO: 3296515 - RNA, 14 nt, Mycobacterium tuberculosis H37Rv
cccaacgccacugc

SEQ ID NO: 3296516 - RNA, 20 nt, Mycobacterium tuberculosis H37Rv
cccaacgcgguaaagccccg

SEQ ID NO: 3296517 - RNA, 23 nt, Mycobacterium tuberculosis H37Rv
cccaacgcgguaaagccccgcuc

SEQ ID NO: 3296518 - RNA, 14 nt, Mycobacterium tuberculosis H37Rv
cccaacgucgccag

SEQ ID NO: 3296519 - RNA, 12 nt, Mycobacterium tuberculosis H37Rv
cccaagaucucg

SEQ ID NO: 3296520 - RNA, 14 nt, Mycobacterium tuberculosis H37Rv
cccaagcaguccac

SEQ ID NO: 3296521 - RNA, 14 nt, Mycobacterium tuberculosis H37Rv
cccaagccgaucgg

SEQ ID NO: 3296522 - RNA, 18 nt, Mycobacterium tuberculosis H37Rv
cccaagccugccgaaccc

SEQ ID NO: 3296523 - RNA, 17 nt, Mycobacterium tuberculosis H37Rv
cccaagcguccgcugca

SEQ ID NO: 3296524 - RNA, 15 nt, Mycobacterium tuberculosis H37Rv
cccaagcgugcugcc

SEQ ID NO: 3296525 - RNA, 20 nt, Mycobacterium tuberculosis H37Rv
cccaagcgugcugccgccuu

SEQ ID NO: 3296526 - RNA, 13 nt, Mycobacterium tuberculosis H37Rv
cccaaggccagga

SEQ ID NO: 3296527 - RNA, 21 nt, Mycobacterium tuberculosis H37Rv
cccaaguccagcagcgacgcu

SEQ ID NO: 3296528 - RNA, 22 nt, Mycobacterium tuberculosis H37Rv
cccaaucgggaucgcugccagc

SEQ ID NO: 3296529 - RNA, 16 nt, Mycobacterium tuberculosis H37Rv
cccaaucgucggccag

SEQ ID NO: 3296530 - RNA, 18 nt, Mycobacterium tuberculosis H37Rv
cccaaucgucggccagca

SEQ ID NO: 3296531 - RNA, 22 nt, Mycobacterium tuberculosis H37Rv
cccaaucgucggccagcagauc

SEQ ID NO: 3296532 - RNA, 13 nt, Mycobacterium tuberculosis H37Rv
cccaaugcgggcu

SEQ ID NO: 3296533 - RNA, 15 nt, Mycobacterium tuberculosis H37Rv
cccaauguccaggcg

SEQ ID NO: 3296534 - RNA, 21 nt, Mycobacterium tuberculosis H37Rv
cccaauucacgacgccgagca

SEQ ID NO: 3296535 - RNA, 21 nt, Mycobacterium tuberculosis H37Rv
cccaauucagauagucgccgc

SEQ ID NO: 3296536 - RNA, 18 nt, Mycobacterium tuberculosis H37Rv
cccaauucgacugcaacu

SEQ ID NO: 3296537 - RNA, 19 nt, Mycobacterium tuberculosis H37Rv
cccacaaagauccggccaa

SEQ ID NO: 3296538 - RNA, 17 nt, Mycobacterium tuberculosis H37Rv
cccacaaccgcaccagg

SEQ ID NO: 3296539 - RNA, 12 nt, Mycobacterium tuberculosis H37Rv
cccacaccagcg

SEQ ID NO: 3296540 - RNA, 15 nt, Mycobacterium tuberculosis H37Rv
cccacaccagcgcag

SEQ ID NO: 3296541 - RNA, 15 nt, Mycobacterium tuberculosis H37Rv
cccacaccuuggcgg

SEQ ID NO: 3296542 - RNA, 21 nt, Mycobacterium tuberculosis H37Rv
cccacacggucgucgcgagcg

SEQ ID NO: 3296543 - RNA, 14 nt, Mycobacterium tuberculosis H37Rv
cccacagcgugcgg

SEQ ID NO: 3296544 - RNA, 21 nt, Mycobacterium tuberculosis H37Rv
cccacagcgugcgggucuuug

SEQ ID NO: 3296545 - RNA, 17 nt, Mycobacterium tuberculosis H37Rv
cccacaggggcagcgcg

SEQ ID NO: 3296546 - RNA, 19 nt, Mycobacterium tuberculosis H37Rv
cccacagucgccggccggc

SEQ ID NO: 3296547 - RNA, 17 nt, Mycobacterium tuberculosis H37Rv
cccacagucgugagcca

SEQ ID NO: 3296548 - RNA, 17 nt, Mycobacterium tuberculosis H37Rv
cccacaguuaucagccg

SEQ ID NO: 3296549 - RNA, 19 nt, Mycobacterium tuberculosis H37Rv
cccacaugaacgaccaccg

SEQ ID NO: 3296550 - RNA, 18 nt, Mycobacterium tuberculosis H37Rv
cccacaugacgaucgcgg

SEQ ID NO: 3296551 - RNA, 21 nt, Mycobacterium tuberculosis H37Rv
cccacaugacgaucgcggcgg

SEQ ID NO: 3296552 - RNA, 18 nt, Mycobacterium tuberculosis H37Rv
cccacaugcgcucgcgga

SEQ ID NO: 3296553 - RNA, 22 nt, Mycobacterium tuberculosis H37Rv
cccacauggcccggaggccgcu

SEQ ID NO: 3296554 - RNA, 12 nt, Mycobacterium tuberculosis H37Rv
cccaccacacag

SEQ ID NO: 3296555 - RNA, 14 nt, Mycobacterium tuberculosis H37Rv
cccaccacacagcc

SEQ ID NO: 3296556 - RNA, 14 nt, Mycobacterium tuberculosis H37Rv
cccaccaccaccgc

SEQ ID NO: 3296557 - RNA, 13 nt, Mycobacterium tuberculosis H37Rv
cccaccagcgcag

SEQ ID NO: 3296558 - RNA, 15 nt, Mycobacterium tuberculosis H37Rv
cccaccagcgcagcc

SEQ ID NO: 3296559 - RNA, 12 nt, Mycobacterium tuberculosis H37Rv
cccaccagugca

SEQ ID NO: 3296560 - RNA, 22 nt, Mycobacterium tuberculosis H37Rv
cccacccagcgacucggccagg

SEQ ID NO: 3296561 - RNA, 21 nt, Mycobacterium tuberculosis H37Rv
cccacccccgguucaccuccc

SEQ ID NO: 3296562 - RNA, 19 nt, Mycobacterium tuberculosis H37Rv
cccagccggaccgcgacgg

SEQ ID NO: 3296563 - RNA, 14 nt, Mycobacterium tuberculosis H37Rv
cccagccggcagca

SEQ ID NO: 3296564 - RNA, 17 nt, Mycobacterium tuberculosis H37Rv
cccagccgugcccaagc

SEQ ID NO: 3296565 - RNA, 16 nt, Mycobacterium tuberculosis H37Rv
cccagccguucgucgc

SEQ ID NO: 3296566 - RNA, 22 nt, Mycobacterium tuberculosis H37Rv
cccagcgaaucacccgcgagau

SEQ ID NO: 3296567 - RNA, 20 nt, Mycobacterium tuberculosis H37Rv
cccagcgaccgcugcagauu

SEQ ID NO: 3296568 - RNA, 20 nt, Mycobacterium tuberculosis H37Rv
cccagcgacgcggccagcgg

SEQ ID NO: 3296569 - RNA, 23 nt, Mycobacterium tuberculosis H37Rv
cccagcgacgcggccagcggcaa

SEQ ID NO: 3296570 - RNA, 17 nt, Mycobacterium tuberculosis H37Rv
cccagcgacucggccag

SEQ ID NO: 3296571 - RNA, 14 nt, Mycobacterium tuberculosis H37Rv
cccagcgagguggg

SEQ ID NO: 3296572 - RNA, 23 nt, Mycobacterium tuberculosis H37Rv
cccagcgaggugggcgucaucga

SEQ ID NO: 3296573 - RNA, 23 nt, Mycobacterium tuberculosis H37Rv
cccagcgcacggaccaucgccag

SEQ ID NO: 3296574 - RNA, 14 nt, Mycobacterium tuberculosis H37Rv
cccagcgcagcagc

SEQ ID NO: 3296575 - RNA, 17 nt, Mycobacterium tuberculosis H37Rv
cccagcgcagcagcggc

SEQ ID NO: 3296576 - RNA, 12 nt, Mycobacterium tuberculosis H37Rv
cccagcgcagcg

SEQ ID NO: 3296577 - RNA, 16 nt, Mycobacterium tuberculosis H37Rv
cccagcgcagcggacg

SEQ ID NO: 3296578 - RNA, 17 nt, Mycobacterium tuberculosis H37Rv
cccagcgcagcggacgg

SEQ ID NO: 3296579 - RNA, 13 nt, Mycobacterium tuberculosis H37Rv
cccagcgccaccg

SEQ ID NO: 3296580 - RNA, 16 nt, Mycobacterium tuberculosis H37Rv
cccagcgcccccagca

SEQ ID NO: 3296581 - RNA, 14 nt, Mycobacterium tuberculosis H37Rv
cccagcgcccgccg

SEQ ID NO: 3296582 - RNA, 17 nt, Mycobacterium tuberculosis H37Rv
cccagcgcccgcgcggc

SEQ ID NO: 3296583 - RNA, 14 nt, Mycobacterium tuberculosis H37Rv
cccagcgcccggcc

SEQ ID NO: 3296584 - RNA, 17 nt, Mycobacterium tuberculosis H37Rv
cccagcgcccggccacu

SEQ ID NO: 3296585 - RNA, 13 nt, Mycobacterium tuberculosis H37Rv
cccagcgccgaau

SEQ ID NO: 3296586 - RNA, 21 nt, Mycobacterium tuberculosis H37Rv
cccagcgccgcaguggaugca

SEQ ID NO: 3296587 - RNA, 15 nt, Mycobacterium tuberculosis H37Rv
cccagcgccuccagc

SEQ ID NO: 3296588 - RNA, 18 nt, Mycobacterium tuberculosis H37Rv
cccagcgccuccagcacc

SEQ ID NO: 3296589 - RNA, 19 nt, Mycobacterium tuberculosis H37Rv
cccagcgccuccagcacca

SEQ ID NO: 3296590 - RNA, 14 nt, Mycobacterium tuberculosis H37Rv
cccagcgcgcggag

SEQ ID NO: 3296591 - RNA, 20 nt, Mycobacterium tuberculosis H37Rv
cccagcgcgcgguggccaac

SEQ ID NO: 3296592 - RNA, 14 nt, Mycobacterium tuberculosis H37Rv
cccagcgcggcaac

SEQ ID NO: 3296593 - RNA, 16 nt, Mycobacterium tuberculosis H37Rv
cccagcgcggcaacuc

SEQ ID NO: 3296594 - RNA, 14 nt, Mycobacterium tuberculosis H37Rv
cccagcgcuagccg

SEQ ID NO: 3296595 - RNA, 18 nt, Mycobacterium tuberculosis H37Rv
cccagcgcugucguaccg

SEQ ID NO: 3296596 - RNA, 23 nt, Mycobacterium tuberculosis H37Rv
cccagcggagccacucggcccgg

SEQ ID NO: 3296597 - RNA, 22 nt, Mycobacterium tuberculosis H37Rv
cccagcggcugguugcgccacu

SEQ ID NO: 3296598 - RNA, 21 nt, Mycobacterium tuberculosis H37Rv
cccagcgggacaaaaucagca

SEQ ID NO: 3296599 - RNA, 23 nt, Mycobacterium tuberculosis H37Rv
cccagcgggacaaaaucagcagc

SEQ ID NO: 3296600 - RNA, 18 nt, Mycobacterium tuberculosis H37Rv
cccagcgguagccgagcu

SEQ ID NO: 3296601 - RNA, 18 nt, Mycobacterium tuberculosis H37Rv
cccagcgguaucccccag

SEQ ID NO: 3296602 - RNA, 19 nt, Mycobacterium tuberculosis H37Rv
cccagcgguaucccccagc

SEQ ID NO: 3296603 - RNA, 14 nt, Mycobacterium tuberculosis H37Rv
cccagcgguugacc

SEQ ID NO: 3296604 - RNA, 20 nt, Mycobacterium tuberculosis H37Rv
cccagcgucugugucccguc

SEQ ID NO: 3296605 - RNA, 15 nt, Mycobacterium tuberculosis H37Rv
cccagcgugcccgcc

SEQ ID NO: 3296606 - RNA, 18 nt, Mycobacterium tuberculosis H37Rv
cccagcgugcccgccacc

SEQ ID NO: 3296607 - RNA, 16 nt, Mycobacterium tuberculosis H37Rv
cccagcucgucgacgu

SEQ ID NO: 3296608 - RNA, 12 nt, Mycobacterium tuberculosis H37Rv
cccagcugcgcc

SEQ ID NO: 3296609 - RNA, 22 nt, Mycobacterium tuberculosis H37Rv
cccagcuugcggugaucccacg

SEQ ID NO: 3296610 - RNA, 21 nt, Mycobacterium tuberculosis H37Rv
cccagcuuggcgucgaugcgg

SEQ ID NO: 3296611 - RNA, 17 nt, Mycobacterium tuberculosis H37Rv
cccaggaacgggacgcc

SEQ ID NO: 3296612 - RNA, 12 nt, Mycobacterium tuberculosis H37Rv
cccaggacaccu

SEQ ID NO: 3296613 - RNA, 14 nt, Mycobacterium tuberculosis H37Rv
cccaggacaccuug

SEQ ID NO: 3296614 - RNA, 23 nt, Mycobacterium tuberculosis H37Rv
cccaggacuccggccgcacgccg

SEQ ID NO: 3296615 - RNA, 17 nt, Mycobacterium tuberculosis H37Rv
cccaggagcaccucgaa

SEQ ID NO: 3296616 - RNA, 22 nt, Mycobacterium tuberculosis H37Rv
cccaggcaaguugugagggagg

SEQ ID NO: 3296617 - RNA, 16 nt, Mycobacterium tuberculosis H37Rv
cccaggcaucggugag

SEQ ID NO: 3296618 - RNA, 17 nt, Mycobacterium tuberculosis H37Rv
cccaggccaagguggcc

SEQ ID NO: 3296619 - RNA, 22 nt, Mycobacterium tuberculosis H37Rv
cccaggccaccggcugcaacca

SEQ ID NO: 3296620 - RNA, 18 nt, Mycobacterium tuberculosis H37Rv
cccaggccgcuugccccg

SEQ ID NO: 3296621 - RNA, 19 nt, Mycobacterium tuberculosis H37Rv
cccaggccgcuugccccgc

SEQ ID NO: 3296622 - RNA, 14 nt, Mycobacterium tuberculosis H37Rv
cccaggcgaacagg

SEQ ID NO: 3296623 - RNA, 19 nt, Mycobacterium tuberculosis H37Rv
cccaggcgaacagggcugc

SEQ ID NO: 3296624 - RNA, 20 nt, Mycobacterium tuberculosis H37Rv
cccaggcgaucgcccggccc

SEQ ID NO: 3296625 - RNA, 18 nt, Mycobacterium tuberculosis H37Rv
cccaggcgcucagcgcgg

SEQ ID NO: 3296626 - RNA, 19 nt, Mycobacterium tuberculosis H37Rv
cccaggcgcucagcgcggc

SEQ ID NO: 3296627 - RNA, 21 nt, Mycobacterium tuberculosis H37Rv
cccaggcgcucaucacccagc

SEQ ID NO: 3296628 - RNA, 14 nt, Mycobacterium tuberculosis H37Rv
cccaggcgcugccg

SEQ ID NO: 3296629 - RNA, 20 nt, Mycobacterium tuberculosis H37Rv
cccaggcgcugccgguguug

SEQ ID NO: 3296630 - RNA, 19 nt, Mycobacterium tuberculosis H37Rv
cccaggcguuuggcgugcc

SEQ ID NO: 3296631 - RNA, 23 nt, Mycobacterium tuberculosis H37Rv
cccaggcguuuggcgugccgucg

SEQ ID NO: 3296632 - RNA, 15 nt, Mycobacterium tuberculosis H37Rv
cccaggcucgcaccg

SEQ ID NO: 3296633 - RNA, 20 nt, Mycobacterium tuberculosis H37Rv
cccaggcugguccgggugcc

SEQ ID NO: 3296634 - RNA, 22 nt, Mycobacterium tuberculosis H37Rv
cccagggcacaucgggcguggu

SEQ ID NO: 3296635 - RNA, 17 nt, Mycobacterium tuberculosis H37Rv
cccagggcguuggcggc

SEQ ID NO: 3296636 - RNA, 14 nt, Mycobacterium tuberculosis H37Rv
cccagggcugccgg

SEQ ID NO: 3296637 - RNA, 15 nt, Mycobacterium tuberculosis H37Rv
cccagggggcgugcc

SEQ ID NO: 3296638 - RNA, 18 nt, Mycobacterium tuberculosis H37Rv
cccagggggcgugccgcc

SEQ ID NO: 3296639 - RNA, 12 nt, Mycobacterium tuberculosis H37Rv
cccagggugcgc

SEQ ID NO: 3296640 - RNA, 14 nt, Mycobacterium tuberculosis H37Rv
cccagggugcgcca

SEQ ID NO: 3296641 - RNA, 16 nt, Mycobacterium tuberculosis H37Rv
cccagggugucuguga

SEQ ID NO: 3296642 - RNA, 13 nt, Mycobacterium tuberculosis H37Rv
cccaggucaacga

SEQ ID NO: 3296643 - RNA, 19 nt, Mycobacterium tuberculosis H37Rv
cccaggucaacgacguuga

SEQ ID NO: 3296644 - RNA, 15 nt, Mycobacterium tuberculosis H37Rv
cccagguccgcgugc

SEQ ID NO: 3296645 - RNA, 16 nt, Mycobacterium tuberculosis H37Rv
cccaggucguaggcgc

SEQ ID NO: 3296646 - RNA, 15 nt, Mycobacterium tuberculosis H37Rv
cccaggugcaagcgg

SEQ ID NO: 3296647 - RNA, 22 nt, Mycobacterium tuberculosis H37Rv
cccaggugcguccaggccaggg

SEQ ID NO: 3296648 - RNA, 14 nt, Mycobacterium tuberculosis H37Rv
cccaggugggcagc

SEQ ID NO: 3296649 - RNA, 18 nt, Mycobacterium tuberculosis H37Rv
cccaggugggcagcaggc

SEQ ID NO: 3296650 - RNA, 21 nt, Mycobacterium tuberculosis H37Rv
cccaggugggccgagagcagc

SEQ ID NO: 3296651 - RNA, 17 nt, Mycobacterium tuberculosis H37Rv
cccagguguguggcggc

SEQ ID NO: 3296652 - RNA, 21 nt, Mycobacterium tuberculosis H37Rv
cccagguugccuuggcggcca

SEQ ID NO: 3296653 - RNA, 16 nt, Mycobacterium tuberculosis H37Rv
cccaguagaucgccuc

SEQ ID NO: 3296654 - RNA, 17 nt, Mycobacterium tuberculosis H37Rv
cccaguccgaagcugcu

SEQ ID NO: 3296655 - RNA, 19 nt, Mycobacterium tuberculosis H37Rv
cccaguccgaagcugcugc

SEQ ID NO: 3296656 - RNA, 20 nt, Mycobacterium tuberculosis H37Rv
cccaguccgaagcugcugcu

SEQ ID NO: 3296657 - RNA, 14 nt, Mycobacterium tuberculosis H37Rv
cccagucgcggcgc

SEQ ID NO: 3296658 - RNA, 13 nt, Mycobacterium tuberculosis H37Rv
ccccauugccgcc

SEQ ID NO: 3296659 - RNA, 22 nt, Mycobacterium tuberculosis H37Rv
cccccaaaucaacagggugggc

SEQ ID NO: 3296660 - RNA, 16 nt, Mycobacterium tuberculosis H37Rv
cccccaagcucugcgu

SEQ ID NO: 3296661 - RNA, 14 nt, Mycobacterium tuberculosis H37Rv
cccccacggcccgu

SEQ ID NO: 3296662 - RNA, 21 nt, Mycobacterium tuberculosis H37Rv
cccccagacaauccgccgccg

SEQ ID NO: 3296663 - RNA, 15 nt, Mycobacterium tuberculosis H37Rv
cccccagcacccggc

SEQ ID NO: 3296664 - RNA, 16 nt, Mycobacterium tuberculosis H37Rv
cccccagcacccggcu

SEQ ID NO: 3296665 - RNA, 12 nt, Mycobacterium tuberculosis H37Rv
cccccagcagcu

SEQ ID NO: 3296666 - RNA, 14 nt, Mycobacterium tuberculosis H37Rv
cccccagccgcggc

SEQ ID NO: 3296667 - RNA, 13 nt, Mycobacterium tuberculosis H37Rv
cccccagcgccgc

SEQ ID NO: 3296668 - RNA, 16 nt, Mycobacterium tuberculosis H37Rv
cccccagcgccgccgc

SEQ ID NO: 3296669 - RNA, 17 nt, Mycobacterium tuberculosis H37Rv
cccccagcgccgccgcg

SEQ ID NO: 3296670 - RNA, 14 nt, Mycobacterium tuberculosis H37Rv
ccccccacccacca

SEQ ID NO: 3296671 - RNA, 14 nt, Mycobacterium tuberculosis H37Rv
ccccccgagcccgc

SEQ ID NO: 3296672 - RNA, 17 nt, Mycobacterium tuberculosis H37Rv
cccccgaaguggugacc

SEQ ID NO: 3296673 - RNA, 12 nt, Mycobacterium tuberculosis H37Rv
cccccgacaccg

SEQ ID NO: 3296674 - RNA, 21 nt, Mycobacterium tuberculosis H37Rv
cccccgacuccggcaggcccg

SEQ ID NO: 3296675 - RNA, 17 nt, Mycobacterium tuberculosis H37Rv
cccccgagcccgccagc

SEQ ID NO: 3296676 - RNA, 22 nt, Mycobacterium tuberculosis H37Rv
cccccgauagcgaccgcggccc

SEQ ID NO: 3296677 - RNA, 20 nt, Mycobacterium tuberculosis H37Rv
cccccgauggcgucgccggc

SEQ ID NO: 3296678 - RNA, 12 nt, Mycobacterium tuberculosis H37Rv
cccccgccgcgc

SEQ ID NO: 3296679 - RNA, 14 nt, Mycobacterium tuberculosis H37Rv
cccccgccggccgc

SEQ ID NO: 3296680 - RNA, 12 nt, Mycobacterium tuberculosis H37Rv
cccccgcgcgaa

SEQ ID NO: 3296681 - RNA, 22 nt, Mycobacterium tuberculosis H37Rv
cccccggauuccagcagccugc

SEQ ID NO: 3296682 - RNA, 17 nt, Mycobacterium tuberculosis H37Rv
cccccggcaccgccggc

SEQ ID NO: 3296683 - RNA, 13 nt, Mycobacterium tuberculosis H37Rv
cccccggcgacgg

SEQ ID NO: 3296684 - RNA, 15 nt, Mycobacterium tuberculosis H37Rv
cccccggcgcggcgg

SEQ ID NO: 3296685 - RNA, 12 nt, Mycobacterium tuberculosis H37Rv
cccccgggcccg

SEQ ID NO: 3296686 - RNA, 15 nt, Mycobacterium tuberculosis H37Rv
cccccggggcgcucg

SEQ ID NO: 3296687 - RNA, 20 nt, Mycobacterium tuberculosis H37Rv
cccccggguagaccaccugc

SEQ ID NO: 3296688 - RNA, 22 nt, Mycobacterium tuberculosis H37Rv
cccccgggugcgggugggacac

SEQ ID NO: 3296689 - RNA, 16 nt, Mycobacterium tuberculosis H37Rv
cccccgguaccgcccg

SEQ ID NO: 3296690 - RNA, 14 nt, Mycobacterium tuberculosis H37Rv
cccccggugccggc

SEQ ID NO: 3296691 - RNA, 16 nt, Mycobacterium tuberculosis H37Rv
cccccgucgaucagcg

SEQ ID NO: 3296692 - RNA, 15 nt, Mycobacterium tuberculosis H37Rv
cccccguugccgccc

SEQ ID NO: 3296693 - RNA, 22 nt, Mycobacterium tuberculosis H37Rv
cccccguugccgcccgucccgc

SEQ ID NO: 3296694 - RNA, 18 nt, Mycobacterium tuberculosis H37Rv
cccccuagaccgggcggu

SEQ ID NO: 3296695 - RNA, 12 nt, Mycobacterium tuberculosis H37Rv
cccccugccaca

SEQ ID NO: 3296696 - RNA, 14 nt, Mycobacterium tuberculosis H37Rv
cccccugguacacc

SEQ ID NO: 3296697 - RNA, 20 nt, Mycobacterium tuberculosis H37Rv
cccccugguacaccaggccg

SEQ ID NO: 3296698 - RNA, 17 nt, Mycobacterium tuberculosis H37Rv
ccccgaacauccgccgc

SEQ ID NO: 3296699 - RNA, 18 nt, Mycobacterium tuberculosis H37Rv
ccccgaacauugcgccca

SEQ ID NO: 3296700 - RNA, 20 nt, Mycobacterium tuberculosis H37Rv
ccccgaacauugcgcccagc

SEQ ID NO: 3296701 - RNA, 18 nt, Mycobacterium tuberculosis H37Rv
ccccgaagcucaucaccg

SEQ ID NO: 3296702 - RNA, 15 nt, Mycobacterium tuberculosis H37Rv
ccccgaaguggugac

SEQ ID NO: 3296703 - RNA, 21 nt, Mycobacterium tuberculosis H37Rv
ccccgaaguggugaccgacgc

SEQ ID NO: 3296704 - RNA, 15 nt, Mycobacterium tuberculosis H37Rv
ccccgacaccgccga

SEQ ID NO: 3296705 - RNA, 15 nt, Mycobacterium tuberculosis H37Rv
ccccgaccgaaccgu

SEQ ID NO: 3296706 - RNA, 13 nt, Mycobacterium tuberculosis H37Rv
ccccgaccgccac

SEQ ID NO: 3296707 - RNA, 16 nt, Mycobacterium tuberculosis H37Rv
ccccgaccgccaccgc

SEQ ID NO: 3296708 - RNA, 12 nt, Mycobacterium tuberculosis H37Rv
ccccgaccgccg

SEQ ID NO: 3296709 - RNA, 13 nt, Mycobacterium tuberculosis H37Rv
ccccgaccgccgu

SEQ ID NO: 3296710 - RNA, 18 nt, Mycobacterium tuberculosis H37Rv
ccccgaccgccguggccg

SEQ ID NO: 3296711 - RNA, 19 nt, Mycobacterium tuberculosis H37Rv
ccccgacgagauacggcca

SEQ ID NO: 3296712 - RNA, 17 nt, Mycobacterium tuberculosis H37Rv
ccccgacggacuccggc

SEQ ID NO: 3296713 - RNA, 20 nt, Mycobacterium tuberculosis H37Rv
ccccgacggacuccggccgg

SEQ ID NO: 3296714 - RNA, 21 nt, Mycobacterium tuberculosis H37Rv
ccccgacggcaaugcggggca

SEQ ID NO: 3296715 - RNA, 13 nt, Mycobacterium tuberculosis H37Rv
ccccgacugccgc

SEQ ID NO: 3296716 - RNA, 13 nt, Mycobacterium tuberculosis H37Rv
ccccgagauccgu

SEQ ID NO: 3296717 - RNA, 19 nt, Mycobacterium tuberculosis H37Rv
ccccgagcggagccgccga

SEQ ID NO: 3296718 - RNA, 16 nt, Mycobacterium tuberculosis H37Rv
ccccgagcugucggcu

SEQ ID NO: 3296719 - RNA, 22 nt, Mycobacterium tuberculosis H37Rv
ccccgauagcgaccgcggcccc

SEQ ID NO: 3296720 - RNA, 15 nt, Mycobacterium tuberculosis H37Rv
ccccgaucaucgacg

SEQ ID NO: 3296721 - RNA, 21 nt, Mycobacterium tuberculosis H37Rv
ccccgauggcgucgccggccc

SEQ ID NO: 3296722 - RNA, 17 nt, Mycobacterium tuberculosis H37Rv
ccccgcacgcgggaggu

SEQ ID NO: 3296723 - RNA, 18 nt, Mycobacterium tuberculosis H37Rv
ccccgcacggaaggucga

SEQ ID NO: 3296724 - RNA, 14 nt, Mycobacterium tuberculosis H37Rv
ccccgcagcaucgc

SEQ ID NO: 3296725 - RNA, 22 nt, Mycobacterium tuberculosis H37Rv
ccccgcagccagaucuccccga

SEQ ID NO: 3296726 - RNA, 13 nt, Mycobacterium tuberculosis H37Rv
ccccgcagcgccu

SEQ ID NO: 3296727 - RNA, 13 nt, Mycobacterium tuberculosis H37Rv
ccccgcagcucac

SEQ ID NO: 3296728 - RNA, 20 nt, Mycobacterium tuberculosis H37Rv
ccccgcagcucaccucauga

SEQ ID NO: 3296729 - RNA, 15 nt, Mycobacterium tuberculosis H37Rv
ccccgcagcugcguc

SEQ ID NO: 3296730 - RNA, 20 nt, Mycobacterium tuberculosis H37Rv
ccccgcagcugcgucccgga

SEQ ID NO: 3296731 - RNA, 13 nt, Mycobacterium tuberculosis H37Rv
ccccgcaucggcg

SEQ ID NO: 3296732 - RNA, 19 nt, Mycobacterium tuberculosis H37Rv
ccccgcauugccgucgggg

SEQ ID NO: 3296733 - RNA, 13 nt, Mycobacterium tuberculosis H37Rv
ccccgccaacccc

SEQ ID NO: 3296734 - RNA, 13 nt, Mycobacterium tuberculosis H37Rv
ccccgccagcgcc

SEQ ID NO: 3296735 - RNA, 15 nt, Mycobacterium tuberculosis H37Rv
ccccgccauugccgc

SEQ ID NO: 3296736 - RNA, 13 nt, Mycobacterium tuberculosis H37Rv
ccccgcccggcca

SEQ ID NO: 3296737 - RNA, 16 nt, Mycobacterium tuberculosis H37Rv
ccccgcccggccagcu

SEQ ID NO: 3296738 - RNA, 15 nt, Mycobacterium tuberculosis H37Rv
ccccgccgaucaccg

SEQ ID NO: 3296739 - RNA, 12 nt, Mycobacterium tuberculosis H37Rv
ccccgccgccac

SEQ ID NO: 3296740 - RNA, 11 nt, Mycobacterium tuberculosis H37Rv
ccccgccgccc

SEQ ID NO: 3296741 - RNA, 18 nt, Mycobacterium tuberculosis H37Rv
ccccgccgccguucccgc

SEQ ID NO: 3296742 - RNA, 12 nt, Mycobacterium tuberculosis H37Rv
ccccgccgccug

SEQ ID NO: 3296743 - RNA, 14 nt, Mycobacterium tuberculosis H37Rv
ccccgccggccgcg

SEQ ID NO: 3296744 - RNA, 16 nt, Mycobacterium tuberculosis H37Rv
ccccgccggccgcgcc

SEQ ID NO: 3296745 - RNA, 13 nt, Mycobacterium tuberculosis H37Rv
ccccgccggccgg

SEQ ID NO: 3296746 - RNA, 17 nt, Mycobacterium tuberculosis H37Rv
ccccgccggcugcggag

SEQ ID NO: 3296747 - RNA, 22 nt, Mycobacterium tuberculosis H37Rv
ccccgccggggccgccgucgcc

SEQ ID NO: 3296748 - RNA, 13 nt, Mycobacterium tuberculosis H37Rv
ccccgccguaccg

SEQ ID NO: 3296749 - RNA, 13 nt, Mycobacterium tuberculosis H37Rv
ccccgccgucacc

SEQ ID NO: 3296750 - RNA, 14 nt, Mycobacterium tuberculosis H37Rv
ccccgccgucaccg

SEQ ID NO: 3296751 - RNA, 15 nt, Mycobacterium tuberculosis H37Rv
ccccgccgucaccgc

SEQ ID NO: 3296752 - RNA, 15 nt, Mycobacterium tuberculosis H37Rv
ccccgccgucgccac

SEQ ID NO: 3296753 - RNA, 15 nt, Mycobacterium tuberculosis H37Rv
ccccgccguugccgc

SEQ ID NO: 3296754 - RNA, 23 nt, Mycobacterium tuberculosis H37Rv
ccccgccguugccgccgacgccg

SEQ ID NO: 3296755 - RNA, 12 nt, Mycobacterium tuberculosis H37Rv
ccccgccuuggc

SEQ ID NO: 3296756 - RNA, 13 nt, Mycobacterium tuberculosis H37Rv
cccgaccacugau

SEQ ID NO: 3296757 - RNA, 15 nt, Mycobacterium tuberculosis H37Rv
cccgaccagcaccag

SEQ ID NO: 3296758 - RNA, 12 nt, Mycobacterium tuberculosis H37Rv
cccgaccgccac

SEQ ID NO: 3296759 - RNA, 15 nt, Mycobacterium tuberculosis H37Rv
cccgaccgccaccgc

SEQ ID NO: 3296760 - RNA, 12 nt, Mycobacterium tuberculosis H37Rv
cccgaccgccga

SEQ ID NO: 3296761 - RNA, 12 nt, Mycobacterium tuberculosis H37Rv
cccgaccgcgua

SEQ ID NO: 3296762 - RNA, 15 nt, Mycobacterium tuberculosis H37Rv
cccgaccgggaacca

SEQ ID NO: 3296763 - RNA, 22 nt, Mycobacterium tuberculosis H37Rv
cccgacgaccauucgagagccu

SEQ ID NO: 3296764 - RNA, 20 nt, Mycobacterium tuberculosis H37Rv
cccgacgagauacggccacc

SEQ ID NO: 3296765 - RNA, 12 nt, Mycobacterium tuberculosis H37Rv
cccgacgagauu

SEQ ID NO: 3296766 - RNA, 16 nt, Mycobacterium tuberculosis H37Rv
cccgacgaggaugucg

SEQ ID NO: 3296767 - RNA, 23 nt, Mycobacterium tuberculosis H37Rv
cccgacgagucgccgcgggcagc

SEQ ID NO: 3296768 - RNA, 22 nt, Mycobacterium tuberculosis H37Rv
cccgacgaugcgggcgaucucg

SEQ ID NO: 3296769 - RNA, 12 nt, Mycobacterium tuberculosis H37Rv
cccgacgcagcu

SEQ ID NO: 3296770 - RNA, 17 nt, Mycobacterium tuberculosis H37Rv
cccgacgcagcuugccc

SEQ ID NO: 3296771 - RNA, 18 nt, Mycobacterium tuberculosis H37Rv
cccgacgccagcugcccg

SEQ ID NO: 3296772 - RNA, 20 nt, Mycobacterium tuberculosis H37Rv
cccgacggguaucccguccc

SEQ ID NO: 3296773 - RNA, 12 nt, Mycobacterium tuberculosis H37Rv
cccgacguucgu

SEQ ID NO: 3296774 - RNA, 13 nt, Mycobacterium tuberculosis H37Rv
cccgacucggccg

SEQ ID NO: 3296775 - RNA, 18 nt, Mycobacterium tuberculosis H37Rv
cccgacucggccgugacc

SEQ ID NO: 3296776 - RNA, 24 nt, Mycobacterium tuberculosis H37Rv
cccgacucggccgugaccgagccg

SEQ ID NO: 3296777 - RNA, 17 nt, Mycobacterium tuberculosis H37Rv
cccgacuggucacugcc

SEQ ID NO: 3296778 - RNA, 20 nt, Mycobacterium tuberculosis H37Rv
cccgacuguagaaaacccgu

SEQ ID NO: 3296779 - RNA, 16 nt, Mycobacterium tuberculosis H37Rv
cccgagaccaacgcgc

SEQ ID NO: 3296780 - RNA, 16 nt, Mycobacterium tuberculosis H37Rv
cccgagaguggacgug

SEQ ID NO: 3296781 - RNA, 13 nt, Mycobacterium tuberculosis H37Rv
cccgagaucaccg

SEQ ID NO: 3296782 - RNA, 18 nt, Mycobacterium tuberculosis H37Rv
cccgagaucaccgguacg

SEQ ID NO: 3296783 - RNA, 13 nt, Mycobacterium tuberculosis H37Rv
cccgagcccgcca

SEQ ID NO: 3296784 - RNA, 12 nt, Mycobacterium tuberculosis H37Rv
cccgagccugga

SEQ ID NO: 3296785 - RNA, 13 nt, Mycobacterium tuberculosis H37Rv
cccgagcgaugcg

SEQ ID NO: 3296786 - RNA, 21 nt, Mycobacterium tuberculosis H37Rv
cccgagcgaugcgaccgacuu

SEQ ID NO: 3296787 - RNA, 14 nt, Mycobacterium tuberculosis H37Rv
cccgagcgcgcgcu

SEQ ID NO: 3296788 - RNA, 15 nt, Mycobacterium tuberculosis H37Rv
cccgagcucaccgca

SEQ ID NO: 3296789 - RNA, 14 nt, Mycobacterium tuberculosis H37Rv
cccgaggcaacaag

SEQ ID NO: 3296790 - RNA, 17 nt, Mycobacterium tuberculosis H37Rv
cccgaggcaacaagcac

SEQ ID NO: 3296791 - RNA, 12 nt, Mycobacterium tuberculosis H37Rv
cccgaggcaccc

SEQ ID NO: 3296792 - RNA, 18 nt, Mycobacterium tuberculosis H37Rv
cccgaggcgagacgcucc

SEQ ID NO: 3296793 - RNA, 21 nt, Mycobacterium tuberculosis H37Rv
cccgaggcgcccaacaggcgg

SEQ ID NO: 3296794 - RNA, 15 nt, Mycobacterium tuberculosis H37Rv
cccgaggcuggcauc

SEQ ID NO: 3296795 - RNA, 18 nt, Mycobacterium tuberculosis H37Rv
cccgagucgaaaccgccc

SEQ ID NO: 3296796 - RNA, 16 nt, Mycobacterium tuberculosis H37Rv
cccgagucugcgagca

SEQ ID NO: 3296797 - RNA, 22 nt, Mycobacterium tuberculosis H37Rv
cccgaguggccggugggccgcc

SEQ ID NO: 3296798 - RNA, 17 nt, Mycobacterium tuberculosis H37Rv
cccgaguuaaacgcagc

SEQ ID NO: 3296799 - RNA, 17 nt, Mycobacterium tuberculosis H37Rv
cccgaguucgcaaugcc

SEQ ID NO: 3296800 - RNA, 15 nt, Mycobacterium tuberculosis H37Rv
cccgaguugaagaau

SEQ ID NO: 3296801 - RNA, 22 nt, Mycobacterium tuberculosis H37Rv
cccgaguugaaggugccggcgu

SEQ ID NO: 3296802 - RNA, 23 nt, Mycobacterium tuberculosis H37Rv
cccgaguugaaggugccggcguu

SEQ ID NO: 3296803 - RNA, 18 nt, Mycobacterium tuberculosis H37Rv
cccgaguuguugcugccc

SEQ ID NO: 3296804 - RNA, 19 nt, Mycobacterium tuberculosis H37Rv
cccgaguuguugcugcccc

SEQ ID NO: 3296805 - RNA, 22 nt, Mycobacterium tuberculosis H37Rv
cccgaguuugcgauacccaccg

SEQ ID NO: 3296806 - RNA, 16 nt, Mycobacterium tuberculosis H37Rv
cccgauaacaaggccg

SEQ ID NO: 3296807 - RNA, 14 nt, Mycobacterium tuberculosis H37Rv
cccgauagcgaccg

SEQ ID NO: 3296808 - RNA, 20 nt, Mycobacterium tuberculosis H37Rv
cccgauagcgaccgcggccc

SEQ ID NO: 3296809 - RNA, 17 nt, Mycobacterium tuberculosis H37Rv
cccgauaguucuggccc

SEQ ID NO: 3296810 - RNA, 23 nt, Mycobacterium tuberculosis H37Rv
cccgauaucaauggcagcugaau

SEQ ID NO: 3296811 - RNA, 16 nt, Mycobacterium tuberculosis H37Rv
cccgaucagcaccgac

SEQ ID NO: 3296812 - RNA, 19 nt, Mycobacterium tuberculosis H37Rv
cccgaucaggcgggcaacg

SEQ ID NO: 3296813 - RNA, 13 nt, Mycobacterium tuberculosis H37Rv
cccgauccagugg

SEQ ID NO: 3296814 - RNA, 12 nt, Mycobacterium tuberculosis H37Rv
cccgaucccgag

SEQ ID NO: 3296815 - RNA, 15 nt, Mycobacterium tuberculosis H37Rv
cccgaucccggccag

SEQ ID NO: 3296816 - RNA, 20 nt, Mycobacterium tuberculosis H37Rv
cccgauccuggccacuccca

SEQ ID NO: 3296817 - RNA, 13 nt, Mycobacterium tuberculosis H37Rv
cccgaucgaccgc

SEQ ID NO: 3296818 - RNA, 17 nt, Mycobacterium tuberculosis H37Rv
cccgaucugcuccucgg

SEQ ID NO: 3296819 - RNA, 14 nt, Mycobacterium tuberculosis H37Rv
cccgaugaccgccu

SEQ ID NO: 3296820 - RNA, 15 nt, Mycobacterium tuberculosis H37Rv
cccgaugaccgccuu

SEQ ID NO: 3296821 - RNA, 23 nt, Mycobacterium tuberculosis H37Rv
cccgaugaggacauccggcgccg

SEQ ID NO: 3296822 - RNA, 20 nt, Mycobacterium tuberculosis H37Rv
cccgaugaucccgccaccga

SEQ ID NO: 3296823 - RNA, 22 nt, Mycobacterium tuberculosis H37Rv
cccgaugccgugcccggugcgg

SEQ ID NO: 3296824 - RNA, 21 nt, Mycobacterium tuberculosis H37Rv
cccgaugccgugccgggccag

SEQ ID NO: 3296825 - RNA, 23 nt, Mycobacterium tuberculosis H37Rv
cccgaugccgugccgggccagau

SEQ ID NO: 3296826 - RNA, 20 nt, Mycobacterium tuberculosis H37Rv
cccgaugguggugccgaccu

SEQ ID NO: 3296827 - RNA, 23 nt, Mycobacterium tuberculosis H37Rv
cccgauguuacggccccacagcg

SEQ ID NO: 3296828 - RNA, 18 nt, Mycobacterium tuberculosis H37Rv
cccgauugaguucggcgg

SEQ ID NO: 3296829 - RNA, 21 nt, Mycobacterium tuberculosis H37Rv
cccgauuggccaaccccaugg

SEQ ID NO: 3296830 - RNA, 20 nt, Mycobacterium tuberculosis H37Rv
cccgcaacccguauggcggc

SEQ ID NO: 3296831 - RNA, 12 nt, Mycobacterium tuberculosis H37Rv
cccgcaacgcgu

SEQ ID NO: 3296832 - RNA, 23 nt, Mycobacterium tuberculosis H37Rv
cccgcaacuacggcguccccgac

SEQ ID NO: 3296833 - RNA, 14 nt, Mycobacterium tuberculosis H37Rv
cccgcaagcggaug

SEQ ID NO: 3296834 - RNA, 14 nt, Mycobacterium tuberculosis H37Rv
cccgcaagucgaga

SEQ ID NO: 3296835 - RNA, 15 nt, Mycobacterium tuberculosis H37Rv
cccgcaaugaccgcg

SEQ ID NO: 3296836 - RNA, 17 nt, Mycobacterium tuberculosis H37Rv
cccgcaaugcgcgcgau

SEQ ID NO: 3296837 - RNA, 20 nt, Mycobacterium tuberculosis H37Rv
cccgcaauggggcgcaaugg

SEQ ID NO: 3296838 - RNA, 16 nt, Mycobacterium tuberculosis H37Rv
cccgcaauuguucgcg

SEQ ID NO: 3296839 - RNA, 14 nt, Mycobacterium tuberculosis H37Rv
cccgcaccaccggc

SEQ ID NO: 3296840 - RNA, 18 nt, Mycobacterium tuberculosis H37Rv
cccgcaccaccggcccca

SEQ ID NO: 3296841 - RNA, 14 nt, Mycobacterium tuberculosis H37Rv
cccgcacccaugau

SEQ ID NO: 3296842 - RNA, 19 nt, Mycobacterium tuberculosis H37Rv
cccgcacccccgacaccgc

SEQ ID NO: 3296843 - RNA, 14 nt, Mycobacterium tuberculosis H37Rv
cccgcaccccggcc

SEQ ID NO: 3296844 - RNA, 16 nt, Mycobacterium tuberculosis H37Rv
cccgcaccgcgguacg

SEQ ID NO: 3296845 - RNA, 21 nt, Mycobacterium tuberculosis H37Rv
cccgcaccgcguucugguugu

SEQ ID NO: 3296846 - RNA, 15 nt, Mycobacterium tuberculosis H37Rv
cccgcaccggaucgg

SEQ ID NO: 3296847 - RNA, 14 nt, Mycobacterium tuberculosis H37Rv
cccgcaccucaccg

SEQ ID NO: 3296848 - RNA, 13 nt, Mycobacterium tuberculosis H37Rv
cccgcacgaaccg

SEQ ID NO: 3296849 - RNA, 14 nt, Mycobacterium tuberculosis H37Rv
cccgcacgaagccg

SEQ ID NO: 3296850 - RNA, 20 nt, Mycobacterium tuberculosis H37Rv
cccgcacgaguuaccggugg

SEQ ID NO: 3296851 - RNA, 23 nt, Mycobacterium tuberculosis H37Rv
cccgcacgaguuaccgguggugc

SEQ ID NO: 3296852 - RNA, 13 nt, Mycobacterium tuberculosis H37Rv
cccgcacgcucgg

SEQ ID NO: 3296853 - RNA, 22 nt, Mycobacterium tuberculosis H37Rv
cccgccggccccgccgucaccg

SEQ ID NO: 3296854 - RNA, 18 nt, Mycobacterium tuberculosis H37Rv
cccgccggccccgccguu

SEQ ID NO: 3296855 - RNA, 13 nt, Mycobacterium tuberculosis H37Rv
cccgccggcgggu

SEQ ID NO: 3296856 - RNA, 17 nt, Mycobacterium tuberculosis H37Rv
cccgccgggaugccucg

SEQ ID NO: 3296857 - RNA, 14 nt, Mycobacterium tuberculosis H37Rv
cccgccgggcucca

SEQ ID NO: 3296858 - RNA, 17 nt, Mycobacterium tuberculosis H37Rv
cccgccgggcuccacgu

SEQ ID NO: 3296859 - RNA, 16 nt, Mycobacterium tuberculosis H37Rv
cccgccggggccgccg

SEQ ID NO: 3296860 - RNA, 15 nt, Mycobacterium tuberculosis H37Rv
cccgccggguccgcc

SEQ ID NO: 3296861 - RNA, 17 nt, Mycobacterium tuberculosis H37Rv
cccgccggguccgccgg

SEQ ID NO: 3296862 - RNA, 15 nt, Mycobacterium tuberculosis H37Rv
cccgccgguggccgc

SEQ ID NO: 3296863 - RNA, 13 nt, Mycobacterium tuberculosis H37Rv
cccgccguagacc

SEQ ID NO: 3296864 - RNA, 14 nt, Mycobacterium tuberculosis H37Rv
cccgccguagacca

SEQ ID NO: 3296865 - RNA, 15 nt, Mycobacterium tuberculosis H37Rv
cccgccgucaccgcc

SEQ ID NO: 3296866 - RNA, 18 nt, Mycobacterium tuberculosis H37Rv
cccgccgucaccgccguu

SEQ ID NO: 3296867 - RNA, 21 nt, Mycobacterium tuberculosis H37Rv
cccgccgucaccgcgcggcuc

SEQ ID NO: 3296868 - RNA, 18 nt, Mycobacterium tuberculosis H37Rv
cccgccguccccgccgcc

SEQ ID NO: 3296869 - RNA, 19 nt, Mycobacterium tuberculosis H37Rv
cccgccguccccgccgccg

SEQ ID NO: 3296870 - RNA, 12 nt, Mycobacterium tuberculosis H37Rv
cccgccgucgcc

SEQ ID NO: 3296871 - RNA, 13 nt, Mycobacterium tuberculosis H37Rv
cccgccgucggca

SEQ ID NO: 3296872 - RNA, 15 nt, Mycobacterium tuberculosis H37Rv
cccgccgucggcauc

SEQ ID NO: 3296873 - RNA, 21 nt, Mycobacterium tuberculosis H37Rv
cccgccguugaacggcaccag

SEQ ID NO: 3296874 - RNA, 16 nt, Mycobacterium tuberculosis H37Rv
cccgccguugccaccg

SEQ ID NO: 3296875 - RNA, 16 nt, Mycobacterium tuberculosis H37Rv
cccgccguugccgccg

SEQ ID NO: 3296876 - RNA, 23 nt, Mycobacterium tuberculosis H37Rv
cccgccguugccgccgacgccgc

SEQ ID NO: 3296877 - RNA, 22 nt, Mycobacterium tuberculosis H37Rv
cccgccguugccgccgucaccg

SEQ ID NO: 3296878 - RNA, 23 nt, Mycobacterium tuberculosis H37Rv
cccgccguugccgccgucaccgc

SEQ ID NO: 3296879 - RNA, 18 nt, Mycobacterium tuberculosis H37Rv
cccgccguuuccgccgcc

SEQ ID NO: 3296880 - RNA, 20 nt, Mycobacterium tuberculosis H37Rv
cccgccucgaccgccagccc

SEQ ID NO: 3296881 - RNA, 15 nt, Mycobacterium tuberculosis H37Rv
cccgccugaccgcca

SEQ ID NO: 3296882 - RNA, 14 nt, Mycobacterium tuberculosis H37Rv
cccgccuuggccac

SEQ ID NO: 3296883 - RNA, 19 nt, Mycobacterium tuberculosis H37Rv
cccgcgaaccgcggaucga

SEQ ID NO: 3296884 - RNA, 22 nt, Mycobacterium tuberculosis H37Rv
cccgcgaauacgaggacgacga

SEQ ID NO: 3296885 - RNA, 17 nt, Mycobacterium tuberculosis H37Rv
cccgcgagaucgggccg

SEQ ID NO: 3296886 - RNA, 22 nt, Mycobacterium tuberculosis H37Rv
cccgcgagaucgggccggccgc

SEQ ID NO: 3296887 - RNA, 23 nt, Mycobacterium tuberculosis H37Rv
cccgcgagaucgggccggccgcc

SEQ ID NO: 3296888 - RNA, 13 nt, Mycobacterium tuberculosis H37Rv
cccgcgagcagcc

SEQ ID NO: 3296889 - RNA, 17 nt, Mycobacterium tuberculosis H37Rv
cccgcgagcagcccggc

SEQ ID NO: 3296890 - RNA, 17 nt, Mycobacterium tuberculosis H37Rv
cccgcgaggacagcugg

SEQ ID NO: 3296891 - RNA, 21 nt, Mycobacterium tuberculosis H37Rv
cccgcgagguugaccaccagc

SEQ ID NO: 3296892 - RNA, 16 nt, Mycobacterium tuberculosis H37Rv
cccgcgcaaccggccg

SEQ ID NO: 3296893 - RNA, 13 nt, Mycobacterium tuberculosis H37Rv
cccgcgcagcacu

SEQ ID NO: 3296894 - RNA, 15 nt, Mycobacterium tuberculosis H37Rv
cccgcgccaccagca

SEQ ID NO: 3296895 - RNA, 19 nt, Mycobacterium tuberculosis H37Rv
cccgcgccaccagcaccgc

SEQ ID NO: 3296896 - RNA, 18 nt, Mycobacterium tuberculosis H37Rv
cccgcgccaccggcaccg

SEQ ID NO: 3296897 - RNA, 20 nt, Mycobacterium tuberculosis H37Rv
cccgcgccaccucccacgcc

SEQ ID NO: 3296898 - RNA, 13 nt, Mycobacterium tuberculosis H37Rv
cccgcgccgccag

SEQ ID NO: 3296899 - RNA, 12 nt, Mycobacterium tuberculosis H37Rv
cccgcgccgccg

SEQ ID NO: 3296900 - RNA, 19 nt, Mycobacterium tuberculosis H37Rv
cccgcgccgccgccaccac

SEQ ID NO: 3296901 - RNA, 23 nt, Mycobacterium tuberculosis H37Rv
cccgcgccgccggacccaccguc

SEQ ID NO: 3296902 - RNA, 14 nt, Mycobacterium tuberculosis H37Rv
cccgcgccgcgcau

SEQ ID NO: 3296903 - RNA, 15 nt, Mycobacterium tuberculosis H37Rv
cccgcgccgcgcauc

SEQ ID NO: 3296904 - RNA, 19 nt, Mycobacterium tuberculosis H37Rv
cccgcgccggccgcacgcc

SEQ ID NO: 3296905 - RNA, 13 nt, Mycobacterium tuberculosis H37Rv
cccgcgccggcga

SEQ ID NO: 3296906 - RNA, 14 nt, Mycobacterium tuberculosis H37Rv
cccgcgccggcguu

SEQ ID NO: 3296907 - RNA, 17 nt, Mycobacterium tuberculosis H37Rv
cccgcgcgagagccucc

SEQ ID NO: 3296908 - RNA, 15 nt, Mycobacterium tuberculosis H37Rv
cccgcgcgagccgcu

SEQ ID NO: 3296909 - RNA, 20 nt, Mycobacterium tuberculosis H37Rv
cccgcgcgggcggaucgccg

SEQ ID NO: 3296910 - RNA, 17 nt, Mycobacterium tuberculosis H37Rv
cccgcgcguacccgauc

SEQ ID NO: 3296911 - RNA, 21 nt, Mycobacterium tuberculosis H37Rv
cccgcgcguacccgaucagcg

SEQ ID NO: 3296912 - RNA, 17 nt, Mycobacterium tuberculosis H37Rv
cccgcgcgucgcccagu

SEQ ID NO: 3296913 - RNA, 13 nt, Mycobacterium tuberculosis H37Rv
cccgcgcucgcac

SEQ ID NO: 3296914 - RNA, 14 nt, Mycobacterium tuberculosis H37Rv
cccgcgcucgcacc

SEQ ID NO: 3296915 - RNA, 14 nt, Mycobacterium tuberculosis H37Rv
cccgcgcucggcau

SEQ ID NO: 3296916 - RNA, 14 nt, Mycobacterium tuberculosis H37Rv
cccgcgcugagcac

SEQ ID NO: 3296917 - RNA, 16 nt, Mycobacterium tuberculosis H37Rv
cccgcggaauccgcgg

SEQ ID NO: 3296918 - RNA, 16 nt, Mycobacterium tuberculosis H37Rv
cccgcggaccgcaacg

SEQ ID NO: 3296919 - RNA, 22 nt, Mycobacterium tuberculosis H37Rv
cccgcggcgaaccgucucgccc

SEQ ID NO: 3296920 - RNA, 15 nt, Mycobacterium tuberculosis H37Rv
cccgcggcgccaccc

SEQ ID NO: 3296921 - RNA, 17 nt, Mycobacterium tuberculosis H37Rv
cccgcggcgccacccgc

SEQ ID NO: 3296922 - RNA, 21 nt, Mycobacterium tuberculosis H37Rv
cccgcggcgccacccgcgccg

SEQ ID NO: 3296923 - RNA, 24 nt, Mycobacterium tuberculosis H37Rv
cccgcggcgccacccgcgccgcca

SEQ ID NO: 3296924 - RNA, 15 nt, Mycobacterium tuberculosis H37Rv
cccgcggcgccgcca

SEQ ID NO: 3296925 - RNA, 23 nt, Mycobacterium tuberculosis H37Rv
cccgcggcgccguugccgccguu

SEQ ID NO: 3296926 - RNA, 20 nt, Mycobacterium tuberculosis H37Rv
cccgcgggcaguggcagccc

SEQ ID NO: 3296927 - RNA, 21 nt, Mycobacterium tuberculosis H37Rv
cccgcgggccccaucgccugg

SEQ ID NO: 3296928 - RNA, 19 nt, Mycobacterium tuberculosis H37Rv
cccgcgggcgguaaucgcg

SEQ ID NO: 3296929 - RNA, 19 nt, Mycobacterium tuberculosis H37Rv
cccgcgggucguccggcgg

SEQ ID NO: 3296930 - RNA, 19 nt, Mycobacterium tuberculosis H37Rv
cccgcggucgaucaggccg

SEQ ID NO: 3296931 - RNA, 17 nt, Mycobacterium tuberculosis H37Rv
cccgcggugaccacccc

SEQ ID NO: 3296932 - RNA, 18 nt, Mycobacterium tuberculosis H37Rv
cccgcggugacgccagcc

SEQ ID NO: 3296933 - RNA, 24 nt, Mycobacterium tuberculosis H37Rv
cccgcggugugcacgucacgcgga

SEQ ID NO: 3296934 - RNA, 19 nt, Mycobacterium tuberculosis H37Rv
cccgcguaccacggugguc

SEQ ID NO: 3296935 - RNA, 16 nt, Mycobacterium tuberculosis H37Rv
cccgcguaugccagga

SEQ ID NO: 3296936 - RNA, 20 nt, Mycobacterium tuberculosis H37Rv
cccgcgucgagugccgccac

SEQ ID NO: 3296937 - RNA, 22 nt, Mycobacterium tuberculosis H37Rv
cccgcgucgagugccgccaccg

SEQ ID NO: 3296938 - RNA, 20 nt, Mycobacterium tuberculosis H37Rv
cccgcgucuacgucguccag

SEQ ID NO: 3296939 - RNA, 14 nt, Mycobacterium tuberculosis H37Rv
cccgcguucgagag

SEQ ID NO: 3296940 - RNA, 16 nt, Mycobacterium tuberculosis H37Rv
cccgcguucgagagcc

SEQ ID NO: 3296941 - RNA, 19 nt, Mycobacterium tuberculosis H37Rv
cccgcguucucggcacccu

SEQ ID NO: 3296942 - RNA, 23 nt, Mycobacterium tuberculosis H37Rv
cccgcguugaaggcgccgguguu

SEQ ID NO: 3296943 - RNA, 22 nt, Mycobacterium tuberculosis H37Rv
cccgcuaacuggcccggacaug

SEQ ID NO: 3296944 - RNA, 23 nt, Mycobacterium tuberculosis H37Rv
cccgcuaacuggcccggacaugc

SEQ ID NO: 3296945 - RNA, 20 nt, Mycobacterium tuberculosis H37Rv
cccgcuacgcgcgcucgcuc

SEQ ID NO: 3296946 - RNA, 20 nt, Mycobacterium tuberculosis H37Rv
cccgcucaacgggccgcauc

SEQ ID NO: 3296947 - RNA, 17 nt, Mycobacterium tuberculosis H37Rv
cccgcucacgcucaccc

SEQ ID NO: 3296948 - RNA, 20 nt, Mycobacterium tuberculosis H37Rv
cccgcuccauaucgucgggc

SEQ ID NO: 3296949 - RNA, 15 nt, Mycobacterium tuberculosis H37Rv
cccggccuugccacc

SEQ ID NO: 3296950 - RNA, 23 nt, Mycobacterium tuberculosis H37Rv
cccggcgaauacgaccgucgcgc

SEQ ID NO: 3296951 - RNA, 14 nt, Mycobacterium tuberculosis H37Rv
cccggcgaccgggu

SEQ ID NO: 3296952 - RNA, 15 nt, Mycobacterium tuberculosis H37Rv
cccggcgacgacccg

SEQ ID NO: 3296953 - RNA, 23 nt, Mycobacterium tuberculosis H37Rv
cccggcgaucagcagcgccagca

SEQ ID NO: 3296954 - RNA, 17 nt, Mycobacterium tuberculosis H37Rv
cccggcgaugcagccgg

SEQ ID NO: 3296955 - RNA, 16 nt, Mycobacterium tuberculosis H37Rv
cccggcgcaagcgccg

SEQ ID NO: 3296956 - RNA, 12 nt, Mycobacterium tuberculosis H37Rv
cccggcgccgcg

SEQ ID NO: 3296957 - RNA, 12 nt, Mycobacterium tuberculosis H37Rv
cccggcgcgaau

SEQ ID NO: 3296958 - RNA, 23 nt, Mycobacterium tuberculosis H37Rv
cccggcgcgaugguuauccccug

SEQ ID NO: 3296959 - RNA, 15 nt, Mycobacterium tuberculosis H37Rv
cccggcgcggccgca

SEQ ID NO: 3296960 - RNA, 20 nt, Mycobacterium tuberculosis H37Rv
cccggcgcgguuugcucguu

SEQ ID NO: 3296961 - RNA, 22 nt, Mycobacterium tuberculosis H37Rv
cccggcgcuagcgccgcgcuug

SEQ ID NO: 3296962 - RNA, 18 nt, Mycobacterium tuberculosis H37Rv
cccggcgcuggugcgcca

SEQ ID NO: 3296963 - RNA, 22 nt, Mycobacterium tuberculosis H37Rv
cccggcgcuggugcgccacgcc

SEQ ID NO: 3296964 - RNA, 12 nt, Mycobacterium tuberculosis H37Rv
cccggcggcagc

SEQ ID NO: 3296965 - RNA, 17 nt, Mycobacterium tuberculosis H37Rv
cccggcggccaucccgc

SEQ ID NO: 3296966 - RNA, 23 nt, Mycobacterium tuberculosis H37Rv
cccggcggcccgauagaucgcgu

SEQ ID NO: 3296967 - RNA, 14 nt, Mycobacterium tuberculosis H37Rv
cccggcggcgcgcc

SEQ ID NO: 3296968 - RNA, 19 nt, Mycobacterium tuberculosis H37Rv
cccggcgggcccgccggcc

SEQ ID NO: 3296969 - RNA, 20 nt, Mycobacterium tuberculosis H37Rv
cccggcgggcccgccggccc

SEQ ID NO: 3296970 - RNA, 17 nt, Mycobacterium tuberculosis H37Rv
cccggcgggcggugggc

SEQ ID NO: 3296971 - RNA, 20 nt, Mycobacterium tuberculosis H37Rv
cccggcgggcggugggcagc

SEQ ID NO: 3296972 - RNA, 19 nt, Mycobacterium tuberculosis H37Rv
cccggcgguaaagcucacc

SEQ ID NO: 3296973 - RNA, 21 nt, Mycobacterium tuberculosis H37Rv
cccggcgguaccagagcagcu

SEQ ID NO: 3296974 - RNA, 15 nt, Mycobacterium tuberculosis H37Rv
cccggcgguaccgcc

SEQ ID NO: 3296975 - RNA, 19 nt, Mycobacterium tuberculosis H37Rv
cccggcgguuggugcagcg

SEQ ID NO: 3296976 - RNA, 21 nt, Mycobacterium tuberculosis H37Rv
cccggcguauugcaccgccag

SEQ ID NO: 3296977 - RNA, 22 nt, Mycobacterium tuberculosis H37Rv
cccggcguauugcaccgccagg

SEQ ID NO: 3296978 - RNA, 17 nt, Mycobacterium tuberculosis H37Rv
cccggcguccgaccggu

SEQ ID NO: 3296979 - RNA, 20 nt, Mycobacterium tuberculosis H37Rv
cccggcguggcuucacccaa

SEQ ID NO: 3296980 - RNA, 21 nt, Mycobacterium tuberculosis H37Rv
cccggcguggugagccucggc

SEQ ID NO: 3296981 - RNA, 16 nt, Mycobacterium tuberculosis H37Rv
cccggcgugucgccgc

SEQ ID NO: 3296982 - RNA, 17 nt, Mycobacterium tuberculosis H37Rv
cccggcgugucgccgcc

SEQ ID NO: 3296983 - RNA, 18 nt, Mycobacterium tuberculosis H37Rv
cccggcgugucgccgcca

SEQ ID NO: 3296984 - RNA, 15 nt, Mycobacterium tuberculosis H37Rv
cccggcguugccgcc

SEQ ID NO: 3296985 - RNA, 16 nt, Mycobacterium tuberculosis H37Rv
cccggcguugccgccg

SEQ ID NO: 3296986 - RNA, 22 nt, Mycobacterium tuberculosis H37Rv
cccggcguuguugaccagcacg

SEQ ID NO: 3296987 - RNA, 14 nt, Mycobacterium tuberculosis H37Rv
cccggcucacagca

SEQ ID NO: 3296988 - RNA, 12 nt, Mycobacterium tuberculosis H37Rv
cccggcuccagc

SEQ ID NO: 3296989 - RNA, 15 nt, Mycobacterium tuberculosis H37Rv
cccggcuccagcacc

SEQ ID NO: 3296990 - RNA, 19 nt, Mycobacterium tuberculosis H37Rv
cccggcuccuccccggccc

SEQ ID NO: 3296991 - RNA, 15 nt, Mycobacterium tuberculosis H37Rv
cccggcucgacgcgu

SEQ ID NO: 3296992 - RNA, 13 nt, Mycobacterium tuberculosis H37Rv
cccggcucggcag

SEQ ID NO: 3296993 - RNA, 15 nt, Mycobacterium tuberculosis H37Rv
cccggcucggccagc

SEQ ID NO: 3296994 - RNA, 18 nt, Mycobacterium tuberculosis H37Rv
cccggcucggccagccag

SEQ ID NO: 3296995 - RNA, 21 nt, Mycobacterium tuberculosis H37Rv
cccggcucggccagccagcgg

SEQ ID NO: 3296996 - RNA, 21 nt, Mycobacterium tuberculosis H37Rv
cccggcucucuucgcgcgcug

SEQ ID NO: 3296997 - RNA, 20 nt, Mycobacterium tuberculosis H37Rv
cccggcugaucuaccagugg

SEQ ID NO: 3296998 - RNA, 15 nt, Mycobacterium tuberculosis H37Rv
cccggcugccagcgc

SEQ ID NO: 3296999 - RNA, 14 nt, Mycobacterium tuberculosis H37Rv
cccggcugcgccgg

SEQ ID NO: 3297000 - RNA, 14 nt, Mycobacterium tuberculosis H37Rv
cccggcugggaucg

SEQ ID NO: 3297001 - RNA, 15 nt, Mycobacterium tuberculosis H37Rv
cccggcuggucaccc

SEQ ID NO: 3297002 - RNA, 16 nt, Mycobacterium tuberculosis H37Rv
cccggcuucgccgcgc

SEQ ID NO: 3297003 - RNA, 17 nt, Mycobacterium tuberculosis H37Rv
cccggcuuuugcgccca

SEQ ID NO: 3297004 - RNA, 23 nt, Mycobacterium tuberculosis H37Rv
cccgggauaguuuucggccgcca

SEQ ID NO: 3297005 - RNA, 18 nt, Mycobacterium tuberculosis H37Rv
cccgggaucgggucaccg

SEQ ID NO: 3297006 - RNA, 16 nt, Mycobacterium tuberculosis H37Rv
cccgggaugaccaccg

SEQ ID NO: 3297007 - RNA, 17 nt, Mycobacterium tuberculosis H37Rv
cccgggccaguucgucg

SEQ ID NO: 3297008 - RNA, 19 nt, Mycobacterium tuberculosis H37Rv
cccgggccaguucgucggc

SEQ ID NO: 3297009 - RNA, 13 nt, Mycobacterium tuberculosis H37Rv
cccgggcccgccg

SEQ ID NO: 3297010 - RNA, 17 nt, Mycobacterium tuberculosis H37Rv
cccgggcccgcgggauc

SEQ ID NO: 3297011 - RNA, 16 nt, Mycobacterium tuberculosis H37Rv
cccgggcccgucgucg

SEQ ID NO: 3297012 - RNA, 13 nt, Mycobacterium tuberculosis H37Rv
cccgggccgccgc

SEQ ID NO: 3297013 - RNA, 22 nt, Mycobacterium tuberculosis H37Rv
cccgggccggucggugagccgu

SEQ ID NO: 3297014 - RNA, 15 nt, Mycobacterium tuberculosis H37Rv
cccgggccguccggc

SEQ ID NO: 3297015 - RNA, 17 nt, Mycobacterium tuberculosis H37Rv
cccgggccguccggcgc

SEQ ID NO: 3297016 - RNA, 17 nt, Mycobacterium tuberculosis H37Rv
cccgggccucggcgccg

SEQ ID NO: 3297017 - RNA, 14 nt, Mycobacterium tuberculosis H37Rv
cccgggccugaacc

SEQ ID NO: 3297018 - RNA, 18 nt, Mycobacterium tuberculosis H37Rv
cccgggccugggacggcg

SEQ ID NO: 3297019 - RNA, 20 nt, Mycobacterium tuberculosis H37Rv
cccgggcgagcgcggccugc

SEQ ID NO: 3297020 - RNA, 20 nt, Mycobacterium tuberculosis H37Rv
cccgggcggccagcugcagc

SEQ ID NO: 3297021 - RNA, 14 nt, Mycobacterium tuberculosis H37Rv
cccgggcggcgccg

SEQ ID NO: 3297022 - RNA, 18 nt, Mycobacterium tuberculosis H37Rv
cccgggcgucccaaucgg

SEQ ID NO: 3297023 - RNA, 16 nt, Mycobacterium tuberculosis H37Rv
cccgggcugccgccca

SEQ ID NO: 3297024 - RNA, 17 nt, Mycobacterium tuberculosis H37Rv
cccggggcgcacagcug

SEQ ID NO: 3297025 - RNA, 19 nt, Mycobacterium tuberculosis H37Rv
cccggggcgcucgcgcgcu

SEQ ID NO: 3297026 - RNA, 21 nt, Mycobacterium tuberculosis H37Rv
cccggggcugggggccggcag

SEQ ID NO: 3297027 - RNA, 18 nt, Mycobacterium tuberculosis H37Rv
cccggggguccaccuugg

SEQ ID NO: 3297028 - RNA, 18 nt, Mycobacterium tuberculosis H37Rv
cccgggguccaucggggc

SEQ ID NO: 3297029 - RNA, 13 nt, Mycobacterium tuberculosis H37Rv
cccggggugccga

SEQ ID NO: 3297030 - RNA, 16 nt, Mycobacterium tuberculosis H37Rv
cccggguagacaccgc

SEQ ID NO: 3297031 - RNA, 15 nt, Mycobacterium tuberculosis H37Rv
cccggguaucgccag

SEQ ID NO: 3297032 - RNA, 21 nt, Mycobacterium tuberculosis H37Rv
cccggguccaagaaccacgac

SEQ ID NO: 3297033 - RNA, 12 nt, Mycobacterium tuberculosis H37Rv
cccgggucccau

SEQ ID NO: 3297034 - RNA, 19 nt, Mycobacterium tuberculosis H37Rv
cccgggucggcacgacccg

SEQ ID NO: 3297035 - RNA, 19 nt, Mycobacterium tuberculosis H37Rv
cccgggucuccggcgcacc

SEQ ID NO: 3297036 - RNA, 18 nt, Mycobacterium tuberculosis H37Rv
cccgggugaaacgauggc

SEQ ID NO: 3297037 - RNA, 13 nt, Mycobacterium tuberculosis H37Rv
cccgggugcugug

SEQ ID NO: 3297038 - RNA, 12 nt, Mycobacterium tuberculosis H37Rv
cccggguggcac

SEQ ID NO: 3297039 - RNA, 15 nt, Mycobacterium tuberculosis H37Rv
cccggguggcccgga

SEQ ID NO: 3297040 - RNA, 21 nt, Mycobacterium tuberculosis H37Rv
cccggguggcccggaacaccg

SEQ ID NO: 3297041 - RNA, 14 nt, Mycobacterium tuberculosis H37Rv
cccgguacgccgcg

SEQ ID NO: 3297042 - RNA, 15 nt, Mycobacterium tuberculosis H37Rv
cccgguacgccgcgc

SEQ ID NO: 3297043 - RNA, 19 nt, Mycobacterium tuberculosis H37Rv
cccgguacgucgaggguga

SEQ ID NO: 3297044 - RNA, 22 nt, Mycobacterium tuberculosis H37Rv
cccggucacgcugugcgguauc

SEQ ID NO: 3297045 - RNA, 14 nt, Mycobacterium tuberculosis H37Rv
cccgugcgacuucg

SEQ ID NO: 3297046 - RNA, 18 nt, Mycobacterium tuberculosis H37Rv
cccgugcgcgcgcagcug

SEQ ID NO: 3297047 - RNA, 22 nt, Mycobacterium tuberculosis H37Rv
cccgugcuuuccuugcgcgcca

SEQ ID NO: 3297048 - RNA, 15 nt, Mycobacterium tuberculosis H37Rv
cccguggaaagugcg

SEQ ID NO: 3297049 - RNA, 24 nt, Mycobacterium tuberculosis H37Rv
cccgugguggcgccaugaagccgg

SEQ ID NO: 3297050 - RNA, 18 nt, Mycobacterium tuberculosis H37Rv
cccguguuaaagaagccu

SEQ ID NO: 3297051 - RNA, 18 nt, Mycobacterium tuberculosis H37Rv
cccguguugaagaagccc

SEQ ID NO: 3297052 - RNA, 17 nt, Mycobacterium tuberculosis H37Rv
cccguuaugcgccgccc

SEQ ID NO: 3297053 - RNA, 13 nt, Mycobacterium tuberculosis H37Rv
cccguuccacgau

SEQ ID NO: 3297054 - RNA, 14 nt, Mycobacterium tuberculosis H37Rv
cccguuccacgauc

SEQ ID NO: 3297055 - RNA, 14 nt, Mycobacterium tuberculosis H37Rv
cccguucgaacugg

SEQ ID NO: 3297056 - RNA, 22 nt, Mycobacterium tuberculosis H37Rv
cccguugagauaccccgagacc

SEQ ID NO: 3297057 - RNA, 13 nt, Mycobacterium tuberculosis H37Rv
cccguugccgccc

SEQ ID NO: 3297058 - RNA, 22 nt, Mycobacterium tuberculosis H37Rv
cccguugccgccguugccgccg

SEQ ID NO: 3297059 - RNA, 15 nt, Mycobacterium tuberculosis H37Rv
cccguuggccaagaa

SEQ ID NO: 3297060 - RNA, 22 nt, Mycobacterium tuberculosis H37Rv
cccguuguccagaacggcgauc

SEQ ID NO: 3297061 - RNA, 20 nt, Mycobacterium tuberculosis H37Rv
cccguuucaagucccuucau

SEQ ID NO: 3297062 - RNA, 19 nt, Mycobacterium tuberculosis H37Rv
cccguuuugggugaucgca

SEQ ID NO: 3297063 - RNA, 13 nt, Mycobacterium tuberculosis H37Rv
cccuaacuccccc

SEQ ID NO: 3297064 - RNA, 17 nt, Mycobacterium tuberculosis H37Rv
cccuacgcagcgcggcu

SEQ ID NO: 3297065 - RNA, 19 nt, Mycobacterium tuberculosis H37Rv
cccuagcuggugcgcccga

SEQ ID NO: 3297066 - RNA, 21 nt, Mycobacterium tuberculosis H37Rv
cccuagggcggugccgccgga

SEQ ID NO: 3297067 - RNA, 13 nt, Mycobacterium tuberculosis H37Rv
cccuauacgcaac

SEQ ID NO: 3297068 - RNA, 12 nt, Mycobacterium tuberculosis H37Rv
cccuaucagccg

SEQ ID NO: 3297069 - RNA, 22 nt, Mycobacterium tuberculosis H37Rv
cccucaccgcgagggcgcgugu

SEQ ID NO: 3297070 - RNA, 21 nt, Mycobacterium tuberculosis H37Rv
cccucacguggacugaccucg

SEQ ID NO: 3297071 - RNA, 12 nt, Mycobacterium tuberculosis H37Rv
cccucagccgcg

SEQ ID NO: 3297072 - RNA, 15 nt, Mycobacterium tuberculosis H37Rv
cccucagccgcgccg

SEQ ID NO: 3297073 - RNA, 18 nt, Mycobacterium tuberculosis H37Rv
cccucaguucacguucgg

SEQ ID NO: 3297074 - RNA, 14 nt, Mycobacterium tuberculosis H37Rv
cccuccagcacgcc

SEQ ID NO: 3297075 - RNA, 13 nt, Mycobacterium tuberculosis H37Rv
cccucccaccagc

SEQ ID NO: 3297076 - RNA, 16 nt, Mycobacterium tuberculosis H37Rv
cccucccaccagcggc

SEQ ID NO: 3297077 - RNA, 22 nt, Mycobacterium tuberculosis H37Rv
cccuccgagcacaggaucaccc

SEQ ID NO: 3297078 - RNA, 23 nt, Mycobacterium tuberculosis H37Rv
cccuccgagcacaggaucaccca

SEQ ID NO: 3297079 - RNA, 18 nt, Mycobacterium tuberculosis H37Rv
cccuccggacccacccgc

SEQ ID NO: 3297080 - RNA, 22 nt, Mycobacterium tuberculosis H37Rv
cccuccggacccacccgcaccg

SEQ ID NO: 3297081 - RNA, 15 nt, Mycobacterium tuberculosis H37Rv
cccuccggcgcagcg

SEQ ID NO: 3297082 - RNA, 16 nt, Mycobacterium tuberculosis H37Rv
cccuccucgaccgcgg

SEQ ID NO: 3297083 - RNA, 20 nt, Mycobacterium tuberculosis H37Rv
cccuccuuuguccucccgga

SEQ ID NO: 3297084 - RNA, 18 nt, Mycobacterium tuberculosis H37Rv
cccucgaauucggccggc

SEQ ID NO: 3297085 - RNA, 19 nt, Mycobacterium tuberculosis H37Rv
cccucgaauucggccggcg

SEQ ID NO: 3297086 - RNA, 20 nt, Mycobacterium tuberculosis H37Rv
cccucgaauucggccggcgc

SEQ ID NO: 3297087 - RNA, 18 nt, Mycobacterium tuberculosis H37Rv
cccucgaucacggcggcc

SEQ ID NO: 3297088 - RNA, 20 nt, Mycobacterium tuberculosis H37Rv
cccucgaucacggcggcccc

SEQ ID NO: 3297089 - RNA, 20 nt, Mycobacterium tuberculosis H37Rv
cccucgaugccgcguagcug

SEQ ID NO: 3297090 - RNA, 13 nt, Mycobacterium tuberculosis H37Rv
cccucgcaaccgg

SEQ ID NO: 3297091 - RNA, 14 nt, Mycobacterium tuberculosis H37Rv
cccucgcaaccggc

SEQ ID NO: 3297092 - RNA, 24 nt, Mycobacterium tuberculosis H37Rv
cccucgcgaaauaacggagcggcc

SEQ ID NO: 3297093 - RNA, 19 nt, Mycobacterium tuberculosis H37Rv
cccucgcgcgcgucgaguu

SEQ ID NO: 3297094 - RNA, 14 nt, Mycobacterium tuberculosis H37Rv
cccucggccgcccg

SEQ ID NO: 3297095 - RNA, 14 nt, Mycobacterium tuberculosis H37Rv
cccucggcgaccug

SEQ ID NO: 3297096 - RNA, 15 nt, Mycobacterium tuberculosis H37Rv
cccucggcgaccugg

SEQ ID NO: 3297097 - RNA, 19 nt, Mycobacterium tuberculosis H37Rv
cccucgggacggccgccgc

SEQ ID NO: 3297098 - RNA, 21 nt, Mycobacterium tuberculosis H37Rv
cccucgggacggccgccgccg

SEQ ID NO: 3297099 - RNA, 22 nt, Mycobacterium tuberculosis H37Rv
cccucggugagaaucgacuccg

SEQ ID NO: 3297100 - RNA, 21 nt, Mycobacterium tuberculosis H37Rv
cccucgguguacaccgcgccc

SEQ ID NO: 3297101 - RNA, 15 nt, Mycobacterium tuberculosis H37Rv
cccucuagcgcccga

SEQ ID NO: 3297102 - RNA, 20 nt, Mycobacterium tuberculosis H37Rv
cccucuagcgccucgccggc

SEQ ID NO: 3297103 - RNA, 20 nt, Mycobacterium tuberculosis H37Rv
cccucuugucuagcggucgc

SEQ ID NO: 3297104 - RNA, 13 nt, Mycobacterium tuberculosis H37Rv
cccugacacccau

SEQ ID NO: 3297105 - RNA, 21 nt, Mycobacterium tuberculosis H37Rv
cccugacacccaucgaccgcc

SEQ ID NO: 3297106 - RNA, 17 nt, Mycobacterium tuberculosis H37Rv
cccugacccggagccgc

SEQ ID NO: 3297107 - RNA, 20 nt, Mycobacterium tuberculosis H37Rv
cccugacccggagccgccag

SEQ ID NO: 3297108 - RNA, 18 nt, Mycobacterium tuberculosis H37Rv
cccugacggcaucugaaa

SEQ ID NO: 3297109 - RNA, 14 nt, Mycobacterium tuberculosis H37Rv
cccugacgguggug

SEQ ID NO: 3297110 - RNA, 22 nt, Mycobacterium tuberculosis H37Rv
cccugacgucacguucggcgca

SEQ ID NO: 3297111 - RNA, 19 nt, Mycobacterium tuberculosis H37Rv
cccugagcgaagugucgcu

SEQ ID NO: 3297112 - RNA, 13 nt, Mycobacterium tuberculosis H37Rv
cccugagcucccg

SEQ ID NO: 3297113 - RNA, 19 nt, Mycobacterium tuberculosis H37Rv
cccugaugaucguccagcc

SEQ ID NO: 3297114 - RNA, 16 nt, Mycobacterium tuberculosis H37Rv
cccugauugaagcccc

SEQ ID NO: 3297115 - RNA, 20 nt, Mycobacterium tuberculosis H37Rv
cccugcaacccggucggcag

SEQ ID NO: 3297116 - RNA, 22 nt, Mycobacterium tuberculosis H37Rv
cccugcaacccggucggcagcu

SEQ ID NO: 3297117 - RNA, 12 nt, Mycobacterium tuberculosis H37Rv
cccugcacagca

SEQ ID NO: 3297118 - RNA, 13 nt, Mycobacterium tuberculosis H37Rv
cccugcacagcag

SEQ ID NO: 3297119 - RNA, 21 nt, Mycobacterium tuberculosis H37Rv
cccugcacagcagcgucauca

SEQ ID NO: 3297120 - RNA, 15 nt, Mycobacterium tuberculosis H37Rv
cccugcacagcaggc

SEQ ID NO: 3297121 - RNA, 14 nt, Mycobacterium tuberculosis H37Rv
cccugcacccagcc

SEQ ID NO: 3297122 - RNA, 21 nt, Mycobacterium tuberculosis H37Rv
cccugcacccagccgugccca

SEQ ID NO: 3297123 - RNA, 14 nt, Mycobacterium tuberculosis H37Rv
cccugcacccgacc

SEQ ID NO: 3297124 - RNA, 15 nt, Mycobacterium tuberculosis H37Rv
cccugcacggugccc

SEQ ID NO: 3297125 - RNA, 22 nt, Mycobacterium tuberculosis H37Rv
cccugcacggugcccagggcga

SEQ ID NO: 3297126 - RNA, 16 nt, Mycobacterium tuberculosis H37Rv
cccugcauaggcgcgg

SEQ ID NO: 3297127 - RNA, 19 nt, Mycobacterium tuberculosis H37Rv
cccugcauaggcgcgguca

SEQ ID NO: 3297128 - RNA, 13 nt, Mycobacterium tuberculosis H37Rv
cccugccacgcgu

SEQ ID NO: 3297129 - RNA, 23 nt, Mycobacterium tuberculosis H37Rv
cccugccaugggaguucaucgca

SEQ ID NO: 3297130 - RNA, 22 nt, Mycobacterium tuberculosis H37Rv
cccugcccgaaggugggauuga

SEQ ID NO: 3297131 - RNA, 12 nt, Mycobacterium tuberculosis H37Rv
cccugcccggcc

SEQ ID NO: 3297132 - RNA, 14 nt, Mycobacterium tuberculosis H37Rv
cccugcccggcccg

SEQ ID NO: 3297133 - RNA, 17 nt, Mycobacterium tuberculosis H37Rv
cccugccgccggccccg

SEQ ID NO: 3297134 - RNA, 12 nt, Mycobacterium tuberculosis H37Rv
cccugccggcag

SEQ ID NO: 3297135 - RNA, 14 nt, Mycobacterium tuberculosis H37Rv
cccugccggcagcg

SEQ ID NO: 3297136 - RNA, 13 nt, Mycobacterium tuberculosis H37Rv
cccugcgcagccg

SEQ ID NO: 3297137 - RNA, 15 nt, Mycobacterium tuberculosis H37Rv
cccugcgcagccgcc

SEQ ID NO: 3297138 - RNA, 14 nt, Mycobacterium tuberculosis H37Rv
cccugcgccgccac

SEQ ID NO: 3297139 - RNA, 19 nt, Mycobacterium tuberculosis H37Rv
cccugcgccucggcggcca

SEQ ID NO: 3297140 - RNA, 13 nt, Mycobacterium tuberculosis H37Rv
cccugcggaucgg

SEQ ID NO: 3297141 - RNA, 22 nt, Mycobacterium tuberculosis H37Rv
ccgaaccguucgcucagggugu

SEQ ID NO: 3297142 - RNA, 16 nt, Mycobacterium tuberculosis H37Rv
ccgaaccugcggcagc

SEQ ID NO: 3297143 - RNA, 19 nt, Mycobacterium tuberculosis H37Rv
ccgaaccugcggcagcgga

SEQ ID NO: 3297144 - RNA, 12 nt, Mycobacterium tuberculosis H37Rv
ccgaacgcacgu

SEQ ID NO: 3297145 - RNA, 15 nt, Mycobacterium tuberculosis H37Rv
ccgaacgccucugcg

SEQ ID NO: 3297146 - RNA, 13 nt, Mycobacterium tuberculosis H37Rv
ccgaacgcgaggu

SEQ ID NO: 3297147 - RNA, 22 nt, Mycobacterium tuberculosis H37Rv
ccgaacgcgagguuccaguugg

SEQ ID NO: 3297148 - RNA, 14 nt, Mycobacterium tuberculosis H37Rv
ccgaacgcuccagg

SEQ ID NO: 3297149 - RNA, 18 nt, Mycobacterium tuberculosis H37Rv
ccgaacggguagacccac

SEQ ID NO: 3297150 - RNA, 21 nt, Mycobacterium tuberculosis H37Rv
ccgaacggguagacccacauc

SEQ ID NO: 3297151 - RNA, 22 nt, Mycobacterium tuberculosis H37Rv
ccgaacgugcaaccauggcggc

SEQ ID NO: 3297152 - RNA, 12 nt, Mycobacterium tuberculosis H37Rv
ccgaacgugcgg

SEQ ID NO: 3297153 - RNA, 17 nt, Mycobacterium tuberculosis H37Rv
ccgaacucaacgacacc

SEQ ID NO: 3297154 - RNA, 20 nt, Mycobacterium tuberculosis H37Rv
ccgaacuccgcggaacccag

SEQ ID NO: 3297155 - RNA, 14 nt, Mycobacterium tuberculosis H37Rv
ccgaacugccgcgc

SEQ ID NO: 3297156 - RNA, 22 nt, Mycobacterium tuberculosis H37Rv
ccgaagaaaacgaacccacugc

SEQ ID NO: 3297157 - RNA, 13 nt, Mycobacterium tuberculosis H37Rv
ccgaagaagcccg

SEQ ID NO: 3297158 - RNA, 16 nt, Mycobacterium tuberculosis H37Rv
ccgaagaaggugacga

SEQ ID NO: 3297159 - RNA, 21 nt, Mycobacterium tuberculosis H37Rv
ccgaagaaugggauggcacca

SEQ ID NO: 3297160 - RNA, 20 nt, Mycobacterium tuberculosis H37Rv
ccgaagaccuccucggugua

SEQ ID NO: 3297161 - RNA, 19 nt, Mycobacterium tuberculosis H37Rv
ccgaagacucgucaacgga

SEQ ID NO: 3297162 - RNA, 15 nt, Mycobacterium tuberculosis H37Rv
ccgaagagcgcgcgc

SEQ ID NO: 3297163 - RNA, 19 nt, Mycobacterium tuberculosis H37Rv
ccgaagagugugacggcgg

SEQ ID NO: 3297164 - RNA, 15 nt, Mycobacterium tuberculosis H37Rv
ccgaagaugaccgcu

SEQ ID NO: 3297165 - RNA, 12 nt, Mycobacterium tuberculosis H37Rv
ccgaagaugccu

SEQ ID NO: 3297166 - RNA, 16 nt, Mycobacterium tuberculosis H37Rv
ccgaagaugccuggaa

SEQ ID NO: 3297167 - RNA, 18 nt, Mycobacterium tuberculosis H37Rv
ccgaagauggccagcgcg

SEQ ID NO: 3297168 - RNA, 21 nt, Mycobacterium tuberculosis H37Rv
ccgaagcagaacaguaucgcc

SEQ ID NO: 3297169 - RNA, 11 nt, Mycobacterium tuberculosis H37Rv
ccgaagcccga

SEQ ID NO: 3297170 - RNA, 14 nt, Mycobacterium tuberculosis H37Rv
ccgaagcccgagcu

SEQ ID NO: 3297171 - RNA, 19 nt, Mycobacterium tuberculosis H37Rv
ccgaagccgaccggguuga

SEQ ID NO: 3297172 - RNA, 13 nt, Mycobacterium tuberculosis H37Rv
ccgaagccgcgca

SEQ ID NO: 3297173 - RNA, 14 nt, Mycobacterium tuberculosis H37Rv
ccgaagcgaugccg

SEQ ID NO: 3297174 - RNA, 14 nt, Mycobacterium tuberculosis H37Rv
ccgaagcgcccguu

SEQ ID NO: 3297175 - RNA, 12 nt, Mycobacterium tuberculosis H37Rv
ccgaagcggcca

SEQ ID NO: 3297176 - RNA, 14 nt, Mycobacterium tuberculosis H37Rv
ccgaagcggugacc

SEQ ID NO: 3297177 - RNA, 20 nt, Mycobacterium tuberculosis H37Rv
ccgaaggcggcuccaccggg

SEQ ID NO: 3297178 - RNA, 23 nt, Mycobacterium tuberculosis H37Rv
ccgaaggcuugucgguagguguc

SEQ ID NO: 3297179 - RNA, 17 nt, Mycobacterium tuberculosis H37Rv
ccgaaguacuggccgcc

SEQ ID NO: 3297180 - RNA, 22 nt, Mycobacterium tuberculosis H37Rv
ccgaaguacuggccgccgcgca

SEQ ID NO: 3297181 - RNA, 18 nt, Mycobacterium tuberculosis H37Rv
ccgaaguagaagcccagg

SEQ ID NO: 3297182 - RNA, 19 nt, Mycobacterium tuberculosis H37Rv
ccgaaguagaagcccagga

SEQ ID NO: 3297183 - RNA, 23 nt, Mycobacterium tuberculosis H37Rv
ccgaagucacaggauccguggcc

SEQ ID NO: 3297184 - RNA, 17 nt, Mycobacterium tuberculosis H37Rv
ccgaaguggugaccgac

SEQ ID NO: 3297185 - RNA, 12 nt, Mycobacterium tuberculosis H37Rv
ccgaaguugaag

SEQ ID NO: 3297186 - RNA, 21 nt, Mycobacterium tuberculosis H37Rv
ccgaauaccacaccgugacca

SEQ ID NO: 3297187 - RNA, 16 nt, Mycobacterium tuberculosis H37Rv
ccgaauaccgccgcgc

SEQ ID NO: 3297188 - RNA, 17 nt, Mycobacterium tuberculosis H37Rv
ccgaauccaucgagacc

SEQ ID NO: 3297189 - RNA, 18 nt, Mycobacterium tuberculosis H37Rv
ccgaaucggcaccgugcg

SEQ ID NO: 3297190 - RNA, 19 nt, Mycobacterium tuberculosis H37Rv
ccgaaugugaaaugcgcga

SEQ ID NO: 3297191 - RNA, 21 nt, Mycobacterium tuberculosis H37Rv
ccgaaugugaaaugcgcgauc

SEQ ID NO: 3297192 - RNA, 17 nt, Mycobacterium tuberculosis H37Rv
ccgaauuugucggcgaa

SEQ ID NO: 3297193 - RNA, 16 nt, Mycobacterium tuberculosis H37Rv
ccgacaaccccgccag

SEQ ID NO: 3297194 - RNA, 17 nt, Mycobacterium tuberculosis H37Rv
ccgacaaccccgccagg

SEQ ID NO: 3297195 - RNA, 17 nt, Mycobacterium tuberculosis H37Rv
ccgacaacccggccggg

SEQ ID NO: 3297196 - RNA, 20 nt, Mycobacterium tuberculosis H37Rv
ccgacaaccuuggcgacugu

SEQ ID NO: 3297197 - RNA, 19 nt, Mycobacterium tuberculosis H37Rv
ccgacaacgacgucgccga

SEQ ID NO: 3297198 - RNA, 21 nt, Mycobacterium tuberculosis H37Rv
ccgacaacgacgucgccgacc

SEQ ID NO: 3297199 - RNA, 18 nt, Mycobacterium tuberculosis H37Rv
ccgacaagaauggccgcc

SEQ ID NO: 3297200 - RNA, 18 nt, Mycobacterium tuberculosis H37Rv
ccgacaagcugucggcga

SEQ ID NO: 3297201 - RNA, 16 nt, Mycobacterium tuberculosis H37Rv
ccgacaaugucggcga

SEQ ID NO: 3297202 - RNA, 17 nt, Mycobacterium tuberculosis H37Rv
ccgacaaugucggcgau

SEQ ID NO: 3297203 - RNA, 17 nt, Mycobacterium tuberculosis H37Rv
ccgacaccaccaggucc

SEQ ID NO: 3297204 - RNA, 20 nt, Mycobacterium tuberculosis H37Rv
ccgacaccaccggcgccgcc

SEQ ID NO: 3297205 - RNA, 15 nt, Mycobacterium tuberculosis H37Rv
ccgacaccaggucgg

SEQ ID NO: 3297206 - RNA, 18 nt, Mycobacterium tuberculosis H37Rv
ccgacacccccggugccg

SEQ ID NO: 3297207 - RNA, 14 nt, Mycobacterium tuberculosis H37Rv
ccgacacccucggg

SEQ ID NO: 3297208 - RNA, 13 nt, Mycobacterium tuberculosis H37Rv
ccgacaccgccga

SEQ ID NO: 3297209 - RNA, 19 nt, Mycobacterium tuberculosis H37Rv
ccgacaccggccgcgacgg

SEQ ID NO: 3297210 - RNA, 15 nt, Mycobacterium tuberculosis H37Rv
ccgacaccggcggca

SEQ ID NO: 3297211 - RNA, 16 nt, Mycobacterium tuberculosis H37Rv
ccgacaccggcggcau

SEQ ID NO: 3297212 - RNA, 23 nt, Mycobacterium tuberculosis H37Rv
ccgacaccggcugaccgacccgg

SEQ ID NO: 3297213 - RNA, 13 nt, Mycobacterium tuberculosis H37Rv
ccgacaccgucca

SEQ ID NO: 3297214 - RNA, 19 nt, Mycobacterium tuberculosis H37Rv
ccgacaccguccagcagcu

SEQ ID NO: 3297215 - RNA, 15 nt, Mycobacterium tuberculosis H37Rv
ccgacacgccguugg

SEQ ID NO: 3297216 - RNA, 13 nt, Mycobacterium tuberculosis H37Rv
ccgacacggcucg

SEQ ID NO: 3297217 - RNA, 23 nt, Mycobacterium tuberculosis H37Rv
ccgacacguugcagcucgauccg

SEQ ID NO: 3297218 - RNA, 18 nt, Mycobacterium tuberculosis H37Rv
ccgacacugggaucccga

SEQ ID NO: 3297219 - RNA, 18 nt, Mycobacterium tuberculosis H37Rv
ccgacacuuaaccugaac

SEQ ID NO: 3297220 - RNA, 17 nt, Mycobacterium tuberculosis H37Rv
ccgacagauggucgguc

SEQ ID NO: 3297221 - RNA, 18 nt, Mycobacterium tuberculosis H37Rv
ccgacagcacccggccac

SEQ ID NO: 3297222 - RNA, 15 nt, Mycobacterium tuberculosis H37Rv
ccgacagcagccggu

SEQ ID NO: 3297223 - RNA, 19 nt, Mycobacterium tuberculosis H37Rv
ccgacagcagguugccgaa

SEQ ID NO: 3297224 - RNA, 21 nt, Mycobacterium tuberculosis H37Rv
ccgacaggccggccaccaguc

SEQ ID NO: 3297225 - RNA, 22 nt, Mycobacterium tuberculosis H37Rv
ccgacagggacccgagaucacc

SEQ ID NO: 3297226 - RNA, 14 nt, Mycobacterium tuberculosis H37Rv
ccgacaguccgcgc

SEQ ID NO: 3297227 - RNA, 15 nt, Mycobacterium tuberculosis H37Rv
ccgacaguggcucac

SEQ ID NO: 3297228 - RNA, 19 nt, Mycobacterium tuberculosis H37Rv
ccgacaguggucccgguga

SEQ ID NO: 3297229 - RNA, 14 nt, Mycobacterium tuberculosis H37Rv
ccgacaucggccag

SEQ ID NO: 3297230 - RNA, 16 nt, Mycobacterium tuberculosis H37Rv
ccgacaucgucaucca

SEQ ID NO: 3297231 - RNA, 18 nt, Mycobacterium tuberculosis H37Rv
ccgacaugaaccggucga

SEQ ID NO: 3297232 - RNA, 20 nt, Mycobacterium tuberculosis H37Rv
ccgacaugaauccacugaac

SEQ ID NO: 3297233 - RNA, 13 nt, Mycobacterium tuberculosis H37Rv
ccgacaugcgccg

SEQ ID NO: 3297234 - RNA, 18 nt, Mycobacterium tuberculosis H37Rv
ccgacauggcggugcgca

SEQ ID NO: 3297235 - RNA, 21 nt, Mycobacterium tuberculosis H37Rv
ccgacauggcggugcgcagcu

SEQ ID NO: 3297236 - RNA, 22 nt, Mycobacterium tuberculosis H37Rv
ccgacaugguccgaccagcggc

SEQ ID NO: 3297237 - RNA, 19 nt, Mycobacterium tuberculosis H37Rv
ccgacgccagaacguggcc

SEQ ID NO: 3297238 - RNA, 18 nt, Mycobacterium tuberculosis H37Rv
ccgacgccagcugcccga

SEQ ID NO: 3297239 - RNA, 20 nt, Mycobacterium tuberculosis H37Rv
ccgacgcccaggcauggccu

SEQ ID NO: 3297240 - RNA, 14 nt, Mycobacterium tuberculosis H37Rv
ccgacgccccgauc

SEQ ID NO: 3297241 - RNA, 12 nt, Mycobacterium tuberculosis H37Rv
ccgacgccgcca

SEQ ID NO: 3297242 - RNA, 19 nt, Mycobacterium tuberculosis H37Rv
ccgacgccgccagguccgc

SEQ ID NO: 3297243 - RNA, 12 nt, Mycobacterium tuberculosis H37Rv
ccgacgccgccg

SEQ ID NO: 3297244 - RNA, 15 nt, Mycobacterium tuberculosis H37Rv
ccgacgccgccggca

SEQ ID NO: 3297245 - RNA, 16 nt, Mycobacterium tuberculosis H37Rv
ccgacgccgccggccc

SEQ ID NO: 3297246 - RNA, 16 nt, Mycobacterium tuberculosis H37Rv
ccgacgccgccggcgc

SEQ ID NO: 3297247 - RNA, 21 nt, Mycobacterium tuberculosis H37Rv
ccgacgccgccggcgccaccg

SEQ ID NO: 3297248 - RNA, 13 nt, Mycobacterium tuberculosis H37Rv
ccgacgccggugg

SEQ ID NO: 3297249 - RNA, 14 nt, Mycobacterium tuberculosis H37Rv
ccgacgccguugcc

SEQ ID NO: 3297250 - RNA, 22 nt, Mycobacterium tuberculosis H37Rv
ccgacgccugggcacggccguc

SEQ ID NO: 3297251 - RNA, 17 nt, Mycobacterium tuberculosis H37Rv
ccgacgccuuccagccc

SEQ ID NO: 3297252 - RNA, 14 nt, Mycobacterium tuberculosis H37Rv
ccgacgcgaacgcg

SEQ ID NO: 3297253 - RNA, 19 nt, Mycobacterium tuberculosis H37Rv
ccgacgcgaacgcggccac

SEQ ID NO: 3297254 - RNA, 15 nt, Mycobacterium tuberculosis H37Rv
ccgacgcgcggccag

SEQ ID NO: 3297255 - RNA, 20 nt, Mycobacterium tuberculosis H37Rv
ccgacgcguccggugcacca

SEQ ID NO: 3297256 - RNA, 15 nt, Mycobacterium tuberculosis H37Rv
ccgacgcgucggcga

SEQ ID NO: 3297257 - RNA, 16 nt, Mycobacterium tuberculosis H37Rv
ccgacgcgucggcgac

SEQ ID NO: 3297258 - RNA, 13 nt, Mycobacterium tuberculosis H37Rv
ccgacgcuccagg

SEQ ID NO: 3297259 - RNA, 20 nt, Mycobacterium tuberculosis H37Rv
ccgacggaaugucagccggu

SEQ ID NO: 3297260 - RNA, 15 nt, Mycobacterium tuberculosis H37Rv
ccgacggacuccggc

SEQ ID NO: 3297261 - RNA, 14 nt, Mycobacterium tuberculosis H37Rv
ccgacggagaucga

SEQ ID NO: 3297262 - RNA, 16 nt, Mycobacterium tuberculosis H37Rv
ccgacggaucgcccug

SEQ ID NO: 3297263 - RNA, 22 nt, Mycobacterium tuberculosis H37Rv
ccgacggaucgcccugacaccc

SEQ ID NO: 3297264 - RNA, 13 nt, Mycobacterium tuberculosis H37Rv
ccgacggccagca

SEQ ID NO: 3297265 - RNA, 15 nt, Mycobacterium tuberculosis H37Rv
ccgacggccagcagg

SEQ ID NO: 3297266 - RNA, 16 nt, Mycobacterium tuberculosis H37Rv
ccgacggccgcggcgu

SEQ ID NO: 3297267 - RNA, 16 nt, Mycobacterium tuberculosis H37Rv
ccgacggcgcccagcg

SEQ ID NO: 3297268 - RNA, 16 nt, Mycobacterium tuberculosis H37Rv
ccgacgggacaacccg

SEQ ID NO: 3297269 - RNA, 20 nt, Mycobacterium tuberculosis H37Rv
ccgacgggacaaggucaucg

SEQ ID NO: 3297270 - RNA, 17 nt, Mycobacterium tuberculosis H37Rv
ccgacgggauagacgac

SEQ ID NO: 3297271 - RNA, 21 nt, Mycobacterium tuberculosis H37Rv
ccgacgggauagacgaccccg

SEQ ID NO: 3297272 - RNA, 20 nt, Mycobacterium tuberculosis H37Rv
ccgacgggccacgaugcgca

SEQ ID NO: 3297273 - RNA, 15 nt, Mycobacterium tuberculosis H37Rv
ccgacgggccgucgc

SEQ ID NO: 3297274 - RNA, 23 nt, Mycobacterium tuberculosis H37Rv
ccgacgggcgaaauuccgggccu

SEQ ID NO: 3297275 - RNA, 16 nt, Mycobacterium tuberculosis H37Rv
ccgacgggggucgggc

SEQ ID NO: 3297276 - RNA, 19 nt, Mycobacterium tuberculosis H37Rv
ccgacggugaaccaccacu

SEQ ID NO: 3297277 - RNA, 12 nt, Mycobacterium tuberculosis H37Rv
ccgacggugaug

SEQ ID NO: 3297278 - RNA, 20 nt, Mycobacterium tuberculosis H37Rv
ccgacguacaggacgguuga

SEQ ID NO: 3297279 - RNA, 17 nt, Mycobacterium tuberculosis H37Rv
ccgacguauagaccagg

SEQ ID NO: 3297280 - RNA, 18 nt, Mycobacterium tuberculosis H37Rv
ccgacguauagaccaggu

SEQ ID NO: 3297281 - RNA, 16 nt, Mycobacterium tuberculosis H37Rv
ccgacgucaggcagcu

SEQ ID NO: 3297282 - RNA, 14 nt, Mycobacterium tuberculosis H37Rv
ccgacgucgaccac

SEQ ID NO: 3297283 - RNA, 20 nt, Mycobacterium tuberculosis H37Rv
ccgacgucgaccacugcccg

SEQ ID NO: 3297284 - RNA, 14 nt, Mycobacterium tuberculosis H37Rv
ccgacgucgccaag

SEQ ID NO: 3297285 - RNA, 14 nt, Mycobacterium tuberculosis H37Rv
ccgacgucgcccau

SEQ ID NO: 3297286 - RNA, 15 nt, Mycobacterium tuberculosis H37Rv
ccgacgucggugacc

SEQ ID NO: 3297287 - RNA, 21 nt, Mycobacterium tuberculosis H37Rv
ccgacgugagggucaugucga

SEQ ID NO: 3297288 - RNA, 20 nt, Mycobacterium tuberculosis H37Rv
ccgacguggccagcccgccc

SEQ ID NO: 3297289 - RNA, 17 nt, Mycobacterium tuberculosis H37Rv
ccgacgugguugccccg

SEQ ID NO: 3297290 - RNA, 21 nt, Mycobacterium tuberculosis H37Rv
ccgacguuccccuucagcacg

SEQ ID NO: 3297291 - RNA, 13 nt, Mycobacterium tuberculosis H37Rv
ccgacguugccga

SEQ ID NO: 3297292 - RNA, 18 nt, Mycobacterium tuberculosis H37Rv
ccgacguugcuggcuggg

SEQ ID NO: 3297293 - RNA, 20 nt, Mycobacterium tuberculosis H37Rv
ccgacguuguagauucccga

SEQ ID NO: 3297294 - RNA, 14 nt, Mycobacterium tuberculosis H37Rv
ccgacuaucggccg

SEQ ID NO: 3297295 - RNA, 24 nt, Mycobacterium tuberculosis H37Rv
ccgacucaggucggugcggucauc

SEQ ID NO: 3297296 - RNA, 19 nt, Mycobacterium tuberculosis H37Rv
ccgacucaucggccgcggu

SEQ ID NO: 3297297 - RNA, 23 nt, Mycobacterium tuberculosis H37Rv
ccgacucccccucuaccuccgcc

SEQ ID NO: 3297298 - RNA, 20 nt, Mycobacterium tuberculosis H37Rv
ccgacuccccgccgggcaau

SEQ ID NO: 3297299 - RNA, 17 nt, Mycobacterium tuberculosis H37Rv
ccgacuccggcaggccc

SEQ ID NO: 3297300 - RNA, 23 nt, Mycobacterium tuberculosis H37Rv
ccgacuccggcaggcccgacggc

SEQ ID NO: 3297301 - RNA, 16 nt, Mycobacterium tuberculosis H37Rv
ccgacuccugggccaa

SEQ ID NO: 3297302 - RNA, 17 nt, Mycobacterium tuberculosis H37Rv
ccgacuccugggccaac

SEQ ID NO: 3297303 - RNA, 13 nt, Mycobacterium tuberculosis H37Rv
ccgacucggccac

SEQ ID NO: 3297304 - RNA, 21 nt, Mycobacterium tuberculosis H37Rv
ccgacucgucggccugguacu

SEQ ID NO: 3297305 - RNA, 23 nt, Mycobacterium tuberculosis H37Rv
ccgacugacagaagcgguucgca

SEQ ID NO: 3297306 - RNA, 15 nt, Mycobacterium tuberculosis H37Rv
ccgacugcacuugaa

SEQ ID NO: 3297307 - RNA, 13 nt, Mycobacterium tuberculosis H37Rv
ccgacugccgcgg

SEQ ID NO: 3297308 - RNA, 15 nt, Mycobacterium tuberculosis H37Rv
ccgacugcugaauca

SEQ ID NO: 3297309 - RNA, 18 nt, Mycobacterium tuberculosis H37Rv
ccgacuggccccgccagc

SEQ ID NO: 3297310 - RNA, 19 nt, Mycobacterium tuberculosis H37Rv
ccgacugggcgcgacccca

SEQ ID NO: 3297311 - RNA, 21 nt, Mycobacterium tuberculosis H37Rv
ccgacugggcgcgaccccagg

SEQ ID NO: 3297312 - RNA, 17 nt, Mycobacterium tuberculosis H37Rv
ccgacuguagaaaaccc

SEQ ID NO: 3297313 - RNA, 19 nt, Mycobacterium tuberculosis H37Rv
ccgacuguagaaaacccgu

SEQ ID NO: 3297314 - RNA, 20 nt, Mycobacterium tuberculosis H37Rv
ccgacuguagaaaacccgua

SEQ ID NO: 3297315 - RNA, 15 nt, Mycobacterium tuberculosis H37Rv
ccgacuguccccguu

SEQ ID NO: 3297316 - RNA, 21 nt, Mycobacterium tuberculosis H37Rv
ccgacuguccccguugagaua

SEQ ID NO: 3297317 - RNA, 21 nt, Mycobacterium tuberculosis H37Rv
ccgacuuccgcgucgccggcc

SEQ ID NO: 3297318 - RNA, 12 nt, Mycobacterium tuberculosis H37Rv
ccgacuucggaa

SEQ ID NO: 3297319 - RNA, 16 nt, Mycobacterium tuberculosis H37Rv
ccgacuucuccaggcu

SEQ ID NO: 3297320 - RNA, 18 nt, Mycobacterium tuberculosis H37Rv
ccgacuucuccaggcuga

SEQ ID NO: 3297321 - RNA, 16 nt, Mycobacterium tuberculosis H37Rv
ccgacuugucgccguu

SEQ ID NO: 3297322 - RNA, 13 nt, Mycobacterium tuberculosis H37Rv
ccgagaacaccac

SEQ ID NO: 3297323 - RNA, 15 nt, Mycobacterium tuberculosis H37Rv
ccgagaacgcccgag

SEQ ID NO: 3297324 - RNA, 20 nt, Mycobacterium tuberculosis H37Rv
ccgagaacgcccgagugacc

SEQ ID NO: 3297325 - RNA, 21 nt, Mycobacterium tuberculosis H37Rv
ccgagaacgcccgagugacca

SEQ ID NO: 3297326 - RNA, 17 nt, Mycobacterium tuberculosis H37Rv
ccgagaagacgcaaaag

SEQ ID NO: 3297327 - RNA, 22 nt, Mycobacterium tuberculosis H37Rv
ccgagaagcccaccgucugcug

SEQ ID NO: 3297328 - RNA, 22 nt, Mycobacterium tuberculosis H37Rv
ccgagaagcguugcacugcugg

SEQ ID NO: 3297329 - RNA, 15 nt, Mycobacterium tuberculosis H37Rv
ccgagaagugggcgg

SEQ ID NO: 3297330 - RNA, 20 nt, Mycobacterium tuberculosis H37Rv
ccgagaauuccccagccgca

SEQ ID NO: 3297331 - RNA, 17 nt, Mycobacterium tuberculosis H37Rv
ccgagaccaugccgacg

SEQ ID NO: 3297332 - RNA, 22 nt, Mycobacterium tuberculosis H37Rv
ccgagaccgccgcugccgccga

SEQ ID NO: 3297333 - RNA, 13 nt, Mycobacterium tuberculosis H37Rv
ccgaggcacccgu

SEQ ID NO: 3297334 - RNA, 16 nt, Mycobacterium tuberculosis H37Rv
ccgaggcacccgugcc

SEQ ID NO: 3297335 - RNA, 19 nt, Mycobacterium tuberculosis H37Rv
ccgaggcacccgugccgcc

SEQ ID NO: 3297336 - RNA, 23 nt, Mycobacterium tuberculosis H37Rv
ccgaggcagacacgagucgccag

SEQ ID NO: 3297337 - RNA, 18 nt, Mycobacterium tuberculosis H37Rv
ccgaggccaugcucgcca

SEQ ID NO: 3297338 - RNA, 19 nt, Mycobacterium tuberculosis H37Rv
ccgaggccaugcucgccaa

SEQ ID NO: 3297339 - RNA, 19 nt, Mycobacterium tuberculosis H37Rv
ccgaggccgccaucgccgc

SEQ ID NO: 3297340 - RNA, 15 nt, Mycobacterium tuberculosis H37Rv
ccgaggccgccgaga

SEQ ID NO: 3297341 - RNA, 16 nt, Mycobacterium tuberculosis H37Rv
ccgaggccgccgagau

SEQ ID NO: 3297342 - RNA, 22 nt, Mycobacterium tuberculosis H37Rv
ccgaggccuaccaggcgcggcc

SEQ ID NO: 3297343 - RNA, 16 nt, Mycobacterium tuberculosis H37Rv
ccgaggccucggccag

SEQ ID NO: 3297344 - RNA, 15 nt, Mycobacterium tuberculosis H37Rv
ccgaggcgagacgcu

SEQ ID NO: 3297345 - RNA, 22 nt, Mycobacterium tuberculosis H37Rv
ccgaggcgagacgcuccagugg

SEQ ID NO: 3297346 - RNA, 14 nt, Mycobacterium tuberculosis H37Rv
ccgaggcgcccaac

SEQ ID NO: 3297347 - RNA, 12 nt, Mycobacterium tuberculosis H37Rv
ccgaggcggaug

SEQ ID NO: 3297348 - RNA, 20 nt, Mycobacterium tuberculosis H37Rv
ccgaggcggguacaccacgg

SEQ ID NO: 3297349 - RNA, 15 nt, Mycobacterium tuberculosis H37Rv
ccgaggcucgggccg

SEQ ID NO: 3297350 - RNA, 17 nt, Mycobacterium tuberculosis H37Rv
ccgaggcucgggccgca

SEQ ID NO: 3297351 - RNA, 16 nt, Mycobacterium tuberculosis H37Rv
ccgaggcuggcauccc

SEQ ID NO: 3297352 - RNA, 18 nt, Mycobacterium tuberculosis H37Rv
ccgagggaacggugcaca

SEQ ID NO: 3297353 - RNA, 22 nt, Mycobacterium tuberculosis H37Rv
ccgaggguagacggggcgagca

SEQ ID NO: 3297354 - RNA, 13 nt, Mycobacterium tuberculosis H37Rv
ccgagggucgggc

SEQ ID NO: 3297355 - RNA, 16 nt, Mycobacterium tuberculosis H37Rv
ccgagguaacgcagcg

SEQ ID NO: 3297356 - RNA, 13 nt, Mycobacterium tuberculosis H37Rv
ccgaggucgguuc

SEQ ID NO: 3297357 - RNA, 19 nt, Mycobacterium tuberculosis H37Rv
ccgaggucgguucggccgg

SEQ ID NO: 3297358 - RNA, 20 nt, Mycobacterium tuberculosis H37Rv
ccgaggucgguucggccgga

SEQ ID NO: 3297359 - RNA, 22 nt, Mycobacterium tuberculosis H37Rv
ccgaguagaacuucgccagcgg

SEQ ID NO: 3297360 - RNA, 23 nt, Mycobacterium tuberculosis H37Rv
ccgaguagaagauggcaccgccc

SEQ ID NO: 3297361 - RNA, 15 nt, Mycobacterium tuberculosis H37Rv
ccgaguauuggucgg

SEQ ID NO: 3297362 - RNA, 23 nt, Mycobacterium tuberculosis H37Rv
ccgaguauuggucggugggguau

SEQ ID NO: 3297363 - RNA, 21 nt, Mycobacterium tuberculosis H37Rv
ccgaguccggcgagcucaaca

SEQ ID NO: 3297364 - RNA, 16 nt, Mycobacterium tuberculosis H37Rv
ccgagucgacggccag

SEQ ID NO: 3297365 - RNA, 22 nt, Mycobacterium tuberculosis H37Rv
ccgagucgacggccagugcgca

SEQ ID NO: 3297366 - RNA, 14 nt, Mycobacterium tuberculosis H37Rv
ccgagucggcaaac

SEQ ID NO: 3297367 - RNA, 17 nt, Mycobacterium tuberculosis H37Rv
ccgagucuaaggaugac

SEQ ID NO: 3297368 - RNA, 16 nt, Mycobacterium tuberculosis H37Rv
ccgagucugcgagcag

SEQ ID NO: 3297369 - RNA, 19 nt, Mycobacterium tuberculosis H37Rv
ccgagugugaaucgcacga

SEQ ID NO: 3297370 - RNA, 15 nt, Mycobacterium tuberculosis H37Rv
ccgaguuaccgguga

SEQ ID NO: 3297371 - RNA, 18 nt, Mycobacterium tuberculosis H37Rv
ccgaguugaacguucccu

SEQ ID NO: 3297372 - RNA, 15 nt, Mycobacterium tuberculosis H37Rv
ccgaguugaccgccg

SEQ ID NO: 3297373 - RNA, 20 nt, Mycobacterium tuberculosis H37Rv
ccgaguugcccgggucggcc

SEQ ID NO: 3297374 - RNA, 13 nt, Mycobacterium tuberculosis H37Rv
ccgaguuggucgu

SEQ ID NO: 3297375 - RNA, 17 nt, Mycobacterium tuberculosis H37Rv
ccgaguuguaggccgcc

SEQ ID NO: 3297376 - RNA, 14 nt, Mycobacterium tuberculosis H37Rv
ccgaguugucgcgc

SEQ ID NO: 3297377 - RNA, 20 nt, Mycobacterium tuberculosis H37Rv
ccgaguuguggacgcccgag

SEQ ID NO: 3297378 - RNA, 17 nt, Mycobacterium tuberculosis H37Rv
ccgauaaaaaccacccc

SEQ ID NO: 3297379 - RNA, 18 nt, Mycobacterium tuberculosis H37Rv
ccgauaaaggucacuccu

SEQ ID NO: 3297380 - RNA, 14 nt, Mycobacterium tuberculosis H37Rv
ccgauaaaugccgc

SEQ ID NO: 3297381 - RNA, 15 nt, Mycobacterium tuberculosis H37Rv
ccgauaaaugccgcg

SEQ ID NO: 3297382 - RNA, 22 nt, Mycobacterium tuberculosis H37Rv
ccgauaacaaggccgccgccgu

SEQ ID NO: 3297383 - RNA, 15 nt, Mycobacterium tuberculosis H37Rv
ccgauacccagcggg

SEQ ID NO: 3297384 - RNA, 15 nt, Mycobacterium tuberculosis H37Rv
ccgauaccgccggcc

SEQ ID NO: 3297385 - RNA, 16 nt, Mycobacterium tuberculosis H37Rv
ccgauacgaagccgcc

SEQ ID NO: 3297386 - RNA, 20 nt, Mycobacterium tuberculosis H37Rv
ccgauacuaaacaggccgcc

SEQ ID NO: 3297387 - RNA, 22 nt, Mycobacterium tuberculosis H37Rv
ccgauacuaaacaggccgccac

SEQ ID NO: 3297388 - RNA, 19 nt, Mycobacterium tuberculosis H37Rv
ccgauagacgugucauccc

SEQ ID NO: 3297389 - RNA, 17 nt, Mycobacterium tuberculosis H37Rv
ccgauagcgcggcacca

SEQ ID NO: 3297390 - RNA, 19 nt, Mycobacterium tuberculosis H37Rv
ccgauagcgcggcaccagc

SEQ ID NO: 3297391 - RNA, 14 nt, Mycobacterium tuberculosis H37Rv
ccgauauaccaggg

SEQ ID NO: 3297392 - RNA, 22 nt, Mycobacterium tuberculosis H37Rv
ccgauauaccagggcaucagca

SEQ ID NO: 3297393 - RNA, 18 nt, Mycobacterium tuberculosis H37Rv
ccgauaucaauggcagcu

SEQ ID NO: 3297394 - RNA, 15 nt, Mycobacterium tuberculosis H37Rv
ccgauauucggccau

SEQ ID NO: 3297395 - RNA, 16 nt, Mycobacterium tuberculosis H37Rv
ccgauauuggcaucgu

SEQ ID NO: 3297396 - RNA, 19 nt, Mycobacterium tuberculosis H37Rv
ccgaucaacaugccgguca

SEQ ID NO: 3297397 - RNA, 15 nt, Mycobacterium tuberculosis H37Rv
ccgaucacccgcacu

SEQ ID NO: 3297398 - RNA, 19 nt, Mycobacterium tuberculosis H37Rv
ccgaucaccgcaucggugc

SEQ ID NO: 3297399 - RNA, 17 nt, Mycobacterium tuberculosis H37Rv
ccgaucaccuucggccg

SEQ ID NO: 3297400 - RNA, 19 nt, Mycobacterium tuberculosis H37Rv
ccgaucaccuucggccgac

SEQ ID NO: 3297401 - RNA, 16 nt, Mycobacterium tuberculosis H37Rv
ccgaucacggugggcg

SEQ ID NO: 3297402 - RNA, 17 nt, Mycobacterium tuberculosis H37Rv
ccgaucagcaccgacgg

SEQ ID NO: 3297403 - RNA, 13 nt, Mycobacterium tuberculosis H37Rv
ccgaucagcagcu

SEQ ID NO: 3297404 - RNA, 16 nt, Mycobacterium tuberculosis H37Rv
ccgaucagcccggccu

SEQ ID NO: 3297405 - RNA, 23 nt, Mycobacterium tuberculosis H37Rv
ccgaucagcccggccuugccgcc

SEQ ID NO: 3297406 - RNA, 14 nt, Mycobacterium tuberculosis H37Rv
ccgaucagccgugg

SEQ ID NO: 3297407 - RNA, 16 nt, Mycobacterium tuberculosis H37Rv
ccgaucagcgcggcgc

SEQ ID NO: 3297408 - RNA, 13 nt, Mycobacterium tuberculosis H37Rv
ccgaucaggccga

SEQ ID NO: 3297409 - RNA, 16 nt, Mycobacterium tuberculosis H37Rv
ccgaucaggccgacgu

SEQ ID NO: 3297410 - RNA, 14 nt, Mycobacterium tuberculosis H37Rv
ccgaucaucgacga

SEQ ID NO: 3297411 - RNA, 20 nt, Mycobacterium tuberculosis H37Rv
ccgauccacaacagcccgua

SEQ ID NO: 3297412 - RNA, 22 nt, Mycobacterium tuberculosis H37Rv
ccgauccccggagaacuugagc

SEQ ID NO: 3297413 - RNA, 16 nt, Mycobacterium tuberculosis H37Rv
ccgaucccggccagcu

SEQ ID NO: 3297414 - RNA, 21 nt, Mycobacterium tuberculosis H37Rv
ccgaucccggcgagcacccgc

SEQ ID NO: 3297415 - RNA, 13 nt, Mycobacterium tuberculosis H37Rv
ccgaucccgucgg

SEQ ID NO: 3297416 - RNA, 15 nt, Mycobacterium tuberculosis H37Rv
ccgauccgcacagca

SEQ ID NO: 3297417 - RNA, 16 nt, Mycobacterium tuberculosis H37Rv
ccgauccgcacagcaa

SEQ ID NO: 3297418 - RNA, 21 nt, Mycobacterium tuberculosis H37Rv
ccgaucgaaccgcugcuccuc

SEQ ID NO: 3297419 - RNA, 20 nt, Mycobacterium tuberculosis H37Rv
ccgaucgccgaggcuagcag

SEQ ID NO: 3297420 - RNA, 18 nt, Mycobacterium tuberculosis H37Rv
ccgaucgcggcggccucc

SEQ ID NO: 3297421 - RNA, 23 nt, Mycobacterium tuberculosis H37Rv
ccgaucgcuccggcccugccgcc

SEQ ID NO: 3297422 - RNA, 14 nt, Mycobacterium tuberculosis H37Rv
ccgaucggcaaccc

SEQ ID NO: 3297423 - RNA, 17 nt, Mycobacterium tuberculosis H37Rv
ccgaucggcaaucgacu

SEQ ID NO: 3297424 - RNA, 15 nt, Mycobacterium tuberculosis H37Rv
ccgaucggcaccgug

SEQ ID NO: 3297425 - RNA, 12 nt, Mycobacterium tuberculosis H37Rv
ccgaucggccaa

SEQ ID NO: 3297426 - RNA, 12 nt, Mycobacterium tuberculosis H37Rv
ccgaucggccag

SEQ ID NO: 3297427 - RNA, 20 nt, Mycobacterium tuberculosis H37Rv
ccgaucggccugcagcgaug

SEQ ID NO: 3297428 - RNA, 15 nt, Mycobacterium tuberculosis H37Rv
ccgaucggcgcgccg

SEQ ID NO: 3297429 - RNA, 18 nt, Mycobacterium tuberculosis H37Rv
ccgcaaugacgucgucgg

SEQ ID NO: 3297430 - RNA, 20 nt, Mycobacterium tuberculosis H37Rv
ccgcaaugacgucgucggcc

SEQ ID NO: 3297431 - RNA, 21 nt, Mycobacterium tuberculosis H37Rv
ccgcaaugacgucgucggcca

SEQ ID NO: 3297432 - RNA, 14 nt, Mycobacterium tuberculosis H37Rv
ccgcaaugcgagcg

SEQ ID NO: 3297433 - RNA, 17 nt, Mycobacterium tuberculosis H37Rv
ccgcaauggaccgaacg

SEQ ID NO: 3297434 - RNA, 14 nt, Mycobacterium tuberculosis H37Rv
ccgcaauucgcggu

SEQ ID NO: 3297435 - RNA, 23 nt, Mycobacterium tuberculosis H37Rv
ccgcaauuggcguagcaacccag

SEQ ID NO: 3297436 - RNA, 20 nt, Mycobacterium tuberculosis H37Rv
ccgcacaacgauaguucggc

SEQ ID NO: 3297437 - RNA, 15 nt, Mycobacterium tuberculosis H37Rv
ccgcacacgcgugca

SEQ ID NO: 3297438 - RNA, 15 nt, Mycobacterium tuberculosis H37Rv
ccgcacagcggcccg

SEQ ID NO: 3297439 - RNA, 19 nt, Mycobacterium tuberculosis H37Rv
ccgcaccaagcagcgacca

SEQ ID NO: 3297440 - RNA, 23 nt, Mycobacterium tuberculosis H37Rv
ccgcaccaaggccgccugcaaca

SEQ ID NO: 3297441 - RNA, 10 nt, Mycobacterium tuberculosis H37Rv
ccgcaccacc

SEQ ID NO: 3297442 - RNA, 16 nt, Mycobacterium tuberculosis H37Rv
ccgcaccaccggcccc

SEQ ID NO: 3297443 - RNA, 18 nt, Mycobacterium tuberculosis H37Rv
ccgcaccaccggccccac

SEQ ID NO: 3297444 - RNA, 19 nt, Mycobacterium tuberculosis H37Rv
ccgcaccaccggccccacc

SEQ ID NO: 3297445 - RNA, 20 nt, Mycobacterium tuberculosis H37Rv
ccgcaccagcugucgggcag

SEQ ID NO: 3297446 - RNA, 21 nt, Mycobacterium tuberculosis H37Rv
ccgcaccagcugucgggcagc

SEQ ID NO: 3297447 - RNA, 11 nt, Mycobacterium tuberculosis H37Rv
ccgcaccaggu

SEQ ID NO: 3297448 - RNA, 15 nt, Mycobacterium tuberculosis H37Rv
ccgcaccagucgcgc

SEQ ID NO: 3297449 - RNA, 14 nt, Mycobacterium tuberculosis H37Rv
ccgcaccaguggcg

SEQ ID NO: 3297450 - RNA, 15 nt, Mycobacterium tuberculosis H37Rv
ccgcaccaguggcgc

SEQ ID NO: 3297451 - RNA, 15 nt, Mycobacterium tuberculosis H37Rv
ccgcacccagaccgc

SEQ ID NO: 3297452 - RNA, 13 nt, Mycobacterium tuberculosis H37Rv
ccgcaccccgccc

SEQ ID NO: 3297453 - RNA, 16 nt, Mycobacterium tuberculosis H37Rv
ccgcaccccggccgcg

SEQ ID NO: 3297454 - RNA, 14 nt, Mycobacterium tuberculosis H37Rv
ccgcacccgcuccc

SEQ ID NO: 3297455 - RNA, 17 nt, Mycobacterium tuberculosis H37Rv
ccgcacccgcucgucgg

SEQ ID NO: 3297456 - RNA, 14 nt, Mycobacterium tuberculosis H37Rv
ccgcacccguugcg

SEQ ID NO: 3297457 - RNA, 14 nt, Mycobacterium tuberculosis H37Rv
ccgcaccgauuucc

SEQ ID NO: 3297458 - RNA, 20 nt, Mycobacterium tuberculosis H37Rv
ccgcaccgccacccugacca

SEQ ID NO: 3297459 - RNA, 15 nt, Mycobacterium tuberculosis H37Rv
ccgcaccgccggcaa

SEQ ID NO: 3297460 - RNA, 23 nt, Mycobacterium tuberculosis H37Rv
ccgcaccgcgguacgccggucgg

SEQ ID NO: 3297461 - RNA, 22 nt, Mycobacterium tuberculosis H37Rv
ccgcaccgcuguugcaucgccg

SEQ ID NO: 3297462 - RNA, 19 nt, Mycobacterium tuberculosis H37Rv
ccgcaccguagccgcugca

SEQ ID NO: 3297463 - RNA, 23 nt, Mycobacterium tuberculosis H37Rv
ccgcaccguaguaguucagccag

SEQ ID NO: 3297464 - RNA, 15 nt, Mycobacterium tuberculosis H37Rv
ccgcaccgucccagu

SEQ ID NO: 3297465 - RNA, 16 nt, Mycobacterium tuberculosis H37Rv
ccgcaccgucccagug

SEQ ID NO: 3297466 - RNA, 13 nt, Mycobacterium tuberculosis H37Rv
ccgcaccgugccg

SEQ ID NO: 3297467 - RNA, 20 nt, Mycobacterium tuberculosis H37Rv
ccgcaccguggacaccuggc

SEQ ID NO: 3297468 - RNA, 21 nt, Mycobacterium tuberculosis H37Rv
ccgcaccguggacaccuggcu

SEQ ID NO: 3297469 - RNA, 17 nt, Mycobacterium tuberculosis H37Rv
ccgcaccucaccggguu

SEQ ID NO: 3297470 - RNA, 16 nt, Mycobacterium tuberculosis H37Rv
ccgcaccuccgccccg

SEQ ID NO: 3297471 - RNA, 15 nt, Mycobacterium tuberculosis H37Rv
ccgcaccugcgauga

SEQ ID NO: 3297472 - RNA, 17 nt, Mycobacterium tuberculosis H37Rv
ccgcaccugggcggcgc

SEQ ID NO: 3297473 - RNA, 21 nt, Mycobacterium tuberculosis H37Rv
ccgcaccugggcggcgcgaag

SEQ ID NO: 3297474 - RNA, 22 nt, Mycobacterium tuberculosis H37Rv
ccgcaccugggcggcgcgaagu

SEQ ID NO: 3297475 - RNA, 17 nt, Mycobacterium tuberculosis H37Rv
ccgcacgaaccggucga

SEQ ID NO: 3297476 - RNA, 21 nt, Mycobacterium tuberculosis H37Rv
ccgcacgaagccggcuucggu

SEQ ID NO: 3297477 - RNA, 13 nt, Mycobacterium tuberculosis H37Rv
ccgcacgaucagg

SEQ ID NO: 3297478 - RNA, 18 nt, Mycobacterium tuberculosis H37Rv
ccgcacgauggccgucga

SEQ ID NO: 3297479 - RNA, 21 nt, Mycobacterium tuberculosis H37Rv
ccgcacgauggccgucgauca

SEQ ID NO: 3297480 - RNA, 23 nt, Mycobacterium tuberculosis H37Rv
ccgcacgcaaugcgggcccucua

SEQ ID NO: 3297481 - RNA, 15 nt, Mycobacterium tuberculosis H37Rv
ccgcacgccgaccag

SEQ ID NO: 3297482 - RNA, 14 nt, Mycobacterium tuberculosis H37Rv
ccgcacgccgaccg

SEQ ID NO: 3297483 - RNA, 15 nt, Mycobacterium tuberculosis H37Rv
ccgcacgccgaccgg

SEQ ID NO: 3297484 - RNA, 17 nt, Mycobacterium tuberculosis H37Rv
ccgcacgccgaccggcc

SEQ ID NO: 3297485 - RNA, 19 nt, Mycobacterium tuberculosis H37Rv
ccgcacgccgaccggcccg

SEQ ID NO: 3297486 - RNA, 13 nt, Mycobacterium tuberculosis H37Rv
ccgcacgccggca

SEQ ID NO: 3297487 - RNA, 16 nt, Mycobacterium tuberculosis H37Rv
ccgcacgccggcaugc

SEQ ID NO: 3297488 - RNA, 15 nt, Mycobacterium tuberculosis H37Rv
ccgcacgccggccag

SEQ ID NO: 3297489 - RNA, 16 nt, Mycobacterium tuberculosis H37Rv
ccgcacgccggccagc

SEQ ID NO: 3297490 - RNA, 18 nt, Mycobacterium tuberculosis H37Rv
ccgcacgccggccagcga

SEQ ID NO: 3297491 - RNA, 16 nt, Mycobacterium tuberculosis H37Rv
ccgcacgcuggcgggc

SEQ ID NO: 3297492 - RNA, 16 nt, Mycobacterium tuberculosis H37Rv
ccgcacggaugucgcc

SEQ ID NO: 3297493 - RNA, 13 nt, Mycobacterium tuberculosis H37Rv
ccgcacgggcgac

SEQ ID NO: 3297494 - RNA, 14 nt, Mycobacterium tuberculosis H37Rv
ccgcacggugacca

SEQ ID NO: 3297495 - RNA, 17 nt, Mycobacterium tuberculosis H37Rv
ccgcacggugaccacgc

SEQ ID NO: 3297496 - RNA, 18 nt, Mycobacterium tuberculosis H37Rv
ccgcacgguguauccgac

SEQ ID NO: 3297497 - RNA, 18 nt, Mycobacterium tuberculosis H37Rv
ccgcacgguugccgucag

SEQ ID NO: 3297498 - RNA, 22 nt, Mycobacterium tuberculosis H37Rv
ccgcacguagaaguaggcggcg

SEQ ID NO: 3297499 - RNA, 19 nt, Mycobacterium tuberculosis H37Rv
ccgcacguauccacggucg

SEQ ID NO: 3297500 - RNA, 12 nt, Mycobacterium tuberculosis H37Rv
ccgcacguuggc

SEQ ID NO: 3297501 - RNA, 21 nt, Mycobacterium tuberculosis H37Rv
ccgcacucacauccugguuga

SEQ ID NO: 3297502 - RNA, 13 nt, Mycobacterium tuberculosis H37Rv
ccgcacuccacga

SEQ ID NO: 3297503 - RNA, 20 nt, Mycobacterium tuberculosis H37Rv
ccgcacuccacgaucggccc

SEQ ID NO: 3297504 - RNA, 13 nt, Mycobacterium tuberculosis H37Rv
ccgcacugccgcc

SEQ ID NO: 3297505 - RNA, 15 nt, Mycobacterium tuberculosis H37Rv
ccgcacugccgccgg

SEQ ID NO: 3297506 - RNA, 22 nt, Mycobacterium tuberculosis H37Rv
ccgcacugccgccgguuccgcc

SEQ ID NO: 3297507 - RNA, 21 nt, Mycobacterium tuberculosis H37Rv
ccgcacugcuagucgugccgc

SEQ ID NO: 3297508 - RNA, 15 nt, Mycobacterium tuberculosis H37Rv
ccgcacuuucuuccu

SEQ ID NO: 3297509 - RNA, 16 nt, Mycobacterium tuberculosis H37Rv
ccgcagaauccggcaa

SEQ ID NO: 3297510 - RNA, 17 nt, Mycobacterium tuberculosis H37Rv
ccgcagaauccggcaac

SEQ ID NO: 3297511 - RNA, 20 nt, Mycobacterium tuberculosis H37Rv
ccgcagaaugucguaggcgc

SEQ ID NO: 3297512 - RNA, 21 nt, Mycobacterium tuberculosis H37Rv
ccgcagaaugucguaggcgcc

SEQ ID NO: 3297513 - RNA, 12 nt, Mycobacterium tuberculosis H37Rv
ccgcagaccgcc

SEQ ID NO: 3297514 - RNA, 14 nt, Mycobacterium tuberculosis H37Rv
ccgcagaccgccac

SEQ ID NO: 3297515 - RNA, 13 nt, Mycobacterium tuberculosis H37Rv
ccgcagacgccga

SEQ ID NO: 3297516 - RNA, 17 nt, Mycobacterium tuberculosis H37Rv
ccgcagacgccgucuga

SEQ ID NO: 3297517 - RNA, 21 nt, Mycobacterium tuberculosis H37Rv
ccgcagagcaccgcgaacagc

SEQ ID NO: 3297518 - RNA, 15 nt, Mycobacterium tuberculosis H37Rv
ccgcagagucgccga

SEQ ID NO: 3297519 - RNA, 17 nt, Mycobacterium tuberculosis H37Rv
ccgcagaucaccgccag

SEQ ID NO: 3297520 - RNA, 18 nt, Mycobacterium tuberculosis H37Rv
ccgcagaucaccgccagc

SEQ ID NO: 3297521 - RNA, 21 nt, Mycobacterium tuberculosis H37Rv
ccgcagaucaccgccagcugg

SEQ ID NO: 3297522 - RNA, 15 nt, Mycobacterium tuberculosis H37Rv
ccgcagauccccgcc

SEQ ID NO: 3297523 - RNA, 22 nt, Mycobacterium tuberculosis H37Rv
ccgcagaugcaguuccuugaga

SEQ ID NO: 3297524 - RNA, 13 nt, Mycobacterium tuberculosis H37Rv
ccgcagaugggcc

SEQ ID NO: 3297525 - RNA, 13 nt, Mycobacterium tuberculosis H37Rv
ccgcagcaccguc

SEQ ID NO: 3297526 - RNA, 15 nt, Mycobacterium tuberculosis H37Rv
ccgccaccagggcac

SEQ ID NO: 3297527 - RNA, 20 nt, Mycobacterium tuberculosis H37Rv
ccgccaccagggcacguucg

SEQ ID NO: 3297528 - RNA, 11 nt, Mycobacterium tuberculosis H37Rv
ccgccaccauc

SEQ ID NO: 3297529 - RNA, 19 nt, Mycobacterium tuberculosis H37Rv
ccgccaccccggucggagc

SEQ ID NO: 3297530 - RNA, 11 nt, Mycobacterium tuberculosis H37Rv
ccgccacccgc

SEQ ID NO: 3297531 - RNA, 13 nt, Mycobacterium tuberculosis H37Rv
ccgccacccggcg

SEQ ID NO: 3297532 - RNA, 11 nt, Mycobacterium tuberculosis H37Rv
ccgccacccuu

SEQ ID NO: 3297533 - RNA, 20 nt, Mycobacterium tuberculosis H37Rv
ccgccacccuuggcccggug

SEQ ID NO: 3297534 - RNA, 21 nt, Mycobacterium tuberculosis H37Rv
ccgccacccuuggcccggugc

SEQ ID NO: 3297535 - RNA, 19 nt, Mycobacterium tuberculosis H37Rv
ccgccaccgaacgcaccga

SEQ ID NO: 3297536 - RNA, 14 nt, Mycobacterium tuberculosis H37Rv
ccgccaccgccacc

SEQ ID NO: 3297537 - RNA, 15 nt, Mycobacterium tuberculosis H37Rv
ccgccaccgccaccg

SEQ ID NO: 3297538 - RNA, 14 nt, Mycobacterium tuberculosis H37Rv
ccgccaccgccagc

SEQ ID NO: 3297539 - RNA, 12 nt, Mycobacterium tuberculosis H37Rv
ccgccaccgcga

SEQ ID NO: 3297540 - RNA, 16 nt, Mycobacterium tuberculosis H37Rv
ccgccaccgcgacacc

SEQ ID NO: 3297541 - RNA, 14 nt, Mycobacterium tuberculosis H37Rv
ccgccaccgcgagc

SEQ ID NO: 3297542 - RNA, 16 nt, Mycobacterium tuberculosis H37Rv
ccgccaccgcggccug

SEQ ID NO: 3297543 - RNA, 14 nt, Mycobacterium tuberculosis H37Rv
ccgccaccggcuga

SEQ ID NO: 3297544 - RNA, 15 nt, Mycobacterium tuberculosis H37Rv
ccgccaccgucaccg

SEQ ID NO: 3297545 - RNA, 18 nt, Mycobacterium tuberculosis H37Rv
ccgccaccucccagggcu

SEQ ID NO: 3297546 - RNA, 15 nt, Mycobacterium tuberculosis H37Rv
ccgccaccucgccgg

SEQ ID NO: 3297547 - RNA, 14 nt, Mycobacterium tuberculosis H37Rv
ccgccacgccgaag

SEQ ID NO: 3297548 - RNA, 18 nt, Mycobacterium tuberculosis H37Rv
ccgccacggaucgcggcg

SEQ ID NO: 3297549 - RNA, 19 nt, Mycobacterium tuberculosis H37Rv
ccgccacggaucgcggcgg

SEQ ID NO: 3297550 - RNA, 14 nt, Mycobacterium tuberculosis H37Rv
ccgccacgggcggc

SEQ ID NO: 3297551 - RNA, 20 nt, Mycobacterium tuberculosis H37Rv
ccgccacgggcggccaccgc

SEQ ID NO: 3297552 - RNA, 18 nt, Mycobacterium tuberculosis H37Rv
ccgccacgguucgggcag

SEQ ID NO: 3297553 - RNA, 22 nt, Mycobacterium tuberculosis H37Rv
ccgccacguaauuccccagggg

SEQ ID NO: 3297554 - RNA, 18 nt, Mycobacterium tuberculosis H37Rv
ccgccacuggcgccggug

SEQ ID NO: 3297555 - RNA, 21 nt, Mycobacterium tuberculosis H37Rv
ccgccacuggcgccggugccg

SEQ ID NO: 3297556 - RNA, 23 nt, Mycobacterium tuberculosis H37Rv
ccgccacuggcgcugaucgccuc

SEQ ID NO: 3297557 - RNA, 21 nt, Mycobacterium tuberculosis H37Rv
ccgccacuugcgcacaguucg

SEQ ID NO: 3297558 - RNA, 12 nt, Mycobacterium tuberculosis H37Rv
ccgccagaaucc

SEQ ID NO: 3297559 - RNA, 15 nt, Mycobacterium tuberculosis H37Rv
ccgccagaaucccgc

SEQ ID NO: 3297560 - RNA, 17 nt, Mycobacterium tuberculosis H37Rv
ccgccagaccgcggcgg

SEQ ID NO: 3297561 - RNA, 18 nt, Mycobacterium tuberculosis H37Rv
ccgccagaccgcggcggc

SEQ ID NO: 3297562 - RNA, 18 nt, Mycobacterium tuberculosis H37Rv
ccgccagaucucgcgcgc

SEQ ID NO: 3297563 - RNA, 20 nt, Mycobacterium tuberculosis H37Rv
ccgccagauugccugacaac

SEQ ID NO: 3297564 - RNA, 20 nt, Mycobacterium tuberculosis H37Rv
ccgccagauuggcgcugccc

SEQ ID NO: 3297565 - RNA, 15 nt, Mycobacterium tuberculosis H37Rv
ccgccagcagggcca

SEQ ID NO: 3297566 - RNA, 16 nt, Mycobacterium tuberculosis H37Rv
ccgccagcaugacacc

SEQ ID NO: 3297567 - RNA, 20 nt, Mycobacterium tuberculosis H37Rv
ccgccagcaugacaccggcc

SEQ ID NO: 3297568 - RNA, 18 nt, Mycobacterium tuberculosis H37Rv
ccgccagcccagcacgcu

SEQ ID NO: 3297569 - RNA, 12 nt, Mycobacterium tuberculosis H37Rv
ccgccagcccca

SEQ ID NO: 3297570 - RNA, 21 nt, Mycobacterium tuberculosis H37Rv
ccgccagcccgucaucgcgua

SEQ ID NO: 3297571 - RNA, 16 nt, Mycobacterium tuberculosis H37Rv
ccgccagccgcgagcc

SEQ ID NO: 3297572 - RNA, 16 nt, Mycobacterium tuberculosis H37Rv
ccgccagccgguccag

SEQ ID NO: 3297573 - RNA, 20 nt, Mycobacterium tuberculosis H37Rv
ccgccagccuggucuuguug

SEQ ID NO: 3297574 - RNA, 12 nt, Mycobacterium tuberculosis H37Rv
ccgccagcgcac

SEQ ID NO: 3297575 - RNA, 16 nt, Mycobacterium tuberculosis H37Rv
ccgccagcgccaccgu

SEQ ID NO: 3297576 - RNA, 16 nt, Mycobacterium tuberculosis H37Rv
ccgccagcgccgccga

SEQ ID NO: 3297577 - RNA, 16 nt, Mycobacterium tuberculosis H37Rv
ccgccagcgccgccgg

SEQ ID NO: 3297578 - RNA, 19 nt, Mycobacterium tuberculosis H37Rv
ccgccagcgccgccggcgc

SEQ ID NO: 3297579 - RNA, 18 nt, Mycobacterium tuberculosis H37Rv
ccgccagcgccgcugaag

SEQ ID NO: 3297580 - RNA, 23 nt, Mycobacterium tuberculosis H37Rv
ccgccagcgcgccgaucacggug

SEQ ID NO: 3297581 - RNA, 14 nt, Mycobacterium tuberculosis H37Rv
ccgccagcggcaau

SEQ ID NO: 3297582 - RNA, 15 nt, Mycobacterium tuberculosis H37Rv
ccgccagcggcagcg

SEQ ID NO: 3297583 - RNA, 19 nt, Mycobacterium tuberculosis H37Rv
ccgccagcggcagcggcgu

SEQ ID NO: 3297584 - RNA, 16 nt, Mycobacterium tuberculosis H37Rv
ccgccagcgucgacac

SEQ ID NO: 3297585 - RNA, 16 nt, Mycobacterium tuberculosis H37Rv
ccgccagcugcgcagc

SEQ ID NO: 3297586 - RNA, 18 nt, Mycobacterium tuberculosis H37Rv
ccgccagcugggcagcca

SEQ ID NO: 3297587 - RNA, 14 nt, Mycobacterium tuberculosis H37Rv
ccgccaggccgacc

SEQ ID NO: 3297588 - RNA, 20 nt, Mycobacterium tuberculosis H37Rv
ccgccaggccgcgcgacaac

SEQ ID NO: 3297589 - RNA, 21 nt, Mycobacterium tuberculosis H37Rv
ccgccagguccgccggugccg

SEQ ID NO: 3297590 - RNA, 21 nt, Mycobacterium tuberculosis H37Rv
ccgccaggucgaggcaggccu

SEQ ID NO: 3297591 - RNA, 15 nt, Mycobacterium tuberculosis H37Rv
ccgccagucccccgc

SEQ ID NO: 3297592 - RNA, 17 nt, Mycobacterium tuberculosis H37Rv
ccgccagucccccgcuc

SEQ ID NO: 3297593 - RNA, 23 nt, Mycobacterium tuberculosis H37Rv
ccgccagucccccgcucgaccag

SEQ ID NO: 3297594 - RNA, 12 nt, Mycobacterium tuberculosis H37Rv
ccgccagugccc

SEQ ID NO: 3297595 - RNA, 13 nt, Mycobacterium tuberculosis H37Rv
ccgccaguucggc

SEQ ID NO: 3297596 - RNA, 21 nt, Mycobacterium tuberculosis H37Rv
ccgccaucaacaaggggcagc

SEQ ID NO: 3297597 - RNA, 15 nt, Mycobacterium tuberculosis H37Rv
ccgccaucaccgccg

SEQ ID NO: 3297598 - RNA, 14 nt, Mycobacterium tuberculosis H37Rv
ccgccaucagcccg

SEQ ID NO: 3297599 - RNA, 16 nt, Mycobacterium tuberculosis H37Rv
ccgccaucagcccggc

SEQ ID NO: 3297600 - RNA, 12 nt, Mycobacterium tuberculosis H37Rv
ccgccaucaucg

SEQ ID NO: 3297601 - RNA, 11 nt, Mycobacterium tuberculosis H37Rv
ccgccaucccc

SEQ ID NO: 3297602 - RNA, 21 nt, Mycobacterium tuberculosis H37Rv
ccgccauccgauggcccggcu

SEQ ID NO: 3297603 - RNA, 16 nt, Mycobacterium tuberculosis H37Rv
ccgccaucgcccgauc

SEQ ID NO: 3297604 - RNA, 13 nt, Mycobacterium tuberculosis H37Rv
ccgccaucgccgc

SEQ ID NO: 3297605 - RNA, 16 nt, Mycobacterium tuberculosis H37Rv
ccgccaucgccgccgg

SEQ ID NO: 3297606 - RNA, 22 nt, Mycobacterium tuberculosis H37Rv
ccgccaugagguaggucgccgc

SEQ ID NO: 3297607 - RNA, 13 nt, Mycobacterium tuberculosis H37Rv
ccgccaugcggcg

SEQ ID NO: 3297608 - RNA, 18 nt, Mycobacterium tuberculosis H37Rv
ccgccaugcggcgcgucg

SEQ ID NO: 3297609 - RNA, 18 nt, Mycobacterium tuberculosis H37Rv
ccgccauguacaggcccc

SEQ ID NO: 3297610 - RNA, 20 nt, Mycobacterium tuberculosis H37Rv
ccgccauguacaggccccac

SEQ ID NO: 3297611 - RNA, 21 nt, Mycobacterium tuberculosis H37Rv
ccgccauuccagccggugccg

SEQ ID NO: 3297612 - RNA, 13 nt, Mycobacterium tuberculosis H37Rv
ccgccauugccgc

SEQ ID NO: 3297613 - RNA, 16 nt, Mycobacterium tuberculosis H37Rv
ccgccauugccgccgg

SEQ ID NO: 3297614 - RNA, 19 nt, Mycobacterium tuberculosis H37Rv
ccgccauugccgccggcgc

SEQ ID NO: 3297615 - RNA, 18 nt, Mycobacterium tuberculosis H37Rv
ccgccauugccgccggug

SEQ ID NO: 3297616 - RNA, 22 nt, Mycobacterium tuberculosis H37Rv
ccgccauugccgccgucgccgc

SEQ ID NO: 3297617 - RNA, 16 nt, Mycobacterium tuberculosis H37Rv
ccgccauugccguccg

SEQ ID NO: 3297618 - RNA, 15 nt, Mycobacterium tuberculosis H37Rv
ccgccauugucgcca

SEQ ID NO: 3297619 - RNA, 16 nt, Mycobacterium tuberculosis H37Rv
ccgccauuucgcccga

SEQ ID NO: 3297620 - RNA, 20 nt, Mycobacterium tuberculosis H37Rv
ccgcccaagguggcggccag

SEQ ID NO: 3297621 - RNA, 18 nt, Mycobacterium tuberculosis H37Rv
ccgcccacaugaacgacc

SEQ ID NO: 3297622 - RNA, 22 nt, Mycobacterium tuberculosis H37Rv
ccgcccacaugaacgaccaccg

SEQ ID NO: 3297623 - RNA, 20 nt, Mycobacterium tuberculosis H37Rv
ccgcccaccacacagccgcg

SEQ ID NO: 3297624 - RNA, 15 nt, Mycobacterium tuberculosis H37Rv
ccgcccacgcugccc

SEQ ID NO: 3297625 - RNA, 15 nt, Mycobacterium tuberculosis H37Rv
ccgcccacggcacca

SEQ ID NO: 3297626 - RNA, 16 nt, Mycobacterium tuberculosis H37Rv
ccgcccagaccgccga

SEQ ID NO: 3297627 - RNA, 13 nt, Mycobacterium tuberculosis H37Rv
ccgcccagcagca

SEQ ID NO: 3297628 - RNA, 15 nt, Mycobacterium tuberculosis H37Rv
ccgcccagccgcagc

SEQ ID NO: 3297629 - RNA, 13 nt, Mycobacterium tuberculosis H37Rv
ccgcccagcgagg

SEQ ID NO: 3297630 - RNA, 13 nt, Mycobacterium tuberculosis H37Rv
ccgcccagugcca

SEQ ID NO: 3297631 - RNA, 14 nt, Mycobacterium tuberculosis H37Rv
ccgcccagugcggc

SEQ ID NO: 3297632 - RNA, 18 nt, Mycobacterium tuberculosis H37Rv
ccgcccccgccggccgcg

SEQ ID NO: 3297633 - RNA, 23 nt, Mycobacterium tuberculosis H37Rv
ccgcccccgccggccgcgccggc

SEQ ID NO: 3297634 - RNA, 14 nt, Mycobacterium tuberculosis H37Rv
ccgcccccgugggg

SEQ ID NO: 3297635 - RNA, 22 nt, Mycobacterium tuberculosis H37Rv
ccgcccccguuuacggcccggc

SEQ ID NO: 3297636 - RNA, 14 nt, Mycobacterium tuberculosis H37Rv
ccgccccggccagg

SEQ ID NO: 3297637 - RNA, 16 nt, Mycobacterium tuberculosis H37Rv
ccgccccggcggcggc

SEQ ID NO: 3297638 - RNA, 18 nt, Mycobacterium tuberculosis H37Rv
ccgccccggugaguccgg

SEQ ID NO: 3297639 - RNA, 20 nt, Mycobacterium tuberculosis H37Rv
ccgccccguugugucaccgg

SEQ ID NO: 3297640 - RNA, 22 nt, Mycobacterium tuberculosis H37Rv
ccgcccgaggcacccgugccgc

SEQ ID NO: 3297641 - RNA, 20 nt, Mycobacterium tuberculosis H37Rv
ccgcccgcacguucacgcgc

SEQ ID NO: 3297642 - RNA, 12 nt, Mycobacterium tuberculosis H37Rv
ccgcccgccagc

SEQ ID NO: 3297643 - RNA, 15 nt, Mycobacterium tuberculosis H37Rv
ccgcccgccagcgau

SEQ ID NO: 3297644 - RNA, 15 nt, Mycobacterium tuberculosis H37Rv
ccgcccgccaggccg

SEQ ID NO: 3297645 - RNA, 13 nt, Mycobacterium tuberculosis H37Rv
ccgcccgcccacc

SEQ ID NO: 3297646 - RNA, 15 nt, Mycobacterium tuberculosis H37Rv
ccgcccgcgccacca

SEQ ID NO: 3297647 - RNA, 21 nt, Mycobacterium tuberculosis H37Rv
ccgcccgcgccaccagcaccg

SEQ ID NO: 3297648 - RNA, 15 nt, Mycobacterium tuberculosis H37Rv
ccgcccgcgccaccg

SEQ ID NO: 3297649 - RNA, 17 nt, Mycobacterium tuberculosis H37Rv
ccgcccgcgccgcccgc

SEQ ID NO: 3297650 - RNA, 14 nt, Mycobacterium tuberculosis H37Rv
ccgcccgcgccucc

SEQ ID NO: 3297651 - RNA, 15 nt, Mycobacterium tuberculosis H37Rv
ccgcccgcgccuccg

SEQ ID NO: 3297652 - RNA, 22 nt, Mycobacterium tuberculosis H37Rv
ccgcccgcuccgccgucgccgc

SEQ ID NO: 3297653 - RNA, 15 nt, Mycobacterium tuberculosis H37Rv
ccgcccgcuccuccg

SEQ ID NO: 3297654 - RNA, 17 nt, Mycobacterium tuberculosis H37Rv
ccgcccgcugcggcggc

SEQ ID NO: 3297655 - RNA, 17 nt, Mycobacterium tuberculosis H37Rv
ccgcccgcugggcucgc

SEQ ID NO: 3297656 - RNA, 17 nt, Mycobacterium tuberculosis H37Rv
ccgcccggaaaggccgc

SEQ ID NO: 3297657 - RNA, 20 nt, Mycobacterium tuberculosis H37Rv
ccgcccggaaaggccgcggu

SEQ ID NO: 3297658 - RNA, 23 nt, Mycobacterium tuberculosis H37Rv
ccgcccggacgcaacacccgggc

SEQ ID NO: 3297659 - RNA, 21 nt, Mycobacterium tuberculosis H37Rv
ccgcccggcaguucgcggcca

SEQ ID NO: 3297660 - RNA, 13 nt, Mycobacterium tuberculosis H37Rv
ccgcccggccagc

SEQ ID NO: 3297661 - RNA, 24 nt, Mycobacterium tuberculosis H37Rv
ccgcccguagacccacagucgccg

SEQ ID NO: 3297662 - RNA, 18 nt, Mycobacterium tuberculosis H37Rv
ccgcccgugaucaccacg

SEQ ID NO: 3297663 - RNA, 13 nt, Mycobacterium tuberculosis H37Rv
ccgcccucaccgc

SEQ ID NO: 3297664 - RNA, 21 nt, Mycobacterium tuberculosis H37Rv
ccgcccucaccgccugugccg

SEQ ID NO: 3297665 - RNA, 20 nt, Mycobacterium tuberculosis H37Rv
ccgcccucccuggggccguc

SEQ ID NO: 3297666 - RNA, 15 nt, Mycobacterium tuberculosis H37Rv
ccgcccucggugaga

SEQ ID NO: 3297667 - RNA, 16 nt, Mycobacterium tuberculosis H37Rv
ccgcccugaccgcccg

SEQ ID NO: 3297668 - RNA, 18 nt, Mycobacterium tuberculosis H37Rv
ccgcccugaccgcccgca

SEQ ID NO: 3297669 - RNA, 15 nt, Mycobacterium tuberculosis H37Rv
ccgcccugguccagg

SEQ ID NO: 3297670 - RNA, 17 nt, Mycobacterium tuberculosis H37Rv
ccgcccugguccaggcc

SEQ ID NO: 3297671 - RNA, 24 nt, Mycobacterium tuberculosis H37Rv
ccgcccugguccaggcccuggcca

SEQ ID NO: 3297672 - RNA, 22 nt, Mycobacterium tuberculosis H37Rv
ccgcccuguccggguagcggcg

SEQ ID NO: 3297673 - RNA, 23 nt, Mycobacterium tuberculosis H37Rv
ccgcccuguccggguagcggcgc

SEQ ID NO: 3297674 - RNA, 17 nt, Mycobacterium tuberculosis H37Rv
ccgcccuugccgccagc

SEQ ID NO: 3297675 - RNA, 19 nt, Mycobacterium tuberculosis H37Rv
ccgcccuugccgccagccc

SEQ ID NO: 3297676 - RNA, 17 nt, Mycobacterium tuberculosis H37Rv
ccgcccuugccgcccgc

SEQ ID NO: 3297677 - RNA, 19 nt, Mycobacterium tuberculosis H37Rv
ccgcccuugccgccggccc

SEQ ID NO: 3297678 - RNA, 21 nt, Mycobacterium tuberculosis H37Rv
ccgcccuugccgccggccccg

SEQ ID NO: 3297679 - RNA, 22 nt, Mycobacterium tuberculosis H37Rv
ccgccgaaaaccucgaaaccgu

SEQ ID NO: 3297680 - RNA, 16 nt, Mycobacterium tuberculosis H37Rv
ccgccgaaacucacca

SEQ ID NO: 3297681 - RNA, 21 nt, Mycobacterium tuberculosis H37Rv
ccgccgaaacucaccagcacc

SEQ ID NO: 3297682 - RNA, 22 nt, Mycobacterium tuberculosis H37Rv
ccgccgaaagcaucaccaccgc

SEQ ID NO: 3297683 - RNA, 23 nt, Mycobacterium tuberculosis H37Rv
ccgccgaaagcaucaccaccgca

SEQ ID NO: 3297684 - RNA, 16 nt, Mycobacterium tuberculosis H37Rv
ccgccgaacaccggua

SEQ ID NO: 3297685 - RNA, 16 nt, Mycobacterium tuberculosis H37Rv
ccgccgaacagugucg

SEQ ID NO: 3297686 - RNA, 22 nt, Mycobacterium tuberculosis H37Rv
ccgccgaacgccucugcgauca

SEQ ID NO: 3297687 - RNA, 19 nt, Mycobacterium tuberculosis H37Rv
ccgccgaagaaggugacga

SEQ ID NO: 3297688 - RNA, 20 nt, Mycobacterium tuberculosis H37Rv
ccgccgaagaaggugacgau

SEQ ID NO: 3297689 - RNA, 14 nt, Mycobacterium tuberculosis H37Rv
ccgccgaagccgac

SEQ ID NO: 3297690 - RNA, 15 nt, Mycobacterium tuberculosis H37Rv
ccgccgaagccgcgc

SEQ ID NO: 3297691 - RNA, 16 nt, Mycobacterium tuberculosis H37Rv
ccgccgaagccgcgca

SEQ ID NO: 3297692 - RNA, 18 nt, Mycobacterium tuberculosis H37Rv
ccgccgaagccgcgcauc

SEQ ID NO: 3297693 - RNA, 22 nt, Mycobacterium tuberculosis H37Rv
ccgccgaaggcgggggagccca

SEQ ID NO: 3297694 - RNA, 16 nt, Mycobacterium tuberculosis H37Rv
ccgccgacaaccccgc

SEQ ID NO: 3297695 - RNA, 18 nt, Mycobacterium tuberculosis H37Rv
ccgccgacaaucaccaac

SEQ ID NO: 3297696 - RNA, 15 nt, Mycobacterium tuberculosis H37Rv
ccgccgacaccaccg

SEQ ID NO: 3297697 - RNA, 17 nt, Mycobacterium tuberculosis H37Rv
ccgccgacaccaccggc

SEQ ID NO: 3297698 - RNA, 19 nt, Mycobacterium tuberculosis H37Rv
ccgccgacaccaccggcgc

SEQ ID NO: 3297699 - RNA, 14 nt, Mycobacterium tuberculosis H37Rv
ccgccgacaccacg

SEQ ID NO: 3297700 - RNA, 20 nt, Mycobacterium tuberculosis H37Rv
ccgccgacacccccggugcc

SEQ ID NO: 3297701 - RNA, 17 nt, Mycobacterium tuberculosis H37Rv
ccgccgaccagaacgcc

SEQ ID NO: 3297702 - RNA, 13 nt, Mycobacterium tuberculosis H37Rv
ccgccgaccggac

SEQ ID NO: 3297703 - RNA, 18 nt, Mycobacterium tuberculosis H37Rv
ccgccgaccggagccgcc

SEQ ID NO: 3297704 - RNA, 17 nt, Mycobacterium tuberculosis H37Rv
ccgccgacgaccgccug

SEQ ID NO: 3297705 - RNA, 18 nt, Mycobacterium tuberculosis H37Rv
ccgccgacgaccgccugc

SEQ ID NO: 3297706 - RNA, 20 nt, Mycobacterium tuberculosis H37Rv
ccgccgacgccagauccuuc

SEQ ID NO: 3297707 - RNA, 13 nt, Mycobacterium tuberculosis H37Rv
ccgccgacgccgc

SEQ ID NO: 3297708 - RNA, 18 nt, Mycobacterium tuberculosis H37Rv
ccgccgacgccgccggca

SEQ ID NO: 3297709 - RNA, 15 nt, Mycobacterium tuberculosis H37Rv
ccgccgagauagcaa

SEQ ID NO: 3297710 - RNA, 22 nt, Mycobacterium tuberculosis H37Rv
ccgccgagauagcaacgaagcc

SEQ ID NO: 3297711 - RNA, 14 nt, Mycobacterium tuberculosis H37Rv
ccgccgagcaccgg

SEQ ID NO: 3297712 - RNA, 14 nt, Mycobacterium tuberculosis H37Rv
ccgccgagcagacg

SEQ ID NO: 3297713 - RNA, 16 nt, Mycobacterium tuberculosis H37Rv
ccgccgagcgguugcc

SEQ ID NO: 3297714 - RNA, 21 nt, Mycobacterium tuberculosis H37Rv
ccgccgagcucggucaccacg

SEQ ID NO: 3297715 - RNA, 13 nt, Mycobacterium tuberculosis H37Rv
ccgccgagcuggc

SEQ ID NO: 3297716 - RNA, 14 nt, Mycobacterium tuberculosis H37Rv
ccgccgagcuggcg

SEQ ID NO: 3297717 - RNA, 13 nt, Mycobacterium tuberculosis H37Rv
ccgccgaggccgc

SEQ ID NO: 3297718 - RNA, 16 nt, Mycobacterium tuberculosis H37Rv
ccgccgauaccgccgg

SEQ ID NO: 3297719 - RNA, 17 nt, Mycobacterium tuberculosis H37Rv
ccgccggcaccucccug

SEQ ID NO: 3297720 - RNA, 23 nt, Mycobacterium tuberculosis H37Rv
ccgccggcaccuccggcaccgcc

SEQ ID NO: 3297721 - RNA, 21 nt, Mycobacterium tuberculosis H37Rv
ccgccggcagugagucgguga

SEQ ID NO: 3297722 - RNA, 17 nt, Mycobacterium tuberculosis H37Rv
ccgccggccagcgucgc

SEQ ID NO: 3297723 - RNA, 15 nt, Mycobacterium tuberculosis H37Rv
ccgccggccagguga

SEQ ID NO: 3297724 - RNA, 18 nt, Mycobacterium tuberculosis H37Rv
ccgccggccaggugacgu

SEQ ID NO: 3297725 - RNA, 16 nt, Mycobacterium tuberculosis H37Rv
ccgccggccaugugca

SEQ ID NO: 3297726 - RNA, 12 nt, Mycobacterium tuberculosis H37Rv
ccgccggcccca

SEQ ID NO: 3297727 - RNA, 14 nt, Mycobacterium tuberculosis H37Rv
ccgccggccccacc

SEQ ID NO: 3297728 - RNA, 22 nt, Mycobacterium tuberculosis H37Rv
ccgccggccccaccggugccgc

SEQ ID NO: 3297729 - RNA, 15 nt, Mycobacterium tuberculosis H37Rv
ccgccggccccgcca

SEQ ID NO: 3297730 - RNA, 15 nt, Mycobacterium tuberculosis H37Rv
ccgccggccccgccg

SEQ ID NO: 3297731 - RNA, 21 nt, Mycobacterium tuberculosis H37Rv
ccgccggccccgccgaugccg

SEQ ID NO: 3297732 - RNA, 19 nt, Mycobacterium tuberculosis H37Rv
ccgccggccccgccgcuac

SEQ ID NO: 3297733 - RNA, 20 nt, Mycobacterium tuberculosis H37Rv
ccgccggccccgccggcccc

SEQ ID NO: 3297734 - RNA, 15 nt, Mycobacterium tuberculosis H37Rv
ccgccggccgccagc

SEQ ID NO: 3297735 - RNA, 18 nt, Mycobacterium tuberculosis H37Rv
ccgccggccgucgaucuu

SEQ ID NO: 3297736 - RNA, 20 nt, Mycobacterium tuberculosis H37Rv
ccgccggccuugugcucgau

SEQ ID NO: 3297737 - RNA, 15 nt, Mycobacterium tuberculosis H37Rv
ccgccggcgccaccc

SEQ ID NO: 3297738 - RNA, 14 nt, Mycobacterium tuberculosis H37Rv
ccgccggcgccagc

SEQ ID NO: 3297739 - RNA, 19 nt, Mycobacterium tuberculosis H37Rv
ccgccggcgccagcgccgc

SEQ ID NO: 3297740 - RNA, 13 nt, Mycobacterium tuberculosis H37Rv
ccgccggcgccca

SEQ ID NO: 3297741 - RNA, 15 nt, Mycobacterium tuberculosis H37Rv
ccgccggcgcccagg

SEQ ID NO: 3297742 - RNA, 22 nt, Mycobacterium tuberculosis H37Rv
ccgccggcgcccaggccgauca

SEQ ID NO: 3297743 - RNA, 15 nt, Mycobacterium tuberculosis H37Rv
ccgccggcgccgccc

SEQ ID NO: 3297744 - RNA, 16 nt, Mycobacterium tuberculosis H37Rv
ccgccggcgccgcccg

SEQ ID NO: 3297745 - RNA, 17 nt, Mycobacterium tuberculosis H37Rv
ccgccggcgccgcccgc

SEQ ID NO: 3297746 - RNA, 18 nt, Mycobacterium tuberculosis H37Rv
ccgccggcgccgccggca

SEQ ID NO: 3297747 - RNA, 15 nt, Mycobacterium tuberculosis H37Rv
ccgccggcgccggag

SEQ ID NO: 3297748 - RNA, 15 nt, Mycobacterium tuberculosis H37Rv
ccgccggcgccggug

SEQ ID NO: 3297749 - RNA, 18 nt, Mycobacterium tuberculosis H37Rv
ccgccggcgccggugccg

SEQ ID NO: 3297750 - RNA, 18 nt, Mycobacterium tuberculosis H37Rv
ccgccggcgcuggcgggc

SEQ ID NO: 3297751 - RNA, 21 nt, Mycobacterium tuberculosis H37Rv
ccgccggcggggugcgcccac

SEQ ID NO: 3297752 - RNA, 23 nt, Mycobacterium tuberculosis H37Rv
ccgccggcggggugcgcccaccg

SEQ ID NO: 3297753 - RNA, 18 nt, Mycobacterium tuberculosis H37Rv
ccgccggcggucgcguac

SEQ ID NO: 3297754 - RNA, 23 nt, Mycobacterium tuberculosis H37Rv
ccgccggcuccgccacuggcgcc

SEQ ID NO: 3297755 - RNA, 20 nt, Mycobacterium tuberculosis H37Rv
ccgccggcuccgccagcgcc

SEQ ID NO: 3297756 - RNA, 21 nt, Mycobacterium tuberculosis H37Rv
ccgccggcuccgccagcgccg

SEQ ID NO: 3297757 - RNA, 18 nt, Mycobacterium tuberculosis H37Rv
ccgccggcugcgccagua

SEQ ID NO: 3297758 - RNA, 15 nt, Mycobacterium tuberculosis H37Rv
ccgccgggaucaccg

SEQ ID NO: 3297759 - RNA, 14 nt, Mycobacterium tuberculosis H37Rv
ccgccgggccaggc

SEQ ID NO: 3297760 - RNA, 15 nt, Mycobacterium tuberculosis H37Rv
ccgccgggccaggcc

SEQ ID NO: 3297761 - RNA, 13 nt, Mycobacterium tuberculosis H37Rv
ccgccgggccccg

SEQ ID NO: 3297762 - RNA, 18 nt, Mycobacterium tuberculosis H37Rv
ccgccgggcccucgccau

SEQ ID NO: 3297763 - RNA, 14 nt, Mycobacterium tuberculosis H37Rv
ccgccgggcucagc

SEQ ID NO: 3297764 - RNA, 22 nt, Mycobacterium tuberculosis H37Rv
ccgccgggcucagcugggccgc

SEQ ID NO: 3297765 - RNA, 15 nt, Mycobacterium tuberculosis H37Rv
ccgccgggggcaccg

SEQ ID NO: 3297766 - RNA, 20 nt, Mycobacterium tuberculosis H37Rv
ccgccggguccggaaccggu

SEQ ID NO: 3297767 - RNA, 16 nt, Mycobacterium tuberculosis H37Rv
ccgccggguccuugcg

SEQ ID NO: 3297768 - RNA, 15 nt, Mycobacterium tuberculosis H37Rv
ccgccggguuggcgc

SEQ ID NO: 3297769 - RNA, 21 nt, Mycobacterium tuberculosis H37Rv
ccgccggguuggcgccggcca

SEQ ID NO: 3297770 - RNA, 17 nt, Mycobacterium tuberculosis H37Rv
ccgccggucccgcgugc

SEQ ID NO: 3297771 - RNA, 18 nt, Mycobacterium tuberculosis H37Rv
ccgccggucccgcgugcc

SEQ ID NO: 3297772 - RNA, 19 nt, Mycobacterium tuberculosis H37Rv
ccgccggugaggaucagcg

SEQ ID NO: 3297773 - RNA, 19 nt, Mycobacterium tuberculosis H37Rv
ccgccggugccaccgacgc

SEQ ID NO: 3297774 - RNA, 18 nt, Mycobacterium tuberculosis H37Rv
ccgccggugccaccggcu

SEQ ID NO: 3297775 - RNA, 17 nt, Mycobacterium tuberculosis H37Rv
ccgccggugccgaucag

SEQ ID NO: 3297776 - RNA, 13 nt, Mycobacterium tuberculosis H37Rv
ccgccggugccgc

SEQ ID NO: 3297777 - RNA, 22 nt, Mycobacterium tuberculosis H37Rv
ccgccggugccgccauugacgc

SEQ ID NO: 3297778 - RNA, 16 nt, Mycobacterium tuberculosis H37Rv
ccgccggugccgcccg

SEQ ID NO: 3297779 - RNA, 16 nt, Mycobacterium tuberculosis H37Rv
ccgccggugccgccgc

SEQ ID NO: 3297780 - RNA, 18 nt, Mycobacterium tuberculosis H37Rv
ccgccggugccgccggug

SEQ ID NO: 3297781 - RNA, 22 nt, Mycobacterium tuberculosis H37Rv
ccgccggugccgccggugccgc

SEQ ID NO: 3297782 - RNA, 16 nt, Mycobacterium tuberculosis H37Rv
ccgccggugccgccgu

SEQ ID NO: 3297783 - RNA, 16 nt, Mycobacterium tuberculosis H37Rv
ccgccggugccgccug

SEQ ID NO: 3297784 - RNA, 17 nt, Mycobacterium tuberculosis H37Rv
ccgccggugccgccugc

SEQ ID NO: 3297785 - RNA, 20 nt, Mycobacterium tuberculosis H37Rv
ccgccgguggcgccggggcc

SEQ ID NO: 3297786 - RNA, 17 nt, Mycobacterium tuberculosis H37Rv
ccgccgguuccgccggc

SEQ ID NO: 3297787 - RNA, 22 nt, Mycobacterium tuberculosis H37Rv
ccgccguaccgaagcggaucug

SEQ ID NO: 3297788 - RNA, 19 nt, Mycobacterium tuberculosis H37Rv
ccgccguagaccagccguc

SEQ ID NO: 3297789 - RNA, 20 nt, Mycobacterium tuberculosis H37Rv
ccgccguagaccagccgucg

SEQ ID NO: 3297790 - RNA, 15 nt, Mycobacterium tuberculosis H37Rv
ccgccgucacccccg

SEQ ID NO: 3297791 - RNA, 16 nt, Mycobacterium tuberculosis H37Rv
ccgccgucaccccgau

SEQ ID NO: 3297792 - RNA, 19 nt, Mycobacterium tuberculosis H37Rv
ccgccgucaccccgauucg

SEQ ID NO: 3297793 - RNA, 20 nt, Mycobacterium tuberculosis H37Rv
ccgccgucaccgccauugcc

SEQ ID NO: 3297794 - RNA, 16 nt, Mycobacterium tuberculosis H37Rv
ccgccgucaccgccga

SEQ ID NO: 3297795 - RNA, 13 nt, Mycobacterium tuberculosis H37Rv
ccgccguccagcg

SEQ ID NO: 3297796 - RNA, 15 nt, Mycobacterium tuberculosis H37Rv
ccgccguccagcgcc

SEQ ID NO: 3297797 - RNA, 16 nt, Mycobacterium tuberculosis H37Rv
ccgccguccagcgccg

SEQ ID NO: 3297798 - RNA, 13 nt, Mycobacterium tuberculosis H37Rv
ccgccguccccgc

SEQ ID NO: 3297799 - RNA, 16 nt, Mycobacterium tuberculosis H37Rv
ccgccguccccgccgc

SEQ ID NO: 3297800 - RNA, 20 nt, Mycobacterium tuberculosis H37Rv
ccgccguccccgccgucgcc

SEQ ID NO: 3297801 - RNA, 21 nt, Mycobacterium tuberculosis H37Rv
ccgccguccccgccgucgcca

SEQ ID NO: 3297802 - RNA, 15 nt, Mycobacterium tuberculosis H37Rv
ccgccgucgaccacg

SEQ ID NO: 3297803 - RNA, 13 nt, Mycobacterium tuberculosis H37Rv
ccgccgucgacgu

SEQ ID NO: 3297804 - RNA, 13 nt, Mycobacterium tuberculosis H37Rv
ccgccgucgccgc

SEQ ID NO: 3297805 - RNA, 19 nt, Mycobacterium tuberculosis H37Rv
ccgccgucgccgccgcuac

SEQ ID NO: 3297806 - RNA, 18 nt, Mycobacterium tuberculosis H37Rv
ccgccgucgccggugccg

SEQ ID NO: 3297807 - RNA, 14 nt, Mycobacterium tuberculosis H37Rv
ccgccgucgccucc

SEQ ID NO: 3297808 - RNA, 19 nt, Mycobacterium tuberculosis H37Rv
ccgccgucgccuccgcuac

SEQ ID NO: 3297809 - RNA, 20 nt, Mycobacterium tuberculosis H37Rv
ccgccgucggcaucgacgcg

SEQ ID NO: 3297810 - RNA, 22 nt, Mycobacterium tuberculosis H37Rv
ccgccgucggguugcgacgaac

SEQ ID NO: 3297811 - RNA, 19 nt, Mycobacterium tuberculosis H37Rv
ccgccgucguugcccgacc

SEQ ID NO: 3297812 - RNA, 21 nt, Mycobacterium tuberculosis H37Rv
ccgccgucguugcccgacccg

SEQ ID NO: 3297813 - RNA, 22 nt, Mycobacterium tuberculosis H37Rv
ccgccgucguugcccgacccgc

SEQ ID NO: 3297814 - RNA, 14 nt, Mycobacterium tuberculosis H37Rv
ccgccgugcugcgg

SEQ ID NO: 3297815 - RNA, 18 nt, Mycobacterium tuberculosis H37Rv
ccgcgaccucgcggcgcu

SEQ ID NO: 3297816 - RNA, 15 nt, Mycobacterium tuberculosis H37Rv
ccgcgacgacgaggu

SEQ ID NO: 3297817 - RNA, 22 nt, Mycobacterium tuberculosis H37Rv
ccgcgacgacugucccagcucc

SEQ ID NO: 3297818 - RNA, 15 nt, Mycobacterium tuberculosis H37Rv
ccgcgacgagcggcc

SEQ ID NO: 3297819 - RNA, 17 nt, Mycobacterium tuberculosis H37Rv
ccgcgacggcacgauca

SEQ ID NO: 3297820 - RNA, 20 nt, Mycobacterium tuberculosis H37Rv
ccgcgacggcgccggcaucg

SEQ ID NO: 3297821 - RNA, 13 nt, Mycobacterium tuberculosis H37Rv
ccgcgacugacga

SEQ ID NO: 3297822 - RNA, 20 nt, Mycobacterium tuberculosis H37Rv
ccgcgagacgcaugucgggc

SEQ ID NO: 3297823 - RNA, 20 nt, Mycobacterium tuberculosis H37Rv
ccgcgagagaguucgcaugc

SEQ ID NO: 3297824 - RNA, 14 nt, Mycobacterium tuberculosis H37Rv
ccgcgagcccggcc

SEQ ID NO: 3297825 - RNA, 18 nt, Mycobacterium tuberculosis H37Rv
ccgcgagcgccggccgcg

SEQ ID NO: 3297826 - RNA, 18 nt, Mycobacterium tuberculosis H37Rv
ccgcgagcgcgcgacugu

SEQ ID NO: 3297827 - RNA, 20 nt, Mycobacterium tuberculosis H37Rv
ccgcgaggcaagaacccgau

SEQ ID NO: 3297828 - RNA, 19 nt, Mycobacterium tuberculosis H37Rv
ccgcgagguacccaucguc

SEQ ID NO: 3297829 - RNA, 22 nt, Mycobacterium tuberculosis H37Rv
ccgcgagguacccaucgucgag

SEQ ID NO: 3297830 - RNA, 17 nt, Mycobacterium tuberculosis H37Rv
ccgcgaguaaucgaccg

SEQ ID NO: 3297831 - RNA, 21 nt, Mycobacterium tuberculosis H37Rv
ccgcgauccagcgcugaccgg

SEQ ID NO: 3297832 - RNA, 16 nt, Mycobacterium tuberculosis H37Rv
ccgcgaucgacggugu

SEQ ID NO: 3297833 - RNA, 11 nt, Mycobacterium tuberculosis H37Rv
ccgcgaucgcc

SEQ ID NO: 3297834 - RNA, 23 nt, Mycobacterium tuberculosis H37Rv
ccgcgaucgccgacgccagaacg

SEQ ID NO: 3297835 - RNA, 16 nt, Mycobacterium tuberculosis H37Rv
ccgcgaucgcgacacg

SEQ ID NO: 3297836 - RNA, 15 nt, Mycobacterium tuberculosis H37Rv
ccgcgaucuccuugg

SEQ ID NO: 3297837 - RNA, 14 nt, Mycobacterium tuberculosis H37Rv
ccgcgaugacgacc

SEQ ID NO: 3297838 - RNA, 23 nt, Mycobacterium tuberculosis H37Rv
ccgcgaugacgaccgaucggcgc

SEQ ID NO: 3297839 - RNA, 19 nt, Mycobacterium tuberculosis H37Rv
ccgcgaugacgacgaaccg

SEQ ID NO: 3297840 - RNA, 21 nt, Mycobacterium tuberculosis H37Rv
ccgcgaugacgacgaaccggu

SEQ ID NO: 3297841 - RNA, 20 nt, Mycobacterium tuberculosis H37Rv
ccgcgaugacggugccgacc

SEQ ID NO: 3297842 - RNA, 16 nt, Mycobacterium tuberculosis H37Rv
ccgcgaugagcggcgc

SEQ ID NO: 3297843 - RNA, 21 nt, Mycobacterium tuberculosis H37Rv
ccgcgaugagcggcgcggcaa

SEQ ID NO: 3297844 - RNA, 20 nt, Mycobacterium tuberculosis H37Rv
ccgcgaugaucgcaucgacg

SEQ ID NO: 3297845 - RNA, 17 nt, Mycobacterium tuberculosis H37Rv
ccgcgauggccgcgugc

SEQ ID NO: 3297846 - RNA, 16 nt, Mycobacterium tuberculosis H37Rv
ccgcgaugggauaccg

SEQ ID NO: 3297847 - RNA, 20 nt, Mycobacterium tuberculosis H37Rv
ccgcgaugggauaccgcguc

SEQ ID NO: 3297848 - RNA, 21 nt, Mycobacterium tuberculosis H37Rv
ccgcgauggugcgccgggcgu

SEQ ID NO: 3297849 - RNA, 12 nt, Mycobacterium tuberculosis H37Rv
ccgcgauucgcg

SEQ ID NO: 3297850 - RNA, 15 nt, Mycobacterium tuberculosis H37Rv
ccgcgcaacccggac

SEQ ID NO: 3297851 - RNA, 14 nt, Mycobacterium tuberculosis H37Rv
ccgcgcaaccggcc

SEQ ID NO: 3297852 - RNA, 18 nt, Mycobacterium tuberculosis H37Rv
ccgcgcaaccggccgucc

SEQ ID NO: 3297853 - RNA, 20 nt, Mycobacterium tuberculosis H37Rv
ccgcgcaaccggccguccag

SEQ ID NO: 3297854 - RNA, 15 nt, Mycobacterium tuberculosis H37Rv
ccgcgcaccgaccgc

SEQ ID NO: 3297855 - RNA, 19 nt, Mycobacterium tuberculosis H37Rv
ccgcgcaccgaccgcaccg

SEQ ID NO: 3297856 - RNA, 15 nt, Mycobacterium tuberculosis H37Rv
ccgcgcaccgcggga

SEQ ID NO: 3297857 - RNA, 14 nt, Mycobacterium tuberculosis H37Rv
ccgcgcacgacaac

SEQ ID NO: 3297858 - RNA, 22 nt, Mycobacterium tuberculosis H37Rv
ccgcgcacgacaacuucgccgg

SEQ ID NO: 3297859 - RNA, 13 nt, Mycobacterium tuberculosis H37Rv
ccgcgcacggcug

SEQ ID NO: 3297860 - RNA, 17 nt, Mycobacterium tuberculosis H37Rv
ccgcgcagauucccggc

SEQ ID NO: 3297861 - RNA, 16 nt, Mycobacterium tuberculosis H37Rv
ccgcgcagcacugcgg

SEQ ID NO: 3297862 - RNA, 20 nt, Mycobacterium tuberculosis H37Rv
ccgcgcagcacugcggcagc

SEQ ID NO: 3297863 - RNA, 14 nt, Mycobacterium tuberculosis H37Rv
ccgcgcagccggcc

SEQ ID NO: 3297864 - RNA, 16 nt, Mycobacterium tuberculosis H37Rv
ccgcgcagccggcccg

SEQ ID NO: 3297865 - RNA, 19 nt, Mycobacterium tuberculosis H37Rv
ccgcgcagcgguccgccgc

SEQ ID NO: 3297866 - RNA, 12 nt, Mycobacterium tuberculosis H37Rv
ccgcgcagcguc

SEQ ID NO: 3297867 - RNA, 18 nt, Mycobacterium tuberculosis H37Rv
ccgcgcagcugccgcacc

SEQ ID NO: 3297868 - RNA, 22 nt, Mycobacterium tuberculosis H37Rv
ccgcgcaggugccuuucggcag

SEQ ID NO: 3297869 - RNA, 18 nt, Mycobacterium tuberculosis H37Rv
ccgcgcaucaucgcccac

SEQ ID NO: 3297870 - RNA, 16 nt, Mycobacterium tuberculosis H37Rv
ccgcgcaucugucgcg

SEQ ID NO: 3297871 - RNA, 18 nt, Mycobacterium tuberculosis H37Rv
ccgcgccaccagcaccgc

SEQ ID NO: 3297872 - RNA, 13 nt, Mycobacterium tuberculosis H37Rv
ccgcgccagccuc

SEQ ID NO: 3297873 - RNA, 17 nt, Mycobacterium tuberculosis H37Rv
ccgcgccagccuccacc

SEQ ID NO: 3297874 - RNA, 18 nt, Mycobacterium tuberculosis H37Rv
ccgcgccagccuccacca

SEQ ID NO: 3297875 - RNA, 13 nt, Mycobacterium tuberculosis H37Rv
ccgcgccaguggc

SEQ ID NO: 3297876 - RNA, 16 nt, Mycobacterium tuberculosis H37Rv
ccgcgccaguggccac

SEQ ID NO: 3297877 - RNA, 20 nt, Mycobacterium tuberculosis H37Rv
ccgcgccaguggccaccauc

SEQ ID NO: 3297878 - RNA, 13 nt, Mycobacterium tuberculosis H37Rv
ccgcgcccacccc

SEQ ID NO: 3297879 - RNA, 14 nt, Mycobacterium tuberculosis H37Rv
ccgcgcccgagccg

SEQ ID NO: 3297880 - RNA, 13 nt, Mycobacterium tuberculosis H37Rv
ccgcgcccgccgc

SEQ ID NO: 3297881 - RNA, 19 nt, Mycobacterium tuberculosis H37Rv
ccgcgcccgccgcggcagc

SEQ ID NO: 3297882 - RNA, 12 nt, Mycobacterium tuberculosis H37Rv
ccgcgcccggcg

SEQ ID NO: 3297883 - RNA, 22 nt, Mycobacterium tuberculosis H37Rv
ccgcgcccggcgcuagcgccgc

SEQ ID NO: 3297884 - RNA, 14 nt, Mycobacterium tuberculosis H37Rv
ccgcgcccuggccu

SEQ ID NO: 3297885 - RNA, 16 nt, Mycobacterium tuberculosis H37Rv
ccgcgcccuucagcac

SEQ ID NO: 3297886 - RNA, 16 nt, Mycobacterium tuberculosis H37Rv
ccgcgccgaaucgcgg

SEQ ID NO: 3297887 - RNA, 15 nt, Mycobacterium tuberculosis H37Rv
ccgcgccgacgccgc

SEQ ID NO: 3297888 - RNA, 14 nt, Mycobacterium tuberculosis H37Rv
ccgcgccgagcccg

SEQ ID NO: 3297889 - RNA, 19 nt, Mycobacterium tuberculosis H37Rv
ccgcgccgauuccaccgcc

SEQ ID NO: 3297890 - RNA, 13 nt, Mycobacterium tuberculosis H37Rv
ccgcgccgccagc

SEQ ID NO: 3297891 - RNA, 14 nt, Mycobacterium tuberculosis H37Rv
ccgcgccgccagcg

SEQ ID NO: 3297892 - RNA, 16 nt, Mycobacterium tuberculosis H37Rv
ccgcgccgccagcgcc

SEQ ID NO: 3297893 - RNA, 15 nt, Mycobacterium tuberculosis H37Rv
ccgcgccgccgccac

SEQ ID NO: 3297894 - RNA, 19 nt, Mycobacterium tuberculosis H37Rv
ccgcgccgccgccaccacc

SEQ ID NO: 3297895 - RNA, 20 nt, Mycobacterium tuberculosis H37Rv
ccgcgccgccggacccaccg

SEQ ID NO: 3297896 - RNA, 20 nt, Mycobacterium tuberculosis H37Rv
ccgcgccgccucgggcaccu

SEQ ID NO: 3297897 - RNA, 20 nt, Mycobacterium tuberculosis H37Rv
ccgcgccgcggcccgcucca

SEQ ID NO: 3297898 - RNA, 19 nt, Mycobacterium tuberculosis H37Rv
ccgcgccggacagcgcauc

SEQ ID NO: 3297899 - RNA, 22 nt, Mycobacterium tuberculosis H37Rv
ccgcgccggcagacccgggcca

SEQ ID NO: 3297900 - RNA, 14 nt, Mycobacterium tuberculosis H37Rv
ccgcgccggccccg

SEQ ID NO: 3297901 - RNA, 24 nt, Mycobacterium tuberculosis H37Rv
ccgcgccggccgcacgccggccag

SEQ ID NO: 3297902 - RNA, 16 nt, Mycobacterium tuberculosis H37Rv
ccgcgccggcgggcga

SEQ ID NO: 3297903 - RNA, 12 nt, Mycobacterium tuberculosis H37Rv
ccgcgccgucgg

SEQ ID NO: 3297904 - RNA, 12 nt, Mycobacterium tuberculosis H37Rv
ccgcgccgucgu

SEQ ID NO: 3297905 - RNA, 13 nt, Mycobacterium tuberculosis H37Rv
ccgcgccuccguu

SEQ ID NO: 3297906 - RNA, 15 nt, Mycobacterium tuberculosis H37Rv
ccgcgccuccguugc

SEQ ID NO: 3297907 - RNA, 13 nt, Mycobacterium tuberculosis H37Rv
ccgcgccucgguc

SEQ ID NO: 3297908 - RNA, 15 nt, Mycobacterium tuberculosis H37Rv
ccgcgccugccucac

SEQ ID NO: 3297909 - RNA, 17 nt, Mycobacterium tuberculosis H37Rv
ccgcgccuuggcacccu

SEQ ID NO: 3297910 - RNA, 15 nt, Mycobacterium tuberculosis H37Rv
ccgcgcgacaacccg

SEQ ID NO: 3297911 - RNA, 17 nt, Mycobacterium tuberculosis H37Rv
ccgcgcgacaacccggc

SEQ ID NO: 3297912 - RNA, 14 nt, Mycobacterium tuberculosis H37Rv
ccgcggcgcgcaac

SEQ ID NO: 3297913 - RNA, 20 nt, Mycobacterium tuberculosis H37Rv
ccgcggcgcggcgggcagcg

SEQ ID NO: 3297914 - RNA, 17 nt, Mycobacterium tuberculosis H37Rv
ccgcggcggcagcaccc

SEQ ID NO: 3297915 - RNA, 20 nt, Mycobacterium tuberculosis H37Rv
ccgcggcggcagcggcgauc

SEQ ID NO: 3297916 - RNA, 21 nt, Mycobacterium tuberculosis H37Rv
ccgcggcggcaucgaggccag

SEQ ID NO: 3297917 - RNA, 17 nt, Mycobacterium tuberculosis H37Rv
ccgcggcggccccgcgc

SEQ ID NO: 3297918 - RNA, 20 nt, Mycobacterium tuberculosis H37Rv
ccgcggcggccccgcgccac

SEQ ID NO: 3297919 - RNA, 19 nt, Mycobacterium tuberculosis H37Rv
ccgcggcgguaaaccuggc

SEQ ID NO: 3297920 - RNA, 13 nt, Mycobacterium tuberculosis H37Rv
ccgcggcggucag

SEQ ID NO: 3297921 - RNA, 17 nt, Mycobacterium tuberculosis H37Rv
ccgcggcgucgccgugc

SEQ ID NO: 3297922 - RNA, 23 nt, Mycobacterium tuberculosis H37Rv
ccgcggcguuaagguacccgguc

SEQ ID NO: 3297923 - RNA, 23 nt, Mycobacterium tuberculosis H37Rv
ccgcggcuaggccagcacggcga

SEQ ID NO: 3297924 - RNA, 12 nt, Mycobacterium tuberculosis H37Rv
ccgcggcugcca

SEQ ID NO: 3297925 - RNA, 17 nt, Mycobacterium tuberculosis H37Rv
ccgcggcugccaucccg

SEQ ID NO: 3297926 - RNA, 20 nt, Mycobacterium tuberculosis H37Rv
ccgcgggacaucaccgcagc

SEQ ID NO: 3297927 - RNA, 21 nt, Mycobacterium tuberculosis H37Rv
ccgcgggaccuucgagccgca

SEQ ID NO: 3297928 - RNA, 21 nt, Mycobacterium tuberculosis H37Rv
ccgcgggaucgguggcggcac

SEQ ID NO: 3297929 - RNA, 20 nt, Mycobacterium tuberculosis H37Rv
ccgcgggcagcguguaaccg

SEQ ID NO: 3297930 - RNA, 18 nt, Mycobacterium tuberculosis H37Rv
ccgcgggcaguggcagcc

SEQ ID NO: 3297931 - RNA, 15 nt, Mycobacterium tuberculosis H37Rv
ccgcgggccagcacc

SEQ ID NO: 3297932 - RNA, 17 nt, Mycobacterium tuberculosis H37Rv
ccgcgggccagcaccuc

SEQ ID NO: 3297933 - RNA, 21 nt, Mycobacterium tuberculosis H37Rv
ccgcgggcgccuuccaggcgg

SEQ ID NO: 3297934 - RNA, 17 nt, Mycobacterium tuberculosis H37Rv
ccgcgggcggaggccgc

SEQ ID NO: 3297935 - RNA, 19 nt, Mycobacterium tuberculosis H37Rv
ccgcgggcggcaucgccga

SEQ ID NO: 3297936 - RNA, 14 nt, Mycobacterium tuberculosis H37Rv
ccgcgggcguugcu

SEQ ID NO: 3297937 - RNA, 15 nt, Mycobacterium tuberculosis H37Rv
ccgcggggcaucggu

SEQ ID NO: 3297938 - RNA, 18 nt, Mycobacterium tuberculosis H37Rv
ccgcgggggaccgcccga

SEQ ID NO: 3297939 - RNA, 17 nt, Mycobacterium tuberculosis H37Rv
ccgcgggguaguucguu

SEQ ID NO: 3297940 - RNA, 12 nt, Mycobacterium tuberculosis H37Rv
ccgcgggucccg

SEQ ID NO: 3297941 - RNA, 22 nt, Mycobacterium tuberculosis H37Rv
ccgcgggucguccggcggcagg

SEQ ID NO: 3297942 - RNA, 18 nt, Mycobacterium tuberculosis H37Rv
ccgcgguaauggcgugca

SEQ ID NO: 3297943 - RNA, 15 nt, Mycobacterium tuberculosis H37Rv
ccgcgguacccaccu

SEQ ID NO: 3297944 - RNA, 19 nt, Mycobacterium tuberculosis H37Rv
ccgcgguacccaccucccg

SEQ ID NO: 3297945 - RNA, 15 nt, Mycobacterium tuberculosis H37Rv
ccgcggucagcucgg

SEQ ID NO: 3297946 - RNA, 18 nt, Mycobacterium tuberculosis H37Rv
ccgcggucagcucggcag

SEQ ID NO: 3297947 - RNA, 12 nt, Mycobacterium tuberculosis H37Rv
ccgcggucgcca

SEQ ID NO: 3297948 - RNA, 12 nt, Mycobacterium tuberculosis H37Rv
ccgcggucggcc

SEQ ID NO: 3297949 - RNA, 14 nt, Mycobacterium tuberculosis H37Rv
ccgcggucggccac

SEQ ID NO: 3297950 - RNA, 16 nt, Mycobacterium tuberculosis H37Rv
ccgcggucggccacca

SEQ ID NO: 3297951 - RNA, 20 nt, Mycobacterium tuberculosis H37Rv
ccgcggucggccaccaacuc

SEQ ID NO: 3297952 - RNA, 13 nt, Mycobacterium tuberculosis H37Rv
ccgcggucggcga

SEQ ID NO: 3297953 - RNA, 23 nt, Mycobacterium tuberculosis H37Rv
ccgcggucucagugcucgcccag

SEQ ID NO: 3297954 - RNA, 20 nt, Mycobacterium tuberculosis H37Rv
ccgcggucucggugccgagc

SEQ ID NO: 3297955 - RNA, 22 nt, Mycobacterium tuberculosis H37Rv
ccgcggucugcgccuucgccag

SEQ ID NO: 3297956 - RNA, 15 nt, Mycobacterium tuberculosis H37Rv
ccgcggucuucuuca

SEQ ID NO: 3297957 - RNA, 16 nt, Mycobacterium tuberculosis H37Rv
ccgcggugacgccagc

SEQ ID NO: 3297958 - RNA, 17 nt, Mycobacterium tuberculosis H37Rv
ccgcggugacggcggcu

SEQ ID NO: 3297959 - RNA, 19 nt, Mycobacterium tuberculosis H37Rv
ccgcggugacucggccucc

SEQ ID NO: 3297960 - RNA, 13 nt, Mycobacterium tuberculosis H37Rv
ccgcgguggccag

SEQ ID NO: 3297961 - RNA, 17 nt, Mycobacterium tuberculosis H37Rv
ccgcgguggcggcgagc

SEQ ID NO: 3297962 - RNA, 18 nt, Mycobacterium tuberculosis H37Rv
ccgcgguggggucgacgc

SEQ ID NO: 3297963 - RNA, 17 nt, Mycobacterium tuberculosis H37Rv
ccgcgguguauccgacg

SEQ ID NO: 3297964 - RNA, 19 nt, Mycobacterium tuberculosis H37Rv
ccgcgguguggcuugcguc

SEQ ID NO: 3297965 - RNA, 18 nt, Mycobacterium tuberculosis H37Rv
ccgcguaaaccggcugac

SEQ ID NO: 3297966 - RNA, 18 nt, Mycobacterium tuberculosis H37Rv
ccgcguaauucgacuucg

SEQ ID NO: 3297967 - RNA, 17 nt, Mycobacterium tuberculosis H37Rv
ccgcguacaggccggcc

SEQ ID NO: 3297968 - RNA, 15 nt, Mycobacterium tuberculosis H37Rv
ccgcguagaccagug

SEQ ID NO: 3297969 - RNA, 16 nt, Mycobacterium tuberculosis H37Rv
ccgcguagaccaguga

SEQ ID NO: 3297970 - RNA, 23 nt, Mycobacterium tuberculosis H37Rv
ccgcguagaccagugaccgcagu

SEQ ID NO: 3297971 - RNA, 16 nt, Mycobacterium tuberculosis H37Rv
ccgcguagguggccag

SEQ ID NO: 3297972 - RNA, 15 nt, Mycobacterium tuberculosis H37Rv
ccgcgucaccggagg

SEQ ID NO: 3297973 - RNA, 22 nt, Mycobacterium tuberculosis H37Rv
ccgcgucaccggaggccgccgc

SEQ ID NO: 3297974 - RNA, 23 nt, Mycobacterium tuberculosis H37Rv
ccgcgucacggaccuggaacugc

SEQ ID NO: 3297975 - RNA, 23 nt, Mycobacterium tuberculosis H37Rv
ccgcgucaucaccgguacugcga

SEQ ID NO: 3297976 - RNA, 15 nt, Mycobacterium tuberculosis H37Rv
ccgcgucgaacuggg

SEQ ID NO: 3297977 - RNA, 16 nt, Mycobacterium tuberculosis H37Rv
ccgcgucgaacugggc

SEQ ID NO: 3297978 - RNA, 12 nt, Mycobacterium tuberculosis H37Rv
ccgcgucgacga

SEQ ID NO: 3297979 - RNA, 12 nt, Mycobacterium tuberculosis H37Rv
ccgcgucgccgg

SEQ ID NO: 3297980 - RNA, 16 nt, Mycobacterium tuberculosis H37Rv
ccgcgucggccgcgcu

SEQ ID NO: 3297981 - RNA, 12 nt, Mycobacterium tuberculosis H37Rv
ccgcgucggcgg

SEQ ID NO: 3297982 - RNA, 15 nt, Mycobacterium tuberculosis H37Rv
ccgcgucggcguucu

SEQ ID NO: 3297983 - RNA, 14 nt, Mycobacterium tuberculosis H37Rv
ccgcgucgucgaga

SEQ ID NO: 3297984 - RNA, 16 nt, Mycobacterium tuberculosis H37Rv
ccgcgucuaccaaccg

SEQ ID NO: 3297985 - RNA, 20 nt, Mycobacterium tuberculosis H37Rv
ccgcgucuaccaaccgguac

SEQ ID NO: 3297986 - RNA, 22 nt, Mycobacterium tuberculosis H37Rv
ccgcgucuuggugcgcgucagc

SEQ ID NO: 3297987 - RNA, 13 nt, Mycobacterium tuberculosis H37Rv
ccgcgugaccgac

SEQ ID NO: 3297988 - RNA, 15 nt, Mycobacterium tuberculosis H37Rv
ccgcgugccacucga

SEQ ID NO: 3297989 - RNA, 13 nt, Mycobacterium tuberculosis H37Rv
ccgcgugccgccc

SEQ ID NO: 3297990 - RNA, 18 nt, Mycobacterium tuberculosis H37Rv
ccgcgugcgcaucccgaa

SEQ ID NO: 3297991 - RNA, 16 nt, Mycobacterium tuberculosis H37Rv
ccgcgugcgucagcgc

SEQ ID NO: 3297992 - RNA, 17 nt, Mycobacterium tuberculosis H37Rv
ccgcgugcucgagcacc

SEQ ID NO: 3297993 - RNA, 13 nt, Mycobacterium tuberculosis H37Rv
ccgcguggcuggc

SEQ ID NO: 3297994 - RNA, 15 nt, Mycobacterium tuberculosis H37Rv
ccgcguggcuggcgg

SEQ ID NO: 3297995 - RNA, 20 nt, Mycobacterium tuberculosis H37Rv
ccgcguggugcugaccgcgc

SEQ ID NO: 3297996 - RNA, 23 nt, Mycobacterium tuberculosis H37Rv
ccgcgugguuccggcgugcagca

SEQ ID NO: 3297997 - RNA, 18 nt, Mycobacterium tuberculosis H37Rv
ccgcguuaugccaggcgc

SEQ ID NO: 3297998 - RNA, 20 nt, Mycobacterium tuberculosis H37Rv
ccgcguucgagagccccgac

SEQ ID NO: 3297999 - RNA, 19 nt, Mycobacterium tuberculosis H37Rv
ccgcguugaugaccgccgc

SEQ ID NO: 3298000 - RNA, 22 nt, Mycobacterium tuberculosis H37Rv
ccgcguugaugaccgccgccgg

SEQ ID NO: 3298001 - RNA, 13 nt, Mycobacterium tuberculosis H37Rv
ccgcguugccaaa

SEQ ID NO: 3298002 - RNA, 22 nt, Mycobacterium tuberculosis H37Rv
ccgcguugccgggguuggucgu

SEQ ID NO: 3298003 - RNA, 13 nt, Mycobacterium tuberculosis H37Rv
ccgcguuggccac

SEQ ID NO: 3298004 - RNA, 22 nt, Mycobacterium tuberculosis H37Rv
ccgcguuuauaccucgccgccc

SEQ ID NO: 3298005 - RNA, 15 nt, Mycobacterium tuberculosis H37Rv
ccgcguuucgcgacg

SEQ ID NO: 3298006 - RNA, 22 nt, Mycobacterium tuberculosis H37Rv
ccgcguuucgcgacgucugcca

SEQ ID NO: 3298007 - RNA, 13 nt, Mycobacterium tuberculosis H37Rv
ccgcuaacgcacc

SEQ ID NO: 3298008 - RNA, 23 nt, Mycobacterium tuberculosis H37Rv
ccgcuggcauaucccuugccguc

SEQ ID NO: 3298009 - RNA, 20 nt, Mycobacterium tuberculosis H37Rv
ccgcuggccaugcggaaagc

SEQ ID NO: 3298010 - RNA, 13 nt, Mycobacterium tuberculosis H37Rv
ccgcuggcccgcc

SEQ ID NO: 3298011 - RNA, 23 nt, Mycobacterium tuberculosis H37Rv
ccgcuggccguauaggcccgggc

SEQ ID NO: 3298012 - RNA, 19 nt, Mycobacterium tuberculosis H37Rv
ccgcuggcgguaagcgaaa

SEQ ID NO: 3298013 - RNA, 20 nt, Mycobacterium tuberculosis H37Rv
ccgcuggcucaucgaagcuu

SEQ ID NO: 3298014 - RNA, 12 nt, Mycobacterium tuberculosis H37Rv
ccgcugggccgg

SEQ ID NO: 3298015 - RNA, 16 nt, Mycobacterium tuberculosis H37Rv
ccgcuggggcgcccga

SEQ ID NO: 3298016 - RNA, 15 nt, Mycobacterium tuberculosis H37Rv
ccgcugggucgaccg

SEQ ID NO: 3298017 - RNA, 12 nt, Mycobacterium tuberculosis H37Rv
ccgcugggucgc

SEQ ID NO: 3298018 - RNA, 14 nt, Mycobacterium tuberculosis H37Rv
ccgcugggugacca

SEQ ID NO: 3298019 - RNA, 19 nt, Mycobacterium tuberculosis H37Rv
ccgcuggucgaccggcguu

SEQ ID NO: 3298020 - RNA, 17 nt, Mycobacterium tuberculosis H37Rv
ccgcuggucgucgaguu

SEQ ID NO: 3298021 - RNA, 20 nt, Mycobacterium tuberculosis H37Rv
ccgcugguggucagcaccca

SEQ ID NO: 3298022 - RNA, 20 nt, Mycobacterium tuberculosis H37Rv
ccgcugugcggucgucaccg

SEQ ID NO: 3298023 - RNA, 18 nt, Mycobacterium tuberculosis H37Rv
ccgcuguguucagcgcau

SEQ ID NO: 3298024 - RNA, 19 nt, Mycobacterium tuberculosis H37Rv
ccgcuguguucagcgcauu

SEQ ID NO: 3298025 - RNA, 19 nt, Mycobacterium tuberculosis H37Rv
ccgcuguucuuggugacca

SEQ ID NO: 3298026 - RNA, 18 nt, Mycobacterium tuberculosis H37Rv
ccgcuuagcaaucggcag

SEQ ID NO: 3298027 - RNA, 21 nt, Mycobacterium tuberculosis H37Rv
ccgcuuaucgaacgucucggc

SEQ ID NO: 3298028 - RNA, 13 nt, Mycobacterium tuberculosis H37Rv
ccgcuucagcacg

SEQ ID NO: 3298029 - RNA, 17 nt, Mycobacterium tuberculosis H37Rv
ccgcuucgcccggcugc

SEQ ID NO: 3298030 - RNA, 20 nt, Mycobacterium tuberculosis H37Rv
ccgcuucgcccggcugcgcc

SEQ ID NO: 3298031 - RNA, 19 nt, Mycobacterium tuberculosis H37Rv
ccgcuugcccgcgcagcac

SEQ ID NO: 3298032 - RNA, 20 nt, Mycobacterium tuberculosis H37Rv
ccgcuugccggacaacugga

SEQ ID NO: 3298033 - RNA, 13 nt, Mycobacterium tuberculosis H37Rv
ccgcuugcggggc

SEQ ID NO: 3298034 - RNA, 16 nt, Mycobacterium tuberculosis H37Rv
ccgcuuggccgcugcc

SEQ ID NO: 3298035 - RNA, 14 nt, Mycobacterium tuberculosis H37Rv
ccgcuuggcgcggc

SEQ ID NO: 3298036 - RNA, 13 nt, Mycobacterium tuberculosis H37Rv
ccgcuugggccug

SEQ ID NO: 3298037 - RNA, 16 nt, Mycobacterium tuberculosis H37Rv
ccgcuugggcgguguc

SEQ ID NO: 3298038 - RNA, 13 nt, Mycobacterium tuberculosis H37Rv
ccgcuugguguga

SEQ ID NO: 3298039 - RNA, 13 nt, Mycobacterium tuberculosis H37Rv
ccgcuuucuuggc

SEQ ID NO: 3298040 - RNA, 17 nt, Mycobacterium tuberculosis H37Rv
ccgcuuucuuggcgggc

SEQ ID NO: 3298041 - RNA, 14 nt, Mycobacterium tuberculosis H37Rv
ccggaaaccacagc

SEQ ID NO: 3298042 - RNA, 15 nt, Mycobacterium tuberculosis H37Rv
ccggaaaccacagcg

SEQ ID NO: 3298043 - RNA, 19 nt, Mycobacterium tuberculosis H37Rv
ccggaaagcccgucgucgg

SEQ ID NO: 3298044 - RNA, 21 nt, Mycobacterium tuberculosis H37Rv
ccggaaagccuaguacgccga

SEQ ID NO: 3298045 - RNA, 18 nt, Mycobacterium tuberculosis H37Rv
ccggaaccggacagcgua

SEQ ID NO: 3298046 - RNA, 17 nt, Mycobacterium tuberculosis H37Rv
ccggaaccggucagccg

SEQ ID NO: 3298047 - RNA, 18 nt, Mycobacterium tuberculosis H37Rv
ccggaaccggucagccgg

SEQ ID NO: 3298048 - RNA, 20 nt, Mycobacterium tuberculosis H37Rv
ccggaacgagcggccgcgcg

SEQ ID NO: 3298049 - RNA, 21 nt, Mycobacterium tuberculosis H37Rv
ccggaacuguggugccugcgg

SEQ ID NO: 3298050 - RNA, 21 nt, Mycobacterium tuberculosis H37Rv
ccggaagcgccggccgaucgg

SEQ ID NO: 3298051 - RNA, 16 nt, Mycobacterium tuberculosis H37Rv
ccggaagcggcguucg

SEQ ID NO: 3298052 - RNA, 21 nt, Mycobacterium tuberculosis H37Rv
ccggaagcggcguucgaugcc

SEQ ID NO: 3298053 - RNA, 12 nt, Mycobacterium tuberculosis H37Rv
ccggaauacacc

SEQ ID NO: 3298054 - RNA, 13 nt, Mycobacterium tuberculosis H37Rv
ccggaaucccgag

SEQ ID NO: 3298055 - RNA, 16 nt, Mycobacterium tuberculosis H37Rv
ccggaauccgggccgc

SEQ ID NO: 3298056 - RNA, 16 nt, Mycobacterium tuberculosis H37Rv
ccggaaucgucgcggc

SEQ ID NO: 3298057 - RNA, 21 nt, Mycobacterium tuberculosis H37Rv
ccggaaucgucgcggccgucg

SEQ ID NO: 3298058 - RNA, 16 nt, Mycobacterium tuberculosis H37Rv
ccggaaugcccgagca

SEQ ID NO: 3298059 - RNA, 21 nt, Mycobacterium tuberculosis H37Rv
ccggacaaagcugcucgucgg

SEQ ID NO: 3298060 - RNA, 16 nt, Mycobacterium tuberculosis H37Rv
ccggacaacugguggc

SEQ ID NO: 3298061 - RNA, 22 nt, Mycobacterium tuberculosis H37Rv
ccggacaagguauccaacgcgc

SEQ ID NO: 3298062 - RNA, 22 nt, Mycobacterium tuberculosis H37Rv
ccggacagaucaacgcgaaccg

SEQ ID NO: 3298063 - RNA, 13 nt, Mycobacterium tuberculosis H37Rv
ccggacagcucgc

SEQ ID NO: 3298064 - RNA, 16 nt, Mycobacterium tuberculosis H37Rv
ccggacauccgaugcg

SEQ ID NO: 3298065 - RNA, 15 nt, Mycobacterium tuberculosis H37Rv
ccggacaugcgggca

SEQ ID NO: 3298066 - RNA, 17 nt, Mycobacterium tuberculosis H37Rv
ccggacaugcgggcagc

SEQ ID NO: 3298067 - RNA, 18 nt, Mycobacterium tuberculosis H37Rv
ccggaccaccgggccgac

SEQ ID NO: 3298068 - RNA, 13 nt, Mycobacterium tuberculosis H37Rv
ccggaccagagcc

SEQ ID NO: 3298069 - RNA, 16 nt, Mycobacterium tuberculosis H37Rv
ccggaccaucgacaac

SEQ ID NO: 3298070 - RNA, 18 nt, Mycobacterium tuberculosis H37Rv
ccggacccacccgcaccg

SEQ ID NO: 3298071 - RNA, 21 nt, Mycobacterium tuberculosis H37Rv
ccggacccuuacccggcgcga

SEQ ID NO: 3298072 - RNA, 21 nt, Mycobacterium tuberculosis H37Rv
ccggaccgaagaccuccucgg

SEQ ID NO: 3298073 - RNA, 23 nt, Mycobacterium tuberculosis H37Rv
ccggaccgcggauuccagcgcgu

SEQ ID NO: 3298074 - RNA, 15 nt, Mycobacterium tuberculosis H37Rv
ccggaccgcggccac

SEQ ID NO: 3298075 - RNA, 22 nt, Mycobacterium tuberculosis H37Rv
ccggaccgggggaagcgguagc

SEQ ID NO: 3298076 - RNA, 15 nt, Mycobacterium tuberculosis H37Rv
ccggaccuuguuggc

SEQ ID NO: 3298077 - RNA, 14 nt, Mycobacterium tuberculosis H37Rv
ccggacgaccggaa

SEQ ID NO: 3298078 - RNA, 16 nt, Mycobacterium tuberculosis H37Rv
ccggacgaucagggug

SEQ ID NO: 3298079 - RNA, 18 nt, Mycobacterium tuberculosis H37Rv
ccggacgcaacacccggg

SEQ ID NO: 3298080 - RNA, 21 nt, Mycobacterium tuberculosis H37Rv
ccggacggggaggucaaaauc

SEQ ID NO: 3298081 - RNA, 16 nt, Mycobacterium tuberculosis H37Rv
ccggacguucuggauc

SEQ ID NO: 3298082 - RNA, 14 nt, Mycobacterium tuberculosis H37Rv
ccggacuaccgccg

SEQ ID NO: 3298083 - RNA, 18 nt, Mycobacterium tuberculosis H37Rv
ccggacuaccgccggcgg

SEQ ID NO: 3298084 - RNA, 20 nt, Mycobacterium tuberculosis H37Rv
ccggacuaccgccggcggcg

SEQ ID NO: 3298085 - RNA, 21 nt, Mycobacterium tuberculosis H37Rv
ccggacuccaaagccgugcca

SEQ ID NO: 3298086 - RNA, 19 nt, Mycobacterium tuberculosis H37Rv
ccggacucuccccuggccc

SEQ ID NO: 3298087 - RNA, 15 nt, Mycobacterium tuberculosis H37Rv
ccggacugaagccgc

SEQ ID NO: 3298088 - RNA, 21 nt, Mycobacterium tuberculosis H37Rv
ccggacugcggcccgacccgg

SEQ ID NO: 3298089 - RNA, 14 nt, Mycobacterium tuberculosis H37Rv
ccggagacacccgc

SEQ ID NO: 3298090 - RNA, 14 nt, Mycobacterium tuberculosis H37Rv
ccggagacucucug

SEQ ID NO: 3298091 - RNA, 18 nt, Mycobacterium tuberculosis H37Rv
ccggagaucccgguccca

SEQ ID NO: 3298092 - RNA, 19 nt, Mycobacterium tuberculosis H37Rv
ccggagaucccggucccaa

SEQ ID NO: 3298093 - RNA, 22 nt, Mycobacterium tuberculosis H37Rv
ccggagaucuugcgcaaugccg

SEQ ID NO: 3298094 - RNA, 22 nt, Mycobacterium tuberculosis H37Rv
ccggagaugaucaugugguggc

SEQ ID NO: 3298095 - RNA, 22 nt, Mycobacterium tuberculosis H37Rv
ccggagccccugucaacgccgc

SEQ ID NO: 3298096 - RNA, 22 nt, Mycobacterium tuberculosis H37Rv
ccggagccgcccaagccgccgg

SEQ ID NO: 3298097 - RNA, 13 nt, Mycobacterium tuberculosis H37Rv
ccggagccgccgg

SEQ ID NO: 3298098 - RNA, 16 nt, Mycobacterium tuberculosis H37Rv
ccggagccgccggccc

SEQ ID NO: 3298099 - RNA, 17 nt, Mycobacterium tuberculosis H37Rv
ccggagccgccggcccc

SEQ ID NO: 3298100 - RNA, 19 nt, Mycobacterium tuberculosis H37Rv
ccggagccgcuacguuacg

SEQ ID NO: 3298101 - RNA, 16 nt, Mycobacterium tuberculosis H37Rv
ccggagccggugccga

SEQ ID NO: 3298102 - RNA, 21 nt, Mycobacterium tuberculosis H37Rv
ccggagcgccgagcucggcgc

SEQ ID NO: 3298103 - RNA, 15 nt, Mycobacterium tuberculosis H37Rv
ccggagcggucagcg

SEQ ID NO: 3298104 - RNA, 17 nt, Mycobacterium tuberculosis H37Rv
ccggcacgcaugccggu

SEQ ID NO: 3298105 - RNA, 19 nt, Mycobacterium tuberculosis H37Rv
ccggcacggugucgcgcga

SEQ ID NO: 3298106 - RNA, 16 nt, Mycobacterium tuberculosis H37Rv
ccggcacugaccgcga

SEQ ID NO: 3298107 - RNA, 14 nt, Mycobacterium tuberculosis H37Rv
ccggcacugcccag

SEQ ID NO: 3298108 - RNA, 18 nt, Mycobacterium tuberculosis H37Rv
ccggcacugcggccaguc

SEQ ID NO: 3298109 - RNA, 16 nt, Mycobacterium tuberculosis H37Rv
ccggcagaugcagcgg

SEQ ID NO: 3298110 - RNA, 22 nt, Mycobacterium tuberculosis H37Rv
ccggcagaugcagcgggucgcc

SEQ ID NO: 3298111 - RNA, 22 nt, Mycobacterium tuberculosis H37Rv
ccggcagcaucggcaccccggc

SEQ ID NO: 3298112 - RNA, 19 nt, Mycobacterium tuberculosis H37Rv
ccggcagcgcccccggacu

SEQ ID NO: 3298113 - RNA, 21 nt, Mycobacterium tuberculosis H37Rv
ccggcagcgcggaugucggca

SEQ ID NO: 3298114 - RNA, 16 nt, Mycobacterium tuberculosis H37Rv
ccggcagcggcgcgcu

SEQ ID NO: 3298115 - RNA, 20 nt, Mycobacterium tuberculosis H37Rv
ccggcagcggcgcucggcgc

SEQ ID NO: 3298116 - RNA, 13 nt, Mycobacterium tuberculosis H37Rv
ccggcagcggcug

SEQ ID NO: 3298117 - RNA, 20 nt, Mycobacterium tuberculosis H37Rv
ccggcagcgguaagcgcauc

SEQ ID NO: 3298118 - RNA, 20 nt, Mycobacterium tuberculosis H37Rv
ccggcagcgguggcaagccu

SEQ ID NO: 3298119 - RNA, 21 nt, Mycobacterium tuberculosis H37Rv
ccggcagcguccgaaccaccu

SEQ ID NO: 3298120 - RNA, 22 nt, Mycobacterium tuberculosis H37Rv
ccggcagcguccgaaccaccug

SEQ ID NO: 3298121 - RNA, 21 nt, Mycobacterium tuberculosis H37Rv
ccggcagcgucggccgguacg

SEQ ID NO: 3298122 - RNA, 19 nt, Mycobacterium tuberculosis H37Rv
ccggcagcugcucggucag

SEQ ID NO: 3298123 - RNA, 19 nt, Mycobacterium tuberculosis H37Rv
ccggcagcuugcagugccg

SEQ ID NO: 3298124 - RNA, 14 nt, Mycobacterium tuberculosis H37Rv
ccggcauaacgauc

SEQ ID NO: 3298125 - RNA, 15 nt, Mycobacterium tuberculosis H37Rv
ccggcauacaccgug

SEQ ID NO: 3298126 - RNA, 17 nt, Mycobacterium tuberculosis H37Rv
ccggcauacaucgccuu

SEQ ID NO: 3298127 - RNA, 20 nt, Mycobacterium tuberculosis H37Rv
ccggcauacaucgccuugcc

SEQ ID NO: 3298128 - RNA, 22 nt, Mycobacterium tuberculosis H37Rv
ccggcauaccgaacagcaccuc

SEQ ID NO: 3298129 - RNA, 17 nt, Mycobacterium tuberculosis H37Rv
ccggcauagcggcccau

SEQ ID NO: 3298130 - RNA, 17 nt, Mycobacterium tuberculosis H37Rv
ccggcauccucaacaac

SEQ ID NO: 3298131 - RNA, 13 nt, Mycobacterium tuberculosis H37Rv
ccggcaucgcgcg

SEQ ID NO: 3298132 - RNA, 15 nt, Mycobacterium tuberculosis H37Rv
ccggcaucggucagc

SEQ ID NO: 3298133 - RNA, 20 nt, Mycobacterium tuberculosis H37Rv
ccggcaucuccaccgucgcc

SEQ ID NO: 3298134 - RNA, 22 nt, Mycobacterium tuberculosis H37Rv
ccggcaucuccaccgucgccgc

SEQ ID NO: 3298135 - RNA, 21 nt, Mycobacterium tuberculosis H37Rv
ccggcaugcccgcggugacca

SEQ ID NO: 3298136 - RNA, 22 nt, Mycobacterium tuberculosis H37Rv
ccggcaugccgccaugcgcacc

SEQ ID NO: 3298137 - RNA, 23 nt, Mycobacterium tuberculosis H37Rv
ccggcaugccgccaugcgcacca

SEQ ID NO: 3298138 - RNA, 20 nt, Mycobacterium tuberculosis H37Rv
ccggcaugcgugccggcagc

SEQ ID NO: 3298139 - RNA, 16 nt, Mycobacterium tuberculosis H37Rv
ccggcauggcggcaua

SEQ ID NO: 3298140 - RNA, 20 nt, Mycobacterium tuberculosis H37Rv
ccggcauuccguaggccaca

SEQ ID NO: 3298141 - RNA, 23 nt, Mycobacterium tuberculosis H37Rv
ccggccaaaacauaucggugccg

SEQ ID NO: 3298142 - RNA, 19 nt, Mycobacterium tuberculosis H37Rv
ccggccaaaauuuugucgg

SEQ ID NO: 3298143 - RNA, 16 nt, Mycobacterium tuberculosis H37Rv
ccggccaacagucgca

SEQ ID NO: 3298144 - RNA, 13 nt, Mycobacterium tuberculosis H37Rv
ccggccaacuggg

SEQ ID NO: 3298145 - RNA, 14 nt, Mycobacterium tuberculosis H37Rv
ccggccaacugggc

SEQ ID NO: 3298146 - RNA, 19 nt, Mycobacterium tuberculosis H37Rv
ccggccaacugggccgagc

SEQ ID NO: 3298147 - RNA, 13 nt, Mycobacterium tuberculosis H37Rv
ccggccaagccgg

SEQ ID NO: 3298148 - RNA, 18 nt, Mycobacterium tuberculosis H37Rv
ccggccaagccggcgagu

SEQ ID NO: 3298149 - RNA, 15 nt, Mycobacterium tuberculosis H37Rv
ccggccaauggccug

SEQ ID NO: 3298150 - RNA, 19 nt, Mycobacterium tuberculosis H37Rv
ccggccaauggccugcagc

SEQ ID NO: 3298151 - RNA, 14 nt, Mycobacterium tuberculosis H37Rv
ccggccaccaccgc

SEQ ID NO: 3298152 - RNA, 12 nt, Mycobacterium tuberculosis H37Rv
ccggccaccacg

SEQ ID NO: 3298153 - RNA, 12 nt, Mycobacterium tuberculosis H37Rv
ccggccaccagc

SEQ ID NO: 3298154 - RNA, 20 nt, Mycobacterium tuberculosis H37Rv
ccggccacgaccucgggauc

SEQ ID NO: 3298155 - RNA, 16 nt, Mycobacterium tuberculosis H37Rv
ccggccacgagucgca

SEQ ID NO: 3298156 - RNA, 18 nt, Mycobacterium tuberculosis H37Rv
ccggccacgguccggccc

SEQ ID NO: 3298157 - RNA, 22 nt, Mycobacterium tuberculosis H37Rv
ccggccacgguccggcccacca

SEQ ID NO: 3298158 - RNA, 17 nt, Mycobacterium tuberculosis H37Rv
ccggccacuacggccug

SEQ ID NO: 3298159 - RNA, 21 nt, Mycobacterium tuberculosis H37Rv
ccggccacuacggccuggcca

SEQ ID NO: 3298160 - RNA, 22 nt, Mycobacterium tuberculosis H37Rv
ccggccacuccaguacgguccg

SEQ ID NO: 3298161 - RNA, 20 nt, Mycobacterium tuberculosis H37Rv
ccggccagacggugcagcuc

SEQ ID NO: 3298162 - RNA, 15 nt, Mycobacterium tuberculosis H37Rv
ccggccagauggugg

SEQ ID NO: 3298163 - RNA, 14 nt, Mycobacterium tuberculosis H37Rv
ccggccagcacucc

SEQ ID NO: 3298164 - RNA, 16 nt, Mycobacterium tuberculosis H37Rv
ccggccagcagguccg

SEQ ID NO: 3298165 - RNA, 11 nt, Mycobacterium tuberculosis H37Rv
ccggccagcgg

SEQ ID NO: 3298166 - RNA, 21 nt, Mycobacterium tuberculosis H37Rv
ccggccagcggccauccggcg

SEQ ID NO: 3298167 - RNA, 12 nt, Mycobacterium tuberculosis H37Rv
ccggccaggccg

SEQ ID NO: 3298168 - RNA, 13 nt, Mycobacterium tuberculosis H37Rv
ccggccaggccga

SEQ ID NO: 3298169 - RNA, 16 nt, Mycobacterium tuberculosis H37Rv
ccggccaggccgacaa

SEQ ID NO: 3298170 - RNA, 16 nt, Mycobacterium tuberculosis H37Rv
ccggccaggccggcgg

SEQ ID NO: 3298171 - RNA, 19 nt, Mycobacterium tuberculosis H37Rv
ccggccaggggaucaccgg

SEQ ID NO: 3298172 - RNA, 17 nt, Mycobacterium tuberculosis H37Rv
ccggccaggggcgcagc

SEQ ID NO: 3298173 - RNA, 17 nt, Mycobacterium tuberculosis H37Rv
ccggccagguauguccg

SEQ ID NO: 3298174 - RNA, 17 nt, Mycobacterium tuberculosis H37Rv
ccggccaggucgacacc

SEQ ID NO: 3298175 - RNA, 18 nt, Mycobacterium tuberculosis H37Rv
ccggccaggucgacaccg

SEQ ID NO: 3298176 - RNA, 22 nt, Mycobacterium tuberculosis H37Rv
ccggccaggucgacaccgcggu

SEQ ID NO: 3298177 - RNA, 15 nt, Mycobacterium tuberculosis H37Rv
ccggccaggugacgu

SEQ ID NO: 3298178 - RNA, 17 nt, Mycobacterium tuberculosis H37Rv
ccggccauaccgcucgc

SEQ ID NO: 3298179 - RNA, 19 nt, Mycobacterium tuberculosis H37Rv
ccggccauaccgcucgccg

SEQ ID NO: 3298180 - RNA, 16 nt, Mycobacterium tuberculosis H37Rv
ccggccaucgcccgau

SEQ ID NO: 3298181 - RNA, 21 nt, Mycobacterium tuberculosis H37Rv
ccggccauugcgggcucaaca

SEQ ID NO: 3298182 - RNA, 18 nt, Mycobacterium tuberculosis H37Rv
ccggcccaccagcgcagc

SEQ ID NO: 3298183 - RNA, 15 nt, Mycobacterium tuberculosis H37Rv
ccggcccaccaggcc

SEQ ID NO: 3298184 - RNA, 13 nt, Mycobacterium tuberculosis H37Rv
ccggcccagaucg

SEQ ID NO: 3298185 - RNA, 14 nt, Mycobacterium tuberculosis H37Rv
ccggccccaccggc

SEQ ID NO: 3298186 - RNA, 14 nt, Mycobacterium tuberculosis H37Rv
ccggccccaccggu

SEQ ID NO: 3298187 - RNA, 14 nt, Mycobacterium tuberculosis H37Rv
ccggccccgccgau

SEQ ID NO: 3298188 - RNA, 14 nt, Mycobacterium tuberculosis H37Rv
ccggccccgccggc

SEQ ID NO: 3298189 - RNA, 16 nt, Mycobacterium tuberculosis H37Rv
ccggccccgccggccc

SEQ ID NO: 3298190 - RNA, 18 nt, Mycobacterium tuberculosis H37Rv
ccggccccgccggccccg

SEQ ID NO: 3298191 - RNA, 16 nt, Mycobacterium tuberculosis H37Rv
ccggccccgccgucac

SEQ ID NO: 3298192 - RNA, 24 nt, Mycobacterium tuberculosis H37Rv
ccggccccgccguuuccgccgccg

SEQ ID NO: 3298193 - RNA, 17 nt, Mycobacterium tuberculosis H37Rv
ccggcccgaagaucucc

SEQ ID NO: 3298194 - RNA, 21 nt, Mycobacterium tuberculosis H37Rv
ccggcccgaagaucuccuccu

SEQ ID NO: 3298195 - RNA, 19 nt, Mycobacterium tuberculosis H37Rv
ccggcccgcaacgcgucgg

SEQ ID NO: 3298196 - RNA, 14 nt, Mycobacterium tuberculosis H37Rv
ccggcccgcagcca

SEQ ID NO: 3298197 - RNA, 15 nt, Mycobacterium tuberculosis H37Rv
ccggcccgcauccgc

SEQ ID NO: 3298198 - RNA, 19 nt, Mycobacterium tuberculosis H37Rv
ccggcccgcauccgcaccg

SEQ ID NO: 3298199 - RNA, 13 nt, Mycobacterium tuberculosis H37Rv
ccggcccgcccgu

SEQ ID NO: 3298200 - RNA, 18 nt, Mycobacterium tuberculosis H37Rv
ccggcgccagcgccgcca

SEQ ID NO: 3298201 - RNA, 21 nt, Mycobacterium tuberculosis H37Rv
ccggcgccagcgccgccaccg

SEQ ID NO: 3298202 - RNA, 20 nt, Mycobacterium tuberculosis H37Rv
ccggcgccauucgccccacc

SEQ ID NO: 3298203 - RNA, 22 nt, Mycobacterium tuberculosis H37Rv
ccggcgcccacaucgucggcgg

SEQ ID NO: 3298204 - RNA, 23 nt, Mycobacterium tuberculosis H37Rv
ccggcgcccagcgccucgauggu

SEQ ID NO: 3298205 - RNA, 13 nt, Mycobacterium tuberculosis H37Rv
ccggcgcccaggc

SEQ ID NO: 3298206 - RNA, 14 nt, Mycobacterium tuberculosis H37Rv
ccggcgcccaggcc

SEQ ID NO: 3298207 - RNA, 15 nt, Mycobacterium tuberculosis H37Rv
ccggcgcccgccgcg

SEQ ID NO: 3298208 - RNA, 20 nt, Mycobacterium tuberculosis H37Rv
ccggcgccgaaaacaacccg

SEQ ID NO: 3298209 - RNA, 13 nt, Mycobacterium tuberculosis H37Rv
ccggcgccgccac

SEQ ID NO: 3298210 - RNA, 16 nt, Mycobacterium tuberculosis H37Rv
ccggcgccgccacugc

SEQ ID NO: 3298211 - RNA, 14 nt, Mycobacterium tuberculosis H37Rv
ccggcgccgccagc

SEQ ID NO: 3298212 - RNA, 13 nt, Mycobacterium tuberculosis H37Rv
ccggcgccgccau

SEQ ID NO: 3298213 - RNA, 17 nt, Mycobacterium tuberculosis H37Rv
ccggcgccgccauugcc

SEQ ID NO: 3298214 - RNA, 13 nt, Mycobacterium tuberculosis H37Rv
ccggcgccgcccg

SEQ ID NO: 3298215 - RNA, 13 nt, Mycobacterium tuberculosis H37Rv
ccggcgccgcccu

SEQ ID NO: 3298216 - RNA, 17 nt, Mycobacterium tuberculosis H37Rv
ccggcgccgcccuugcc

SEQ ID NO: 3298217 - RNA, 12 nt, Mycobacterium tuberculosis H37Rv
ccggcgccgccg

SEQ ID NO: 3298218 - RNA, 15 nt, Mycobacterium tuberculosis H37Rv
ccggcgccgccggca

SEQ ID NO: 3298219 - RNA, 16 nt, Mycobacterium tuberculosis H37Rv
ccggcgccgccggcac

SEQ ID NO: 3298220 - RNA, 20 nt, Mycobacterium tuberculosis H37Rv
ccggcgccgccggcgccgcc

SEQ ID NO: 3298221 - RNA, 17 nt, Mycobacterium tuberculosis H37Rv
ccggcgccgccggugcc

SEQ ID NO: 3298222 - RNA, 15 nt, Mycobacterium tuberculosis H37Rv
ccggcgccgccgucg

SEQ ID NO: 3298223 - RNA, 17 nt, Mycobacterium tuberculosis H37Rv
ccggcgccgccguuacc

SEQ ID NO: 3298224 - RNA, 17 nt, Mycobacterium tuberculosis H37Rv
ccggcgccgccguugcc

SEQ ID NO: 3298225 - RNA, 12 nt, Mycobacterium tuberculosis H37Rv
ccggcgccgcgg

SEQ ID NO: 3298226 - RNA, 17 nt, Mycobacterium tuberculosis H37Rv
ccggcgccggaguugaa

SEQ ID NO: 3298227 - RNA, 14 nt, Mycobacterium tuberculosis H37Rv
ccggcgccggcccg

SEQ ID NO: 3298228 - RNA, 15 nt, Mycobacterium tuberculosis H37Rv
ccggcgccggcccgc

SEQ ID NO: 3298229 - RNA, 18 nt, Mycobacterium tuberculosis H37Rv
ccggcgccggcgcgucgg

SEQ ID NO: 3298230 - RNA, 20 nt, Mycobacterium tuberculosis H37Rv
ccggcgccugcugcggccag

SEQ ID NO: 3298231 - RNA, 18 nt, Mycobacterium tuberculosis H37Rv
ccggcgcgauggcgauag

SEQ ID NO: 3298232 - RNA, 17 nt, Mycobacterium tuberculosis H37Rv
ccggcgcgcaccccggc

SEQ ID NO: 3298233 - RNA, 17 nt, Mycobacterium tuberculosis H37Rv
ccggcgcgccccaccgc

SEQ ID NO: 3298234 - RNA, 19 nt, Mycobacterium tuberculosis H37Rv
ccggcgcgccccaccgcgc

SEQ ID NO: 3298235 - RNA, 21 nt, Mycobacterium tuberculosis H37Rv
ccggcgcgccccaccgcgccg

SEQ ID NO: 3298236 - RNA, 15 nt, Mycobacterium tuberculosis H37Rv
ccggcgcgccccgcc

SEQ ID NO: 3298237 - RNA, 12 nt, Mycobacterium tuberculosis H37Rv
ccggcgcgccga

SEQ ID NO: 3298238 - RNA, 15 nt, Mycobacterium tuberculosis H37Rv
ccggcgcgccgauga

SEQ ID NO: 3298239 - RNA, 19 nt, Mycobacterium tuberculosis H37Rv
ccggcgcgccgggcggcgc

SEQ ID NO: 3298240 - RNA, 22 nt, Mycobacterium tuberculosis H37Rv
ccggcgcggaacgcgucgccga

SEQ ID NO: 3298241 - RNA, 17 nt, Mycobacterium tuberculosis H37Rv
ccggcgcggagugccca

SEQ ID NO: 3298242 - RNA, 20 nt, Mycobacterium tuberculosis H37Rv
ccggcgcggagugcccaggg

SEQ ID NO: 3298243 - RNA, 22 nt, Mycobacterium tuberculosis H37Rv
ccggcgcggagugcccagggcc

SEQ ID NO: 3298244 - RNA, 11 nt, Mycobacterium tuberculosis H37Rv
ccggcgcggcc

SEQ ID NO: 3298245 - RNA, 13 nt, Mycobacterium tuberculosis H37Rv
ccggcgcggccgc

SEQ ID NO: 3298246 - RNA, 15 nt, Mycobacterium tuberculosis H37Rv
ccggcgcggucucgg

SEQ ID NO: 3298247 - RNA, 19 nt, Mycobacterium tuberculosis H37Rv
ccggcgcguuccaucaggg

SEQ ID NO: 3298248 - RNA, 17 nt, Mycobacterium tuberculosis H37Rv
ccggcgcguuggguuga

SEQ ID NO: 3298249 - RNA, 16 nt, Mycobacterium tuberculosis H37Rv
ccggcgcuagcgccgc

SEQ ID NO: 3298250 - RNA, 15 nt, Mycobacterium tuberculosis H37Rv
ccggcgcucaucgcg

SEQ ID NO: 3298251 - RNA, 21 nt, Mycobacterium tuberculosis H37Rv
ccggcgcucaucgcgugcucg

SEQ ID NO: 3298252 - RNA, 18 nt, Mycobacterium tuberculosis H37Rv
ccggcgcuccacugacca

SEQ ID NO: 3298253 - RNA, 22 nt, Mycobacterium tuberculosis H37Rv
ccggcgcuccacugaccagguc

SEQ ID NO: 3298254 - RNA, 13 nt, Mycobacterium tuberculosis H37Rv
ccggcgcuccgcc

SEQ ID NO: 3298255 - RNA, 20 nt, Mycobacterium tuberculosis H37Rv
ccggcgcugcugccauugcc

SEQ ID NO: 3298256 - RNA, 15 nt, Mycobacterium tuberculosis H37Rv
ccggcggaagcggcg

SEQ ID NO: 3298257 - RNA, 21 nt, Mycobacterium tuberculosis H37Rv
ccggcggacaccucgggcgcc

SEQ ID NO: 3298258 - RNA, 18 nt, Mycobacterium tuberculosis H37Rv
ccggcggaccccucgacc

SEQ ID NO: 3298259 - RNA, 17 nt, Mycobacterium tuberculosis H37Rv
ccggcggacgacgucgg

SEQ ID NO: 3298260 - RNA, 21 nt, Mycobacterium tuberculosis H37Rv
ccggcggacgcccggcgcacc

SEQ ID NO: 3298261 - RNA, 21 nt, Mycobacterium tuberculosis H37Rv
ccggcggacgugaccagaucg

SEQ ID NO: 3298262 - RNA, 19 nt, Mycobacterium tuberculosis H37Rv
ccggcggagcgggccagca

SEQ ID NO: 3298263 - RNA, 21 nt, Mycobacterium tuberculosis H37Rv
ccggcggagcgggccagcacc

SEQ ID NO: 3298264 - RNA, 17 nt, Mycobacterium tuberculosis H37Rv
ccggcggaucugaucgg

SEQ ID NO: 3298265 - RNA, 20 nt, Mycobacterium tuberculosis H37Rv
ccggcggaucugaucggcgc

SEQ ID NO: 3298266 - RNA, 13 nt, Mycobacterium tuberculosis H37Rv
ccggcggaucugg

SEQ ID NO: 3298267 - RNA, 15 nt, Mycobacterium tuberculosis H37Rv
ccggcggauucggcg

SEQ ID NO: 3298268 - RNA, 16 nt, Mycobacterium tuberculosis H37Rv
ccggcggauucggcgc

SEQ ID NO: 3298269 - RNA, 22 nt, Mycobacterium tuberculosis H37Rv
ccggcggcaaagagcagccggc

SEQ ID NO: 3298270 - RNA, 21 nt, Mycobacterium tuberculosis H37Rv
ccggcggcagcggcgccgccu

SEQ ID NO: 3298271 - RNA, 20 nt, Mycobacterium tuberculosis H37Rv
ccggcggcaggaaucggguc

SEQ ID NO: 3298272 - RNA, 14 nt, Mycobacterium tuberculosis H37Rv
ccggcggcagguag

SEQ ID NO: 3298273 - RNA, 15 nt, Mycobacterium tuberculosis H37Rv
ccggcggcaucgagu

SEQ ID NO: 3298274 - RNA, 12 nt, Mycobacterium tuberculosis H37Rv
ccggcggcaugg

SEQ ID NO: 3298275 - RNA, 11 nt, Mycobacterium tuberculosis H37Rv
ccggcggccaa

SEQ ID NO: 3298276 - RNA, 15 nt, Mycobacterium tuberculosis H37Rv
ccggcggccaccagu

SEQ ID NO: 3298277 - RNA, 14 nt, Mycobacterium tuberculosis H37Rv
ccggcggccacgcc

SEQ ID NO: 3298278 - RNA, 20 nt, Mycobacterium tuberculosis H37Rv
ccggcggccaucccgcguuc

SEQ ID NO: 3298279 - RNA, 15 nt, Mycobacterium tuberculosis H37Rv
ccggcggccccaggg

SEQ ID NO: 3298280 - RNA, 14 nt, Mycobacterium tuberculosis H37Rv
ccggcggccgccau

SEQ ID NO: 3298281 - RNA, 18 nt, Mycobacterium tuberculosis H37Rv
ccggcggccgcggugccc

SEQ ID NO: 3298282 - RNA, 19 nt, Mycobacterium tuberculosis H37Rv
ccggcggcgacgucugcca

SEQ ID NO: 3298283 - RNA, 18 nt, Mycobacterium tuberculosis H37Rv
ccggcggcgagcggccuc

SEQ ID NO: 3298284 - RNA, 21 nt, Mycobacterium tuberculosis H37Rv
ccggcggcgcaucaccuccgc

SEQ ID NO: 3298285 - RNA, 16 nt, Mycobacterium tuberculosis H37Rv
ccggcggcgcgcccgg

SEQ ID NO: 3298286 - RNA, 14 nt, Mycobacterium tuberculosis H37Rv
ccggcggcggccag

SEQ ID NO: 3298287 - RNA, 15 nt, Mycobacterium tuberculosis H37Rv
ccggcggcggccgca

SEQ ID NO: 3298288 - RNA, 23 nt, Mycobacterium tuberculosis H37Rv
ccggcggcggccgcagcggccag

SEQ ID NO: 3298289 - RNA, 21 nt, Mycobacterium tuberculosis H37Rv
ccggcggcggcgcucggccau

SEQ ID NO: 3298290 - RNA, 23 nt, Mycobacterium tuberculosis H37Rv
ccggcggcggcggcccguuugcc

SEQ ID NO: 3298291 - RNA, 14 nt, Mycobacterium tuberculosis H37Rv
ccggcggcggugcg

SEQ ID NO: 3298292 - RNA, 19 nt, Mycobacterium tuberculosis H37Rv
ccggcggcggugcgccccg

SEQ ID NO: 3298293 - RNA, 18 nt, Mycobacterium tuberculosis H37Rv
ccggcggcuggucucugg

SEQ ID NO: 3298294 - RNA, 20 nt, Mycobacterium tuberculosis H37Rv
ccggcgggacgucgccgcag

SEQ ID NO: 3298295 - RNA, 23 nt, Mycobacterium tuberculosis H37Rv
ccggcgggacgucgccgcaguac

SEQ ID NO: 3298296 - RNA, 21 nt, Mycobacterium tuberculosis H37Rv
ccgggccgaucaccccggugg

SEQ ID NO: 3298297 - RNA, 22 nt, Mycobacterium tuberculosis H37Rv
ccgggccgcacggucagcgcgc

SEQ ID NO: 3298298 - RNA, 21 nt, Mycobacterium tuberculosis H37Rv
ccgggccgccagggcccuagc

SEQ ID NO: 3298299 - RNA, 15 nt, Mycobacterium tuberculosis H37Rv
ccgggccgccgcgau

SEQ ID NO: 3298300 - RNA, 20 nt, Mycobacterium tuberculosis H37Rv
ccgggccgccgcgauggccc

SEQ ID NO: 3298301 - RNA, 20 nt, Mycobacterium tuberculosis H37Rv
ccgggccgccucgaucgacu

SEQ ID NO: 3298302 - RNA, 16 nt, Mycobacterium tuberculosis H37Rv
ccgggccgcggcggcc

SEQ ID NO: 3298303 - RNA, 13 nt, Mycobacterium tuberculosis H37Rv
ccgggccggucgg

SEQ ID NO: 3298304 - RNA, 15 nt, Mycobacterium tuberculosis H37Rv
ccgggccucggcgcc

SEQ ID NO: 3298305 - RNA, 16 nt, Mycobacterium tuberculosis H37Rv
ccgggccugggacggc

SEQ ID NO: 3298306 - RNA, 22 nt, Mycobacterium tuberculosis H37Rv
ccgggccugggacggcggcagu

SEQ ID NO: 3298307 - RNA, 23 nt, Mycobacterium tuberculosis H37Rv
ccgggccuuguucuuggccaccc

SEQ ID NO: 3298308 - RNA, 18 nt, Mycobacterium tuberculosis H37Rv
ccgggcgaccaccaccgc

SEQ ID NO: 3298309 - RNA, 22 nt, Mycobacterium tuberculosis H37Rv
ccgggcgaccaccaccgccgcc

SEQ ID NO: 3298310 - RNA, 12 nt, Mycobacterium tuberculosis H37Rv
ccgggcgacggu

SEQ ID NO: 3298311 - RNA, 21 nt, Mycobacterium tuberculosis H37Rv
ccgggcgaguacaggcgcagc

SEQ ID NO: 3298312 - RNA, 17 nt, Mycobacterium tuberculosis H37Rv
ccgggcgaugcugggcg

SEQ ID NO: 3298313 - RNA, 17 nt, Mycobacterium tuberculosis H37Rv
ccgggcgcaagcagccc

SEQ ID NO: 3298314 - RNA, 17 nt, Mycobacterium tuberculosis H37Rv
ccgggcgcgccggccau

SEQ ID NO: 3298315 - RNA, 23 nt, Mycobacterium tuberculosis H37Rv
ccgggcgcucggucuccaccacc

SEQ ID NO: 3298316 - RNA, 19 nt, Mycobacterium tuberculosis H37Rv
ccgggcgcugcuugagguc

SEQ ID NO: 3298317 - RNA, 18 nt, Mycobacterium tuberculosis H37Rv
ccgggcggaacgccggca

SEQ ID NO: 3298318 - RNA, 14 nt, Mycobacterium tuberculosis H37Rv
ccgggcggacagga

SEQ ID NO: 3298319 - RNA, 12 nt, Mycobacterium tuberculosis H37Rv
ccgggcggccaa

SEQ ID NO: 3298320 - RNA, 17 nt, Mycobacterium tuberculosis H37Rv
ccgggcggccagcugca

SEQ ID NO: 3298321 - RNA, 13 nt, Mycobacterium tuberculosis H37Rv
ccgggcggccgcc

SEQ ID NO: 3298322 - RNA, 22 nt, Mycobacterium tuberculosis H37Rv
ccgggcggccucccgggccgcc

SEQ ID NO: 3298323 - RNA, 15 nt, Mycobacterium tuberculosis H37Rv
ccgggcggcgccggc

SEQ ID NO: 3298324 - RNA, 18 nt, Mycobacterium tuberculosis H37Rv
ccgggcggcgccggcgca

SEQ ID NO: 3298325 - RNA, 20 nt, Mycobacterium tuberculosis H37Rv
ccgggcggcgccggcgcaga

SEQ ID NO: 3298326 - RNA, 13 nt, Mycobacterium tuberculosis H37Rv
ccgggcggcggcg

SEQ ID NO: 3298327 - RNA, 15 nt, Mycobacterium tuberculosis H37Rv
ccgggcggcggcgac

SEQ ID NO: 3298328 - RNA, 15 nt, Mycobacterium tuberculosis H37Rv
ccgggcggcggugcg

SEQ ID NO: 3298329 - RNA, 23 nt, Mycobacterium tuberculosis H37Rv
ccgggcggcggugcgucagcugg

SEQ ID NO: 3298330 - RNA, 19 nt, Mycobacterium tuberculosis H37Rv
ccgggcggcgucggugagc

SEQ ID NO: 3298331 - RNA, 17 nt, Mycobacterium tuberculosis H37Rv
ccgggcgggacucggcg

SEQ ID NO: 3298332 - RNA, 19 nt, Mycobacterium tuberculosis H37Rv
ccgggcgggagucgucgag

SEQ ID NO: 3298333 - RNA, 21 nt, Mycobacterium tuberculosis H37Rv
ccgggcgggcggccgaucccg

SEQ ID NO: 3298334 - RNA, 12 nt, Mycobacterium tuberculosis H37Rv
ccgggcgggcug

SEQ ID NO: 3298335 - RNA, 15 nt, Mycobacterium tuberculosis H37Rv
ccgggcggucgagau

SEQ ID NO: 3298336 - RNA, 14 nt, Mycobacterium tuberculosis H37Rv
ccgggcggugucug

SEQ ID NO: 3298337 - RNA, 16 nt, Mycobacterium tuberculosis H37Rv
ccgggcgugcggcggc

SEQ ID NO: 3298338 - RNA, 14 nt, Mycobacterium tuberculosis H37Rv
ccgggcgugggugu

SEQ ID NO: 3298339 - RNA, 19 nt, Mycobacterium tuberculosis H37Rv
ccgggcgugguaucgccgg

SEQ ID NO: 3298340 - RNA, 14 nt, Mycobacterium tuberculosis H37Rv
ccgggcucagcugg

SEQ ID NO: 3298341 - RNA, 19 nt, Mycobacterium tuberculosis H37Rv
ccgggcucagcugggccgc

SEQ ID NO: 3298342 - RNA, 17 nt, Mycobacterium tuberculosis H37Rv
ccgggcuccaauugcgg

SEQ ID NO: 3298343 - RNA, 23 nt, Mycobacterium tuberculosis H37Rv
ccgggcuccaauugcggccgcgc

SEQ ID NO: 3298344 - RNA, 20 nt, Mycobacterium tuberculosis H37Rv
ccgggcucggcgaaggccgc

SEQ ID NO: 3298345 - RNA, 19 nt, Mycobacterium tuberculosis H37Rv
ccgggcucggcgucgccgc

SEQ ID NO: 3298346 - RNA, 20 nt, Mycobacterium tuberculosis H37Rv
ccgggcucggcgucgccgcc

SEQ ID NO: 3298347 - RNA, 22 nt, Mycobacterium tuberculosis H37Rv
ccgggcucggcgucgccgccau

SEQ ID NO: 3298348 - RNA, 19 nt, Mycobacterium tuberculosis H37Rv
ccgggcucggcguugauga

SEQ ID NO: 3298349 - RNA, 19 nt, Mycobacterium tuberculosis H37Rv
ccgggcucggugacccccg

SEQ ID NO: 3298350 - RNA, 19 nt, Mycobacterium tuberculosis H37Rv
ccgggcugccacggccuuc

SEQ ID NO: 3298351 - RNA, 15 nt, Mycobacterium tuberculosis H37Rv
ccgggcuggccagcg

SEQ ID NO: 3298352 - RNA, 16 nt, Mycobacterium tuberculosis H37Rv
ccgggcuggccagcgc

SEQ ID NO: 3298353 - RNA, 20 nt, Mycobacterium tuberculosis H37Rv
ccgggcuggccagcgcgcuc

SEQ ID NO: 3298354 - RNA, 12 nt, Mycobacterium tuberculosis H37Rv
ccgggcuggcga

SEQ ID NO: 3298355 - RNA, 16 nt, Mycobacterium tuberculosis H37Rv
ccgggcuggcgacgac

SEQ ID NO: 3298356 - RNA, 22 nt, Mycobacterium tuberculosis H37Rv
ccgggcuggguaugcacccagg

SEQ ID NO: 3298357 - RNA, 22 nt, Mycobacterium tuberculosis H37Rv
ccgggcuuacuugaucucggcg

SEQ ID NO: 3298358 - RNA, 16 nt, Mycobacterium tuberculosis H37Rv
ccggggaacgugaccc

SEQ ID NO: 3298359 - RNA, 12 nt, Mycobacterium tuberculosis H37Rv
ccggggaccacg

SEQ ID NO: 3298360 - RNA, 18 nt, Mycobacterium tuberculosis H37Rv
ccggggaccucggcgauc

SEQ ID NO: 3298361 - RNA, 18 nt, Mycobacterium tuberculosis H37Rv
ccggggacgccgcggcgc

SEQ ID NO: 3298362 - RNA, 13 nt, Mycobacterium tuberculosis H37Rv
ccggggacggguc

SEQ ID NO: 3298363 - RNA, 14 nt, Mycobacterium tuberculosis H37Rv
ccggggcagauggu

SEQ ID NO: 3298364 - RNA, 16 nt, Mycobacterium tuberculosis H37Rv
ccggggccgccgucgc

SEQ ID NO: 3298365 - RNA, 20 nt, Mycobacterium tuberculosis H37Rv
ccggggcgaugucggcuggu

SEQ ID NO: 3298366 - RNA, 13 nt, Mycobacterium tuberculosis H37Rv
ccggggcgcccgg

SEQ ID NO: 3298367 - RNA, 17 nt, Mycobacterium tuberculosis H37Rv
ccggggcgcccggccag

SEQ ID NO: 3298368 - RNA, 21 nt, Mycobacterium tuberculosis H37Rv
ccggggcgcccggccaggucg

SEQ ID NO: 3298369 - RNA, 18 nt, Mycobacterium tuberculosis H37Rv
ccggggcgcucgcgcgcu

SEQ ID NO: 3298370 - RNA, 23 nt, Mycobacterium tuberculosis H37Rv
ccggggcgcucgcgcgcugggcg

SEQ ID NO: 3298371 - RNA, 16 nt, Mycobacterium tuberculosis H37Rv
ccggggcggaaccugu

SEQ ID NO: 3298372 - RNA, 22 nt, Mycobacterium tuberculosis H37Rv
ccggggcucaagucucccggcc

SEQ ID NO: 3298373 - RNA, 14 nt, Mycobacterium tuberculosis H37Rv
ccggggcugcccgc

SEQ ID NO: 3298374 - RNA, 15 nt, Mycobacterium tuberculosis H37Rv
ccggggcugccgaac

SEQ ID NO: 3298375 - RNA, 20 nt, Mycobacterium tuberculosis H37Rv
ccggggcugccgccguugcc

SEQ ID NO: 3298376 - RNA, 14 nt, Mycobacterium tuberculosis H37Rv
ccggggcugggggc

SEQ ID NO: 3298377 - RNA, 12 nt, Mycobacterium tuberculosis H37Rv
ccgggggaacgg

SEQ ID NO: 3298378 - RNA, 24 nt, Mycobacterium tuberculosis H37Rv
ccgggggacgauuccgcccacaug

SEQ ID NO: 3298379 - RNA, 17 nt, Mycobacterium tuberculosis H37Rv
ccgggggcaccguuacc

SEQ ID NO: 3298380 - RNA, 15 nt, Mycobacterium tuberculosis H37Rv
ccgggggcgccgccg

SEQ ID NO: 3298381 - RNA, 16 nt, Mycobacterium tuberculosis H37Rv
ccggggggcugcugcu

SEQ ID NO: 3298382 - RNA, 20 nt, Mycobacterium tuberculosis H37Rv
ccgggggguugaucggcaac

SEQ ID NO: 3298383 - RNA, 15 nt, Mycobacterium tuberculosis H37Rv
ccgggguaucgaccc

SEQ ID NO: 3298384 - RNA, 21 nt, Mycobacterium tuberculosis H37Rv
ccgggguccaucggggccguc

SEQ ID NO: 3298385 - RNA, 23 nt, Mycobacterium tuberculosis H37Rv
ccgggguccaucggggccgucgg

SEQ ID NO: 3298386 - RNA, 19 nt, Mycobacterium tuberculosis H37Rv
ccggggugaacgcggacac

SEQ ID NO: 3298387 - RNA, 17 nt, Mycobacterium tuberculosis H37Rv
ccggggugacaucgcga

SEQ ID NO: 3298388 - RNA, 14 nt, Mycobacterium tuberculosis H37Rv
ccggggugcccccg

SEQ ID NO: 3298389 - RNA, 18 nt, Mycobacterium tuberculosis H37Rv
ccggggugcccggccgcc

SEQ ID NO: 3298390 - RNA, 18 nt, Mycobacterium tuberculosis H37Rv
ccggggugccggcgaugu

SEQ ID NO: 3298391 - RNA, 19 nt, Mycobacterium tuberculosis H37Rv
ccggggugcugacauaggu

SEQ ID NO: 3298392 - RNA, 16 nt, Mycobacterium tuberculosis H37Rv
ccggucaucccaagcg

SEQ ID NO: 3298393 - RNA, 17 nt, Mycobacterium tuberculosis H37Rv
ccggucaucccaagcgu

SEQ ID NO: 3298394 - RNA, 18 nt, Mycobacterium tuberculosis H37Rv
ccggucauggucagcaga

SEQ ID NO: 3298395 - RNA, 13 nt, Mycobacterium tuberculosis H37Rv
ccgguccagaccc

SEQ ID NO: 3298396 - RNA, 19 nt, Mycobacterium tuberculosis H37Rv
ccgguccagcagcucggcc

SEQ ID NO: 3298397 - RNA, 16 nt, Mycobacterium tuberculosis H37Rv
ccgguccagcccagcg

SEQ ID NO: 3298398 - RNA, 19 nt, Mycobacterium tuberculosis H37Rv
ccgguccauggacggccag

SEQ ID NO: 3298399 - RNA, 17 nt, Mycobacterium tuberculosis H37Rv
ccggucccaaggcguug

SEQ ID NO: 3298400 - RNA, 17 nt, Mycobacterium tuberculosis H37Rv
ccgguccccccguugcc

SEQ ID NO: 3298401 - RNA, 16 nt, Mycobacterium tuberculosis H37Rv
ccgguccccucggugc

SEQ ID NO: 3298402 - RNA, 20 nt, Mycobacterium tuberculosis H37Rv
ccggucccgcgugccacucg

SEQ ID NO: 3298403 - RNA, 13 nt, Mycobacterium tuberculosis H37Rv
ccgguccgauucg

SEQ ID NO: 3298404 - RNA, 16 nt, Mycobacterium tuberculosis H37Rv
ccgguccggucggcgg

SEQ ID NO: 3298405 - RNA, 19 nt, Mycobacterium tuberculosis H37Rv
ccgguccgucaccaccgcc

SEQ ID NO: 3298406 - RNA, 17 nt, Mycobacterium tuberculosis H37Rv
ccgguccucgucggcga

SEQ ID NO: 3298407 - RNA, 17 nt, Mycobacterium tuberculosis H37Rv
ccgguccugggauccgg

SEQ ID NO: 3298408 - RNA, 22 nt, Mycobacterium tuberculosis H37Rv
ccgguccugggauccggcggca

SEQ ID NO: 3298409 - RNA, 20 nt, Mycobacterium tuberculosis H37Rv
ccggucgagccagcggagca

SEQ ID NO: 3298410 - RNA, 16 nt, Mycobacterium tuberculosis H37Rv
ccggucgaggcccucg

SEQ ID NO: 3298411 - RNA, 14 nt, Mycobacterium tuberculosis H37Rv
ccggucgaggugac

SEQ ID NO: 3298412 - RNA, 19 nt, Mycobacterium tuberculosis H37Rv
ccggucgaugaccucguca

SEQ ID NO: 3298413 - RNA, 15 nt, Mycobacterium tuberculosis H37Rv
ccggucgaugccgau

SEQ ID NO: 3298414 - RNA, 19 nt, Mycobacterium tuberculosis H37Rv
ccggucgaugccgaugcga

SEQ ID NO: 3298415 - RNA, 14 nt, Mycobacterium tuberculosis H37Rv
ccggucgcacuugg

SEQ ID NO: 3298416 - RNA, 18 nt, Mycobacterium tuberculosis H37Rv
ccggucgcacuuggcccc

SEQ ID NO: 3298417 - RNA, 19 nt, Mycobacterium tuberculosis H37Rv
ccggucgcauggucgacga

SEQ ID NO: 3298418 - RNA, 16 nt, Mycobacterium tuberculosis H37Rv
ccggucgccggcuggg

SEQ ID NO: 3298419 - RNA, 15 nt, Mycobacterium tuberculosis H37Rv
ccggucgccgggacg

SEQ ID NO: 3298420 - RNA, 21 nt, Mycobacterium tuberculosis H37Rv
ccggucgccggucaucgccga

SEQ ID NO: 3298421 - RNA, 17 nt, Mycobacterium tuberculosis H37Rv
ccggucgccucaccggc

SEQ ID NO: 3298422 - RNA, 23 nt, Mycobacterium tuberculosis H37Rv
ccggucgcgcauuucguggcgcg

SEQ ID NO: 3298423 - RNA, 14 nt, Mycobacterium tuberculosis H37Rv
ccggucgcggaacu

SEQ ID NO: 3298424 - RNA, 14 nt, Mycobacterium tuberculosis H37Rv
ccggucggagcggu

SEQ ID NO: 3298425 - RNA, 13 nt, Mycobacterium tuberculosis H37Rv
ccggucggcagcu

SEQ ID NO: 3298426 - RNA, 15 nt, Mycobacterium tuberculosis H37Rv
ccggucggcagcugg

SEQ ID NO: 3298427 - RNA, 14 nt, Mycobacterium tuberculosis H37Rv
ccggucggcagcuu

SEQ ID NO: 3298428 - RNA, 12 nt, Mycobacterium tuberculosis H37Rv
ccggucggccag

SEQ ID NO: 3298429 - RNA, 20 nt, Mycobacterium tuberculosis H37Rv
ccggucggccagcaagugcg

SEQ ID NO: 3298430 - RNA, 16 nt, Mycobacterium tuberculosis H37Rv
ccggucggccaggccg

SEQ ID NO: 3298431 - RNA, 19 nt, Mycobacterium tuberculosis H37Rv
ccggucggccauccaccgc

SEQ ID NO: 3298432 - RNA, 12 nt, Mycobacterium tuberculosis H37Rv
ccggucggcgac

SEQ ID NO: 3298433 - RNA, 13 nt, Mycobacterium tuberculosis H37Rv
ccggucggcggca

SEQ ID NO: 3298434 - RNA, 15 nt, Mycobacterium tuberculosis H37Rv
ccggucggcgguagc

SEQ ID NO: 3298435 - RNA, 18 nt, Mycobacterium tuberculosis H37Rv
ccggucggcgguagccga

SEQ ID NO: 3298436 - RNA, 21 nt, Mycobacterium tuberculosis H37Rv
ccggucgggggcguccuccug

SEQ ID NO: 3298437 - RNA, 20 nt, Mycobacterium tuberculosis H37Rv
ccggucggguccaacgccgc

SEQ ID NO: 3298438 - RNA, 15 nt, Mycobacterium tuberculosis H37Rv
ccggucggucucggc

SEQ ID NO: 3298439 - RNA, 15 nt, Mycobacterium tuberculosis H37Rv
ccggucggugagccg

SEQ ID NO: 3298440 - RNA, 16 nt, Mycobacterium tuberculosis H37Rv
ccggucggugagccgu

SEQ ID NO: 3298441 - RNA, 16 nt, Mycobacterium tuberculosis H37Rv
ccggucuacgccaccg

SEQ ID NO: 3298442 - RNA, 22 nt, Mycobacterium tuberculosis H37Rv
ccggucugcugggcacgauggc

SEQ ID NO: 3298443 - RNA, 15 nt, Mycobacterium tuberculosis H37Rv
ccggucuuacggucg

SEQ ID NO: 3298444 - RNA, 16 nt, Mycobacterium tuberculosis H37Rv
ccggucuuggacagca

SEQ ID NO: 3298445 - RNA, 21 nt, Mycobacterium tuberculosis H37Rv
ccggugaacaccagcaggaag

SEQ ID NO: 3298446 - RNA, 13 nt, Mycobacterium tuberculosis H37Rv
ccggugaacaggg

SEQ ID NO: 3298447 - RNA, 19 nt, Mycobacterium tuberculosis H37Rv
ccggugaaccgggacagca

SEQ ID NO: 3298448 - RNA, 16 nt, Mycobacterium tuberculosis H37Rv
ccggugaacggcagca

SEQ ID NO: 3298449 - RNA, 15 nt, Mycobacterium tuberculosis H37Rv
ccggugacaaggaug

SEQ ID NO: 3298450 - RNA, 17 nt, Mycobacterium tuberculosis H37Rv
ccggugacaaguggugc

SEQ ID NO: 3298451 - RNA, 17 nt, Mycobacterium tuberculosis H37Rv
ccggugaccacuugcag

SEQ ID NO: 3298452 - RNA, 20 nt, Mycobacterium tuberculosis H37Rv
ccggugaccacuugcagcac

SEQ ID NO: 3298453 - RNA, 17 nt, Mycobacterium tuberculosis H37Rv
ccggugaccucgguauc

SEQ ID NO: 3298454 - RNA, 13 nt, Mycobacterium tuberculosis H37Rv
ccggugacggugu

SEQ ID NO: 3298455 - RNA, 17 nt, Mycobacterium tuberculosis H37Rv
ccggugagaagaagccc

SEQ ID NO: 3298456 - RNA, 14 nt, Mycobacterium tuberculosis H37Rv
ccggugagcgagcg

SEQ ID NO: 3298457 - RNA, 18 nt, Mycobacterium tuberculosis H37Rv
ccggugagcgagcgcgcg

SEQ ID NO: 3298458 - RNA, 22 nt, Mycobacterium tuberculosis H37Rv
ccggugagcgcagcuugauccc

SEQ ID NO: 3298459 - RNA, 18 nt, Mycobacterium tuberculosis H37Rv
ccggugaggaucagcgug

SEQ ID NO: 3298460 - RNA, 14 nt, Mycobacterium tuberculosis H37Rv
ccggugauccgguc

SEQ ID NO: 3298461 - RNA, 18 nt, Mycobacterium tuberculosis H37Rv
ccggugaugaucgcgccg

SEQ ID NO: 3298462 - RNA, 13 nt, Mycobacterium tuberculosis H37Rv
ccggugauggccg

SEQ ID NO: 3298463 - RNA, 14 nt, Mycobacterium tuberculosis H37Rv
ccggugauggccga

SEQ ID NO: 3298464 - RNA, 17 nt, Mycobacterium tuberculosis H37Rv
ccggugauggugaccag

SEQ ID NO: 3298465 - RNA, 19 nt, Mycobacterium tuberculosis H37Rv
ccggugauggugaccagca

SEQ ID NO: 3298466 - RNA, 17 nt, Mycobacterium tuberculosis H37Rv
ccggugccacugccguu

SEQ ID NO: 3298467 - RNA, 21 nt, Mycobacterium tuberculosis H37Rv
ccggugccaguacucggccag

SEQ ID NO: 3298468 - RNA, 23 nt, Mycobacterium tuberculosis H37Rv
ccggugccaguacucggccagcg

SEQ ID NO: 3298469 - RNA, 19 nt, Mycobacterium tuberculosis H37Rv
ccggugcccgcaccacacc

SEQ ID NO: 3298470 - RNA, 12 nt, Mycobacterium tuberculosis H37Rv
ccggugccgacg

SEQ ID NO: 3298471 - RNA, 13 nt, Mycobacterium tuberculosis H37Rv
ccggugccgccau

SEQ ID NO: 3298472 - RNA, 19 nt, Mycobacterium tuberculosis H37Rv
ccggugccgccauugacgc

SEQ ID NO: 3298473 - RNA, 14 nt, Mycobacterium tuberculosis H37Rv
ccggugccgcccgc

SEQ ID NO: 3298474 - RNA, 15 nt, Mycobacterium tuberculosis H37Rv
ccggugccgcccgcg

SEQ ID NO: 3298475 - RNA, 20 nt, Mycobacterium tuberculosis H37Rv
ccggugccgcccgcgccgcc

SEQ ID NO: 3298476 - RNA, 21 nt, Mycobacterium tuberculosis H37Rv
ccggugccgcccgcgccgccg

SEQ ID NO: 3298477 - RNA, 15 nt, Mycobacterium tuberculosis H37Rv
ccggugccgccgccu

SEQ ID NO: 3298478 - RNA, 19 nt, Mycobacterium tuberculosis H37Rv
ccggugccgccgcggccac

SEQ ID NO: 3298479 - RNA, 20 nt, Mycobacterium tuberculosis H37Rv
ccggugccgccgcggccacc

SEQ ID NO: 3298480 - RNA, 20 nt, Mycobacterium tuberculosis H37Rv
ccggugccgccggugccgcc

SEQ ID NO: 3298481 - RNA, 22 nt, Mycobacterium tuberculosis H37Rv
ccggugccgccggugccgccug

SEQ ID NO: 3298482 - RNA, 15 nt, Mycobacterium tuberculosis H37Rv
ccggugccgccgucg

SEQ ID NO: 3298483 - RNA, 17 nt, Mycobacterium tuberculosis H37Rv
ccggugccgccguugcc

SEQ ID NO: 3298484 - RNA, 20 nt, Mycobacterium tuberculosis H37Rv
ccggugccgccguugccauu

SEQ ID NO: 3298485 - RNA, 15 nt, Mycobacterium tuberculosis H37Rv
ccggugccgccuccg

SEQ ID NO: 3298486 - RNA, 12 nt, Mycobacterium tuberculosis H37Rv
ccggugccgcgg

SEQ ID NO: 3298487 - RNA, 22 nt, Mycobacterium tuberculosis H37Rv
ccggugccgcgguaggugcaug

SEQ ID NO: 3298488 - RNA, 14 nt, Mycobacterium tuberculosis H37Rv
ccggugccggcgca

SEQ ID NO: 3298489 - RNA, 13 nt, Mycobacterium tuberculosis H37Rv
ccguaccggugau

SEQ ID NO: 3298490 - RNA, 15 nt, Mycobacterium tuberculosis H37Rv
ccguacgccggcggu

SEQ ID NO: 3298491 - RNA, 13 nt, Mycobacterium tuberculosis H37Rv
ccguagacccaca

SEQ ID NO: 3298492 - RNA, 16 nt, Mycobacterium tuberculosis H37Rv
ccguagacgccgagca

SEQ ID NO: 3298493 - RNA, 20 nt, Mycobacterium tuberculosis H37Rv
ccguagagcaugccgcccgc

SEQ ID NO: 3298494 - RNA, 14 nt, Mycobacterium tuberculosis H37Rv
ccguagcacaccgg

SEQ ID NO: 3298495 - RNA, 18 nt, Mycobacterium tuberculosis H37Rv
ccguagcacaccggugga

SEQ ID NO: 3298496 - RNA, 22 nt, Mycobacterium tuberculosis H37Rv
ccguagcacaccgguggacccg

SEQ ID NO: 3298497 - RNA, 16 nt, Mycobacterium tuberculosis H37Rv
ccguagcccacgacga

SEQ ID NO: 3298498 - RNA, 14 nt, Mycobacterium tuberculosis H37Rv
ccguagccgagcuu

SEQ ID NO: 3298499 - RNA, 15 nt, Mycobacterium tuberculosis H37Rv
ccguagccgcugcac

SEQ ID NO: 3298500 - RNA, 17 nt, Mycobacterium tuberculosis H37Rv
ccguagcgcagcgccuc

SEQ ID NO: 3298501 - RNA, 18 nt, Mycobacterium tuberculosis H37Rv
ccguagcgcaggagcgcg

SEQ ID NO: 3298502 - RNA, 16 nt, Mycobacterium tuberculosis H37Rv
ccguagcugcgcagcg

SEQ ID NO: 3298503 - RNA, 15 nt, Mycobacterium tuberculosis H37Rv
ccguaggcgccgaac

SEQ ID NO: 3298504 - RNA, 23 nt, Mycobacterium tuberculosis H37Rv
ccguaguaguucagccaggccgc

SEQ ID NO: 3298505 - RNA, 23 nt, Mycobacterium tuberculosis H37Rv
ccguagucgucaaacacucugau

SEQ ID NO: 3298506 - RNA, 22 nt, Mycobacterium tuberculosis H37Rv
ccguagugaacggcucgggcag

SEQ ID NO: 3298507 - RNA, 19 nt, Mycobacterium tuberculosis H37Rv
ccguagugcacgucggcgg

SEQ ID NO: 3298508 - RNA, 14 nt, Mycobacterium tuberculosis H37Rv
ccguaguggccggc

SEQ ID NO: 3298509 - RNA, 19 nt, Mycobacterium tuberculosis H37Rv
ccguaguugguccagguga

SEQ ID NO: 3298510 - RNA, 22 nt, Mycobacterium tuberculosis H37Rv
ccguauaggcccgggcggccag

SEQ ID NO: 3298511 - RNA, 16 nt, Mycobacterium tuberculosis H37Rv
ccguaucggggcacca

SEQ ID NO: 3298512 - RNA, 17 nt, Mycobacterium tuberculosis H37Rv
ccguauugaccagcggg

SEQ ID NO: 3298513 - RNA, 19 nt, Mycobacterium tuberculosis H37Rv
ccguauugaugcugcccga

SEQ ID NO: 3298514 - RNA, 16 nt, Mycobacterium tuberculosis H37Rv
ccgucacaagucgaca

SEQ ID NO: 3298515 - RNA, 23 nt, Mycobacterium tuberculosis H37Rv
ccgucacaagucgacacgccgaa

SEQ ID NO: 3298516 - RNA, 19 nt, Mycobacterium tuberculosis H37Rv
ccgucacaaugcccaggcu

SEQ ID NO: 3298517 - RNA, 14 nt, Mycobacterium tuberculosis H37Rv
ccgucacccccgau

SEQ ID NO: 3298518 - RNA, 23 nt, Mycobacterium tuberculosis H37Rv
ccgucacccccgauagcgaccgc

SEQ ID NO: 3298519 - RNA, 23 nt, Mycobacterium tuberculosis H37Rv
ccgucaccgaucgaacagugccu

SEQ ID NO: 3298520 - RNA, 13 nt, Mycobacterium tuberculosis H37Rv
ccgucaccgccga

SEQ ID NO: 3298521 - RNA, 14 nt, Mycobacterium tuberculosis H37Rv
ccgucaccgccggc

SEQ ID NO: 3298522 - RNA, 19 nt, Mycobacterium tuberculosis H37Rv
ccgucaccgccggcaccgc

SEQ ID NO: 3298523 - RNA, 21 nt, Mycobacterium tuberculosis H37Rv
ccgucaccgcugagccccccg

SEQ ID NO: 3298524 - RNA, 22 nt, Mycobacterium tuberculosis H37Rv
ccgucaccggaauccccccugu

SEQ ID NO: 3298525 - RNA, 19 nt, Mycobacterium tuberculosis H37Rv
ccgucacgcccgcgaaccg

SEQ ID NO: 3298526 - RNA, 19 nt, Mycobacterium tuberculosis H37Rv
ccgucacugaugggccggu

SEQ ID NO: 3298527 - RNA, 23 nt, Mycobacterium tuberculosis H37Rv
ccgucagaacaccggccaggccg

SEQ ID NO: 3298528 - RNA, 20 nt, Mycobacterium tuberculosis H37Rv
ccgucagcaccccgccgccu

SEQ ID NO: 3298529 - RNA, 15 nt, Mycobacterium tuberculosis H37Rv
ccgucagccaggugc

SEQ ID NO: 3298530 - RNA, 19 nt, Mycobacterium tuberculosis H37Rv
ccgucagcccgacguugcg

SEQ ID NO: 3298531 - RNA, 17 nt, Mycobacterium tuberculosis H37Rv
ccgucagcgcgaccguc

SEQ ID NO: 3298532 - RNA, 23 nt, Mycobacterium tuberculosis H37Rv
ccgucagcggcaacaugucaccu

SEQ ID NO: 3298533 - RNA, 19 nt, Mycobacterium tuberculosis H37Rv
ccgucaggaugaucugcgc

SEQ ID NO: 3298534 - RNA, 23 nt, Mycobacterium tuberculosis H37Rv
ccgucagguacgucuuggaucac

SEQ ID NO: 3298535 - RNA, 22 nt, Mycobacterium tuberculosis H37Rv
ccgucaguucggugugcggcgc

SEQ ID NO: 3298536 - RNA, 16 nt, Mycobacterium tuberculosis H37Rv
ccgucauacucgacac

SEQ ID NO: 3298537 - RNA, 20 nt, Mycobacterium tuberculosis H37Rv
ccgucaucgaguaacacccc

SEQ ID NO: 3298538 - RNA, 20 nt, Mycobacterium tuberculosis H37Rv
ccgucaucgcggugugccgg

SEQ ID NO: 3298539 - RNA, 19 nt, Mycobacterium tuberculosis H37Rv
ccgucaucgugcccgcguc

SEQ ID NO: 3298540 - RNA, 15 nt, Mycobacterium tuberculosis H37Rv
ccgucaugccgacga

SEQ ID NO: 3298541 - RNA, 13 nt, Mycobacterium tuberculosis H37Rv
ccgucauggcccg

SEQ ID NO: 3298542 - RNA, 16 nt, Mycobacterium tuberculosis H37Rv
ccgucauggcccgauc

SEQ ID NO: 3298543 - RNA, 23 nt, Mycobacterium tuberculosis H37Rv
ccgucauggcgaaccgucagcgc

SEQ ID NO: 3298544 - RNA, 20 nt, Mycobacterium tuberculosis H37Rv
ccgucauggcgggugcggcg

SEQ ID NO: 3298545 - RNA, 18 nt, Mycobacterium tuberculosis H37Rv
ccguccaagccggcugca

SEQ ID NO: 3298546 - RNA, 16 nt, Mycobacterium tuberculosis H37Rv
ccguccaauagcugac

SEQ ID NO: 3298547 - RNA, 15 nt, Mycobacterium tuberculosis H37Rv
ccguccagcaacagc

SEQ ID NO: 3298548 - RNA, 22 nt, Mycobacterium tuberculosis H37Rv
ccguccagcaacagcgagcggu

SEQ ID NO: 3298549 - RNA, 18 nt, Mycobacterium tuberculosis H37Rv
ccguccaggcgcugcagc

SEQ ID NO: 3298550 - RNA, 20 nt, Mycobacterium tuberculosis H37Rv
ccguccaggcgcugcagcau

SEQ ID NO: 3298551 - RNA, 21 nt, Mycobacterium tuberculosis H37Rv
ccgucccacgugugcggaagc

SEQ ID NO: 3298552 - RNA, 15 nt, Mycobacterium tuberculosis H37Rv
ccgucccacugaccg

SEQ ID NO: 3298553 - RNA, 14 nt, Mycobacterium tuberculosis H37Rv
ccgucccagcugac

SEQ ID NO: 3298554 - RNA, 20 nt, Mycobacterium tuberculosis H37Rv
ccguccccaccgacgccgau

SEQ ID NO: 3298555 - RNA, 18 nt, Mycobacterium tuberculosis H37Rv
ccguccccgcagcgccua

SEQ ID NO: 3298556 - RNA, 15 nt, Mycobacterium tuberculosis H37Rv
ccgucccgccggccc

SEQ ID NO: 3298557 - RNA, 14 nt, Mycobacterium tuberculosis H37Rv
ccgucccgcgagca

SEQ ID NO: 3298558 - RNA, 20 nt, Mycobacterium tuberculosis H37Rv
ccgucccgcgagcagcccgg

SEQ ID NO: 3298559 - RNA, 20 nt, Mycobacterium tuberculosis H37Rv
ccgucccugugucgccgucg

SEQ ID NO: 3298560 - RNA, 13 nt, Mycobacterium tuberculosis H37Rv
ccguccgcaccgg

SEQ ID NO: 3298561 - RNA, 20 nt, Mycobacterium tuberculosis H37Rv
ccguccgccguaugccgcca

SEQ ID NO: 3298562 - RNA, 21 nt, Mycobacterium tuberculosis H37Rv
ccguccgcggguagcgguuca

SEQ ID NO: 3298563 - RNA, 20 nt, Mycobacterium tuberculosis H37Rv
ccguccggccgggcccucca

SEQ ID NO: 3298564 - RNA, 19 nt, Mycobacterium tuberculosis H37Rv
ccguccggcgccugcugcg

SEQ ID NO: 3298565 - RNA, 22 nt, Mycobacterium tuberculosis H37Rv
ccguccgggcggccucccgggc

SEQ ID NO: 3298566 - RNA, 15 nt, Mycobacterium tuberculosis H37Rv
ccguccgggucacca

SEQ ID NO: 3298567 - RNA, 14 nt, Mycobacterium tuberculosis H37Rv
ccguccgguccguc

SEQ ID NO: 3298568 - RNA, 19 nt, Mycobacterium tuberculosis H37Rv
ccguccgguggaccgccga

SEQ ID NO: 3298569 - RNA, 12 nt, Mycobacterium tuberculosis H37Rv
ccguccgucggc

SEQ ID NO: 3298570 - RNA, 14 nt, Mycobacterium tuberculosis H37Rv
ccguccgucggcgc

SEQ ID NO: 3298571 - RNA, 18 nt, Mycobacterium tuberculosis H37Rv
ccguccucgaucgcgcag

SEQ ID NO: 3298572 - RNA, 22 nt, Mycobacterium tuberculosis H37Rv
ccguccucggucagcucgucgg

SEQ ID NO: 3298573 - RNA, 17 nt, Mycobacterium tuberculosis H37Rv
ccgucgaaccuaccgug

SEQ ID NO: 3298574 - RNA, 22 nt, Mycobacterium tuberculosis H37Rv
ccgucgaagaugaccugaucga

SEQ ID NO: 3298575 - RNA, 22 nt, Mycobacterium tuberculosis H37Rv
ccgucgaagcgaacacccgguc

SEQ ID NO: 3298576 - RNA, 20 nt, Mycobacterium tuberculosis H37Rv
ccgucgacaccgcggacccg

SEQ ID NO: 3298577 - RNA, 13 nt, Mycobacterium tuberculosis H37Rv
ccgucgaccggcg

SEQ ID NO: 3298578 - RNA, 17 nt, Mycobacterium tuberculosis H37Rv
ccgucgacgagcgccuc

SEQ ID NO: 3298579 - RNA, 16 nt, Mycobacterium tuberculosis H37Rv
ccgucgacgaucagcg

SEQ ID NO: 3298580 - RNA, 14 nt, Mycobacterium tuberculosis H37Rv
ccgucgacgcgguc

SEQ ID NO: 3298581 - RNA, 16 nt, Mycobacterium tuberculosis H37Rv
ccgucgacgucgaugg

SEQ ID NO: 3298582 - RNA, 21 nt, Mycobacterium tuberculosis H37Rv
ccgucgagcacggugagccgg

SEQ ID NO: 3298583 - RNA, 15 nt, Mycobacterium tuberculosis H37Rv
ccgucgagccgugcc

SEQ ID NO: 3298584 - RNA, 20 nt, Mycobacterium tuberculosis H37Rv
ccgucuuugucacgcaccgc

SEQ ID NO: 3298585 - RNA, 21 nt, Mycobacterium tuberculosis H37Rv
ccgucuuugucacgcaccgcg

SEQ ID NO: 3298586 - RNA, 15 nt, Mycobacterium tuberculosis H37Rv
ccgugaaccgcccgc

SEQ ID NO: 3298587 - RNA, 22 nt, Mycobacterium tuberculosis H37Rv
ccgugaacggcgcgggccacca

SEQ ID NO: 3298588 - RNA, 18 nt, Mycobacterium tuberculosis H37Rv
ccgugaaucgagcaccgc

SEQ ID NO: 3298589 - RNA, 22 nt, Mycobacterium tuberculosis H37Rv
ccgugaauggcagcacgaccug

SEQ ID NO: 3298590 - RNA, 21 nt, Mycobacterium tuberculosis H37Rv
ccgugacagcggcauugccag

SEQ ID NO: 3298591 - RNA, 20 nt, Mycobacterium tuberculosis H37Rv
ccgugacccauucucggccg

SEQ ID NO: 3298592 - RNA, 21 nt, Mycobacterium tuberculosis H37Rv
ccgugacccugauggggcguu

SEQ ID NO: 3298593 - RNA, 15 nt, Mycobacterium tuberculosis H37Rv
ccgugaccgccgcgc

SEQ ID NO: 3298594 - RNA, 16 nt, Mycobacterium tuberculosis H37Rv
ccgugaccgccgcgcc

SEQ ID NO: 3298595 - RNA, 20 nt, Mycobacterium tuberculosis H37Rv
ccgugacguagggcagcgcc

SEQ ID NO: 3298596 - RNA, 18 nt, Mycobacterium tuberculosis H37Rv
ccgugagcaccagcagca

SEQ ID NO: 3298597 - RNA, 19 nt, Mycobacterium tuberculosis H37Rv
ccgugagcaccagcagcac

SEQ ID NO: 3298598 - RNA, 21 nt, Mycobacterium tuberculosis H37Rv
ccgugagccuuucgugcaccg

SEQ ID NO: 3298599 - RNA, 22 nt, Mycobacterium tuberculosis H37Rv
ccgugaguagguccacguucgg

SEQ ID NO: 3298600 - RNA, 14 nt, Mycobacterium tuberculosis H37Rv
ccgugaucggcgcc

SEQ ID NO: 3298601 - RNA, 16 nt, Mycobacterium tuberculosis H37Rv
ccgugauugucggcga

SEQ ID NO: 3298602 - RNA, 20 nt, Mycobacterium tuberculosis H37Rv
ccgugcaccagcucacccgg

SEQ ID NO: 3298603 - RNA, 16 nt, Mycobacterium tuberculosis H37Rv
ccgugcacgaucgcgg

SEQ ID NO: 3298604 - RNA, 18 nt, Mycobacterium tuberculosis H37Rv
ccgugcacgucagcggau

SEQ ID NO: 3298605 - RNA, 17 nt, Mycobacterium tuberculosis H37Rv
ccgugcagcucggucag

SEQ ID NO: 3298606 - RNA, 23 nt, Mycobacterium tuberculosis H37Rv
ccgugcagggcauugcggcccgc

SEQ ID NO: 3298607 - RNA, 21 nt, Mycobacterium tuberculosis H37Rv
ccgugccaaugacuuggccag

SEQ ID NO: 3298608 - RNA, 11 nt, Mycobacterium tuberculosis H37Rv
ccgugccagcu

SEQ ID NO: 3298609 - RNA, 14 nt, Mycobacterium tuberculosis H37Rv
ccgugcccaggcca

SEQ ID NO: 3298610 - RNA, 17 nt, Mycobacterium tuberculosis H37Rv
ccgugccgaaaaucgca

SEQ ID NO: 3298611 - RNA, 18 nt, Mycobacterium tuberculosis H37Rv
ccgugccgaaaaucgcag

SEQ ID NO: 3298612 - RNA, 21 nt, Mycobacterium tuberculosis H37Rv
ccgugccgaaaaucgcagcca

SEQ ID NO: 3298613 - RNA, 16 nt, Mycobacterium tuberculosis H37Rv
ccgugccgaccaccag

SEQ ID NO: 3298614 - RNA, 17 nt, Mycobacterium tuberculosis H37Rv
ccgugccgaccaccagc

SEQ ID NO: 3298615 - RNA, 12 nt, Mycobacterium tuberculosis H37Rv
ccgugccgagcg

SEQ ID NO: 3298616 - RNA, 12 nt, Mycobacterium tuberculosis H37Rv
ccgugccgccag

SEQ ID NO: 3298617 - RNA, 19 nt, Mycobacterium tuberculosis H37Rv
ccgugccgcccgcgccgcc

SEQ ID NO: 3298618 - RNA, 19 nt, Mycobacterium tuberculosis H37Rv
ccgugccgccgacaccacc

SEQ ID NO: 3298619 - RNA, 21 nt, Mycobacterium tuberculosis H37Rv
ccgugccgguguguccagcgg

SEQ ID NO: 3298620 - RNA, 18 nt, Mycobacterium tuberculosis H37Rv
ccgugccgguuuggccga

SEQ ID NO: 3298621 - RNA, 19 nt, Mycobacterium tuberculosis H37Rv
ccgugccgucaacgauggu

SEQ ID NO: 3298622 - RNA, 18 nt, Mycobacterium tuberculosis H37Rv
ccgugccgucggcgugca

SEQ ID NO: 3298623 - RNA, 16 nt, Mycobacterium tuberculosis H37Rv
ccgugcgaucgucaac

SEQ ID NO: 3298624 - RNA, 18 nt, Mycobacterium tuberculosis H37Rv
ccgugcgaugcacaaccg

SEQ ID NO: 3298625 - RNA, 13 nt, Mycobacterium tuberculosis H37Rv
ccgugcgcacuga

SEQ ID NO: 3298626 - RNA, 15 nt, Mycobacterium tuberculosis H37Rv
ccgugcgcgcgcagc

SEQ ID NO: 3298627 - RNA, 20 nt, Mycobacterium tuberculosis H37Rv
ccgugcgcgcgcagcugacg

SEQ ID NO: 3298628 - RNA, 14 nt, Mycobacterium tuberculosis H37Rv
ccgugcggcggcug

SEQ ID NO: 3298629 - RNA, 20 nt, Mycobacterium tuberculosis H37Rv
ccgugcggcggcugccgguu

SEQ ID NO: 3298630 - RNA, 16 nt, Mycobacterium tuberculosis H37Rv
ccgugcggggggcagc

SEQ ID NO: 3298631 - RNA, 23 nt, Mycobacterium tuberculosis H37Rv
ccgugcgguauuugaacgcccgc

SEQ ID NO: 3298632 - RNA, 23 nt, Mycobacterium tuberculosis H37Rv
ccgugcucgucguacaugggcag

SEQ ID NO: 3298633 - RNA, 23 nt, Mycobacterium tuberculosis H37Rv
ccgugcugaacuccgccgcgauc

SEQ ID NO: 3298634 - RNA, 14 nt, Mycobacterium tuberculosis H37Rv
ccgugcugcggcga

SEQ ID NO: 3298635 - RNA, 17 nt, Mycobacterium tuberculosis H37Rv
ccgugcugggccgacgg

SEQ ID NO: 3298636 - RNA, 19 nt, Mycobacterium tuberculosis H37Rv
ccguggaagacgucgaggu

SEQ ID NO: 3298637 - RNA, 22 nt, Mycobacterium tuberculosis H37Rv
ccguggaagauguugccgccgg

SEQ ID NO: 3298638 - RNA, 18 nt, Mycobacterium tuberculosis H37Rv
ccguggacaagcacagcg

SEQ ID NO: 3298639 - RNA, 21 nt, Mycobacterium tuberculosis H37Rv
ccguggauaacgacugacaac

SEQ ID NO: 3298640 - RNA, 14 nt, Mycobacterium tuberculosis H37Rv
ccguggcagucgca

SEQ ID NO: 3298641 - RNA, 15 nt, Mycobacterium tuberculosis H37Rv
ccguggcaucgccuc

SEQ ID NO: 3298642 - RNA, 15 nt, Mycobacterium tuberculosis H37Rv
ccguggcccaacccg

SEQ ID NO: 3298643 - RNA, 13 nt, Mycobacterium tuberculosis H37Rv
ccguggccucgaa

SEQ ID NO: 3298644 - RNA, 20 nt, Mycobacterium tuberculosis H37Rv
ccguggcgaaugacggccag

SEQ ID NO: 3298645 - RNA, 15 nt, Mycobacterium tuberculosis H37Rv
ccguggcgcggucgg

SEQ ID NO: 3298646 - RNA, 18 nt, Mycobacterium tuberculosis H37Rv
ccguggcggccuccuccc

SEQ ID NO: 3298647 - RNA, 22 nt, Mycobacterium tuberculosis H37Rv
ccguggcggcgggccucggcga

SEQ ID NO: 3298648 - RNA, 23 nt, Mycobacterium tuberculosis H37Rv
ccguggcggcgggccucggcgac

SEQ ID NO: 3298649 - RNA, 23 nt, Mycobacterium tuberculosis H37Rv
ccguggcugaaauaagggccggc

SEQ ID NO: 3298650 - RNA, 20 nt, Mycobacterium tuberculosis H37Rv
ccgugggguguggcggcggg

SEQ ID NO: 3298651 - RNA, 23 nt, Mycobacterium tuberculosis H37Rv
ccguggguguugaugggcagccg

SEQ ID NO: 3298652 - RNA, 14 nt, Mycobacterium tuberculosis H37Rv
ccguggucgaggug

SEQ ID NO: 3298653 - RNA, 13 nt, Mycobacterium tuberculosis H37Rv
ccguggucgauca

SEQ ID NO: 3298654 - RNA, 21 nt, Mycobacterium tuberculosis H37Rv
ccguggugaucaaacuaccga

SEQ ID NO: 3298655 - RNA, 20 nt, Mycobacterium tuberculosis H37Rv
ccguggugcuagcgccgcca

SEQ ID NO: 3298656 - RNA, 18 nt, Mycobacterium tuberculosis H37Rv
ccgugguggaugagccgg

SEQ ID NO: 3298657 - RNA, 13 nt, Mycobacterium tuberculosis H37Rv
ccgugguggucgg

SEQ ID NO: 3298658 - RNA, 20 nt, Mycobacterium tuberculosis H37Rv
ccgugguggucgggcgcaac

SEQ ID NO: 3298659 - RNA, 21 nt, Mycobacterium tuberculosis H37Rv
ccguggugguugaucagccag

SEQ ID NO: 3298660 - RNA, 16 nt, Mycobacterium tuberculosis H37Rv
ccgugguguacccgcc

SEQ ID NO: 3298661 - RNA, 18 nt, Mycobacterium tuberculosis H37Rv
ccgugguugcacguucgg

SEQ ID NO: 3298662 - RNA, 13 nt, Mycobacterium tuberculosis H37Rv
ccguguaggccau

SEQ ID NO: 3298663 - RNA, 17 nt, Mycobacterium tuberculosis H37Rv
ccguguaugcauccacu

SEQ ID NO: 3298664 - RNA, 24 nt, Mycobacterium tuberculosis H37Rv
ccgugucaccgccgggaagccgca

SEQ ID NO: 3298665 - RNA, 13 nt, Mycobacterium tuberculosis H37Rv
ccguguccagcau

SEQ ID NO: 3298666 - RNA, 16 nt, Mycobacterium tuberculosis H37Rv
ccgugucgagaucuca

SEQ ID NO: 3298667 - RNA, 20 nt, Mycobacterium tuberculosis H37Rv
ccgugucgagaucucacgug

SEQ ID NO: 3298668 - RNA, 20 nt, Mycobacterium tuberculosis H37Rv
ccgugucgcagaucaggacg

SEQ ID NO: 3298669 - RNA, 17 nt, Mycobacterium tuberculosis H37Rv
ccgugucgccggcgaag

SEQ ID NO: 3298670 - RNA, 14 nt, Mycobacterium tuberculosis H37Rv
ccgugugcacgcga

SEQ ID NO: 3298671 - RNA, 15 nt, Mycobacterium tuberculosis H37Rv
ccgugugccacgggg

SEQ ID NO: 3298672 - RNA, 19 nt, Mycobacterium tuberculosis H37Rv
ccgugugcuucgagcaccg

SEQ ID NO: 3298673 - RNA, 20 nt, Mycobacterium tuberculosis H37Rv
ccgugugcuucgagcaccga

SEQ ID NO: 3298674 - RNA, 13 nt, Mycobacterium tuberculosis H37Rv
ccgugugggcguu

SEQ ID NO: 3298675 - RNA, 17 nt, Mycobacterium tuberculosis H37Rv
ccguguggugcgcaaac

SEQ ID NO: 3298676 - RNA, 22 nt, Mycobacterium tuberculosis H37Rv
ccguguugaagaagcccgaguu

SEQ ID NO: 3298677 - RNA, 13 nt, Mycobacterium tuberculosis H37Rv
ccguguuucgaac

SEQ ID NO: 3298678 - RNA, 13 nt, Mycobacterium tuberculosis H37Rv
ccguuaccgccaa

SEQ ID NO: 3298679 - RNA, 21 nt, Mycobacterium tuberculosis H37Rv
ccguuaccgccguuaccgacg

SEQ ID NO: 3298680 - RNA, 22 nt, Mycobacterium tuberculosis H37Rv
ccuaugcugcccggcaaccugg

SEQ ID NO: 3298681 - RNA, 15 nt, Mycobacterium tuberculosis H37Rv
ccuauggucaaccgc

SEQ ID NO: 3298682 - RNA, 16 nt, Mycobacterium tuberculosis H37Rv
ccuauugaacccgugu

SEQ ID NO: 3298683 - RNA, 12 nt, Mycobacterium tuberculosis H37Rv
ccucaagcgaag

SEQ ID NO: 3298684 - RNA, 19 nt, Mycobacterium tuberculosis H37Rv
ccucaaggagcccguccag

SEQ ID NO: 3298685 - RNA, 20 nt, Mycobacterium tuberculosis H37Rv
ccucaaggagcccguccagg

SEQ ID NO: 3298686 - RNA, 16 nt, Mycobacterium tuberculosis H37Rv
ccucaaggucggccag

SEQ ID NO: 3298687 - RNA, 13 nt, Mycobacterium tuberculosis H37Rv
ccucaccagucag

SEQ ID NO: 3298688 - RNA, 13 nt, Mycobacterium tuberculosis H37Rv
ccucacccagcug

SEQ ID NO: 3298689 - RNA, 18 nt, Mycobacterium tuberculosis H37Rv
ccucaccgaacggcaggg

SEQ ID NO: 3298690 - RNA, 19 nt, Mycobacterium tuberculosis H37Rv
ccucaccgacgucgccaag

SEQ ID NO: 3298691 - RNA, 21 nt, Mycobacterium tuberculosis H37Rv
ccucaccgaucucgaccagcg

SEQ ID NO: 3298692 - RNA, 22 nt, Mycobacterium tuberculosis H37Rv
ccucaccggguuggaagccgca

SEQ ID NO: 3298693 - RNA, 23 nt, Mycobacterium tuberculosis H37Rv
ccucaccggguuggaagccgcac

SEQ ID NO: 3298694 - RNA, 15 nt, Mycobacterium tuberculosis H37Rv
ccucaccugacacgc

SEQ ID NO: 3298695 - RNA, 18 nt, Mycobacterium tuberculosis H37Rv
ccucacguggacugaccu

SEQ ID NO: 3298696 - RNA, 18 nt, Mycobacterium tuberculosis H37Rv
ccucagacagcugcacac

SEQ ID NO: 3298697 - RNA, 18 nt, Mycobacterium tuberculosis H37Rv
ccucagcccgucagccga

SEQ ID NO: 3298698 - RNA, 13 nt, Mycobacterium tuberculosis H37Rv
ccucagccgccug

SEQ ID NO: 3298699 - RNA, 21 nt, Mycobacterium tuberculosis H37Rv
ccucagcgcgguccaucccga

SEQ ID NO: 3298700 - RNA, 22 nt, Mycobacterium tuberculosis H37Rv
ccucagcgcgguccaucccgag

SEQ ID NO: 3298701 - RNA, 12 nt, Mycobacterium tuberculosis H37Rv
ccucagcggccc

SEQ ID NO: 3298702 - RNA, 21 nt, Mycobacterium tuberculosis H37Rv
ccucagcuagcgcgggcucac

SEQ ID NO: 3298703 - RNA, 22 nt, Mycobacterium tuberculosis H37Rv
ccucagcugcucgucuuggcgg

SEQ ID NO: 3298704 - RNA, 19 nt, Mycobacterium tuberculosis H37Rv
ccucaguucacgcucgacg

SEQ ID NO: 3298705 - RNA, 17 nt, Mycobacterium tuberculosis H37Rv
ccucauagagcggcacc

SEQ ID NO: 3298706 - RNA, 18 nt, Mycobacterium tuberculosis H37Rv
ccucauagagcggcacca

SEQ ID NO: 3298707 - RNA, 21 nt, Mycobacterium tuberculosis H37Rv
ccucauagagcggcaccagau

SEQ ID NO: 3298708 - RNA, 22 nt, Mycobacterium tuberculosis H37Rv
ccucauagauacagucgaccgg

SEQ ID NO: 3298709 - RNA, 15 nt, Mycobacterium tuberculosis H37Rv
ccucaucacugauca

SEQ ID NO: 3298710 - RNA, 21 nt, Mycobacterium tuberculosis H37Rv
ccucaucacugaucaaccgga

SEQ ID NO: 3298711 - RNA, 14 nt, Mycobacterium tuberculosis H37Rv
ccucaucgcagacg

SEQ ID NO: 3298712 - RNA, 20 nt, Mycobacterium tuberculosis H37Rv
ccucaucgcagacggcugcc

SEQ ID NO: 3298713 - RNA, 13 nt, Mycobacterium tuberculosis H37Rv
ccucaucgugggg

SEQ ID NO: 3298714 - RNA, 15 nt, Mycobacterium tuberculosis H37Rv
ccuccaagcccgccg

SEQ ID NO: 3298715 - RNA, 22 nt, Mycobacterium tuberculosis H37Rv
ccuccaauugcgaaccggccgu

SEQ ID NO: 3298716 - RNA, 24 nt, Mycobacterium tuberculosis H37Rv
ccuccaauugcgaaccggccgucg

SEQ ID NO: 3298717 - RNA, 14 nt, Mycobacterium tuberculosis H37Rv
ccuccacagcggcc

SEQ ID NO: 3298718 - RNA, 17 nt, Mycobacterium tuberculosis H37Rv
ccuccaccaacucgacg

SEQ ID NO: 3298719 - RNA, 12 nt, Mycobacterium tuberculosis H37Rv
ccuccacccgcc

SEQ ID NO: 3298720 - RNA, 17 nt, Mycobacterium tuberculosis H37Rv
ccuccacgcuggcgccc

SEQ ID NO: 3298721 - RNA, 22 nt, Mycobacterium tuberculosis H37Rv
ccuccacgcuggcgcccccgac

SEQ ID NO: 3298722 - RNA, 19 nt, Mycobacterium tuberculosis H37Rv
ccuccacucuucgggcggc

SEQ ID NO: 3298723 - RNA, 20 nt, Mycobacterium tuberculosis H37Rv
ccuccacugggucggugccg

SEQ ID NO: 3298724 - RNA, 21 nt, Mycobacterium tuberculosis H37Rv
ccuccagauaccaccgccgcu

SEQ ID NO: 3298725 - RNA, 17 nt, Mycobacterium tuberculosis H37Rv
ccuccagauccgggcau

SEQ ID NO: 3298726 - RNA, 11 nt, Mycobacterium tuberculosis H37Rv
ccuccagcacc

SEQ ID NO: 3298727 - RNA, 14 nt, Mycobacterium tuberculosis H37Rv
ccuccagcagcgac

SEQ ID NO: 3298728 - RNA, 15 nt, Mycobacterium tuberculosis H37Rv
ccuccagcagguccg

SEQ ID NO: 3298729 - RNA, 15 nt, Mycobacterium tuberculosis H37Rv
ccuccagccggcgaa

SEQ ID NO: 3298730 - RNA, 18 nt, Mycobacterium tuberculosis H37Rv
ccuccagcugcgcgggcg

SEQ ID NO: 3298731 - RNA, 21 nt, Mycobacterium tuberculosis H37Rv
ccuccagguagucgcgguagg

SEQ ID NO: 3298732 - RNA, 23 nt, Mycobacterium tuberculosis H37Rv
ccuccauuucgucggagaacgcc

SEQ ID NO: 3298733 - RNA, 15 nt, Mycobacterium tuberculosis H37Rv
ccucccaccagcggc

SEQ ID NO: 3298734 - RNA, 13 nt, Mycobacterium tuberculosis H37Rv
ccucccacccccg

SEQ ID NO: 3298735 - RNA, 17 nt, Mycobacterium tuberculosis H37Rv
ccucccacucacccagc

SEQ ID NO: 3298736 - RNA, 22 nt, Mycobacterium tuberculosis H37Rv
ccucccagggcucggcggcccg

SEQ ID NO: 3298737 - RNA, 12 nt, Mycobacterium tuberculosis H37Rv
ccuccccgagcg

SEQ ID NO: 3298738 - RNA, 20 nt, Mycobacterium tuberculosis H37Rv
ccucccgauucucgaucugg

SEQ ID NO: 3298739 - RNA, 23 nt, Mycobacterium tuberculosis H37Rv
ccucccgcaaugcgagcgcgccg

SEQ ID NO: 3298740 - RNA, 19 nt, Mycobacterium tuberculosis H37Rv
ccucccgcagccgggcacc

SEQ ID NO: 3298741 - RNA, 13 nt, Mycobacterium tuberculosis H37Rv
ccucccgcggcac

SEQ ID NO: 3298742 - RNA, 14 nt, Mycobacterium tuberculosis H37Rv
ccucccgcgugcgg

SEQ ID NO: 3298743 - RNA, 13 nt, Mycobacterium tuberculosis H37Rv
ccucccgggcccg

SEQ ID NO: 3298744 - RNA, 16 nt, Mycobacterium tuberculosis H37Rv
ccucccgggccgccgc

SEQ ID NO: 3298745 - RNA, 17 nt, Mycobacterium tuberculosis H37Rv
ccucccgggccgccgcg

SEQ ID NO: 3298746 - RNA, 19 nt, Mycobacterium tuberculosis H37Rv
ccucccucuagcgcccgaa

SEQ ID NO: 3298747 - RNA, 14 nt, Mycobacterium tuberculosis H37Rv
ccuccgacgcgauc

SEQ ID NO: 3298748 - RNA, 17 nt, Mycobacterium tuberculosis H37Rv
ccuccgacggccgcggc

SEQ ID NO: 3298749 - RNA, 21 nt, Mycobacterium tuberculosis H37Rv
ccuccgaggaauacagcuuga

SEQ ID NO: 3298750 - RNA, 14 nt, Mycobacterium tuberculosis H37Rv
ccuccgccaaggag

SEQ ID NO: 3298751 - RNA, 20 nt, Mycobacterium tuberculosis H37Rv
ccuccgccggcaccuccggc

SEQ ID NO: 3298752 - RNA, 18 nt, Mycobacterium tuberculosis H37Rv
ccuccgcgaucaccgacg

SEQ ID NO: 3298753 - RNA, 19 nt, Mycobacterium tuberculosis H37Rv
ccuccgcgaucaccgacga

SEQ ID NO: 3298754 - RNA, 16 nt, Mycobacterium tuberculosis H37Rv
ccuccgcgccgaucag

SEQ ID NO: 3298755 - RNA, 16 nt, Mycobacterium tuberculosis H37Rv
ccuccgcugccgcccg

SEQ ID NO: 3298756 - RNA, 17 nt, Mycobacterium tuberculosis H37Rv
ccuccggaaggcucgcc

SEQ ID NO: 3298757 - RNA, 21 nt, Mycobacterium tuberculosis H37Rv
ccuccggaaucgcccgggcgg

SEQ ID NO: 3298758 - RNA, 15 nt, Mycobacterium tuberculosis H37Rv
ccuccggacccaccc

SEQ ID NO: 3298759 - RNA, 20 nt, Mycobacterium tuberculosis H37Rv
ccuccggauaacccagcggc

SEQ ID NO: 3298760 - RNA, 20 nt, Mycobacterium tuberculosis H37Rv
ccuccggauccucggccgcc

SEQ ID NO: 3298761 - RNA, 22 nt, Mycobacterium tuberculosis H37Rv
ccuccggcaccaacgccaccgu

SEQ ID NO: 3298762 - RNA, 20 nt, Mycobacterium tuberculosis H37Rv
ccuccggcgcagcgaccggu

SEQ ID NO: 3298763 - RNA, 12 nt, Mycobacterium tuberculosis H37Rv
ccuccggcgccg

SEQ ID NO: 3298764 - RNA, 16 nt, Mycobacterium tuberculosis H37Rv
ccuccggcgccgcccg

SEQ ID NO: 3298765 - RNA, 17 nt, Mycobacterium tuberculosis H37Rv
ccuccggggugaacgcg

SEQ ID NO: 3298766 - RNA, 19 nt, Mycobacterium tuberculosis H37Rv
ccuccggggugaacgcgga

SEQ ID NO: 3298767 - RNA, 21 nt, Mycobacterium tuberculosis H37Rv
ccuccggguauggcggcgacg

SEQ ID NO: 3298768 - RNA, 17 nt, Mycobacterium tuberculosis H37Rv
ccuccgguaucggcgac

SEQ ID NO: 3298769 - RNA, 18 nt, Mycobacterium tuberculosis H37Rv
ccuccgguaucggcgacc

SEQ ID NO: 3298770 - RNA, 20 nt, Mycobacterium tuberculosis H37Rv
ccuccguaacgccaagcucg

SEQ ID NO: 3298771 - RNA, 24 nt, Mycobacterium tuberculosis H37Rv
ccuccguaacgccaagcucggccc

SEQ ID NO: 3298772 - RNA, 15 nt, Mycobacterium tuberculosis H37Rv
ccuccgucagcgccg

SEQ ID NO: 3298773 - RNA, 19 nt, Mycobacterium tuberculosis H37Rv
ccuccgucagcgccgcgcg

SEQ ID NO: 3298774 - RNA, 18 nt, Mycobacterium tuberculosis H37Rv
ccuccgugggcagcgcgc

SEQ ID NO: 3298775 - RNA, 14 nt, Mycobacterium tuberculosis H37Rv
ccuccuccccgacc

SEQ ID NO: 3298776 - RNA, 23 nt, Mycobacterium tuberculosis H37Rv
ccucgggcccguucucgcggccg

SEQ ID NO: 3298777 - RNA, 13 nt, Mycobacterium tuberculosis H37Rv
ccucgggccggcg

SEQ ID NO: 3298778 - RNA, 17 nt, Mycobacterium tuberculosis H37Rv
ccucgggguuacguugu

SEQ ID NO: 3298779 - RNA, 23 nt, Mycobacterium tuberculosis H37Rv
ccucgggguucuuccacagcgcg

SEQ ID NO: 3298780 - RNA, 18 nt, Mycobacterium tuberculosis H37Rv
ccucggguguggucacca

SEQ ID NO: 3298781 - RNA, 17 nt, Mycobacterium tuberculosis H37Rv
ccucgguacuugccacg

SEQ ID NO: 3298782 - RNA, 14 nt, Mycobacterium tuberculosis H37Rv
ccucggucaccgag

SEQ ID NO: 3298783 - RNA, 23 nt, Mycobacterium tuberculosis H37Rv
ccucggugaccaggccggcccgc

SEQ ID NO: 3298784 - RNA, 22 nt, Mycobacterium tuberculosis H37Rv
ccucggugacuucacucguuga

SEQ ID NO: 3298785 - RNA, 15 nt, Mycobacterium tuberculosis H37Rv
ccucggugagcagcu

SEQ ID NO: 3298786 - RNA, 19 nt, Mycobacterium tuberculosis H37Rv
ccucggugagcugcacgcc

SEQ ID NO: 3298787 - RNA, 17 nt, Mycobacterium tuberculosis H37Rv
ccucgguguacaccgcg

SEQ ID NO: 3298788 - RNA, 22 nt, Mycobacterium tuberculosis H37Rv
ccucguagaacgcuagcgccaa

SEQ ID NO: 3298789 - RNA, 20 nt, Mycobacterium tuberculosis H37Rv
ccucguaggcguacaccagg

SEQ ID NO: 3298790 - RNA, 17 nt, Mycobacterium tuberculosis H37Rv
ccucgucaaucaccacc

SEQ ID NO: 3298791 - RNA, 15 nt, Mycobacterium tuberculosis H37Rv
ccucguccagcucgg

SEQ ID NO: 3298792 - RNA, 16 nt, Mycobacterium tuberculosis H37Rv
ccucgucccacagguu

SEQ ID NO: 3298793 - RNA, 19 nt, Mycobacterium tuberculosis H37Rv
ccucgucgacgucggcauc

SEQ ID NO: 3298794 - RNA, 23 nt, Mycobacterium tuberculosis H37Rv
ccucgucgacgucggcaucggcg

SEQ ID NO: 3298795 - RNA, 15 nt, Mycobacterium tuberculosis H37Rv
ccucgucgaggucag

SEQ ID NO: 3298796 - RNA, 18 nt, Mycobacterium tuberculosis H37Rv
ccucgucgcgggccaccg

SEQ ID NO: 3298797 - RNA, 16 nt, Mycobacterium tuberculosis H37Rv
ccucgucgcucccggu

SEQ ID NO: 3298798 - RNA, 20 nt, Mycobacterium tuberculosis H37Rv
ccucgucgcucccgguuggg

SEQ ID NO: 3298799 - RNA, 18 nt, Mycobacterium tuberculosis H37Rv
ccucgucggcgacggcca

SEQ ID NO: 3298800 - RNA, 21 nt, Mycobacterium tuberculosis H37Rv
ccucgucggcgacggccagcg

SEQ ID NO: 3298801 - RNA, 22 nt, Mycobacterium tuberculosis H37Rv
ccucgucggugugccagugcug

SEQ ID NO: 3298802 - RNA, 23 nt, Mycobacterium tuberculosis H37Rv
ccucgucggugugccagugcugc

SEQ ID NO: 3298803 - RNA, 18 nt, Mycobacterium tuberculosis H37Rv
ccucgucguaccguucgg

SEQ ID NO: 3298804 - RNA, 17 nt, Mycobacterium tuberculosis H37Rv
ccucgucgugcaccucg

SEQ ID NO: 3298805 - RNA, 19 nt, Mycobacterium tuberculosis H37Rv
ccucgugaguugacggugg

SEQ ID NO: 3298806 - RNA, 22 nt, Mycobacterium tuberculosis H37Rv
ccucgugcacgcacagcccgau

SEQ ID NO: 3298807 - RNA, 14 nt, Mycobacterium tuberculosis H37Rv
ccucgugcagcacu

SEQ ID NO: 3298808 - RNA, 21 nt, Mycobacterium tuberculosis H37Rv
ccucgugcgugggcgcggcgc

SEQ ID NO: 3298809 - RNA, 18 nt, Mycobacterium tuberculosis H37Rv
ccucguuaucgaccgccg

SEQ ID NO: 3298810 - RNA, 19 nt, Mycobacterium tuberculosis H37Rv
ccucguuaucgaccgccgc

SEQ ID NO: 3298811 - RNA, 17 nt, Mycobacterium tuberculosis H37Rv
ccucguugcugccggcg

SEQ ID NO: 3298812 - RNA, 14 nt, Mycobacterium tuberculosis H37Rv
ccucguuguagccg

SEQ ID NO: 3298813 - RNA, 21 nt, Mycobacterium tuberculosis H37Rv
ccucuaaaccaagaaucaccg

SEQ ID NO: 3298814 - RNA, 14 nt, Mycobacterium tuberculosis H37Rv
ccucuagcgcccga

SEQ ID NO: 3298815 - RNA, 20 nt, Mycobacterium tuberculosis H37Rv
ccucuaugcgggcagcgauc

SEQ ID NO: 3298816 - RNA, 22 nt, Mycobacterium tuberculosis H37Rv
ccucuaugcgggcagcgaucuu

SEQ ID NO: 3298817 - RNA, 16 nt, Mycobacterium tuberculosis H37Rv
ccucuccguccucguc

SEQ ID NO: 3298818 - RNA, 12 nt, Mycobacterium tuberculosis H37Rv
ccucucugcgcc

SEQ ID NO: 3298819 - RNA, 15 nt, Mycobacterium tuberculosis H37Rv
ccucucugcgccagg

SEQ ID NO: 3298820 - RNA, 19 nt, Mycobacterium tuberculosis H37Rv
ccucucugucgcguugugg

SEQ ID NO: 3298821 - RNA, 17 nt, Mycobacterium tuberculosis H37Rv
ccucugcgaucaguucg

SEQ ID NO: 3298822 - RNA, 23 nt, Mycobacterium tuberculosis H37Rv
ccucugcugagcugcucgccggc

SEQ ID NO: 3298823 - RNA, 20 nt, Mycobacterium tuberculosis H37Rv
ccucugguggcgcugaagcc

SEQ ID NO: 3298824 - RNA, 14 nt, Mycobacterium tuberculosis H37Rv
ccucugucuucagc

SEQ ID NO: 3298825 - RNA, 18 nt, Mycobacterium tuberculosis H37Rv
ccucuucgaucuguuccu

SEQ ID NO: 3298826 - RNA, 15 nt, Mycobacterium tuberculosis H37Rv
ccucuucggagguga

SEQ ID NO: 3298827 - RNA, 17 nt, Mycobacterium tuberculosis H37Rv
ccucuucgggugcagcc

SEQ ID NO: 3298828 - RNA, 15 nt, Mycobacterium tuberculosis H37Rv
ccucuugcaccaggg

SEQ ID NO: 3298829 - RNA, 17 nt, Mycobacterium tuberculosis H37Rv
ccucuugcucggcgugc

SEQ ID NO: 3298830 - RNA, 23 nt, Mycobacterium tuberculosis H37Rv
ccugaaacgauugcugcggcuuu

SEQ ID NO: 3298831 - RNA, 14 nt, Mycobacterium tuberculosis H37Rv
ccugaaccggccgc

SEQ ID NO: 3298832 - RNA, 17 nt, Mycobacterium tuberculosis H37Rv
ccugaagccagcgcagc

SEQ ID NO: 3298833 - RNA, 20 nt, Mycobacterium tuberculosis H37Rv
ccugaagccgcgcugcgacu

SEQ ID NO: 3298834 - RNA, 14 nt, Mycobacterium tuberculosis H37Rv
ccugaagggccgcc

SEQ ID NO: 3298835 - RNA, 18 nt, Mycobacterium tuberculosis H37Rv
ccugacacgcccgcgagc

SEQ ID NO: 3298836 - RNA, 18 nt, Mycobacterium tuberculosis H37Rv
ccugaccgaagucugcag

SEQ ID NO: 3298837 - RNA, 17 nt, Mycobacterium tuberculosis H37Rv
ccugaccggcgguuuug

SEQ ID NO: 3298838 - RNA, 18 nt, Mycobacterium tuberculosis H37Rv
ccugaccggucacccgug

SEQ ID NO: 3298839 - RNA, 19 nt, Mycobacterium tuberculosis H37Rv
ccugacgaucauugcaccc

SEQ ID NO: 3298840 - RNA, 22 nt, Mycobacterium tuberculosis H37Rv
ccugacgccauucaucggcauc

SEQ ID NO: 3298841 - RNA, 23 nt, Mycobacterium tuberculosis H37Rv
ccugacgcucggucgccaccgcc

SEQ ID NO: 3298842 - RNA, 21 nt, Mycobacterium tuberculosis H37Rv
ccugacggaaguacuccaugg

SEQ ID NO: 3298843 - RNA, 18 nt, Mycobacterium tuberculosis H37Rv
ccugacgguacagcucca

SEQ ID NO: 3298844 - RNA, 19 nt, Mycobacterium tuberculosis H37Rv
ccugacgguacagcuccac

SEQ ID NO: 3298845 - RNA, 15 nt, Mycobacterium tuberculosis H37Rv
ccugacucaucaccg

SEQ ID NO: 3298846 - RNA, 16 nt, Mycobacterium tuberculosis H37Rv
ccugacucaucaccga

SEQ ID NO: 3298847 - RNA, 17 nt, Mycobacterium tuberculosis H37Rv
ccugagcaccaagaccg

SEQ ID NO: 3298848 - RNA, 11 nt, Mycobacterium tuberculosis H37Rv
ccugagcagau

SEQ ID NO: 3298849 - RNA, 19 nt, Mycobacterium tuberculosis H37Rv
ccugagcaucuccucgccu

SEQ ID NO: 3298850 - RNA, 14 nt, Mycobacterium tuberculosis H37Rv
ccugagccaccaac

SEQ ID NO: 3298851 - RNA, 22 nt, Mycobacterium tuberculosis H37Rv
ccugagcgucgucgccggcgcu

SEQ ID NO: 3298852 - RNA, 17 nt, Mycobacterium tuberculosis H37Rv
ccugagcgugucuggcg

SEQ ID NO: 3298853 - RNA, 13 nt, Mycobacterium tuberculosis H37Rv
ccugagcucccgc

SEQ ID NO: 3298854 - RNA, 23 nt, Mycobacterium tuberculosis H37Rv
ccugagucggcauugcugguugc

SEQ ID NO: 3298855 - RNA, 21 nt, Mycobacterium tuberculosis H37Rv
ccugauaccaauccggcugcg

SEQ ID NO: 3298856 - RNA, 15 nt, Mycobacterium tuberculosis H37Rv
ccugauugaagcccc

SEQ ID NO: 3298857 - RNA, 19 nt, Mycobacterium tuberculosis H37Rv
ccugcaacgccgcggacca

SEQ ID NO: 3298858 - RNA, 21 nt, Mycobacterium tuberculosis H37Rv
ccugcaacgucacucccuggc

SEQ ID NO: 3298859 - RNA, 13 nt, Mycobacterium tuberculosis H37Rv
ccugcaagaacca

SEQ ID NO: 3298860 - RNA, 19 nt, Mycobacterium tuberculosis H37Rv
ccugcaagaaccacugcau

SEQ ID NO: 3298861 - RNA, 12 nt, Mycobacterium tuberculosis H37Rv
ccugcacagcag

SEQ ID NO: 3298862 - RNA, 13 nt, Mycobacterium tuberculosis H37Rv
ccugcacagcagc

SEQ ID NO: 3298863 - RNA, 23 nt, Mycobacterium tuberculosis H37Rv
ccugcaccacggcggccaccugc

SEQ ID NO: 3298864 - RNA, 13 nt, Mycobacterium tuberculosis H37Rv
ccugcacccaggc

SEQ ID NO: 3298865 - RNA, 15 nt, Mycobacterium tuberculosis H37Rv
ccugcacccgacccg

SEQ ID NO: 3298866 - RNA, 12 nt, Mycobacterium tuberculosis H37Rv
ccugcacccggc

SEQ ID NO: 3298867 - RNA, 17 nt, Mycobacterium tuberculosis H37Rv
ccugcacgacccgcugg

SEQ ID NO: 3298868 - RNA, 16 nt, Mycobacterium tuberculosis H37Rv
ccugcacgccggcgcu

SEQ ID NO: 3298869 - RNA, 22 nt, Mycobacterium tuberculosis H37Rv
ccugcacgccggcgcuggagac

SEQ ID NO: 3298870 - RNA, 19 nt, Mycobacterium tuberculosis H37Rv
ccugcacgugacccugggg

SEQ ID NO: 3298871 - RNA, 22 nt, Mycobacterium tuberculosis H37Rv
ccugcagcacgacgugcgucgg

SEQ ID NO: 3298872 - RNA, 16 nt, Mycobacterium tuberculosis H37Rv
ccuggccacucccagc

SEQ ID NO: 3298873 - RNA, 22 nt, Mycobacterium tuberculosis H37Rv
ccuggccagcagagcggcacgc

SEQ ID NO: 3298874 - RNA, 12 nt, Mycobacterium tuberculosis H37Rv
ccuggccaucga

SEQ ID NO: 3298875 - RNA, 15 nt, Mycobacterium tuberculosis H37Rv
ccuggcccccgguac

SEQ ID NO: 3298876 - RNA, 23 nt, Mycobacterium tuberculosis H37Rv
ccuggcccccgguaccgcccgca

SEQ ID NO: 3298877 - RNA, 20 nt, Mycobacterium tuberculosis H37Rv
ccuggcccgauaaaugccgc

SEQ ID NO: 3298878 - RNA, 16 nt, Mycobacterium tuberculosis H37Rv
ccuggcccuuguuggc

SEQ ID NO: 3298879 - RNA, 19 nt, Mycobacterium tuberculosis H37Rv
ccuggccgccggcgccgcc

SEQ ID NO: 3298880 - RNA, 15 nt, Mycobacterium tuberculosis H37Rv
ccuggccgggaccgc

SEQ ID NO: 3298881 - RNA, 18 nt, Mycobacterium tuberculosis H37Rv
ccuggcgaacucgcgcag

SEQ ID NO: 3298882 - RNA, 16 nt, Mycobacterium tuberculosis H37Rv
ccuggcggcgccgcag

SEQ ID NO: 3298883 - RNA, 21 nt, Mycobacterium tuberculosis H37Rv
ccuggcggcgccgcagaucac

SEQ ID NO: 3298884 - RNA, 19 nt, Mycobacterium tuberculosis H37Rv
ccuggcggguggcgaugag

SEQ ID NO: 3298885 - RNA, 19 nt, Mycobacterium tuberculosis H37Rv
ccuggcggguguggcagug

SEQ ID NO: 3298886 - RNA, 17 nt, Mycobacterium tuberculosis H37Rv
ccuggcguagugcagcu

SEQ ID NO: 3298887 - RNA, 15 nt, Mycobacterium tuberculosis H37Rv
ccuggcgugucgccg

SEQ ID NO: 3298888 - RNA, 18 nt, Mycobacterium tuberculosis H37Rv
ccuggcgugucgccgcca

SEQ ID NO: 3298889 - RNA, 19 nt, Mycobacterium tuberculosis H37Rv
ccuggcgugucgccgccac

SEQ ID NO: 3298890 - RNA, 21 nt, Mycobacterium tuberculosis H37Rv
ccuggcuaucgcagaacggac

SEQ ID NO: 3298891 - RNA, 15 nt, Mycobacterium tuberculosis H37Rv
ccugggcaaacuggg

SEQ ID NO: 3298892 - RNA, 15 nt, Mycobacterium tuberculosis H37Rv
ccugggcgccccagg

SEQ ID NO: 3298893 - RNA, 23 nt, Mycobacterium tuberculosis H37Rv
ccugggcggcgcgaagucuugac

SEQ ID NO: 3298894 - RNA, 17 nt, Mycobacterium tuberculosis H37Rv
ccugggcugccggccag

SEQ ID NO: 3298895 - RNA, 13 nt, Mycobacterium tuberculosis H37Rv
ccuggggcagccg

SEQ ID NO: 3298896 - RNA, 13 nt, Mycobacterium tuberculosis H37Rv
ccuggggccacca

SEQ ID NO: 3298897 - RNA, 19 nt, Mycobacterium tuberculosis H37Rv
ccuggggccaccagaacca

SEQ ID NO: 3298898 - RNA, 12 nt, Mycobacterium tuberculosis H37Rv
ccuggggccgca

SEQ ID NO: 3298899 - RNA, 16 nt, Mycobacterium tuberculosis H37Rv
ccuggggccguccggc

SEQ ID NO: 3298900 - RNA, 19 nt, Mycobacterium tuberculosis H37Rv
ccugggguagccaucggcu

SEQ ID NO: 3298901 - RNA, 19 nt, Mycobacterium tuberculosis H37Rv
ccugggugauggccgcgcc

SEQ ID NO: 3298902 - RNA, 18 nt, Mycobacterium tuberculosis H37Rv
ccuggguugugccgcccu

SEQ ID NO: 3298903 - RNA, 18 nt, Mycobacterium tuberculosis H37Rv
ccugguaaggccggccgg

SEQ ID NO: 3298904 - RNA, 22 nt, Mycobacterium tuberculosis H37Rv
ccugguaggugucgugguagcg

SEQ ID NO: 3298905 - RNA, 14 nt, Mycobacterium tuberculosis H37Rv
ccugguagucgccc

SEQ ID NO: 3298906 - RNA, 14 nt, Mycobacterium tuberculosis H37Rv
ccuggucaaccgcg

SEQ ID NO: 3298907 - RNA, 19 nt, Mycobacterium tuberculosis H37Rv
ccuggucaccagccaccgc

SEQ ID NO: 3298908 - RNA, 18 nt, Mycobacterium tuberculosis H37Rv
ccugguccaaucgcgaca

SEQ ID NO: 3298909 - RNA, 20 nt, Mycobacterium tuberculosis H37Rv
ccugguccaggcccuggcca

SEQ ID NO: 3298910 - RNA, 16 nt, Mycobacterium tuberculosis H37Rv
ccuggucgagcacgcu

SEQ ID NO: 3298911 - RNA, 19 nt, Mycobacterium tuberculosis H37Rv
ccuggucggugacugugcg

SEQ ID NO: 3298912 - RNA, 20 nt, Mycobacterium tuberculosis H37Rv
ccuggucuuguugcgcagcg

SEQ ID NO: 3298913 - RNA, 17 nt, Mycobacterium tuberculosis H37Rv
ccuggugcaaccgugcc

SEQ ID NO: 3298914 - RNA, 13 nt, Mycobacterium tuberculosis H37Rv
ccugguggcagac

SEQ ID NO: 3298915 - RNA, 17 nt, Mycobacterium tuberculosis H37Rv
ccugguguagccgagca

SEQ ID NO: 3298916 - RNA, 13 nt, Mycobacterium tuberculosis H37Rv
ccuggugugcggg

SEQ ID NO: 3298917 - RNA, 21 nt, Mycobacterium tuberculosis H37Rv
ccugguguucgggcagcuggc

SEQ ID NO: 3298918 - RNA, 21 nt, Mycobacterium tuberculosis H37Rv
ccugguugaccucggugaaga

SEQ ID NO: 3298919 - RNA, 20 nt, Mycobacterium tuberculosis H37Rv
ccuguaguucgaugacugaa

SEQ ID NO: 3298920 - RNA, 14 nt, Mycobacterium tuberculosis H37Rv
ccuguaugccgcgg

SEQ ID NO: 3298921 - RNA, 13 nt, Mycobacterium tuberculosis H37Rv
ccuguccacccag

SEQ ID NO: 3298922 - RNA, 23 nt, Mycobacterium tuberculosis H37Rv
ccuguccggcauaccgaacagca

SEQ ID NO: 3298923 - RNA, 22 nt, Mycobacterium tuberculosis H37Rv
ccuguccugcgggaggcagcgu

SEQ ID NO: 3298924 - RNA, 16 nt, Mycobacterium tuberculosis H37Rv
ccugugcugccaacgg

SEQ ID NO: 3298925 - RNA, 19 nt, Mycobacterium tuberculosis H37Rv
ccuguguugagcggcagcc

SEQ ID NO: 3298926 - RNA, 23 nt, Mycobacterium tuberculosis H37Rv
ccuguuguugucggugucgguga

SEQ ID NO: 3298927 - RNA, 21 nt, Mycobacterium tuberculosis H37Rv
ccuguuugagcgcacucaccu

SEQ ID NO: 3298928 - RNA, 19 nt, Mycobacterium tuberculosis H37Rv
ccuuaccccgcagcucacc

SEQ ID NO: 3298929 - RNA, 19 nt, Mycobacterium tuberculosis H37Rv
ccuuaucgcucucggucag

SEQ ID NO: 3298930 - RNA, 23 nt, Mycobacterium tuberculosis H37Rv
ccuuaucgcucucggucaguucc

SEQ ID NO: 3298931 - RNA, 11 nt, Mycobacterium tuberculosis H37Rv
ccuuauugccg

SEQ ID NO: 3298932 - RNA, 21 nt, Mycobacterium tuberculosis H37Rv
ccuuauugccgagcucggcua

SEQ ID NO: 3298933 - RNA, 14 nt, Mycobacterium tuberculosis H37Rv
ccuucaaagcggcc

SEQ ID NO: 3298934 - RNA, 21 nt, Mycobacterium tuberculosis H37Rv
ccuucaaagcggccucgaccu

SEQ ID NO: 3298935 - RNA, 19 nt, Mycobacterium tuberculosis H37Rv
ccuucaccgggugacccgc

SEQ ID NO: 3298936 - RNA, 19 nt, Mycobacterium tuberculosis H37Rv
ccuucacgcuggccuccag

SEQ ID NO: 3298937 - RNA, 23 nt, Mycobacterium tuberculosis H37Rv
ccuucacgcuggccuccagcuug

SEQ ID NO: 3298938 - RNA, 23 nt, Mycobacterium tuberculosis H37Rv
ccuucagcacggugaucagcagc

SEQ ID NO: 3298939 - RNA, 15 nt, Mycobacterium tuberculosis H37Rv
ccuucagccagucca

SEQ ID NO: 3298940 - RNA, 23 nt, Mycobacterium tuberculosis H37Rv
ccuucagggcgucgaacucaucu

SEQ ID NO: 3298941 - RNA, 21 nt, Mycobacterium tuberculosis H37Rv
ccuucaucaacgacaccagau

SEQ ID NO: 3298942 - RNA, 22 nt, Mycobacterium tuberculosis H37Rv
ccuuccgacccaacgaccacca

SEQ ID NO: 3298943 - RNA, 24 nt, Mycobacterium tuberculosis H37Rv
ccuuccgacccaacgaccaccacc

SEQ ID NO: 3298944 - RNA, 23 nt, Mycobacterium tuberculosis H37Rv
ccuuccgcgcuucacagccacca

SEQ ID NO: 3298945 - RNA, 22 nt, Mycobacterium tuberculosis H37Rv
ccuucgaaugccgugccgaagu

SEQ ID NO: 3298946 - RNA, 22 nt, Mycobacterium tuberculosis H37Rv
ccuucgaguuuggugucgauca

SEQ ID NO: 3298947 - RNA, 12 nt, Mycobacterium tuberculosis H37Rv
ccuucgccgccg

SEQ ID NO: 3298948 - RNA, 15 nt, Mycobacterium tuberculosis H37Rv
ccuucgccggcgcca

SEQ ID NO: 3298949 - RNA, 16 nt, Mycobacterium tuberculosis H37Rv
ccuucgccggcgccag

SEQ ID NO: 3298950 - RNA, 22 nt, Mycobacterium tuberculosis H37Rv
ccuucgcggugugcggcagccc

SEQ ID NO: 3298951 - RNA, 18 nt, Mycobacterium tuberculosis H37Rv
ccuucguagcggccgcag

SEQ ID NO: 3298952 - RNA, 12 nt, Mycobacterium tuberculosis H37Rv
ccuucucacgca

SEQ ID NO: 3298953 - RNA, 21 nt, Mycobacterium tuberculosis H37Rv
ccuucucccgcacggccgggu

SEQ ID NO: 3298954 - RNA, 15 nt, Mycobacterium tuberculosis H37Rv
ccuucucgccgccgc

SEQ ID NO: 3298955 - RNA, 16 nt, Mycobacterium tuberculosis H37Rv
ccuucucgucggccag

SEQ ID NO: 3298956 - RNA, 15 nt, Mycobacterium tuberculosis H37Rv
ccuucugguccagca

SEQ ID NO: 3298957 - RNA, 14 nt, Mycobacterium tuberculosis H37Rv
ccuucugguucggg

SEQ ID NO: 3298958 - RNA, 20 nt, Mycobacterium tuberculosis H37Rv
ccuucuucgcuaccuucuug

SEQ ID NO: 3298959 - RNA, 13 nt, Mycobacterium tuberculosis H37Rv
ccuucuucucggc

SEQ ID NO: 3298960 - RNA, 13 nt, Mycobacterium tuberculosis H37Rv
ccuugacccgcaa

SEQ ID NO: 3298961 - RNA, 14 nt, Mycobacterium tuberculosis H37Rv
ccuugaccgaccag

SEQ ID NO: 3298962 - RNA, 13 nt, Mycobacterium tuberculosis H37Rv
ccuugaccgcggu

SEQ ID NO: 3298963 - RNA, 18 nt, Mycobacterium tuberculosis H37Rv
ccuugaccgcugcccagu

SEQ ID NO: 3298964 - RNA, 22 nt, Mycobacterium tuberculosis H37Rv
ccuugaccucggguaacguguu

SEQ ID NO: 3298965 - RNA, 22 nt, Mycobacterium tuberculosis H37Rv
ccuugacgcgcaacgccgccag

SEQ ID NO: 3298966 - RNA, 14 nt, Mycobacterium tuberculosis H37Rv
ccuugacgcggcca

SEQ ID NO: 3298967 - RNA, 16 nt, Mycobacterium tuberculosis H37Rv
ccuugacgcggccaca

SEQ ID NO: 3298968 - RNA, 13 nt, Mycobacterium tuberculosis H37Rv
ccuugacggugag

SEQ ID NO: 3298969 - RNA, 19 nt, Mycobacterium tuberculosis H37Rv
ccuugacggugagaucggg

SEQ ID NO: 3298970 - RNA, 16 nt, Mycobacterium tuberculosis H37Rv
ccuugagcaaaauggc

SEQ ID NO: 3298971 - RNA, 16 nt, Mycobacterium tuberculosis H37Rv
ccuugaggucacccau

SEQ ID NO: 3298972 - RNA, 19 nt, Mycobacterium tuberculosis H37Rv
ccuugaggucaucgggcag

SEQ ID NO: 3298973 - RNA, 17 nt, Mycobacterium tuberculosis H37Rv
ccuugaucgagcagggu

SEQ ID NO: 3298974 - RNA, 15 nt, Mycobacterium tuberculosis H37Rv
ccuugaucugagcgc

SEQ ID NO: 3298975 - RNA, 15 nt, Mycobacterium tuberculosis H37Rv
ccuugaugcgcccca

SEQ ID NO: 3298976 - RNA, 16 nt, Mycobacterium tuberculosis H37Rv
ccuugaugcggccgcg

SEQ ID NO: 3298977 - RNA, 15 nt, Mycobacterium tuberculosis H37Rv
ccuugauguccgcga

SEQ ID NO: 3298978 - RNA, 15 nt, Mycobacterium tuberculosis H37Rv
ccuugauugccgcgu

SEQ ID NO: 3298979 - RNA, 13 nt, Mycobacterium tuberculosis H37Rv
ccuugcacaagcu

SEQ ID NO: 3298980 - RNA, 21 nt, Mycobacterium tuberculosis H37Rv
ccuugcagcgcccccgcugcc

SEQ ID NO: 3298981 - RNA, 23 nt, Mycobacterium tuberculosis H37Rv
ccuugcagcgcccccgcugccau

SEQ ID NO: 3298982 - RNA, 20 nt, Mycobacterium tuberculosis H37Rv
ccuugcagcgcguucggcac

SEQ ID NO: 3298983 - RNA, 19 nt, Mycobacterium tuberculosis H37Rv
ccuugccaaucgccgucag

SEQ ID NO: 3298984 - RNA, 12 nt, Mycobacterium tuberculosis H37Rv
ccuugcccacgg

SEQ ID NO: 3298985 - RNA, 16 nt, Mycobacterium tuberculosis H37Rv
ccuugccgcccgcucc

SEQ ID NO: 3298986 - RNA, 16 nt, Mycobacterium tuberculosis H37Rv
ccuugccgccggcccc

SEQ ID NO: 3298987 - RNA, 19 nt, Mycobacterium tuberculosis H37Rv
ccuugccgccggccccgcc

SEQ ID NO: 3298988 - RNA, 19 nt, Mycobacterium tuberculosis H37Rv
ccuugccgccggcuccgcc

SEQ ID NO: 3298989 - RNA, 20 nt, Mycobacterium tuberculosis H37Rv
ccuugccgccguugccgccg

SEQ ID NO: 3298990 - RNA, 13 nt, Mycobacterium tuberculosis H37Rv
ccuugccgguggg

SEQ ID NO: 3298991 - RNA, 16 nt, Mycobacterium tuberculosis H37Rv
ccuugccuagccgcag

SEQ ID NO: 3298992 - RNA, 19 nt, Mycobacterium tuberculosis H37Rv
ccuugccuccggcgccgcc

SEQ ID NO: 3298993 - RNA, 21 nt, Mycobacterium tuberculosis H37Rv
ccuugccuccggcgccgcccg

SEQ ID NO: 3298994 - RNA, 17 nt, Mycobacterium tuberculosis H37Rv
ccuugccuuccgaccca

SEQ ID NO: 3298995 - RNA, 16 nt, Mycobacterium tuberculosis H37Rv
ccuugcgacguucuug

SEQ ID NO: 3298996 - RNA, 22 nt, Mycobacterium tuberculosis H37Rv
ccuugcgauugcgcacacccug

SEQ ID NO: 3298997 - RNA, 14 nt, Mycobacterium tuberculosis H37Rv
ccuugcgcagcacc

SEQ ID NO: 3298998 - RNA, 18 nt, Mycobacterium tuberculosis H37Rv
ccuugcgcagcaccaggg

SEQ ID NO: 3298999 - RNA, 22 nt, Mycobacterium tuberculosis H37Rv
ccuugcgcgcgcagaucgucca

SEQ ID NO: 3299000 - RNA, 16 nt, Mycobacterium tuberculosis H37Rv
ccuugcggaagaagug

SEQ ID NO: 3299001 - RNA, 14 nt, Mycobacterium tuberculosis H37Rv
ccuugcggcagacc

SEQ ID NO: 3299002 - RNA, 18 nt, Mycobacterium tuberculosis H37Rv
ccuugcggcagaccaagc

SEQ ID NO: 3299003 - RNA, 16 nt, Mycobacterium tuberculosis H37Rv
ccuugcggccgggcgg

SEQ ID NO: 3299004 - RNA, 15 nt, Mycobacterium tuberculosis H37Rv
ccuugcgggccuggu

SEQ ID NO: 3299005 - RNA, 21 nt, Mycobacterium tuberculosis H37Rv
ccuugcgguccaggccggcac

SEQ ID NO: 3299006 - RNA, 15 nt, Mycobacterium tuberculosis H37Rv
ccuugcguguaccag

SEQ ID NO: 3299007 - RNA, 19 nt, Mycobacterium tuberculosis H37Rv
ccuugcguguaccagccca

SEQ ID NO: 3299008 - RNA, 16 nt, Mycobacterium tuberculosis H37Rv
ccuugcucagcacgcc

SEQ ID NO: 3299009 - RNA, 16 nt, Mycobacterium tuberculosis H37Rv
ccuugcucagccggcc

SEQ ID NO: 3299010 - RNA, 18 nt, Mycobacterium tuberculosis H37Rv
ccuugcucagccggcccu

SEQ ID NO: 3299011 - RNA, 14 nt, Mycobacterium tuberculosis H37Rv
ccuugcuccacauc

SEQ ID NO: 3299012 - RNA, 12 nt, Mycobacterium tuberculosis H37Rv
ccuuggacucgg

SEQ ID NO: 3299013 - RNA, 14 nt, Mycobacterium tuberculosis H37Rv
ccuuggcacccucc

SEQ ID NO: 3299014 - RNA, 11 nt, Mycobacterium tuberculosis H37Rv
ccuuggcagcc

SEQ ID NO: 3299015 - RNA, 12 nt, Mycobacterium tuberculosis H37Rv
ccuuggccagca

SEQ ID NO: 3299016 - RNA, 15 nt, Mycobacterium tuberculosis H37Rv
ccuuggccagcaggg

SEQ ID NO: 3299017 - RNA, 22 nt, Mycobacterium tuberculosis H37Rv
ccuuggccagcagggccaccac

SEQ ID NO: 3299018 - RNA, 19 nt, Mycobacterium tuberculosis H37Rv
ccuuggccaggaagucccg

SEQ ID NO: 3299019 - RNA, 15 nt, Mycobacterium tuberculosis H37Rv
ccuuggcccagcggu

SEQ ID NO: 3299020 - RNA, 14 nt, Mycobacterium tuberculosis H37Rv
ccuuggcgcggcac

SEQ ID NO: 3299021 - RNA, 23 nt, Mycobacterium tuberculosis H37Rv
ccuuggcgcggcacccggucggc

SEQ ID NO: 3299022 - RNA, 16 nt, Mycobacterium tuberculosis H37Rv
ccuuggcggucggcag

SEQ ID NO: 3299023 - RNA, 13 nt, Mycobacterium tuberculosis H37Rv
ccuugggcagcuu

SEQ ID NO: 3299024 - RNA, 20 nt, Mycobacterium tuberculosis H37Rv
ccuugggcgacgcggcgccg

SEQ ID NO: 3299025 - RNA, 16 nt, Mycobacterium tuberculosis H37Rv
ccuugguagccggccg

SEQ ID NO: 3299026 - RNA, 12 nt, Mycobacterium tuberculosis H37Rv
ccuuggucaccu

SEQ ID NO: 3299027 - RNA, 15 nt, Mycobacterium tuberculosis H37Rv
ccuuggucgccgccu

SEQ ID NO: 3299028 - RNA, 15 nt, Mycobacterium tuberculosis H37Rv
ccuuggucgccggcg

SEQ ID NO: 3299029 - RNA, 22 nt, Mycobacterium tuberculosis H37Rv
ccuuggugggcagauacgagcu

SEQ ID NO: 3299030 - RNA, 18 nt, Mycobacterium tuberculosis H37Rv
ccuugguguggggcggcu

SEQ ID NO: 3299031 - RNA, 23 nt, Mycobacterium tuberculosis H37Rv
ccuugguugccaacgaaccgcuc

SEQ ID NO: 3299032 - RNA, 14 nt, Mycobacterium tuberculosis H37Rv
ccuugugaccccgg

SEQ ID NO: 3299033 - RNA, 20 nt, Mycobacterium tuberculosis H37Rv
ccuuguggucugccagcacc

SEQ ID NO: 3299034 - RNA, 20 nt, Mycobacterium tuberculosis H37Rv
ccuuguucccgaaacccgau

SEQ ID NO: 3299035 - RNA, 14 nt, Mycobacterium tuberculosis H37Rv
ccuuguucgcccac

SEQ ID NO: 3299036 - RNA, 16 nt, Mycobacterium tuberculosis H37Rv
ccuuguucuuggccac

SEQ ID NO: 3299037 - RNA, 14 nt, Mycobacterium tuberculosis H37Rv
ccuuguugccgccg

SEQ ID NO: 3299038 - RNA, 13 nt, Mycobacterium tuberculosis H37Rv
ccuuguugccgcg

SEQ ID NO: 3299039 - RNA, 20 nt, Mycobacterium tuberculosis H37Rv
ccuuguuggcgcccgggccc

SEQ ID NO: 3299040 - RNA, 20 nt, Mycobacterium tuberculosis H37Rv
ccuuguuguccuucagccag

SEQ ID NO: 3299041 - RNA, 16 nt, Mycobacterium tuberculosis H37Rv
ccuuuccggccgccug

SEQ ID NO: 3299042 - RNA, 17 nt, Mycobacterium tuberculosis H37Rv
ccuuucugaagcugagc

SEQ ID NO: 3299043 - RNA, 20 nt, Mycobacterium tuberculosis H37Rv
ccuuugagcgcggccaccag

SEQ ID NO: 3299044 - RNA, 16 nt, Mycobacterium tuberculosis H37Rv
ccuuugcacgguggca

SEQ ID NO: 3299045 - RNA, 16 nt, Mycobacterium tuberculosis H37Rv
ccuuuggccgcgaccg

SEQ ID NO: 3299046 - RNA, 20 nt, Mycobacterium tuberculosis H37Rv
ccuuugucgccuucuuggca

SEQ ID NO: 3299047 - RNA, 18 nt, Mycobacterium tuberculosis H37Rv
ccuuuguggggccgggcu

SEQ ID NO: 3299048 - RNA, 17 nt, Mycobacterium tuberculosis H37Rv
cgaaaaacaccagcgag

SEQ ID NO: 3299049 - RNA, 12 nt, Mycobacterium tuberculosis H37Rv
cgaaaacaaccc

SEQ ID NO: 3299050 - RNA, 21 nt, Mycobacterium tuberculosis H37Rv
cgaaaaccucggacugcagcg

SEQ ID NO: 3299051 - RNA, 14 nt, Mycobacterium tuberculosis H37Rv
cgaaaacugacccc

SEQ ID NO: 3299052 - RNA, 18 nt, Mycobacterium tuberculosis H37Rv
cgaaaagccguucgcguc

SEQ ID NO: 3299053 - RNA, 19 nt, Mycobacterium tuberculosis H37Rv
cgaaaagccuugacccaug

SEQ ID NO: 3299054 - RNA, 22 nt, Mycobacterium tuberculosis H37Rv
cgaaaagggcgacagcggcgac

SEQ ID NO: 3299055 - RNA, 18 nt, Mycobacterium tuberculosis H37Rv
cgaaaaguagaccgagcc

SEQ ID NO: 3299056 - RNA, 15 nt, Mycobacterium tuberculosis H37Rv
cgaaacagcacccag

SEQ ID NO: 3299057 - RNA, 19 nt, Mycobacterium tuberculosis H37Rv
cgaaacagcacccagacga

SEQ ID NO: 3299058 - RNA, 14 nt, Mycobacterium tuberculosis H37Rv
cgaaacaugcgcca

SEQ ID NO: 3299059 - RNA, 13 nt, Mycobacterium tuberculosis H37Rv
cgaaacauugccc

SEQ ID NO: 3299060 - RNA, 23 nt, Mycobacterium tuberculosis H37Rv
cgaaaccacuuccggcguggccc

SEQ ID NO: 3299061 - RNA, 15 nt, Mycobacterium tuberculosis H37Rv
cgaaaccgcagcgcg

SEQ ID NO: 3299062 - RNA, 12 nt, Mycobacterium tuberculosis H37Rv
cgaaaccgccgu

SEQ ID NO: 3299063 - RNA, 22 nt, Mycobacterium tuberculosis H37Rv
cgaaacgccauacgucgccucg

SEQ ID NO: 3299064 - RNA, 20 nt, Mycobacterium tuberculosis H37Rv
cgaaacgcccuugugaacgg

SEQ ID NO: 3299065 - RNA, 21 nt, Mycobacterium tuberculosis H37Rv
cgaacgaguccaacucggcca

SEQ ID NO: 3299066 - RNA, 16 nt, Mycobacterium tuberculosis H37Rv
cgaacgcaacgccgau

SEQ ID NO: 3299067 - RNA, 19 nt, Mycobacterium tuberculosis H37Rv
cgaacgcaacgccgauggc

SEQ ID NO: 3299068 - RNA, 15 nt, Mycobacterium tuberculosis H37Rv
cgaacgcagccagcg

SEQ ID NO: 3299069 - RNA, 14 nt, Mycobacterium tuberculosis H37Rv
cgaacgccaccacc

SEQ ID NO: 3299070 - RNA, 18 nt, Mycobacterium tuberculosis H37Rv
cgaacgccagcagcugug

SEQ ID NO: 3299071 - RNA, 23 nt, Mycobacterium tuberculosis H37Rv
cgaacgcccugacgguggugacc

SEQ ID NO: 3299072 - RNA, 16 nt, Mycobacterium tuberculosis H37Rv
cgaacgccgucgacgc

SEQ ID NO: 3299073 - RNA, 18 nt, Mycobacterium tuberculosis H37Rv
cgaacgccguggugcgca

SEQ ID NO: 3299074 - RNA, 17 nt, Mycobacterium tuberculosis H37Rv
cgaacgccucaccgacg

SEQ ID NO: 3299075 - RNA, 18 nt, Mycobacterium tuberculosis H37Rv
cgaacgccucgccggccg

SEQ ID NO: 3299076 - RNA, 19 nt, Mycobacterium tuberculosis H37Rv
cgaacgccucugcgaucag

SEQ ID NO: 3299077 - RNA, 16 nt, Mycobacterium tuberculosis H37Rv
cgaacgccugcuggua

SEQ ID NO: 3299078 - RNA, 19 nt, Mycobacterium tuberculosis H37Rv
cgaacgcgaucgaccuugg

SEQ ID NO: 3299079 - RNA, 23 nt, Mycobacterium tuberculosis H37Rv
cgaacgcggccaccgaccgcacg

SEQ ID NO: 3299080 - RNA, 14 nt, Mycobacterium tuberculosis H37Rv
cgaacgcggcgucg

SEQ ID NO: 3299081 - RNA, 20 nt, Mycobacterium tuberculosis H37Rv
cgaacgcggcgucgauaacc

SEQ ID NO: 3299082 - RNA, 16 nt, Mycobacterium tuberculosis H37Rv
cgaacgcguccagcgc

SEQ ID NO: 3299083 - RNA, 23 nt, Mycobacterium tuberculosis H37Rv
cgaacgcguccagcgcggccuug

SEQ ID NO: 3299084 - RNA, 14 nt, Mycobacterium tuberculosis H37Rv
cgaacgcuccaggc

SEQ ID NO: 3299085 - RNA, 14 nt, Mycobacterium tuberculosis H37Rv
cgaacgcugccgag

SEQ ID NO: 3299086 - RNA, 14 nt, Mycobacterium tuberculosis H37Rv
cgaacgcugcuccg

SEQ ID NO: 3299087 - RNA, 20 nt, Mycobacterium tuberculosis H37Rv
cgaacgcuucaccucgucga

SEQ ID NO: 3299088 - RNA, 17 nt, Mycobacterium tuberculosis H37Rv
cgaacgcuuccagcgug

SEQ ID NO: 3299089 - RNA, 18 nt, Mycobacterium tuberculosis H37Rv
cgaacggacccggcgcga

SEQ ID NO: 3299090 - RNA, 16 nt, Mycobacterium tuberculosis H37Rv
cgaacggaucucggug

SEQ ID NO: 3299091 - RNA, 20 nt, Mycobacterium tuberculosis H37Rv
cgaacggcaccagaucuucg

SEQ ID NO: 3299092 - RNA, 16 nt, Mycobacterium tuberculosis H37Rv
cgaacggccaggacaa

SEQ ID NO: 3299093 - RNA, 19 nt, Mycobacterium tuberculosis H37Rv
cgaacggccaggacaacgc

SEQ ID NO: 3299094 - RNA, 13 nt, Mycobacterium tuberculosis H37Rv
cgaacggcggugu

SEQ ID NO: 3299095 - RNA, 19 nt, Mycobacterium tuberculosis H37Rv
cgaacgggucggcgaccac

SEQ ID NO: 3299096 - RNA, 22 nt, Mycobacterium tuberculosis H37Rv
cgaacgggugaaggaugcggcc

SEQ ID NO: 3299097 - RNA, 17 nt, Mycobacterium tuberculosis H37Rv
cgaacgguugcucgucc

SEQ ID NO: 3299098 - RNA, 23 nt, Mycobacterium tuberculosis H37Rv
cgaacgucaaccgggcggcguuu

SEQ ID NO: 3299099 - RNA, 19 nt, Mycobacterium tuberculosis H37Rv
cgaacgugcaaccauggcg

SEQ ID NO: 3299100 - RNA, 23 nt, Mycobacterium tuberculosis H37Rv
cgaacuaucguugugcggacauc

SEQ ID NO: 3299101 - RNA, 21 nt, Mycobacterium tuberculosis H37Rv
cgaacucaucuuugacaccgg

SEQ ID NO: 3299102 - RNA, 20 nt, Mycobacterium tuberculosis H37Rv
cgaacucgaggucgagcgcc

SEQ ID NO: 3299103 - RNA, 17 nt, Mycobacterium tuberculosis H37Rv
cgaacucgcgccgagcc

SEQ ID NO: 3299104 - RNA, 23 nt, Mycobacterium tuberculosis H37Rv
cgaacucgcgccgagccagcacc

SEQ ID NO: 3299105 - RNA, 15 nt, Mycobacterium tuberculosis H37Rv
cgaacucgcgggcga

SEQ ID NO: 3299106 - RNA, 16 nt, Mycobacterium tuberculosis H37Rv
cgaacucggcgaugaa

SEQ ID NO: 3299107 - RNA, 18 nt, Mycobacterium tuberculosis H37Rv
cgaacucggcggccagcg

SEQ ID NO: 3299108 - RNA, 20 nt, Mycobacterium tuberculosis H37Rv
cgaacucggcggccagcgcg

SEQ ID NO: 3299109 - RNA, 14 nt, Mycobacterium tuberculosis H37Rv
cgaacucgggcgac

SEQ ID NO: 3299110 - RNA, 14 nt, Mycobacterium tuberculosis H37Rv
cgaacucuacggug

SEQ ID NO: 3299111 - RNA, 14 nt, Mycobacterium tuberculosis H37Rv
cgaacugaucgacc

SEQ ID NO: 3299112 - RNA, 19 nt, Mycobacterium tuberculosis H37Rv
cgaacugcagccauucuuc

SEQ ID NO: 3299113 - RNA, 20 nt, Mycobacterium tuberculosis H37Rv
cgaacugcagccauucuucg

SEQ ID NO: 3299114 - RNA, 23 nt, Mycobacterium tuberculosis H37Rv
cgaacugccgcgccgacgccgcg

SEQ ID NO: 3299115 - RNA, 17 nt, Mycobacterium tuberculosis H37Rv
cgaacugccucaaaccg

SEQ ID NO: 3299116 - RNA, 20 nt, Mycobacterium tuberculosis H37Rv
cgaacugcuugcgcaucgcc

SEQ ID NO: 3299117 - RNA, 20 nt, Mycobacterium tuberculosis H37Rv
cgaacuuccauucauggccg

SEQ ID NO: 3299118 - RNA, 12 nt, Mycobacterium tuberculosis H37Rv
cgaagaacaaca

SEQ ID NO: 3299119 - RNA, 20 nt, Mycobacterium tuberculosis H37Rv
cgaagaacaacaucgccaua

SEQ ID NO: 3299120 - RNA, 18 nt, Mycobacterium tuberculosis H37Rv
cgaagaaccgccaccaga

SEQ ID NO: 3299121 - RNA, 23 nt, Mycobacterium tuberculosis H37Rv
cgaagaaccugagcaccaagacc

SEQ ID NO: 3299122 - RNA, 19 nt, Mycobacterium tuberculosis H37Rv
cgaagaacgacgccaccgc

SEQ ID NO: 3299123 - RNA, 20 nt, Mycobacterium tuberculosis H37Rv
cgaagaagaacucggcgucg

SEQ ID NO: 3299124 - RNA, 20 nt, Mycobacterium tuberculosis H37Rv
cgaagaauaugccgaugacc

SEQ ID NO: 3299125 - RNA, 22 nt, Mycobacterium tuberculosis H37Rv
cgaagaaugggauggcaccacc

SEQ ID NO: 3299126 - RNA, 22 nt, Mycobacterium tuberculosis H37Rv
cgaagaccaagagcgcgcagca

SEQ ID NO: 3299127 - RNA, 17 nt, Mycobacterium tuberculosis H37Rv
cgaagaccucgucgcgu

SEQ ID NO: 3299128 - RNA, 15 nt, Mycobacterium tuberculosis H37Rv
cgaagagcaccgcgc

SEQ ID NO: 3299129 - RNA, 16 nt, Mycobacterium tuberculosis H37Rv
cgaagagccagcaacg

SEQ ID NO: 3299130 - RNA, 15 nt, Mycobacterium tuberculosis H37Rv
cgaagagcgcacuga

SEQ ID NO: 3299131 - RNA, 18 nt, Mycobacterium tuberculosis H37Rv
cgaagagcuccgucgcgg

SEQ ID NO: 3299132 - RNA, 14 nt, Mycobacterium tuberculosis H37Rv
cgaagaggagaacg

SEQ ID NO: 3299133 - RNA, 13 nt, Mycobacterium tuberculosis H37Rv
cgaagagggcgcc

SEQ ID NO: 3299134 - RNA, 23 nt, Mycobacterium tuberculosis H37Rv
cgaagcacaccguccgucggcgc

SEQ ID NO: 3299135 - RNA, 15 nt, Mycobacterium tuberculosis H37Rv
cgaagcaccucccga

SEQ ID NO: 3299136 - RNA, 19 nt, Mycobacterium tuberculosis H37Rv
cgaagcaucgcguuguagg

SEQ ID NO: 3299137 - RNA, 17 nt, Mycobacterium tuberculosis H37Rv
cgaagccaccaggucga

SEQ ID NO: 3299138 - RNA, 20 nt, Mycobacterium tuberculosis H37Rv
cgaagccacucaucuucucg

SEQ ID NO: 3299139 - RNA, 14 nt, Mycobacterium tuberculosis H37Rv
cgaagccagaucgc

SEQ ID NO: 3299140 - RNA, 11 nt, Mycobacterium tuberculosis H37Rv
cgaagcccacg

SEQ ID NO: 3299141 - RNA, 23 nt, Mycobacterium tuberculosis H37Rv
cgaagcccagcaccaccacccga

SEQ ID NO: 3299142 - RNA, 12 nt, Mycobacterium tuberculosis H37Rv
cgaagcccgaca

SEQ ID NO: 3299143 - RNA, 17 nt, Mycobacterium tuberculosis H37Rv
cgaagcccgaguugaag

SEQ ID NO: 3299144 - RNA, 22 nt, Mycobacterium tuberculosis H37Rv
cgaagcccggacaacuucuuua

SEQ ID NO: 3299145 - RNA, 19 nt, Mycobacterium tuberculosis H37Rv
cgaagccgaaggggaacgc

SEQ ID NO: 3299146 - RNA, 11 nt, Mycobacterium tuberculosis H37Rv
cgaagccgacc

SEQ ID NO: 3299147 - RNA, 17 nt, Mycobacterium tuberculosis H37Rv
cgaagccgccgcgacca

SEQ ID NO: 3299148 - RNA, 19 nt, Mycobacterium tuberculosis H37Rv
cgaagccgccgggugcgcc

SEQ ID NO: 3299149 - RNA, 18 nt, Mycobacterium tuberculosis H37Rv
cgaagccggcgccggcuu

SEQ ID NO: 3299150 - RNA, 16 nt, Mycobacterium tuberculosis H37Rv
cgaagccuugcagcgc

SEQ ID NO: 3299151 - RNA, 18 nt, Mycobacterium tuberculosis H37Rv
cgaagcgaucgccggccg

SEQ ID NO: 3299152 - RNA, 12 nt, Mycobacterium tuberculosis H37Rv
cgaagcgaugcc

SEQ ID NO: 3299153 - RNA, 19 nt, Mycobacterium tuberculosis H37Rv
cgaagcgggaaggcucacc

SEQ ID NO: 3299154 - RNA, 15 nt, Mycobacterium tuberculosis H37Rv
cgaagcgggcccgca

SEQ ID NO: 3299155 - RNA, 21 nt, Mycobacterium tuberculosis H37Rv
cgaagcgggcggaaacaagca

SEQ ID NO: 3299156 - RNA, 19 nt, Mycobacterium tuberculosis H37Rv
cgaagcgggcuugagcgcc

SEQ ID NO: 3299157 - RNA, 23 nt, Mycobacterium tuberculosis H37Rv
cgaagcgggcuugagcgccgaug

SEQ ID NO: 3299158 - RNA, 13 nt, Mycobacterium tuberculosis H37Rv
cgaagcggucgcg

SEQ ID NO: 3299159 - RNA, 17 nt, Mycobacterium tuberculosis H37Rv
cgaagcggugacccacu

SEQ ID NO: 3299160 - RNA, 21 nt, Mycobacterium tuberculosis H37Rv
cgaagcgucuggucagccgcg

SEQ ID NO: 3299161 - RNA, 15 nt, Mycobacterium tuberculosis H37Rv
cgacaaucaccaacg

SEQ ID NO: 3299162 - RNA, 14 nt, Mycobacterium tuberculosis H37Rv
cgacaauucccuug

SEQ ID NO: 3299163 - RNA, 12 nt, Mycobacterium tuberculosis H37Rv
cgacacacccac

SEQ ID NO: 3299164 - RNA, 19 nt, Mycobacterium tuberculosis H37Rv
cgacacauagugcggcacc

SEQ ID NO: 3299165 - RNA, 12 nt, Mycobacterium tuberculosis H37Rv
cgacaccaccag

SEQ ID NO: 3299166 - RNA, 20 nt, Mycobacterium tuberculosis H37Rv
cgacaccaccagguccaccc

SEQ ID NO: 3299167 - RNA, 17 nt, Mycobacterium tuberculosis H37Rv
cgacaccacggaccagc

SEQ ID NO: 3299168 - RNA, 21 nt, Mycobacterium tuberculosis H37Rv
cgacaccagaucguuccaggc

SEQ ID NO: 3299169 - RNA, 22 nt, Mycobacterium tuberculosis H37Rv
cgacacccaccaacacccgggc

SEQ ID NO: 3299170 - RNA, 19 nt, Mycobacterium tuberculosis H37Rv
cgacacccgaugugcccgg

SEQ ID NO: 3299171 - RNA, 11 nt, Mycobacterium tuberculosis H37Rv
cgacacccucg

SEQ ID NO: 3299172 - RNA, 22 nt, Mycobacterium tuberculosis H37Rv
cgacacccugggugccggcagc

SEQ ID NO: 3299173 - RNA, 23 nt, Mycobacterium tuberculosis H37Rv
cgacacccugggugccggcagcg

SEQ ID NO: 3299174 - RNA, 22 nt, Mycobacterium tuberculosis H37Rv
cgacaccgaggaccucgucacc

SEQ ID NO: 3299175 - RNA, 16 nt, Mycobacterium tuberculosis H37Rv
cgacaccgccaccacg

SEQ ID NO: 3299176 - RNA, 20 nt, Mycobacterium tuberculosis H37Rv
cgacaccgcggacccgcagc

SEQ ID NO: 3299177 - RNA, 16 nt, Mycobacterium tuberculosis H37Rv
cgacaccgcggugccc

SEQ ID NO: 3299178 - RNA, 15 nt, Mycobacterium tuberculosis H37Rv
cgacaccggcugacc

SEQ ID NO: 3299179 - RNA, 20 nt, Mycobacterium tuberculosis H37Rv
cgacaccggcugaccgaccc

SEQ ID NO: 3299180 - RNA, 18 nt, Mycobacterium tuberculosis H37Rv
cgacaccguccagcagcu

SEQ ID NO: 3299181 - RNA, 20 nt, Mycobacterium tuberculosis H37Rv
cgacaccucgaaggcacugc

SEQ ID NO: 3299182 - RNA, 17 nt, Mycobacterium tuberculosis H37Rv
cgacacgaaggucgcgg

SEQ ID NO: 3299183 - RNA, 22 nt, Mycobacterium tuberculosis H37Rv
cgacacgccaggugaugccgcc

SEQ ID NO: 3299184 - RNA, 17 nt, Mycobacterium tuberculosis H37Rv
cgacacgccauccacga

SEQ ID NO: 3299185 - RNA, 14 nt, Mycobacterium tuberculosis H37Rv
cgacacggugaucu

SEQ ID NO: 3299186 - RNA, 18 nt, Mycobacterium tuberculosis H37Rv
cgacacggugcugccguu

SEQ ID NO: 3299187 - RNA, 19 nt, Mycobacterium tuberculosis H37Rv
cgacacggugcugccguug

SEQ ID NO: 3299188 - RNA, 18 nt, Mycobacterium tuberculosis H37Rv
cgacacgugcaucuguga

SEQ ID NO: 3299189 - RNA, 20 nt, Mycobacterium tuberculosis H37Rv
cgacacucacgggugcuggc

SEQ ID NO: 3299190 - RNA, 16 nt, Mycobacterium tuberculosis H37Rv
cgacagacaaacuccg

SEQ ID NO: 3299191 - RNA, 12 nt, Mycobacterium tuberculosis H37Rv
cgacagcagccg

SEQ ID NO: 3299192 - RNA, 14 nt, Mycobacterium tuberculosis H37Rv
cgacagcagcgcga

SEQ ID NO: 3299193 - RNA, 14 nt, Mycobacterium tuberculosis H37Rv
cgacagcaucacgc

SEQ ID NO: 3299194 - RNA, 13 nt, Mycobacterium tuberculosis H37Rv
cgacagccaccgc

SEQ ID NO: 3299195 - RNA, 16 nt, Mycobacterium tuberculosis H37Rv
cgacagccaccgcgaa

SEQ ID NO: 3299196 - RNA, 19 nt, Mycobacterium tuberculosis H37Rv
cgacagccccaucaccacc

SEQ ID NO: 3299197 - RNA, 20 nt, Mycobacterium tuberculosis H37Rv
cgacagccccaucaccaccg

SEQ ID NO: 3299198 - RNA, 12 nt, Mycobacterium tuberculosis H37Rv
cgacagcccgcc

SEQ ID NO: 3299199 - RNA, 21 nt, Mycobacterium tuberculosis H37Rv
cgacagcccuaucagccgaga

SEQ ID NO: 3299200 - RNA, 20 nt, Mycobacterium tuberculosis H37Rv
cgacagccgauccgaucgca

SEQ ID NO: 3299201 - RNA, 22 nt, Mycobacterium tuberculosis H37Rv
cgacagccgauccgaucgcaga

SEQ ID NO: 3299202 - RNA, 14 nt, Mycobacterium tuberculosis H37Rv
cgacagccguggcg

SEQ ID NO: 3299203 - RNA, 15 nt, Mycobacterium tuberculosis H37Rv
cgacagccguggcgc

SEQ ID NO: 3299204 - RNA, 14 nt, Mycobacterium tuberculosis H37Rv
cgacagcgcggcgg

SEQ ID NO: 3299205 - RNA, 18 nt, Mycobacterium tuberculosis H37Rv
cgacagcgcggcggucga

SEQ ID NO: 3299206 - RNA, 17 nt, Mycobacterium tuberculosis H37Rv
cgacagcgcugggccca

SEQ ID NO: 3299207 - RNA, 14 nt, Mycobacterium tuberculosis H37Rv
cgacagcggcaccg

SEQ ID NO: 3299208 - RNA, 19 nt, Mycobacterium tuberculosis H37Rv
cgacagcggcgacaugauc

SEQ ID NO: 3299209 - RNA, 15 nt, Mycobacterium tuberculosis H37Rv
cgacagcggcgucgg

SEQ ID NO: 3299210 - RNA, 22 nt, Mycobacterium tuberculosis H37Rv
cgacagcucaucgauccucgcc

SEQ ID NO: 3299211 - RNA, 20 nt, Mycobacterium tuberculosis H37Rv
cgacagcugccugaccggcg

SEQ ID NO: 3299212 - RNA, 14 nt, Mycobacterium tuberculosis H37Rv
cgacaggccaccgc

SEQ ID NO: 3299213 - RNA, 14 nt, Mycobacterium tuberculosis H37Rv
cgacaggccggcca

SEQ ID NO: 3299214 - RNA, 23 nt, Mycobacterium tuberculosis H37Rv
cgacagggaauucccaugcugcg

SEQ ID NO: 3299215 - RNA, 15 nt, Mycobacterium tuberculosis H37Rv
cgacaggugaaggug

SEQ ID NO: 3299216 - RNA, 17 nt, Mycobacterium tuberculosis H37Rv
cgacaggugcucgucau

SEQ ID NO: 3299217 - RNA, 13 nt, Mycobacterium tuberculosis H37Rv
cgacagugcgcau

SEQ ID NO: 3299218 - RNA, 15 nt, Mycobacterium tuberculosis H37Rv
cgacagugcgcauca

SEQ ID NO: 3299219 - RNA, 15 nt, Mycobacterium tuberculosis H37Rv
cgacaguggcucacc

SEQ ID NO: 3299220 - RNA, 17 nt, Mycobacterium tuberculosis H37Rv
cgacaguggucccggug

SEQ ID NO: 3299221 - RNA, 22 nt, Mycobacterium tuberculosis H37Rv
cgacaguugcgccagcguuagg

SEQ ID NO: 3299222 - RNA, 21 nt, Mycobacterium tuberculosis H37Rv
cgacaguuuaccgugccgccc

SEQ ID NO: 3299223 - RNA, 15 nt, Mycobacterium tuberculosis H37Rv
cgacaucaccaccga

SEQ ID NO: 3299224 - RNA, 18 nt, Mycobacterium tuberculosis H37Rv
cgacaucaccaccgcacg

SEQ ID NO: 3299225 - RNA, 15 nt, Mycobacterium tuberculosis H37Rv
cgacaucaccgaacg

SEQ ID NO: 3299226 - RNA, 20 nt, Mycobacterium tuberculosis H37Rv
cgacaucauggugaaggcaa

SEQ ID NO: 3299227 - RNA, 14 nt, Mycobacterium tuberculosis H37Rv
cgacaucgcugcga

SEQ ID NO: 3299228 - RNA, 20 nt, Mycobacterium tuberculosis H37Rv
cgacaucgguggcggccucc

SEQ ID NO: 3299229 - RNA, 22 nt, Mycobacterium tuberculosis H37Rv
cgacaucgguggcggccuccga

SEQ ID NO: 3299230 - RNA, 20 nt, Mycobacterium tuberculosis H37Rv
cgacaucucggucagaugcg

SEQ ID NO: 3299231 - RNA, 16 nt, Mycobacterium tuberculosis H37Rv
cgacaugacgcggcca

SEQ ID NO: 3299232 - RNA, 12 nt, Mycobacterium tuberculosis H37Rv
cgacaugagcgc

SEQ ID NO: 3299233 - RNA, 16 nt, Mycobacterium tuberculosis H37Rv
cgacaugcccgccaau

SEQ ID NO: 3299234 - RNA, 23 nt, Mycobacterium tuberculosis H37Rv
cgacaugcccgccaauccgcguc

SEQ ID NO: 3299235 - RNA, 18 nt, Mycobacterium tuberculosis H37Rv
cgacaugguccgaccagc

SEQ ID NO: 3299236 - RNA, 20 nt, Mycobacterium tuberculosis H37Rv
cgacaugguccgaccagcgg

SEQ ID NO: 3299237 - RNA, 11 nt, Mycobacterium tuberculosis H37Rv
cgacauucguc

SEQ ID NO: 3299238 - RNA, 18 nt, Mycobacterium tuberculosis H37Rv
cgacauucguccgggcaa

SEQ ID NO: 3299239 - RNA, 19 nt, Mycobacterium tuberculosis H37Rv
cgacauuggccgucaucgc

SEQ ID NO: 3299240 - RNA, 18 nt, Mycobacterium tuberculosis H37Rv
cgacauuggucaccugcu

SEQ ID NO: 3299241 - RNA, 15 nt, Mycobacterium tuberculosis H37Rv
cgaccaacacgucga

SEQ ID NO: 3299242 - RNA, 19 nt, Mycobacterium tuberculosis H37Rv
cgaccaacacgucgagcag

SEQ ID NO: 3299243 - RNA, 18 nt, Mycobacterium tuberculosis H37Rv
cgaccaagguguccagca

SEQ ID NO: 3299244 - RNA, 15 nt, Mycobacterium tuberculosis H37Rv
cgaccaagucaugcc

SEQ ID NO: 3299245 - RNA, 21 nt, Mycobacterium tuberculosis H37Rv
cgaccaauaccaguccguuca

SEQ ID NO: 3299246 - RNA, 19 nt, Mycobacterium tuberculosis H37Rv
cgaccaauucgcaaucggc

SEQ ID NO: 3299247 - RNA, 15 nt, Mycobacterium tuberculosis H37Rv
cgaccacaucaugcc

SEQ ID NO: 3299248 - RNA, 14 nt, Mycobacterium tuberculosis H37Rv
cgaccacauuccgc

SEQ ID NO: 3299249 - RNA, 19 nt, Mycobacterium tuberculosis H37Rv
cgaccacauuccgcagucc

SEQ ID NO: 3299250 - RNA, 12 nt, Mycobacterium tuberculosis H37Rv
cgaccaccacca

SEQ ID NO: 3299251 - RNA, 15 nt, Mycobacterium tuberculosis H37Rv
cgaccaccaccaacg

SEQ ID NO: 3299252 - RNA, 12 nt, Mycobacterium tuberculosis H37Rv
cgaccaccaccc

SEQ ID NO: 3299253 - RNA, 16 nt, Mycobacterium tuberculosis H37Rv
cgaccaccaccgccgc

SEQ ID NO: 3299254 - RNA, 15 nt, Mycobacterium tuberculosis H37Rv
cgaccaccagcgccg

SEQ ID NO: 3299255 - RNA, 18 nt, Mycobacterium tuberculosis H37Rv
cgaccaccccgagcggcu

SEQ ID NO: 3299256 - RNA, 13 nt, Mycobacterium tuberculosis H37Rv
cgaccaccgccga

SEQ ID NO: 3299257 - RNA, 14 nt, Mycobacterium tuberculosis H37Rv
cgaccaccgccgag

SEQ ID NO: 3299258 - RNA, 12 nt, Mycobacterium tuberculosis H37Rv
cgaccgaccagc

SEQ ID NO: 3299259 - RNA, 16 nt, Mycobacterium tuberculosis H37Rv
cgaccgaccuggucgg

SEQ ID NO: 3299260 - RNA, 20 nt, Mycobacterium tuberculosis H37Rv
cgaccgaccuggucggugac

SEQ ID NO: 3299261 - RNA, 23 nt, Mycobacterium tuberculosis H37Rv
cgaccgacggacuucccgcgcga

SEQ ID NO: 3299262 - RNA, 15 nt, Mycobacterium tuberculosis H37Rv
cgaccgagucgacgu

SEQ ID NO: 3299263 - RNA, 17 nt, Mycobacterium tuberculosis H37Rv
cgaccgagucgacgugu

SEQ ID NO: 3299264 - RNA, 18 nt, Mycobacterium tuberculosis H37Rv
cgaccgauagcuggccga

SEQ ID NO: 3299265 - RNA, 15 nt, Mycobacterium tuberculosis H37Rv
cgaccgaucggcgcg

SEQ ID NO: 3299266 - RNA, 20 nt, Mycobacterium tuberculosis H37Rv
cgaccgaucggcgcgucgau

SEQ ID NO: 3299267 - RNA, 17 nt, Mycobacterium tuberculosis H37Rv
cgaccgcaccgugccga

SEQ ID NO: 3299268 - RNA, 15 nt, Mycobacterium tuberculosis H37Rv
cgaccgcacgaucgc

SEQ ID NO: 3299269 - RNA, 16 nt, Mycobacterium tuberculosis H37Rv
cgaccgcacgaucgca

SEQ ID NO: 3299270 - RNA, 23 nt, Mycobacterium tuberculosis H37Rv
cgaccgcauccggucucggccga

SEQ ID NO: 3299271 - RNA, 16 nt, Mycobacterium tuberculosis H37Rv
cgaccgcccgccaacu

SEQ ID NO: 3299272 - RNA, 16 nt, Mycobacterium tuberculosis H37Rv
cgaccgcccgccagcg

SEQ ID NO: 3299273 - RNA, 16 nt, Mycobacterium tuberculosis H37Rv
cgaccgccgcgagcag

SEQ ID NO: 3299274 - RNA, 18 nt, Mycobacterium tuberculosis H37Rv
cgaccgccgcgagcagaa

SEQ ID NO: 3299275 - RNA, 18 nt, Mycobacterium tuberculosis H37Rv
cgaccgccgcuaccccag

SEQ ID NO: 3299276 - RNA, 20 nt, Mycobacterium tuberculosis H37Rv
cgaccgccuccucgauagcg

SEQ ID NO: 3299277 - RNA, 12 nt, Mycobacterium tuberculosis H37Rv
cgaccgccugca

SEQ ID NO: 3299278 - RNA, 20 nt, Mycobacterium tuberculosis H37Rv
cgaccgccugcaacacgcga

SEQ ID NO: 3299279 - RNA, 16 nt, Mycobacterium tuberculosis H37Rv
cgaccgcgagcaucug

SEQ ID NO: 3299280 - RNA, 20 nt, Mycobacterium tuberculosis H37Rv
cgaccgcgaugggauaccgc

SEQ ID NO: 3299281 - RNA, 17 nt, Mycobacterium tuberculosis H37Rv
cgaccgcgcacggcugg

SEQ ID NO: 3299282 - RNA, 14 nt, Mycobacterium tuberculosis H37Rv
cgaccgcgccgcau

SEQ ID NO: 3299283 - RNA, 22 nt, Mycobacterium tuberculosis H37Rv
cgaccgcgcucaccggggccgu

SEQ ID NO: 3299284 - RNA, 16 nt, Mycobacterium tuberculosis H37Rv
cgaccgcggccccgcc

SEQ ID NO: 3299285 - RNA, 20 nt, Mycobacterium tuberculosis H37Rv
cgaccgcggccccgccguug

SEQ ID NO: 3299286 - RNA, 16 nt, Mycobacterium tuberculosis H37Rv
cgaccgcggccgggug

SEQ ID NO: 3299287 - RNA, 14 nt, Mycobacterium tuberculosis H37Rv
cgaccgcggccuug

SEQ ID NO: 3299288 - RNA, 15 nt, Mycobacterium tuberculosis H37Rv
cgaccgcggccuugg

SEQ ID NO: 3299289 - RNA, 14 nt, Mycobacterium tuberculosis H37Rv
cgaccgcggcggca

SEQ ID NO: 3299290 - RNA, 16 nt, Mycobacterium tuberculosis H37Rv
cgaccgcgggccgacg

SEQ ID NO: 3299291 - RNA, 14 nt, Mycobacterium tuberculosis H37Rv
cgaccgcggucgcc

SEQ ID NO: 3299292 - RNA, 14 nt, Mycobacterium tuberculosis H37Rv
cgaccgcggucgcu

SEQ ID NO: 3299293 - RNA, 16 nt, Mycobacterium tuberculosis H37Rv
cgaccgcggucgcugc

SEQ ID NO: 3299294 - RNA, 15 nt, Mycobacterium tuberculosis H37Rv
cgaccgcgugcaccg

SEQ ID NO: 3299295 - RNA, 22 nt, Mycobacterium tuberculosis H37Rv
cgaccgcuaugaugccgccggu

SEQ ID NO: 3299296 - RNA, 13 nt, Mycobacterium tuberculosis H37Rv
cgaccgcucccgg

SEQ ID NO: 3299297 - RNA, 22 nt, Mycobacterium tuberculosis H37Rv
cgaccgcugguucucgcuguug

SEQ ID NO: 3299298 - RNA, 20 nt, Mycobacterium tuberculosis H37Rv
cgaccggaacguuccugcac

SEQ ID NO: 3299299 - RNA, 21 nt, Mycobacterium tuberculosis H37Rv
cgaccggaacuguggugccug

SEQ ID NO: 3299300 - RNA, 19 nt, Mycobacterium tuberculosis H37Rv
cgaccggacacuccugcac

SEQ ID NO: 3299301 - RNA, 15 nt, Mycobacterium tuberculosis H37Rv
cgaccggaccggggg

SEQ ID NO: 3299302 - RNA, 15 nt, Mycobacterium tuberculosis H37Rv
cgaccggacgagcgu

SEQ ID NO: 3299303 - RNA, 15 nt, Mycobacterium tuberculosis H37Rv
cgaccggacgaucag

SEQ ID NO: 3299304 - RNA, 19 nt, Mycobacterium tuberculosis H37Rv
cgaccggacgaucagggug

SEQ ID NO: 3299305 - RNA, 14 nt, Mycobacterium tuberculosis H37Rv
cgaccggagccgcc

SEQ ID NO: 3299306 - RNA, 20 nt, Mycobacterium tuberculosis H37Rv
cgaccggcaacgcggccuug

SEQ ID NO: 3299307 - RNA, 14 nt, Mycobacterium tuberculosis H37Rv
cgaccggcacccgc

SEQ ID NO: 3299308 - RNA, 16 nt, Mycobacterium tuberculosis H37Rv
cgaccggcacccgcgg

SEQ ID NO: 3299309 - RNA, 15 nt, Mycobacterium tuberculosis H37Rv
cgaccggcacggugg

SEQ ID NO: 3299310 - RNA, 14 nt, Mycobacterium tuberculosis H37Rv
cgaccggcagcgau

SEQ ID NO: 3299311 - RNA, 15 nt, Mycobacterium tuberculosis H37Rv
cgaccggcagcgaug

SEQ ID NO: 3299312 - RNA, 16 nt, Mycobacterium tuberculosis H37Rv
cgaccggcgaccggcg

SEQ ID NO: 3299313 - RNA, 17 nt, Mycobacterium tuberculosis H37Rv
cgaccggcgagcccgca

SEQ ID NO: 3299314 - RNA, 12 nt, Mycobacterium tuberculosis H37Rv
cgaccggcggga

SEQ ID NO: 3299315 - RNA, 12 nt, Mycobacterium tuberculosis H37Rv
cgaccggcguug

SEQ ID NO: 3299316 - RNA, 15 nt, Mycobacterium tuberculosis H37Rv
cgaccggcuaccggc

SEQ ID NO: 3299317 - RNA, 18 nt, Mycobacterium tuberculosis H37Rv
cgaccgggaacagggugg

SEQ ID NO: 3299318 - RNA, 16 nt, Mycobacterium tuberculosis H37Rv
cgaccgggccgcacgg

SEQ ID NO: 3299319 - RNA, 18 nt, Mycobacterium tuberculosis H37Rv
cgaccgggcucuggccag

SEQ ID NO: 3299320 - RNA, 19 nt, Mycobacterium tuberculosis H37Rv
cgaccgggucgcaaccgcc

SEQ ID NO: 3299321 - RNA, 20 nt, Mycobacterium tuberculosis H37Rv
cgaccgggucgcaaccgccg

SEQ ID NO: 3299322 - RNA, 21 nt, Mycobacterium tuberculosis H37Rv
cgaccgggucgcaaccgccgc

SEQ ID NO: 3299323 - RNA, 17 nt, Mycobacterium tuberculosis H37Rv
cgaccgguacccguagc

SEQ ID NO: 3299324 - RNA, 12 nt, Mycobacterium tuberculosis H37Rv
cgaccggucagc

SEQ ID NO: 3299325 - RNA, 16 nt, Mycobacterium tuberculosis H37Rv
cgaccggucagcgcgc

SEQ ID NO: 3299326 - RNA, 18 nt, Mycobacterium tuberculosis H37Rv
cgaccgguccagccaacg

SEQ ID NO: 3299327 - RNA, 20 nt, Mycobacterium tuberculosis H37Rv
cgaccggucuggcgaugacg

SEQ ID NO: 3299328 - RNA, 19 nt, Mycobacterium tuberculosis H37Rv
cgaccgguggcgucaugcc

SEQ ID NO: 3299329 - RNA, 23 nt, Mycobacterium tuberculosis H37Rv
cgaccgguuggguagcaccgauu

SEQ ID NO: 3299330 - RNA, 19 nt, Mycobacterium tuberculosis H37Rv
cgaccguauugaccagcgg

SEQ ID NO: 3299331 - RNA, 20 nt, Mycobacterium tuberculosis H37Rv
cgaccguauugaccagcggg

SEQ ID NO: 3299332 - RNA, 21 nt, Mycobacterium tuberculosis H37Rv
cgaccgucacaagucgacacg

SEQ ID NO: 3299333 - RNA, 13 nt, Mycobacterium tuberculosis H37Rv
cgaccgucaccgg

SEQ ID NO: 3299334 - RNA, 15 nt, Mycobacterium tuberculosis H37Rv
cgaccgucacugaug

SEQ ID NO: 3299335 - RNA, 18 nt, Mycobacterium tuberculosis H37Rv
cgaccgucacugaugggc

SEQ ID NO: 3299336 - RNA, 23 nt, Mycobacterium tuberculosis H37Rv
cgaccgucacugaugggccgguu

SEQ ID NO: 3299337 - RNA, 16 nt, Mycobacterium tuberculosis H37Rv
cgaccgucccagcgcc

SEQ ID NO: 3299338 - RNA, 12 nt, Mycobacterium tuberculosis H37Rv
cgaccguccggg

SEQ ID NO: 3299339 - RNA, 17 nt, Mycobacterium tuberculosis H37Rv
cgaccguccgggucacc

SEQ ID NO: 3299340 - RNA, 20 nt, Mycobacterium tuberculosis H37Rv
cgaccguccgggucaccagc

SEQ ID NO: 3299341 - RNA, 12 nt, Mycobacterium tuberculosis H37Rv
cgaccgucgcgc

SEQ ID NO: 3299342 - RNA, 15 nt, Mycobacterium tuberculosis H37Rv
cgaccgucgcgcugc

SEQ ID NO: 3299343 - RNA, 22 nt, Mycobacterium tuberculosis H37Rv
cgaccgucguccagacgccacu

SEQ ID NO: 3299344 - RNA, 14 nt, Mycobacterium tuberculosis H37Rv
cgaccgugaucagc

SEQ ID NO: 3299345 - RNA, 15 nt, Mycobacterium tuberculosis H37Rv
cgaccgugcugggcg

SEQ ID NO: 3299346 - RNA, 22 nt, Mycobacterium tuberculosis H37Rv
cgaccgugguggucgggcgcaa

SEQ ID NO: 3299347 - RNA, 13 nt, Mycobacterium tuberculosis H37Rv
cgaccgugucacc

SEQ ID NO: 3299348 - RNA, 18 nt, Mycobacterium tuberculosis H37Rv
cgaccgugucaccgccgg

SEQ ID NO: 3299349 - RNA, 14 nt, Mycobacterium tuberculosis H37Rv
cgaccguugcauac

SEQ ID NO: 3299350 - RNA, 19 nt, Mycobacterium tuberculosis H37Rv
cgaccucacccacccgcgg

SEQ ID NO: 3299351 - RNA, 16 nt, Mycobacterium tuberculosis H37Rv
cgaccucacgaaucgc

SEQ ID NO: 3299352 - RNA, 16 nt, Mycobacterium tuberculosis H37Rv
cgaccucacugcggcg

SEQ ID NO: 3299353 - RNA, 14 nt, Mycobacterium tuberculosis H37Rv
cgaccucaucggca

SEQ ID NO: 3299354 - RNA, 15 nt, Mycobacterium tuberculosis H37Rv
cgaccucaucggcac

SEQ ID NO: 3299355 - RNA, 23 nt, Mycobacterium tuberculosis H37Rv
cgacgaugugccaggugcgguga

SEQ ID NO: 3299356 - RNA, 20 nt, Mycobacterium tuberculosis H37Rv
cgacgauuaccagcggcacc

SEQ ID NO: 3299357 - RNA, 16 nt, Mycobacterium tuberculosis H37Rv
cgacgcaaagcagcgc

SEQ ID NO: 3299358 - RNA, 15 nt, Mycobacterium tuberculosis H37Rv
cgacgcacacccggu

SEQ ID NO: 3299359 - RNA, 19 nt, Mycobacterium tuberculosis H37Rv
cgacgcaccaacgcgauca

SEQ ID NO: 3299360 - RNA, 20 nt, Mycobacterium tuberculosis H37Rv
cgacgcaccaacgcgaucag

SEQ ID NO: 3299361 - RNA, 20 nt, Mycobacterium tuberculosis H37Rv
cgacgcacugccccgcaucg

SEQ ID NO: 3299362 - RNA, 21 nt, Mycobacterium tuberculosis H37Rv
cgacgcacugccccgcaucgc

SEQ ID NO: 3299363 - RNA, 18 nt, Mycobacterium tuberculosis H37Rv
cgacgcagaacggcguug

SEQ ID NO: 3299364 - RNA, 20 nt, Mycobacterium tuberculosis H37Rv
cgacgcagugcccgaucgcu

SEQ ID NO: 3299365 - RNA, 17 nt, Mycobacterium tuberculosis H37Rv
cgacgcauaaccggcgc

SEQ ID NO: 3299366 - RNA, 20 nt, Mycobacterium tuberculosis H37Rv
cgacgcauaaccggcgcgcc

SEQ ID NO: 3299367 - RNA, 15 nt, Mycobacterium tuberculosis H37Rv
cgacgccaacgccag

SEQ ID NO: 3299368 - RNA, 16 nt, Mycobacterium tuberculosis H37Rv
cgacgccaacgccagc

SEQ ID NO: 3299369 - RNA, 17 nt, Mycobacterium tuberculosis H37Rv
cgacgccaacgccagcg

SEQ ID NO: 3299370 - RNA, 15 nt, Mycobacterium tuberculosis H37Rv
cgacgccaaugccgc

SEQ ID NO: 3299371 - RNA, 16 nt, Mycobacterium tuberculosis H37Rv
cgacgccaaugccgcg

SEQ ID NO: 3299372 - RNA, 12 nt, Mycobacterium tuberculosis H37Rv
cgacgccaccgc

SEQ ID NO: 3299373 - RNA, 15 nt, Mycobacterium tuberculosis H37Rv
cgacgccaccgccac

SEQ ID NO: 3299374 - RNA, 17 nt, Mycobacterium tuberculosis H37Rv
cgacgccaccgccacca

SEQ ID NO: 3299375 - RNA, 22 nt, Mycobacterium tuberculosis H37Rv
cgacgccagcugcccgacguug

SEQ ID NO: 3299376 - RNA, 13 nt, Mycobacterium tuberculosis H37Rv
cgacgccaguguu

SEQ ID NO: 3299377 - RNA, 15 nt, Mycobacterium tuberculosis H37Rv
cgacgccauggucag

SEQ ID NO: 3299378 - RNA, 18 nt, Mycobacterium tuberculosis H37Rv
cgacgccaugucgauguc

SEQ ID NO: 3299379 - RNA, 15 nt, Mycobacterium tuberculosis H37Rv
cgacgcccaccguug

SEQ ID NO: 3299380 - RNA, 23 nt, Mycobacterium tuberculosis H37Rv
cgacgcccauggcgucgaaccag

SEQ ID NO: 3299381 - RNA, 16 nt, Mycobacterium tuberculosis H37Rv
cgacgccccgaucggc

SEQ ID NO: 3299382 - RNA, 16 nt, Mycobacterium tuberculosis H37Rv
cgacgcccgccaccgg

SEQ ID NO: 3299383 - RNA, 17 nt, Mycobacterium tuberculosis H37Rv
cgacgcccgcccuggca

SEQ ID NO: 3299384 - RNA, 13 nt, Mycobacterium tuberculosis H37Rv
cgacgcccgccuu

SEQ ID NO: 3299385 - RNA, 21 nt, Mycobacterium tuberculosis H37Rv
cgacgcccucacaacgauugc

SEQ ID NO: 3299386 - RNA, 16 nt, Mycobacterium tuberculosis H37Rv
cgacgccgaaaaugcc

SEQ ID NO: 3299387 - RNA, 17 nt, Mycobacterium tuberculosis H37Rv
cgacgccgaaaaugccg

SEQ ID NO: 3299388 - RNA, 18 nt, Mycobacterium tuberculosis H37Rv
cgacgccgaaaaugccgc

SEQ ID NO: 3299389 - RNA, 23 nt, Mycobacterium tuberculosis H37Rv
cgacgccgaaaaugccgcccagc

SEQ ID NO: 3299390 - RNA, 23 nt, Mycobacterium tuberculosis H37Rv
cgacgccgacgaugacgcgcgaa

SEQ ID NO: 3299391 - RNA, 13 nt, Mycobacterium tuberculosis H37Rv
cgacgccgaucgc

SEQ ID NO: 3299392 - RNA, 19 nt, Mycobacterium tuberculosis H37Rv
cgacgccgaucgcggcggc

SEQ ID NO: 3299393 - RNA, 13 nt, Mycobacterium tuberculosis H37Rv
cgacgccgcagcg

SEQ ID NO: 3299394 - RNA, 16 nt, Mycobacterium tuberculosis H37Rv
cgacgccgcagcgucc

SEQ ID NO: 3299395 - RNA, 14 nt, Mycobacterium tuberculosis H37Rv
cgacgccgccaccc

SEQ ID NO: 3299396 - RNA, 17 nt, Mycobacterium tuberculosis H37Rv
cgacgccgccacccggc

SEQ ID NO: 3299397 - RNA, 16 nt, Mycobacterium tuberculosis H37Rv
cgacgccgccggcccc

SEQ ID NO: 3299398 - RNA, 14 nt, Mycobacterium tuberculosis H37Rv
cgacgccgccggcg

SEQ ID NO: 3299399 - RNA, 14 nt, Mycobacterium tuberculosis H37Rv
cgacgccgcgcagc

SEQ ID NO: 3299400 - RNA, 21 nt, Mycobacterium tuberculosis H37Rv
cgacgccgcucccgcacaagc

SEQ ID NO: 3299401 - RNA, 15 nt, Mycobacterium tuberculosis H37Rv
cgacgccgcuggaga

SEQ ID NO: 3299402 - RNA, 15 nt, Mycobacterium tuberculosis H37Rv
cgacgccggccuggc

SEQ ID NO: 3299403 - RNA, 14 nt, Mycobacterium tuberculosis H37Rv
cgacgccggccuug

SEQ ID NO: 3299404 - RNA, 14 nt, Mycobacterium tuberculosis H37Rv
cgacgccgguggca

SEQ ID NO: 3299405 - RNA, 21 nt, Mycobacterium tuberculosis H37Rv
cgacgccgguggcagagccgc

SEQ ID NO: 3299406 - RNA, 22 nt, Mycobacterium tuberculosis H37Rv
cgacgccggugucggcuggucg

SEQ ID NO: 3299407 - RNA, 14 nt, Mycobacterium tuberculosis H37Rv
cgacgccugcggcg

SEQ ID NO: 3299408 - RNA, 15 nt, Mycobacterium tuberculosis H37Rv
cgacgcgacacacgc

SEQ ID NO: 3299409 - RNA, 18 nt, Mycobacterium tuberculosis H37Rv
cgacgcgacacacgccgc

SEQ ID NO: 3299410 - RNA, 17 nt, Mycobacterium tuberculosis H37Rv
cgacgcgacacgccgau

SEQ ID NO: 3299411 - RNA, 13 nt, Mycobacterium tuberculosis H37Rv
cgacgcgaucugu

SEQ ID NO: 3299412 - RNA, 19 nt, Mycobacterium tuberculosis H37Rv
cgacgcgaugacacaccgc

SEQ ID NO: 3299413 - RNA, 14 nt, Mycobacterium tuberculosis H37Rv
cgacgcgauggccg

SEQ ID NO: 3299414 - RNA, 19 nt, Mycobacterium tuberculosis H37Rv
cgacgcgauggccgccagu

SEQ ID NO: 3299415 - RNA, 20 nt, Mycobacterium tuberculosis H37Rv
cgacgcgcauucgccgggcg

SEQ ID NO: 3299416 - RNA, 18 nt, Mycobacterium tuberculosis H37Rv
cgacgcgcccgcgcgcuc

SEQ ID NO: 3299417 - RNA, 21 nt, Mycobacterium tuberculosis H37Rv
cgacgcgcgagaacacccgug

SEQ ID NO: 3299418 - RNA, 14 nt, Mycobacterium tuberculosis H37Rv
cgacgcgcucggcg

SEQ ID NO: 3299419 - RNA, 23 nt, Mycobacterium tuberculosis H37Rv
cgacgcggaguccgucgacaccg

SEQ ID NO: 3299420 - RNA, 20 nt, Mycobacterium tuberculosis H37Rv
cgacgcggccagcggcaagg

SEQ ID NO: 3299421 - RNA, 16 nt, Mycobacterium tuberculosis H37Rv
cgacgcggccggccgc

SEQ ID NO: 3299422 - RNA, 22 nt, Mycobacterium tuberculosis H37Rv
cgacgcgguggugauugacggu

SEQ ID NO: 3299423 - RNA, 16 nt, Mycobacterium tuberculosis H37Rv
cgacgcguagcacggc

SEQ ID NO: 3299424 - RNA, 14 nt, Mycobacterium tuberculosis H37Rv
cgacgcgucggcga

SEQ ID NO: 3299425 - RNA, 15 nt, Mycobacterium tuberculosis H37Rv
cgacgcgucggcgac

SEQ ID NO: 3299426 - RNA, 17 nt, Mycobacterium tuberculosis H37Rv
cgacgcgugucugggac

SEQ ID NO: 3299427 - RNA, 16 nt, Mycobacterium tuberculosis H37Rv
cgacgcguuccucgac

SEQ ID NO: 3299428 - RNA, 18 nt, Mycobacterium tuberculosis H37Rv
cgacgcguuccucgacgu

SEQ ID NO: 3299429 - RNA, 17 nt, Mycobacterium tuberculosis H37Rv
cgacgcguugcucgaaa

SEQ ID NO: 3299430 - RNA, 14 nt, Mycobacterium tuberculosis H37Rv
cgacgcucaucucg

SEQ ID NO: 3299431 - RNA, 15 nt, Mycobacterium tuberculosis H37Rv
cgacgcucgcugcag

SEQ ID NO: 3299432 - RNA, 16 nt, Mycobacterium tuberculosis H37Rv
cgacgcucgcugcagc

SEQ ID NO: 3299433 - RNA, 17 nt, Mycobacterium tuberculosis H37Rv
cgacgcucgcugcagca

SEQ ID NO: 3299434 - RNA, 15 nt, Mycobacterium tuberculosis H37Rv
cgacgcugccgccag

SEQ ID NO: 3299435 - RNA, 19 nt, Mycobacterium tuberculosis H37Rv
cgacgcugccgccaggcuc

SEQ ID NO: 3299436 - RNA, 18 nt, Mycobacterium tuberculosis H37Rv
cgacgcuggucggcggcu

SEQ ID NO: 3299437 - RNA, 19 nt, Mycobacterium tuberculosis H37Rv
cgacggacuucccgcgcga

SEQ ID NO: 3299438 - RNA, 19 nt, Mycobacterium tuberculosis H37Rv
cgacggaguucgacgucgg

SEQ ID NO: 3299439 - RNA, 15 nt, Mycobacterium tuberculosis H37Rv
cgacggaugaucagc

SEQ ID NO: 3299440 - RNA, 24 nt, Mycobacterium tuberculosis H37Rv
cgacggcaagcgcaucgcacagcg

SEQ ID NO: 3299441 - RNA, 13 nt, Mycobacterium tuberculosis H37Rv
cgacggcaccaug

SEQ ID NO: 3299442 - RNA, 16 nt, Mycobacterium tuberculosis H37Rv
cgacggcagugcugca

SEQ ID NO: 3299443 - RNA, 15 nt, Mycobacterium tuberculosis H37Rv
cgacggcaucgucga

SEQ ID NO: 3299444 - RNA, 17 nt, Mycobacterium tuberculosis H37Rv
cgacggcauguaccgac

SEQ ID NO: 3299445 - RNA, 22 nt, Mycobacterium tuberculosis H37Rv
cgacggcauuucagcgcgccgc

SEQ ID NO: 3299446 - RNA, 21 nt, Mycobacterium tuberculosis H37Rv
cgacggccaccccgucggggu

SEQ ID NO: 3299447 - RNA, 22 nt, Mycobacterium tuberculosis H37Rv
cgacggccaccccgucgggguc

SEQ ID NO: 3299448 - RNA, 20 nt, Mycobacterium tuberculosis H37Rv
cgacggccacgguggagcgc

SEQ ID NO: 3299449 - RNA, 16 nt, Mycobacterium tuberculosis H37Rv
cgacggccagcaagac

SEQ ID NO: 3299450 - RNA, 23 nt, Mycobacterium tuberculosis H37Rv
cgacggccagcaagacgaugaca

SEQ ID NO: 3299451 - RNA, 15 nt, Mycobacterium tuberculosis H37Rv
cgacuaccaucgccg

SEQ ID NO: 3299452 - RNA, 17 nt, Mycobacterium tuberculosis H37Rv
cgacuagacgccgccgc

SEQ ID NO: 3299453 - RNA, 22 nt, Mycobacterium tuberculosis H37Rv
cgacuaucggccgccggaucag

SEQ ID NO: 3299454 - RNA, 13 nt, Mycobacterium tuberculosis H37Rv
cgacucacacacc

SEQ ID NO: 3299455 - RNA, 16 nt, Mycobacterium tuberculosis H37Rv
cgacucacccacccgc

SEQ ID NO: 3299456 - RNA, 13 nt, Mycobacterium tuberculosis H37Rv
cgacucacggauc

SEQ ID NO: 3299457 - RNA, 13 nt, Mycobacterium tuberculosis H37Rv
cgacucaggucgg

SEQ ID NO: 3299458 - RNA, 23 nt, Mycobacterium tuberculosis H37Rv
cgacucaggucggugcggucauc

SEQ ID NO: 3299459 - RNA, 14 nt, Mycobacterium tuberculosis H37Rv
cgacucaucggccg

SEQ ID NO: 3299460 - RNA, 16 nt, Mycobacterium tuberculosis H37Rv
cgacuccagcaccagc

SEQ ID NO: 3299461 - RNA, 21 nt, Mycobacterium tuberculosis H37Rv
cgacuccagcaccagcacggc

SEQ ID NO: 3299462 - RNA, 22 nt, Mycobacterium tuberculosis H37Rv
cgacuccagcaccagcacggca

SEQ ID NO: 3299463 - RNA, 15 nt, Mycobacterium tuberculosis H37Rv
cgacucccccucuac

SEQ ID NO: 3299464 - RNA, 17 nt, Mycobacterium tuberculosis H37Rv
cgacuccccgccgggca

SEQ ID NO: 3299465 - RNA, 20 nt, Mycobacterium tuberculosis H37Rv
cgacucgaggaccugcucgg

SEQ ID NO: 3299466 - RNA, 16 nt, Mycobacterium tuberculosis H37Rv
cgacucgccggcgaau

SEQ ID NO: 3299467 - RNA, 18 nt, Mycobacterium tuberculosis H37Rv
cgacucggccgugaccga

SEQ ID NO: 3299468 - RNA, 22 nt, Mycobacterium tuberculosis H37Rv
cgacucggcggcgcggucgaag

SEQ ID NO: 3299469 - RNA, 23 nt, Mycobacterium tuberculosis H37Rv
cgacucggcggcgcggucgaagc

SEQ ID NO: 3299470 - RNA, 15 nt, Mycobacterium tuberculosis H37Rv
cgacucggugcggug

SEQ ID NO: 3299471 - RNA, 16 nt, Mycobacterium tuberculosis H37Rv
cgacucggugcgguga

SEQ ID NO: 3299472 - RNA, 18 nt, Mycobacterium tuberculosis H37Rv
cgacucgguugaggacga

SEQ ID NO: 3299473 - RNA, 19 nt, Mycobacterium tuberculosis H37Rv
cgacucguggcgccacggc

SEQ ID NO: 3299474 - RNA, 16 nt, Mycobacterium tuberculosis H37Rv
cgacucgugucugccu

SEQ ID NO: 3299475 - RNA, 18 nt, Mycobacterium tuberculosis H37Rv
cgacucgugucugccucg

SEQ ID NO: 3299476 - RNA, 18 nt, Mycobacterium tuberculosis H37Rv
cgacucucaucgacucga

SEQ ID NO: 3299477 - RNA, 17 nt, Mycobacterium tuberculosis H37Rv
cgacugagaucgcuucc

SEQ ID NO: 3299478 - RNA, 20 nt, Mycobacterium tuberculosis H37Rv
cgacugaucaagugccagcg

SEQ ID NO: 3299479 - RNA, 16 nt, Mycobacterium tuberculosis H37Rv
cgacugauccucgaug

SEQ ID NO: 3299480 - RNA, 16 nt, Mycobacterium tuberculosis H37Rv
cgacugcaacucuucc

SEQ ID NO: 3299481 - RNA, 21 nt, Mycobacterium tuberculosis H37Rv
cgacugcagaaacagccgcag

SEQ ID NO: 3299482 - RNA, 22 nt, Mycobacterium tuberculosis H37Rv
cgacugcagaaacagccgcagc

SEQ ID NO: 3299483 - RNA, 13 nt, Mycobacterium tuberculosis H37Rv
cgacugccagcgc

SEQ ID NO: 3299484 - RNA, 15 nt, Mycobacterium tuberculosis H37Rv
cgacugccgcgggca

SEQ ID NO: 3299485 - RNA, 16 nt, Mycobacterium tuberculosis H37Rv
cgacuggaaggcgggc

SEQ ID NO: 3299486 - RNA, 20 nt, Mycobacterium tuberculosis H37Rv
cgacuggccguuucggcgcc

SEQ ID NO: 3299487 - RNA, 18 nt, Mycobacterium tuberculosis H37Rv
cgacuggcgcccagccgg

SEQ ID NO: 3299488 - RNA, 14 nt, Mycobacterium tuberculosis H37Rv
cgacugggacgacg

SEQ ID NO: 3299489 - RNA, 19 nt, Mycobacterium tuberculosis H37Rv
cgacuggguggugcucacc

SEQ ID NO: 3299490 - RNA, 14 nt, Mycobacterium tuberculosis H37Rv
cgacugugcgccgc

SEQ ID NO: 3299491 - RNA, 14 nt, Mycobacterium tuberculosis H37Rv
cgacuucgcccggg

SEQ ID NO: 3299492 - RNA, 13 nt, Mycobacterium tuberculosis H37Rv
cgacuucggcguc

SEQ ID NO: 3299493 - RNA, 15 nt, Mycobacterium tuberculosis H37Rv
cgacuucggcgucgg

SEQ ID NO: 3299494 - RNA, 16 nt, Mycobacterium tuberculosis H37Rv
cgacuucgggaacgcu

SEQ ID NO: 3299495 - RNA, 12 nt, Mycobacterium tuberculosis H37Rv
cgacuucuccag

SEQ ID NO: 3299496 - RNA, 20 nt, Mycobacterium tuberculosis H37Rv
cgacuugccuagcgcgggcu

SEQ ID NO: 3299497 - RNA, 18 nt, Mycobacterium tuberculosis H37Rv
cgacuugcggugcucacc

SEQ ID NO: 3299498 - RNA, 13 nt, Mycobacterium tuberculosis H37Rv
cgacuugcuggcg

SEQ ID NO: 3299499 - RNA, 13 nt, Mycobacterium tuberculosis H37Rv
cgacuuggcaucg

SEQ ID NO: 3299500 - RNA, 15 nt, Mycobacterium tuberculosis H37Rv
cgacuuggcaucgcg

SEQ ID NO: 3299501 - RNA, 19 nt, Mycobacterium tuberculosis H37Rv
cgacuuggugacaccgagg

SEQ ID NO: 3299502 - RNA, 14 nt, Mycobacterium tuberculosis H37Rv
cgacuugucgccgu

SEQ ID NO: 3299503 - RNA, 18 nt, Mycobacterium tuberculosis H37Rv
cgacuuucaucgcgagaa

SEQ ID NO: 3299504 - RNA, 13 nt, Mycobacterium tuberculosis H37Rv
cgagaacacccgu

SEQ ID NO: 3299505 - RNA, 14 nt, Mycobacterium tuberculosis H37Rv
cgagaacaccggcc

SEQ ID NO: 3299506 - RNA, 14 nt, Mycobacterium tuberculosis H37Rv
cgagaacgcccgag

SEQ ID NO: 3299507 - RNA, 22 nt, Mycobacterium tuberculosis H37Rv
cgagaacgcccgagugaccagg

SEQ ID NO: 3299508 - RNA, 12 nt, Mycobacterium tuberculosis H37Rv
cgagaacgucga

SEQ ID NO: 3299509 - RNA, 21 nt, Mycobacterium tuberculosis H37Rv
cgagaagaucucguagccgcc

SEQ ID NO: 3299510 - RNA, 21 nt, Mycobacterium tuberculosis H37Rv
cgagaagcguugcacugcugg

SEQ ID NO: 3299511 - RNA, 15 nt, Mycobacterium tuberculosis H37Rv
cgagaagucgcagcg

SEQ ID NO: 3299512 - RNA, 15 nt, Mycobacterium tuberculosis H37Rv
cgagaaucacgguca

SEQ ID NO: 3299513 - RNA, 13 nt, Mycobacterium tuberculosis H37Rv
cgagaaucccggg

SEQ ID NO: 3299514 - RNA, 16 nt, Mycobacterium tuberculosis H37Rv
cgagaccaacgcgcag

SEQ ID NO: 3299515 - RNA, 17 nt, Mycobacterium tuberculosis H37Rv
cgagaccaacgcgcagg

SEQ ID NO: 3299516 - RNA, 20 nt, Mycobacterium tuberculosis H37Rv
cgagaccaacgcgcaggccg

SEQ ID NO: 3299517 - RNA, 21 nt, Mycobacterium tuberculosis H37Rv
cgagaccgaaacuugcucacc

SEQ ID NO: 3299518 - RNA, 14 nt, Mycobacterium tuberculosis H37Rv
cgagaccgccgcug

SEQ ID NO: 3299519 - RNA, 16 nt, Mycobacterium tuberculosis H37Rv
cgagaccgccgcugcc

SEQ ID NO: 3299520 - RNA, 18 nt, Mycobacterium tuberculosis H37Rv
cgagaccgcgagcagcac

SEQ ID NO: 3299521 - RNA, 20 nt, Mycobacterium tuberculosis H37Rv
cgagaccgcgagcagcacag

SEQ ID NO: 3299522 - RNA, 14 nt, Mycobacterium tuberculosis H37Rv
cgagaccggcaccg

SEQ ID NO: 3299523 - RNA, 16 nt, Mycobacterium tuberculosis H37Rv
cgagaccggcaccggc

SEQ ID NO: 3299524 - RNA, 22 nt, Mycobacterium tuberculosis H37Rv
cgagacgaccuccucgaugacc

SEQ ID NO: 3299525 - RNA, 18 nt, Mycobacterium tuberculosis H37Rv
cgagacgcacggccaccg

SEQ ID NO: 3299526 - RNA, 18 nt, Mycobacterium tuberculosis H37Rv
cgagacgcuuuccgccgc

SEQ ID NO: 3299527 - RNA, 14 nt, Mycobacterium tuberculosis H37Rv
cgagacggccacgu

SEQ ID NO: 3299528 - RNA, 21 nt, Mycobacterium tuberculosis H37Rv
cgagacggcgucgggccguug

SEQ ID NO: 3299529 - RNA, 22 nt, Mycobacterium tuberculosis H37Rv
cgagacggcguugucgacgaag

SEQ ID NO: 3299530 - RNA, 23 nt, Mycobacterium tuberculosis H37Rv
cgagacgucgaacuucagcggcg

SEQ ID NO: 3299531 - RNA, 15 nt, Mycobacterium tuberculosis H37Rv
cgagacuccgccuug

SEQ ID NO: 3299532 - RNA, 14 nt, Mycobacterium tuberculosis H37Rv
cgagacuucgacgc

SEQ ID NO: 3299533 - RNA, 14 nt, Mycobacterium tuberculosis H37Rv
cgagagaguucgca

SEQ ID NO: 3299534 - RNA, 18 nt, Mycobacterium tuberculosis H37Rv
cgagagaguucgcaugcu

SEQ ID NO: 3299535 - RNA, 18 nt, Mycobacterium tuberculosis H37Rv
cgagagcagccagccacc

SEQ ID NO: 3299536 - RNA, 19 nt, Mycobacterium tuberculosis H37Rv
cgagagccccgaccagcag

SEQ ID NO: 3299537 - RNA, 15 nt, Mycobacterium tuberculosis H37Rv
cgagagccgaccggg

SEQ ID NO: 3299538 - RNA, 21 nt, Mycobacterium tuberculosis H37Rv
cgagagccgaccggguaaagc

SEQ ID NO: 3299539 - RNA, 16 nt, Mycobacterium tuberculosis H37Rv
cgagagccucggccau

SEQ ID NO: 3299540 - RNA, 15 nt, Mycobacterium tuberculosis H37Rv
cgagagcgcuguccc

SEQ ID NO: 3299541 - RNA, 16 nt, Mycobacterium tuberculosis H37Rv
cgagaggagggcggcc

SEQ ID NO: 3299542 - RNA, 20 nt, Mycobacterium tuberculosis H37Rv
cgagagggaucacgccacca

SEQ ID NO: 3299543 - RNA, 16 nt, Mycobacterium tuberculosis H37Rv
cgagauaaccaccauc

SEQ ID NO: 3299544 - RNA, 13 nt, Mycobacterium tuberculosis H37Rv
cgagauacggcca

SEQ ID NO: 3299545 - RNA, 18 nt, Mycobacterium tuberculosis H37Rv
cgagauacggccaccagg

SEQ ID NO: 3299546 - RNA, 19 nt, Mycobacterium tuberculosis H37Rv
cgagauacggccaccaggu

SEQ ID NO: 3299547 - RNA, 13 nt, Mycobacterium tuberculosis H37Rv
cgagaucaccgcc

SEQ ID NO: 3299548 - RNA, 15 nt, Mycobacterium tuberculosis H37Rv
cgagccacccaccga

SEQ ID NO: 3299549 - RNA, 14 nt, Mycobacterium tuberculosis H37Rv
cgagccacgccagc

SEQ ID NO: 3299550 - RNA, 21 nt, Mycobacterium tuberculosis H37Rv
cgagccacgccagcgucgacc

SEQ ID NO: 3299551 - RNA, 14 nt, Mycobacterium tuberculosis H37Rv
cgagccagcggagc

SEQ ID NO: 3299552 - RNA, 13 nt, Mycobacterium tuberculosis H37Rv
cgagccagcuccg

SEQ ID NO: 3299553 - RNA, 20 nt, Mycobacterium tuberculosis H37Rv
cgagccaucgucgagcgcga

SEQ ID NO: 3299554 - RNA, 16 nt, Mycobacterium tuberculosis H37Rv
cgagcccaccgucgca

SEQ ID NO: 3299555 - RNA, 20 nt, Mycobacterium tuberculosis H37Rv
cgagcccacgcgccaccgag

SEQ ID NO: 3299556 - RNA, 18 nt, Mycobacterium tuberculosis H37Rv
cgagcccagccgggcacc

SEQ ID NO: 3299557 - RNA, 15 nt, Mycobacterium tuberculosis H37Rv
cgagcccagcgccuc

SEQ ID NO: 3299558 - RNA, 19 nt, Mycobacterium tuberculosis H37Rv
cgagcccagcgccuccagc

SEQ ID NO: 3299559 - RNA, 14 nt, Mycobacterium tuberculosis H37Rv
cgagcccagcugcg

SEQ ID NO: 3299560 - RNA, 13 nt, Mycobacterium tuberculosis H37Rv
cgagcccgauggu

SEQ ID NO: 3299561 - RNA, 14 nt, Mycobacterium tuberculosis H37Rv
cgagcccgcaucgc

SEQ ID NO: 3299562 - RNA, 13 nt, Mycobacterium tuberculosis H37Rv
cgagcccgccagc

SEQ ID NO: 3299563 - RNA, 17 nt, Mycobacterium tuberculosis H37Rv
cgagcccgccagcgccg

SEQ ID NO: 3299564 - RNA, 18 nt, Mycobacterium tuberculosis H37Rv
cgagcccgccagcgccgc

SEQ ID NO: 3299565 - RNA, 20 nt, Mycobacterium tuberculosis H37Rv
cgagcccgccagcgccgcug

SEQ ID NO: 3299566 - RNA, 13 nt, Mycobacterium tuberculosis H37Rv
cgagcccggugcu

SEQ ID NO: 3299567 - RNA, 16 nt, Mycobacterium tuberculosis H37Rv
cgagcccggugcuacc

SEQ ID NO: 3299568 - RNA, 20 nt, Mycobacterium tuberculosis H37Rv
cgagcccggugcuaccggcu

SEQ ID NO: 3299569 - RNA, 15 nt, Mycobacterium tuberculosis H37Rv
cgagcccgucgauca

SEQ ID NO: 3299570 - RNA, 13 nt, Mycobacterium tuberculosis H37Rv
cgagccgacaucg

SEQ ID NO: 3299571 - RNA, 22 nt, Mycobacterium tuberculosis H37Rv
cgagccgaccaccccgagcggc

SEQ ID NO: 3299572 - RNA, 21 nt, Mycobacterium tuberculosis H37Rv
cgagccgacccgacgcugguc

SEQ ID NO: 3299573 - RNA, 23 nt, Mycobacterium tuberculosis H37Rv
cgagccgacccgacgcuggucgg

SEQ ID NO: 3299574 - RNA, 14 nt, Mycobacterium tuberculosis H37Rv
cgagccgaccgcgg

SEQ ID NO: 3299575 - RNA, 20 nt, Mycobacterium tuberculosis H37Rv
cgagccgauauaccagggca

SEQ ID NO: 3299576 - RNA, 13 nt, Mycobacterium tuberculosis H37Rv
cgagccgcacagc

SEQ ID NO: 3299577 - RNA, 16 nt, Mycobacterium tuberculosis H37Rv
cgagccgcacagcaug

SEQ ID NO: 3299578 - RNA, 13 nt, Mycobacterium tuberculosis H37Rv
cgagccgcacgau

SEQ ID NO: 3299579 - RNA, 14 nt, Mycobacterium tuberculosis H37Rv
cgagccgccaccgu

SEQ ID NO: 3299580 - RNA, 24 nt, Mycobacterium tuberculosis H37Rv
cgagccgccaccguacgacagucg

SEQ ID NO: 3299581 - RNA, 14 nt, Mycobacterium tuberculosis H37Rv
cgagccgccgugga

SEQ ID NO: 3299582 - RNA, 22 nt, Mycobacterium tuberculosis H37Rv
cgagccgcgauugugcagcgaa

SEQ ID NO: 3299583 - RNA, 14 nt, Mycobacterium tuberculosis H37Rv
cgagccgcggcaac

SEQ ID NO: 3299584 - RNA, 21 nt, Mycobacterium tuberculosis H37Rv
cgagccgcggcaacaccaccu

SEQ ID NO: 3299585 - RNA, 22 nt, Mycobacterium tuberculosis H37Rv
cgagccgcggucggcgugcagg

SEQ ID NO: 3299586 - RNA, 15 nt, Mycobacterium tuberculosis H37Rv
cgagccgcuaggacg

SEQ ID NO: 3299587 - RNA, 13 nt, Mycobacterium tuberculosis H37Rv
cgagccgcucgcu

SEQ ID NO: 3299588 - RNA, 14 nt, Mycobacterium tuberculosis H37Rv
cgagccggaacagu

SEQ ID NO: 3299589 - RNA, 20 nt, Mycobacterium tuberculosis H37Rv
cgagccggauucggcugcca

SEQ ID NO: 3299590 - RNA, 19 nt, Mycobacterium tuberculosis H37Rv
cgagccgggguuaggcgca

SEQ ID NO: 3299591 - RNA, 21 nt, Mycobacterium tuberculosis H37Rv
cgagccgguauacucggcccc

SEQ ID NO: 3299592 - RNA, 19 nt, Mycobacterium tuberculosis H37Rv
cgagccggugccacugccg

SEQ ID NO: 3299593 - RNA, 18 nt, Mycobacterium tuberculosis H37Rv
cgagccgguggcgugggc

SEQ ID NO: 3299594 - RNA, 16 nt, Mycobacterium tuberculosis H37Rv
cgagccgucgucgagc

SEQ ID NO: 3299595 - RNA, 15 nt, Mycobacterium tuberculosis H37Rv
cgagccgugccagca

SEQ ID NO: 3299596 - RNA, 14 nt, Mycobacterium tuberculosis H37Rv
cgagccucgcgcgc

SEQ ID NO: 3299597 - RNA, 16 nt, Mycobacterium tuberculosis H37Rv
cgagccucgcgcgcca

SEQ ID NO: 3299598 - RNA, 21 nt, Mycobacterium tuberculosis H37Rv
cgagccucgcgcgccacggug

SEQ ID NO: 3299599 - RNA, 20 nt, Mycobacterium tuberculosis H37Rv
cgagccucgcucuccauggc

SEQ ID NO: 3299600 - RNA, 20 nt, Mycobacterium tuberculosis H37Rv
cgagccugauaaagcccggc

SEQ ID NO: 3299601 - RNA, 23 nt, Mycobacterium tuberculosis H37Rv
cgagccugauaaagcccggcggc

SEQ ID NO: 3299602 - RNA, 20 nt, Mycobacterium tuberculosis H37Rv
cgagcgaaccgaagccgucg

SEQ ID NO: 3299603 - RNA, 21 nt, Mycobacterium tuberculosis H37Rv
cgagcgaccgucccagcgccg

SEQ ID NO: 3299604 - RNA, 14 nt, Mycobacterium tuberculosis H37Rv
cgagcgagccaacu

SEQ ID NO: 3299605 - RNA, 18 nt, Mycobacterium tuberculosis H37Rv
cgagcgauacgucgucag

SEQ ID NO: 3299606 - RNA, 20 nt, Mycobacterium tuberculosis H37Rv
cgagcgcaagagccguccga

SEQ ID NO: 3299607 - RNA, 16 nt, Mycobacterium tuberculosis H37Rv
cgagcgcaaucgacca

SEQ ID NO: 3299608 - RNA, 19 nt, Mycobacterium tuberculosis H37Rv
cgagcgcaaucgaccacga

SEQ ID NO: 3299609 - RNA, 17 nt, Mycobacterium tuberculosis H37Rv
cgagcgcacaccggcuu

SEQ ID NO: 3299610 - RNA, 13 nt, Mycobacterium tuberculosis H37Rv
cgagcgcaccacg

SEQ ID NO: 3299611 - RNA, 17 nt, Mycobacterium tuberculosis H37Rv
cgagcgcaccgcugacc

SEQ ID NO: 3299612 - RNA, 19 nt, Mycobacterium tuberculosis H37Rv
cgagcgcaccgcugaccgc

SEQ ID NO: 3299613 - RNA, 12 nt, Mycobacterium tuberculosis H37Rv
cgagcgcacugg

SEQ ID NO: 3299614 - RNA, 20 nt, Mycobacterium tuberculosis H37Rv
cgagcgcacuggggaggcca

SEQ ID NO: 3299615 - RNA, 13 nt, Mycobacterium tuberculosis H37Rv
cgagcgcagcgca

SEQ ID NO: 3299616 - RNA, 14 nt, Mycobacterium tuberculosis H37Rv
cgagcgcaucaggg

SEQ ID NO: 3299617 - RNA, 15 nt, Mycobacterium tuberculosis H37Rv
cgagcgcaucggcca

SEQ ID NO: 3299618 - RNA, 23 nt, Mycobacterium tuberculosis H37Rv
cgagcgcauguugcaggcgcagc

SEQ ID NO: 3299619 - RNA, 15 nt, Mycobacterium tuberculosis H37Rv
cgagcgcccgcagcg

SEQ ID NO: 3299620 - RNA, 19 nt, Mycobacterium tuberculosis H37Rv
cgagcgccgcuaugaggca

SEQ ID NO: 3299621 - RNA, 23 nt, Mycobacterium tuberculosis H37Rv
cgagcgccucaagcucgccggau

SEQ ID NO: 3299622 - RNA, 21 nt, Mycobacterium tuberculosis H37Rv
cgagcgccuugucgaucucgu

SEQ ID NO: 3299623 - RNA, 13 nt, Mycobacterium tuberculosis H37Rv
cgagcgcgccaau

SEQ ID NO: 3299624 - RNA, 17 nt, Mycobacterium tuberculosis H37Rv
cgagcgcgccgaaggcg

SEQ ID NO: 3299625 - RNA, 20 nt, Mycobacterium tuberculosis H37Rv
cgagcgcgccgcgcucgccg

SEQ ID NO: 3299626 - RNA, 15 nt, Mycobacterium tuberculosis H37Rv
cgagcgcgccggcca

SEQ ID NO: 3299627 - RNA, 14 nt, Mycobacterium tuberculosis H37Rv
cgagcgcgccuuca

SEQ ID NO: 3299628 - RNA, 13 nt, Mycobacterium tuberculosis H37Rv
cgagcgcgcgacg

SEQ ID NO: 3299629 - RNA, 16 nt, Mycobacterium tuberculosis H37Rv
cgagcgcggugccgcc

SEQ ID NO: 3299630 - RNA, 18 nt, Mycobacterium tuberculosis H37Rv
cgagcgcggugccgccac

SEQ ID NO: 3299631 - RNA, 15 nt, Mycobacterium tuberculosis H37Rv
cgagcgcgucgguca

SEQ ID NO: 3299632 - RNA, 18 nt, Mycobacterium tuberculosis H37Rv
cgagcgcgucggucaccg

SEQ ID NO: 3299633 - RNA, 16 nt, Mycobacterium tuberculosis H37Rv
cgagcgcuaucaccgc

SEQ ID NO: 3299634 - RNA, 17 nt, Mycobacterium tuberculosis H37Rv
cgagcgcuaucaccgcc

SEQ ID NO: 3299635 - RNA, 18 nt, Mycobacterium tuberculosis H37Rv
cgagcgcuaucaccgccu

SEQ ID NO: 3299636 - RNA, 20 nt, Mycobacterium tuberculosis H37Rv
cgagcgcuugaccccgccga

SEQ ID NO: 3299637 - RNA, 19 nt, Mycobacterium tuberculosis H37Rv
cgagcggcaucggucaccg

SEQ ID NO: 3299638 - RNA, 23 nt, Mycobacterium tuberculosis H37Rv
cgagcggcaucggucaccgcggc

SEQ ID NO: 3299639 - RNA, 15 nt, Mycobacterium tuberculosis H37Rv
cgagcggccgcgcgc

SEQ ID NO: 3299640 - RNA, 16 nt, Mycobacterium tuberculosis H37Rv
cgagcggccgcgcgca

SEQ ID NO: 3299641 - RNA, 16 nt, Mycobacterium tuberculosis H37Rv
cgagcggccuccagca

SEQ ID NO: 3299642 - RNA, 19 nt, Mycobacterium tuberculosis H37Rv
cgagcggccuccagcaccc

SEQ ID NO: 3299643 - RNA, 14 nt, Mycobacterium tuberculosis H37Rv
cgagcgguacgccc

SEQ ID NO: 3299644 - RNA, 12 nt, Mycobacterium tuberculosis H37Rv
cgaggcgaucac

SEQ ID NO: 3299645 - RNA, 19 nt, Mycobacterium tuberculosis H37Rv
cgaggcgcccagcgacaac

SEQ ID NO: 3299646 - RNA, 12 nt, Mycobacterium tuberculosis H37Rv
cgaggcggcggu

SEQ ID NO: 3299647 - RNA, 18 nt, Mycobacterium tuberculosis H37Rv
cgaggcggcggucgagcu

SEQ ID NO: 3299648 - RNA, 17 nt, Mycobacterium tuberculosis H37Rv
cgaggcggguacaccac

SEQ ID NO: 3299649 - RNA, 17 nt, Mycobacterium tuberculosis H37Rv
cgaggcgucaccccggu

SEQ ID NO: 3299650 - RNA, 21 nt, Mycobacterium tuberculosis H37Rv
cgaggcgucaccccggucccg

SEQ ID NO: 3299651 - RNA, 13 nt, Mycobacterium tuberculosis H37Rv
cgaggcuguccga

SEQ ID NO: 3299652 - RNA, 19 nt, Mycobacterium tuberculosis H37Rv
cgaggcuguccgaaccgac

SEQ ID NO: 3299653 - RNA, 13 nt, Mycobacterium tuberculosis H37Rv
cgaggcuugcggc

SEQ ID NO: 3299654 - RNA, 20 nt, Mycobacterium tuberculosis H37Rv
cgagggauguagugcugcuc

SEQ ID NO: 3299655 - RNA, 16 nt, Mycobacterium tuberculosis H37Rv
cgagggcaacggcacu

SEQ ID NO: 3299656 - RNA, 21 nt, Mycobacterium tuberculosis H37Rv
cgagggcaaggacaagccgcu

SEQ ID NO: 3299657 - RNA, 15 nt, Mycobacterium tuberculosis H37Rv
cgagggcauccgagc

SEQ ID NO: 3299658 - RNA, 18 nt, Mycobacterium tuberculosis H37Rv
cgagggccacggcugcgg

SEQ ID NO: 3299659 - RNA, 19 nt, Mycobacterium tuberculosis H37Rv
cgagggccacguagcagca

SEQ ID NO: 3299660 - RNA, 20 nt, Mycobacterium tuberculosis H37Rv
cgagggccacguagcagcag

SEQ ID NO: 3299661 - RNA, 24 nt, Mycobacterium tuberculosis H37Rv
cgagggccagcaaguacgcgucgg

SEQ ID NO: 3299662 - RNA, 15 nt, Mycobacterium tuberculosis H37Rv
cgagggccagcagcc

SEQ ID NO: 3299663 - RNA, 18 nt, Mycobacterium tuberculosis H37Rv
cgagggccagcagccgcg

SEQ ID NO: 3299664 - RNA, 23 nt, Mycobacterium tuberculosis H37Rv
cgagggcgcgagcagacgcagaa

SEQ ID NO: 3299665 - RNA, 19 nt, Mycobacterium tuberculosis H37Rv
cgagggcugacgggauggu

SEQ ID NO: 3299666 - RNA, 13 nt, Mycobacterium tuberculosis H37Rv
cgagggcugcgug

SEQ ID NO: 3299667 - RNA, 20 nt, Mycobacterium tuberculosis H37Rv
cgaggggagugucagcgcca

SEQ ID NO: 3299668 - RNA, 13 nt, Mycobacterium tuberculosis H37Rv
cgaggggcggcaa

SEQ ID NO: 3299669 - RNA, 20 nt, Mycobacterium tuberculosis H37Rv
cgaggggcggcaaucggugg

SEQ ID NO: 3299670 - RNA, 19 nt, Mycobacterium tuberculosis H37Rv
cgagggggguguugaggcc

SEQ ID NO: 3299671 - RNA, 20 nt, Mycobacterium tuberculosis H37Rv
cgagggggguguugaggccg

SEQ ID NO: 3299672 - RNA, 18 nt, Mycobacterium tuberculosis H37Rv
cgagggugaagacaccgg

SEQ ID NO: 3299673 - RNA, 17 nt, Mycobacterium tuberculosis H37Rv
cgaggguuuccauggcg

SEQ ID NO: 3299674 - RNA, 17 nt, Mycobacterium tuberculosis H37Rv
cgagguaagcgagucga

SEQ ID NO: 3299675 - RNA, 18 nt, Mycobacterium tuberculosis H37Rv
cgagguauucgcgcagca

SEQ ID NO: 3299676 - RNA, 15 nt, Mycobacterium tuberculosis H37Rv
cgaggucagcucccg

SEQ ID NO: 3299677 - RNA, 23 nt, Mycobacterium tuberculosis H37Rv
cgaggucccgaaugucgaugacg

SEQ ID NO: 3299678 - RNA, 24 nt, Mycobacterium tuberculosis H37Rv
cgaggucccggccgagcguggcca

SEQ ID NO: 3299679 - RNA, 15 nt, Mycobacterium tuberculosis H37Rv
cgagguccucagcga

SEQ ID NO: 3299680 - RNA, 15 nt, Mycobacterium tuberculosis H37Rv
cgagguccucgucgg

SEQ ID NO: 3299681 - RNA, 14 nt, Mycobacterium tuberculosis H37Rv
cgaggucgaaccgc

SEQ ID NO: 3299682 - RNA, 16 nt, Mycobacterium tuberculosis H37Rv
cgaggucgaaccgccg

SEQ ID NO: 3299683 - RNA, 12 nt, Mycobacterium tuberculosis H37Rv
cgaggucggaga

SEQ ID NO: 3299684 - RNA, 23 nt, Mycobacterium tuberculosis H37Rv
cgaggucggccagcagcagugcc

SEQ ID NO: 3299685 - RNA, 12 nt, Mycobacterium tuberculosis H37Rv
cgaggucggcgg

SEQ ID NO: 3299686 - RNA, 15 nt, Mycobacterium tuberculosis H37Rv
cgaggucugguagag

SEQ ID NO: 3299687 - RNA, 19 nt, Mycobacterium tuberculosis H37Rv
cgaggugagguugaccccc

SEQ ID NO: 3299688 - RNA, 23 nt, Mycobacterium tuberculosis H37Rv
cgaggugagguugacccccgggu

SEQ ID NO: 3299689 - RNA, 23 nt, Mycobacterium tuberculosis H37Rv
cgaggugccgggguggcgcgcca

SEQ ID NO: 3299690 - RNA, 23 nt, Mycobacterium tuberculosis H37Rv
cgaggugcucggaucggcucgcc

SEQ ID NO: 3299691 - RNA, 23 nt, Mycobacterium tuberculosis H37Rv
cgaggugcugcacacugccgcgc

SEQ ID NO: 3299692 - RNA, 17 nt, Mycobacterium tuberculosis H37Rv
cgagguggacaaaucga

SEQ ID NO: 3299693 - RNA, 15 nt, Mycobacterium tuberculosis H37Rv
cgagguggcgggcga

SEQ ID NO: 3299694 - RNA, 19 nt, Mycobacterium tuberculosis H37Rv
cgagguggcgggcgaugcg

SEQ ID NO: 3299695 - RNA, 17 nt, Mycobacterium tuberculosis H37Rv
cgagguggggugguggu

SEQ ID NO: 3299696 - RNA, 14 nt, Mycobacterium tuberculosis H37Rv
cgagguggucgacc

SEQ ID NO: 3299697 - RNA, 18 nt, Mycobacterium tuberculosis H37Rv
cgagguguagcccuccga

SEQ ID NO: 3299698 - RNA, 21 nt, Mycobacterium tuberculosis H37Rv
cgagguguagcccuccgagca

SEQ ID NO: 3299699 - RNA, 18 nt, Mycobacterium tuberculosis H37Rv
cgagguucaaagcagcgc

SEQ ID NO: 3299700 - RNA, 22 nt, Mycobacterium tuberculosis H37Rv
cgagguucaaagcagcgcacca

SEQ ID NO: 3299701 - RNA, 17 nt, Mycobacterium tuberculosis H37Rv
cgagguuccacuugguc

SEQ ID NO: 3299702 - RNA, 15 nt, Mycobacterium tuberculosis H37Rv
cgagguucugccgcg

SEQ ID NO: 3299703 - RNA, 16 nt, Mycobacterium tuberculosis H37Rv
cgagguugaccaccag

SEQ ID NO: 3299704 - RNA, 19 nt, Mycobacterium tuberculosis H37Rv
cgagguugacgucaggcug

SEQ ID NO: 3299705 - RNA, 20 nt, Mycobacterium tuberculosis H37Rv
cgagguugacgucaggcuga

SEQ ID NO: 3299706 - RNA, 21 nt, Mycobacterium tuberculosis H37Rv
cgagguugauuggggccaggu

SEQ ID NO: 3299707 - RNA, 15 nt, Mycobacterium tuberculosis H37Rv
cgagguugccgcacc

SEQ ID NO: 3299708 - RNA, 13 nt, Mycobacterium tuberculosis H37Rv
cgagguugcgccg

SEQ ID NO: 3299709 - RNA, 16 nt, Mycobacterium tuberculosis H37Rv
cgagguugcgccgacc

SEQ ID NO: 3299710 - RNA, 16 nt, Mycobacterium tuberculosis H37Rv
cgaguaccggccagcc

SEQ ID NO: 3299711 - RNA, 17 nt, Mycobacterium tuberculosis H37Rv
cgaguaccggccagccg

SEQ ID NO: 3299712 - RNA, 19 nt, Mycobacterium tuberculosis H37Rv
cgaguaccggccagccgcg

SEQ ID NO: 3299713 - RNA, 21 nt, Mycobacterium tuberculosis H37Rv
cgaguacgggcaggccgcugg

SEQ ID NO: 3299714 - RNA, 16 nt, Mycobacterium tuberculosis H37Rv
cgaguagauggucgac

SEQ ID NO: 3299715 - RNA, 19 nt, Mycobacterium tuberculosis H37Rv
cgaguagauggucgacggg

SEQ ID NO: 3299716 - RNA, 18 nt, Mycobacterium tuberculosis H37Rv
cgaguaggcgugggucca

SEQ ID NO: 3299717 - RNA, 19 nt, Mycobacterium tuberculosis H37Rv
cgaguauuuuucgaccagc

SEQ ID NO: 3299718 - RNA, 19 nt, Mycobacterium tuberculosis H37Rv
cgagucaccaaaggcgucu

SEQ ID NO: 3299719 - RNA, 17 nt, Mycobacterium tuberculosis H37Rv
cgaguccaacucggcca

SEQ ID NO: 3299720 - RNA, 15 nt, Mycobacterium tuberculosis H37Rv
cgaguccaggcagcu

SEQ ID NO: 3299721 - RNA, 16 nt, Mycobacterium tuberculosis H37Rv
cgaguccaggcagcuu

SEQ ID NO: 3299722 - RNA, 20 nt, Mycobacterium tuberculosis H37Rv
cgaguccaggcugaucccga

SEQ ID NO: 3299723 - RNA, 16 nt, Mycobacterium tuberculosis H37Rv
cgagucccggcgguug

SEQ ID NO: 3299724 - RNA, 17 nt, Mycobacterium tuberculosis H37Rv
cgaguccgacaguccgc

SEQ ID NO: 3299725 - RNA, 19 nt, Mycobacterium tuberculosis H37Rv
cgaguccucgagugccgcc

SEQ ID NO: 3299726 - RNA, 16 nt, Mycobacterium tuberculosis H37Rv
cgagucgaacccgcga

SEQ ID NO: 3299727 - RNA, 19 nt, Mycobacterium tuberculosis H37Rv
cgagucgacaagccgucgg

SEQ ID NO: 3299728 - RNA, 15 nt, Mycobacterium tuberculosis H37Rv
cgagucgacggccag

SEQ ID NO: 3299729 - RNA, 16 nt, Mycobacterium tuberculosis H37Rv
cgagucgaugaccccg

SEQ ID NO: 3299730 - RNA, 16 nt, Mycobacterium tuberculosis H37Rv
cgagucgggggccgcg

SEQ ID NO: 3299731 - RNA, 21 nt, Mycobacterium tuberculosis H37Rv
cgagucgggggccgcgucucg

SEQ ID NO: 3299732 - RNA, 17 nt, Mycobacterium tuberculosis H37Rv
cgagucgguccugccaa

SEQ ID NO: 3299733 - RNA, 17 nt, Mycobacterium tuberculosis H37Rv
cgagucuaaggaugacc

SEQ ID NO: 3299734 - RNA, 13 nt, Mycobacterium tuberculosis H37Rv
cgagugaccaggg

SEQ ID NO: 3299735 - RNA, 14 nt, Mycobacterium tuberculosis H37Rv
cgagugcccagcga

SEQ ID NO: 3299736 - RNA, 15 nt, Mycobacterium tuberculosis H37Rv
cgagugcgacggcga

SEQ ID NO: 3299737 - RNA, 18 nt, Mycobacterium tuberculosis H37Rv
cgagugcggcacgaucgc

SEQ ID NO: 3299738 - RNA, 19 nt, Mycobacterium tuberculosis H37Rv
cgagugcggcacgaucgcc

SEQ ID NO: 3299739 - RNA, 15 nt, Mycobacterium tuberculosis H37Rv
cgagugcggcgacca

SEQ ID NO: 3299740 - RNA, 21 nt, Mycobacterium tuberculosis H37Rv
cgauccaccaagcucgcaacc

SEQ ID NO: 3299741 - RNA, 14 nt, Mycobacterium tuberculosis H37Rv
cgauccacuccggc

SEQ ID NO: 3299742 - RNA, 19 nt, Mycobacterium tuberculosis H37Rv
cgauccacucggcgaucuc

SEQ ID NO: 3299743 - RNA, 16 nt, Mycobacterium tuberculosis H37Rv
cgauccacuguagggc

SEQ ID NO: 3299744 - RNA, 13 nt, Mycobacterium tuberculosis H37Rv
cgauccagacggu

SEQ ID NO: 3299745 - RNA, 22 nt, Mycobacterium tuberculosis H37Rv
cgauccagcaggccgucgauca

SEQ ID NO: 3299746 - RNA, 23 nt, Mycobacterium tuberculosis H37Rv
cgauccagcccaacucggccagc

SEQ ID NO: 3299747 - RNA, 13 nt, Mycobacterium tuberculosis H37Rv
cgauccaggccag

SEQ ID NO: 3299748 - RNA, 15 nt, Mycobacterium tuberculosis H37Rv
cgauccaggccaguu

SEQ ID NO: 3299749 - RNA, 20 nt, Mycobacterium tuberculosis H37Rv
cgauccagggucaccucguc

SEQ ID NO: 3299750 - RNA, 16 nt, Mycobacterium tuberculosis H37Rv
cgauccagucugggac

SEQ ID NO: 3299751 - RNA, 20 nt, Mycobacterium tuberculosis H37Rv
cgauccagucugggacaccg

SEQ ID NO: 3299752 - RNA, 19 nt, Mycobacterium tuberculosis H37Rv
cgauccaguucaccgcgcu

SEQ ID NO: 3299753 - RNA, 18 nt, Mycobacterium tuberculosis H37Rv
cgaucccaacgcccgggc

SEQ ID NO: 3299754 - RNA, 19 nt, Mycobacterium tuberculosis H37Rv
cgauccccacaaucagccc

SEQ ID NO: 3299755 - RNA, 16 nt, Mycobacterium tuberculosis H37Rv
cgauccccagcaccac

SEQ ID NO: 3299756 - RNA, 15 nt, Mycobacterium tuberculosis H37Rv
cgauccccaggccgc

SEQ ID NO: 3299757 - RNA, 16 nt, Mycobacterium tuberculosis H37Rv
cgauccccaggccgcu

SEQ ID NO: 3299758 - RNA, 15 nt, Mycobacterium tuberculosis H37Rv
cgauccccgacgucg

SEQ ID NO: 3299759 - RNA, 15 nt, Mycobacterium tuberculosis H37Rv
cgaucccgaucgcgc

SEQ ID NO: 3299760 - RNA, 17 nt, Mycobacterium tuberculosis H37Rv
cgaucccgcggccgggc

SEQ ID NO: 3299761 - RNA, 14 nt, Mycobacterium tuberculosis H37Rv
cgaucccggucggu

SEQ ID NO: 3299762 - RNA, 18 nt, Mycobacterium tuberculosis H37Rv
cgaucccguccgcgccca

SEQ ID NO: 3299763 - RNA, 23 nt, Mycobacterium tuberculosis H37Rv
cgaucccgucgggcacaccgacg

SEQ ID NO: 3299764 - RNA, 14 nt, Mycobacterium tuberculosis H37Rv
cgauccgagaccgc

SEQ ID NO: 3299765 - RNA, 18 nt, Mycobacterium tuberculosis H37Rv
cgauccgauccgcucacc

SEQ ID NO: 3299766 - RNA, 18 nt, Mycobacterium tuberculosis H37Rv
cgauccgcacccggccgc

SEQ ID NO: 3299767 - RNA, 20 nt, Mycobacterium tuberculosis H37Rv
cgauccgcggcguuccccga

SEQ ID NO: 3299768 - RNA, 18 nt, Mycobacterium tuberculosis H37Rv
cgauccggaucccaccac

SEQ ID NO: 3299769 - RNA, 15 nt, Mycobacterium tuberculosis H37Rv
cgauccggcgcacga

SEQ ID NO: 3299770 - RNA, 15 nt, Mycobacterium tuberculosis H37Rv
cgauccggcuccacc

SEQ ID NO: 3299771 - RNA, 23 nt, Mycobacterium tuberculosis H37Rv
cgauccggggcuggcuguggcgc

SEQ ID NO: 3299772 - RNA, 19 nt, Mycobacterium tuberculosis H37Rv
cgauccgguuaugcgguac

SEQ ID NO: 3299773 - RNA, 18 nt, Mycobacterium tuberculosis H37Rv
cgaucgaagaaacggcgu

SEQ ID NO: 3299774 - RNA, 21 nt, Mycobacterium tuberculosis H37Rv
cgaucgaauugcguucgccgc

SEQ ID NO: 3299775 - RNA, 13 nt, Mycobacterium tuberculosis H37Rv
cgaucgacaccag

SEQ ID NO: 3299776 - RNA, 16 nt, Mycobacterium tuberculosis H37Rv
cgaucgacacccgcuc

SEQ ID NO: 3299777 - RNA, 20 nt, Mycobacterium tuberculosis H37Rv
cgaucgacacccgcucggcc

SEQ ID NO: 3299778 - RNA, 14 nt, Mycobacterium tuberculosis H37Rv
cgaucgacggucgu

SEQ ID NO: 3299779 - RNA, 22 nt, Mycobacterium tuberculosis H37Rv
cgaucgaggaguuggugcagcg

SEQ ID NO: 3299780 - RNA, 13 nt, Mycobacterium tuberculosis H37Rv
cgaucgauuccgc

SEQ ID NO: 3299781 - RNA, 18 nt, Mycobacterium tuberculosis H37Rv
cgaucgcauccgcgguug

SEQ ID NO: 3299782 - RNA, 14 nt, Mycobacterium tuberculosis H37Rv
cgaucgccaggccg

SEQ ID NO: 3299783 - RNA, 15 nt, Mycobacterium tuberculosis H37Rv
cgaucgccaggccga

SEQ ID NO: 3299784 - RNA, 23 nt, Mycobacterium tuberculosis H37Rv
cgaucgccgcgaagcgcucggca

SEQ ID NO: 3299785 - RNA, 14 nt, Mycobacterium tuberculosis H37Rv
cgaucgccgcgcug

SEQ ID NO: 3299786 - RNA, 18 nt, Mycobacterium tuberculosis H37Rv
cgaucgccugagacucgc

SEQ ID NO: 3299787 - RNA, 16 nt, Mycobacterium tuberculosis H37Rv
cgaucgcgacacggcc

SEQ ID NO: 3299788 - RNA, 15 nt, Mycobacterium tuberculosis H37Rv
cgaucgcgacccgau

SEQ ID NO: 3299789 - RNA, 16 nt, Mycobacterium tuberculosis H37Rv
cgaucgcgagcgagcc

SEQ ID NO: 3299790 - RNA, 23 nt, Mycobacterium tuberculosis H37Rv
cgaucgcgagcgagccaacucca

SEQ ID NO: 3299791 - RNA, 16 nt, Mycobacterium tuberculosis H37Rv
cgaucgcgccgucggc

SEQ ID NO: 3299792 - RNA, 20 nt, Mycobacterium tuberculosis H37Rv
cgaucgcgccgucggcgaug

SEQ ID NO: 3299793 - RNA, 22 nt, Mycobacterium tuberculosis H37Rv
cgaucgcgccugugcgcaaggc

SEQ ID NO: 3299794 - RNA, 14 nt, Mycobacterium tuberculosis H37Rv
cgaucgcgcuggga

SEQ ID NO: 3299795 - RNA, 17 nt, Mycobacterium tuberculosis H37Rv
cgaucgcggcgcccagg

SEQ ID NO: 3299796 - RNA, 21 nt, Mycobacterium tuberculosis H37Rv
cgaucgcggucuugacaccgc

SEQ ID NO: 3299797 - RNA, 16 nt, Mycobacterium tuberculosis H37Rv
cgaucgcguccgcgcu

SEQ ID NO: 3299798 - RNA, 21 nt, Mycobacterium tuberculosis H37Rv
cgaucgcguccgcgcucaacc

SEQ ID NO: 3299799 - RNA, 16 nt, Mycobacterium tuberculosis H37Rv
cgaucgcguucugcac

SEQ ID NO: 3299800 - RNA, 18 nt, Mycobacterium tuberculosis H37Rv
cgaucgcguucugcacca

SEQ ID NO: 3299801 - RNA, 19 nt, Mycobacterium tuberculosis H37Rv
cgaucgcguucugcaccag

SEQ ID NO: 3299802 - RNA, 16 nt, Mycobacterium tuberculosis H37Rv
cgaucgcucauucgug

SEQ ID NO: 3299803 - RNA, 22 nt, Mycobacterium tuberculosis H37Rv
cgaucgcuccggcccugccgcc

SEQ ID NO: 3299804 - RNA, 14 nt, Mycobacterium tuberculosis H37Rv
cgaucggaccacca

SEQ ID NO: 3299805 - RNA, 16 nt, Mycobacterium tuberculosis H37Rv
cgaucggaccaccagg

SEQ ID NO: 3299806 - RNA, 17 nt, Mycobacterium tuberculosis H37Rv
cgaucggaccaccaggg

SEQ ID NO: 3299807 - RNA, 15 nt, Mycobacterium tuberculosis H37Rv
cgaucggaucggcac

SEQ ID NO: 3299808 - RNA, 13 nt, Mycobacterium tuberculosis H37Rv
cgaucggcagcca

SEQ ID NO: 3299809 - RNA, 19 nt, Mycobacterium tuberculosis H37Rv
cgaucggcggcgcgccgau

SEQ ID NO: 3299810 - RNA, 23 nt, Mycobacterium tuberculosis H37Rv
cgaucggcugguuacucaccaac

SEQ ID NO: 3299811 - RNA, 17 nt, Mycobacterium tuberculosis H37Rv
cgaucgggcccagcagc

SEQ ID NO: 3299812 - RNA, 22 nt, Mycobacterium tuberculosis H37Rv
cgaucgggcucacucgccgaau

SEQ ID NO: 3299813 - RNA, 21 nt, Mycobacterium tuberculosis H37Rv
cgaucggggcggugacuccgc

SEQ ID NO: 3299814 - RNA, 18 nt, Mycobacterium tuberculosis H37Rv
cgaucggugacgcgccgu

SEQ ID NO: 3299815 - RNA, 23 nt, Mycobacterium tuberculosis H37Rv
cgaucggugccgaagcugcccaa

SEQ ID NO: 3299816 - RNA, 16 nt, Mycobacterium tuberculosis H37Rv
cgaucggugcgaucag

SEQ ID NO: 3299817 - RNA, 19 nt, Mycobacterium tuberculosis H37Rv
cgaucggugcgggcgccgc

SEQ ID NO: 3299818 - RNA, 21 nt, Mycobacterium tuberculosis H37Rv
cgaucggugcgggcgccgcua

SEQ ID NO: 3299819 - RNA, 15 nt, Mycobacterium tuberculosis H37Rv
cgaucgucaacgacg

SEQ ID NO: 3299820 - RNA, 19 nt, Mycobacterium tuberculosis H37Rv
cgaucgucaacgacgacga

SEQ ID NO: 3299821 - RNA, 18 nt, Mycobacterium tuberculosis H37Rv
cgaucgucaagccgggca

SEQ ID NO: 3299822 - RNA, 13 nt, Mycobacterium tuberculosis H37Rv
cgaucgucgacgc

SEQ ID NO: 3299823 - RNA, 15 nt, Mycobacterium tuberculosis H37Rv
cgaucgucgacgcgu

SEQ ID NO: 3299824 - RNA, 22 nt, Mycobacterium tuberculosis H37Rv
cgaucgucgagccgaucgcccg

SEQ ID NO: 3299825 - RNA, 20 nt, Mycobacterium tuberculosis H37Rv
cgaucgugagacgccgucga

SEQ ID NO: 3299826 - RNA, 22 nt, Mycobacterium tuberculosis H37Rv
cgaucgugagacgccgucgacg

SEQ ID NO: 3299827 - RNA, 19 nt, Mycobacterium tuberculosis H37Rv
cgaucgugccccuagaguu

SEQ ID NO: 3299828 - RNA, 23 nt, Mycobacterium tuberculosis H37Rv
cgaucgugcgacgcaggaucaca

SEQ ID NO: 3299829 - RNA, 13 nt, Mycobacterium tuberculosis H37Rv
cgaucgugcugcc

SEQ ID NO: 3299830 - RNA, 22 nt, Mycobacterium tuberculosis H37Rv
cgaucguuccgcuggacggauc

SEQ ID NO: 3299831 - RNA, 18 nt, Mycobacterium tuberculosis H37Rv
cgaucguugccgcugaau

SEQ ID NO: 3299832 - RNA, 19 nt, Mycobacterium tuberculosis H37Rv
cgaucuccuccaccagugc

SEQ ID NO: 3299833 - RNA, 20 nt, Mycobacterium tuberculosis H37Rv
cgaucuccucuugcaccagg

SEQ ID NO: 3299834 - RNA, 15 nt, Mycobacterium tuberculosis H37Rv
cgaucucgaccagcg

SEQ ID NO: 3299835 - RNA, 23 nt, Mycobacterium tuberculosis H37Rv
cgaucucgccggcgaagaccgcc

SEQ ID NO: 3299836 - RNA, 17 nt, Mycobacterium tuberculosis H37Rv
cgaugccguguucagca

SEQ ID NO: 3299837 - RNA, 15 nt, Mycobacterium tuberculosis H37Rv
cgaugcgacgcagac

SEQ ID NO: 3299838 - RNA, 15 nt, Mycobacterium tuberculosis H37Rv
cgaugcgaucgacga

SEQ ID NO: 3299839 - RNA, 21 nt, Mycobacterium tuberculosis H37Rv
cgaugcgauuccgcgucugcu

SEQ ID NO: 3299840 - RNA, 21 nt, Mycobacterium tuberculosis H37Rv
cgaugcgauucugcgucugcu

SEQ ID NO: 3299841 - RNA, 23 nt, Mycobacterium tuberculosis H37Rv
cgaugcgcaacuucuucagcagc

SEQ ID NO: 3299842 - RNA, 15 nt, Mycobacterium tuberculosis H37Rv
cgaugcgcacaccga

SEQ ID NO: 3299843 - RNA, 12 nt, Mycobacterium tuberculosis H37Rv
cgaugcgcacca

SEQ ID NO: 3299844 - RNA, 13 nt, Mycobacterium tuberculosis H37Rv
cgaugcgcaccag

SEQ ID NO: 3299845 - RNA, 12 nt, Mycobacterium tuberculosis H37Rv
cgaugcgccgga

SEQ ID NO: 3299846 - RNA, 16 nt, Mycobacterium tuberculosis H37Rv
cgaugcgcgccggcuu

SEQ ID NO: 3299847 - RNA, 16 nt, Mycobacterium tuberculosis H37Rv
cgaugcgcugcucacg

SEQ ID NO: 3299848 - RNA, 22 nt, Mycobacterium tuberculosis H37Rv
cgaugcgcugcucacgcagcag

SEQ ID NO: 3299849 - RNA, 19 nt, Mycobacterium tuberculosis H37Rv
cgaugcggcgucgaacugc

SEQ ID NO: 3299850 - RNA, 13 nt, Mycobacterium tuberculosis H37Rv
cgaugcggcguug

SEQ ID NO: 3299851 - RNA, 15 nt, Mycobacterium tuberculosis H37Rv
cgaugcgggccauca

SEQ ID NO: 3299852 - RNA, 13 nt, Mycobacterium tuberculosis H37Rv
cgaugcgggccgc

SEQ ID NO: 3299853 - RNA, 20 nt, Mycobacterium tuberculosis H37Rv
cgaugcgggccgccaggcgg

SEQ ID NO: 3299854 - RNA, 21 nt, Mycobacterium tuberculosis H37Rv
cgaugcgggccgccaggcggc

SEQ ID NO: 3299855 - RNA, 15 nt, Mycobacterium tuberculosis H37Rv
cgaugcgggcgacga

SEQ ID NO: 3299856 - RNA, 14 nt, Mycobacterium tuberculosis H37Rv
cgaugcgguucucg

SEQ ID NO: 3299857 - RNA, 23 nt, Mycobacterium tuberculosis H37Rv
cgaugcgguucucgagcucggcg

SEQ ID NO: 3299858 - RNA, 21 nt, Mycobacterium tuberculosis H37Rv
cgaugcguccgcccagccgca

SEQ ID NO: 3299859 - RNA, 15 nt, Mycobacterium tuberculosis H37Rv
cgaugcucagcuggu

SEQ ID NO: 3299860 - RNA, 22 nt, Mycobacterium tuberculosis H37Rv
cgaugcucgucccagaaccggc

SEQ ID NO: 3299861 - RNA, 13 nt, Mycobacterium tuberculosis H37Rv
cgaugcugaucac

SEQ ID NO: 3299862 - RNA, 20 nt, Mycobacterium tuberculosis H37Rv
cgaugcuggcaaaguaucgc

SEQ ID NO: 3299863 - RNA, 19 nt, Mycobacterium tuberculosis H37Rv
cgaugcuucccggaugccg

SEQ ID NO: 3299864 - RNA, 15 nt, Mycobacterium tuberculosis H37Rv
cgauggacgcccagu

SEQ ID NO: 3299865 - RNA, 22 nt, Mycobacterium tuberculosis H37Rv
cgauggacgcccaguugccggu

SEQ ID NO: 3299866 - RNA, 21 nt, Mycobacterium tuberculosis H37Rv
cgauggaguucucaucgccaa

SEQ ID NO: 3299867 - RNA, 16 nt, Mycobacterium tuberculosis H37Rv
cgauggauccaaccgu

SEQ ID NO: 3299868 - RNA, 14 nt, Mycobacterium tuberculosis H37Rv
cgauggauggcguc

SEQ ID NO: 3299869 - RNA, 23 nt, Mycobacterium tuberculosis H37Rv
cgauggauuggcgucagcagcaa

SEQ ID NO: 3299870 - RNA, 18 nt, Mycobacterium tuberculosis H37Rv
cgauggcaagggccgacg

SEQ ID NO: 3299871 - RNA, 15 nt, Mycobacterium tuberculosis H37Rv
cgauggcaccacuac

SEQ ID NO: 3299872 - RNA, 14 nt, Mycobacterium tuberculosis H37Rv
cgauggcaccgugg

SEQ ID NO: 3299873 - RNA, 16 nt, Mycobacterium tuberculosis H37Rv
cgauggcaucggccau

SEQ ID NO: 3299874 - RNA, 16 nt, Mycobacterium tuberculosis H37Rv
cgauggccagcacggu

SEQ ID NO: 3299875 - RNA, 20 nt, Mycobacterium tuberculosis H37Rv
cgauggccagcacgguguug

SEQ ID NO: 3299876 - RNA, 16 nt, Mycobacterium tuberculosis H37Rv
cgauggccaggcuggc

SEQ ID NO: 3299877 - RNA, 18 nt, Mycobacterium tuberculosis H37Rv
cgauggccaucaucgacg

SEQ ID NO: 3299878 - RNA, 19 nt, Mycobacterium tuberculosis H37Rv
cgauggccaucaucgacgg

SEQ ID NO: 3299879 - RNA, 19 nt, Mycobacterium tuberculosis H37Rv
cgauggcccggcucacagc

SEQ ID NO: 3299880 - RNA, 16 nt, Mycobacterium tuberculosis H37Rv
cgauggccgacgcugc

SEQ ID NO: 3299881 - RNA, 20 nt, Mycobacterium tuberculosis H37Rv
cgauggccgccaguucuucg

SEQ ID NO: 3299882 - RNA, 16 nt, Mycobacterium tuberculosis H37Rv
cgauggcgauacgcgc

SEQ ID NO: 3299883 - RNA, 22 nt, Mycobacterium tuberculosis H37Rv
cgauggcgaugagguggccgcg

SEQ ID NO: 3299884 - RNA, 13 nt, Mycobacterium tuberculosis H37Rv
cgauggcgcaccg

SEQ ID NO: 3299885 - RNA, 13 nt, Mycobacterium tuberculosis H37Rv
cgauggcggccac

SEQ ID NO: 3299886 - RNA, 18 nt, Mycobacterium tuberculosis H37Rv
cgauggcggccaccagcg

SEQ ID NO: 3299887 - RNA, 21 nt, Mycobacterium tuberculosis H37Rv
cgauggcggccaccgucagcg

SEQ ID NO: 3299888 - RNA, 17 nt, Mycobacterium tuberculosis H37Rv
cgauggcgguggggcug

SEQ ID NO: 3299889 - RNA, 15 nt, Mycobacterium tuberculosis H37Rv
cgauggcguacagca

SEQ ID NO: 3299890 - RNA, 15 nt, Mycobacterium tuberculosis H37Rv
cgauggcgucgccgg

SEQ ID NO: 3299891 - RNA, 12 nt, Mycobacterium tuberculosis H37Rv
cgauggcgucgg

SEQ ID NO: 3299892 - RNA, 16 nt, Mycobacterium tuberculosis H37Rv
cgauggcgucggccag

SEQ ID NO: 3299893 - RNA, 15 nt, Mycobacterium tuberculosis H37Rv
cgauggcuaccccag

SEQ ID NO: 3299894 - RNA, 13 nt, Mycobacterium tuberculosis H37Rv
cgauggcucacau

SEQ ID NO: 3299895 - RNA, 17 nt, Mycobacterium tuberculosis H37Rv
cgauggcugcgccgaac

SEQ ID NO: 3299896 - RNA, 18 nt, Mycobacterium tuberculosis H37Rv
cgauggcuuggugcccaa

SEQ ID NO: 3299897 - RNA, 18 nt, Mycobacterium tuberculosis H37Rv
cgaugggagcccggcggc

SEQ ID NO: 3299898 - RNA, 19 nt, Mycobacterium tuberculosis H37Rv
cgaugggagcccggcggcc

SEQ ID NO: 3299899 - RNA, 15 nt, Mycobacterium tuberculosis H37Rv
cgaugggauaccgcg

SEQ ID NO: 3299900 - RNA, 21 nt, Mycobacterium tuberculosis H37Rv
cgaugggugacgguggccggc

SEQ ID NO: 3299901 - RNA, 14 nt, Mycobacterium tuberculosis H37Rv
cgaugggugcaccg

SEQ ID NO: 3299902 - RNA, 15 nt, Mycobacterium tuberculosis H37Rv
cgaugggugcaccga

SEQ ID NO: 3299903 - RNA, 21 nt, Mycobacterium tuberculosis H37Rv
cgauggguguugcuggccgcg

SEQ ID NO: 3299904 - RNA, 17 nt, Mycobacterium tuberculosis H37Rv
cgaugguaucgccgcua

SEQ ID NO: 3299905 - RNA, 14 nt, Mycobacterium tuberculosis H37Rv
cgauggucaucuug

SEQ ID NO: 3299906 - RNA, 14 nt, Mycobacterium tuberculosis H37Rv
cgauggugaugggg

SEQ ID NO: 3299907 - RNA, 13 nt, Mycobacterium tuberculosis H37Rv
cgauggugccgac

SEQ ID NO: 3299908 - RNA, 14 nt, Mycobacterium tuberculosis H37Rv
cgauggugccgacc

SEQ ID NO: 3299909 - RNA, 20 nt, Mycobacterium tuberculosis H37Rv
cgauggugccgacccgccgc

SEQ ID NO: 3299910 - RNA, 20 nt, Mycobacterium tuberculosis H37Rv
cgauggugcucaaggcuucg

SEQ ID NO: 3299911 - RNA, 18 nt, Mycobacterium tuberculosis H37Rv
cgaugguggccgcgcggu

SEQ ID NO: 3299912 - RNA, 20 nt, Mycobacterium tuberculosis H37Rv
cgaugguggcgaucaucggc

SEQ ID NO: 3299913 - RNA, 20 nt, Mycobacterium tuberculosis H37Rv
cgaugguggugccgaccugu

SEQ ID NO: 3299914 - RNA, 19 nt, Mycobacterium tuberculosis H37Rv
cgaugguguaacggcggcu

SEQ ID NO: 3299915 - RNA, 15 nt, Mycobacterium tuberculosis H37Rv
cgauggugugcagca

SEQ ID NO: 3299916 - RNA, 18 nt, Mycobacterium tuberculosis H37Rv
cgaugguuauccccuggc

SEQ ID NO: 3299917 - RNA, 20 nt, Mycobacterium tuberculosis H37Rv
cgaugguugccuuguucgcc

SEQ ID NO: 3299918 - RNA, 18 nt, Mycobacterium tuberculosis H37Rv
cgauguacagcgggaucc

SEQ ID NO: 3299919 - RNA, 23 nt, Mycobacterium tuberculosis H37Rv
cgauguacagcgggaucccgauc

SEQ ID NO: 3299920 - RNA, 17 nt, Mycobacterium tuberculosis H37Rv
cgauguauccgaugcga

SEQ ID NO: 3299921 - RNA, 17 nt, Mycobacterium tuberculosis H37Rv
cgaugucaacgcccagc

SEQ ID NO: 3299922 - RNA, 11 nt, Mycobacterium tuberculosis H37Rv
cgaugucagcc

SEQ ID NO: 3299923 - RNA, 20 nt, Mycobacterium tuberculosis H37Rv
cgaugucagccaccaucugg

SEQ ID NO: 3299924 - RNA, 19 nt, Mycobacterium tuberculosis H37Rv
cgaugucagugaucaccaa

SEQ ID NO: 3299925 - RNA, 21 nt, Mycobacterium tuberculosis H37Rv
cgaugucagugaucaccaacc

SEQ ID NO: 3299926 - RNA, 15 nt, Mycobacterium tuberculosis H37Rv
cgauguccccggcgg

SEQ ID NO: 3299927 - RNA, 18 nt, Mycobacterium tuberculosis H37Rv
cgaugucccgagcccgcu

SEQ ID NO: 3299928 - RNA, 19 nt, Mycobacterium tuberculosis H37Rv
cgauguccgacgccaccgc

SEQ ID NO: 3299929 - RNA, 20 nt, Mycobacterium tuberculosis H37Rv
cgauguccgcagcaccgucg

SEQ ID NO: 3299930 - RNA, 16 nt, Mycobacterium tuberculosis H37Rv
cgauguccucgauccg

SEQ ID NO: 3299931 - RNA, 14 nt, Mycobacterium tuberculosis H37Rv
cgauguccuggaag

SEQ ID NO: 3299932 - RNA, 18 nt, Mycobacterium tuberculosis H37Rv
cgcaacgggacgucaccg

SEQ ID NO: 3299933 - RNA, 18 nt, Mycobacterium tuberculosis H37Rv
cgcaacgggucggguccc

SEQ ID NO: 3299934 - RNA, 22 nt, Mycobacterium tuberculosis H37Rv
cgcaacguacgcacgcagcccc

SEQ ID NO: 3299935 - RNA, 19 nt, Mycobacterium tuberculosis H37Rv
cgcaacucccagcacggug

SEQ ID NO: 3299936 - RNA, 12 nt, Mycobacterium tuberculosis H37Rv
cgcaacugcagg

SEQ ID NO: 3299937 - RNA, 22 nt, Mycobacterium tuberculosis H37Rv
cgcaagaaucagcagcagcgug

SEQ ID NO: 3299938 - RNA, 14 nt, Mycobacterium tuberculosis H37Rv
cgcaagcgcggcga

SEQ ID NO: 3299939 - RNA, 14 nt, Mycobacterium tuberculosis H37Rv
cgcaaggaugucgg

SEQ ID NO: 3299940 - RNA, 17 nt, Mycobacterium tuberculosis H37Rv
cgcaagguugccaacgc

SEQ ID NO: 3299941 - RNA, 18 nt, Mycobacterium tuberculosis H37Rv
cgcaagguugccaacgcc

SEQ ID NO: 3299942 - RNA, 20 nt, Mycobacterium tuberculosis H37Rv
cgcaagugucuccggcaaca

SEQ ID NO: 3299943 - RNA, 19 nt, Mycobacterium tuberculosis H37Rv
cgcaaguugagcagcuugg

SEQ ID NO: 3299944 - RNA, 23 nt, Mycobacterium tuberculosis H37Rv
cgcaauaagggagaccgcggccg

SEQ ID NO: 3299945 - RNA, 19 nt, Mycobacterium tuberculosis H37Rv
cgcaauauccggccgagcc

SEQ ID NO: 3299946 - RNA, 15 nt, Mycobacterium tuberculosis H37Rv
cgcaauaugccacag

SEQ ID NO: 3299947 - RNA, 24 nt, Mycobacterium tuberculosis H37Rv
cgcaaucagacggcgaguaggcgu

SEQ ID NO: 3299948 - RNA, 18 nt, Mycobacterium tuberculosis H37Rv
cgcaaucauccgaucgcc

SEQ ID NO: 3299949 - RNA, 18 nt, Mycobacterium tuberculosis H37Rv
cgcaaucgacugaucgaa

SEQ ID NO: 3299950 - RNA, 14 nt, Mycobacterium tuberculosis H37Rv
cgcaaucgcgacgg

SEQ ID NO: 3299951 - RNA, 18 nt, Mycobacterium tuberculosis H37Rv
cgcaaucgucgccuucgg

SEQ ID NO: 3299952 - RNA, 22 nt, Mycobacterium tuberculosis H37Rv
cgcaaugaccgcggauuccggc

SEQ ID NO: 3299953 - RNA, 19 nt, Mycobacterium tuberculosis H37Rv
cgcaaugcgcgcgauggcg

SEQ ID NO: 3299954 - RNA, 20 nt, Mycobacterium tuberculosis H37Rv
cgcaauuccggugaucgcgg

SEQ ID NO: 3299955 - RNA, 22 nt, Mycobacterium tuberculosis H37Rv
cgcaauuccggugaucgcggug

SEQ ID NO: 3299956 - RNA, 18 nt, Mycobacterium tuberculosis H37Rv
cgcacaaaaucagcgauu

SEQ ID NO: 3299957 - RNA, 14 nt, Mycobacterium tuberculosis H37Rv
cgcacaaacgggcg

SEQ ID NO: 3299958 - RNA, 13 nt, Mycobacterium tuberculosis H37Rv
cgcacaacugcgc

SEQ ID NO: 3299959 - RNA, 16 nt, Mycobacterium tuberculosis H37Rv
cgcacaauggcggcgc

SEQ ID NO: 3299960 - RNA, 22 nt, Mycobacterium tuberculosis H37Rv
cgcacaccaacaccgcggcgcu

SEQ ID NO: 3299961 - RNA, 16 nt, Mycobacterium tuberculosis H37Rv
cgcacaccugcgcggc

SEQ ID NO: 3299962 - RNA, 15 nt, Mycobacterium tuberculosis H37Rv
cgcacacgaucgcgg

SEQ ID NO: 3299963 - RNA, 12 nt, Mycobacterium tuberculosis H37Rv
cgcacacgcgug

SEQ ID NO: 3299964 - RNA, 14 nt, Mycobacterium tuberculosis H37Rv
cgcacacgcgugca

SEQ ID NO: 3299965 - RNA, 12 nt, Mycobacterium tuberculosis H37Rv
cgcacagcacca

SEQ ID NO: 3299966 - RNA, 19 nt, Mycobacterium tuberculosis H37Rv
cgcacagcccgaugccgug

SEQ ID NO: 3299967 - RNA, 21 nt, Mycobacterium tuberculosis H37Rv
cgcacagccgcuuggcgcggc

SEQ ID NO: 3299968 - RNA, 14 nt, Mycobacterium tuberculosis H37Rv
cgcacagcgacgag

SEQ ID NO: 3299969 - RNA, 14 nt, Mycobacterium tuberculosis H37Rv
cgcacagcgagcac

SEQ ID NO: 3299970 - RNA, 15 nt, Mycobacterium tuberculosis H37Rv
cgcacagcgagcaca

SEQ ID NO: 3299971 - RNA, 16 nt, Mycobacterium tuberculosis H37Rv
cgcacagcggauucgg

SEQ ID NO: 3299972 - RNA, 22 nt, Mycobacterium tuberculosis H37Rv
cgcacaggaagcccauccccgc

SEQ ID NO: 3299973 - RNA, 18 nt, Mycobacterium tuberculosis H37Rv
cgcacaggcgcgaucgcu

SEQ ID NO: 3299974 - RNA, 20 nt, Mycobacterium tuberculosis H37Rv
cgcaccaacguugugccgcu

SEQ ID NO: 3299975 - RNA, 14 nt, Mycobacterium tuberculosis H37Rv
cgcaccaagacgcc

SEQ ID NO: 3299976 - RNA, 17 nt, Mycobacterium tuberculosis H37Rv
cgcaccaagcagcgacc

SEQ ID NO: 3299977 - RNA, 14 nt, Mycobacterium tuberculosis H37Rv
cgcaccacaccacg

SEQ ID NO: 3299978 - RNA, 14 nt, Mycobacterium tuberculosis H37Rv
cgcaccacaccgug

SEQ ID NO: 3299979 - RNA, 21 nt, Mycobacterium tuberculosis H37Rv
cgcaccacacuggcagugugg

SEQ ID NO: 3299980 - RNA, 12 nt, Mycobacterium tuberculosis H37Rv
cgcaccaccacg

SEQ ID NO: 3299981 - RNA, 13 nt, Mycobacterium tuberculosis H37Rv
cgcaccaccgccc

SEQ ID NO: 3299982 - RNA, 17 nt, Mycobacterium tuberculosis H37Rv
cgcaccaccgcggcggc

SEQ ID NO: 3299983 - RNA, 15 nt, Mycobacterium tuberculosis H37Rv
cgcaccaccgucucg

SEQ ID NO: 3299984 - RNA, 15 nt, Mycobacterium tuberculosis H37Rv
cgcaccacgagcagc

SEQ ID NO: 3299985 - RNA, 22 nt, Mycobacterium tuberculosis H37Rv
cgcaccacgagcagccgaugcu

SEQ ID NO: 3299986 - RNA, 12 nt, Mycobacterium tuberculosis H37Rv
cgcaccacgccc

SEQ ID NO: 3299987 - RNA, 21 nt, Mycobacterium tuberculosis H37Rv
cgcaccagcugucgggcagcu

SEQ ID NO: 3299988 - RNA, 12 nt, Mycobacterium tuberculosis H37Rv
cgcaccaggguu

SEQ ID NO: 3299989 - RNA, 16 nt, Mycobacterium tuberculosis H37Rv
cgcaccaguccagcgg

SEQ ID NO: 3299990 - RNA, 18 nt, Mycobacterium tuberculosis H37Rv
cgcaccaucgcggccgcu

SEQ ID NO: 3299991 - RNA, 14 nt, Mycobacterium tuberculosis H37Rv
cgcacccaacucca

SEQ ID NO: 3299992 - RNA, 18 nt, Mycobacterium tuberculosis H37Rv
cgcacccaacuccaucag

SEQ ID NO: 3299993 - RNA, 23 nt, Mycobacterium tuberculosis H37Rv
cgcacccaacuccaucagcgcga

SEQ ID NO: 3299994 - RNA, 17 nt, Mycobacterium tuberculosis H37Rv
cgcacccagaccgccga

SEQ ID NO: 3299995 - RNA, 12 nt, Mycobacterium tuberculosis H37Rv
cgcacccagccc

SEQ ID NO: 3299996 - RNA, 18 nt, Mycobacterium tuberculosis H37Rv
cgcacccaugaucccgcu

SEQ ID NO: 3299997 - RNA, 19 nt, Mycobacterium tuberculosis H37Rv
cgcaccccauacucggcgg

SEQ ID NO: 3299998 - RNA, 21 nt, Mycobacterium tuberculosis H37Rv
cgcaccccauacucggcggcu

SEQ ID NO: 3299999 - RNA, 20 nt, Mycobacterium tuberculosis H37Rv
cgcacccccgacaccgccga

SEQ ID NO: 3300000 - RNA, 15 nt, Mycobacterium tuberculosis H37Rv
cgcacccccgucgau

SEQ ID NO: 3300001 - RNA, 20 nt, Mycobacterium tuberculosis H37Rv
cgcacccccgucgaucagcg

SEQ ID NO: 3300002 - RNA, 17 nt, Mycobacterium tuberculosis H37Rv
cgcacccccuccgcgau

SEQ ID NO: 3300003 - RNA, 14 nt, Mycobacterium tuberculosis H37Rv
cgcaccccgcccga

SEQ ID NO: 3300004 - RNA, 18 nt, Mycobacterium tuberculosis H37Rv
cgcaccccgcuugcgcgg

SEQ ID NO: 3300005 - RNA, 18 nt, Mycobacterium tuberculosis H37Rv
cgcaccccggccgcgcgc

SEQ ID NO: 3300006 - RNA, 19 nt, Mycobacterium tuberculosis H37Rv
cgcaccccggccgcgcgca

SEQ ID NO: 3300007 - RNA, 22 nt, Mycobacterium tuberculosis H37Rv
cgcaccccggcggcguccaucg

SEQ ID NO: 3300008 - RNA, 19 nt, Mycobacterium tuberculosis H37Rv
cgcacccgaucgacggucg

SEQ ID NO: 3300009 - RNA, 13 nt, Mycobacterium tuberculosis H37Rv
cgcacccgcucgu

SEQ ID NO: 3300010 - RNA, 15 nt, Mycobacterium tuberculosis H37Rv
cgcacccggucgagc

SEQ ID NO: 3300011 - RNA, 15 nt, Mycobacterium tuberculosis H37Rv
cgcacccguccgccg

SEQ ID NO: 3300012 - RNA, 17 nt, Mycobacterium tuberculosis H37Rv
cgcacccguccggccgg

SEQ ID NO: 3300013 - RNA, 22 nt, Mycobacterium tuberculosis H37Rv
cgcacccguccggccgggcccu

SEQ ID NO: 3300014 - RNA, 17 nt, Mycobacterium tuberculosis H37Rv
cgcacccguucgugagc

SEQ ID NO: 3300015 - RNA, 14 nt, Mycobacterium tuberculosis H37Rv
cgcacccugcgcgg

SEQ ID NO: 3300016 - RNA, 13 nt, Mycobacterium tuberculosis H37Rv
cgcacccugggua

SEQ ID NO: 3300017 - RNA, 22 nt, Mycobacterium tuberculosis H37Rv
cgcacccuggguauccaccgcg

SEQ ID NO: 3300018 - RNA, 22 nt, Mycobacterium tuberculosis H37Rv
cgcaccgaaaccaugccgccga

SEQ ID NO: 3300019 - RNA, 18 nt, Mycobacterium tuberculosis H37Rv
cgcaccgaaacgccgacc

SEQ ID NO: 3300020 - RNA, 20 nt, Mycobacterium tuberculosis H37Rv
cgcaccgaccugagucggca

SEQ ID NO: 3300021 - RNA, 17 nt, Mycobacterium tuberculosis H37Rv
cgcaccgaggccgccga

SEQ ID NO: 3300022 - RNA, 20 nt, Mycobacterium tuberculosis H37Rv
cgcaccgaugccuugaccgc

SEQ ID NO: 3300023 - RNA, 21 nt, Mycobacterium tuberculosis H37Rv
cgcaccgcaaacucgguauau

SEQ ID NO: 3300024 - RNA, 15 nt, Mycobacterium tuberculosis H37Rv
cgcaccgccacccug

SEQ ID NO: 3300025 - RNA, 21 nt, Mycobacterium tuberculosis H37Rv
cgcaccgccaguuccggugac

SEQ ID NO: 3300026 - RNA, 13 nt, Mycobacterium tuberculosis H37Rv
cgcaccgccccgc

SEQ ID NO: 3300027 - RNA, 22 nt, Mycobacterium tuberculosis H37Rv
cgcaccgccgcgcgacaggccc

SEQ ID NO: 3300028 - RNA, 18 nt, Mycobacterium tuberculosis H37Rv
cgcacucccggcucggcc

SEQ ID NO: 3300029 - RNA, 21 nt, Mycobacterium tuberculosis H37Rv
cgcacucccggcucggccagc

SEQ ID NO: 3300030 - RNA, 20 nt, Mycobacterium tuberculosis H37Rv
cgcacucgcgucccgaaccg

SEQ ID NO: 3300031 - RNA, 20 nt, Mycobacterium tuberculosis H37Rv
cgcacucguugccgaccaug

SEQ ID NO: 3300032 - RNA, 18 nt, Mycobacterium tuberculosis H37Rv
cgcacucuuuccuuccgc

SEQ ID NO: 3300033 - RNA, 23 nt, Mycobacterium tuberculosis H37Rv
cgcacugaaauggcgugcucgac

SEQ ID NO: 3300034 - RNA, 19 nt, Mycobacterium tuberculosis H37Rv
cgcacugaugucacccgcc

SEQ ID NO: 3300035 - RNA, 20 nt, Mycobacterium tuberculosis H37Rv
cgcacugaugucacccgccc

SEQ ID NO: 3300036 - RNA, 13 nt, Mycobacterium tuberculosis H37Rv
cgcacugccccgc

SEQ ID NO: 3300037 - RNA, 15 nt, Mycobacterium tuberculosis H37Rv
cgcacugccgggugg

SEQ ID NO: 3300038 - RNA, 15 nt, Mycobacterium tuberculosis H37Rv
cgcacugcgccggcc

SEQ ID NO: 3300039 - RNA, 17 nt, Mycobacterium tuberculosis H37Rv
cgcacugcgccggccgc

SEQ ID NO: 3300040 - RNA, 22 nt, Mycobacterium tuberculosis H37Rv
cgcacugcuagucgugccgcgu

SEQ ID NO: 3300041 - RNA, 16 nt, Mycobacterium tuberculosis H37Rv
cgcacugggugcgucg

SEQ ID NO: 3300042 - RNA, 23 nt, Mycobacterium tuberculosis H37Rv
cgcacuucuuucgaaaugagguc

SEQ ID NO: 3300043 - RNA, 22 nt, Mycobacterium tuberculosis H37Rv
cgcacuugaucgacggccaucg

SEQ ID NO: 3300044 - RNA, 21 nt, Mycobacterium tuberculosis H37Rv
cgcagaaauguauugcgguga

SEQ ID NO: 3300045 - RNA, 23 nt, Mycobacterium tuberculosis H37Rv
cgcagaaauguauugcggugagu

SEQ ID NO: 3300046 - RNA, 16 nt, Mycobacterium tuberculosis H37Rv
cgcagaacaccaccgc

SEQ ID NO: 3300047 - RNA, 19 nt, Mycobacterium tuberculosis H37Rv
cgcagaacaccaccgccag

SEQ ID NO: 3300048 - RNA, 15 nt, Mycobacterium tuberculosis H37Rv
cgcagaacgaucgcg

SEQ ID NO: 3300049 - RNA, 17 nt, Mycobacterium tuberculosis H37Rv
cgcagaacggaccucgg

SEQ ID NO: 3300050 - RNA, 18 nt, Mycobacterium tuberculosis H37Rv
cgcagaacggcguugcgg

SEQ ID NO: 3300051 - RNA, 19 nt, Mycobacterium tuberculosis H37Rv
cgcagaacggcguugcgga

SEQ ID NO: 3300052 - RNA, 15 nt, Mycobacterium tuberculosis H37Rv
cgcagaauccggcaa

SEQ ID NO: 3300053 - RNA, 15 nt, Mycobacterium tuberculosis H37Rv
cgcagaaucgcacgc

SEQ ID NO: 3300054 - RNA, 17 nt, Mycobacterium tuberculosis H37Rv
cgcagaaucgcacgcga

SEQ ID NO: 3300055 - RNA, 15 nt, Mycobacterium tuberculosis H37Rv
cgcagaaucgcauga

SEQ ID NO: 3300056 - RNA, 16 nt, Mycobacterium tuberculosis H37Rv
cgcagacacugcugcg

SEQ ID NO: 3300057 - RNA, 12 nt, Mycobacterium tuberculosis H37Rv
cgcagaccagac

SEQ ID NO: 3300058 - RNA, 19 nt, Mycobacterium tuberculosis H37Rv
cgcagaccagacugcagug

SEQ ID NO: 3300059 - RNA, 23 nt, Mycobacterium tuberculosis H37Rv
cgcagaccagacugcagugccgu

SEQ ID NO: 3300060 - RNA, 19 nt, Mycobacterium tuberculosis H37Rv
cgcagacccucgucgucga

SEQ ID NO: 3300061 - RNA, 17 nt, Mycobacterium tuberculosis H37Rv
cgcagaccgccaccggc

SEQ ID NO: 3300062 - RNA, 19 nt, Mycobacterium tuberculosis H37Rv
cgcagaccgccaccggcug

SEQ ID NO: 3300063 - RNA, 16 nt, Mycobacterium tuberculosis H37Rv
cgcagaccugcaucac

SEQ ID NO: 3300064 - RNA, 15 nt, Mycobacterium tuberculosis H37Rv
cgcagacgacaaccg

SEQ ID NO: 3300065 - RNA, 15 nt, Mycobacterium tuberculosis H37Rv
cgcagacguccuggg

SEQ ID NO: 3300066 - RNA, 15 nt, Mycobacterium tuberculosis H37Rv
cgcagacgugguagc

SEQ ID NO: 3300067 - RNA, 23 nt, Mycobacterium tuberculosis H37Rv
cgcagacucgauaugcagcucgc

SEQ ID NO: 3300068 - RNA, 17 nt, Mycobacterium tuberculosis H37Rv
cgcagacucgccaccgc

SEQ ID NO: 3300069 - RNA, 14 nt, Mycobacterium tuberculosis H37Rv
cgcagagucaacag

SEQ ID NO: 3300070 - RNA, 22 nt, Mycobacterium tuberculosis H37Rv
cgcagauagcgcucgaacucgg

SEQ ID NO: 3300071 - RNA, 17 nt, Mycobacterium tuberculosis H37Rv
cgcagaucaccgccagc

SEQ ID NO: 3300072 - RNA, 15 nt, Mycobacterium tuberculosis H37Rv
cgcagaucagggugg

SEQ ID NO: 3300073 - RNA, 18 nt, Mycobacterium tuberculosis H37Rv
cgcagaucaggguggcgc

SEQ ID NO: 3300074 - RNA, 18 nt, Mycobacterium tuberculosis H37Rv
cgcagauccccgccaccg

SEQ ID NO: 3300075 - RNA, 22 nt, Mycobacterium tuberculosis H37Rv
cgcagaucgaaaucagcccgcg

SEQ ID NO: 3300076 - RNA, 18 nt, Mycobacterium tuberculosis H37Rv
cgcagaugagcgcggcga

SEQ ID NO: 3300077 - RNA, 18 nt, Mycobacterium tuberculosis H37Rv
cgcagauuugcuccagcg

SEQ ID NO: 3300078 - RNA, 23 nt, Mycobacterium tuberculosis H37Rv
cgcagcaacaccucgucacccgg

SEQ ID NO: 3300079 - RNA, 13 nt, Mycobacterium tuberculosis H37Rv
cgcagcaacggcg

SEQ ID NO: 3300080 - RNA, 13 nt, Mycobacterium tuberculosis H37Rv
cgcagcaacucga

SEQ ID NO: 3300081 - RNA, 16 nt, Mycobacterium tuberculosis H37Rv
cgcagcaccaaggucu

SEQ ID NO: 3300082 - RNA, 20 nt, Mycobacterium tuberculosis H37Rv
cgcagcacccugcgggccga

SEQ ID NO: 3300083 - RNA, 16 nt, Mycobacterium tuberculosis H37Rv
cgcagcaccggcucga

SEQ ID NO: 3300084 - RNA, 14 nt, Mycobacterium tuberculosis H37Rv
cgcagcaccgguca

SEQ ID NO: 3300085 - RNA, 18 nt, Mycobacterium tuberculosis H37Rv
cgcagcaccgucgggccc

SEQ ID NO: 3300086 - RNA, 21 nt, Mycobacterium tuberculosis H37Rv
cgcagcaccgucgggcccagc

SEQ ID NO: 3300087 - RNA, 22 nt, Mycobacterium tuberculosis H37Rv
cgcagcaccgucgggcccagcc

SEQ ID NO: 3300088 - RNA, 16 nt, Mycobacterium tuberculosis H37Rv
cgcagcaccucgucga

SEQ ID NO: 3300089 - RNA, 21 nt, Mycobacterium tuberculosis H37Rv
cgcagcaccucgucgaucgcc

SEQ ID NO: 3300090 - RNA, 14 nt, Mycobacterium tuberculosis H37Rv
cgcagcacucgccc

SEQ ID NO: 3300091 - RNA, 13 nt, Mycobacterium tuberculosis H37Rv
cgcagcacugcgg

SEQ ID NO: 3300092 - RNA, 18 nt, Mycobacterium tuberculosis H37Rv
cgcagcacugcggcagcg

SEQ ID NO: 3300093 - RNA, 19 nt, Mycobacterium tuberculosis H37Rv
cgcagcacugcggcagcga

SEQ ID NO: 3300094 - RNA, 12 nt, Mycobacterium tuberculosis H37Rv
cgcagcagacca

SEQ ID NO: 3300095 - RNA, 22 nt, Mycobacterium tuberculosis H37Rv
cgcagcagcaucggcacgucgu

SEQ ID NO: 3300096 - RNA, 12 nt, Mycobacterium tuberculosis H37Rv
cgcagcagcgug

SEQ ID NO: 3300097 - RNA, 22 nt, Mycobacterium tuberculosis H37Rv
cgcagcaggggacgaccaugcc

SEQ ID NO: 3300098 - RNA, 21 nt, Mycobacterium tuberculosis H37Rv
cgcagcaggugagccaguugg

SEQ ID NO: 3300099 - RNA, 21 nt, Mycobacterium tuberculosis H37Rv
cgcagcauaaagaggucgggc

SEQ ID NO: 3300100 - RNA, 17 nt, Mycobacterium tuberculosis H37Rv
cgcagcauccccgcagc

SEQ ID NO: 3300101 - RNA, 20 nt, Mycobacterium tuberculosis H37Rv
cgcagcaucccugguccgga

SEQ ID NO: 3300102 - RNA, 14 nt, Mycobacterium tuberculosis H37Rv
cgcagcaucgccag

SEQ ID NO: 3300103 - RNA, 18 nt, Mycobacterium tuberculosis H37Rv
cgcagcaucgccagcagg

SEQ ID NO: 3300104 - RNA, 15 nt, Mycobacterium tuberculosis H37Rv
cgcagcaucgucgcc

SEQ ID NO: 3300105 - RNA, 20 nt, Mycobacterium tuberculosis H37Rv
cgcagcaucgucgccacgau

SEQ ID NO: 3300106 - RNA, 18 nt, Mycobacterium tuberculosis H37Rv
cgcagcaucuccgccggu

SEQ ID NO: 3300107 - RNA, 22 nt, Mycobacterium tuberculosis H37Rv
cgcagccacguuacgcucgcgg

SEQ ID NO: 3300108 - RNA, 23 nt, Mycobacterium tuberculosis H37Rv
cgcagccacguuacgcucgcggg

SEQ ID NO: 3300109 - RNA, 14 nt, Mycobacterium tuberculosis H37Rv
cgcagccagcaagu

SEQ ID NO: 3300110 - RNA, 23 nt, Mycobacterium tuberculosis H37Rv
cgcagccagcaagucugcccgac

SEQ ID NO: 3300111 - RNA, 12 nt, Mycobacterium tuberculosis H37Rv
cgcagccagcgc

SEQ ID NO: 3300112 - RNA, 14 nt, Mycobacterium tuberculosis H37Rv
cgcagccagcgcca

SEQ ID NO: 3300113 - RNA, 14 nt, Mycobacterium tuberculosis H37Rv
cgcagccagcggua

SEQ ID NO: 3300114 - RNA, 17 nt, Mycobacterium tuberculosis H37Rv
cgcagccagcugaacac

SEQ ID NO: 3300115 - RNA, 18 nt, Mycobacterium tuberculosis H37Rv
cgcagccaggcugcggau

SEQ ID NO: 3300116 - RNA, 13 nt, Mycobacterium tuberculosis H37Rv
cgcagcccgccgg

SEQ ID NO: 3300117 - RNA, 16 nt, Mycobacterium tuberculosis H37Rv
cgcagcccgucggcgc

SEQ ID NO: 3300118 - RNA, 12 nt, Mycobacterium tuberculosis H37Rv
cgcagcccguga

SEQ ID NO: 3300119 - RNA, 19 nt, Mycobacterium tuberculosis H37Rv
cgcagcccgugacugguga

SEQ ID NO: 3300120 - RNA, 14 nt, Mycobacterium tuberculosis H37Rv
cgcagccgcaccgg

SEQ ID NO: 3300121 - RNA, 14 nt, Mycobacterium tuberculosis H37Rv
cgcagccgccucaa

SEQ ID NO: 3300122 - RNA, 23 nt, Mycobacterium tuberculosis H37Rv
cgcagccgccucaaugaccaccg

SEQ ID NO: 3300123 - RNA, 16 nt, Mycobacterium tuberculosis H37Rv
cgcagccgcgcgguga

SEQ ID NO: 3300124 - RNA, 22 nt, Mycobacterium tuberculosis H37Rv
cgcaguuggcaccagccgguga

SEQ ID NO: 3300125 - RNA, 14 nt, Mycobacterium tuberculosis H37Rv
cgcauaaaucgggg

SEQ ID NO: 3300126 - RNA, 19 nt, Mycobacterium tuberculosis H37Rv
cgcauaacgccagucccgg

SEQ ID NO: 3300127 - RNA, 19 nt, Mycobacterium tuberculosis H37Rv
cgcauaacgcgaacccgcg

SEQ ID NO: 3300128 - RNA, 14 nt, Mycobacterium tuberculosis H37Rv
cgcauaagcccccg

SEQ ID NO: 3300129 - RNA, 21 nt, Mycobacterium tuberculosis H37Rv
cgcauaccuaacgagccgucc

SEQ ID NO: 3300130 - RNA, 21 nt, Mycobacterium tuberculosis H37Rv
cgcauaccuuccagaucgcgg

SEQ ID NO: 3300131 - RNA, 19 nt, Mycobacterium tuberculosis H37Rv
cgcauacgcccacuccagc

SEQ ID NO: 3300132 - RNA, 20 nt, Mycobacterium tuberculosis H37Rv
cgcauaggcggccaucgacg

SEQ ID NO: 3300133 - RNA, 22 nt, Mycobacterium tuberculosis H37Rv
cgcauaggcggccaucgacgac

SEQ ID NO: 3300134 - RNA, 21 nt, Mycobacterium tuberculosis H37Rv
cgcauaggcuuccggcgcgac

SEQ ID NO: 3300135 - RNA, 15 nt, Mycobacterium tuberculosis H37Rv
cgcauagggccaccg

SEQ ID NO: 3300136 - RNA, 18 nt, Mycobacterium tuberculosis H37Rv
cgcauagugcggcugcaa

SEQ ID NO: 3300137 - RNA, 15 nt, Mycobacterium tuberculosis H37Rv
cgcauaugccgccgg

SEQ ID NO: 3300138 - RNA, 20 nt, Mycobacterium tuberculosis H37Rv
cgcauaugccgccggcagcg

SEQ ID NO: 3300139 - RNA, 15 nt, Mycobacterium tuberculosis H37Rv
cgcaucaccagggug

SEQ ID NO: 3300140 - RNA, 13 nt, Mycobacterium tuberculosis H37Rv
cgcaucacccggg

SEQ ID NO: 3300141 - RNA, 14 nt, Mycobacterium tuberculosis H37Rv
cgcaucagcgguac

SEQ ID NO: 3300142 - RNA, 19 nt, Mycobacterium tuberculosis H37Rv
cgcaucauagacagggccg

SEQ ID NO: 3300143 - RNA, 14 nt, Mycobacterium tuberculosis H37Rv
cgcauccagccgug

SEQ ID NO: 3300144 - RNA, 14 nt, Mycobacterium tuberculosis H37Rv
cgcauccgcaccga

SEQ ID NO: 3300145 - RNA, 15 nt, Mycobacterium tuberculosis H37Rv
cgcauccgcgacggc

SEQ ID NO: 3300146 - RNA, 19 nt, Mycobacterium tuberculosis H37Rv
cgcauccgcgacggcgccc

SEQ ID NO: 3300147 - RNA, 16 nt, Mycobacterium tuberculosis H37Rv
cgcauccgcgguuggc

SEQ ID NO: 3300148 - RNA, 18 nt, Mycobacterium tuberculosis H37Rv
cgcauccggucucggccg

SEQ ID NO: 3300149 - RNA, 15 nt, Mycobacterium tuberculosis H37Rv
cgcaucgacgcucau

SEQ ID NO: 3300150 - RNA, 20 nt, Mycobacterium tuberculosis H37Rv
cgcaucgacgugcgcggcau

SEQ ID NO: 3300151 - RNA, 17 nt, Mycobacterium tuberculosis H37Rv
cgcaucgagcaccucca

SEQ ID NO: 3300152 - RNA, 21 nt, Mycobacterium tuberculosis H37Rv
cgcaucgagcccggacgagug

SEQ ID NO: 3300153 - RNA, 16 nt, Mycobacterium tuberculosis H37Rv
cgcaucgcacagcgcc

SEQ ID NO: 3300154 - RNA, 11 nt, Mycobacterium tuberculosis H37Rv
cgcaucgccaa

SEQ ID NO: 3300155 - RNA, 13 nt, Mycobacterium tuberculosis H37Rv
cgcaucgccacca

SEQ ID NO: 3300156 - RNA, 19 nt, Mycobacterium tuberculosis H37Rv
cgcaucgcccaagccguag

SEQ ID NO: 3300157 - RNA, 15 nt, Mycobacterium tuberculosis H37Rv
cgcaucgccgacagc

SEQ ID NO: 3300158 - RNA, 14 nt, Mycobacterium tuberculosis H37Rv
cgcaucgccgcugg

SEQ ID NO: 3300159 - RNA, 22 nt, Mycobacterium tuberculosis H37Rv
cgcaucgccgcuggccagcaca

SEQ ID NO: 3300160 - RNA, 15 nt, Mycobacterium tuberculosis H37Rv
cgcaucgccucacca

SEQ ID NO: 3300161 - RNA, 21 nt, Mycobacterium tuberculosis H37Rv
cgcaucgccuccucgacgucg

SEQ ID NO: 3300162 - RNA, 13 nt, Mycobacterium tuberculosis H37Rv
cgcaucgcggcga

SEQ ID NO: 3300163 - RNA, 19 nt, Mycobacterium tuberculosis H37Rv
cgcaucggcgccagaucga

SEQ ID NO: 3300164 - RNA, 12 nt, Mycobacterium tuberculosis H37Rv
cgcaucgguguc

SEQ ID NO: 3300165 - RNA, 15 nt, Mycobacterium tuberculosis H37Rv
cgcaucgucagcgac

SEQ ID NO: 3300166 - RNA, 18 nt, Mycobacterium tuberculosis H37Rv
cgcaucgucgaaagccug

SEQ ID NO: 3300167 - RNA, 22 nt, Mycobacterium tuberculosis H37Rv
cgcaucugcucggcaucgagca

SEQ ID NO: 3300168 - RNA, 22 nt, Mycobacterium tuberculosis H37Rv
cgcaugcacgucaucggcuggc

SEQ ID NO: 3300169 - RNA, 13 nt, Mycobacterium tuberculosis H37Rv
cgcaugccacggc

SEQ ID NO: 3300170 - RNA, 21 nt, Mycobacterium tuberculosis H37Rv
cgcaugccccgaccgcguaca

SEQ ID NO: 3300171 - RNA, 21 nt, Mycobacterium tuberculosis H37Rv
cgcaugcccuggaccagcggg

SEQ ID NO: 3300172 - RNA, 19 nt, Mycobacterium tuberculosis H37Rv
cgcaugcgcuccggcgcga

SEQ ID NO: 3300173 - RNA, 18 nt, Mycobacterium tuberculosis H37Rv
cgcaugcguaugcccacg

SEQ ID NO: 3300174 - RNA, 22 nt, Mycobacterium tuberculosis H37Rv
cgcaugcguaugcccacgaacc

SEQ ID NO: 3300175 - RNA, 18 nt, Mycobacterium tuberculosis H37Rv
cgcaugcucagcaucguc

SEQ ID NO: 3300176 - RNA, 20 nt, Mycobacterium tuberculosis H37Rv
cgcaugcucagcaucgucga

SEQ ID NO: 3300177 - RNA, 17 nt, Mycobacterium tuberculosis H37Rv
cgcaugcucgaucgcgu

SEQ ID NO: 3300178 - RNA, 21 nt, Mycobacterium tuberculosis H37Rv
cgcaugcuugaaacccaggcc

SEQ ID NO: 3300179 - RNA, 14 nt, Mycobacterium tuberculosis H37Rv
cgcauggacaacag

SEQ ID NO: 3300180 - RNA, 19 nt, Mycobacterium tuberculosis H37Rv
cgcauggacaacagcuugg

SEQ ID NO: 3300181 - RNA, 20 nt, Mycobacterium tuberculosis H37Rv
cgcauggacgaacgcggcca

SEQ ID NO: 3300182 - RNA, 13 nt, Mycobacterium tuberculosis H37Rv
cgcauggacgcga

SEQ ID NO: 3300183 - RNA, 13 nt, Mycobacterium tuberculosis H37Rv
cgcaugggccagg

SEQ ID NO: 3300184 - RNA, 12 nt, Mycobacterium tuberculosis H37Rv
cgcauggucgac

SEQ ID NO: 3300185 - RNA, 20 nt, Mycobacterium tuberculosis H37Rv
cgcaugguggugggugaugg

SEQ ID NO: 3300186 - RNA, 19 nt, Mycobacterium tuberculosis H37Rv
cgcaugucgggccaggcga

SEQ ID NO: 3300187 - RNA, 17 nt, Mycobacterium tuberculosis H37Rv
cgcauguucuccacgcc

SEQ ID NO: 3300188 - RNA, 23 nt, Mycobacterium tuberculosis H37Rv
cgcauuagccugcguggagcgcu

SEQ ID NO: 3300189 - RNA, 16 nt, Mycobacterium tuberculosis H37Rv
cgcauuccccacggug

SEQ ID NO: 3300190 - RNA, 19 nt, Mycobacterium tuberculosis H37Rv
cgcauucggacgccacgga

SEQ ID NO: 3300191 - RNA, 14 nt, Mycobacterium tuberculosis H37Rv
cgcauucugcugcc

SEQ ID NO: 3300192 - RNA, 15 nt, Mycobacterium tuberculosis H37Rv
cgcauucugcugcca

SEQ ID NO: 3300193 - RNA, 14 nt, Mycobacterium tuberculosis H37Rv
cgcauugagcuggc

SEQ ID NO: 3300194 - RNA, 21 nt, Mycobacterium tuberculosis H37Rv
cgcauugagcuggcgcccggg

SEQ ID NO: 3300195 - RNA, 23 nt, Mycobacterium tuberculosis H37Rv
cgcauugaucucgaccggcuugc

SEQ ID NO: 3300196 - RNA, 16 nt, Mycobacterium tuberculosis H37Rv
cgcauugcagaaccgc

SEQ ID NO: 3300197 - RNA, 12 nt, Mycobacterium tuberculosis H37Rv
cgcauuggcggc

SEQ ID NO: 3300198 - RNA, 19 nt, Mycobacterium tuberculosis H37Rv
cgcauuggggacgcccgaa

SEQ ID NO: 3300199 - RNA, 17 nt, Mycobacterium tuberculosis H37Rv
cgcauuucggaucucga

SEQ ID NO: 3300200 - RNA, 16 nt, Mycobacterium tuberculosis H37Rv
cgcauuuggugucggc

SEQ ID NO: 3300201 - RNA, 20 nt, Mycobacterium tuberculosis H37Rv
cgcauuuguugcugcugccg

SEQ ID NO: 3300202 - RNA, 21 nt, Mycobacterium tuberculosis H37Rv
cgcauuuuucgccagcugaca

SEQ ID NO: 3300203 - RNA, 23 nt, Mycobacterium tuberculosis H37Rv
cgccaaaaaggaucccgccgcug

SEQ ID NO: 3300204 - RNA, 19 nt, Mycobacterium tuberculosis H37Rv
cgccaaaacggucgaccgu

SEQ ID NO: 3300205 - RNA, 10 nt, Mycobacterium tuberculosis H37Rv
cgccaaaauc

SEQ ID NO: 3300206 - RNA, 23 nt, Mycobacterium tuberculosis H37Rv
cgccaaaauccgcccaccggucg

SEQ ID NO: 3300207 - RNA, 22 nt, Mycobacterium tuberculosis H37Rv
cgccaaauccggugcccgcacc

SEQ ID NO: 3300208 - RNA, 20 nt, Mycobacterium tuberculosis H37Rv
cgccaacaacuucucgucga

SEQ ID NO: 3300209 - RNA, 18 nt, Mycobacterium tuberculosis H37Rv
cgccaacaccaaccagug

SEQ ID NO: 3300210 - RNA, 20 nt, Mycobacterium tuberculosis H37Rv
cgccaacaucuccgcgucgg

SEQ ID NO: 3300211 - RNA, 20 nt, Mycobacterium tuberculosis H37Rv
cgccaaccacuuuccggccg

SEQ ID NO: 3300212 - RNA, 21 nt, Mycobacterium tuberculosis H37Rv
cgccaaccacuuuccggccga

SEQ ID NO: 3300213 - RNA, 16 nt, Mycobacterium tuberculosis H37Rv
cgccaaccgcgugcgu

SEQ ID NO: 3300214 - RNA, 20 nt, Mycobacterium tuberculosis H37Rv
cgccaaccgcgugcgucagc

SEQ ID NO: 3300215 - RNA, 16 nt, Mycobacterium tuberculosis H37Rv
cgccaaccuuugcguu

SEQ ID NO: 3300216 - RNA, 12 nt, Mycobacterium tuberculosis H37Rv
cgccaacgccaa

SEQ ID NO: 3300217 - RNA, 14 nt, Mycobacterium tuberculosis H37Rv
cgccaacgccagca

SEQ ID NO: 3300218 - RNA, 21 nt, Mycobacterium tuberculosis H37Rv
cgccaacgccagcaccagcgu

SEQ ID NO: 3300219 - RNA, 16 nt, Mycobacterium tuberculosis H37Rv
cgccaacgccagcggg

SEQ ID NO: 3300220 - RNA, 17 nt, Mycobacterium tuberculosis H37Rv
cgccaccguuugcgcac

SEQ ID NO: 3300221 - RNA, 19 nt, Mycobacterium tuberculosis H37Rv
cgccaccucgacgcacacc

SEQ ID NO: 3300222 - RNA, 20 nt, Mycobacterium tuberculosis H37Rv
cgccaccugacgugcggcgc

SEQ ID NO: 3300223 - RNA, 17 nt, Mycobacterium tuberculosis H37Rv
cgccaccuguugcccuu

SEQ ID NO: 3300224 - RNA, 18 nt, Mycobacterium tuberculosis H37Rv
cgccaccuuggcguugac

SEQ ID NO: 3300225 - RNA, 15 nt, Mycobacterium tuberculosis H37Rv
cgccacgaccgccga

SEQ ID NO: 3300226 - RNA, 14 nt, Mycobacterium tuberculosis H37Rv
cgccacgacgucgu

SEQ ID NO: 3300227 - RNA, 15 nt, Mycobacterium tuberculosis H37Rv
cgccacgacgucguc

SEQ ID NO: 3300228 - RNA, 19 nt, Mycobacterium tuberculosis H37Rv
cgccacgagcaacgggcga

SEQ ID NO: 3300229 - RNA, 24 nt, Mycobacterium tuberculosis H37Rv
cgccacgagcguccgggucgacgc

SEQ ID NO: 3300230 - RNA, 15 nt, Mycobacterium tuberculosis H37Rv
cgccacgaugaccgg

SEQ ID NO: 3300231 - RNA, 17 nt, Mycobacterium tuberculosis H37Rv
cgccacgaugucgucga

SEQ ID NO: 3300232 - RNA, 15 nt, Mycobacterium tuberculosis H37Rv
cgccacgcacccggc

SEQ ID NO: 3300233 - RNA, 16 nt, Mycobacterium tuberculosis H37Rv
cgccacgcacccggca

SEQ ID NO: 3300234 - RNA, 13 nt, Mycobacterium tuberculosis H37Rv
cgccacgccaccg

SEQ ID NO: 3300235 - RNA, 19 nt, Mycobacterium tuberculosis H37Rv
cgccacgccaccgcgguca

SEQ ID NO: 3300236 - RNA, 13 nt, Mycobacterium tuberculosis H37Rv
cgccacgcccgac

SEQ ID NO: 3300237 - RNA, 18 nt, Mycobacterium tuberculosis H37Rv
cgccacgcccgacgccag

SEQ ID NO: 3300238 - RNA, 22 nt, Mycobacterium tuberculosis H37Rv
cgccacgcgucuucggucgcgg

SEQ ID NO: 3300239 - RNA, 15 nt, Mycobacterium tuberculosis H37Rv
cgccacggaucgcgg

SEQ ID NO: 3300240 - RNA, 20 nt, Mycobacterium tuberculosis H37Rv
cgccacggcaucggccaccu

SEQ ID NO: 3300241 - RNA, 13 nt, Mycobacterium tuberculosis H37Rv
cgccacgggcggc

SEQ ID NO: 3300242 - RNA, 18 nt, Mycobacterium tuberculosis H37Rv
cgccacgggcggccaccg

SEQ ID NO: 3300243 - RNA, 18 nt, Mycobacterium tuberculosis H37Rv
cgccacgggugacucggg

SEQ ID NO: 3300244 - RNA, 20 nt, Mycobacterium tuberculosis H37Rv
cgccacguacuccaccgcgc

SEQ ID NO: 3300245 - RNA, 21 nt, Mycobacterium tuberculosis H37Rv
cgccacguacuuggacgaccc

SEQ ID NO: 3300246 - RNA, 18 nt, Mycobacterium tuberculosis H37Rv
cgccacgucgccggcuac

SEQ ID NO: 3300247 - RNA, 18 nt, Mycobacterium tuberculosis H37Rv
cgccacuagcccugagcg

SEQ ID NO: 3300248 - RNA, 16 nt, Mycobacterium tuberculosis H37Rv
cgccacugaccgcgau

SEQ ID NO: 3300249 - RNA, 21 nt, Mycobacterium tuberculosis H37Rv
cgccacugaccgcgaucgccg

SEQ ID NO: 3300250 - RNA, 16 nt, Mycobacterium tuberculosis H37Rv
cgccacugccagccgu

SEQ ID NO: 3300251 - RNA, 17 nt, Mycobacterium tuberculosis H37Rv
cgccacugccagccgug

SEQ ID NO: 3300252 - RNA, 19 nt, Mycobacterium tuberculosis H37Rv
cgccacugccagccgugca

SEQ ID NO: 3300253 - RNA, 12 nt, Mycobacterium tuberculosis H37Rv
cgccacugcugg

SEQ ID NO: 3300254 - RNA, 21 nt, Mycobacterium tuberculosis H37Rv
cgccacugcugggcuucgagu

SEQ ID NO: 3300255 - RNA, 18 nt, Mycobacterium tuberculosis H37Rv
cgccacugcuuccggaac

SEQ ID NO: 3300256 - RNA, 22 nt, Mycobacterium tuberculosis H37Rv
cgccacuggcgccggugccgcc

SEQ ID NO: 3300257 - RNA, 18 nt, Mycobacterium tuberculosis H37Rv
cgccacuggcgcugaucg

SEQ ID NO: 3300258 - RNA, 21 nt, Mycobacterium tuberculosis H37Rv
cgccacuguugaagaagcccg

SEQ ID NO: 3300259 - RNA, 16 nt, Mycobacterium tuberculosis H37Rv
cgccacuugaugccgc

SEQ ID NO: 3300260 - RNA, 13 nt, Mycobacterium tuberculosis H37Rv
cgccagaacggcg

SEQ ID NO: 3300261 - RNA, 17 nt, Mycobacterium tuberculosis H37Rv
cgccagaaucccgcucc

SEQ ID NO: 3300262 - RNA, 17 nt, Mycobacterium tuberculosis H37Rv
cgccagaauugccggcg

SEQ ID NO: 3300263 - RNA, 19 nt, Mycobacterium tuberculosis H37Rv
cgccagaauugccggcgau

SEQ ID NO: 3300264 - RNA, 16 nt, Mycobacterium tuberculosis H37Rv
cgccagaucucgcgcg

SEQ ID NO: 3300265 - RNA, 20 nt, Mycobacterium tuberculosis H37Rv
cgccagaucucgcgcgcggc

SEQ ID NO: 3300266 - RNA, 15 nt, Mycobacterium tuberculosis H37Rv
cgccagauggccacg

SEQ ID NO: 3300267 - RNA, 18 nt, Mycobacterium tuberculosis H37Rv
cgccagcaaaccuucgau

SEQ ID NO: 3300268 - RNA, 15 nt, Mycobacterium tuberculosis H37Rv
cgccagcaacgucgg

SEQ ID NO: 3300269 - RNA, 14 nt, Mycobacterium tuberculosis H37Rv
cgccagcaaugccc

SEQ ID NO: 3300270 - RNA, 17 nt, Mycobacterium tuberculosis H37Rv
cgccagcaaugcccgca

SEQ ID NO: 3300271 - RNA, 21 nt, Mycobacterium tuberculosis H37Rv
cgccagcaaugcccgcaccgc

SEQ ID NO: 3300272 - RNA, 19 nt, Mycobacterium tuberculosis H37Rv
cgccagcacaaccaucgcg

SEQ ID NO: 3300273 - RNA, 14 nt, Mycobacterium tuberculosis H37Rv
cgccagcaccaccg

SEQ ID NO: 3300274 - RNA, 16 nt, Mycobacterium tuberculosis H37Rv
cgccagcaccaccggc

SEQ ID NO: 3300275 - RNA, 20 nt, Mycobacterium tuberculosis H37Rv
cgccagcaccucggccagcu

SEQ ID NO: 3300276 - RNA, 13 nt, Mycobacterium tuberculosis H37Rv
cgccagcagaucu

SEQ ID NO: 3300277 - RNA, 23 nt, Mycobacterium tuberculosis H37Rv
cgccagcagcugugguaccaacg

SEQ ID NO: 3300278 - RNA, 20 nt, Mycobacterium tuberculosis H37Rv
cgccagcauugaagaagccc

SEQ ID NO: 3300279 - RNA, 21 nt, Mycobacterium tuberculosis H37Rv
cgccagcauugaagaagcccg

SEQ ID NO: 3300280 - RNA, 22 nt, Mycobacterium tuberculosis H37Rv
cgccagcauugaagaagcccga

SEQ ID NO: 3300281 - RNA, 13 nt, Mycobacterium tuberculosis H37Rv
cgccagccaccac

SEQ ID NO: 3300282 - RNA, 13 nt, Mycobacterium tuberculosis H37Rv
cgccagcccagca

SEQ ID NO: 3300283 - RNA, 20 nt, Mycobacterium tuberculosis H37Rv
cgccagcccagcacgcuggc

SEQ ID NO: 3300284 - RNA, 16 nt, Mycobacterium tuberculosis H37Rv
cgccagccccacccgc

SEQ ID NO: 3300285 - RNA, 14 nt, Mycobacterium tuberculosis H37Rv
cgccagccccgccg

SEQ ID NO: 3300286 - RNA, 15 nt, Mycobacterium tuberculosis H37Rv
cgccagccccgccgg

SEQ ID NO: 3300287 - RNA, 16 nt, Mycobacterium tuberculosis H37Rv
cgccagccccgccggg

SEQ ID NO: 3300288 - RNA, 16 nt, Mycobacterium tuberculosis H37Rv
cgccagccccgcgccc

SEQ ID NO: 3300289 - RNA, 17 nt, Mycobacterium tuberculosis H37Rv
cgccagccccgcgccca

SEQ ID NO: 3300290 - RNA, 14 nt, Mycobacterium tuberculosis H37Rv
cgccagccggccgc

SEQ ID NO: 3300291 - RNA, 14 nt, Mycobacterium tuberculosis H37Rv
cgccagccggcgca

SEQ ID NO: 3300292 - RNA, 22 nt, Mycobacterium tuberculosis H37Rv
cgccagccggcgcacucccgga

SEQ ID NO: 3300293 - RNA, 19 nt, Mycobacterium tuberculosis H37Rv
cgccagccgguccagcagc

SEQ ID NO: 3300294 - RNA, 13 nt, Mycobacterium tuberculosis H37Rv
cgccagccuccac

SEQ ID NO: 3300295 - RNA, 14 nt, Mycobacterium tuberculosis H37Rv
cgccagccuccacc

SEQ ID NO: 3300296 - RNA, 15 nt, Mycobacterium tuberculosis H37Rv
cgccagccuccacca

SEQ ID NO: 3300297 - RNA, 17 nt, Mycobacterium tuberculosis H37Rv
cgccagccuccaccagg

SEQ ID NO: 3300298 - RNA, 19 nt, Mycobacterium tuberculosis H37Rv
cgccagccuccaccagguc

SEQ ID NO: 3300299 - RNA, 19 nt, Mycobacterium tuberculosis H37Rv
cgccagccugaaccgcccc

SEQ ID NO: 3300300 - RNA, 19 nt, Mycobacterium tuberculosis H37Rv
cgccagcgagcauaccgcc

SEQ ID NO: 3300301 - RNA, 21 nt, Mycobacterium tuberculosis H37Rv
cgccagcgagcauaccgccgc

SEQ ID NO: 3300302 - RNA, 22 nt, Mycobacterium tuberculosis H37Rv
cgccagcgagcauaccgccgcu

SEQ ID NO: 3300303 - RNA, 20 nt, Mycobacterium tuberculosis H37Rv
cgccagcgauaucggcggcu

SEQ ID NO: 3300304 - RNA, 13 nt, Mycobacterium tuberculosis H37Rv
cgccagcgccacc

SEQ ID NO: 3300305 - RNA, 15 nt, Mycobacterium tuberculosis H37Rv
cgccagcgccaccgu

SEQ ID NO: 3300306 - RNA, 17 nt, Mycobacterium tuberculosis H37Rv
cgccagcgccagugccu

SEQ ID NO: 3300307 - RNA, 11 nt, Mycobacterium tuberculosis H37Rv
cgccagcgccg

SEQ ID NO: 3300308 - RNA, 16 nt, Mycobacterium tuberculosis H37Rv
cgccagcgccgccacc

SEQ ID NO: 3300309 - RNA, 17 nt, Mycobacterium tuberculosis H37Rv
cgccagcgccgccaggu

SEQ ID NO: 3300310 - RNA, 15 nt, Mycobacterium tuberculosis H37Rv
cgccagcgccgccga

SEQ ID NO: 3300311 - RNA, 20 nt, Mycobacterium tuberculosis H37Rv
cgccagcgccgccggcaccu

SEQ ID NO: 3300312 - RNA, 22 nt, Mycobacterium tuberculosis H37Rv
cgccagcgccgccggcaccucc

SEQ ID NO: 3300313 - RNA, 18 nt, Mycobacterium tuberculosis H37Rv
cgccagcgccgccggcgc

SEQ ID NO: 3300314 - RNA, 16 nt, Mycobacterium tuberculosis H37Rv
cgccagcgccgcugaa

SEQ ID NO: 3300315 - RNA, 19 nt, Mycobacterium tuberculosis H37Rv
cgccagcgccgcugaagcc

SEQ ID NO: 3300316 - RNA, 14 nt, Mycobacterium tuberculosis H37Rv
cgccauccaugaug

SEQ ID NO: 3300317 - RNA, 22 nt, Mycobacterium tuberculosis H37Rv
cgccauccaugauggccgucag

SEQ ID NO: 3300318 - RNA, 22 nt, Mycobacterium tuberculosis H37Rv
cgccauccgauggcccggcuca

SEQ ID NO: 3300319 - RNA, 16 nt, Mycobacterium tuberculosis H37Rv
cgccaucgccuccagc

SEQ ID NO: 3300320 - RNA, 15 nt, Mycobacterium tuberculosis H37Rv
cgccaucgguugacc

SEQ ID NO: 3300321 - RNA, 23 nt, Mycobacterium tuberculosis H37Rv
cgccaucgguugacccggcagcc

SEQ ID NO: 3300322 - RNA, 19 nt, Mycobacterium tuberculosis H37Rv
cgccaucgucgaagaccuc

SEQ ID NO: 3300323 - RNA, 20 nt, Mycobacterium tuberculosis H37Rv
cgccaucgucgaagaccuca

SEQ ID NO: 3300324 - RNA, 17 nt, Mycobacterium tuberculosis H37Rv
cgccaucucgacgguga

SEQ ID NO: 3300325 - RNA, 23 nt, Mycobacterium tuberculosis H37Rv
cgccaucucgacggugaccggau

SEQ ID NO: 3300326 - RNA, 14 nt, Mycobacterium tuberculosis H37Rv
cgccaugaagccgg

SEQ ID NO: 3300327 - RNA, 15 nt, Mycobacterium tuberculosis H37Rv
cgccaugauggacag

SEQ ID NO: 3300328 - RNA, 22 nt, Mycobacterium tuberculosis H37Rv
cgccaugauggacagcugcggg

SEQ ID NO: 3300329 - RNA, 18 nt, Mycobacterium tuberculosis H37Rv
cgccaugcacguugccga

SEQ ID NO: 3300330 - RNA, 19 nt, Mycobacterium tuberculosis H37Rv
cgccaugcgccaacccggc

SEQ ID NO: 3300331 - RNA, 15 nt, Mycobacterium tuberculosis H37Rv
cgccauggccgccgu

SEQ ID NO: 3300332 - RNA, 17 nt, Mycobacterium tuberculosis H37Rv
cgccauggucgcugcgu

SEQ ID NO: 3300333 - RNA, 19 nt, Mycobacterium tuberculosis H37Rv
cgccauguugaagcgaagc

SEQ ID NO: 3300334 - RNA, 13 nt, Mycobacterium tuberculosis H37Rv
cgccauucaucgg

SEQ ID NO: 3300335 - RNA, 15 nt, Mycobacterium tuberculosis H37Rv
cgccauucaucggca

SEQ ID NO: 3300336 - RNA, 22 nt, Mycobacterium tuberculosis H37Rv
cgccauuccagccggugccgcc

SEQ ID NO: 3300337 - RNA, 15 nt, Mycobacterium tuberculosis H37Rv
cgccauugacgccgu

SEQ ID NO: 3300338 - RNA, 17 nt, Mycobacterium tuberculosis H37Rv
cgccauugacgccguug

SEQ ID NO: 3300339 - RNA, 22 nt, Mycobacterium tuberculosis H37Rv
cgccauugacgccguugccgcc

SEQ ID NO: 3300340 - RNA, 16 nt, Mycobacterium tuberculosis H37Rv
cgccauugccaccaag

SEQ ID NO: 3300341 - RNA, 22 nt, Mycobacterium tuberculosis H37Rv
cgccauugccgccggugccgcc

SEQ ID NO: 3300342 - RNA, 16 nt, Mycobacterium tuberculosis H37Rv
cgcccaaaacgucacc

SEQ ID NO: 3300343 - RNA, 20 nt, Mycobacterium tuberculosis H37Rv
cgcccaaaacgucaccgccg

SEQ ID NO: 3300344 - RNA, 14 nt, Mycobacterium tuberculosis H37Rv
cgcccaaagaaaug

SEQ ID NO: 3300345 - RNA, 18 nt, Mycobacterium tuberculosis H37Rv
cgcccaacaacgcuucgg

SEQ ID NO: 3300346 - RNA, 15 nt, Mycobacterium tuberculosis H37Rv
cgcccaacaccgcgc

SEQ ID NO: 3300347 - RNA, 17 nt, Mycobacterium tuberculosis H37Rv
cgcccaacaccgcgccg

SEQ ID NO: 3300348 - RNA, 18 nt, Mycobacterium tuberculosis H37Rv
cgcccaacaccgcgccga

SEQ ID NO: 3300349 - RNA, 23 nt, Mycobacterium tuberculosis H37Rv
cgcccaacaggcgggacaaccgg

SEQ ID NO: 3300350 - RNA, 16 nt, Mycobacterium tuberculosis H37Rv
cgcccaacgucgccag

SEQ ID NO: 3300351 - RNA, 16 nt, Mycobacterium tuberculosis H37Rv
cgcccaagccgccggc

SEQ ID NO: 3300352 - RNA, 24 nt, Mycobacterium tuberculosis H37Rv
cgcccaagccguaguaguggccgc

SEQ ID NO: 3300353 - RNA, 20 nt, Mycobacterium tuberculosis H37Rv
cgcccaauucggcacgaaau

SEQ ID NO: 3300354 - RNA, 17 nt, Mycobacterium tuberculosis H37Rv
cgcccaauuucgucucg

SEQ ID NO: 3300355 - RNA, 14 nt, Mycobacterium tuberculosis H37Rv
cgcccacaggggca

SEQ ID NO: 3300356 - RNA, 21 nt, Mycobacterium tuberculosis H37Rv
cgcccacaggggcagcgcggc

SEQ ID NO: 3300357 - RNA, 16 nt, Mycobacterium tuberculosis H37Rv
cgcccacaugcucagg

SEQ ID NO: 3300358 - RNA, 14 nt, Mycobacterium tuberculosis H37Rv
cgcccaccacacag

SEQ ID NO: 3300359 - RNA, 21 nt, Mycobacterium tuberculosis H37Rv
cgcccaccacacagccgcgcu

SEQ ID NO: 3300360 - RNA, 23 nt, Mycobacterium tuberculosis H37Rv
cgcccaccacacagccgcgcugc

SEQ ID NO: 3300361 - RNA, 22 nt, Mycobacterium tuberculosis H37Rv
cgcccaccaccacugcggccgc

SEQ ID NO: 3300362 - RNA, 14 nt, Mycobacterium tuberculosis H37Rv
cgcccaccacgcga

SEQ ID NO: 3300363 - RNA, 22 nt, Mycobacterium tuberculosis H37Rv
cgcccaccacgcgacgcggggc

SEQ ID NO: 3300364 - RNA, 23 nt, Mycobacterium tuberculosis H37Rv
cgcccaccacugugacacccgag

SEQ ID NO: 3300365 - RNA, 13 nt, Mycobacterium tuberculosis H37Rv
cgcccaccaugau

SEQ ID NO: 3300366 - RNA, 22 nt, Mycobacterium tuberculosis H37Rv
cgcccaccaugaucacaccgag

SEQ ID NO: 3300367 - RNA, 13 nt, Mycobacterium tuberculosis H37Rv
cgcccaccccggc

SEQ ID NO: 3300368 - RNA, 15 nt, Mycobacterium tuberculosis H37Rv
cgcccacccgcugcg

SEQ ID NO: 3300369 - RNA, 24 nt, Mycobacterium tuberculosis H37Rv
cgcccacccgcugcgagaucgcgg

SEQ ID NO: 3300370 - RNA, 13 nt, Mycobacterium tuberculosis H37Rv
cgcccaccgggcg

SEQ ID NO: 3300371 - RNA, 23 nt, Mycobacterium tuberculosis H37Rv
cgcccaccguugcgaagaagaag

SEQ ID NO: 3300372 - RNA, 13 nt, Mycobacterium tuberculosis H37Rv
cgcccaccucgau

SEQ ID NO: 3300373 - RNA, 19 nt, Mycobacterium tuberculosis H37Rv
cgcccacggcaccaccaag

SEQ ID NO: 3300374 - RNA, 16 nt, Mycobacterium tuberculosis H37Rv
cgcccacuauggcccg

SEQ ID NO: 3300375 - RNA, 22 nt, Mycobacterium tuberculosis H37Rv
cgcccacuauggcccgcacuug

SEQ ID NO: 3300376 - RNA, 17 nt, Mycobacterium tuberculosis H37Rv
cgcccacuccagcagcu

SEQ ID NO: 3300377 - RNA, 15 nt, Mycobacterium tuberculosis H37Rv
cgcccacuggugauc

SEQ ID NO: 3300378 - RNA, 16 nt, Mycobacterium tuberculosis H37Rv
cgcccacuggugaucu

SEQ ID NO: 3300379 - RNA, 14 nt, Mycobacterium tuberculosis H37Rv
cgcccagagccgcu

SEQ ID NO: 3300380 - RNA, 21 nt, Mycobacterium tuberculosis H37Rv
cgcccagagugaauccggcau

SEQ ID NO: 3300381 - RNA, 14 nt, Mycobacterium tuberculosis H37Rv
cgcccagaucgccg

SEQ ID NO: 3300382 - RNA, 16 nt, Mycobacterium tuberculosis H37Rv
cgcccagaucgccgag

SEQ ID NO: 3300383 - RNA, 18 nt, Mycobacterium tuberculosis H37Rv
cgcccagaucgccgagau

SEQ ID NO: 3300384 - RNA, 22 nt, Mycobacterium tuberculosis H37Rv
cgcccagauguuuagcguccga

SEQ ID NO: 3300385 - RNA, 18 nt, Mycobacterium tuberculosis H37Rv
cgcccagcacccuguucc

SEQ ID NO: 3300386 - RNA, 15 nt, Mycobacterium tuberculosis H37Rv
cgcccagcagcaccu

SEQ ID NO: 3300387 - RNA, 18 nt, Mycobacterium tuberculosis H37Rv
cgcccagcagcaccugca

SEQ ID NO: 3300388 - RNA, 21 nt, Mycobacterium tuberculosis H37Rv
cgcccagcagcaccugcaccg

SEQ ID NO: 3300389 - RNA, 19 nt, Mycobacterium tuberculosis H37Rv
cgcccagcaucucggcggc

SEQ ID NO: 3300390 - RNA, 21 nt, Mycobacterium tuberculosis H37Rv
cgcccagccacugacggcuuc

SEQ ID NO: 3300391 - RNA, 23 nt, Mycobacterium tuberculosis H37Rv
cgcccagccacugacggcuucca

SEQ ID NO: 3300392 - RNA, 15 nt, Mycobacterium tuberculosis H37Rv
cgcccagccgagcgu

SEQ ID NO: 3300393 - RNA, 17 nt, Mycobacterium tuberculosis H37Rv
cgcccagccgcagcacc

SEQ ID NO: 3300394 - RNA, 18 nt, Mycobacterium tuberculosis H37Rv
cgcccagcgacaacacca

SEQ ID NO: 3300395 - RNA, 16 nt, Mycobacterium tuberculosis H37Rv
cgcccagcgacccggc

SEQ ID NO: 3300396 - RNA, 18 nt, Mycobacterium tuberculosis H37Rv
cgcccagcgacccggcca

SEQ ID NO: 3300397 - RNA, 22 nt, Mycobacterium tuberculosis H37Rv
cgcccagcgcuagccgggcgcg

SEQ ID NO: 3300398 - RNA, 12 nt, Mycobacterium tuberculosis H37Rv
cgcccagcgucu

SEQ ID NO: 3300399 - RNA, 23 nt, Mycobacterium tuberculosis H37Rv
cgcccagcguugucggguggcug

SEQ ID NO: 3300400 - RNA, 13 nt, Mycobacterium tuberculosis H37Rv
cgcccagcucgau

SEQ ID NO: 3300401 - RNA, 17 nt, Mycobacterium tuberculosis H37Rv
cgcccaggccgaucagc

SEQ ID NO: 3300402 - RNA, 16 nt, Mycobacterium tuberculosis H37Rv
cgcccaggcgcgacgu

SEQ ID NO: 3300403 - RNA, 15 nt, Mycobacterium tuberculosis H37Rv
cgcccaggcguccau

SEQ ID NO: 3300404 - RNA, 14 nt, Mycobacterium tuberculosis H37Rv
cgcccagucgccgc

SEQ ID NO: 3300405 - RNA, 19 nt, Mycobacterium tuberculosis H37Rv
cgcccagugcgcaacccag

SEQ ID NO: 3300406 - RNA, 18 nt, Mycobacterium tuberculosis H37Rv
cgcccagugcggccaccu

SEQ ID NO: 3300407 - RNA, 20 nt, Mycobacterium tuberculosis H37Rv
cgcccauagcugccggccca

SEQ ID NO: 3300408 - RNA, 18 nt, Mycobacterium tuberculosis H37Rv
cgcccaucgcgacggccc

SEQ ID NO: 3300409 - RNA, 17 nt, Mycobacterium tuberculosis H37Rv
cgcccauggccaccagg

SEQ ID NO: 3300410 - RNA, 18 nt, Mycobacterium tuberculosis H37Rv
cgcccauggccaccaggg

SEQ ID NO: 3300411 - RNA, 21 nt, Mycobacterium tuberculosis H37Rv
cgcccauucccagaggcccgc

SEQ ID NO: 3300412 - RNA, 13 nt, Mycobacterium tuberculosis H37Rv
cgcccgcgccucc

SEQ ID NO: 3300413 - RNA, 17 nt, Mycobacterium tuberculosis H37Rv
cgcccgcgccuccguug

SEQ ID NO: 3300414 - RNA, 22 nt, Mycobacterium tuberculosis H37Rv
cgcccgcgccuccguugccccc

SEQ ID NO: 3300415 - RNA, 14 nt, Mycobacterium tuberculosis H37Rv
cgcccgcgcggcca

SEQ ID NO: 3300416 - RNA, 16 nt, Mycobacterium tuberculosis H37Rv
cgcccgcgcggccacu

SEQ ID NO: 3300417 - RNA, 22 nt, Mycobacterium tuberculosis H37Rv
cgcccgcgggcaguggcagccc

SEQ ID NO: 3300418 - RNA, 17 nt, Mycobacterium tuberculosis H37Rv
cgcccgcgguccggcga

SEQ ID NO: 3300419 - RNA, 14 nt, Mycobacterium tuberculosis H37Rv
cgcccgcgugacgc

SEQ ID NO: 3300420 - RNA, 15 nt, Mycobacterium tuberculosis H37Rv
cgcccgcgugacgcu

SEQ ID NO: 3300421 - RNA, 17 nt, Mycobacterium tuberculosis H37Rv
cgcccgcuacggcagcc

SEQ ID NO: 3300422 - RNA, 18 nt, Mycobacterium tuberculosis H37Rv
cgcccgcuccuccggcac

SEQ ID NO: 3300423 - RNA, 22 nt, Mycobacterium tuberculosis H37Rv
cgcccgcucggagaucgccacu

SEQ ID NO: 3300424 - RNA, 14 nt, Mycobacterium tuberculosis H37Rv
cgcccgcucggccg

SEQ ID NO: 3300425 - RNA, 18 nt, Mycobacterium tuberculosis H37Rv
cgcccgcucggccgcagc

SEQ ID NO: 3300426 - RNA, 16 nt, Mycobacterium tuberculosis H37Rv
cgcccgcugagccagc

SEQ ID NO: 3300427 - RNA, 19 nt, Mycobacterium tuberculosis H37Rv
cgcccgcugagccagcucc

SEQ ID NO: 3300428 - RNA, 15 nt, Mycobacterium tuberculosis H37Rv
cgcccgcugcggcgg

SEQ ID NO: 3300429 - RNA, 17 nt, Mycobacterium tuberculosis H37Rv
cgcccgcugcggcggcu

SEQ ID NO: 3300430 - RNA, 20 nt, Mycobacterium tuberculosis H37Rv
cgcccggaaaggccgcggug

SEQ ID NO: 3300431 - RNA, 21 nt, Mycobacterium tuberculosis H37Rv
cgcccggaaaggccgcgguga

SEQ ID NO: 3300432 - RNA, 15 nt, Mycobacterium tuberculosis H37Rv
cgcccggaaccggcg

SEQ ID NO: 3300433 - RNA, 19 nt, Mycobacterium tuberculosis H37Rv
cgcccggaaccggcgugca

SEQ ID NO: 3300434 - RNA, 21 nt, Mycobacterium tuberculosis H37Rv
cgcccggaaccggcgugcagc

SEQ ID NO: 3300435 - RNA, 21 nt, Mycobacterium tuberculosis H37Rv
cgcccggacgcaacacccggg

SEQ ID NO: 3300436 - RNA, 14 nt, Mycobacterium tuberculosis H37Rv
cgcccggcaccccu

SEQ ID NO: 3300437 - RNA, 15 nt, Mycobacterium tuberculosis H37Rv
cgcccggcaguucgc

SEQ ID NO: 3300438 - RNA, 20 nt, Mycobacterium tuberculosis H37Rv
cgcccggccaagccggcgag

SEQ ID NO: 3300439 - RNA, 15 nt, Mycobacterium tuberculosis H37Rv
cgcccggccagcucg

SEQ ID NO: 3300440 - RNA, 18 nt, Mycobacterium tuberculosis H37Rv
cgcccggccaggucgaca

SEQ ID NO: 3300441 - RNA, 19 nt, Mycobacterium tuberculosis H37Rv
cgcccggccaggucgacac

SEQ ID NO: 3300442 - RNA, 15 nt, Mycobacterium tuberculosis H37Rv
cgcccggcccgccac

SEQ ID NO: 3300443 - RNA, 19 nt, Mycobacterium tuberculosis H37Rv
cgcccggcccgccaccccg

SEQ ID NO: 3300444 - RNA, 20 nt, Mycobacterium tuberculosis H37Rv
cgcccggcccggcucggugc

SEQ ID NO: 3300445 - RNA, 14 nt, Mycobacterium tuberculosis H37Rv
cgcccggccgcagc

SEQ ID NO: 3300446 - RNA, 20 nt, Mycobacterium tuberculosis H37Rv
cgcccggcgcaagcgccgcg

SEQ ID NO: 3300447 - RNA, 22 nt, Mycobacterium tuberculosis H37Rv
cgcccggcgcaagcgccgcgcu

SEQ ID NO: 3300448 - RNA, 17 nt, Mycobacterium tuberculosis H37Rv
cgcccggcgcaccaucg

SEQ ID NO: 3300449 - RNA, 19 nt, Mycobacterium tuberculosis H37Rv
cgcccggcgcaccaucgcg

SEQ ID NO: 3300450 - RNA, 14 nt, Mycobacterium tuberculosis H37Rv
cgcccggcgcuagc

SEQ ID NO: 3300451 - RNA, 22 nt, Mycobacterium tuberculosis H37Rv
cgcccggcugcgccgggcucgc

SEQ ID NO: 3300452 - RNA, 22 nt, Mycobacterium tuberculosis H37Rv
cgcccgggauaguuuucggccg

SEQ ID NO: 3300453 - RNA, 20 nt, Mycobacterium tuberculosis H37Rv
cgcccgggaucgggucaccg

SEQ ID NO: 3300454 - RNA, 18 nt, Mycobacterium tuberculosis H37Rv
cgcccgggcaccggccgg

SEQ ID NO: 3300455 - RNA, 21 nt, Mycobacterium tuberculosis H37Rv
cgcccgggcgaauccggcggg

SEQ ID NO: 3300456 - RNA, 22 nt, Mycobacterium tuberculosis H37Rv
cgcccgggcggaacgccggcac

SEQ ID NO: 3300457 - RNA, 13 nt, Mycobacterium tuberculosis H37Rv
cgcccgggcggcg

SEQ ID NO: 3300458 - RNA, 21 nt, Mycobacterium tuberculosis H37Rv
cgcccgggcggcgucggugag

SEQ ID NO: 3300459 - RNA, 13 nt, Mycobacterium tuberculosis H37Rv
cgcccgggcggga

SEQ ID NO: 3300460 - RNA, 17 nt, Mycobacterium tuberculosis H37Rv
cgcccggggcgcacagc

SEQ ID NO: 3300461 - RNA, 22 nt, Mycobacterium tuberculosis H37Rv
cgcccgggguguucgucgacca

SEQ ID NO: 3300462 - RNA, 18 nt, Mycobacterium tuberculosis H37Rv
cgcccgggucccggcagc

SEQ ID NO: 3300463 - RNA, 14 nt, Mycobacterium tuberculosis H37Rv
cgcccggucgagcc

SEQ ID NO: 3300464 - RNA, 21 nt, Mycobacterium tuberculosis H37Rv
cgcccggucgagccagcggag

SEQ ID NO: 3300465 - RNA, 15 nt, Mycobacterium tuberculosis H37Rv
cgcccggucucgacg

SEQ ID NO: 3300466 - RNA, 19 nt, Mycobacterium tuberculosis H37Rv
cgcccggugcuaaccgacg

SEQ ID NO: 3300467 - RNA, 14 nt, Mycobacterium tuberculosis H37Rv
cgcccgguugaccg

SEQ ID NO: 3300468 - RNA, 15 nt, Mycobacterium tuberculosis H37Rv
cgcccgguugaccgc

SEQ ID NO: 3300469 - RNA, 16 nt, Mycobacterium tuberculosis H37Rv
cgcccguacacgauca

SEQ ID NO: 3300470 - RNA, 20 nt, Mycobacterium tuberculosis H37Rv
cgcccguagaacaguucgac

SEQ ID NO: 3300471 - RNA, 22 nt, Mycobacterium tuberculosis H37Rv
cgcccguagaacaguucgacau

SEQ ID NO: 3300472 - RNA, 17 nt, Mycobacterium tuberculosis H37Rv
cgcccguaucggcuucg

SEQ ID NO: 3300473 - RNA, 14 nt, Mycobacterium tuberculosis H37Rv
cgcccgucgcgaau

SEQ ID NO: 3300474 - RNA, 15 nt, Mycobacterium tuberculosis H37Rv
cgcccgucuccagca

SEQ ID NO: 3300475 - RNA, 16 nt, Mycobacterium tuberculosis H37Rv
cgcccgucuuccagcc

SEQ ID NO: 3300476 - RNA, 15 nt, Mycobacterium tuberculosis H37Rv
cgcccgugaucacca

SEQ ID NO: 3300477 - RNA, 13 nt, Mycobacterium tuberculosis H37Rv
cgcccgugccgcc

SEQ ID NO: 3300478 - RNA, 16 nt, Mycobacterium tuberculosis H37Rv
cgcccgugccgcccgc

SEQ ID NO: 3300479 - RNA, 18 nt, Mycobacterium tuberculosis H37Rv
cgcccgugccgcccgcgc

SEQ ID NO: 3300480 - RNA, 22 nt, Mycobacterium tuberculosis H37Rv
cgcccgugccgcccgcgccgcc

SEQ ID NO: 3300481 - RNA, 15 nt, Mycobacterium tuberculosis H37Rv
cgcccgugccgcccu

SEQ ID NO: 3300482 - RNA, 16 nt, Mycobacterium tuberculosis H37Rv
cgcccgugccgcccuc

SEQ ID NO: 3300483 - RNA, 17 nt, Mycobacterium tuberculosis H37Rv
cgcccguggcggugagc

SEQ ID NO: 3300484 - RNA, 21 nt, Mycobacterium tuberculosis H37Rv
cgcccguggcggugagccgcc

SEQ ID NO: 3300485 - RNA, 19 nt, Mycobacterium tuberculosis H37Rv
cgcccuagcuggugcgccc

SEQ ID NO: 3300486 - RNA, 21 nt, Mycobacterium tuberculosis H37Rv
cgcccuagcuggugcgcccga

SEQ ID NO: 3300487 - RNA, 21 nt, Mycobacterium tuberculosis H37Rv
cgcccuauacgcaacaggcca

SEQ ID NO: 3300488 - RNA, 23 nt, Mycobacterium tuberculosis H37Rv
cgcccucaccgccugugccgccg

SEQ ID NO: 3300489 - RNA, 14 nt, Mycobacterium tuberculosis H37Rv
cgcccucagccgcg

SEQ ID NO: 3300490 - RNA, 16 nt, Mycobacterium tuberculosis H37Rv
cgcccucagccgcggc

SEQ ID NO: 3300491 - RNA, 18 nt, Mycobacterium tuberculosis H37Rv
cgcccucagccgcggcca

SEQ ID NO: 3300492 - RNA, 23 nt, Mycobacterium tuberculosis H37Rv
cgcccucaguucacgcucgacga

SEQ ID NO: 3300493 - RNA, 21 nt, Mycobacterium tuberculosis H37Rv
cgcccucaguucacguucggc

SEQ ID NO: 3300494 - RNA, 14 nt, Mycobacterium tuberculosis H37Rv
cgcccucccgggcc

SEQ ID NO: 3300495 - RNA, 14 nt, Mycobacterium tuberculosis H37Rv
cgcccucccugggg

SEQ ID NO: 3300496 - RNA, 20 nt, Mycobacterium tuberculosis H37Rv
cgcccucgacgccgcgcagc

SEQ ID NO: 3300497 - RNA, 20 nt, Mycobacterium tuberculosis H37Rv
cgcccucgacgcgcucgggc

SEQ ID NO: 3300498 - RNA, 13 nt, Mycobacterium tuberculosis H37Rv
cgcccucggcgac

SEQ ID NO: 3300499 - RNA, 16 nt, Mycobacterium tuberculosis H37Rv
cgcccucgucgaucgc

SEQ ID NO: 3300500 - RNA, 17 nt, Mycobacterium tuberculosis H37Rv
cgcccucgucgaucgcc

SEQ ID NO: 3300501 - RNA, 16 nt, Mycobacterium tuberculosis H37Rv
cgcccucgucgcgggc

SEQ ID NO: 3300502 - RNA, 18 nt, Mycobacterium tuberculosis H37Rv
cgcccucucacggcggua

SEQ ID NO: 3300503 - RNA, 21 nt, Mycobacterium tuberculosis H37Rv
cgcccugaagggccgccucgc

SEQ ID NO: 3300504 - RNA, 13 nt, Mycobacterium tuberculosis H37Rv
cgcccugacaccc

SEQ ID NO: 3300505 - RNA, 23 nt, Mycobacterium tuberculosis H37Rv
cgcccugacacccaucgaccgcc

SEQ ID NO: 3300506 - RNA, 23 nt, Mycobacterium tuberculosis H37Rv
cgcccugacccggagccgccagg

SEQ ID NO: 3300507 - RNA, 18 nt, Mycobacterium tuberculosis H37Rv
cgcccugaccgcccgcac

SEQ ID NO: 3300508 - RNA, 13 nt, Mycobacterium tuberculosis H37Rv
cgccgaccgcgcc

SEQ ID NO: 3300509 - RNA, 19 nt, Mycobacterium tuberculosis H37Rv
cgccgaccggagccgccgg

SEQ ID NO: 3300510 - RNA, 17 nt, Mycobacterium tuberculosis H37Rv
cgccgaccucaucggca

SEQ ID NO: 3300511 - RNA, 15 nt, Mycobacterium tuberculosis H37Rv
cgccgaccuccuccu

SEQ ID NO: 3300512 - RNA, 23 nt, Mycobacterium tuberculosis H37Rv
cgccgaccuccuccuugaaccgg

SEQ ID NO: 3300513 - RNA, 14 nt, Mycobacterium tuberculosis H37Rv
cgccgaccuggaca

SEQ ID NO: 3300514 - RNA, 24 nt, Mycobacterium tuberculosis H37Rv
cgccgacgaacaguugcggcuggc

SEQ ID NO: 3300515 - RNA, 20 nt, Mycobacterium tuberculosis H37Rv
cgccgacgaccgccugcaac

SEQ ID NO: 3300516 - RNA, 20 nt, Mycobacterium tuberculosis H37Rv
cgccgacgacuccggcaagc

SEQ ID NO: 3300517 - RNA, 16 nt, Mycobacterium tuberculosis H37Rv
cgccgacgaugacgcg

SEQ ID NO: 3300518 - RNA, 20 nt, Mycobacterium tuberculosis H37Rv
cgccgacgauuaccagcggc

SEQ ID NO: 3300519 - RNA, 17 nt, Mycobacterium tuberculosis H37Rv
cgccgacgccagaacgu

SEQ ID NO: 3300520 - RNA, 21 nt, Mycobacterium tuberculosis H37Rv
cgccgacgccagauccuucaa

SEQ ID NO: 3300521 - RNA, 12 nt, Mycobacterium tuberculosis H37Rv
cgccgacgccgc

SEQ ID NO: 3300522 - RNA, 15 nt, Mycobacterium tuberculosis H37Rv
cgccgacgccgccgg

SEQ ID NO: 3300523 - RNA, 18 nt, Mycobacterium tuberculosis H37Rv
cgccgacgccgccggcac

SEQ ID NO: 3300524 - RNA, 18 nt, Mycobacterium tuberculosis H37Rv
cgccgacgccgccggccc

SEQ ID NO: 3300525 - RNA, 19 nt, Mycobacterium tuberculosis H37Rv
cgccgacgccgcggaguag

SEQ ID NO: 3300526 - RNA, 13 nt, Mycobacterium tuberculosis H37Rv
cgccgacgccguu

SEQ ID NO: 3300527 - RNA, 17 nt, Mycobacterium tuberculosis H37Rv
cgccgacgccguugccc

SEQ ID NO: 3300528 - RNA, 14 nt, Mycobacterium tuberculosis H37Rv
cgccgacggcaagg

SEQ ID NO: 3300529 - RNA, 17 nt, Mycobacterium tuberculosis H37Rv
cgccgacggccagcagg

SEQ ID NO: 3300530 - RNA, 18 nt, Mycobacterium tuberculosis H37Rv
cgccgacggccagcagga

SEQ ID NO: 3300531 - RNA, 20 nt, Mycobacterium tuberculosis H37Rv
cgccgacggccagcaggaug

SEQ ID NO: 3300532 - RNA, 21 nt, Mycobacterium tuberculosis H37Rv
cgccgacguauagaccaggua

SEQ ID NO: 3300533 - RNA, 20 nt, Mycobacterium tuberculosis H37Rv
cgccgacgucgacgccggcc

SEQ ID NO: 3300534 - RNA, 16 nt, Mycobacterium tuberculosis H37Rv
cgccgacuaguccgag

SEQ ID NO: 3300535 - RNA, 14 nt, Mycobacterium tuberculosis H37Rv
cgccgacuccccgc

SEQ ID NO: 3300536 - RNA, 19 nt, Mycobacterium tuberculosis H37Rv
cgccgacuccccgccgggc

SEQ ID NO: 3300537 - RNA, 22 nt, Mycobacterium tuberculosis H37Rv
cgccgacucggcaccgcggccg

SEQ ID NO: 3300538 - RNA, 19 nt, Mycobacterium tuberculosis H37Rv
cgccgacuuccgcgucgcc

SEQ ID NO: 3300539 - RNA, 21 nt, Mycobacterium tuberculosis H37Rv
cgccgacuuccgcgucgccgg

SEQ ID NO: 3300540 - RNA, 22 nt, Mycobacterium tuberculosis H37Rv
cgccgacuuccgcgucgccggc

SEQ ID NO: 3300541 - RNA, 16 nt, Mycobacterium tuberculosis H37Rv
cgccgagaaccagcga

SEQ ID NO: 3300542 - RNA, 16 nt, Mycobacterium tuberculosis H37Rv
cgccgagaacgauguc

SEQ ID NO: 3300543 - RNA, 23 nt, Mycobacterium tuberculosis H37Rv
cgccgagaacgauguccgcgcga

SEQ ID NO: 3300544 - RNA, 20 nt, Mycobacterium tuberculosis H37Rv
cgccgagaagacgcaaaagc

SEQ ID NO: 3300545 - RNA, 13 nt, Mycobacterium tuberculosis H37Rv
cgccgagaccgcc

SEQ ID NO: 3300546 - RNA, 15 nt, Mycobacterium tuberculosis H37Rv
cgccgagaccgccgc

SEQ ID NO: 3300547 - RNA, 16 nt, Mycobacterium tuberculosis H37Rv
cgccgagaccgccgcu

SEQ ID NO: 3300548 - RNA, 14 nt, Mycobacterium tuberculosis H37Rv
cgccgagagcaccg

SEQ ID NO: 3300549 - RNA, 16 nt, Mycobacterium tuberculosis H37Rv
cgccgagagcaccgcu

SEQ ID NO: 3300550 - RNA, 17 nt, Mycobacterium tuberculosis H37Rv
cgccgagauccacgcca

SEQ ID NO: 3300551 - RNA, 14 nt, Mycobacterium tuberculosis H37Rv
cgccgagauccgcg

SEQ ID NO: 3300552 - RNA, 20 nt, Mycobacterium tuberculosis H37Rv
cgccgagaugcugcacccgg

SEQ ID NO: 3300553 - RNA, 17 nt, Mycobacterium tuberculosis H37Rv
cgccgagcacacgucgg

SEQ ID NO: 3300554 - RNA, 19 nt, Mycobacterium tuberculosis H37Rv
cgccgagcacacgucggga

SEQ ID NO: 3300555 - RNA, 21 nt, Mycobacterium tuberculosis H37Rv
cgccgagcacacgucgggagu

SEQ ID NO: 3300556 - RNA, 20 nt, Mycobacterium tuberculosis H37Rv
cgccgagcagacgcaacggc

SEQ ID NO: 3300557 - RNA, 16 nt, Mycobacterium tuberculosis H37Rv
cgccgagcagacgcag

SEQ ID NO: 3300558 - RNA, 16 nt, Mycobacterium tuberculosis H37Rv
cgccgagcagacgcgg

SEQ ID NO: 3300559 - RNA, 16 nt, Mycobacterium tuberculosis H37Rv
cgccgagccagcaccc

SEQ ID NO: 3300560 - RNA, 13 nt, Mycobacterium tuberculosis H37Rv
cgccgagcccgcc

SEQ ID NO: 3300561 - RNA, 15 nt, Mycobacterium tuberculosis H37Rv
cgccgagcccgccgg

SEQ ID NO: 3300562 - RNA, 16 nt, Mycobacterium tuberculosis H37Rv
cgccgagcccgccggg

SEQ ID NO: 3300563 - RNA, 18 nt, Mycobacterium tuberculosis H37Rv
cgccgagcggaucgucgu

SEQ ID NO: 3300564 - RNA, 18 nt, Mycobacterium tuberculosis H37Rv
cgccgagcuagaucacgg

SEQ ID NO: 3300565 - RNA, 16 nt, Mycobacterium tuberculosis H37Rv
cgccgagcucggucac

SEQ ID NO: 3300566 - RNA, 15 nt, Mycobacterium tuberculosis H37Rv
cgccgagcuggcaac

SEQ ID NO: 3300567 - RNA, 22 nt, Mycobacterium tuberculosis H37Rv
cgccgagcuggcaacgccgcgc

SEQ ID NO: 3300568 - RNA, 22 nt, Mycobacterium tuberculosis H37Rv
cgccgagcugguugacggcgaa

SEQ ID NO: 3300569 - RNA, 21 nt, Mycobacterium tuberculosis H37Rv
cgccgaggacacauugaccag

SEQ ID NO: 3300570 - RNA, 16 nt, Mycobacterium tuberculosis H37Rv
cgccgaggacgccggc

SEQ ID NO: 3300571 - RNA, 18 nt, Mycobacterium tuberculosis H37Rv
cgccgaggacgccggcgc

SEQ ID NO: 3300572 - RNA, 20 nt, Mycobacterium tuberculosis H37Rv
cgccgaggcagcgucgucga

SEQ ID NO: 3300573 - RNA, 22 nt, Mycobacterium tuberculosis H37Rv
cgccgaggcagcgucgucgacg

SEQ ID NO: 3300574 - RNA, 13 nt, Mycobacterium tuberculosis H37Rv
cgccgaggccgcc

SEQ ID NO: 3300575 - RNA, 15 nt, Mycobacterium tuberculosis H37Rv
cgccgaggccgccgu

SEQ ID NO: 3300576 - RNA, 19 nt, Mycobacterium tuberculosis H37Rv
cgccgaggccuaccaggcg

SEQ ID NO: 3300577 - RNA, 18 nt, Mycobacterium tuberculosis H37Rv
cgccgaggccucggccag

SEQ ID NO: 3300578 - RNA, 17 nt, Mycobacterium tuberculosis H37Rv
cgccgagguagauggcg

SEQ ID NO: 3300579 - RNA, 20 nt, Mycobacterium tuberculosis H37Rv
cgccgaggucgaaccgccgg

SEQ ID NO: 3300580 - RNA, 12 nt, Mycobacterium tuberculosis H37Rv
cgccgaggucgg

SEQ ID NO: 3300581 - RNA, 18 nt, Mycobacterium tuberculosis H37Rv
cgccgaggucgguucggc

SEQ ID NO: 3300582 - RNA, 17 nt, Mycobacterium tuberculosis H37Rv
cgccgaguaccggccag

SEQ ID NO: 3300583 - RNA, 20 nt, Mycobacterium tuberculosis H37Rv
cgccgaguauuggucggugg

SEQ ID NO: 3300584 - RNA, 17 nt, Mycobacterium tuberculosis H37Rv
cgccgaguccggcgagc

SEQ ID NO: 3300585 - RNA, 16 nt, Mycobacterium tuberculosis H37Rv
cgccgaguugaccgcc

SEQ ID NO: 3300586 - RNA, 17 nt, Mycobacterium tuberculosis H37Rv
cgccgauacccagcggg

SEQ ID NO: 3300587 - RNA, 23 nt, Mycobacterium tuberculosis H37Rv
cgccgauacccagcgggucgcgg

SEQ ID NO: 3300588 - RNA, 18 nt, Mycobacterium tuberculosis H37Rv
cgccgauaccgccggccc

SEQ ID NO: 3300589 - RNA, 14 nt, Mycobacterium tuberculosis H37Rv
cgccgauaccggcg

SEQ ID NO: 3300590 - RNA, 19 nt, Mycobacterium tuberculosis H37Rv
cgccgauacuucaucggca

SEQ ID NO: 3300591 - RNA, 21 nt, Mycobacterium tuberculosis H37Rv
cgccgauacuucaucggcaca

SEQ ID NO: 3300592 - RNA, 16 nt, Mycobacterium tuberculosis H37Rv
cgccgauaucgcagau

SEQ ID NO: 3300593 - RNA, 16 nt, Mycobacterium tuberculosis H37Rv
cgccgauaucggugac

SEQ ID NO: 3300594 - RNA, 20 nt, Mycobacterium tuberculosis H37Rv
cgccgaucaccaccggcaga

SEQ ID NO: 3300595 - RNA, 15 nt, Mycobacterium tuberculosis H37Rv
cgccgaucaccgcug

SEQ ID NO: 3300596 - RNA, 16 nt, Mycobacterium tuberculosis H37Rv
cgccgaucaccgcugu

SEQ ID NO: 3300597 - RNA, 19 nt, Mycobacterium tuberculosis H37Rv
cgccgaucacugucgggua

SEQ ID NO: 3300598 - RNA, 23 nt, Mycobacterium tuberculosis H37Rv
cgccgaucagcgaaccaccggcg

SEQ ID NO: 3300599 - RNA, 13 nt, Mycobacterium tuberculosis H37Rv
cgccgaucccggc

SEQ ID NO: 3300600 - RNA, 16 nt, Mycobacterium tuberculosis H37Rv
cgccgaucccggcggu

SEQ ID NO: 3300601 - RNA, 18 nt, Mycobacterium tuberculosis H37Rv
cgccgaucgaaccgcugc

SEQ ID NO: 3300602 - RNA, 20 nt, Mycobacterium tuberculosis H37Rv
cgccgaucgaaccgcugcuc

SEQ ID NO: 3300603 - RNA, 18 nt, Mycobacterium tuberculosis H37Rv
cgccgaucgcggcggccu

SEQ ID NO: 3300604 - RNA, 17 nt, Mycobacterium tuberculosis H37Rv
cgccgcccgcgccacca

SEQ ID NO: 3300605 - RNA, 20 nt, Mycobacterium tuberculosis H37Rv
cgccgcccgcgccgccgcca

SEQ ID NO: 3300606 - RNA, 15 nt, Mycobacterium tuberculosis H37Rv
cgccgcccgcugggc

SEQ ID NO: 3300607 - RNA, 18 nt, Mycobacterium tuberculosis H37Rv
cgccgcccgugccgcccu

SEQ ID NO: 3300608 - RNA, 19 nt, Mycobacterium tuberculosis H37Rv
cgccgcccgugccgcccuc

SEQ ID NO: 3300609 - RNA, 17 nt, Mycobacterium tuberculosis H37Rv
cgccgcccuaaggggca

SEQ ID NO: 3300610 - RNA, 16 nt, Mycobacterium tuberculosis H37Rv
cgccgcccuccgacgg

SEQ ID NO: 3300611 - RNA, 17 nt, Mycobacterium tuberculosis H37Rv
cgccgcccuccgacggg

SEQ ID NO: 3300612 - RNA, 15 nt, Mycobacterium tuberculosis H37Rv
cgccgcccuguccgg

SEQ ID NO: 3300613 - RNA, 17 nt, Mycobacterium tuberculosis H37Rv
cgccgcccuugccgccg

SEQ ID NO: 3300614 - RNA, 18 nt, Mycobacterium tuberculosis H37Rv
cgccgcccuugccgccgg

SEQ ID NO: 3300615 - RNA, 19 nt, Mycobacterium tuberculosis H37Rv
cgccgcccuugccgccggc

SEQ ID NO: 3300616 - RNA, 22 nt, Mycobacterium tuberculosis H37Rv
cgccgcccuugccgccggcccc

SEQ ID NO: 3300617 - RNA, 20 nt, Mycobacterium tuberculosis H37Rv
cgccgccgacgaaggcgacg

SEQ ID NO: 3300618 - RNA, 15 nt, Mycobacterium tuberculosis H37Rv
cgccgccgacgccgc

SEQ ID NO: 3300619 - RNA, 18 nt, Mycobacterium tuberculosis H37Rv
cgccgccgacgccgccgg

SEQ ID NO: 3300620 - RNA, 21 nt, Mycobacterium tuberculosis H37Rv
cgccgccgacgccgccggcgc

SEQ ID NO: 3300621 - RNA, 14 nt, Mycobacterium tuberculosis H37Rv
cgccgccgacggau

SEQ ID NO: 3300622 - RNA, 15 nt, Mycobacterium tuberculosis H37Rv
cgccgccgacgugag

SEQ ID NO: 3300623 - RNA, 14 nt, Mycobacterium tuberculosis H37Rv
cgccgccgaucccg

SEQ ID NO: 3300624 - RNA, 13 nt, Mycobacterium tuberculosis H37Rv
cgccgccgccaau

SEQ ID NO: 3300625 - RNA, 14 nt, Mycobacterium tuberculosis H37Rv
cgccgccgccaccg

SEQ ID NO: 3300626 - RNA, 14 nt, Mycobacterium tuberculosis H37Rv
cgccgccgcccgua

SEQ ID NO: 3300627 - RNA, 15 nt, Mycobacterium tuberculosis H37Rv
cgccgccgccgccgg

SEQ ID NO: 3300628 - RNA, 18 nt, Mycobacterium tuberculosis H37Rv
cgccgccgccgccggcgc

SEQ ID NO: 3300629 - RNA, 12 nt, Mycobacterium tuberculosis H37Rv
cgccgccgcgac

SEQ ID NO: 3300630 - RNA, 22 nt, Mycobacterium tuberculosis H37Rv
cgccgccgcgagcgccggccgc

SEQ ID NO: 3300631 - RNA, 13 nt, Mycobacterium tuberculosis H37Rv
cgccgccgcgggc

SEQ ID NO: 3300632 - RNA, 12 nt, Mycobacterium tuberculosis H37Rv
cgccgccgcguu

SEQ ID NO: 3300633 - RNA, 13 nt, Mycobacterium tuberculosis H37Rv
cgccgccgcguuc

SEQ ID NO: 3300634 - RNA, 18 nt, Mycobacterium tuberculosis H37Rv
cgccgccgcuaccgccgg

SEQ ID NO: 3300635 - RNA, 16 nt, Mycobacterium tuberculosis H37Rv
cgccgccgcugccgcc

SEQ ID NO: 3300636 - RNA, 20 nt, Mycobacterium tuberculosis H37Rv
cgccgccggaagcgccggcc

SEQ ID NO: 3300637 - RNA, 16 nt, Mycobacterium tuberculosis H37Rv
cgccgccggaucgccg

SEQ ID NO: 3300638 - RNA, 12 nt, Mycobacterium tuberculosis H37Rv
cgccgccggcaa

SEQ ID NO: 3300639 - RNA, 13 nt, Mycobacterium tuberculosis H37Rv
cgccgccggcaac

SEQ ID NO: 3300640 - RNA, 15 nt, Mycobacterium tuberculosis H37Rv
cgccgccggcaccac

SEQ ID NO: 3300641 - RNA, 14 nt, Mycobacterium tuberculosis H37Rv
cgccgccggcaccg

SEQ ID NO: 3300642 - RNA, 18 nt, Mycobacterium tuberculosis H37Rv
cgccgccggcaccgccgg

SEQ ID NO: 3300643 - RNA, 21 nt, Mycobacterium tuberculosis H37Rv
cgccgccggcaccgccggcac

SEQ ID NO: 3300644 - RNA, 14 nt, Mycobacterium tuberculosis H37Rv
cgccgccggcaccu

SEQ ID NO: 3300645 - RNA, 18 nt, Mycobacterium tuberculosis H37Rv
cgccgccggccccgccga

SEQ ID NO: 3300646 - RNA, 13 nt, Mycobacterium tuberculosis H37Rv
cgccgccggccgc

SEQ ID NO: 3300647 - RNA, 17 nt, Mycobacterium tuberculosis H37Rv
cgccgccggccgccagc

SEQ ID NO: 3300648 - RNA, 18 nt, Mycobacterium tuberculosis H37Rv
cgccgccggccgccagcg

SEQ ID NO: 3300649 - RNA, 16 nt, Mycobacterium tuberculosis H37Rv
cgccgccggcgccacc

SEQ ID NO: 3300650 - RNA, 14 nt, Mycobacterium tuberculosis H37Rv
cgccgccggcgccg

SEQ ID NO: 3300651 - RNA, 18 nt, Mycobacterium tuberculosis H37Rv
cgccgccggcgccgcccg

SEQ ID NO: 3300652 - RNA, 19 nt, Mycobacterium tuberculosis H37Rv
cgccgccggcgccgcccgc

SEQ ID NO: 3300653 - RNA, 13 nt, Mycobacterium tuberculosis H37Rv
cgccgccggcgcu

SEQ ID NO: 3300654 - RNA, 14 nt, Mycobacterium tuberculosis H37Rv
cgccgccggcgcug

SEQ ID NO: 3300655 - RNA, 15 nt, Mycobacterium tuberculosis H37Rv
cgccgccggcgcuga

SEQ ID NO: 3300656 - RNA, 18 nt, Mycobacterium tuberculosis H37Rv
cgccgccggcggcgguac

SEQ ID NO: 3300657 - RNA, 13 nt, Mycobacterium tuberculosis H37Rv
cgccgccgggcag

SEQ ID NO: 3300658 - RNA, 22 nt, Mycobacterium tuberculosis H37Rv
cgccgccgggucgaacgcaugc

SEQ ID NO: 3300659 - RNA, 16 nt, Mycobacterium tuberculosis H37Rv
cgccgccgguccccuc

SEQ ID NO: 3300660 - RNA, 16 nt, Mycobacterium tuberculosis H37Rv
cgccgccggugccacc

SEQ ID NO: 3300661 - RNA, 20 nt, Mycobacterium tuberculosis H37Rv
cgccgccggugccaccgacg

SEQ ID NO: 3300662 - RNA, 17 nt, Mycobacterium tuberculosis H37Rv
cgccgccggugccgccc

SEQ ID NO: 3300663 - RNA, 19 nt, Mycobacterium tuberculosis H37Rv
cgccgccggugccgcccga

SEQ ID NO: 3300664 - RNA, 21 nt, Mycobacterium tuberculosis H37Rv
cgccgccguccagcgccgcgg

SEQ ID NO: 3300665 - RNA, 16 nt, Mycobacterium tuberculosis H37Rv
cgccgccgucgccgua

SEQ ID NO: 3300666 - RNA, 16 nt, Mycobacterium tuberculosis H37Rv
cgccgccgucggguug

SEQ ID NO: 3300667 - RNA, 18 nt, Mycobacterium tuberculosis H37Rv
cgccgccguucccgccgg

SEQ ID NO: 3300668 - RNA, 23 nt, Mycobacterium tuberculosis H37Rv
cgccgccguucccgccggccccg

SEQ ID NO: 3300669 - RNA, 16 nt, Mycobacterium tuberculosis H37Rv
cgccgccguugccgau

SEQ ID NO: 3300670 - RNA, 17 nt, Mycobacterium tuberculosis H37Rv
cgccgccguugccgcca

SEQ ID NO: 3300671 - RNA, 18 nt, Mycobacterium tuberculosis H37Rv
cgccgccguugccgccau

SEQ ID NO: 3300672 - RNA, 19 nt, Mycobacterium tuberculosis H37Rv
cgccgccguugccgccguc

SEQ ID NO: 3300673 - RNA, 14 nt, Mycobacterium tuberculosis H37Rv
cgccgccuccgccg

SEQ ID NO: 3300674 - RNA, 16 nt, Mycobacterium tuberculosis H37Rv
cgccgccucgucgucg

SEQ ID NO: 3300675 - RNA, 18 nt, Mycobacterium tuberculosis H37Rv
cgccgccucgucgucgga

SEQ ID NO: 3300676 - RNA, 14 nt, Mycobacterium tuberculosis H37Rv
cgccgccugcccgg

SEQ ID NO: 3300677 - RNA, 18 nt, Mycobacterium tuberculosis H37Rv
cgccgccugcccggcccg

SEQ ID NO: 3300678 - RNA, 15 nt, Mycobacterium tuberculosis H37Rv
cgccgccugcuccuc

SEQ ID NO: 3300679 - RNA, 13 nt, Mycobacterium tuberculosis H37Rv
cgccgccuggacg

SEQ ID NO: 3300680 - RNA, 20 nt, Mycobacterium tuberculosis H37Rv
cgccgccuggacgccgccgg

SEQ ID NO: 3300681 - RNA, 22 nt, Mycobacterium tuberculosis H37Rv
cgccgccuuccuggcgggcgcc

SEQ ID NO: 3300682 - RNA, 22 nt, Mycobacterium tuberculosis H37Rv
cgccgccuucuucucggcgagc

SEQ ID NO: 3300683 - RNA, 20 nt, Mycobacterium tuberculosis H37Rv
cgccgccuugacccuccgca

SEQ ID NO: 3300684 - RNA, 21 nt, Mycobacterium tuberculosis H37Rv
cgccgcgaacuccagcagccc

SEQ ID NO: 3300685 - RNA, 22 nt, Mycobacterium tuberculosis H37Rv
cgccgcgaacuccagcagcccg

SEQ ID NO: 3300686 - RNA, 18 nt, Mycobacterium tuberculosis H37Rv
cgccgcgaagcgcucggc

SEQ ID NO: 3300687 - RNA, 19 nt, Mycobacterium tuberculosis H37Rv
cgccgcgaagcgcucggca

SEQ ID NO: 3300688 - RNA, 22 nt, Mycobacterium tuberculosis H37Rv
cgccgcgaagcgcucggcagcc

SEQ ID NO: 3300689 - RNA, 21 nt, Mycobacterium tuberculosis H37Rv
cgccgcgaaggggugcccggc

SEQ ID NO: 3300690 - RNA, 20 nt, Mycobacterium tuberculosis H37Rv
cgccgcgaaugucgccgccu

SEQ ID NO: 3300691 - RNA, 21 nt, Mycobacterium tuberculosis H37Rv
cgccgcgaaugucgccgccug

SEQ ID NO: 3300692 - RNA, 23 nt, Mycobacterium tuberculosis H37Rv
cgccgcgacaaaucggucgacga

SEQ ID NO: 3300693 - RNA, 16 nt, Mycobacterium tuberculosis H37Rv
cgccgcgaccgcgagc

SEQ ID NO: 3300694 - RNA, 15 nt, Mycobacterium tuberculosis H37Rv
cgccgcgacgcacug

SEQ ID NO: 3300695 - RNA, 20 nt, Mycobacterium tuberculosis H37Rv
cgccgcgacgcacugccccg

SEQ ID NO: 3300696 - RNA, 17 nt, Mycobacterium tuberculosis H37Rv
cgccgcgagagccggcg

SEQ ID NO: 3300697 - RNA, 13 nt, Mycobacterium tuberculosis H37Rv
cgccgcgaggaug

SEQ ID NO: 3300698 - RNA, 21 nt, Mycobacterium tuberculosis H37Rv
cgccgcgaucuccuuggccgu

SEQ ID NO: 3300699 - RNA, 17 nt, Mycobacterium tuberculosis H37Rv
cgccgcgaugacggugc

SEQ ID NO: 3300700 - RNA, 18 nt, Mycobacterium tuberculosis H37Rv
cgccggcggccaccagug

SEQ ID NO: 3300701 - RNA, 13 nt, Mycobacterium tuberculosis H37Rv
cgccggcggcggc

SEQ ID NO: 3300702 - RNA, 17 nt, Mycobacterium tuberculosis H37Rv
cgccggcggcggccgca

SEQ ID NO: 3300703 - RNA, 19 nt, Mycobacterium tuberculosis H37Rv
cgccggcggcggccgcagc

SEQ ID NO: 3300704 - RNA, 13 nt, Mycobacterium tuberculosis H37Rv
cgccggcggcggu

SEQ ID NO: 3300705 - RNA, 14 nt, Mycobacterium tuberculosis H37Rv
cgccggcguccgga

SEQ ID NO: 3300706 - RNA, 23 nt, Mycobacterium tuberculosis H37Rv
cgccggcguccggagccccuguc

SEQ ID NO: 3300707 - RNA, 15 nt, Mycobacterium tuberculosis H37Rv
cgccggcgucgaccc

SEQ ID NO: 3300708 - RNA, 21 nt, Mycobacterium tuberculosis H37Rv
cgccggcgucgacccugccca

SEQ ID NO: 3300709 - RNA, 15 nt, Mycobacterium tuberculosis H37Rv
cgccggcgucgagcc

SEQ ID NO: 3300710 - RNA, 18 nt, Mycobacterium tuberculosis H37Rv
cgccggcgucggcgccca

SEQ ID NO: 3300711 - RNA, 15 nt, Mycobacterium tuberculosis H37Rv
cgccggcuccgcagc

SEQ ID NO: 3300712 - RNA, 15 nt, Mycobacterium tuberculosis H37Rv
cgccggcuccgccac

SEQ ID NO: 3300713 - RNA, 21 nt, Mycobacterium tuberculosis H37Rv
cgccggcuccgccacuggcgc

SEQ ID NO: 3300714 - RNA, 16 nt, Mycobacterium tuberculosis H37Rv
cgccggcuccgccagc

SEQ ID NO: 3300715 - RNA, 15 nt, Mycobacterium tuberculosis H37Rv
cgccggcuccgccgu

SEQ ID NO: 3300716 - RNA, 13 nt, Mycobacterium tuberculosis H37Rv
cgccggcugccac

SEQ ID NO: 3300717 - RNA, 15 nt, Mycobacterium tuberculosis H37Rv
cgccggcugcgccag

SEQ ID NO: 3300718 - RNA, 16 nt, Mycobacterium tuberculosis H37Rv
cgccggcuucgcccag

SEQ ID NO: 3300719 - RNA, 19 nt, Mycobacterium tuberculosis H37Rv
cgccggcuucgcccagagc

SEQ ID NO: 3300720 - RNA, 22 nt, Mycobacterium tuberculosis H37Rv
cgccggcuucgcccagagccgc

SEQ ID NO: 3300721 - RNA, 22 nt, Mycobacterium tuberculosis H37Rv
cgccggcuucggguguucgcgc

SEQ ID NO: 3300722 - RNA, 12 nt, Mycobacterium tuberculosis H37Rv
cgccgggaaaca

SEQ ID NO: 3300723 - RNA, 19 nt, Mycobacterium tuberculosis H37Rv
cgccgggaaacaccggcuu

SEQ ID NO: 3300724 - RNA, 20 nt, Mycobacterium tuberculosis H37Rv
cgccgggaacaucccagcga

SEQ ID NO: 3300725 - RNA, 16 nt, Mycobacterium tuberculosis H37Rv
cgccgggaagccgcau

SEQ ID NO: 3300726 - RNA, 17 nt, Mycobacterium tuberculosis H37Rv
cgccgggaugccggccc

SEQ ID NO: 3300727 - RNA, 14 nt, Mycobacterium tuberculosis H37Rv
cgccgggcacgaac

SEQ ID NO: 3300728 - RNA, 20 nt, Mycobacterium tuberculosis H37Rv
cgccgggcaguuuggcggca

SEQ ID NO: 3300729 - RNA, 16 nt, Mycobacterium tuberculosis H37Rv
cgccgggcaucggcgg

SEQ ID NO: 3300730 - RNA, 23 nt, Mycobacterium tuberculosis H37Rv
cgccgggcggcggugcgucagcu

SEQ ID NO: 3300731 - RNA, 21 nt, Mycobacterium tuberculosis H37Rv
cgccgggcguccgccggcgag

SEQ ID NO: 3300732 - RNA, 12 nt, Mycobacterium tuberculosis H37Rv
cgccgggcugca

SEQ ID NO: 3300733 - RNA, 22 nt, Mycobacterium tuberculosis H37Rv
cgccgggcuuacuugaucucgg

SEQ ID NO: 3300734 - RNA, 21 nt, Mycobacterium tuberculosis H37Rv
cgccgggcuuaggccgcggca

SEQ ID NO: 3300735 - RNA, 17 nt, Mycobacterium tuberculosis H37Rv
cgccggggacacagcgu

SEQ ID NO: 3300736 - RNA, 15 nt, Mycobacterium tuberculosis H37Rv
cgccggggacgccgc

SEQ ID NO: 3300737 - RNA, 17 nt, Mycobacterium tuberculosis H37Rv
cgccggggauaccgguc

SEQ ID NO: 3300738 - RNA, 20 nt, Mycobacterium tuberculosis H37Rv
cgccggggauaccggucagc

SEQ ID NO: 3300739 - RNA, 14 nt, Mycobacterium tuberculosis H37Rv
cgccggggccgccg

SEQ ID NO: 3300740 - RNA, 16 nt, Mycobacterium tuberculosis H37Rv
cgccggggccgccgau

SEQ ID NO: 3300741 - RNA, 13 nt, Mycobacterium tuberculosis H37Rv
cgccggggggcug

SEQ ID NO: 3300742 - RNA, 18 nt, Mycobacterium tuberculosis H37Rv
cgccggggggcugcugcu

SEQ ID NO: 3300743 - RNA, 12 nt, Mycobacterium tuberculosis H37Rv
cgccgggucacg

SEQ ID NO: 3300744 - RNA, 13 nt, Mycobacterium tuberculosis H37Rv
cgccgggucacgu

SEQ ID NO: 3300745 - RNA, 14 nt, Mycobacterium tuberculosis H37Rv
cgccgggucagccc

SEQ ID NO: 3300746 - RNA, 18 nt, Mycobacterium tuberculosis H37Rv
cgccggguccgccgggcc

SEQ ID NO: 3300747 - RNA, 19 nt, Mycobacterium tuberculosis H37Rv
cgccgggugcaacggcguu

SEQ ID NO: 3300748 - RNA, 15 nt, Mycobacterium tuberculosis H37Rv
cgccgggugcgccgu

SEQ ID NO: 3300749 - RNA, 17 nt, Mycobacterium tuberculosis H37Rv
cgccggguucgccggau

SEQ ID NO: 3300750 - RNA, 20 nt, Mycobacterium tuberculosis H37Rv
cgccgguaacuguccgcccg

SEQ ID NO: 3300751 - RNA, 18 nt, Mycobacterium tuberculosis H37Rv
cgccgguaggcggccagc

SEQ ID NO: 3300752 - RNA, 20 nt, Mycobacterium tuberculosis H37Rv
cgccgguaggcggccagcgc

SEQ ID NO: 3300753 - RNA, 16 nt, Mycobacterium tuberculosis H37Rv
cgccggucaggccgcc

SEQ ID NO: 3300754 - RNA, 16 nt, Mycobacterium tuberculosis H37Rv
cgccggucaucccaag

SEQ ID NO: 3300755 - RNA, 24 nt, Mycobacterium tuberculosis H37Rv
cgccggucaucccaagcguccgcu

SEQ ID NO: 3300756 - RNA, 14 nt, Mycobacterium tuberculosis H37Rv
cgccggucaucgcc

SEQ ID NO: 3300757 - RNA, 17 nt, Mycobacterium tuberculosis H37Rv
cgccgguccccgccggc

SEQ ID NO: 3300758 - RNA, 19 nt, Mycobacterium tuberculosis H37Rv
cgccgguccccucggugcc

SEQ ID NO: 3300759 - RNA, 16 nt, Mycobacterium tuberculosis H37Rv
cgccgguccucgucgg

SEQ ID NO: 3300760 - RNA, 11 nt, Mycobacterium tuberculosis H37Rv
cgccggucgcc

SEQ ID NO: 3300761 - RNA, 13 nt, Mycobacterium tuberculosis H37Rv
cgccggucgccgg

SEQ ID NO: 3300762 - RNA, 17 nt, Mycobacterium tuberculosis H37Rv
cgccggucgccggcugg

SEQ ID NO: 3300763 - RNA, 15 nt, Mycobacterium tuberculosis H37Rv
cgccggucggaucgg

SEQ ID NO: 3300764 - RNA, 13 nt, Mycobacterium tuberculosis H37Rv
cgccggucggugc

SEQ ID NO: 3300765 - RNA, 12 nt, Mycobacterium tuberculosis H37Rv
cgccggugacga

SEQ ID NO: 3300766 - RNA, 15 nt, Mycobacterium tuberculosis H37Rv
cgccggugacgacgu

SEQ ID NO: 3300767 - RNA, 18 nt, Mycobacterium tuberculosis H37Rv
cgccggugacgacgucgc

SEQ ID NO: 3300768 - RNA, 17 nt, Mycobacterium tuberculosis H37Rv
cgccggugacgaugacc

SEQ ID NO: 3300769 - RNA, 22 nt, Mycobacterium tuberculosis H37Rv
cgccggugacgaugaccgcgcg

SEQ ID NO: 3300770 - RNA, 23 nt, Mycobacterium tuberculosis H37Rv
cgccggugacgggguugaccgcc

SEQ ID NO: 3300771 - RNA, 22 nt, Mycobacterium tuberculosis H37Rv
cgccggugaggcgaccggacga

SEQ ID NO: 3300772 - RNA, 13 nt, Mycobacterium tuberculosis H37Rv
cgccggugccacc

SEQ ID NO: 3300773 - RNA, 16 nt, Mycobacterium tuberculosis H37Rv
cgccggugccaccgac

SEQ ID NO: 3300774 - RNA, 19 nt, Mycobacterium tuberculosis H37Rv
cgccggugccaccggcugg

SEQ ID NO: 3300775 - RNA, 17 nt, Mycobacterium tuberculosis H37Rv
cgccggugccgaucagc

SEQ ID NO: 3300776 - RNA, 21 nt, Mycobacterium tuberculosis H37Rv
cgccggugccgaucagcagug

SEQ ID NO: 3300777 - RNA, 15 nt, Mycobacterium tuberculosis H37Rv
cgccggugccgauga

SEQ ID NO: 3300778 - RNA, 19 nt, Mycobacterium tuberculosis H37Rv
cgccggugccgccaucgcc

SEQ ID NO: 3300779 - RNA, 15 nt, Mycobacterium tuberculosis H37Rv
cgccggugccgcccg

SEQ ID NO: 3300780 - RNA, 15 nt, Mycobacterium tuberculosis H37Rv
cgccggugccgccgc

SEQ ID NO: 3300781 - RNA, 14 nt, Mycobacterium tuberculosis H37Rv
cgccggugccgccu

SEQ ID NO: 3300782 - RNA, 22 nt, Mycobacterium tuberculosis H37Rv
cgccggugccgccugcgccgcc

SEQ ID NO: 3300783 - RNA, 15 nt, Mycobacterium tuberculosis H37Rv
cgccggugccggcca

SEQ ID NO: 3300784 - RNA, 14 nt, Mycobacterium tuberculosis H37Rv
cgccggugccggua

SEQ ID NO: 3300785 - RNA, 17 nt, Mycobacterium tuberculosis H37Rv
cgccggugcgcgcugac

SEQ ID NO: 3300786 - RNA, 22 nt, Mycobacterium tuberculosis H37Rv
cgccggugcgcgcugacccgcc

SEQ ID NO: 3300787 - RNA, 13 nt, Mycobacterium tuberculosis H37Rv
cgccggugcgcug

SEQ ID NO: 3300788 - RNA, 17 nt, Mycobacterium tuberculosis H37Rv
cgccgguggcacccgcg

SEQ ID NO: 3300789 - RNA, 16 nt, Mycobacterium tuberculosis H37Rv
cgccgguggcacggcc

SEQ ID NO: 3300790 - RNA, 17 nt, Mycobacterium tuberculosis H37Rv
cgccgguggcacggccc

SEQ ID NO: 3300791 - RNA, 19 nt, Mycobacterium tuberculosis H37Rv
cgccgguggcagagccgcc

SEQ ID NO: 3300792 - RNA, 21 nt, Mycobacterium tuberculosis H37Rv
cgccgguggcagagccgccgu

SEQ ID NO: 3300793 - RNA, 16 nt, Mycobacterium tuberculosis H37Rv
cgccgguggccgcgcu

SEQ ID NO: 3300794 - RNA, 18 nt, Mycobacterium tuberculosis H37Rv
cgccgguggcgccggggc

SEQ ID NO: 3300795 - RNA, 21 nt, Mycobacterium tuberculosis H37Rv
cgccgguggucacgccgugug

SEQ ID NO: 3300796 - RNA, 22 nt, Mycobacterium tuberculosis H37Rv
cgccgguggucagguuggcacg

SEQ ID NO: 3300797 - RNA, 19 nt, Mycobacterium tuberculosis H37Rv
cgccgugguugcacguucg

SEQ ID NO: 3300798 - RNA, 22 nt, Mycobacterium tuberculosis H37Rv
cgccgugguugcacguucggcg

SEQ ID NO: 3300799 - RNA, 19 nt, Mycobacterium tuberculosis H37Rv
cgccgugugcaucggcgac

SEQ ID NO: 3300800 - RNA, 18 nt, Mycobacterium tuberculosis H37Rv
cgccgugugccacggggc

SEQ ID NO: 3300801 - RNA, 18 nt, Mycobacterium tuberculosis H37Rv
cgccgugugugcggcggu

SEQ ID NO: 3300802 - RNA, 15 nt, Mycobacterium tuberculosis H37Rv
cgccguguuccaggu

SEQ ID NO: 3300803 - RNA, 16 nt, Mycobacterium tuberculosis H37Rv
cgccguuaccgccguu

SEQ ID NO: 3300804 - RNA, 15 nt, Mycobacterium tuberculosis H37Rv
cgccguuagcgucgc

SEQ ID NO: 3300805 - RNA, 18 nt, Mycobacterium tuberculosis H37Rv
cgccguuauccgacgaac

SEQ ID NO: 3300806 - RNA, 21 nt, Mycobacterium tuberculosis H37Rv
cgccguuauccgacgaaccgg

SEQ ID NO: 3300807 - RNA, 17 nt, Mycobacterium tuberculosis H37Rv
cgccguucccacccacg

SEQ ID NO: 3300808 - RNA, 23 nt, Mycobacterium tuberculosis H37Rv
cgccguucccacccacgccgacu

SEQ ID NO: 3300809 - RNA, 16 nt, Mycobacterium tuberculosis H37Rv
cgccguucccgccggc

SEQ ID NO: 3300810 - RNA, 15 nt, Mycobacterium tuberculosis H37Rv
cgccguucgggaugc

SEQ ID NO: 3300811 - RNA, 16 nt, Mycobacterium tuberculosis H37Rv
cgccguucgucgugga

SEQ ID NO: 3300812 - RNA, 15 nt, Mycobacterium tuberculosis H37Rv
cgccguucucgcgca

SEQ ID NO: 3300813 - RNA, 15 nt, Mycobacterium tuberculosis H37Rv
cgccguugaacggca

SEQ ID NO: 3300814 - RNA, 21 nt, Mycobacterium tuberculosis H37Rv
cgccguugaacggcaccagcg

SEQ ID NO: 3300815 - RNA, 15 nt, Mycobacterium tuberculosis H37Rv
cgccguugacgccgu

SEQ ID NO: 3300816 - RNA, 22 nt, Mycobacterium tuberculosis H37Rv
cgccguugaucuugacggucgc

SEQ ID NO: 3300817 - RNA, 15 nt, Mycobacterium tuberculosis H37Rv
cgccguugccaccgu

SEQ ID NO: 3300818 - RNA, 17 nt, Mycobacterium tuberculosis H37Rv
cgccguugccauugccu

SEQ ID NO: 3300819 - RNA, 22 nt, Mycobacterium tuberculosis H37Rv
cgccguugccauugccucccgc

SEQ ID NO: 3300820 - RNA, 17 nt, Mycobacterium tuberculosis H37Rv
cgccguugccgaucagc

SEQ ID NO: 3300821 - RNA, 19 nt, Mycobacterium tuberculosis H37Rv
cgccguugccgaucagccc

SEQ ID NO: 3300822 - RNA, 13 nt, Mycobacterium tuberculosis H37Rv
cgccguugccgcc

SEQ ID NO: 3300823 - RNA, 18 nt, Mycobacterium tuberculosis H37Rv
cgccguugccgccacgca

SEQ ID NO: 3300824 - RNA, 23 nt, Mycobacterium tuberculosis H37Rv
cgccguugccgccagcgccaccg

SEQ ID NO: 3300825 - RNA, 21 nt, Mycobacterium tuberculosis H37Rv
cgccguugccgccgacgccgc

SEQ ID NO: 3300826 - RNA, 18 nt, Mycobacterium tuberculosis H37Rv
cgccguugccgccggcgc

SEQ ID NO: 3300827 - RNA, 17 nt, Mycobacterium tuberculosis H37Rv
cgccguugccgccguca

SEQ ID NO: 3300828 - RNA, 20 nt, Mycobacterium tuberculosis H37Rv
cgccguugccgccgucaccg

SEQ ID NO: 3300829 - RNA, 17 nt, Mycobacterium tuberculosis H37Rv
cgccguugccgccgucg

SEQ ID NO: 3300830 - RNA, 18 nt, Mycobacterium tuberculosis H37Rv
cgccguugccgccgucgc

SEQ ID NO: 3300831 - RNA, 12 nt, Mycobacterium tuberculosis H37Rv
cgccguugccgg

SEQ ID NO: 3300832 - RNA, 17 nt, Mycobacterium tuberculosis H37Rv
cgccguugccggccacc

SEQ ID NO: 3300833 - RNA, 13 nt, Mycobacterium tuberculosis H37Rv
cgccguugccguc

SEQ ID NO: 3300834 - RNA, 14 nt, Mycobacterium tuberculosis H37Rv
cgccguugccgucg

SEQ ID NO: 3300835 - RNA, 18 nt, Mycobacterium tuberculosis H37Rv
cgccguugccgucgucgc

SEQ ID NO: 3300836 - RNA, 18 nt, Mycobacterium tuberculosis H37Rv
cgccguuggagacgucgc

SEQ ID NO: 3300837 - RNA, 14 nt, Mycobacterium tuberculosis H37Rv
cgccguuggcaccg

SEQ ID NO: 3300838 - RNA, 15 nt, Mycobacterium tuberculosis H37Rv
cgccguugggccgcg

SEQ ID NO: 3300839 - RNA, 19 nt, Mycobacterium tuberculosis H37Rv
cgccguugggccgcgcccu

SEQ ID NO: 3300840 - RNA, 15 nt, Mycobacterium tuberculosis H37Rv
cgccguugucggcgg

SEQ ID NO: 3300841 - RNA, 21 nt, Mycobacterium tuberculosis H37Rv
cgccguuuccgccgccgccau

SEQ ID NO: 3300842 - RNA, 15 nt, Mycobacterium tuberculosis H37Rv
cgccguuugcgccgu

SEQ ID NO: 3300843 - RNA, 23 nt, Mycobacterium tuberculosis H37Rv
cgccguuuggccucacccgguca

SEQ ID NO: 3300844 - RNA, 18 nt, Mycobacterium tuberculosis H37Rv
cgccuaagcauucagcgc

SEQ ID NO: 3300845 - RNA, 20 nt, Mycobacterium tuberculosis H37Rv
cgccuaagcauucagcgcgc

SEQ ID NO: 3300846 - RNA, 23 nt, Mycobacterium tuberculosis H37Rv
cgccuaaucggccugccggcagc

SEQ ID NO: 3300847 - RNA, 19 nt, Mycobacterium tuberculosis H37Rv
cgccuagcacgaagcuggc

SEQ ID NO: 3300848 - RNA, 22 nt, Mycobacterium tuberculosis H37Rv
cgccuagcgagcgcacaccggc

SEQ ID NO: 3300849 - RNA, 20 nt, Mycobacterium tuberculosis H37Rv
cgccuaggacuucggugagc

SEQ ID NO: 3300850 - RNA, 19 nt, Mycobacterium tuberculosis H37Rv
cgccuaggaguuccucgau

SEQ ID NO: 3300851 - RNA, 17 nt, Mycobacterium tuberculosis H37Rv
cgccucaagcucgccgg

SEQ ID NO: 3300852 - RNA, 21 nt, Mycobacterium tuberculosis H37Rv
cgccucaaugaccaccgggcg

SEQ ID NO: 3300853 - RNA, 12 nt, Mycobacterium tuberculosis H37Rv
cgccucaccgac

SEQ ID NO: 3300854 - RNA, 17 nt, Mycobacterium tuberculosis H37Rv
cgccucaccgacgucgc

SEQ ID NO: 3300855 - RNA, 16 nt, Mycobacterium tuberculosis H37Rv
cgccucaccggcgcga

SEQ ID NO: 3300856 - RNA, 18 nt, Mycobacterium tuberculosis H37Rv
cgccuccacucuucgggc

SEQ ID NO: 3300857 - RNA, 16 nt, Mycobacterium tuberculosis H37Rv
cgccuccagcaccacg

SEQ ID NO: 3300858 - RNA, 14 nt, Mycobacterium tuberculosis H37Rv
cgccuccagcaggu

SEQ ID NO: 3300859 - RNA, 20 nt, Mycobacterium tuberculosis H37Rv
cgccuccaggcgccacccga

SEQ ID NO: 3300860 - RNA, 15 nt, Mycobacterium tuberculosis H37Rv
cgccuccgccugccc

SEQ ID NO: 3300861 - RNA, 13 nt, Mycobacterium tuberculosis H37Rv
cgccuccgcggca

SEQ ID NO: 3300862 - RNA, 22 nt, Mycobacterium tuberculosis H37Rv
cgccuccggauccucggccgcc

SEQ ID NO: 3300863 - RNA, 19 nt, Mycobacterium tuberculosis H37Rv
cgccuccggcaccuccagc

SEQ ID NO: 3300864 - RNA, 16 nt, Mycobacterium tuberculosis H37Rv
cgccuccguugccccc

SEQ ID NO: 3300865 - RNA, 23 nt, Mycobacterium tuberculosis H37Rv
cgccuccguugcccccauugccg

SEQ ID NO: 3300866 - RNA, 14 nt, Mycobacterium tuberculosis H37Rv
cgccuccucgacgu

SEQ ID NO: 3300867 - RNA, 17 nt, Mycobacterium tuberculosis H37Rv
cgccuccucgacgucgg

SEQ ID NO: 3300868 - RNA, 18 nt, Mycobacterium tuberculosis H37Rv
cgccuccucgacgucggc

SEQ ID NO: 3300869 - RNA, 13 nt, Mycobacterium tuberculosis H37Rv
cgccuccucgauc

SEQ ID NO: 3300870 - RNA, 22 nt, Mycobacterium tuberculosis H37Rv
cgccuccucgugcaggaccagc

SEQ ID NO: 3300871 - RNA, 14 nt, Mycobacterium tuberculosis H37Rv
cgccuccugccgcc

SEQ ID NO: 3300872 - RNA, 17 nt, Mycobacterium tuberculosis H37Rv
cgccuccugccgccgcu

SEQ ID NO: 3300873 - RNA, 19 nt, Mycobacterium tuberculosis H37Rv
cgccucgacacccagccgc

SEQ ID NO: 3300874 - RNA, 15 nt, Mycobacterium tuberculosis H37Rv
cgccucgaccgccag

SEQ ID NO: 3300875 - RNA, 17 nt, Mycobacterium tuberculosis H37Rv
cgccucgaggaccacca

SEQ ID NO: 3300876 - RNA, 19 nt, Mycobacterium tuberculosis H37Rv
cgccucgaggaccaccacu

SEQ ID NO: 3300877 - RNA, 20 nt, Mycobacterium tuberculosis H37Rv
cgccucgagguauucgcgca

SEQ ID NO: 3300878 - RNA, 22 nt, Mycobacterium tuberculosis H37Rv
cgccucgagguauucgcgcagc

SEQ ID NO: 3300879 - RNA, 23 nt, Mycobacterium tuberculosis H37Rv
cgccucgagguauucgcgcagca

SEQ ID NO: 3300880 - RNA, 19 nt, Mycobacterium tuberculosis H37Rv
cgccucgauaucgucggga

SEQ ID NO: 3300881 - RNA, 13 nt, Mycobacterium tuberculosis H37Rv
cgccucgcccagc

SEQ ID NO: 3300882 - RNA, 13 nt, Mycobacterium tuberculosis H37Rv
cgccucgccggcc

SEQ ID NO: 3300883 - RNA, 16 nt, Mycobacterium tuberculosis H37Rv
cgccucgccggccacc

SEQ ID NO: 3300884 - RNA, 19 nt, Mycobacterium tuberculosis H37Rv
cgccucgccggccacccgc

SEQ ID NO: 3300885 - RNA, 16 nt, Mycobacterium tuberculosis H37Rv
cgccucgccggccgcc

SEQ ID NO: 3300886 - RNA, 18 nt, Mycobacterium tuberculosis H37Rv
cgccucggacacggcagc

SEQ ID NO: 3300887 - RNA, 17 nt, Mycobacterium tuberculosis H37Rv
cgccucggaccagaccc

SEQ ID NO: 3300888 - RNA, 20 nt, Mycobacterium tuberculosis H37Rv
cgccucggcaucgccgcggg

SEQ ID NO: 3300889 - RNA, 14 nt, Mycobacterium tuberculosis H37Rv
cgccucggcggcca

SEQ ID NO: 3300890 - RNA, 16 nt, Mycobacterium tuberculosis H37Rv
cgccucggcggccagc

SEQ ID NO: 3300891 - RNA, 17 nt, Mycobacterium tuberculosis H37Rv
cgccucggcggccagcu

SEQ ID NO: 3300892 - RNA, 14 nt, Mycobacterium tuberculosis H37Rv
cgccucgggcaccu

SEQ ID NO: 3300893 - RNA, 13 nt, Mycobacterium tuberculosis H37Rv
cgcgaacagcggg

SEQ ID NO: 3300894 - RNA, 14 nt, Mycobacterium tuberculosis H37Rv
cgcgaacaucgcca

SEQ ID NO: 3300895 - RNA, 15 nt, Mycobacterium tuberculosis H37Rv
cgcgaacaucgccag

SEQ ID NO: 3300896 - RNA, 18 nt, Mycobacterium tuberculosis H37Rv
cgcgaacaucgccagcgc

SEQ ID NO: 3300897 - RNA, 17 nt, Mycobacterium tuberculosis H37Rv
cgcgaaccccagccgau

SEQ ID NO: 3300898 - RNA, 13 nt, Mycobacterium tuberculosis H37Rv
cgcgaacccgcga

SEQ ID NO: 3300899 - RNA, 13 nt, Mycobacterium tuberculosis H37Rv
cgcgaacccugcu

SEQ ID NO: 3300900 - RNA, 22 nt, Mycobacterium tuberculosis H37Rv
cgcgaaccgcggaucgaccgcc

SEQ ID NO: 3300901 - RNA, 16 nt, Mycobacterium tuberculosis H37Rv
cgcgaaccggccaucg

SEQ ID NO: 3300902 - RNA, 14 nt, Mycobacterium tuberculosis H37Rv
cgcgaacgcggcca

SEQ ID NO: 3300903 - RNA, 20 nt, Mycobacterium tuberculosis H37Rv
cgcgaacucaugcccgacga

SEQ ID NO: 3300904 - RNA, 18 nt, Mycobacterium tuberculosis H37Rv
cgcgaagaacgacgccac

SEQ ID NO: 3300905 - RNA, 20 nt, Mycobacterium tuberculosis H37Rv
cgcgaagaacgacgccaccg

SEQ ID NO: 3300906 - RNA, 21 nt, Mycobacterium tuberculosis H37Rv
cgcgaagaacgacgccaccgc

SEQ ID NO: 3300907 - RNA, 15 nt, Mycobacterium tuberculosis H37Rv
cgcgaagccaccagg

SEQ ID NO: 3300908 - RNA, 17 nt, Mycobacterium tuberculosis H37Rv
cgcgaagccaccagguc

SEQ ID NO: 3300909 - RNA, 17 nt, Mycobacterium tuberculosis H37Rv
cgcgaagcgcucggcag

SEQ ID NO: 3300910 - RNA, 14 nt, Mycobacterium tuberculosis H37Rv
cgcgaaggucucga

SEQ ID NO: 3300911 - RNA, 19 nt, Mycobacterium tuberculosis H37Rv
cgcgaagucguccagaaug

SEQ ID NO: 3300912 - RNA, 21 nt, Mycobacterium tuberculosis H37Rv
cgcgaauaccagaccggccga

SEQ ID NO: 3300913 - RNA, 20 nt, Mycobacterium tuberculosis H37Rv
cgcgaauauagcggcguucc

SEQ ID NO: 3300914 - RNA, 16 nt, Mycobacterium tuberculosis H37Rv
cgcgaaugucgccgcc

SEQ ID NO: 3300915 - RNA, 22 nt, Mycobacterium tuberculosis H37Rv
cgcgacaaaguucgacgagaag

SEQ ID NO: 3300916 - RNA, 17 nt, Mycobacterium tuberculosis H37Rv
cgcgacaaaucggucga

SEQ ID NO: 3300917 - RNA, 15 nt, Mycobacterium tuberculosis H37Rv
cgcgacaacccggcg

SEQ ID NO: 3300918 - RNA, 22 nt, Mycobacterium tuberculosis H37Rv
cgcgacaauggugcccaggaag

SEQ ID NO: 3300919 - RNA, 18 nt, Mycobacterium tuberculosis H37Rv
cgcgacacacgccgccgg

SEQ ID NO: 3300920 - RNA, 14 nt, Mycobacterium tuberculosis H37Rv
cgcgacacgcggcc

SEQ ID NO: 3300921 - RNA, 15 nt, Mycobacterium tuberculosis H37Rv
cgcgacacgcggccc

SEQ ID NO: 3300922 - RNA, 14 nt, Mycobacterium tuberculosis H37Rv
cgcgacacggccau

SEQ ID NO: 3300923 - RNA, 19 nt, Mycobacterium tuberculosis H37Rv
cgcgacagacagcaccgcc

SEQ ID NO: 3300924 - RNA, 21 nt, Mycobacterium tuberculosis H37Rv
cgcgacagacagcaccgccgg

SEQ ID NO: 3300925 - RNA, 22 nt, Mycobacterium tuberculosis H37Rv
cgcgacagacagcaccgccggu

SEQ ID NO: 3300926 - RNA, 22 nt, Mycobacterium tuberculosis H37Rv
cgcgacagccguggcgcgacgu

SEQ ID NO: 3300927 - RNA, 13 nt, Mycobacterium tuberculosis H37Rv
cgcgacagugcgc

SEQ ID NO: 3300928 - RNA, 14 nt, Mycobacterium tuberculosis H37Rv
cgcgacauccgcgg

SEQ ID NO: 3300929 - RNA, 15 nt, Mycobacterium tuberculosis H37Rv
cgcgacauucguccg

SEQ ID NO: 3300930 - RNA, 22 nt, Mycobacterium tuberculosis H37Rv
cgcgaccaaaccgcuguaaccg

SEQ ID NO: 3300931 - RNA, 13 nt, Mycobacterium tuberculosis H37Rv
cgcgaccacccgc

SEQ ID NO: 3300932 - RNA, 17 nt, Mycobacterium tuberculosis H37Rv
cgcgaccacccgccgca

SEQ ID NO: 3300933 - RNA, 12 nt, Mycobacterium tuberculosis H37Rv
cgcgaccaccgc

SEQ ID NO: 3300934 - RNA, 17 nt, Mycobacterium tuberculosis H37Rv
cgcgaccacgcaccgcc

SEQ ID NO: 3300935 - RNA, 19 nt, Mycobacterium tuberculosis H37Rv
cgcgaccacgcaccgcccc

SEQ ID NO: 3300936 - RNA, 16 nt, Mycobacterium tuberculosis H37Rv
cgcgaccagccagcga

SEQ ID NO: 3300937 - RNA, 14 nt, Mycobacterium tuberculosis H37Rv
cgcgaccagcgccg

SEQ ID NO: 3300938 - RNA, 15 nt, Mycobacterium tuberculosis H37Rv
cgcgaccagcgccgc

SEQ ID NO: 3300939 - RNA, 13 nt, Mycobacterium tuberculosis H37Rv
cgcgaccaggaag

SEQ ID NO: 3300940 - RNA, 16 nt, Mycobacterium tuberculosis H37Rv
cgcgaccauacccgcg

SEQ ID NO: 3300941 - RNA, 19 nt, Mycobacterium tuberculosis H37Rv
cgcgaccauacccgcgcgc

SEQ ID NO: 3300942 - RNA, 23 nt, Mycobacterium tuberculosis H37Rv
cgcgaccaugagcuugguggcca

SEQ ID NO: 3300943 - RNA, 16 nt, Mycobacterium tuberculosis H37Rv
cgcgaccaugguggua

SEQ ID NO: 3300944 - RNA, 15 nt, Mycobacterium tuberculosis H37Rv
cgcgaccccaggcgc

SEQ ID NO: 3300945 - RNA, 14 nt, Mycobacterium tuberculosis H37Rv
cgcgacccgaucgc

SEQ ID NO: 3300946 - RNA, 16 nt, Mycobacterium tuberculosis H37Rv
cgcgacccgaucgcgc

SEQ ID NO: 3300947 - RNA, 14 nt, Mycobacterium tuberculosis H37Rv
cgcgacccgcgcaa

SEQ ID NO: 3300948 - RNA, 17 nt, Mycobacterium tuberculosis H37Rv
cgcgacccggcccagcg

SEQ ID NO: 3300949 - RNA, 20 nt, Mycobacterium tuberculosis H37Rv
cgcgaccggcguaaccggca

SEQ ID NO: 3300950 - RNA, 17 nt, Mycobacterium tuberculosis H37Rv
cgcgaccgucaggguca

SEQ ID NO: 3300951 - RNA, 20 nt, Mycobacterium tuberculosis H37Rv
cgcgaccgucagggucaccu

SEQ ID NO: 3300952 - RNA, 22 nt, Mycobacterium tuberculosis H37Rv
cgcgaccgucagggucaccugc

SEQ ID NO: 3300953 - RNA, 16 nt, Mycobacterium tuberculosis H37Rv
cgcgaccuccgcgauc

SEQ ID NO: 3300954 - RNA, 17 nt, Mycobacterium tuberculosis H37Rv
cgcgaccuccgcgauca

SEQ ID NO: 3300955 - RNA, 13 nt, Mycobacterium tuberculosis H37Rv
cgcgacgacauug

SEQ ID NO: 3300956 - RNA, 14 nt, Mycobacterium tuberculosis H37Rv
cgcgacgagcaugc

SEQ ID NO: 3300957 - RNA, 14 nt, Mycobacterium tuberculosis H37Rv
cgcgacgccguccu

SEQ ID NO: 3300958 - RNA, 15 nt, Mycobacterium tuberculosis H37Rv
cgcgacgcggggcuc

SEQ ID NO: 3300959 - RNA, 16 nt, Mycobacterium tuberculosis H37Rv
cgcgacgcggggcuca

SEQ ID NO: 3300960 - RNA, 13 nt, Mycobacterium tuberculosis H37Rv
cgcgacgcucgcu

SEQ ID NO: 3300961 - RNA, 21 nt, Mycobacterium tuberculosis H37Rv
cgcgacgcucgcugcagcagg

SEQ ID NO: 3300962 - RNA, 18 nt, Mycobacterium tuberculosis H37Rv
cgcgacggcauguaccga

SEQ ID NO: 3300963 - RNA, 21 nt, Mycobacterium tuberculosis H37Rv
cgcgacggcauguaccgaccg

SEQ ID NO: 3300964 - RNA, 23 nt, Mycobacterium tuberculosis H37Rv
cgcgacggcccgaucccgaucga

SEQ ID NO: 3300965 - RNA, 13 nt, Mycobacterium tuberculosis H37Rv
cgcgacggcgccc

SEQ ID NO: 3300966 - RNA, 16 nt, Mycobacterium tuberculosis H37Rv
cgcgacggcgcggugc

SEQ ID NO: 3300967 - RNA, 15 nt, Mycobacterium tuberculosis H37Rv
cgcgacguagacgac

SEQ ID NO: 3300968 - RNA, 18 nt, Mycobacterium tuberculosis H37Rv
cgcgacguagacgacguc

SEQ ID NO: 3300969 - RNA, 20 nt, Mycobacterium tuberculosis H37Rv
cgcgacguagacgacgucgg

SEQ ID NO: 3300970 - RNA, 22 nt, Mycobacterium tuberculosis H37Rv
cgcgacguagacgacgucggcc

SEQ ID NO: 3300971 - RNA, 20 nt, Mycobacterium tuberculosis H37Rv
cgcgacguaguggaagccga

SEQ ID NO: 3300972 - RNA, 22 nt, Mycobacterium tuberculosis H37Rv
cgcgacguaguggaagccgacc

SEQ ID NO: 3300973 - RNA, 19 nt, Mycobacterium tuberculosis H37Rv
cgcgacgucugccaggcgc

SEQ ID NO: 3300974 - RNA, 15 nt, Mycobacterium tuberculosis H37Rv
cgcgagaacacccgu

SEQ ID NO: 3300975 - RNA, 14 nt, Mycobacterium tuberculosis H37Rv
cgcgagaucagccg

SEQ ID NO: 3300976 - RNA, 17 nt, Mycobacterium tuberculosis H37Rv
cgcgagauccuucgcgu

SEQ ID NO: 3300977 - RNA, 16 nt, Mycobacterium tuberculosis H37Rv
cgcgagaucgggccgg

SEQ ID NO: 3300978 - RNA, 23 nt, Mycobacterium tuberculosis H37Rv
cgcgagaucgggccggccgccgc

SEQ ID NO: 3300979 - RNA, 18 nt, Mycobacterium tuberculosis H37Rv
cgcgagcagacgcagaag

SEQ ID NO: 3300980 - RNA, 13 nt, Mycobacterium tuberculosis H37Rv
cgcgagcagcccg

SEQ ID NO: 3300981 - RNA, 14 nt, Mycobacterium tuberculosis H37Rv
cgcgagcaucgacg

SEQ ID NO: 3300982 - RNA, 22 nt, Mycobacterium tuberculosis H37Rv
cgcgagcaucugggguccggug

SEQ ID NO: 3300983 - RNA, 23 nt, Mycobacterium tuberculosis H37Rv
cgcgagcaucugggguccgguga

SEQ ID NO: 3300984 - RNA, 15 nt, Mycobacterium tuberculosis H37Rv
cgcgagccagcugcu

SEQ ID NO: 3300985 - RNA, 13 nt, Mycobacterium tuberculosis H37Rv
cgcgagcccgcca

SEQ ID NO: 3300986 - RNA, 23 nt, Mycobacterium tuberculosis H37Rv
cgcgagcccggccucggcgagca

SEQ ID NO: 3300987 - RNA, 18 nt, Mycobacterium tuberculosis H37Rv
cgcgagccgcacgaugcc

SEQ ID NO: 3300988 - RNA, 18 nt, Mycobacterium tuberculosis H37Rv
cgcgagccggugauccgg

SEQ ID NO: 3300989 - RNA, 17 nt, Mycobacterium tuberculosis H37Rv
cgcgcaccccggcauac

SEQ ID NO: 3300990 - RNA, 15 nt, Mycobacterium tuberculosis H37Rv
cgcgcaccgaccgca

SEQ ID NO: 3300991 - RNA, 16 nt, Mycobacterium tuberculosis H37Rv
cgcgcaccggaucgcc

SEQ ID NO: 3300992 - RNA, 20 nt, Mycobacterium tuberculosis H37Rv
cgcgcaccggaucgccgucg

SEQ ID NO: 3300993 - RNA, 20 nt, Mycobacterium tuberculosis H37Rv
cgcgcaccggguugagccgc

SEQ ID NO: 3300994 - RNA, 18 nt, Mycobacterium tuberculosis H37Rv
cgcgcaccugaucgguca

SEQ ID NO: 3300995 - RNA, 13 nt, Mycobacterium tuberculosis H37Rv
cgcgcacgacagg

SEQ ID NO: 3300996 - RNA, 16 nt, Mycobacterium tuberculosis H37Rv
cgcgcacgccaccggg

SEQ ID NO: 3300997 - RNA, 15 nt, Mycobacterium tuberculosis H37Rv
cgcgcacgcccugaa

SEQ ID NO: 3300998 - RNA, 14 nt, Mycobacterium tuberculosis H37Rv
cgcgcacgcgugcc

SEQ ID NO: 3300999 - RNA, 17 nt, Mycobacterium tuberculosis H37Rv
cgcgcacgcgugccgca

SEQ ID NO: 3301000 - RNA, 13 nt, Mycobacterium tuberculosis H37Rv
cgcgcacggcguc

SEQ ID NO: 3301001 - RNA, 12 nt, Mycobacterium tuberculosis H37Rv
cgcgcacgucga

SEQ ID NO: 3301002 - RNA, 17 nt, Mycobacterium tuberculosis H37Rv
cgcgcacucgaccagga

SEQ ID NO: 3301003 - RNA, 16 nt, Mycobacterium tuberculosis H37Rv
cgcgcacuugcguggc

SEQ ID NO: 3301004 - RNA, 18 nt, Mycobacterium tuberculosis H37Rv
cgcgcacuugcguggcgu

SEQ ID NO: 3301005 - RNA, 23 nt, Mycobacterium tuberculosis H37Rv
cgcgcagaaagucgcgcgcgaac

SEQ ID NO: 3301006 - RNA, 21 nt, Mycobacterium tuberculosis H37Rv
cgcgcagaucguccaccgccg

SEQ ID NO: 3301007 - RNA, 22 nt, Mycobacterium tuberculosis H37Rv
cgcgcagcaccggcucgacugc

SEQ ID NO: 3301008 - RNA, 13 nt, Mycobacterium tuberculosis H37Rv
cgcgcagcacugc

SEQ ID NO: 3301009 - RNA, 15 nt, Mycobacterium tuberculosis H37Rv
cgcgcagcacugcgg

SEQ ID NO: 3301010 - RNA, 17 nt, Mycobacterium tuberculosis H37Rv
cgcgcagccgcucgacg

SEQ ID NO: 3301011 - RNA, 21 nt, Mycobacterium tuberculosis H37Rv
cgcgcagccgggucuacagcg

SEQ ID NO: 3301012 - RNA, 14 nt, Mycobacterium tuberculosis H37Rv
cgcgcagcgauucg

SEQ ID NO: 3301013 - RNA, 12 nt, Mycobacterium tuberculosis H37Rv
cgcgcagcucgg

SEQ ID NO: 3301014 - RNA, 18 nt, Mycobacterium tuberculosis H37Rv
cgcgcagcucgggcucgu

SEQ ID NO: 3301015 - RNA, 15 nt, Mycobacterium tuberculosis H37Rv
cgcgcagcugacguc

SEQ ID NO: 3301016 - RNA, 19 nt, Mycobacterium tuberculosis H37Rv
cgcgcagcugacgucacca

SEQ ID NO: 3301017 - RNA, 19 nt, Mycobacterium tuberculosis H37Rv
cgcgcaggcuuccagccac

SEQ ID NO: 3301018 - RNA, 22 nt, Mycobacterium tuberculosis H37Rv
cgcgcaggcuuccagccacagc

SEQ ID NO: 3301019 - RNA, 20 nt, Mycobacterium tuberculosis H37Rv
cgcgcagggcgucggcgaau

SEQ ID NO: 3301020 - RNA, 21 nt, Mycobacterium tuberculosis H37Rv
cgcgcaggggcggcgugaagu

SEQ ID NO: 3301021 - RNA, 14 nt, Mycobacterium tuberculosis H37Rv
cgcgcagguagcgc

SEQ ID NO: 3301022 - RNA, 21 nt, Mycobacterium tuberculosis H37Rv
cgcgcagguagcgccgcacuu

SEQ ID NO: 3301023 - RNA, 21 nt, Mycobacterium tuberculosis H37Rv
cgcgcagguagcgcucgauca

SEQ ID NO: 3301024 - RNA, 18 nt, Mycobacterium tuberculosis H37Rv
cgcgcagguagucgacga

SEQ ID NO: 3301025 - RNA, 19 nt, Mycobacterium tuberculosis H37Rv
cgcgcagguagucgacgac

SEQ ID NO: 3301026 - RNA, 19 nt, Mycobacterium tuberculosis H37Rv
cgcgcaguacuugaccguc

SEQ ID NO: 3301027 - RNA, 14 nt, Mycobacterium tuberculosis H37Rv
cgcgcauccgcagc

SEQ ID NO: 3301028 - RNA, 18 nt, Mycobacterium tuberculosis H37Rv
cgcgcaucgccuccucga

SEQ ID NO: 3301029 - RNA, 13 nt, Mycobacterium tuberculosis H37Rv
cgcgcaucgcggc

SEQ ID NO: 3301030 - RNA, 17 nt, Mycobacterium tuberculosis H37Rv
cgcgcaucgcggccgaa

SEQ ID NO: 3301031 - RNA, 19 nt, Mycobacterium tuberculosis H37Rv
cgcgcaucugucgcgcggc

SEQ ID NO: 3301032 - RNA, 18 nt, Mycobacterium tuberculosis H37Rv
cgcgcauucgccgggcgg

SEQ ID NO: 3301033 - RNA, 20 nt, Mycobacterium tuberculosis H37Rv
cgcgcauugccgacgcgcgg

SEQ ID NO: 3301034 - RNA, 18 nt, Mycobacterium tuberculosis H37Rv
cgcgcauuuuucgccagc

SEQ ID NO: 3301035 - RNA, 19 nt, Mycobacterium tuberculosis H37Rv
cgcgccaaacaccccggcc

SEQ ID NO: 3301036 - RNA, 22 nt, Mycobacterium tuberculosis H37Rv
cgcgccaaacaccccggccuug

SEQ ID NO: 3301037 - RNA, 16 nt, Mycobacterium tuberculosis H37Rv
cgcgccaaacgccgga

SEQ ID NO: 3301038 - RNA, 15 nt, Mycobacterium tuberculosis H37Rv
cgcgccaaguggcgc

SEQ ID NO: 3301039 - RNA, 15 nt, Mycobacterium tuberculosis H37Rv
cgcgccaaucgccca

SEQ ID NO: 3301040 - RNA, 14 nt, Mycobacterium tuberculosis H37Rv
cgcgccaccagcac

SEQ ID NO: 3301041 - RNA, 19 nt, Mycobacterium tuberculosis H37Rv
cgcgccaccagcaccgccg

SEQ ID NO: 3301042 - RNA, 22 nt, Mycobacterium tuberculosis H37Rv
cgcgccaccagcaccgccgcug

SEQ ID NO: 3301043 - RNA, 14 nt, Mycobacterium tuberculosis H37Rv
cgcgccaccgauac

SEQ ID NO: 3301044 - RNA, 15 nt, Mycobacterium tuberculosis H37Rv
cgcgccaccggcacc

SEQ ID NO: 3301045 - RNA, 17 nt, Mycobacterium tuberculosis H37Rv
cgcgccaccggcaccgc

SEQ ID NO: 3301046 - RNA, 18 nt, Mycobacterium tuberculosis H37Rv
cgcgccaccggcaccgcc

SEQ ID NO: 3301047 - RNA, 21 nt, Mycobacterium tuberculosis H37Rv
cgcgccaccggcaccgccugc

SEQ ID NO: 3301048 - RNA, 21 nt, Mycobacterium tuberculosis H37Rv
cgcgccaccuccgacgggcga

SEQ ID NO: 3301049 - RNA, 19 nt, Mycobacterium tuberculosis H37Rv
cgcgccacgagcaacgggc

SEQ ID NO: 3301050 - RNA, 15 nt, Mycobacterium tuberculosis H37Rv
cgcgccacgcacccg

SEQ ID NO: 3301051 - RNA, 16 nt, Mycobacterium tuberculosis H37Rv
cgcgccacgcacccgg

SEQ ID NO: 3301052 - RNA, 16 nt, Mycobacterium tuberculosis H37Rv
cgcgccagcuugucgg

SEQ ID NO: 3301053 - RNA, 14 nt, Mycobacterium tuberculosis H37Rv
cgcgccaggcgcga

SEQ ID NO: 3301054 - RNA, 18 nt, Mycobacterium tuberculosis H37Rv
cgcgccaguggccaccau

SEQ ID NO: 3301055 - RNA, 19 nt, Mycobacterium tuberculosis H37Rv
cgcgccaucgccuccagcc

SEQ ID NO: 3301056 - RNA, 21 nt, Mycobacterium tuberculosis H37Rv
cgcgccaucgccuccagccgg

SEQ ID NO: 3301057 - RNA, 14 nt, Mycobacterium tuberculosis H37Rv
cgcgccaucgucgc

SEQ ID NO: 3301058 - RNA, 13 nt, Mycobacterium tuberculosis H37Rv
cgcgcccaccaug

SEQ ID NO: 3301059 - RNA, 16 nt, Mycobacterium tuberculosis H37Rv
cgcgcccaccccggcc

SEQ ID NO: 3301060 - RNA, 19 nt, Mycobacterium tuberculosis H37Rv
cgcgcccaccccggccgca

SEQ ID NO: 3301061 - RNA, 17 nt, Mycobacterium tuberculosis H37Rv
cgcgccccaguucgacg

SEQ ID NO: 3301062 - RNA, 15 nt, Mycobacterium tuberculosis H37Rv
cgcgcccgacacccg

SEQ ID NO: 3301063 - RNA, 12 nt, Mycobacterium tuberculosis H37Rv
cgcgcccgacga

SEQ ID NO: 3301064 - RNA, 22 nt, Mycobacterium tuberculosis H37Rv
cgcgcccgacgagauugccggg

SEQ ID NO: 3301065 - RNA, 19 nt, Mycobacterium tuberculosis H37Rv
cgcgcccgagaccggcacc

SEQ ID NO: 3301066 - RNA, 14 nt, Mycobacterium tuberculosis H37Rv
cgcgcccgcaccac

SEQ ID NO: 3301067 - RNA, 19 nt, Mycobacterium tuberculosis H37Rv
cgcgcccgcaccaccggcc

SEQ ID NO: 3301068 - RNA, 13 nt, Mycobacterium tuberculosis H37Rv
cgcgcccgccgau

SEQ ID NO: 3301069 - RNA, 12 nt, Mycobacterium tuberculosis H37Rv
cgcgcccgccgc

SEQ ID NO: 3301070 - RNA, 14 nt, Mycobacterium tuberculosis H37Rv
cgcgcccgccucau

SEQ ID NO: 3301071 - RNA, 17 nt, Mycobacterium tuberculosis H37Rv
cgcgcccgccucaucgg

SEQ ID NO: 3301072 - RNA, 19 nt, Mycobacterium tuberculosis H37Rv
cgcgcccggaucucggcgu

SEQ ID NO: 3301073 - RNA, 20 nt, Mycobacterium tuberculosis H37Rv
cgcgcccggaucucggcgua

SEQ ID NO: 3301074 - RNA, 24 nt, Mycobacterium tuberculosis H37Rv
cgcgcccggaucucggcguaggcg

SEQ ID NO: 3301075 - RNA, 13 nt, Mycobacterium tuberculosis H37Rv
cgcgcccggcgca

SEQ ID NO: 3301076 - RNA, 21 nt, Mycobacterium tuberculosis H37Rv
cgcgcccggcgcaagcgccgc

SEQ ID NO: 3301077 - RNA, 19 nt, Mycobacterium tuberculosis H37Rv
cgcgcccgggcauccuuca

SEQ ID NO: 3301078 - RNA, 14 nt, Mycobacterium tuberculosis H37Rv
cgcgcccuagcugg

SEQ ID NO: 3301079 - RNA, 20 nt, Mycobacterium tuberculosis H37Rv
cgcgcccuagcuggugcgcc

SEQ ID NO: 3301080 - RNA, 20 nt, Mycobacterium tuberculosis H37Rv
cgcgcccugcggaucggaca

SEQ ID NO: 3301081 - RNA, 16 nt, Mycobacterium tuberculosis H37Rv
cgcgcccuucagcacg

SEQ ID NO: 3301082 - RNA, 17 nt, Mycobacterium tuberculosis H37Rv
cgcgccgaaucgcgggc

SEQ ID NO: 3301083 - RNA, 14 nt, Mycobacterium tuberculosis H37Rv
cgcgccgaccaccg

SEQ ID NO: 3301084 - RNA, 19 nt, Mycobacterium tuberculosis H37Rv
cgcgccgaccaccgcugcg

SEQ ID NO: 3301085 - RNA, 21 nt, Mycobacterium tuberculosis H37Rv
cgcgcggguacuuacgggucg

SEQ ID NO: 3301086 - RNA, 16 nt, Mycobacterium tuberculosis H37Rv
cgcgcgggugcaaccg

SEQ ID NO: 3301087 - RNA, 15 nt, Mycobacterium tuberculosis H37Rv
cgcgcggguggcggc

SEQ ID NO: 3301088 - RNA, 16 nt, Mycobacterium tuberculosis H37Rv
cgcgcgguacugcgca

SEQ ID NO: 3301089 - RNA, 19 nt, Mycobacterium tuberculosis H37Rv
cgcgcgguacugcgcagcg

SEQ ID NO: 3301090 - RNA, 17 nt, Mycobacterium tuberculosis H37Rv
cgcgcgguagucgucgc

SEQ ID NO: 3301091 - RNA, 19 nt, Mycobacterium tuberculosis H37Rv
cgcgcggugauggucaccg

SEQ ID NO: 3301092 - RNA, 22 nt, Mycobacterium tuberculosis H37Rv
cgcgcgguuuucggcugccgcu

SEQ ID NO: 3301093 - RNA, 14 nt, Mycobacterium tuberculosis H37Rv
cgcgcguacccgau

SEQ ID NO: 3301094 - RNA, 14 nt, Mycobacterium tuberculosis H37Rv
cgcgcguaggccgc

SEQ ID NO: 3301095 - RNA, 16 nt, Mycobacterium tuberculosis H37Rv
cgcgcgucauaacgcu

SEQ ID NO: 3301096 - RNA, 14 nt, Mycobacterium tuberculosis H37Rv
cgcgcguccgucgg

SEQ ID NO: 3301097 - RNA, 14 nt, Mycobacterium tuberculosis H37Rv
cgcgcgucgcccag

SEQ ID NO: 3301098 - RNA, 13 nt, Mycobacterium tuberculosis H37Rv
cgcgcgugcagcc

SEQ ID NO: 3301099 - RNA, 17 nt, Mycobacterium tuberculosis H37Rv
cgcgcguggucgccccg

SEQ ID NO: 3301100 - RNA, 21 nt, Mycobacterium tuberculosis H37Rv
cgcgcguggucgccccgauga

SEQ ID NO: 3301101 - RNA, 16 nt, Mycobacterium tuberculosis H37Rv
cgcgcguuccagcaca

SEQ ID NO: 3301102 - RNA, 19 nt, Mycobacterium tuberculosis H37Rv
cgcgcguucggcgagcagc

SEQ ID NO: 3301103 - RNA, 20 nt, Mycobacterium tuberculosis H37Rv
cgcgcguucggcgagcagcg

SEQ ID NO: 3301104 - RNA, 15 nt, Mycobacterium tuberculosis H37Rv
cgcgcguucggcgcu

SEQ ID NO: 3301105 - RNA, 16 nt, Mycobacterium tuberculosis H37Rv
cgcgcguugaagucgc

SEQ ID NO: 3301106 - RNA, 23 nt, Mycobacterium tuberculosis H37Rv
cgcgcguugaagucgccggugac

SEQ ID NO: 3301107 - RNA, 15 nt, Mycobacterium tuberculosis H37Rv
cgcgcguugcgguca

SEQ ID NO: 3301108 - RNA, 21 nt, Mycobacterium tuberculosis H37Rv
cgcgcuaaggugggcacagcg

SEQ ID NO: 3301109 - RNA, 16 nt, Mycobacterium tuberculosis H37Rv
cgcgcuacgcggccga

SEQ ID NO: 3301110 - RNA, 19 nt, Mycobacterium tuberculosis H37Rv
cgcgcuacgcggccgaggu

SEQ ID NO: 3301111 - RNA, 13 nt, Mycobacterium tuberculosis H37Rv
cgcgcucaccgac

SEQ ID NO: 3301112 - RNA, 14 nt, Mycobacterium tuberculosis H37Rv
cgcgcucaccgggg

SEQ ID NO: 3301113 - RNA, 13 nt, Mycobacterium tuberculosis H37Rv
cgcgcucagccgg

SEQ ID NO: 3301114 - RNA, 16 nt, Mycobacterium tuberculosis H37Rv
cgcgcucagcuccggc

SEQ ID NO: 3301115 - RNA, 17 nt, Mycobacterium tuberculosis H37Rv
cgcgcucagcuccggcg

SEQ ID NO: 3301116 - RNA, 16 nt, Mycobacterium tuberculosis H37Rv
cgcgcucaucgaccgc

SEQ ID NO: 3301117 - RNA, 23 nt, Mycobacterium tuberculosis H37Rv
cgcgcucauguucucgaccgcgu

SEQ ID NO: 3301118 - RNA, 21 nt, Mycobacterium tuberculosis H37Rv
cgcgcuccaacaaugccagcu

SEQ ID NO: 3301119 - RNA, 22 nt, Mycobacterium tuberculosis H37Rv
cgcgcuccagauggggcucgag

SEQ ID NO: 3301120 - RNA, 17 nt, Mycobacterium tuberculosis H37Rv
cgcgcucgacgagcacg

SEQ ID NO: 3301121 - RNA, 23 nt, Mycobacterium tuberculosis H37Rv
cgcgcucgauggcggccaccagc

SEQ ID NO: 3301122 - RNA, 23 nt, Mycobacterium tuberculosis H37Rv
cgcgcucgcacccgcucggcgcg

SEQ ID NO: 3301123 - RNA, 13 nt, Mycobacterium tuberculosis H37Rv
cgcgcucgccgau

SEQ ID NO: 3301124 - RNA, 15 nt, Mycobacterium tuberculosis H37Rv
cgcgcucgcgcaagc

SEQ ID NO: 3301125 - RNA, 17 nt, Mycobacterium tuberculosis H37Rv
cgcgcucgcucaccggc

SEQ ID NO: 3301126 - RNA, 13 nt, Mycobacterium tuberculosis H37Rv
cgcgcucgggccc

SEQ ID NO: 3301127 - RNA, 20 nt, Mycobacterium tuberculosis H37Rv
cgcgcugaaaugccgucguc

SEQ ID NO: 3301128 - RNA, 15 nt, Mycobacterium tuberculosis H37Rv
cgcgcugaaucaccc

SEQ ID NO: 3301129 - RNA, 16 nt, Mycobacterium tuberculosis H37Rv
cgcgcugacccgccga

SEQ ID NO: 3301130 - RNA, 12 nt, Mycobacterium tuberculosis H37Rv
cgcgcugagcac

SEQ ID NO: 3301131 - RNA, 13 nt, Mycobacterium tuberculosis H37Rv
cgcgcugagcgac

SEQ ID NO: 3301132 - RNA, 16 nt, Mycobacterium tuberculosis H37Rv
cgcgcugagcgacugc

SEQ ID NO: 3301133 - RNA, 22 nt, Mycobacterium tuberculosis H37Rv
cgcgcugagcgacugcagcggc

SEQ ID NO: 3301134 - RNA, 15 nt, Mycobacterium tuberculosis H37Rv
cgcgcugaucagccc

SEQ ID NO: 3301135 - RNA, 14 nt, Mycobacterium tuberculosis H37Rv
cgcgcugcagcacg

SEQ ID NO: 3301136 - RNA, 15 nt, Mycobacterium tuberculosis H37Rv
cgcgcugcagcacgg

SEQ ID NO: 3301137 - RNA, 12 nt, Mycobacterium tuberculosis H37Rv
cgcgcugcgcag

SEQ ID NO: 3301138 - RNA, 13 nt, Mycobacterium tuberculosis H37Rv
cgcgcugcggccc

SEQ ID NO: 3301139 - RNA, 16 nt, Mycobacterium tuberculosis H37Rv
cgcgcugcgggaaccc

SEQ ID NO: 3301140 - RNA, 19 nt, Mycobacterium tuberculosis H37Rv
cgcgcugcgucgucgacga

SEQ ID NO: 3301141 - RNA, 19 nt, Mycobacterium tuberculosis H37Rv
cgcgcugcugucgauuucg

SEQ ID NO: 3301142 - RNA, 15 nt, Mycobacterium tuberculosis H37Rv
cgcgcugcuucuucg

SEQ ID NO: 3301143 - RNA, 20 nt, Mycobacterium tuberculosis H37Rv
cgcgcuggaccugaugagcu

SEQ ID NO: 3301144 - RNA, 18 nt, Mycobacterium tuberculosis H37Rv
cgcgcugggcgcgcucau

SEQ ID NO: 3301145 - RNA, 20 nt, Mycobacterium tuberculosis H37Rv
cgcgcuggucaacuccacgc

SEQ ID NO: 3301146 - RNA, 16 nt, Mycobacterium tuberculosis H37Rv
cgcgcuggucggagac

SEQ ID NO: 3301147 - RNA, 23 nt, Mycobacterium tuberculosis H37Rv
cgcgcuucacagccaccagccgg

SEQ ID NO: 3301148 - RNA, 20 nt, Mycobacterium tuberculosis H37Rv
cgcgcuucaggcaucaccgg

SEQ ID NO: 3301149 - RNA, 17 nt, Mycobacterium tuberculosis H37Rv
cgcgcuugcgaucgccg

SEQ ID NO: 3301150 - RNA, 18 nt, Mycobacterium tuberculosis H37Rv
cgcgcuugcgaucgccgc

SEQ ID NO: 3301151 - RNA, 20 nt, Mycobacterium tuberculosis H37Rv
cgcgcuugcgaucgccgcua

SEQ ID NO: 3301152 - RNA, 16 nt, Mycobacterium tuberculosis H37Rv
cgcgcuugcgaucggc

SEQ ID NO: 3301153 - RNA, 18 nt, Mycobacterium tuberculosis H37Rv
cgcgcuugcgaucggcac

SEQ ID NO: 3301154 - RNA, 14 nt, Mycobacterium tuberculosis H37Rv
cgcgcuugcgccgc

SEQ ID NO: 3301155 - RNA, 23 nt, Mycobacterium tuberculosis H37Rv
cgcgcuuuccucaccagccguca

SEQ ID NO: 3301156 - RNA, 16 nt, Mycobacterium tuberculosis H37Rv
cgcggaaaccaucgcc

SEQ ID NO: 3301157 - RNA, 15 nt, Mycobacterium tuberculosis H37Rv
cgcggaacgcgucgc

SEQ ID NO: 3301158 - RNA, 20 nt, Mycobacterium tuberculosis H37Rv
cgcggaacucgucgcugccc

SEQ ID NO: 3301159 - RNA, 14 nt, Mycobacterium tuberculosis H37Rv
cgcggaagccgccu

SEQ ID NO: 3301160 - RNA, 20 nt, Mycobacterium tuberculosis H37Rv
cgcggaagccgccuaggacu

SEQ ID NO: 3301161 - RNA, 15 nt, Mycobacterium tuberculosis H37Rv
cgcggaaggccagcu

SEQ ID NO: 3301162 - RNA, 19 nt, Mycobacterium tuberculosis H37Rv
cgcggaauccgcggcgauc

SEQ ID NO: 3301163 - RNA, 20 nt, Mycobacterium tuberculosis H37Rv
cgcggaauccgcggcgauca

SEQ ID NO: 3301164 - RNA, 16 nt, Mycobacterium tuberculosis H37Rv
cgcggacaccgcggcg

SEQ ID NO: 3301165 - RNA, 13 nt, Mycobacterium tuberculosis H37Rv
cgcggacacucgc

SEQ ID NO: 3301166 - RNA, 15 nt, Mycobacterium tuberculosis H37Rv
cgcggacacucgcgg

SEQ ID NO: 3301167 - RNA, 16 nt, Mycobacterium tuberculosis H37Rv
cgcggacacugcgaag

SEQ ID NO: 3301168 - RNA, 20 nt, Mycobacterium tuberculosis H37Rv
cgcggacagcccggacgcgc

SEQ ID NO: 3301169 - RNA, 19 nt, Mycobacterium tuberculosis H37Rv
cgcggacaugacagccccg

SEQ ID NO: 3301170 - RNA, 15 nt, Mycobacterium tuberculosis H37Rv
cgcggaccagagugg

SEQ ID NO: 3301171 - RNA, 12 nt, Mycobacterium tuberculosis H37Rv
cgcggacccgcg

SEQ ID NO: 3301172 - RNA, 15 nt, Mycobacterium tuberculosis H37Rv
cgcggacccgcgcgu

SEQ ID NO: 3301173 - RNA, 15 nt, Mycobacterium tuberculosis H37Rv
cgcggaccucggcga

SEQ ID NO: 3301174 - RNA, 22 nt, Mycobacterium tuberculosis H37Rv
cgcggacgcaacucgacgcgua

SEQ ID NO: 3301175 - RNA, 23 nt, Mycobacterium tuberculosis H37Rv
cgcggacucgggcaggccccacu

SEQ ID NO: 3301176 - RNA, 20 nt, Mycobacterium tuberculosis H37Rv
cgcggacucguagcaccggu

SEQ ID NO: 3301177 - RNA, 21 nt, Mycobacterium tuberculosis H37Rv
cgcggacuucguuccgugccg

SEQ ID NO: 3301178 - RNA, 15 nt, Mycobacterium tuberculosis H37Rv
cgcggacuuggcggu

SEQ ID NO: 3301179 - RNA, 16 nt, Mycobacterium tuberculosis H37Rv
cgcggagagccugcuc

SEQ ID NO: 3301180 - RNA, 13 nt, Mycobacterium tuberculosis H37Rv
cgcggagccagga

SEQ ID NO: 3301181 - RNA, 18 nt, Mycobacterium tuberculosis H37Rv
cgcggaggcggccagccu

SEQ ID NO: 3301182 - RNA, 13 nt, Mycobacterium tuberculosis H37Rv
cgcggccggcgcu

SEQ ID NO: 3301183 - RNA, 15 nt, Mycobacterium tuberculosis H37Rv
cgcggccggcgcucg

SEQ ID NO: 3301184 - RNA, 13 nt, Mycobacterium tuberculosis H37Rv
cgcggccgggcgc

SEQ ID NO: 3301185 - RNA, 14 nt, Mycobacterium tuberculosis H37Rv
cgcggccgucgcgg

SEQ ID NO: 3301186 - RNA, 12 nt, Mycobacterium tuberculosis H37Rv
cgcggccucgua

SEQ ID NO: 3301187 - RNA, 16 nt, Mycobacterium tuberculosis H37Rv
cgcggccucguagucc

SEQ ID NO: 3301188 - RNA, 14 nt, Mycobacterium tuberculosis H37Rv
cgcggccugcacca

SEQ ID NO: 3301189 - RNA, 20 nt, Mycobacterium tuberculosis H37Rv
cgcggcgaacaucaccgucg

SEQ ID NO: 3301190 - RNA, 23 nt, Mycobacterium tuberculosis H37Rv
cgcggcgaaccgucucgcccccu

SEQ ID NO: 3301191 - RNA, 18 nt, Mycobacterium tuberculosis H37Rv
cgcggcgaccuguccggu

SEQ ID NO: 3301192 - RNA, 14 nt, Mycobacterium tuberculosis H37Rv
cgcggcgagagccu

SEQ ID NO: 3301193 - RNA, 16 nt, Mycobacterium tuberculosis H37Rv
cgcggcgagccucgcg

SEQ ID NO: 3301194 - RNA, 18 nt, Mycobacterium tuberculosis H37Rv
cgcggcgagccucgcgcg

SEQ ID NO: 3301195 - RNA, 16 nt, Mycobacterium tuberculosis H37Rv
cgcggcgagcuccgau

SEQ ID NO: 3301196 - RNA, 19 nt, Mycobacterium tuberculosis H37Rv
cgcggcgaguggcuccauc

SEQ ID NO: 3301197 - RNA, 14 nt, Mycobacterium tuberculosis H37Rv
cgcggcgaucugcg

SEQ ID NO: 3301198 - RNA, 17 nt, Mycobacterium tuberculosis H37Rv
cgcggcgaucugcgaca

SEQ ID NO: 3301199 - RNA, 17 nt, Mycobacterium tuberculosis H37Rv
cgcggcgcacaacccgu

SEQ ID NO: 3301200 - RNA, 21 nt, Mycobacterium tuberculosis H37Rv
cgcggcgcagcaccgucggca

SEQ ID NO: 3301201 - RNA, 20 nt, Mycobacterium tuberculosis H37Rv
cgcggcgcagcacggcggcc

SEQ ID NO: 3301202 - RNA, 23 nt, Mycobacterium tuberculosis H37Rv
cgcggcgccacccgcgccgccag

SEQ ID NO: 3301203 - RNA, 13 nt, Mycobacterium tuberculosis H37Rv
cgcggcgccagau

SEQ ID NO: 3301204 - RNA, 16 nt, Mycobacterium tuberculosis H37Rv
cgcggcgcccggcgga

SEQ ID NO: 3301205 - RNA, 12 nt, Mycobacterium tuberculosis H37Rv
cgcggcgccgcc

SEQ ID NO: 3301206 - RNA, 16 nt, Mycobacterium tuberculosis H37Rv
cgcggcgcgcugaaau

SEQ ID NO: 3301207 - RNA, 12 nt, Mycobacterium tuberculosis H37Rv
cgcggcgcggcc

SEQ ID NO: 3301208 - RNA, 15 nt, Mycobacterium tuberculosis H37Rv
cgcggcgcggccgca

SEQ ID NO: 3301209 - RNA, 19 nt, Mycobacterium tuberculosis H37Rv
cgcggcgcggcgggcagcg

SEQ ID NO: 3301210 - RNA, 19 nt, Mycobacterium tuberculosis H37Rv
cgcggcgcgggucacgccg

SEQ ID NO: 3301211 - RNA, 21 nt, Mycobacterium tuberculosis H37Rv
cgcggcggaaggcgucgaaca

SEQ ID NO: 3301212 - RNA, 16 nt, Mycobacterium tuberculosis H37Rv
cgcggcggccagcgca

SEQ ID NO: 3301213 - RNA, 17 nt, Mycobacterium tuberculosis H37Rv
cgcggcggccgcggcuu

SEQ ID NO: 3301214 - RNA, 16 nt, Mycobacterium tuberculosis H37Rv
cgcggcggccuccacc

SEQ ID NO: 3301215 - RNA, 18 nt, Mycobacterium tuberculosis H37Rv
cgcggcggccuccaccac

SEQ ID NO: 3301216 - RNA, 12 nt, Mycobacterium tuberculosis H37Rv
cgcggcggcgcc

SEQ ID NO: 3301217 - RNA, 14 nt, Mycobacterium tuberculosis H37Rv
cgcggcggcggcca

SEQ ID NO: 3301218 - RNA, 13 nt, Mycobacterium tuberculosis H37Rv
cgcggcggcgucg

SEQ ID NO: 3301219 - RNA, 13 nt, Mycobacterium tuberculosis H37Rv
cgcggcgggcagc

SEQ ID NO: 3301220 - RNA, 19 nt, Mycobacterium tuberculosis H37Rv
cgcggcgggcagcgggccc

SEQ ID NO: 3301221 - RNA, 14 nt, Mycobacterium tuberculosis H37Rv
cgcggcgggcccga

SEQ ID NO: 3301222 - RNA, 15 nt, Mycobacterium tuberculosis H37Rv
cgcggcgggcccgau

SEQ ID NO: 3301223 - RNA, 21 nt, Mycobacterium tuberculosis H37Rv
cgcggcggguccucgcggagc

SEQ ID NO: 3301224 - RNA, 20 nt, Mycobacterium tuberculosis H37Rv
cgcggcggucagucccguga

SEQ ID NO: 3301225 - RNA, 23 nt, Mycobacterium tuberculosis H37Rv
cgcggcggucagucccgugacga

SEQ ID NO: 3301226 - RNA, 21 nt, Mycobacterium tuberculosis H37Rv
cgcggcggucccugaagccag

SEQ ID NO: 3301227 - RNA, 22 nt, Mycobacterium tuberculosis H37Rv
cgcggcgguuaucgucggguca

SEQ ID NO: 3301228 - RNA, 12 nt, Mycobacterium tuberculosis H37Rv
cgcggcgucgcc

SEQ ID NO: 3301229 - RNA, 19 nt, Mycobacterium tuberculosis H37Rv
cgcggcgucggucgggugg

SEQ ID NO: 3301230 - RNA, 15 nt, Mycobacterium tuberculosis H37Rv
cgcggcgugcgcggu

SEQ ID NO: 3301231 - RNA, 17 nt, Mycobacterium tuberculosis H37Rv
cgcggcgugcgcgguga

SEQ ID NO: 3301232 - RNA, 20 nt, Mycobacterium tuberculosis H37Rv
cgcggcgugcgcggugaugg

SEQ ID NO: 3301233 - RNA, 20 nt, Mycobacterium tuberculosis H37Rv
cgcggcgugcuugagcacgu

SEQ ID NO: 3301234 - RNA, 15 nt, Mycobacterium tuberculosis H37Rv
cgcggcguucgccgg

SEQ ID NO: 3301235 - RNA, 20 nt, Mycobacterium tuberculosis H37Rv
cgcggcguucggcuucacug

SEQ ID NO: 3301236 - RNA, 21 nt, Mycobacterium tuberculosis H37Rv
cgcggcguugugaccgccgau

SEQ ID NO: 3301237 - RNA, 18 nt, Mycobacterium tuberculosis H37Rv
cgcggcuacaucggcggc

SEQ ID NO: 3301238 - RNA, 21 nt, Mycobacterium tuberculosis H37Rv
cgcggcuacaucggcggcguc

SEQ ID NO: 3301239 - RNA, 16 nt, Mycobacterium tuberculosis H37Rv
cgcggcuaggccaagc

SEQ ID NO: 3301240 - RNA, 20 nt, Mycobacterium tuberculosis H37Rv
cgcggcuaggccagcacggc

SEQ ID NO: 3301241 - RNA, 17 nt, Mycobacterium tuberculosis H37Rv
cgcggcucaaucuccuc

SEQ ID NO: 3301242 - RNA, 23 nt, Mycobacterium tuberculosis H37Rv
cgcggcuccguuguccagcgcga

SEQ ID NO: 3301243 - RNA, 16 nt, Mycobacterium tuberculosis H37Rv
cgcggcugacaagccu

SEQ ID NO: 3301244 - RNA, 16 nt, Mycobacterium tuberculosis H37Rv
cgcggcugccagaaug

SEQ ID NO: 3301245 - RNA, 23 nt, Mycobacterium tuberculosis H37Rv
cgcggcugccagaaugggcggca

SEQ ID NO: 3301246 - RNA, 21 nt, Mycobacterium tuberculosis H37Rv
cgcggcugccaucccgauccc

SEQ ID NO: 3301247 - RNA, 19 nt, Mycobacterium tuberculosis H37Rv
cgcggcugccgucuccugg

SEQ ID NO: 3301248 - RNA, 18 nt, Mycobacterium tuberculosis H37Rv
cgcggcugcgucgucugc

SEQ ID NO: 3301249 - RNA, 21 nt, Mycobacterium tuberculosis H37Rv
cgcggcugggggauaccgcug

SEQ ID NO: 3301250 - RNA, 20 nt, Mycobacterium tuberculosis H37Rv
cgcggcugugcccgaucagc

SEQ ID NO: 3301251 - RNA, 21 nt, Mycobacterium tuberculosis H37Rv
cgcggcugugcccgaucagcc

SEQ ID NO: 3301252 - RNA, 22 nt, Mycobacterium tuberculosis H37Rv
cgcggcugugcccgaucagccg

SEQ ID NO: 3301253 - RNA, 17 nt, Mycobacterium tuberculosis H37Rv
cgcggcuucacugcuag

SEQ ID NO: 3301254 - RNA, 16 nt, Mycobacterium tuberculosis H37Rv
cgcggcuucaguccgg

SEQ ID NO: 3301255 - RNA, 19 nt, Mycobacterium tuberculosis H37Rv
cgcggcuucaguccggccc

SEQ ID NO: 3301256 - RNA, 22 nt, Mycobacterium tuberculosis H37Rv
cgcggcuucaguccggcccccc

SEQ ID NO: 3301257 - RNA, 16 nt, Mycobacterium tuberculosis H37Rv
cgcggcuucgucgaca

SEQ ID NO: 3301258 - RNA, 21 nt, Mycobacterium tuberculosis H37Rv
cgcggcuuggccuagccgcgg

SEQ ID NO: 3301259 - RNA, 23 nt, Mycobacterium tuberculosis H37Rv
cgcggcuuggccuagccgcggca

SEQ ID NO: 3301260 - RNA, 20 nt, Mycobacterium tuberculosis H37Rv
cgcggcuuugacgcccggca

SEQ ID NO: 3301261 - RNA, 15 nt, Mycobacterium tuberculosis H37Rv
cgcgggaacgaugcc

SEQ ID NO: 3301262 - RNA, 15 nt, Mycobacterium tuberculosis H37Rv
cgcgggacaccaccg

SEQ ID NO: 3301263 - RNA, 16 nt, Mycobacterium tuberculosis H37Rv
cgcgggacaccaccgc

SEQ ID NO: 3301264 - RNA, 19 nt, Mycobacterium tuberculosis H37Rv
cgcgggaccuucgagccgc

SEQ ID NO: 3301265 - RNA, 21 nt, Mycobacterium tuberculosis H37Rv
cgcgggaccuucgagccgcac

SEQ ID NO: 3301266 - RNA, 18 nt, Mycobacterium tuberculosis H37Rv
cgcgggagguacccccag

SEQ ID NO: 3301267 - RNA, 13 nt, Mycobacterium tuberculosis H37Rv
cgcgggagucauc

SEQ ID NO: 3301268 - RNA, 22 nt, Mycobacterium tuberculosis H37Rv
cgcgggauccaggcccagccga

SEQ ID NO: 3301269 - RNA, 15 nt, Mycobacterium tuberculosis H37Rv
cgcgggcaagccgga

SEQ ID NO: 3301270 - RNA, 15 nt, Mycobacterium tuberculosis H37Rv
cgcgggcacuggugg

SEQ ID NO: 3301271 - RNA, 14 nt, Mycobacterium tuberculosis H37Rv
cgcgggcaguggca

SEQ ID NO: 3301272 - RNA, 18 nt, Mycobacterium tuberculosis H37Rv
cgcgggccaccgcuguca

SEQ ID NO: 3301273 - RNA, 14 nt, Mycobacterium tuberculosis H37Rv
cgcgggccagcacc

SEQ ID NO: 3301274 - RNA, 21 nt, Mycobacterium tuberculosis H37Rv
cgcgggccccaucgccuggau

SEQ ID NO: 3301275 - RNA, 16 nt, Mycobacterium tuberculosis H37Rv
cgcgggccgacgcagg

SEQ ID NO: 3301276 - RNA, 17 nt, Mycobacterium tuberculosis H37Rv
cgcgggccgacgcaggu

SEQ ID NO: 3301277 - RNA, 13 nt, Mycobacterium tuberculosis H37Rv
cgcgggccgcguc

SEQ ID NO: 3301278 - RNA, 21 nt, Mycobacterium tuberculosis H37Rv
cgcgguggcggugucggcgcc

SEQ ID NO: 3301279 - RNA, 15 nt, Mycobacterium tuberculosis H37Rv
cgcggugggcacagc

SEQ ID NO: 3301280 - RNA, 17 nt, Mycobacterium tuberculosis H37Rv
cgcggugggcacagcca

SEQ ID NO: 3301281 - RNA, 18 nt, Mycobacterium tuberculosis H37Rv
cgcggugggcacagccag

SEQ ID NO: 3301282 - RNA, 16 nt, Mycobacterium tuberculosis H37Rv
cgcggugggccccgau

SEQ ID NO: 3301283 - RNA, 17 nt, Mycobacterium tuberculosis H37Rv
cgcgguggggcgcgccg

SEQ ID NO: 3301284 - RNA, 19 nt, Mycobacterium tuberculosis H37Rv
cgcgguggggucgacgcag

SEQ ID NO: 3301285 - RNA, 14 nt, Mycobacterium tuberculosis H37Rv
cgcgguggucagca

SEQ ID NO: 3301286 - RNA, 22 nt, Mycobacterium tuberculosis H37Rv
cgcgguguagaagcgggcgucg

SEQ ID NO: 3301287 - RNA, 23 nt, Mycobacterium tuberculosis H37Rv
cgcgguguagaagcgggcgucgc

SEQ ID NO: 3301288 - RNA, 21 nt, Mycobacterium tuberculosis H37Rv
cgcggugugcggcagcccgcu

SEQ ID NO: 3301289 - RNA, 23 nt, Mycobacterium tuberculosis H37Rv
cgcggugugcggcagcccgcugg

SEQ ID NO: 3301290 - RNA, 23 nt, Mycobacterium tuberculosis H37Rv
cgcggugugcgugucacccaaug

SEQ ID NO: 3301291 - RNA, 11 nt, Mycobacterium tuberculosis H37Rv
cgcgguguucg

SEQ ID NO: 3301292 - RNA, 18 nt, Mycobacterium tuberculosis H37Rv
cgcgguuaccucaccgaa

SEQ ID NO: 3301293 - RNA, 18 nt, Mycobacterium tuberculosis H37Rv
cgcgguuaucgccgagau

SEQ ID NO: 3301294 - RNA, 14 nt, Mycobacterium tuberculosis H37Rv
cgcgguucgaugac

SEQ ID NO: 3301295 - RNA, 15 nt, Mycobacterium tuberculosis H37Rv
cgcgguugcugguca

SEQ ID NO: 3301296 - RNA, 23 nt, Mycobacterium tuberculosis H37Rv
cgcgguuggcaguggcgcggcga

SEQ ID NO: 3301297 - RNA, 14 nt, Mycobacterium tuberculosis H37Rv
cgcgguuggcggcg

SEQ ID NO: 3301298 - RNA, 21 nt, Mycobacterium tuberculosis H37Rv
cgcgguuggcugaugacgcgg

SEQ ID NO: 3301299 - RNA, 20 nt, Mycobacterium tuberculosis H37Rv
cgcgguuguccuccgacggg

SEQ ID NO: 3301300 - RNA, 17 nt, Mycobacterium tuberculosis H37Rv
cgcgguugugcugggug

SEQ ID NO: 3301301 - RNA, 21 nt, Mycobacterium tuberculosis H37Rv
cgcgguuguggcugaucccgg

SEQ ID NO: 3301302 - RNA, 15 nt, Mycobacterium tuberculosis H37Rv
cgcgguuguuucggc

SEQ ID NO: 3301303 - RNA, 17 nt, Mycobacterium tuberculosis H37Rv
cgcgguuuugugcgggc

SEQ ID NO: 3301304 - RNA, 22 nt, Mycobacterium tuberculosis H37Rv
cgcguaauccgagcgcggcggc

SEQ ID NO: 3301305 - RNA, 20 nt, Mycobacterium tuberculosis H37Rv
cgcguacaggccggccacca

SEQ ID NO: 3301306 - RNA, 15 nt, Mycobacterium tuberculosis H37Rv
cgcguaccacggugg

SEQ ID NO: 3301307 - RNA, 23 nt, Mycobacterium tuberculosis H37Rv
cgcguaccgguggaaacccugca

SEQ ID NO: 3301308 - RNA, 17 nt, Mycobacterium tuberculosis H37Rv
cgcguacuucgcuggaa

SEQ ID NO: 3301309 - RNA, 16 nt, Mycobacterium tuberculosis H37Rv
cgcguagaccagugac

SEQ ID NO: 3301310 - RNA, 15 nt, Mycobacterium tuberculosis H37Rv
cgcguagagcagcag

SEQ ID NO: 3301311 - RNA, 16 nt, Mycobacterium tuberculosis H37Rv
cgcguagagcagcagc

SEQ ID NO: 3301312 - RNA, 16 nt, Mycobacterium tuberculosis H37Rv
cgcguagcgcaggauc

SEQ ID NO: 3301313 - RNA, 23 nt, Mycobacterium tuberculosis H37Rv
cgcguagcucgcggggcgcaccg

SEQ ID NO: 3301314 - RNA, 17 nt, Mycobacterium tuberculosis H37Rv
cgcguagggccagcgcc

SEQ ID NO: 3301315 - RNA, 20 nt, Mycobacterium tuberculosis H37Rv
cgcguaguaaugcucgacgu

SEQ ID NO: 3301316 - RNA, 22 nt, Mycobacterium tuberculosis H37Rv
cgcguaguaaugcucgacguag

SEQ ID NO: 3301317 - RNA, 16 nt, Mycobacterium tuberculosis H37Rv
cgcguaguccgcaucc

SEQ ID NO: 3301318 - RNA, 13 nt, Mycobacterium tuberculosis H37Rv
cgcguagucgcgg

SEQ ID NO: 3301319 - RNA, 19 nt, Mycobacterium tuberculosis H37Rv
cgcguagugccacgaggac

SEQ ID NO: 3301320 - RNA, 12 nt, Mycobacterium tuberculosis H37Rv
cgcguaugccag

SEQ ID NO: 3301321 - RNA, 19 nt, Mycobacterium tuberculosis H37Rv
cgcgucaaccgaucggucg

SEQ ID NO: 3301322 - RNA, 23 nt, Mycobacterium tuberculosis H37Rv
cgcgucaacgcuguugucgucca

SEQ ID NO: 3301323 - RNA, 17 nt, Mycobacterium tuberculosis H37Rv
cgcgucacaccagcggg

SEQ ID NO: 3301324 - RNA, 16 nt, Mycobacterium tuberculosis H37Rv
cgcgucacggaccugg

SEQ ID NO: 3301325 - RNA, 14 nt, Mycobacterium tuberculosis H37Rv
cgcgucagccgcac

SEQ ID NO: 3301326 - RNA, 19 nt, Mycobacterium tuberculosis H37Rv
cgcgucagccgcaccccgc

SEQ ID NO: 3301327 - RNA, 23 nt, Mycobacterium tuberculosis H37Rv
cgcgucagccgcaccccgcccga

SEQ ID NO: 3301328 - RNA, 17 nt, Mycobacterium tuberculosis H37Rv
cgcgucagcggcgagca

SEQ ID NO: 3301329 - RNA, 11 nt, Mycobacterium tuberculosis H37Rv
cgcgucaucaa

SEQ ID NO: 3301330 - RNA, 17 nt, Mycobacterium tuberculosis H37Rv
cgcguccacccacgauc

SEQ ID NO: 3301331 - RNA, 20 nt, Mycobacterium tuberculosis H37Rv
cgcguccccagcgccaccgu

SEQ ID NO: 3301332 - RNA, 13 nt, Mycobacterium tuberculosis H37Rv
cgcgucccgccgc

SEQ ID NO: 3301333 - RNA, 14 nt, Mycobacterium tuberculosis H37Rv
cgcgucccgccgca

SEQ ID NO: 3301334 - RNA, 17 nt, Mycobacterium tuberculosis H37Rv
cgcgucccgccgcaccg

SEQ ID NO: 3301335 - RNA, 18 nt, Mycobacterium tuberculosis H37Rv
cgcgucccgccgcaccgc

SEQ ID NO: 3301336 - RNA, 20 nt, Mycobacterium tuberculosis H37Rv
cgcguccgcaggcgauugca

SEQ ID NO: 3301337 - RNA, 13 nt, Mycobacterium tuberculosis H37Rv
cgcguccgcgauc

SEQ ID NO: 3301338 - RNA, 14 nt, Mycobacterium tuberculosis H37Rv
cgcguccgggcagc

SEQ ID NO: 3301339 - RNA, 22 nt, Mycobacterium tuberculosis H37Rv
cgcguccgggcagccgcgccgc

SEQ ID NO: 3301340 - RNA, 21 nt, Mycobacterium tuberculosis H37Rv
cgcguccgggcucgcgcucga

SEQ ID NO: 3301341 - RNA, 20 nt, Mycobacterium tuberculosis H37Rv
cgcguccggugcaccaggua

SEQ ID NO: 3301342 - RNA, 12 nt, Mycobacterium tuberculosis H37Rv
cgcguccuccuc

SEQ ID NO: 3301343 - RNA, 13 nt, Mycobacterium tuberculosis H37Rv
cgcguccuccucg

SEQ ID NO: 3301344 - RNA, 14 nt, Mycobacterium tuberculosis H37Rv
cgcguccuccucgg

SEQ ID NO: 3301345 - RNA, 14 nt, Mycobacterium tuberculosis H37Rv
cgcguccucgccgc

SEQ ID NO: 3301346 - RNA, 18 nt, Mycobacterium tuberculosis H37Rv
cgcguccucgccgcacgc

SEQ ID NO: 3301347 - RNA, 22 nt, Mycobacterium tuberculosis H37Rv
cgcgucgaacugggcgcccgcg

SEQ ID NO: 3301348 - RNA, 21 nt, Mycobacterium tuberculosis H37Rv
cgcgucgaauuccggcucacc

SEQ ID NO: 3301349 - RNA, 22 nt, Mycobacterium tuberculosis H37Rv
cgcgucgaauuccggcucaccg

SEQ ID NO: 3301350 - RNA, 23 nt, Mycobacterium tuberculosis H37Rv
cgcgucgaauuccggcucaccga

SEQ ID NO: 3301351 - RNA, 22 nt, Mycobacterium tuberculosis H37Rv
cgcgucgacccgaacugggcga

SEQ ID NO: 3301352 - RNA, 16 nt, Mycobacterium tuberculosis H37Rv
cgcgucgacgagcggc

SEQ ID NO: 3301353 - RNA, 14 nt, Mycobacterium tuberculosis H37Rv
cgcgucgagcagca

SEQ ID NO: 3301354 - RNA, 22 nt, Mycobacterium tuberculosis H37Rv
cgcgucgagcagcaccacccgc

SEQ ID NO: 3301355 - RNA, 20 nt, Mycobacterium tuberculosis H37Rv
cgcgucgagugccgccaccg

SEQ ID NO: 3301356 - RNA, 18 nt, Mycobacterium tuberculosis H37Rv
cgcgucgaguuuugcggc

SEQ ID NO: 3301357 - RNA, 20 nt, Mycobacterium tuberculosis H37Rv
cgcgucgaucguuccgcugg

SEQ ID NO: 3301358 - RNA, 15 nt, Mycobacterium tuberculosis H37Rv
cgcgucgaucugugg

SEQ ID NO: 3301359 - RNA, 11 nt, Mycobacterium tuberculosis H37Rv
cgcgucgccga

SEQ ID NO: 3301360 - RNA, 13 nt, Mycobacterium tuberculosis H37Rv
cgcgucgccgaaa

SEQ ID NO: 3301361 - RNA, 21 nt, Mycobacterium tuberculosis H37Rv
cgcgucgcgaaaggccacgau

SEQ ID NO: 3301362 - RNA, 14 nt, Mycobacterium tuberculosis H37Rv
cgcgucgcgcgccu

SEQ ID NO: 3301363 - RNA, 17 nt, Mycobacterium tuberculosis H37Rv
cgcgucgcgcgcggcau

SEQ ID NO: 3301364 - RNA, 19 nt, Mycobacterium tuberculosis H37Rv
cgcgucgcgcgcggcaugg

SEQ ID NO: 3301365 - RNA, 20 nt, Mycobacterium tuberculosis H37Rv
cgcgucgcuguuggcgaagg

SEQ ID NO: 3301366 - RNA, 17 nt, Mycobacterium tuberculosis H37Rv
cgcgucggaccguuucg

SEQ ID NO: 3301367 - RNA, 14 nt, Mycobacterium tuberculosis H37Rv
cgcgucggagccgg

SEQ ID NO: 3301368 - RNA, 15 nt, Mycobacterium tuberculosis H37Rv
cgcgucggcaccgau

SEQ ID NO: 3301369 - RNA, 16 nt, Mycobacterium tuberculosis H37Rv
cgcgucggcaccgauc

SEQ ID NO: 3301370 - RNA, 23 nt, Mycobacterium tuberculosis H37Rv
cgcgucggccgaacaaccuucgg

SEQ ID NO: 3301371 - RNA, 14 nt, Mycobacterium tuberculosis H37Rv
cgcgucggcgauga

SEQ ID NO: 3301372 - RNA, 13 nt, Mycobacterium tuberculosis H37Rv
cgcgucggcggcc

SEQ ID NO: 3301373 - RNA, 17 nt, Mycobacterium tuberculosis H37Rv
cgcgucggcguuggggc

SEQ ID NO: 3301374 - RNA, 23 nt, Mycobacterium tuberculosis H37Rv
cgcuagcggauucagcgucgcca

SEQ ID NO: 3301375 - RNA, 20 nt, Mycobacterium tuberculosis H37Rv
cgcuaggacggcgcgagccg

SEQ ID NO: 3301376 - RNA, 17 nt, Mycobacterium tuberculosis H37Rv
cgcuaggcgauccagac

SEQ ID NO: 3301377 - RNA, 15 nt, Mycobacterium tuberculosis H37Rv
cgcuagggugagccc

SEQ ID NO: 3301378 - RNA, 14 nt, Mycobacterium tuberculosis H37Rv
cgcuaggucaggug

SEQ ID NO: 3301379 - RNA, 17 nt, Mycobacterium tuberculosis H37Rv
cgcuaucaugaccaccg

SEQ ID NO: 3301380 - RNA, 18 nt, Mycobacterium tuberculosis H37Rv
cgcuaucaugaccaccga

SEQ ID NO: 3301381 - RNA, 15 nt, Mycobacterium tuberculosis H37Rv
cgcuauccggcggcc

SEQ ID NO: 3301382 - RNA, 13 nt, Mycobacterium tuberculosis H37Rv
cgcuauggcauua

SEQ ID NO: 3301383 - RNA, 19 nt, Mycobacterium tuberculosis H37Rv
cgcuauggcccgggccgaa

SEQ ID NO: 3301384 - RNA, 22 nt, Mycobacterium tuberculosis H37Rv
cgcucaacaaucgguggucgua

SEQ ID NO: 3301385 - RNA, 19 nt, Mycobacterium tuberculosis H37Rv
cgcucaacgggccgcaucg

SEQ ID NO: 3301386 - RNA, 15 nt, Mycobacterium tuberculosis H37Rv
cgcucaccccgcgcu

SEQ ID NO: 3301387 - RNA, 15 nt, Mycobacterium tuberculosis H37Rv
cgcucacccgcccgg

SEQ ID NO: 3301388 - RNA, 16 nt, Mycobacterium tuberculosis H37Rv
cgcucacccgcccgga

SEQ ID NO: 3301389 - RNA, 18 nt, Mycobacterium tuberculosis H37Rv
cgcucacccgcccggaac

SEQ ID NO: 3301390 - RNA, 14 nt, Mycobacterium tuberculosis H37Rv
cgcucacccgccgc

SEQ ID NO: 3301391 - RNA, 16 nt, Mycobacterium tuberculosis H37Rv
cgcucacccggucgca

SEQ ID NO: 3301392 - RNA, 18 nt, Mycobacterium tuberculosis H37Rv
cgcucaccgacgcugacc

SEQ ID NO: 3301393 - RNA, 18 nt, Mycobacterium tuberculosis H37Rv
cgcucaccggggccgucg

SEQ ID NO: 3301394 - RNA, 21 nt, Mycobacterium tuberculosis H37Rv
cgcucaccggggccgucggca

SEQ ID NO: 3301395 - RNA, 21 nt, Mycobacterium tuberculosis H37Rv
cgcucaccuuuggccgcgacc

SEQ ID NO: 3301396 - RNA, 14 nt, Mycobacterium tuberculosis H37Rv
cgcucacgaagacc

SEQ ID NO: 3301397 - RNA, 17 nt, Mycobacterium tuberculosis H37Rv
cgcucacggcccgagcc

SEQ ID NO: 3301398 - RNA, 23 nt, Mycobacterium tuberculosis H37Rv
cgcucacugcagcgccucgaucc

SEQ ID NO: 3301399 - RNA, 19 nt, Mycobacterium tuberculosis H37Rv
cgcucagccguccgggcgg

SEQ ID NO: 3301400 - RNA, 19 nt, Mycobacterium tuberculosis H37Rv
cgcucagcgauuccacggc

SEQ ID NO: 3301401 - RNA, 16 nt, Mycobacterium tuberculosis H37Rv
cgcucagcgcggccac

SEQ ID NO: 3301402 - RNA, 21 nt, Mycobacterium tuberculosis H37Rv
cgcucagcgcggccacgccga

SEQ ID NO: 3301403 - RNA, 15 nt, Mycobacterium tuberculosis H37Rv
cgcucagggugcgcc

SEQ ID NO: 3301404 - RNA, 18 nt, Mycobacterium tuberculosis H37Rv
cgcucaguuuggccuggu

SEQ ID NO: 3301405 - RNA, 22 nt, Mycobacterium tuberculosis H37Rv
cgcucauccauucggcggcggc

SEQ ID NO: 3301406 - RNA, 11 nt, Mycobacterium tuberculosis H37Rv
cgcucaucgac

SEQ ID NO: 3301407 - RNA, 12 nt, Mycobacterium tuberculosis H37Rv
cgcucaucgacc

SEQ ID NO: 3301408 - RNA, 18 nt, Mycobacterium tuberculosis H37Rv
cgcucaucgggcacaucg

SEQ ID NO: 3301409 - RNA, 21 nt, Mycobacterium tuberculosis H37Rv
cgcucaucuguaaccuccucg

SEQ ID NO: 3301410 - RNA, 21 nt, Mycobacterium tuberculosis H37Rv
cgcucaugggcgccaucccgc

SEQ ID NO: 3301411 - RNA, 18 nt, Mycobacterium tuberculosis H37Rv
cgcucauguucucgaccg

SEQ ID NO: 3301412 - RNA, 22 nt, Mycobacterium tuberculosis H37Rv
cgcucauguucucgaccgcguc

SEQ ID NO: 3301413 - RNA, 22 nt, Mycobacterium tuberculosis H37Rv
cgcucauucgugcccgggcggu

SEQ ID NO: 3301414 - RNA, 18 nt, Mycobacterium tuberculosis H37Rv
cgcuccaacaacuccagc

SEQ ID NO: 3301415 - RNA, 16 nt, Mycobacterium tuberculosis H37Rv
cgcuccaccucggcgu

SEQ ID NO: 3301416 - RNA, 18 nt, Mycobacterium tuberculosis H37Rv
cgcuccaccucggcguug

SEQ ID NO: 3301417 - RNA, 18 nt, Mycobacterium tuberculosis H37Rv
cgcuccacguacgcggcu

SEQ ID NO: 3301418 - RNA, 13 nt, Mycobacterium tuberculosis H37Rv
cgcuccagauggg

SEQ ID NO: 3301419 - RNA, 14 nt, Mycobacterium tuberculosis H37Rv
cgcuccagaugggg

SEQ ID NO: 3301420 - RNA, 15 nt, Mycobacterium tuberculosis H37Rv
cgcuccagcacccgc

SEQ ID NO: 3301421 - RNA, 15 nt, Mycobacterium tuberculosis H37Rv
cgcuccagccgcgcg

SEQ ID NO: 3301422 - RNA, 19 nt, Mycobacterium tuberculosis H37Rv
cgcuccagcucggccagug

SEQ ID NO: 3301423 - RNA, 19 nt, Mycobacterium tuberculosis H37Rv
cgcuccaugacaaaccugc

SEQ ID NO: 3301424 - RNA, 22 nt, Mycobacterium tuberculosis H37Rv
cgcucccaagaaggacaucacg

SEQ ID NO: 3301425 - RNA, 20 nt, Mycobacterium tuberculosis H37Rv
cgcucccccgcuacgcgcgc

SEQ ID NO: 3301426 - RNA, 21 nt, Mycobacterium tuberculosis H37Rv
cgcucccccgcuacgcgcgcu

SEQ ID NO: 3301427 - RNA, 14 nt, Mycobacterium tuberculosis H37Rv
cgcucccgccggca

SEQ ID NO: 3301428 - RNA, 16 nt, Mycobacterium tuberculosis H37Rv
cgcucccgucucgaca

SEQ ID NO: 3301429 - RNA, 18 nt, Mycobacterium tuberculosis H37Rv
cgcucccucuacacccgg

SEQ ID NO: 3301430 - RNA, 21 nt, Mycobacterium tuberculosis H37Rv
cgcuccgaugugccgauuggc

SEQ ID NO: 3301431 - RNA, 21 nt, Mycobacterium tuberculosis H37Rv
cgcuccgccgucgccgccggc

SEQ ID NO: 3301432 - RNA, 17 nt, Mycobacterium tuberculosis H37Rv
cgcuccgcggcgcagca

SEQ ID NO: 3301433 - RNA, 12 nt, Mycobacterium tuberculosis H37Rv
cgcuccgcggcu

SEQ ID NO: 3301434 - RNA, 21 nt, Mycobacterium tuberculosis H37Rv
cgcuccggcccugccgccggc

SEQ ID NO: 3301435 - RNA, 20 nt, Mycobacterium tuberculosis H37Rv
cgcuccggcgugcgcaaggc

SEQ ID NO: 3301436 - RNA, 23 nt, Mycobacterium tuberculosis H37Rv
cgcuccgggaauggcgaccaccc

SEQ ID NO: 3301437 - RNA, 14 nt, Mycobacterium tuberculosis H37Rv
cgcuccuccggcac

SEQ ID NO: 3301438 - RNA, 18 nt, Mycobacterium tuberculosis H37Rv
cgcuccuccggcaccaac

SEQ ID NO: 3301439 - RNA, 19 nt, Mycobacterium tuberculosis H37Rv
cgcuccuccggcaccaacg

SEQ ID NO: 3301440 - RNA, 14 nt, Mycobacterium tuberculosis H37Rv
cgcuccugcucguc

SEQ ID NO: 3301441 - RNA, 17 nt, Mycobacterium tuberculosis H37Rv
cgcucgaaagagccgcu

SEQ ID NO: 3301442 - RNA, 15 nt, Mycobacterium tuberculosis H37Rv
cgcucgaacuccccg

SEQ ID NO: 3301443 - RNA, 16 nt, Mycobacterium tuberculosis H37Rv
cgcucgaacuccccgg

SEQ ID NO: 3301444 - RNA, 14 nt, Mycobacterium tuberculosis H37Rv
cgcucgaccagacg

SEQ ID NO: 3301445 - RNA, 21 nt, Mycobacterium tuberculosis H37Rv
cgcucgaccagacgcugccca

SEQ ID NO: 3301446 - RNA, 15 nt, Mycobacterium tuberculosis H37Rv
cgcucgacgaccacg

SEQ ID NO: 3301447 - RNA, 17 nt, Mycobacterium tuberculosis H37Rv
cgcucgacgacgggcgc

SEQ ID NO: 3301448 - RNA, 18 nt, Mycobacterium tuberculosis H37Rv
cgcucgacgacgggcgcc

SEQ ID NO: 3301449 - RNA, 15 nt, Mycobacterium tuberculosis H37Rv
cgcucgacggcccgc

SEQ ID NO: 3301450 - RNA, 22 nt, Mycobacterium tuberculosis H37Rv
cgcucgacguacagcgcggcgu

SEQ ID NO: 3301451 - RNA, 22 nt, Mycobacterium tuberculosis H37Rv
cgcucgagcaggcuggcguugg

SEQ ID NO: 3301452 - RNA, 17 nt, Mycobacterium tuberculosis H37Rv
cgcucgaggguggcgcg

SEQ ID NO: 3301453 - RNA, 19 nt, Mycobacterium tuberculosis H37Rv
cgcucgaucacuagcgccc

SEQ ID NO: 3301454 - RNA, 13 nt, Mycobacterium tuberculosis H37Rv
cgcucgaucaggu

SEQ ID NO: 3301455 - RNA, 19 nt, Mycobacterium tuberculosis H37Rv
cgcucgaucggcagccagg

SEQ ID NO: 3301456 - RNA, 15 nt, Mycobacterium tuberculosis H37Rv
cgcucgaucugcccg

SEQ ID NO: 3301457 - RNA, 19 nt, Mycobacterium tuberculosis H37Rv
cgcucgauggcggccacca

SEQ ID NO: 3301458 - RNA, 23 nt, Mycobacterium tuberculosis H37Rv
cgcucgauggcggccaccagcgc

SEQ ID NO: 3301459 - RNA, 22 nt, Mycobacterium tuberculosis H37Rv
cgcucgaugucccgagcccgcu

SEQ ID NO: 3301460 - RNA, 12 nt, Mycobacterium tuberculosis H37Rv
cgcucgcacagc

SEQ ID NO: 3301461 - RNA, 14 nt, Mycobacterium tuberculosis H37Rv
cgcucgcaccgccc

SEQ ID NO: 3301462 - RNA, 22 nt, Mycobacterium tuberculosis H37Rv
cgcucgcccgccgccaccagcu

SEQ ID NO: 3301463 - RNA, 22 nt, Mycobacterium tuberculosis H37Rv
cgcucgccgguaggcggccagc

SEQ ID NO: 3301464 - RNA, 14 nt, Mycobacterium tuberculosis H37Rv
cgcucgcgaaagag

SEQ ID NO: 3301465 - RNA, 22 nt, Mycobacterium tuberculosis H37Rv
cgcucgcgaaagagagcuaagu

SEQ ID NO: 3301466 - RNA, 16 nt, Mycobacterium tuberculosis H37Rv
cgcucgcgcacccugc

SEQ ID NO: 3301467 - RNA, 14 nt, Mycobacterium tuberculosis H37Rv
cgcucgcgcgcugg

SEQ ID NO: 3301468 - RNA, 21 nt, Mycobacterium tuberculosis H37Rv
cgcucgcgcgcugggcgcgcu

SEQ ID NO: 3301469 - RNA, 15 nt, Mycobacterium tuberculosis H37Rv
cgcucgcggcgacca

SEQ ID NO: 3301470 - RNA, 21 nt, Mycobacterium tuberculosis H37Rv
cgcugccaaacuaacggcagc

SEQ ID NO: 3301471 - RNA, 16 nt, Mycobacterium tuberculosis H37Rv
cgcugccaauccgauc

SEQ ID NO: 3301472 - RNA, 13 nt, Mycobacterium tuberculosis H37Rv
cgcugccacccau

SEQ ID NO: 3301473 - RNA, 23 nt, Mycobacterium tuberculosis H37Rv
cgcugccagcauugacccgacga

SEQ ID NO: 3301474 - RNA, 13 nt, Mycobacterium tuberculosis H37Rv
cgcugccagccgu

SEQ ID NO: 3301475 - RNA, 18 nt, Mycobacterium tuberculosis H37Rv
cgcugccagccguucccc

SEQ ID NO: 3301476 - RNA, 13 nt, Mycobacterium tuberculosis H37Rv
cgcugccagcggc

SEQ ID NO: 3301477 - RNA, 20 nt, Mycobacterium tuberculosis H37Rv
cgcugccagggugcgccggu

SEQ ID NO: 3301478 - RNA, 15 nt, Mycobacterium tuberculosis H37Rv
cgcugccaucgccuu

SEQ ID NO: 3301479 - RNA, 21 nt, Mycobacterium tuberculosis H37Rv
cgcugccauugccugggcgac

SEQ ID NO: 3301480 - RNA, 21 nt, Mycobacterium tuberculosis H37Rv
cgcugcccaaaagcgcggcaa

SEQ ID NO: 3301481 - RNA, 20 nt, Mycobacterium tuberculosis H37Rv
cgcugcccacggagggcagg

SEQ ID NO: 3301482 - RNA, 17 nt, Mycobacterium tuberculosis H37Rv
cgcugcccacgggccgg

SEQ ID NO: 3301483 - RNA, 19 nt, Mycobacterium tuberculosis H37Rv
cgcugcccaucacacccgg

SEQ ID NO: 3301484 - RNA, 16 nt, Mycobacterium tuberculosis H37Rv
cgcugcccaugcggca

SEQ ID NO: 3301485 - RNA, 13 nt, Mycobacterium tuberculosis H37Rv
cgcugccccgccg

SEQ ID NO: 3301486 - RNA, 14 nt, Mycobacterium tuberculosis H37Rv
cgcugcccgccagc

SEQ ID NO: 3301487 - RNA, 18 nt, Mycobacterium tuberculosis H37Rv
cgcugcccgccagcccau

SEQ ID NO: 3301488 - RNA, 13 nt, Mycobacterium tuberculosis H37Rv
cgcugcccgccgc

SEQ ID NO: 3301489 - RNA, 14 nt, Mycobacterium tuberculosis H37Rv
cgcugcccgcgcgg

SEQ ID NO: 3301490 - RNA, 15 nt, Mycobacterium tuberculosis H37Rv
cgcugcccgcgcggc

SEQ ID NO: 3301491 - RNA, 12 nt, Mycobacterium tuberculosis H37Rv
cgcugcccgcgg

SEQ ID NO: 3301492 - RNA, 20 nt, Mycobacterium tuberculosis H37Rv
cgcugccgaagcggccaccg

SEQ ID NO: 3301493 - RNA, 16 nt, Mycobacterium tuberculosis H37Rv
cgcugccgagcccacg

SEQ ID NO: 3301494 - RNA, 16 nt, Mycobacterium tuberculosis H37Rv
cgcugccgcccuugcc

SEQ ID NO: 3301495 - RNA, 21 nt, Mycobacterium tuberculosis H37Rv
cgcugccgccgagcuggcgcg

SEQ ID NO: 3301496 - RNA, 18 nt, Mycobacterium tuberculosis H37Rv
cgcugccgccgaucgaca

SEQ ID NO: 3301497 - RNA, 14 nt, Mycobacterium tuberculosis H37Rv
cgcugccgccgccg

SEQ ID NO: 3301498 - RNA, 15 nt, Mycobacterium tuberculosis H37Rv
cgcugccgccgccgg

SEQ ID NO: 3301499 - RNA, 16 nt, Mycobacterium tuberculosis H37Rv
cgcugccgccgccggc

SEQ ID NO: 3301500 - RNA, 18 nt, Mycobacterium tuberculosis H37Rv
cgcugccgccgccggcgg

SEQ ID NO: 3301501 - RNA, 21 nt, Mycobacterium tuberculosis H37Rv
cgcugccgccggugccgccau

SEQ ID NO: 3301502 - RNA, 16 nt, Mycobacterium tuberculosis H37Rv
cgcugccgcugcgcgu

SEQ ID NO: 3301503 - RNA, 14 nt, Mycobacterium tuberculosis H37Rv
cgcugccggcagcg

SEQ ID NO: 3301504 - RNA, 13 nt, Mycobacterium tuberculosis H37Rv
cgcugccggccgc

SEQ ID NO: 3301505 - RNA, 14 nt, Mycobacterium tuberculosis H37Rv
cgcugccggccgcg

SEQ ID NO: 3301506 - RNA, 13 nt, Mycobacterium tuberculosis H37Rv
cgcugccggcgcc

SEQ ID NO: 3301507 - RNA, 15 nt, Mycobacterium tuberculosis H37Rv
cgcugccggcgccgc

SEQ ID NO: 3301508 - RNA, 16 nt, Mycobacterium tuberculosis H37Rv
cgcugccggcgccgcc

SEQ ID NO: 3301509 - RNA, 22 nt, Mycobacterium tuberculosis H37Rv
cgcugccggugucucccuugcc

SEQ ID NO: 3301510 - RNA, 23 nt, Mycobacterium tuberculosis H37Rv
cgcugccucuugcucggcgugcu

SEQ ID NO: 3301511 - RNA, 17 nt, Mycobacterium tuberculosis H37Rv
cgcugcgacuggccguc

SEQ ID NO: 3301512 - RNA, 18 nt, Mycobacterium tuberculosis H37Rv
cgcugcgaugcugaucac

SEQ ID NO: 3301513 - RNA, 19 nt, Mycobacterium tuberculosis H37Rv
cgcugcgccgucgcagcca

SEQ ID NO: 3301514 - RNA, 12 nt, Mycobacterium tuberculosis H37Rv
cgcugcgcgacu

SEQ ID NO: 3301515 - RNA, 13 nt, Mycobacterium tuberculosis H37Rv
cgcugcgcggccc

SEQ ID NO: 3301516 - RNA, 15 nt, Mycobacterium tuberculosis H37Rv
cgcugcggcaccacc

SEQ ID NO: 3301517 - RNA, 15 nt, Mycobacterium tuberculosis H37Rv
cgcugcggcccacac

SEQ ID NO: 3301518 - RNA, 19 nt, Mycobacterium tuberculosis H37Rv
cgcugcggcccacaccagc

SEQ ID NO: 3301519 - RNA, 18 nt, Mycobacterium tuberculosis H37Rv
cgcugcggcgcuggccag

SEQ ID NO: 3301520 - RNA, 13 nt, Mycobacterium tuberculosis H37Rv
cgcugcggcggcu

SEQ ID NO: 3301521 - RNA, 16 nt, Mycobacterium tuberculosis H37Rv
cgcugcggcggcuuug

SEQ ID NO: 3301522 - RNA, 15 nt, Mycobacterium tuberculosis H37Rv
cgcugcggcgguaug

SEQ ID NO: 3301523 - RNA, 15 nt, Mycobacterium tuberculosis H37Rv
cgcugcgggucccaa

SEQ ID NO: 3301524 - RNA, 17 nt, Mycobacterium tuberculosis H37Rv
cgcugcggugccggccc

SEQ ID NO: 3301525 - RNA, 18 nt, Mycobacterium tuberculosis H37Rv
cgcugcggugccggcccu

SEQ ID NO: 3301526 - RNA, 16 nt, Mycobacterium tuberculosis H37Rv
cgcugcuccucgcggu

SEQ ID NO: 3301527 - RNA, 22 nt, Mycobacterium tuberculosis H37Rv
cgcugcucugagcuuggucgcc

SEQ ID NO: 3301528 - RNA, 15 nt, Mycobacterium tuberculosis H37Rv
cgcugcucuggacgg

SEQ ID NO: 3301529 - RNA, 16 nt, Mycobacterium tuberculosis H37Rv
cgcugcugauggugac

SEQ ID NO: 3301530 - RNA, 13 nt, Mycobacterium tuberculosis H37Rv
cgcugcugccauu

SEQ ID NO: 3301531 - RNA, 13 nt, Mycobacterium tuberculosis H37Rv
cgcugcugccgca

SEQ ID NO: 3301532 - RNA, 16 nt, Mycobacterium tuberculosis H37Rv
cgcugcuggcagacca

SEQ ID NO: 3301533 - RNA, 22 nt, Mycobacterium tuberculosis H37Rv
cgcugcuugaggucccgugcgc

SEQ ID NO: 3301534 - RNA, 14 nt, Mycobacterium tuberculosis H37Rv
cgcugcuugcgggc

SEQ ID NO: 3301535 - RNA, 19 nt, Mycobacterium tuberculosis H37Rv
cgcugcuugcgggcucgug

SEQ ID NO: 3301536 - RNA, 22 nt, Mycobacterium tuberculosis H37Rv
cgcuggaaaccucuucgggugc

SEQ ID NO: 3301537 - RNA, 21 nt, Mycobacterium tuberculosis H37Rv
cgcuggaacuuggcgucgaca

SEQ ID NO: 3301538 - RNA, 19 nt, Mycobacterium tuberculosis H37Rv
cgcuggaccgggucgggca

SEQ ID NO: 3301539 - RNA, 21 nt, Mycobacterium tuberculosis H37Rv
cgcuggaggacccgcuacgac

SEQ ID NO: 3301540 - RNA, 15 nt, Mycobacterium tuberculosis H37Rv
cgcuggaggccacca

SEQ ID NO: 3301541 - RNA, 16 nt, Mycobacterium tuberculosis H37Rv
cgcuggaggccaccac

SEQ ID NO: 3301542 - RNA, 23 nt, Mycobacterium tuberculosis H37Rv
cgcuggaucgagcuaguucggcg

SEQ ID NO: 3301543 - RNA, 13 nt, Mycobacterium tuberculosis H37Rv
cgcuggaucgcgu

SEQ ID NO: 3301544 - RNA, 22 nt, Mycobacterium tuberculosis H37Rv
cgcuggaucuucgacaggccac

SEQ ID NO: 3301545 - RNA, 20 nt, Mycobacterium tuberculosis H37Rv
cgcuggaugugggcgcucgc

SEQ ID NO: 3301546 - RNA, 15 nt, Mycobacterium tuberculosis H37Rv
cgcuggcaaguccgg

SEQ ID NO: 3301547 - RNA, 21 nt, Mycobacterium tuberculosis H37Rv
cgcuggcacacuccugcacca

SEQ ID NO: 3301548 - RNA, 12 nt, Mycobacterium tuberculosis H37Rv
cgcuggccacga

SEQ ID NO: 3301549 - RNA, 18 nt, Mycobacterium tuberculosis H37Rv
cgcuggccacgauccgcg

SEQ ID NO: 3301550 - RNA, 15 nt, Mycobacterium tuberculosis H37Rv
cgcuggccauggugg

SEQ ID NO: 3301551 - RNA, 12 nt, Mycobacterium tuberculosis H37Rv
cgcuggcccgcc

SEQ ID NO: 3301552 - RNA, 15 nt, Mycobacterium tuberculosis H37Rv
cgcuggcccgccaga

SEQ ID NO: 3301553 - RNA, 20 nt, Mycobacterium tuberculosis H37Rv
cgcuggccgucgaagacgaa

SEQ ID NO: 3301554 - RNA, 18 nt, Mycobacterium tuberculosis H37Rv
cgcuggccuccagcuugg

SEQ ID NO: 3301555 - RNA, 22 nt, Mycobacterium tuberculosis H37Rv
cgcuggcgcccuugccggcgag

SEQ ID NO: 3301556 - RNA, 14 nt, Mycobacterium tuberculosis H37Rv
cgcuggcgggcagc

SEQ ID NO: 3301557 - RNA, 14 nt, Mycobacterium tuberculosis H37Rv
cgcuggcgggcggc

SEQ ID NO: 3301558 - RNA, 17 nt, Mycobacterium tuberculosis H37Rv
cgcuggcgggcggcgug

SEQ ID NO: 3301559 - RNA, 12 nt, Mycobacterium tuberculosis H37Rv
cgcuggcgucgu

SEQ ID NO: 3301560 - RNA, 23 nt, Mycobacterium tuberculosis H37Rv
cgcuggcuacgccuccuucguga

SEQ ID NO: 3301561 - RNA, 16 nt, Mycobacterium tuberculosis H37Rv
cgcuggcucaucgaag

SEQ ID NO: 3301562 - RNA, 20 nt, Mycobacterium tuberculosis H37Rv
cgcuggcuugggccagcgca

SEQ ID NO: 3301563 - RNA, 16 nt, Mycobacterium tuberculosis H37Rv
cgcugggacgggcgcg

SEQ ID NO: 3301564 - RNA, 19 nt, Mycobacterium tuberculosis H37Rv
cgcugggacgggcgcgucg

SEQ ID NO: 3301565 - RNA, 16 nt, Mycobacterium tuberculosis H37Rv
cgcugggacggucgcu

SEQ ID NO: 3301566 - RNA, 22 nt, Mycobacterium tuberculosis H37Rv
cgcugggacggucgcucggcau

SEQ ID NO: 3301567 - RNA, 13 nt, Mycobacterium tuberculosis H37Rv
cggaacggccagg

SEQ ID NO: 3301568 - RNA, 22 nt, Mycobacterium tuberculosis H37Rv
cggaacgugaccgacgccgucg

SEQ ID NO: 3301569 - RNA, 15 nt, Mycobacterium tuberculosis H37Rv
cggaacugcgcaaca

SEQ ID NO: 3301570 - RNA, 14 nt, Mycobacterium tuberculosis H37Rv
cggaagaagcagua

SEQ ID NO: 3301571 - RNA, 21 nt, Mycobacterium tuberculosis H37Rv
cggaagaccgcgggaccuucg

SEQ ID NO: 3301572 - RNA, 23 nt, Mycobacterium tuberculosis H37Rv
cggaagcccuuguagcacaccga

SEQ ID NO: 3301573 - RNA, 12 nt, Mycobacterium tuberculosis H37Rv
cggaagcgccgg

SEQ ID NO: 3301574 - RNA, 17 nt, Mycobacterium tuberculosis H37Rv
cggaaggacggcagcca

SEQ ID NO: 3301575 - RNA, 13 nt, Mycobacterium tuberculosis H37Rv
cggaaggccagcu

SEQ ID NO: 3301576 - RNA, 19 nt, Mycobacterium tuberculosis H37Rv
cggaaggcccggcgcggcc

SEQ ID NO: 3301577 - RNA, 22 nt, Mycobacterium tuberculosis H37Rv
cggaaguagcgcaaugcggccc

SEQ ID NO: 3301578 - RNA, 21 nt, Mycobacterium tuberculosis H37Rv
cggaauacccggcccauuguc

SEQ ID NO: 3301579 - RNA, 16 nt, Mycobacterium tuberculosis H37Rv
cggaauagcaacgcug

SEQ ID NO: 3301580 - RNA, 21 nt, Mycobacterium tuberculosis H37Rv
cggaauagcaacgcugcagca

SEQ ID NO: 3301581 - RNA, 23 nt, Mycobacterium tuberculosis H37Rv
cggaauccccccugucgccgaug

SEQ ID NO: 3301582 - RNA, 21 nt, Mycobacterium tuberculosis H37Rv
cggaaucgcaccgugugggcc

SEQ ID NO: 3301583 - RNA, 23 nt, Mycobacterium tuberculosis H37Rv
cggaaucgcaucuagguucaguu

SEQ ID NO: 3301584 - RNA, 15 nt, Mycobacterium tuberculosis H37Rv
cggaaucggagucuu

SEQ ID NO: 3301585 - RNA, 12 nt, Mycobacterium tuberculosis H37Rv
cggaaucgucgc

SEQ ID NO: 3301586 - RNA, 17 nt, Mycobacterium tuberculosis H37Rv
cggaaucgucgcggccg

SEQ ID NO: 3301587 - RNA, 16 nt, Mycobacterium tuberculosis H37Rv
cggaaucgucggcgcg

SEQ ID NO: 3301588 - RNA, 17 nt, Mycobacterium tuberculosis H37Rv
cggaauggaggccgccg

SEQ ID NO: 3301589 - RNA, 18 nt, Mycobacterium tuberculosis H37Rv
cggaauggaggccgccga

SEQ ID NO: 3301590 - RNA, 21 nt, Mycobacterium tuberculosis H37Rv
cggaauguagccgacuucguc

SEQ ID NO: 3301591 - RNA, 23 nt, Mycobacterium tuberculosis H37Rv
cggaauguugcgagugagcucag

SEQ ID NO: 3301592 - RNA, 18 nt, Mycobacterium tuberculosis H37Rv
cggacaaaagaacgccag

SEQ ID NO: 3301593 - RNA, 16 nt, Mycobacterium tuberculosis H37Rv
cggacaaagccgucgc

SEQ ID NO: 3301594 - RNA, 19 nt, Mycobacterium tuberculosis H37Rv
cggacaaagcugcucgucg

SEQ ID NO: 3301595 - RNA, 18 nt, Mycobacterium tuberculosis H37Rv
cggacaauuccgcuugcu

SEQ ID NO: 3301596 - RNA, 14 nt, Mycobacterium tuberculosis H37Rv
cggacacacaggcg

SEQ ID NO: 3301597 - RNA, 13 nt, Mycobacterium tuberculosis H37Rv
cggacacgaucgc

SEQ ID NO: 3301598 - RNA, 16 nt, Mycobacterium tuberculosis H37Rv
cggacacggcagccuu

SEQ ID NO: 3301599 - RNA, 16 nt, Mycobacterium tuberculosis H37Rv
cggacagcgccuggcc

SEQ ID NO: 3301600 - RNA, 21 nt, Mycobacterium tuberculosis H37Rv
cggacagcguaucucccaacg

SEQ ID NO: 3301601 - RNA, 14 nt, Mycobacterium tuberculosis H37Rv
cggacagcucgcgg

SEQ ID NO: 3301602 - RNA, 16 nt, Mycobacterium tuberculosis H37Rv
cggacagcucgcggua

SEQ ID NO: 3301603 - RNA, 22 nt, Mycobacterium tuberculosis H37Rv
cggacaggcuugacugcacacc

SEQ ID NO: 3301604 - RNA, 14 nt, Mycobacterium tuberculosis H37Rv
cggacauaccgcga

SEQ ID NO: 3301605 - RNA, 18 nt, Mycobacterium tuberculosis H37Rv
cggacaucaccggcaugc

SEQ ID NO: 3301606 - RNA, 15 nt, Mycobacterium tuberculosis H37Rv
cggacauccgaugcg

SEQ ID NO: 3301607 - RNA, 18 nt, Mycobacterium tuberculosis H37Rv
cggacauccgaugcguca

SEQ ID NO: 3301608 - RNA, 19 nt, Mycobacterium tuberculosis H37Rv
cggacauccgggccgagcg

SEQ ID NO: 3301609 - RNA, 12 nt, Mycobacterium tuberculosis H37Rv
cggaccacaucu

SEQ ID NO: 3301610 - RNA, 17 nt, Mycobacterium tuberculosis H37Rv
cggaccacaucugguca

SEQ ID NO: 3301611 - RNA, 12 nt, Mycobacterium tuberculosis H37Rv
cggaccaccagg

SEQ ID NO: 3301612 - RNA, 13 nt, Mycobacterium tuberculosis H37Rv
cggaccaccgcuc

SEQ ID NO: 3301613 - RNA, 21 nt, Mycobacterium tuberculosis H37Rv
cggaccaccgggccgacagca

SEQ ID NO: 3301614 - RNA, 22 nt, Mycobacterium tuberculosis H37Rv
cggaccaccgggccgacagcac

SEQ ID NO: 3301615 - RNA, 20 nt, Mycobacterium tuberculosis H37Rv
cggaccacuguuggugccgc

SEQ ID NO: 3301616 - RNA, 13 nt, Mycobacterium tuberculosis H37Rv
cggaccagcugcc

SEQ ID NO: 3301617 - RNA, 18 nt, Mycobacterium tuberculosis H37Rv
cggaccaggccgcgcgca

SEQ ID NO: 3301618 - RNA, 22 nt, Mycobacterium tuberculosis H37Rv
cggaccaggccgcgcgcaccgg

SEQ ID NO: 3301619 - RNA, 18 nt, Mycobacterium tuberculosis H37Rv
cggaccaucgccaggccc

SEQ ID NO: 3301620 - RNA, 17 nt, Mycobacterium tuberculosis H37Rv
cggacccaaagcacuuc

SEQ ID NO: 3301621 - RNA, 13 nt, Mycobacterium tuberculosis H37Rv
cggacccacccgc

SEQ ID NO: 3301622 - RNA, 18 nt, Mycobacterium tuberculosis H37Rv
cggacccacccgcaccgc

SEQ ID NO: 3301623 - RNA, 15 nt, Mycobacterium tuberculosis H37Rv
cggacccaccgucac

SEQ ID NO: 3301624 - RNA, 14 nt, Mycobacterium tuberculosis H37Rv
cggacccgcagcug

SEQ ID NO: 3301625 - RNA, 18 nt, Mycobacterium tuberculosis H37Rv
cggacccgcagcugcgga

SEQ ID NO: 3301626 - RNA, 20 nt, Mycobacterium tuberculosis H37Rv
cggacccgcagcugcggauc

SEQ ID NO: 3301627 - RNA, 21 nt, Mycobacterium tuberculosis H37Rv
cggacccuaacucccccgcua

SEQ ID NO: 3301628 - RNA, 13 nt, Mycobacterium tuberculosis H37Rv
cggacccuuccgc

SEQ ID NO: 3301629 - RNA, 18 nt, Mycobacterium tuberculosis H37Rv
cggaccgaccggcucacg

SEQ ID NO: 3301630 - RNA, 14 nt, Mycobacterium tuberculosis H37Rv
cggaccgaugacga

SEQ ID NO: 3301631 - RNA, 20 nt, Mycobacterium tuberculosis H37Rv
cggaccgauugucggcaacg

SEQ ID NO: 3301632 - RNA, 12 nt, Mycobacterium tuberculosis H37Rv
cggaccgcagcg

SEQ ID NO: 3301633 - RNA, 14 nt, Mycobacterium tuberculosis H37Rv
cggaccgcagcgug

SEQ ID NO: 3301634 - RNA, 22 nt, Mycobacterium tuberculosis H37Rv
cggaccgcagcgugaucuggcc

SEQ ID NO: 3301635 - RNA, 16 nt, Mycobacterium tuberculosis H37Rv
cggaccgccaccuugg

SEQ ID NO: 3301636 - RNA, 18 nt, Mycobacterium tuberculosis H37Rv
cggaccgccaccuuggcg

SEQ ID NO: 3301637 - RNA, 20 nt, Mycobacterium tuberculosis H37Rv
cggaccgcgacggcgccggc

SEQ ID NO: 3301638 - RNA, 15 nt, Mycobacterium tuberculosis H37Rv
cggaccgcggccacc

SEQ ID NO: 3301639 - RNA, 12 nt, Mycobacterium tuberculosis H37Rv
cggaccgcuucg

SEQ ID NO: 3301640 - RNA, 16 nt, Mycobacterium tuberculosis H37Rv
cggaccgucgccggug

SEQ ID NO: 3301641 - RNA, 17 nt, Mycobacterium tuberculosis H37Rv
cggaccgucgccgguga

SEQ ID NO: 3301642 - RNA, 19 nt, Mycobacterium tuberculosis H37Rv
cggaccgucguggcggugg

SEQ ID NO: 3301643 - RNA, 22 nt, Mycobacterium tuberculosis H37Rv
cggaccguguuguuagccccgc

SEQ ID NO: 3301644 - RNA, 17 nt, Mycobacterium tuberculosis H37Rv
cggaccuccucgcccau

SEQ ID NO: 3301645 - RNA, 18 nt, Mycobacterium tuberculosis H37Rv
cggaccuccucgcccauu

SEQ ID NO: 3301646 - RNA, 19 nt, Mycobacterium tuberculosis H37Rv
cggaccucgaagcccagca

SEQ ID NO: 3301647 - RNA, 20 nt, Mycobacterium tuberculosis H37Rv
cggaccucggcgaccugcuc

SEQ ID NO: 3301648 - RNA, 13 nt, Mycobacterium tuberculosis H37Rv
cggaccucggcgg

SEQ ID NO: 3301649 - RNA, 15 nt, Mycobacterium tuberculosis H37Rv
cggaccugcgccggu

SEQ ID NO: 3301650 - RNA, 16 nt, Mycobacterium tuberculosis H37Rv
cggaccugcgccggug

SEQ ID NO: 3301651 - RNA, 17 nt, Mycobacterium tuberculosis H37Rv
cggaccugcgccgguga

SEQ ID NO: 3301652 - RNA, 20 nt, Mycobacterium tuberculosis H37Rv
cggaccugggcgacuaccgg

SEQ ID NO: 3301653 - RNA, 12 nt, Mycobacterium tuberculosis H37Rv
cggaccugggug

SEQ ID NO: 3301654 - RNA, 14 nt, Mycobacterium tuberculosis H37Rv
cggacgaacccguu

SEQ ID NO: 3301655 - RNA, 21 nt, Mycobacterium tuberculosis H37Rv
cggacgaacgccgucgacgcg

SEQ ID NO: 3301656 - RNA, 20 nt, Mycobacterium tuberculosis H37Rv
cggacgacaacaggccgucg

SEQ ID NO: 3301657 - RNA, 15 nt, Mycobacterium tuberculosis H37Rv
cggacgacgucgggu

SEQ ID NO: 3301658 - RNA, 14 nt, Mycobacterium tuberculosis H37Rv
cggacgaucagggu

SEQ ID NO: 3301659 - RNA, 17 nt, Mycobacterium tuberculosis H37Rv
cggacgaucaggguguc

SEQ ID NO: 3301660 - RNA, 22 nt, Mycobacterium tuberculosis H37Rv
cggacgauggcgucggccagga

SEQ ID NO: 3301661 - RNA, 16 nt, Mycobacterium tuberculosis H37Rv
cggacgcaacacccgg

SEQ ID NO: 3301662 - RNA, 18 nt, Mycobacterium tuberculosis H37Rv
cggacgcaacucgacgcg

SEQ ID NO: 3301663 - RNA, 20 nt, Mycobacterium tuberculosis H37Rv
cggaggugggguggggagcu

SEQ ID NO: 3301664 - RNA, 22 nt, Mycobacterium tuberculosis H37Rv
cggaguacaagggaauugucga

SEQ ID NO: 3301665 - RNA, 14 nt, Mycobacterium tuberculosis H37Rv
cggaguaccgcgcg

SEQ ID NO: 3301666 - RNA, 17 nt, Mycobacterium tuberculosis H37Rv
cggaguaggccgcgccc

SEQ ID NO: 3301667 - RNA, 16 nt, Mycobacterium tuberculosis H37Rv
cggagucaagcagcag

SEQ ID NO: 3301668 - RNA, 18 nt, Mycobacterium tuberculosis H37Rv
cggagucaagcagcagca

SEQ ID NO: 3301669 - RNA, 15 nt, Mycobacterium tuberculosis H37Rv
cggagucacgcagcc

SEQ ID NO: 3301670 - RNA, 18 nt, Mycobacterium tuberculosis H37Rv
cggagucacgcagccgcg

SEQ ID NO: 3301671 - RNA, 20 nt, Mycobacterium tuberculosis H37Rv
cggagucacgcagccgcgcg

SEQ ID NO: 3301672 - RNA, 19 nt, Mycobacterium tuberculosis H37Rv
cggaguccgucgacaccgc

SEQ ID NO: 3301673 - RNA, 12 nt, Mycobacterium tuberculosis H37Rv
cggagucgacgg

SEQ ID NO: 3301674 - RNA, 19 nt, Mycobacterium tuberculosis H37Rv
cggagucgacggucacggu

SEQ ID NO: 3301675 - RNA, 18 nt, Mycobacterium tuberculosis H37Rv
cggagucgagcacaccga

SEQ ID NO: 3301676 - RNA, 23 nt, Mycobacterium tuberculosis H37Rv
cggagucgagcacaccgaggucg

SEQ ID NO: 3301677 - RNA, 19 nt, Mycobacterium tuberculosis H37Rv
cggagucgcccgguccgcc

SEQ ID NO: 3301678 - RNA, 14 nt, Mycobacterium tuberculosis H37Rv
cggagucggggggc

SEQ ID NO: 3301679 - RNA, 20 nt, Mycobacterium tuberculosis H37Rv
cggagucgucggcaacgcug

SEQ ID NO: 3301680 - RNA, 21 nt, Mycobacterium tuberculosis H37Rv
cggagucgucggcaacgcugg

SEQ ID NO: 3301681 - RNA, 18 nt, Mycobacterium tuberculosis H37Rv
cggagucuucaacgucga

SEQ ID NO: 3301682 - RNA, 17 nt, Mycobacterium tuberculosis H37Rv
cggagucuucgucgucg

SEQ ID NO: 3301683 - RNA, 18 nt, Mycobacterium tuberculosis H37Rv
cggagucuucgucgucgg

SEQ ID NO: 3301684 - RNA, 13 nt, Mycobacterium tuberculosis H37Rv
cggaguggccagu

SEQ ID NO: 3301685 - RNA, 19 nt, Mycobacterium tuberculosis H37Rv
cggaguuccgccauugccg

SEQ ID NO: 3301686 - RNA, 19 nt, Mycobacterium tuberculosis H37Rv
cggaguucgcugacggcca

SEQ ID NO: 3301687 - RNA, 20 nt, Mycobacterium tuberculosis H37Rv
cggaguucuuguagccgccg

SEQ ID NO: 3301688 - RNA, 21 nt, Mycobacterium tuberculosis H37Rv
cggaguugaagaagcccgacg

SEQ ID NO: 3301689 - RNA, 22 nt, Mycobacterium tuberculosis H37Rv
cggaguugaagaagcccgacga

SEQ ID NO: 3301690 - RNA, 16 nt, Mycobacterium tuberculosis H37Rv
cggaguugagcugucg

SEQ ID NO: 3301691 - RNA, 21 nt, Mycobacterium tuberculosis H37Rv
cggaguugucgacggccaccc

SEQ ID NO: 3301692 - RNA, 20 nt, Mycobacterium tuberculosis H37Rv
cggaguuuaagacgcccgag

SEQ ID NO: 3301693 - RNA, 15 nt, Mycobacterium tuberculosis H37Rv
cggauaaccggcaug

SEQ ID NO: 3301694 - RNA, 18 nt, Mycobacterium tuberculosis H37Rv
cggauaauucaacagcac

SEQ ID NO: 3301695 - RNA, 19 nt, Mycobacterium tuberculosis H37Rv
cggauacagccgccgccgg

SEQ ID NO: 3301696 - RNA, 23 nt, Mycobacterium tuberculosis H37Rv
cggauacagccgccgccggcaac

SEQ ID NO: 3301697 - RNA, 20 nt, Mycobacterium tuberculosis H37Rv
cggauacaugguccggccgc

SEQ ID NO: 3301698 - RNA, 23 nt, Mycobacterium tuberculosis H37Rv
cggauacauuucgucgucgcagu

SEQ ID NO: 3301699 - RNA, 20 nt, Mycobacterium tuberculosis H37Rv
cggauacccuuugcacggug

SEQ ID NO: 3301700 - RNA, 16 nt, Mycobacterium tuberculosis H37Rv
cggauagcaccggcac

SEQ ID NO: 3301701 - RNA, 16 nt, Mycobacterium tuberculosis H37Rv
cggauaucgaccaccg

SEQ ID NO: 3301702 - RNA, 14 nt, Mycobacterium tuberculosis H37Rv
cggauauuccuuua

SEQ ID NO: 3301703 - RNA, 16 nt, Mycobacterium tuberculosis H37Rv
cggaucaccaucgccg

SEQ ID NO: 3301704 - RNA, 15 nt, Mycobacterium tuberculosis H37Rv
cggaucaggcccggg

SEQ ID NO: 3301705 - RNA, 22 nt, Mycobacterium tuberculosis H37Rv
cggaucaucgccgcggccaggu

SEQ ID NO: 3301706 - RNA, 17 nt, Mycobacterium tuberculosis H37Rv
cggaucauucugcggcc

SEQ ID NO: 3301707 - RNA, 20 nt, Mycobacterium tuberculosis H37Rv
cggauccacaccgagaagcu

SEQ ID NO: 3301708 - RNA, 22 nt, Mycobacterium tuberculosis H37Rv
cggauccaccacgcuggccucg

SEQ ID NO: 3301709 - RNA, 14 nt, Mycobacterium tuberculosis H37Rv
cggaucccagugcc

SEQ ID NO: 3301710 - RNA, 15 nt, Mycobacterium tuberculosis H37Rv
cggaucccgaggcgc

SEQ ID NO: 3301711 - RNA, 21 nt, Mycobacterium tuberculosis H37Rv
cggaucccugugccagcagca

SEQ ID NO: 3301712 - RNA, 22 nt, Mycobacterium tuberculosis H37Rv
cggauccgauccgcacagcaac

SEQ ID NO: 3301713 - RNA, 17 nt, Mycobacterium tuberculosis H37Rv
cggauccggaggcggcu

SEQ ID NO: 3301714 - RNA, 14 nt, Mycobacterium tuberculosis H37Rv
cggauccucggccg

SEQ ID NO: 3301715 - RNA, 22 nt, Mycobacterium tuberculosis H37Rv
cggauccucggccgccaucgcc

SEQ ID NO: 3301716 - RNA, 23 nt, Mycobacterium tuberculosis H37Rv
cggaucgaaacucagcccgucgg

SEQ ID NO: 3301717 - RNA, 19 nt, Mycobacterium tuberculosis H37Rv
cggaucgaccaauucgacc

SEQ ID NO: 3301718 - RNA, 18 nt, Mycobacterium tuberculosis H37Rv
cggaucgccaggccgucg

SEQ ID NO: 3301719 - RNA, 17 nt, Mycobacterium tuberculosis H37Rv
cggaucgcccugacacc

SEQ ID NO: 3301720 - RNA, 18 nt, Mycobacterium tuberculosis H37Rv
cggaucgcgagcgccgcu

SEQ ID NO: 3301721 - RNA, 16 nt, Mycobacterium tuberculosis H37Rv
cggaucgcgcugcggg

SEQ ID NO: 3301722 - RNA, 14 nt, Mycobacterium tuberculosis H37Rv
cggaucgcggucag

SEQ ID NO: 3301723 - RNA, 17 nt, Mycobacterium tuberculosis H37Rv
cggaucggccuguccac

SEQ ID NO: 3301724 - RNA, 15 nt, Mycobacterium tuberculosis H37Rv
cggaucggcgccgca

SEQ ID NO: 3301725 - RNA, 14 nt, Mycobacterium tuberculosis H37Rv
cggaucggcucgcc

SEQ ID NO: 3301726 - RNA, 23 nt, Mycobacterium tuberculosis H37Rv
cggaucgggcaccccgaccacca

SEQ ID NO: 3301727 - RNA, 17 nt, Mycobacterium tuberculosis H37Rv
cggaucggucggcacca

SEQ ID NO: 3301728 - RNA, 23 nt, Mycobacterium tuberculosis H37Rv
cggaucguacgggucggcgacga

SEQ ID NO: 3301729 - RNA, 22 nt, Mycobacterium tuberculosis H37Rv
cggaucgucgaacagcaccgcc

SEQ ID NO: 3301730 - RNA, 14 nt, Mycobacterium tuberculosis H37Rv
cggaucgucgaggc

SEQ ID NO: 3301731 - RNA, 19 nt, Mycobacterium tuberculosis H37Rv
cggaucgugcccuguccgg

SEQ ID NO: 3301732 - RNA, 14 nt, Mycobacterium tuberculosis H37Rv
cggaucugcagcac

SEQ ID NO: 3301733 - RNA, 15 nt, Mycobacterium tuberculosis H37Rv
cggaucugguccagu

SEQ ID NO: 3301734 - RNA, 17 nt, Mycobacterium tuberculosis H37Rv
cggaucuggugggugcg

SEQ ID NO: 3301735 - RNA, 17 nt, Mycobacterium tuberculosis H37Rv
cggaugacaccgaccgg

SEQ ID NO: 3301736 - RNA, 19 nt, Mycobacterium tuberculosis H37Rv
cggaugacaccgaccgggu

SEQ ID NO: 3301737 - RNA, 16 nt, Mycobacterium tuberculosis H37Rv
cggaugacgcccaggg

SEQ ID NO: 3301738 - RNA, 16 nt, Mycobacterium tuberculosis H37Rv
cggaugagcucggcca

SEQ ID NO: 3301739 - RNA, 17 nt, Mycobacterium tuberculosis H37Rv
cggaugcagugacagca

SEQ ID NO: 3301740 - RNA, 17 nt, Mycobacterium tuberculosis H37Rv
cggaugccggucggcgu

SEQ ID NO: 3301741 - RNA, 15 nt, Mycobacterium tuberculosis H37Rv
cggaugcgaugcccg

SEQ ID NO: 3301742 - RNA, 14 nt, Mycobacterium tuberculosis H37Rv
cggaugcgauggcc

SEQ ID NO: 3301743 - RNA, 19 nt, Mycobacterium tuberculosis H37Rv
cggaugcgcaaccgcggcc

SEQ ID NO: 3301744 - RNA, 16 nt, Mycobacterium tuberculosis H37Rv
cggaugcggccgaacu

SEQ ID NO: 3301745 - RNA, 19 nt, Mycobacterium tuberculosis H37Rv
cggaugcguuggccccagg

SEQ ID NO: 3301746 - RNA, 20 nt, Mycobacterium tuberculosis H37Rv
cggaugcucaggucaccggc

SEQ ID NO: 3301747 - RNA, 15 nt, Mycobacterium tuberculosis H37Rv
cggaugcugucagca

SEQ ID NO: 3301748 - RNA, 20 nt, Mycobacterium tuberculosis H37Rv
cggaugcugucagcagccca

SEQ ID NO: 3301749 - RNA, 22 nt, Mycobacterium tuberculosis H37Rv
cggaugcugucagcagcccauu

SEQ ID NO: 3301750 - RNA, 17 nt, Mycobacterium tuberculosis H37Rv
cggauggaaggcggcca

SEQ ID NO: 3301751 - RNA, 24 nt, Mycobacterium tuberculosis H37Rv
cggauggaaggcggccaggugcag

SEQ ID NO: 3301752 - RNA, 20 nt, Mycobacterium tuberculosis H37Rv
cggauggccucgaacgccgc

SEQ ID NO: 3301753 - RNA, 22 nt, Mycobacterium tuberculosis H37Rv
cggauggccucggcgauaccga

SEQ ID NO: 3301754 - RNA, 13 nt, Mycobacterium tuberculosis H37Rv
cggauggcgucga

SEQ ID NO: 3301755 - RNA, 13 nt, Mycobacterium tuberculosis H37Rv
cggauggguacga

SEQ ID NO: 3301756 - RNA, 18 nt, Mycobacterium tuberculosis H37Rv
cggauggguggccagcaa

SEQ ID NO: 3301757 - RNA, 17 nt, Mycobacterium tuberculosis H37Rv
cggauggugugucgggu

SEQ ID NO: 3301758 - RNA, 20 nt, Mycobacterium tuberculosis H37Rv
cggcaccccacgccugccga

SEQ ID NO: 3301759 - RNA, 16 nt, Mycobacterium tuberculosis H37Rv
cggcaccccacggcca

SEQ ID NO: 3301760 - RNA, 18 nt, Mycobacterium tuberculosis H37Rv
cggcacccccgucgccac

SEQ ID NO: 3301761 - RNA, 21 nt, Mycobacterium tuberculosis H37Rv
cggcacccccgucgccaccga

SEQ ID NO: 3301762 - RNA, 22 nt, Mycobacterium tuberculosis H37Rv
cggcacccgaaaacugaccccc

SEQ ID NO: 3301763 - RNA, 22 nt, Mycobacterium tuberculosis H37Rv
cggcacccgacucgucggccug

SEQ ID NO: 3301764 - RNA, 15 nt, Mycobacterium tuberculosis H37Rv
cggcacccgcacggc

SEQ ID NO: 3301765 - RNA, 21 nt, Mycobacterium tuberculosis H37Rv
cggcacccgcuggcgguaagc

SEQ ID NO: 3301766 - RNA, 12 nt, Mycobacterium tuberculosis H37Rv
cggcacccggca

SEQ ID NO: 3301767 - RNA, 16 nt, Mycobacterium tuberculosis H37Rv
cggcacccggucggcc

SEQ ID NO: 3301768 - RNA, 17 nt, Mycobacterium tuberculosis H37Rv
cggcacccggucggcca

SEQ ID NO: 3301769 - RNA, 16 nt, Mycobacterium tuberculosis H37Rv
cggcacccugcggcac

SEQ ID NO: 3301770 - RNA, 18 nt, Mycobacterium tuberculosis H37Rv
cggcacccugcggcaccu

SEQ ID NO: 3301771 - RNA, 18 nt, Mycobacterium tuberculosis H37Rv
cggcaccgaaacgcgcgg

SEQ ID NO: 3301772 - RNA, 22 nt, Mycobacterium tuberculosis H37Rv
cggcaccgcagcggaacugggc

SEQ ID NO: 3301773 - RNA, 14 nt, Mycobacterium tuberculosis H37Rv
cggcaccgcccuug

SEQ ID NO: 3301774 - RNA, 21 nt, Mycobacterium tuberculosis H37Rv
cggcaccgcccuugccgccgu

SEQ ID NO: 3301775 - RNA, 12 nt, Mycobacterium tuberculosis H37Rv
cggcaccgccgg

SEQ ID NO: 3301776 - RNA, 19 nt, Mycobacterium tuberculosis H37Rv
cggcaccgccggcgccgcc

SEQ ID NO: 3301777 - RNA, 22 nt, Mycobacterium tuberculosis H37Rv
cggcaccgccggcgccgccguc

SEQ ID NO: 3301778 - RNA, 14 nt, Mycobacterium tuberculosis H37Rv
cggcaccgccggug

SEQ ID NO: 3301779 - RNA, 11 nt, Mycobacterium tuberculosis H37Rv
cggcaccgccu

SEQ ID NO: 3301780 - RNA, 15 nt, Mycobacterium tuberculosis H37Rv
cggcaccgccugcgc

SEQ ID NO: 3301781 - RNA, 16 nt, Mycobacterium tuberculosis H37Rv
cggcaccgccugcgcc

SEQ ID NO: 3301782 - RNA, 15 nt, Mycobacterium tuberculosis H37Rv
cggcaccgcgccggc

SEQ ID NO: 3301783 - RNA, 17 nt, Mycobacterium tuberculosis H37Rv
cggcaccgcgccggcgg

SEQ ID NO: 3301784 - RNA, 14 nt, Mycobacterium tuberculosis H37Rv
cggcaccgcugagg

SEQ ID NO: 3301785 - RNA, 13 nt, Mycobacterium tuberculosis H37Rv
cggcaccgcugcc

SEQ ID NO: 3301786 - RNA, 15 nt, Mycobacterium tuberculosis H37Rv
cggcaccgcugccgc

SEQ ID NO: 3301787 - RNA, 16 nt, Mycobacterium tuberculosis H37Rv
cggcaccgcugccgcu

SEQ ID NO: 3301788 - RNA, 13 nt, Mycobacterium tuberculosis H37Rv
cggcaccgcuuca

SEQ ID NO: 3301789 - RNA, 16 nt, Mycobacterium tuberculosis H37Rv
cggcaccgcuucaggc

SEQ ID NO: 3301790 - RNA, 17 nt, Mycobacterium tuberculosis H37Rv
cggcaccgcuucaggcg

SEQ ID NO: 3301791 - RNA, 18 nt, Mycobacterium tuberculosis H37Rv
cggcaccggccgugccgc

SEQ ID NO: 3301792 - RNA, 20 nt, Mycobacterium tuberculosis H37Rv
cggcaccggccgugccgccg

SEQ ID NO: 3301793 - RNA, 12 nt, Mycobacterium tuberculosis H37Rv
cggcaccggcuc

SEQ ID NO: 3301794 - RNA, 15 nt, Mycobacterium tuberculosis H37Rv
cggcaccggcucagg

SEQ ID NO: 3301795 - RNA, 16 nt, Mycobacterium tuberculosis H37Rv
cggcaccggcucaggg

SEQ ID NO: 3301796 - RNA, 22 nt, Mycobacterium tuberculosis H37Rv
cggcaccggugcccaccaccga

SEQ ID NO: 3301797 - RNA, 21 nt, Mycobacterium tuberculosis H37Rv
cggcaccguagagcaugccgc

SEQ ID NO: 3301798 - RNA, 15 nt, Mycobacterium tuberculosis H37Rv
cggcaccgucucgca

SEQ ID NO: 3301799 - RNA, 16 nt, Mycobacterium tuberculosis H37Rv
cggcaccucauugccg

SEQ ID NO: 3301800 - RNA, 17 nt, Mycobacterium tuberculosis H37Rv
cggcaccucauugccgu

SEQ ID NO: 3301801 - RNA, 17 nt, Mycobacterium tuberculosis H37Rv
cggcaccuccagcacca

SEQ ID NO: 3301802 - RNA, 14 nt, Mycobacterium tuberculosis H37Rv
cggcaccuccgccg

SEQ ID NO: 3301803 - RNA, 16 nt, Mycobacterium tuberculosis H37Rv
cggcaccuccgccggc

SEQ ID NO: 3301804 - RNA, 17 nt, Mycobacterium tuberculosis H37Rv
cggcaccuccgccggca

SEQ ID NO: 3301805 - RNA, 20 nt, Mycobacterium tuberculosis H37Rv
cggcaccuccggcaccgccc

SEQ ID NO: 3301806 - RNA, 20 nt, Mycobacterium tuberculosis H37Rv
cggcaccuuguagcgggcaa

SEQ ID NO: 3301807 - RNA, 23 nt, Mycobacterium tuberculosis H37Rv
cggcacgaaaaugggggcuggua

SEQ ID NO: 3301808 - RNA, 18 nt, Mycobacterium tuberculosis H37Rv
cggcacgaaauugggcga

SEQ ID NO: 3301809 - RNA, 14 nt, Mycobacterium tuberculosis H37Rv
cggcacgaaucccc

SEQ ID NO: 3301810 - RNA, 19 nt, Mycobacterium tuberculosis H37Rv
cggcacgaaucccccggac

SEQ ID NO: 3301811 - RNA, 15 nt, Mycobacterium tuberculosis H37Rv
cggcacgaucggcag

SEQ ID NO: 3301812 - RNA, 20 nt, Mycobacterium tuberculosis H37Rv
cggcacgccggccgcgcuga

SEQ ID NO: 3301813 - RNA, 15 nt, Mycobacterium tuberculosis H37Rv
cggcacgcuccagcu

SEQ ID NO: 3301814 - RNA, 23 nt, Mycobacterium tuberculosis H37Rv
cggcacgcuccagcucggccagu

SEQ ID NO: 3301815 - RNA, 13 nt, Mycobacterium tuberculosis H37Rv
cggcacgcucgcg

SEQ ID NO: 3301816 - RNA, 15 nt, Mycobacterium tuberculosis H37Rv
cggcacgcugaccgg

SEQ ID NO: 3301817 - RNA, 17 nt, Mycobacterium tuberculosis H37Rv
cggcacggaugcgaugg

SEQ ID NO: 3301818 - RNA, 20 nt, Mycobacterium tuberculosis H37Rv
cggcacggaugcgauggccg

SEQ ID NO: 3301819 - RNA, 20 nt, Mycobacterium tuberculosis H37Rv
cggcacgggaaucgcucgcg

SEQ ID NO: 3301820 - RNA, 16 nt, Mycobacterium tuberculosis H37Rv
cggcacgggcgucguc

SEQ ID NO: 3301821 - RNA, 20 nt, Mycobacterium tuberculosis H37Rv
cggcacggucacacgccagc

SEQ ID NO: 3301822 - RNA, 12 nt, Mycobacterium tuberculosis H37Rv
cggcacgguguc

SEQ ID NO: 3301823 - RNA, 18 nt, Mycobacterium tuberculosis H37Rv
cggcacgucggcgccgac

SEQ ID NO: 3301824 - RNA, 12 nt, Mycobacterium tuberculosis H37Rv
cggcacgucguc

SEQ ID NO: 3301825 - RNA, 17 nt, Mycobacterium tuberculosis H37Rv
cggcacuagcccgaccg

SEQ ID NO: 3301826 - RNA, 15 nt, Mycobacterium tuberculosis H37Rv
cggcacucccugggg

SEQ ID NO: 3301827 - RNA, 16 nt, Mycobacterium tuberculosis H37Rv
cggcacucccuggggu

SEQ ID NO: 3301828 - RNA, 14 nt, Mycobacterium tuberculosis H37Rv
cggcacugaccgcg

SEQ ID NO: 3301829 - RNA, 20 nt, Mycobacterium tuberculosis H37Rv
cggcacugcgaaucuccgcg

SEQ ID NO: 3301830 - RNA, 13 nt, Mycobacterium tuberculosis H37Rv
cggcacugcggcc

SEQ ID NO: 3301831 - RNA, 14 nt, Mycobacterium tuberculosis H37Rv
cggcacugcggcca

SEQ ID NO: 3301832 - RNA, 14 nt, Mycobacterium tuberculosis H37Rv
cggcacuggccccg

SEQ ID NO: 3301833 - RNA, 16 nt, Mycobacterium tuberculosis H37Rv
cggcacuggccccggu

SEQ ID NO: 3301834 - RNA, 17 nt, Mycobacterium tuberculosis H37Rv
cggcacuggguccacgc

SEQ ID NO: 3301835 - RNA, 20 nt, Mycobacterium tuberculosis H37Rv
cggcacuggugcccgacccg

SEQ ID NO: 3301836 - RNA, 16 nt, Mycobacterium tuberculosis H37Rv
cggcacuuagcccgau

SEQ ID NO: 3301837 - RNA, 23 nt, Mycobacterium tuberculosis H37Rv
cggcacuugggaaggauggucga

SEQ ID NO: 3301838 - RNA, 17 nt, Mycobacterium tuberculosis H37Rv
cggcagaauccggucga

SEQ ID NO: 3301839 - RNA, 16 nt, Mycobacterium tuberculosis H37Rv
cggcagacacgcugca

SEQ ID NO: 3301840 - RNA, 19 nt, Mycobacterium tuberculosis H37Rv
cggcagaccaagcccgucg

SEQ ID NO: 3301841 - RNA, 15 nt, Mycobacterium tuberculosis H37Rv
cggcagaccaugguc

SEQ ID NO: 3301842 - RNA, 17 nt, Mycobacterium tuberculosis H37Rv
cggcagacccgagcgcu

SEQ ID NO: 3301843 - RNA, 13 nt, Mycobacterium tuberculosis H37Rv
cggcagaccgacc

SEQ ID NO: 3301844 - RNA, 22 nt, Mycobacterium tuberculosis H37Rv
cggcagaccggugcugucgacg

SEQ ID NO: 3301845 - RNA, 19 nt, Mycobacterium tuberculosis H37Rv
cggcagaucccacgccagg

SEQ ID NO: 3301846 - RNA, 14 nt, Mycobacterium tuberculosis H37Rv
cggcagaugcagcg

SEQ ID NO: 3301847 - RNA, 18 nt, Mycobacterium tuberculosis H37Rv
cggcagaugcagcggguc

SEQ ID NO: 3301848 - RNA, 23 nt, Mycobacterium tuberculosis H37Rv
cggcagcacccacaucagccgca

SEQ ID NO: 3301849 - RNA, 15 nt, Mycobacterium tuberculosis H37Rv
cggcagcacggucug

SEQ ID NO: 3301850 - RNA, 15 nt, Mycobacterium tuberculosis H37Rv
cggcagcagaguucc

SEQ ID NO: 3301851 - RNA, 21 nt, Mycobacterium tuberculosis H37Rv
cggcagcagaguucccugaug

SEQ ID NO: 3301852 - RNA, 11 nt, Mycobacterium tuberculosis H37Rv
cggcagcagca

SEQ ID NO: 3301853 - RNA, 15 nt, Mycobacterium tuberculosis H37Rv
cggcagcagccggcg

SEQ ID NO: 3301854 - RNA, 17 nt, Mycobacterium tuberculosis H37Rv
cggcagcagcgggcgcg

SEQ ID NO: 3301855 - RNA, 14 nt, Mycobacterium tuberculosis H37Rv
cggcaucuccaccg

SEQ ID NO: 3301856 - RNA, 23 nt, Mycobacterium tuberculosis H37Rv
cggcaucugaaaauugacccccu

SEQ ID NO: 3301857 - RNA, 21 nt, Mycobacterium tuberculosis H37Rv
cggcaugauuuuucgcaguga

SEQ ID NO: 3301858 - RNA, 21 nt, Mycobacterium tuberculosis H37Rv
cggcaugcaaugcuggcggcg

SEQ ID NO: 3301859 - RNA, 17 nt, Mycobacterium tuberculosis H37Rv
cggcaugcccgcgguga

SEQ ID NO: 3301860 - RNA, 22 nt, Mycobacterium tuberculosis H37Rv
cggcaugccgccaugcgcacca

SEQ ID NO: 3301861 - RNA, 17 nt, Mycobacterium tuberculosis H37Rv
cggcaugcgcagaaacg

SEQ ID NO: 3301862 - RNA, 16 nt, Mycobacterium tuberculosis H37Rv
cggcaugcucgacaac

SEQ ID NO: 3301863 - RNA, 18 nt, Mycobacterium tuberculosis H37Rv
cggcauggauacgcagca

SEQ ID NO: 3301864 - RNA, 13 nt, Mycobacterium tuberculosis H37Rv
cggcaugggccgg

SEQ ID NO: 3301865 - RNA, 16 nt, Mycobacterium tuberculosis H37Rv
cggcaugggccggcgc

SEQ ID NO: 3301866 - RNA, 19 nt, Mycobacterium tuberculosis H37Rv
cggcaugggccggcgccgc

SEQ ID NO: 3301867 - RNA, 17 nt, Mycobacterium tuberculosis H37Rv
cggcauguaccgaccgc

SEQ ID NO: 3301868 - RNA, 19 nt, Mycobacterium tuberculosis H37Rv
cggcauguaccgaccgcgu

SEQ ID NO: 3301869 - RNA, 17 nt, Mycobacterium tuberculosis H37Rv
cggcaugugacaucggg

SEQ ID NO: 3301870 - RNA, 14 nt, Mycobacterium tuberculosis H37Rv
cggcauuccacagg

SEQ ID NO: 3301871 - RNA, 17 nt, Mycobacterium tuberculosis H37Rv
cggcauucucgagcacc

SEQ ID NO: 3301872 - RNA, 19 nt, Mycobacterium tuberculosis H37Rv
cggcauucucgagcacccg

SEQ ID NO: 3301873 - RNA, 21 nt, Mycobacterium tuberculosis H37Rv
cggcauugcccgagcccagcg

SEQ ID NO: 3301874 - RNA, 15 nt, Mycobacterium tuberculosis H37Rv
cggcauuggcggugc

SEQ ID NO: 3301875 - RNA, 18 nt, Mycobacterium tuberculosis H37Rv
cggcauuggcgucgucgc

SEQ ID NO: 3301876 - RNA, 23 nt, Mycobacterium tuberculosis H37Rv
cggcauuuucgagguacaacggg

SEQ ID NO: 3301877 - RNA, 20 nt, Mycobacterium tuberculosis H37Rv
cggccaaaacauaucggugc

SEQ ID NO: 3301878 - RNA, 17 nt, Mycobacterium tuberculosis H37Rv
cggccaaagacccggca

SEQ ID NO: 3301879 - RNA, 18 nt, Mycobacterium tuberculosis H37Rv
cggccaaagacccggcac

SEQ ID NO: 3301880 - RNA, 20 nt, Mycobacterium tuberculosis H37Rv
cggccaaagcuuucccguug

SEQ ID NO: 3301881 - RNA, 18 nt, Mycobacterium tuberculosis H37Rv
cggccaaauaacgcggga

SEQ ID NO: 3301882 - RNA, 22 nt, Mycobacterium tuberculosis H37Rv
cggccaaaugccuuugggcugu

SEQ ID NO: 3301883 - RNA, 15 nt, Mycobacterium tuberculosis H37Rv
cggccaacaccacua

SEQ ID NO: 3301884 - RNA, 21 nt, Mycobacterium tuberculosis H37Rv
cggccaacaccacuagcggcu

SEQ ID NO: 3301885 - RNA, 13 nt, Mycobacterium tuberculosis H37Rv
cggccaacagcac

SEQ ID NO: 3301886 - RNA, 18 nt, Mycobacterium tuberculosis H37Rv
cggccaacagucgcagca

SEQ ID NO: 3301887 - RNA, 16 nt, Mycobacterium tuberculosis H37Rv
cggccaaccaccaacu

SEQ ID NO: 3301888 - RNA, 13 nt, Mycobacterium tuberculosis H37Rv
cggccaacccauc

SEQ ID NO: 3301889 - RNA, 13 nt, Mycobacterium tuberculosis H37Rv
cggccaaccccga

SEQ ID NO: 3301890 - RNA, 21 nt, Mycobacterium tuberculosis H37Rv
cggccaaccccgaugaggcgc

SEQ ID NO: 3301891 - RNA, 15 nt, Mycobacterium tuberculosis H37Rv
cggccaacccgggcc

SEQ ID NO: 3301892 - RNA, 22 nt, Mycobacterium tuberculosis H37Rv
cggccaacgaacgugccccggc

SEQ ID NO: 3301893 - RNA, 15 nt, Mycobacterium tuberculosis H37Rv
cggccaacggaccgu

SEQ ID NO: 3301894 - RNA, 15 nt, Mycobacterium tuberculosis H37Rv
cggccaacggcaccc

SEQ ID NO: 3301895 - RNA, 18 nt, Mycobacterium tuberculosis H37Rv
cggccaacggcuccgggc

SEQ ID NO: 3301896 - RNA, 14 nt, Mycobacterium tuberculosis H37Rv
cggccaacugggcc

SEQ ID NO: 3301897 - RNA, 16 nt, Mycobacterium tuberculosis H37Rv
cggccaacugggccga

SEQ ID NO: 3301898 - RNA, 19 nt, Mycobacterium tuberculosis H37Rv
cggccaacugggccgagcg

SEQ ID NO: 3301899 - RNA, 23 nt, Mycobacterium tuberculosis H37Rv
cggccaacuucugcacgaacgcc

SEQ ID NO: 3301900 - RNA, 18 nt, Mycobacterium tuberculosis H37Rv
cggccaagaccgcggccc

SEQ ID NO: 3301901 - RNA, 18 nt, Mycobacterium tuberculosis H37Rv
cggccaagaucggcgccc

SEQ ID NO: 3301902 - RNA, 22 nt, Mycobacterium tuberculosis H37Rv
cggccaagaucggcgccccugc

SEQ ID NO: 3301903 - RNA, 14 nt, Mycobacterium tuberculosis H37Rv
cggccaagccggcg

SEQ ID NO: 3301904 - RNA, 20 nt, Mycobacterium tuberculosis H37Rv
cggccaaucagcccgccgga

SEQ ID NO: 3301905 - RNA, 18 nt, Mycobacterium tuberculosis H37Rv
cggccaauccggggcccg

SEQ ID NO: 3301906 - RNA, 14 nt, Mycobacterium tuberculosis H37Rv
cggccacaaacccg

SEQ ID NO: 3301907 - RNA, 18 nt, Mycobacterium tuberculosis H37Rv
cggccacaaccucgucgu

SEQ ID NO: 3301908 - RNA, 18 nt, Mycobacterium tuberculosis H37Rv
cggccacaaugcggccgu

SEQ ID NO: 3301909 - RNA, 21 nt, Mycobacterium tuberculosis H37Rv
cggccacaccgucacgccacc

SEQ ID NO: 3301910 - RNA, 17 nt, Mycobacterium tuberculosis H37Rv
cggccacauaccaccac

SEQ ID NO: 3301911 - RNA, 19 nt, Mycobacterium tuberculosis H37Rv
cggccacaugaucgagcag

SEQ ID NO: 3301912 - RNA, 21 nt, Mycobacterium tuberculosis H37Rv
cggccacaugccacagcggcg

SEQ ID NO: 3301913 - RNA, 14 nt, Mycobacterium tuberculosis H37Rv
cggccaccaaccuc

SEQ ID NO: 3301914 - RNA, 18 nt, Mycobacterium tuberculosis H37Rv
cggccaccaaccucaucg

SEQ ID NO: 3301915 - RNA, 19 nt, Mycobacterium tuberculosis H37Rv
cggccaccaacucggcgac

SEQ ID NO: 3301916 - RNA, 14 nt, Mycobacterium tuberculosis H37Rv
cggccaccacaacg

SEQ ID NO: 3301917 - RNA, 12 nt, Mycobacterium tuberculosis H37Rv
cggccaccacca

SEQ ID NO: 3301918 - RNA, 14 nt, Mycobacterium tuberculosis H37Rv
cggccaccaccagg

SEQ ID NO: 3301919 - RNA, 19 nt, Mycobacterium tuberculosis H37Rv
cggccaccaccaggcugac

SEQ ID NO: 3301920 - RNA, 20 nt, Mycobacterium tuberculosis H37Rv
cggccaccaccaggcugacg

SEQ ID NO: 3301921 - RNA, 12 nt, Mycobacterium tuberculosis H37Rv
cggccaccaccg

SEQ ID NO: 3301922 - RNA, 16 nt, Mycobacterium tuberculosis H37Rv
cggccaccaccgccgc

SEQ ID NO: 3301923 - RNA, 14 nt, Mycobacterium tuberculosis H37Rv
cggccaccaccgcg

SEQ ID NO: 3301924 - RNA, 17 nt, Mycobacterium tuberculosis H37Rv
cggccaccaccgcgccg

SEQ ID NO: 3301925 - RNA, 14 nt, Mycobacterium tuberculosis H37Rv
cggccaccagcaug

SEQ ID NO: 3301926 - RNA, 22 nt, Mycobacterium tuberculosis H37Rv
cggccaccagcgcccggcccgc

SEQ ID NO: 3301927 - RNA, 16 nt, Mycobacterium tuberculosis H37Rv
cggccaccagcgccuu

SEQ ID NO: 3301928 - RNA, 18 nt, Mycobacterium tuberculosis H37Rv
cggccaccagggccaccg

SEQ ID NO: 3301929 - RNA, 19 nt, Mycobacterium tuberculosis H37Rv
cggccaccagggccaccgc

SEQ ID NO: 3301930 - RNA, 23 nt, Mycobacterium tuberculosis H37Rv
cggccaccagggccaccgcgccg

SEQ ID NO: 3301931 - RNA, 16 nt, Mycobacterium tuberculosis H37Rv
cggccaccaguccgau

SEQ ID NO: 3301932 - RNA, 17 nt, Mycobacterium tuberculosis H37Rv
cggccaccaucgccccg

SEQ ID NO: 3301933 - RNA, 13 nt, Mycobacterium tuberculosis H37Rv
cggccacccgcga

SEQ ID NO: 3301934 - RNA, 20 nt, Mycobacterium tuberculosis H37Rv
cggccacccggacauagccg

SEQ ID NO: 3301935 - RNA, 15 nt, Mycobacterium tuberculosis H37Rv
cggccaccgaggcgu

SEQ ID NO: 3301936 - RNA, 19 nt, Mycobacterium tuberculosis H37Rv
cggccaccgaggcguucag

SEQ ID NO: 3301937 - RNA, 20 nt, Mycobacterium tuberculosis H37Rv
cggccaccgaggcguucagu

SEQ ID NO: 3301938 - RNA, 12 nt, Mycobacterium tuberculosis H37Rv
cggccaccgccg

SEQ ID NO: 3301939 - RNA, 13 nt, Mycobacterium tuberculosis H37Rv
cggccaccgccgc

SEQ ID NO: 3301940 - RNA, 15 nt, Mycobacterium tuberculosis H37Rv
cggccaccgccgccg

SEQ ID NO: 3301941 - RNA, 13 nt, Mycobacterium tuberculosis H37Rv
cggccaccgccug

SEQ ID NO: 3301942 - RNA, 22 nt, Mycobacterium tuberculosis H37Rv
cggccaccgccuguacgagcag

SEQ ID NO: 3301943 - RNA, 15 nt, Mycobacterium tuberculosis H37Rv
cggccaccgcgcaac

SEQ ID NO: 3301944 - RNA, 19 nt, Mycobacterium tuberculosis H37Rv
cggccaccggacgaaacga

SEQ ID NO: 3301945 - RNA, 13 nt, Mycobacterium tuberculosis H37Rv
cggccaccggcgu

SEQ ID NO: 3301946 - RNA, 17 nt, Mycobacterium tuberculosis H37Rv
cggccaccggcgucugc

SEQ ID NO: 3301947 - RNA, 20 nt, Mycobacterium tuberculosis H37Rv
cggccaccgucagcgcgacc

SEQ ID NO: 3301948 - RNA, 13 nt, Mycobacterium tuberculosis H37Rv
cggccaccugcuc

SEQ ID NO: 3301949 - RNA, 22 nt, Mycobacterium tuberculosis H37Rv
cggccaccugcucgucggucac

SEQ ID NO: 3301950 - RNA, 17 nt, Mycobacterium tuberculosis H37Rv
cggccacgacgacugga

SEQ ID NO: 3301951 - RNA, 17 nt, Mycobacterium tuberculosis H37Rv
cggccauaccgcucgcc

SEQ ID NO: 3301952 - RNA, 15 nt, Mycobacterium tuberculosis H37Rv
cggccauagcgccgc

SEQ ID NO: 3301953 - RNA, 20 nt, Mycobacterium tuberculosis H37Rv
cggccauaucgcccaccacg

SEQ ID NO: 3301954 - RNA, 17 nt, Mycobacterium tuberculosis H37Rv
cggccauccaccgcaga

SEQ ID NO: 3301955 - RNA, 18 nt, Mycobacterium tuberculosis H37Rv
cggccaucccgcguucga

SEQ ID NO: 3301956 - RNA, 21 nt, Mycobacterium tuberculosis H37Rv
cggccauccggucgcucgaug

SEQ ID NO: 3301957 - RNA, 14 nt, Mycobacterium tuberculosis H37Rv
cggccaucgaccgu

SEQ ID NO: 3301958 - RNA, 19 nt, Mycobacterium tuberculosis H37Rv
cggccaucgaccguccggg

SEQ ID NO: 3301959 - RNA, 13 nt, Mycobacterium tuberculosis H37Rv
cggccaucgucca

SEQ ID NO: 3301960 - RNA, 15 nt, Mycobacterium tuberculosis H37Rv
cggccaucugcucgu

SEQ ID NO: 3301961 - RNA, 17 nt, Mycobacterium tuberculosis H37Rv
cggccaucugcucgugg

SEQ ID NO: 3301962 - RNA, 18 nt, Mycobacterium tuberculosis H37Rv
cggccaugaaaaucggca

SEQ ID NO: 3301963 - RNA, 19 nt, Mycobacterium tuberculosis H37Rv
cggccaugacacguugacc

SEQ ID NO: 3301964 - RNA, 21 nt, Mycobacterium tuberculosis H37Rv
cggccaugguguucggcagcg

SEQ ID NO: 3301965 - RNA, 16 nt, Mycobacterium tuberculosis H37Rv
cggccauguagccguu

SEQ ID NO: 3301966 - RNA, 20 nt, Mycobacterium tuberculosis H37Rv
cggccaugucuccgacauug

SEQ ID NO: 3301967 - RNA, 20 nt, Mycobacterium tuberculosis H37Rv
cggccauguugcccugcaac

SEQ ID NO: 3301968 - RNA, 20 nt, Mycobacterium tuberculosis H37Rv
cggccauuagcagcacccgg

SEQ ID NO: 3301969 - RNA, 21 nt, Mycobacterium tuberculosis H37Rv
cggccauuagcagcacccggg

SEQ ID NO: 3301970 - RNA, 22 nt, Mycobacterium tuberculosis H37Rv
cggccauuagcagcacccgggc

SEQ ID NO: 3301971 - RNA, 16 nt, Mycobacterium tuberculosis H37Rv
cggccauugcccgggc

SEQ ID NO: 3301972 - RNA, 20 nt, Mycobacterium tuberculosis H37Rv
cggccauugcccgggcggga

SEQ ID NO: 3301973 - RNA, 16 nt, Mycobacterium tuberculosis H37Rv
cggccauugcgggcuc

SEQ ID NO: 3301974 - RNA, 15 nt, Mycobacterium tuberculosis H37Rv
cggcccaaccggucg

SEQ ID NO: 3301975 - RNA, 19 nt, Mycobacterium tuberculosis H37Rv
cggcccaaggaacggcguc

SEQ ID NO: 3301976 - RNA, 23 nt, Mycobacterium tuberculosis H37Rv
cggcccaaguucuaagcguuugg

SEQ ID NO: 3301977 - RNA, 15 nt, Mycobacterium tuberculosis H37Rv
cggcccacaccagcg

SEQ ID NO: 3301978 - RNA, 16 nt, Mycobacterium tuberculosis H37Rv
cggcccacaccagcgc

SEQ ID NO: 3301979 - RNA, 21 nt, Mycobacterium tuberculosis H37Rv
cggcccacaccagcgcagcau

SEQ ID NO: 3301980 - RNA, 14 nt, Mycobacterium tuberculosis H37Rv
cggcccaccggucg

SEQ ID NO: 3301981 - RNA, 14 nt, Mycobacterium tuberculosis H37Rv
cggcccacgguguc

SEQ ID NO: 3301982 - RNA, 17 nt, Mycobacterium tuberculosis H37Rv
cggcccacggugucccg

SEQ ID NO: 3301983 - RNA, 22 nt, Mycobacterium tuberculosis H37Rv
cggcccacucacacaaccgacg

SEQ ID NO: 3301984 - RNA, 12 nt, Mycobacterium tuberculosis H37Rv
cggcccagcccu

SEQ ID NO: 3301985 - RNA, 13 nt, Mycobacterium tuberculosis H37Rv
cggcccagcgcgc

SEQ ID NO: 3301986 - RNA, 20 nt, Mycobacterium tuberculosis H37Rv
cggcccagguugccuuggcg

SEQ ID NO: 3301987 - RNA, 20 nt, Mycobacterium tuberculosis H37Rv
cggcccaguucugcaggaag

SEQ ID NO: 3301988 - RNA, 12 nt, Mycobacterium tuberculosis H37Rv
cggcccaucggg

SEQ ID NO: 3301989 - RNA, 22 nt, Mycobacterium tuberculosis H37Rv
cggcccaucuucggacgccagc

SEQ ID NO: 3301990 - RNA, 23 nt, Mycobacterium tuberculosis H37Rv
cggcccaucuucggacgccagcu

SEQ ID NO: 3301991 - RNA, 19 nt, Mycobacterium tuberculosis H37Rv
cggcccaugaucucggcga

SEQ ID NO: 3301992 - RNA, 22 nt, Mycobacterium tuberculosis H37Rv
cggcccaugggggaacccccuc

SEQ ID NO: 3301993 - RNA, 20 nt, Mycobacterium tuberculosis H37Rv
cggcccauugucgaucaccu

SEQ ID NO: 3301994 - RNA, 17 nt, Mycobacterium tuberculosis H37Rv
cggccccaccggcaccc

SEQ ID NO: 3301995 - RNA, 19 nt, Mycobacterium tuberculosis H37Rv
cggccccaccggcaccccc

SEQ ID NO: 3301996 - RNA, 14 nt, Mycobacterium tuberculosis H37Rv
cggccccaccggua

SEQ ID NO: 3301997 - RNA, 18 nt, Mycobacterium tuberculosis H37Rv
cggccccaccggugccgc

SEQ ID NO: 3301998 - RNA, 19 nt, Mycobacterium tuberculosis H37Rv
cggccccaccggugccgcc

SEQ ID NO: 3301999 - RNA, 21 nt, Mycobacterium tuberculosis H37Rv
cggccccaccggugccgccgu

SEQ ID NO: 3302000 - RNA, 15 nt, Mycobacterium tuberculosis H37Rv
cggcccccccccagg

SEQ ID NO: 3302001 - RNA, 17 nt, Mycobacterium tuberculosis H37Rv
cggcccccgagaggcac

SEQ ID NO: 3302002 - RNA, 14 nt, Mycobacterium tuberculosis H37Rv
cggcccccggcagc

SEQ ID NO: 3302003 - RNA, 16 nt, Mycobacterium tuberculosis H37Rv
cggccccgaaacgaug

SEQ ID NO: 3302004 - RNA, 18 nt, Mycobacterium tuberculosis H37Rv
cggccccgaaacgauggc

SEQ ID NO: 3302005 - RNA, 18 nt, Mycobacterium tuberculosis H37Rv
cggccccgacugccgcgg

SEQ ID NO: 3302006 - RNA, 14 nt, Mycobacterium tuberculosis H37Rv
cggccccgccgaug

SEQ ID NO: 3302007 - RNA, 14 nt, Mycobacterium tuberculosis H37Rv
cggccccgccgcua

SEQ ID NO: 3302008 - RNA, 15 nt, Mycobacterium tuberculosis H37Rv
cggccccgccgucac

SEQ ID NO: 3302009 - RNA, 18 nt, Mycobacterium tuberculosis H37Rv
cggccccgccgucaccgc

SEQ ID NO: 3302010 - RNA, 19 nt, Mycobacterium tuberculosis H37Rv
cggccccgccgucaccgcc

SEQ ID NO: 3302011 - RNA, 14 nt, Mycobacterium tuberculosis H37Rv
cggccccgccguua

SEQ ID NO: 3302012 - RNA, 14 nt, Mycobacterium tuberculosis H37Rv
cggccccgccguug

SEQ ID NO: 3302013 - RNA, 17 nt, Mycobacterium tuberculosis H37Rv
cggccccgccguugccg

SEQ ID NO: 3302014 - RNA, 21 nt, Mycobacterium tuberculosis H37Rv
cggccccgccguuuccgccgc

SEQ ID NO: 3302015 - RNA, 17 nt, Mycobacterium tuberculosis H37Rv
cggccccgcgccaccuc

SEQ ID NO: 3302016 - RNA, 13 nt, Mycobacterium tuberculosis H37Rv
cggccccggccgc

SEQ ID NO: 3302017 - RNA, 14 nt, Mycobacterium tuberculosis H37Rv
cggccccggccgcg

SEQ ID NO: 3302018 - RNA, 16 nt, Mycobacterium tuberculosis H37Rv
cggccccgucgucuag

SEQ ID NO: 3302019 - RNA, 13 nt, Mycobacterium tuberculosis H37Rv
cggccccugccac

SEQ ID NO: 3302020 - RNA, 18 nt, Mycobacterium tuberculosis H37Rv
cggcccgaauuugggcga

SEQ ID NO: 3302021 - RNA, 13 nt, Mycobacterium tuberculosis H37Rv
cggcccgacgggu

SEQ ID NO: 3302022 - RNA, 16 nt, Mycobacterium tuberculosis H37Rv
cggcccgagccgcuag

SEQ ID NO: 3302023 - RNA, 13 nt, Mycobacterium tuberculosis H37Rv
cggcccgaggugc

SEQ ID NO: 3302024 - RNA, 15 nt, Mycobacterium tuberculosis H37Rv
cggcccgaucaccag

SEQ ID NO: 3302025 - RNA, 17 nt, Mycobacterium tuberculosis H37Rv
cggcccgaucaccagcc

SEQ ID NO: 3302026 - RNA, 18 nt, Mycobacterium tuberculosis H37Rv
cggcccgcaacgcgucgg

SEQ ID NO: 3302027 - RNA, 19 nt, Mycobacterium tuberculosis H37Rv
cggcccgcacggccgcagc

SEQ ID NO: 3302028 - RNA, 15 nt, Mycobacterium tuberculosis H37Rv
cggcccgcagcagca

SEQ ID NO: 3302029 - RNA, 18 nt, Mycobacterium tuberculosis H37Rv
cggcccgcagcagcaucg

SEQ ID NO: 3302030 - RNA, 20 nt, Mycobacterium tuberculosis H37Rv
cggcccgcagccaaguccgc

SEQ ID NO: 3302031 - RNA, 19 nt, Mycobacterium tuberculosis H37Rv
cggcccgcaucgucgccga

SEQ ID NO: 3302032 - RNA, 18 nt, Mycobacterium tuberculosis H37Rv
cggcccgcaucguugccg

SEQ ID NO: 3302033 - RNA, 20 nt, Mycobacterium tuberculosis H37Rv
cggcccgcaucguugccgac

SEQ ID NO: 3302034 - RNA, 13 nt, Mycobacterium tuberculosis H37Rv
cggcccgcccgua

SEQ ID NO: 3302035 - RNA, 13 nt, Mycobacterium tuberculosis H37Rv
cggcccgccgagu

SEQ ID NO: 3302036 - RNA, 12 nt, Mycobacterium tuberculosis H37Rv
cggcccgcgggc

SEQ ID NO: 3302037 - RNA, 15 nt, Mycobacterium tuberculosis H37Rv
cggcccgcggucgcg

SEQ ID NO: 3302038 - RNA, 17 nt, Mycobacterium tuberculosis H37Rv
cggcccgcucaccuugg

SEQ ID NO: 3302039 - RNA, 13 nt, Mycobacterium tuberculosis H37Rv
cggcccgcucagc

SEQ ID NO: 3302040 - RNA, 15 nt, Mycobacterium tuberculosis H37Rv
cggcccgcucgaucg

SEQ ID NO: 3302041 - RNA, 16 nt, Mycobacterium tuberculosis H37Rv
cggcccgcucgaucgg

SEQ ID NO: 3302042 - RNA, 20 nt, Mycobacterium tuberculosis H37Rv
cggcccggacugaucgucug

SEQ ID NO: 3302043 - RNA, 16 nt, Mycobacterium tuberculosis H37Rv
cggcccggcacccggu

SEQ ID NO: 3302044 - RNA, 22 nt, Mycobacterium tuberculosis H37Rv
cggcccggcucggugcgccaga

SEQ ID NO: 3302045 - RNA, 20 nt, Mycobacterium tuberculosis H37Rv
cggcccggggacgcccucgg

SEQ ID NO: 3302046 - RNA, 17 nt, Mycobacterium tuberculosis H37Rv
cggcccgguccagcccc

SEQ ID NO: 3302047 - RNA, 19 nt, Mycobacterium tuberculosis H37Rv
cggccgcggucggccacca

SEQ ID NO: 3302048 - RNA, 22 nt, Mycobacterium tuberculosis H37Rv
cggccgcggucggccaccaacu

SEQ ID NO: 3302049 - RNA, 13 nt, Mycobacterium tuberculosis H37Rv
cggccgcggugac

SEQ ID NO: 3302050 - RNA, 22 nt, Mycobacterium tuberculosis H37Rv
cggccgcggugacggcggcugu

SEQ ID NO: 3302051 - RNA, 20 nt, Mycobacterium tuberculosis H37Rv
cggccgcguaaaccggcuga

SEQ ID NO: 3302052 - RNA, 21 nt, Mycobacterium tuberculosis H37Rv
cggccgcgucacggaccugga

SEQ ID NO: 3302053 - RNA, 15 nt, Mycobacterium tuberculosis H37Rv
cggccgcgucgucga

SEQ ID NO: 3302054 - RNA, 19 nt, Mycobacterium tuberculosis H37Rv
cggccgcuauggcccgggc

SEQ ID NO: 3302055 - RNA, 14 nt, Mycobacterium tuberculosis H37Rv
cggccgcuccaccu

SEQ ID NO: 3302056 - RNA, 19 nt, Mycobacterium tuberculosis H37Rv
cggccgcuccaccucggcg

SEQ ID NO: 3302057 - RNA, 12 nt, Mycobacterium tuberculosis H37Rv
cggccgcucggg

SEQ ID NO: 3302058 - RNA, 14 nt, Mycobacterium tuberculosis H37Rv
cggccgcucgggcc

SEQ ID NO: 3302059 - RNA, 17 nt, Mycobacterium tuberculosis H37Rv
cggccgcugaucaacag

SEQ ID NO: 3302060 - RNA, 13 nt, Mycobacterium tuberculosis H37Rv
cggccgcugccac

SEQ ID NO: 3302061 - RNA, 15 nt, Mycobacterium tuberculosis H37Rv
cggccgcuggcguug

SEQ ID NO: 3302062 - RNA, 16 nt, Mycobacterium tuberculosis H37Rv
cggccgcugggcccau

SEQ ID NO: 3302063 - RNA, 18 nt, Mycobacterium tuberculosis H37Rv
cggccgcuucggcgguca

SEQ ID NO: 3302064 - RNA, 20 nt, Mycobacterium tuberculosis H37Rv
cggccgcuucggcggucagc

SEQ ID NO: 3302065 - RNA, 14 nt, Mycobacterium tuberculosis H37Rv
cggccgcuuggccg

SEQ ID NO: 3302066 - RNA, 17 nt, Mycobacterium tuberculosis H37Rv
cggccggaacgcccggc

SEQ ID NO: 3302067 - RNA, 19 nt, Mycobacterium tuberculosis H37Rv
cggccggaauacccggccc

SEQ ID NO: 3302068 - RNA, 20 nt, Mycobacterium tuberculosis H37Rv
cggccggaauacccggccca

SEQ ID NO: 3302069 - RNA, 15 nt, Mycobacterium tuberculosis H37Rv
cggccggacgggugc

SEQ ID NO: 3302070 - RNA, 15 nt, Mycobacterium tuberculosis H37Rv
cggccggagccgccg

SEQ ID NO: 3302071 - RNA, 18 nt, Mycobacterium tuberculosis H37Rv
cggccggagccgccggcc

SEQ ID NO: 3302072 - RNA, 20 nt, Mycobacterium tuberculosis H37Rv
cggccggagccgccggcccc

SEQ ID NO: 3302073 - RNA, 22 nt, Mycobacterium tuberculosis H37Rv
cggccggagccgccggccccgc

SEQ ID NO: 3302074 - RNA, 18 nt, Mycobacterium tuberculosis H37Rv
cggccggaguccgucggg

SEQ ID NO: 3302075 - RNA, 16 nt, Mycobacterium tuberculosis H37Rv
cggccggauacggcga

SEQ ID NO: 3302076 - RNA, 23 nt, Mycobacterium tuberculosis H37Rv
cggccggauguugaccggcucga

SEQ ID NO: 3302077 - RNA, 17 nt, Mycobacterium tuberculosis H37Rv
cggccggcaagcagucg

SEQ ID NO: 3302078 - RNA, 15 nt, Mycobacterium tuberculosis H37Rv
cggccggcaaugccg

SEQ ID NO: 3302079 - RNA, 23 nt, Mycobacterium tuberculosis H37Rv
cggccggcaaugccgcggccagu

SEQ ID NO: 3302080 - RNA, 13 nt, Mycobacterium tuberculosis H37Rv
cggccggcacccc

SEQ ID NO: 3302081 - RNA, 20 nt, Mycobacterium tuberculosis H37Rv
cggccggcaccccacggcca

SEQ ID NO: 3302082 - RNA, 18 nt, Mycobacterium tuberculosis H37Rv
cggccggcaguccgagcu

SEQ ID NO: 3302083 - RNA, 19 nt, Mycobacterium tuberculosis H37Rv
cggccggcaguccgagcuu

SEQ ID NO: 3302084 - RNA, 14 nt, Mycobacterium tuberculosis H37Rv
cggccggcccgggu

SEQ ID NO: 3302085 - RNA, 20 nt, Mycobacterium tuberculosis H37Rv
cggccggccgcccgcucgau

SEQ ID NO: 3302086 - RNA, 14 nt, Mycobacterium tuberculosis H37Rv
cggccggccgcggg

SEQ ID NO: 3302087 - RNA, 23 nt, Mycobacterium tuberculosis H37Rv
cggccggccgcucaccccgcgcu

SEQ ID NO: 3302088 - RNA, 13 nt, Mycobacterium tuberculosis H37Rv
cggccggccgcug

SEQ ID NO: 3302089 - RNA, 17 nt, Mycobacterium tuberculosis H37Rv
cggccggccuagccgau

SEQ ID NO: 3302090 - RNA, 20 nt, Mycobacterium tuberculosis H37Rv
cggccggccuagccgauggc

SEQ ID NO: 3302091 - RNA, 12 nt, Mycobacterium tuberculosis H37Rv
cggccggcgacg

SEQ ID NO: 3302092 - RNA, 15 nt, Mycobacterium tuberculosis H37Rv
cggccggcgcucgcg

SEQ ID NO: 3302093 - RNA, 14 nt, Mycobacterium tuberculosis H37Rv
cggccggcggccgc

SEQ ID NO: 3302094 - RNA, 16 nt, Mycobacterium tuberculosis H37Rv
cggccggcggccgccc

SEQ ID NO: 3302095 - RNA, 13 nt, Mycobacterium tuberculosis H37Rv
cggccggcgggcc

SEQ ID NO: 3302096 - RNA, 17 nt, Mycobacterium tuberculosis H37Rv
cggccggcgucagcccc

SEQ ID NO: 3302097 - RNA, 15 nt, Mycobacterium tuberculosis H37Rv
cggccgggacggcga

SEQ ID NO: 3302098 - RNA, 13 nt, Mycobacterium tuberculosis H37Rv
cggccgggcccuc

SEQ ID NO: 3302099 - RNA, 21 nt, Mycobacterium tuberculosis H37Rv
cggccgggcggccaggcgcga

SEQ ID NO: 3302100 - RNA, 19 nt, Mycobacterium tuberculosis H37Rv
cggccgggcgggcggccga

SEQ ID NO: 3302101 - RNA, 16 nt, Mycobacterium tuberculosis H37Rv
cggccgggucggugac

SEQ ID NO: 3302102 - RNA, 17 nt, Mycobacterium tuberculosis H37Rv
cggccggguggcccggc

SEQ ID NO: 3302103 - RNA, 21 nt, Mycobacterium tuberculosis H37Rv
cggccggguguagcucggacc

SEQ ID NO: 3302104 - RNA, 19 nt, Mycobacterium tuberculosis H37Rv
cggccggguuaucggcagc

SEQ ID NO: 3302105 - RNA, 22 nt, Mycobacterium tuberculosis H37Rv
cggccggguuaucggcagcagg

SEQ ID NO: 3302106 - RNA, 19 nt, Mycobacterium tuberculosis H37Rv
cggccggguucgcgucuga

SEQ ID NO: 3302107 - RNA, 20 nt, Mycobacterium tuberculosis H37Rv
cggccggguucgcgucugac

SEQ ID NO: 3302108 - RNA, 22 nt, Mycobacterium tuberculosis H37Rv
cggccgguagaucuucggccgc

SEQ ID NO: 3302109 - RNA, 14 nt, Mycobacterium tuberculosis H37Rv
cggccggucgagac

SEQ ID NO: 3302110 - RNA, 13 nt, Mycobacterium tuberculosis H37Rv
cggccggugauga

SEQ ID NO: 3302111 - RNA, 19 nt, Mycobacterium tuberculosis H37Rv
cggccggugaugaucgcgc

SEQ ID NO: 3302112 - RNA, 23 nt, Mycobacterium tuberculosis H37Rv
cggccggugaugaucgcgccggg

SEQ ID NO: 3302113 - RNA, 21 nt, Mycobacterium tuberculosis H37Rv
cggccgguggaaaccgggcga

SEQ ID NO: 3302114 - RNA, 18 nt, Mycobacterium tuberculosis H37Rv
cggccgguuggccagcca

SEQ ID NO: 3302115 - RNA, 19 nt, Mycobacterium tuberculosis H37Rv
cggccgguuggccagccac

SEQ ID NO: 3302116 - RNA, 20 nt, Mycobacterium tuberculosis H37Rv
cggccgucaccggucggcca

SEQ ID NO: 3302117 - RNA, 16 nt, Mycobacterium tuberculosis H37Rv
cggccgucauggcccg

SEQ ID NO: 3302118 - RNA, 18 nt, Mycobacterium tuberculosis H37Rv
cggccgucccgcgagcag

SEQ ID NO: 3302119 - RNA, 22 nt, Mycobacterium tuberculosis H37Rv
cggccguccuuuccaggagaga

SEQ ID NO: 3302120 - RNA, 12 nt, Mycobacterium tuberculosis H37Rv
cggccgucgacg

SEQ ID NO: 3302121 - RNA, 13 nt, Mycobacterium tuberculosis H37Rv
cggccgucgaucu

SEQ ID NO: 3302122 - RNA, 15 nt, Mycobacterium tuberculosis H37Rv
cggccgucgauugca

SEQ ID NO: 3302123 - RNA, 16 nt, Mycobacterium tuberculosis H37Rv
cggccgucgcgcgacc

SEQ ID NO: 3302124 - RNA, 15 nt, Mycobacterium tuberculosis H37Rv
cggccgucgcgggac

SEQ ID NO: 3302125 - RNA, 13 nt, Mycobacterium tuberculosis H37Rv
cggccgucgucgg

SEQ ID NO: 3302126 - RNA, 16 nt, Mycobacterium tuberculosis H37Rv
cggccgucgucggcca

SEQ ID NO: 3302127 - RNA, 17 nt, Mycobacterium tuberculosis H37Rv
cggccgucuucggugau

SEQ ID NO: 3302128 - RNA, 18 nt, Mycobacterium tuberculosis H37Rv
cggccgugaauucgccga

SEQ ID NO: 3302129 - RNA, 16 nt, Mycobacterium tuberculosis H37Rv
cggccgugagcccggc

SEQ ID NO: 3302130 - RNA, 15 nt, Mycobacterium tuberculosis H37Rv
cggccgugccgccga

SEQ ID NO: 3302131 - RNA, 19 nt, Mycobacterium tuberculosis H37Rv
cggccguggaaagccggcg

SEQ ID NO: 3302132 - RNA, 16 nt, Mycobacterium tuberculosis H37Rv
cggccguggcuggacc

SEQ ID NO: 3302133 - RNA, 14 nt, Mycobacterium tuberculosis H37Rv
cggccgugucgggc

SEQ ID NO: 3302134 - RNA, 12 nt, Mycobacterium tuberculosis H37Rv
cggccguugggc

SEQ ID NO: 3302135 - RNA, 14 nt, Mycobacterium tuberculosis H37Rv
cggccguugggcca

SEQ ID NO: 3302136 - RNA, 17 nt, Mycobacterium tuberculosis H37Rv
cggccguugggccaccg

SEQ ID NO: 3302137 - RNA, 18 nt, Mycobacterium tuberculosis H37Rv
cggccguugggccaccgg

SEQ ID NO: 3302138 - RNA, 21 nt, Mycobacterium tuberculosis H37Rv
cggccuaacucgccugcaccc

SEQ ID NO: 3302139 - RNA, 16 nt, Mycobacterium tuberculosis H37Rv
cggccuaggacgccgc

SEQ ID NO: 3302140 - RNA, 21 nt, Mycobacterium tuberculosis H37Rv
cggccucaguacagcgcguug

SEQ ID NO: 3302141 - RNA, 12 nt, Mycobacterium tuberculosis H37Rv
cggccuccacca

SEQ ID NO: 3302142 - RNA, 18 nt, Mycobacterium tuberculosis H37Rv
cggccuccaccacgucgg

SEQ ID NO: 3302143 - RNA, 20 nt, Mycobacterium tuberculosis H37Rv
cggcgaagucacgcacccgg

SEQ ID NO: 3302144 - RNA, 21 nt, Mycobacterium tuberculosis H37Rv
cggcgaagucacgcacccggc

SEQ ID NO: 3302145 - RNA, 17 nt, Mycobacterium tuberculosis H37Rv
cggcgaagucgagugcc

SEQ ID NO: 3302146 - RNA, 21 nt, Mycobacterium tuberculosis H37Rv
cggcgaagugcuccaccucgg

SEQ ID NO: 3302147 - RNA, 15 nt, Mycobacterium tuberculosis H37Rv
cggcgaauacgaccg

SEQ ID NO: 3302148 - RNA, 14 nt, Mycobacterium tuberculosis H37Rv
cggcgaaucgggca

SEQ ID NO: 3302149 - RNA, 18 nt, Mycobacterium tuberculosis H37Rv
cggcgaaugccagugaca

SEQ ID NO: 3302150 - RNA, 15 nt, Mycobacterium tuberculosis H37Rv
cggcgacaacagcac

SEQ ID NO: 3302151 - RNA, 23 nt, Mycobacterium tuberculosis H37Rv
cggcgacaagccgagcccgucga

SEQ ID NO: 3302152 - RNA, 17 nt, Mycobacterium tuberculosis H37Rv
cggcgacacccugggug

SEQ ID NO: 3302153 - RNA, 16 nt, Mycobacterium tuberculosis H37Rv
cggcgacaccgcaccg

SEQ ID NO: 3302154 - RNA, 19 nt, Mycobacterium tuberculosis H37Rv
cggcgacacgccagccgug

SEQ ID NO: 3302155 - RNA, 21 nt, Mycobacterium tuberculosis H37Rv
cggcgacacgccagccgugcc

SEQ ID NO: 3302156 - RNA, 16 nt, Mycobacterium tuberculosis H37Rv
cggcgacacgccaggu

SEQ ID NO: 3302157 - RNA, 20 nt, Mycobacterium tuberculosis H37Rv
cggcgacagcgcggcggucg

SEQ ID NO: 3302158 - RNA, 19 nt, Mycobacterium tuberculosis H37Rv
cggcgacagcuuggccggu

SEQ ID NO: 3302159 - RNA, 22 nt, Mycobacterium tuberculosis H37Rv
cggcgacagcuuggccgguuca

SEQ ID NO: 3302160 - RNA, 20 nt, Mycobacterium tuberculosis H37Rv
cggcgacaggagacgguacg

SEQ ID NO: 3302161 - RNA, 17 nt, Mycobacterium tuberculosis H37Rv
cggcgacaggccgagca

SEQ ID NO: 3302162 - RNA, 18 nt, Mycobacterium tuberculosis H37Rv
cggcgacaugaucugcca

SEQ ID NO: 3302163 - RNA, 18 nt, Mycobacterium tuberculosis H37Rv
cggcgaccaccagcgccg

SEQ ID NO: 3302164 - RNA, 14 nt, Mycobacterium tuberculosis H37Rv
cggcgaccaccccg

SEQ ID NO: 3302165 - RNA, 17 nt, Mycobacterium tuberculosis H37Rv
cggcgaccaccccguag

SEQ ID NO: 3302166 - RNA, 13 nt, Mycobacterium tuberculosis H37Rv
cggcgaccaccgu

SEQ ID NO: 3302167 - RNA, 15 nt, Mycobacterium tuberculosis H37Rv
cggcgaccacgccgc

SEQ ID NO: 3302168 - RNA, 22 nt, Mycobacterium tuberculosis H37Rv
cggcgaccacgccgccggcgcu

SEQ ID NO: 3302169 - RNA, 16 nt, Mycobacterium tuberculosis H37Rv
cggcgaccacggcacc

SEQ ID NO: 3302170 - RNA, 17 nt, Mycobacterium tuberculosis H37Rv
cggcgaccacggcaccg

SEQ ID NO: 3302171 - RNA, 16 nt, Mycobacterium tuberculosis H37Rv
cggcgaccagaaucuc

SEQ ID NO: 3302172 - RNA, 21 nt, Mycobacterium tuberculosis H37Rv
cggcgaccagaaucucgccgg

SEQ ID NO: 3302173 - RNA, 20 nt, Mycobacterium tuberculosis H37Rv
cggcgaccagcucagcugcg

SEQ ID NO: 3302174 - RNA, 23 nt, Mycobacterium tuberculosis H37Rv
cggcgaccauaagcucguagagc

SEQ ID NO: 3302175 - RNA, 21 nt, Mycobacterium tuberculosis H37Rv
cggcgaccccgaacauccgcc

SEQ ID NO: 3302176 - RNA, 20 nt, Mycobacterium tuberculosis H37Rv
cggcgaccccgaagaugacc

SEQ ID NO: 3302177 - RNA, 15 nt, Mycobacterium tuberculosis H37Rv
cggcgacccgccugu

SEQ ID NO: 3302178 - RNA, 16 nt, Mycobacterium tuberculosis H37Rv
cggcgacccgccugua

SEQ ID NO: 3302179 - RNA, 13 nt, Mycobacterium tuberculosis H37Rv
cggcgacccgggu

SEQ ID NO: 3302180 - RNA, 14 nt, Mycobacterium tuberculosis H37Rv
cggcgacccgggua

SEQ ID NO: 3302181 - RNA, 12 nt, Mycobacterium tuberculosis H37Rv
cggcgacccggu

SEQ ID NO: 3302182 - RNA, 16 nt, Mycobacterium tuberculosis H37Rv
cggcgacccggucacu

SEQ ID NO: 3302183 - RNA, 17 nt, Mycobacterium tuberculosis H37Rv
cggcgaccgccugcgcg

SEQ ID NO: 3302184 - RNA, 16 nt, Mycobacterium tuberculosis H37Rv
cggcgaccgcgcucac

SEQ ID NO: 3302185 - RNA, 18 nt, Mycobacterium tuberculosis H37Rv
cggcgaccgcgcucaccg

SEQ ID NO: 3302186 - RNA, 20 nt, Mycobacterium tuberculosis H37Rv
cggcgaccgcgcucaccggg

SEQ ID NO: 3302187 - RNA, 19 nt, Mycobacterium tuberculosis H37Rv
cggcgaccggcgagcccgc

SEQ ID NO: 3302188 - RNA, 12 nt, Mycobacterium tuberculosis H37Rv
cggcgaccgucg

SEQ ID NO: 3302189 - RNA, 14 nt, Mycobacterium tuberculosis H37Rv
cggcgaccgucgau

SEQ ID NO: 3302190 - RNA, 17 nt, Mycobacterium tuberculosis H37Rv
cggcgaccuccgggaug

SEQ ID NO: 3302191 - RNA, 19 nt, Mycobacterium tuberculosis H37Rv
cggcgaccucggcggcggc

SEQ ID NO: 3302192 - RNA, 22 nt, Mycobacterium tuberculosis H37Rv
cggcgaccucggguugcagcag

SEQ ID NO: 3302193 - RNA, 23 nt, Mycobacterium tuberculosis H37Rv
cggcgaccucggguugcagcagc

SEQ ID NO: 3302194 - RNA, 21 nt, Mycobacterium tuberculosis H37Rv
cggcgaccugcucgcugguga

SEQ ID NO: 3302195 - RNA, 14 nt, Mycobacterium tuberculosis H37Rv
cggcgacgaaccgc

SEQ ID NO: 3302196 - RNA, 15 nt, Mycobacterium tuberculosis H37Rv
cggcgacgaaccgcc

SEQ ID NO: 3302197 - RNA, 18 nt, Mycobacterium tuberculosis H37Rv
cggcgacgaaccgccaga

SEQ ID NO: 3302198 - RNA, 14 nt, Mycobacterium tuberculosis H37Rv
cggcgacgacccgg

SEQ ID NO: 3302199 - RNA, 14 nt, Mycobacterium tuberculosis H37Rv
cggcgacgaccguc

SEQ ID NO: 3302200 - RNA, 15 nt, Mycobacterium tuberculosis H37Rv
cggcgacgaccgucg

SEQ ID NO: 3302201 - RNA, 19 nt, Mycobacterium tuberculosis H37Rv
cggcgacgaccgucggcuc

SEQ ID NO: 3302202 - RNA, 17 nt, Mycobacterium tuberculosis H37Rv
cggcgacgagcgcagcg

SEQ ID NO: 3302203 - RNA, 12 nt, Mycobacterium tuberculosis H37Rv
cggcgacgaugu

SEQ ID NO: 3302204 - RNA, 19 nt, Mycobacterium tuberculosis H37Rv
cggcgacgauucgagcggu

SEQ ID NO: 3302205 - RNA, 23 nt, Mycobacterium tuberculosis H37Rv
cggcgacgauucgagcgguugcc

SEQ ID NO: 3302206 - RNA, 15 nt, Mycobacterium tuberculosis H37Rv
cggcgacgccgcugg

SEQ ID NO: 3302207 - RNA, 18 nt, Mycobacterium tuberculosis H37Rv
cggcgacgcgccgguuca

SEQ ID NO: 3302208 - RNA, 14 nt, Mycobacterium tuberculosis H37Rv
cggcgacgcguagc

SEQ ID NO: 3302209 - RNA, 14 nt, Mycobacterium tuberculosis H37Rv
cggcgacgcgucga

SEQ ID NO: 3302210 - RNA, 19 nt, Mycobacterium tuberculosis H37Rv
cggcgacgcuaccgccgga

SEQ ID NO: 3302211 - RNA, 20 nt, Mycobacterium tuberculosis H37Rv
cggcgacggccagcgcgucg

SEQ ID NO: 3302212 - RNA, 14 nt, Mycobacterium tuberculosis H37Rv
cggcgacggccgcu

SEQ ID NO: 3302213 - RNA, 15 nt, Mycobacterium tuberculosis H37Rv
cggcgacggcgccca

SEQ ID NO: 3302214 - RNA, 16 nt, Mycobacterium tuberculosis H37Rv
cggcgacgggucgggc

SEQ ID NO: 3302215 - RNA, 17 nt, Mycobacterium tuberculosis H37Rv
cggcgacgggucgggca

SEQ ID NO: 3302216 - RNA, 19 nt, Mycobacterium tuberculosis H37Rv
cggcgacguagacgguccg

SEQ ID NO: 3302217 - RNA, 19 nt, Mycobacterium tuberculosis H37Rv
cggcgacgucucgcaugcu

SEQ ID NO: 3302218 - RNA, 13 nt, Mycobacterium tuberculosis H37Rv
cggcgacgucugc

SEQ ID NO: 3302219 - RNA, 14 nt, Mycobacterium tuberculosis H37Rv
cggcgacguggcgc

SEQ ID NO: 3302220 - RNA, 16 nt, Mycobacterium tuberculosis H37Rv
cggcgacuacccagcc

SEQ ID NO: 3302221 - RNA, 22 nt, Mycobacterium tuberculosis H37Rv
cggcgacuacccagccagccgc

SEQ ID NO: 3302222 - RNA, 23 nt, Mycobacterium tuberculosis H37Rv
cggcgacucgaggaccugcucgg

SEQ ID NO: 3302223 - RNA, 15 nt, Mycobacterium tuberculosis H37Rv
cggcgacucugcggg

SEQ ID NO: 3302224 - RNA, 20 nt, Mycobacterium tuberculosis H37Rv
cggcgacugcgcaccugggu

SEQ ID NO: 3302225 - RNA, 12 nt, Mycobacterium tuberculosis H37Rv
cggcgacugcgu

SEQ ID NO: 3302226 - RNA, 13 nt, Mycobacterium tuberculosis H37Rv
cggcgacuguccc

SEQ ID NO: 3302227 - RNA, 14 nt, Mycobacterium tuberculosis H37Rv
cggcgagagcguca

SEQ ID NO: 3302228 - RNA, 18 nt, Mycobacterium tuberculosis H37Rv
cggcgagagggcggggca

SEQ ID NO: 3302229 - RNA, 14 nt, Mycobacterium tuberculosis H37Rv
cggcgagcaccacc

SEQ ID NO: 3302230 - RNA, 15 nt, Mycobacterium tuberculosis H37Rv
cggcgagcaccaccc

SEQ ID NO: 3302231 - RNA, 19 nt, Mycobacterium tuberculosis H37Rv
cggcgagcacccgcugguc

SEQ ID NO: 3302232 - RNA, 16 nt, Mycobacterium tuberculosis H37Rv
cggcgagcacgcgggc

SEQ ID NO: 3302233 - RNA, 17 nt, Mycobacterium tuberculosis H37Rv
cggcgagcagacgccgc

SEQ ID NO: 3302234 - RNA, 15 nt, Mycobacterium tuberculosis H37Rv
cggcgagcccgcauc

SEQ ID NO: 3302235 - RNA, 16 nt, Mycobacterium tuberculosis H37Rv
cggcgagcccgcaucg

SEQ ID NO: 3302236 - RNA, 15 nt, Mycobacterium tuberculosis H37Rv
cggcgagccgcgccc

SEQ ID NO: 3302237 - RNA, 23 nt, Mycobacterium tuberculosis H37Rv
cggcgagccgcucgcugaaccgg

SEQ ID NO: 3302238 - RNA, 19 nt, Mycobacterium tuberculosis H37Rv
cggcgagccucgcgcgcca

SEQ ID NO: 3302239 - RNA, 14 nt, Mycobacterium tuberculosis H37Rv
cggcgccaccgccg

SEQ ID NO: 3302240 - RNA, 16 nt, Mycobacterium tuberculosis H37Rv
cggcgccaccgccgcu

SEQ ID NO: 3302241 - RNA, 17 nt, Mycobacterium tuberculosis H37Rv
cggcgccaccgccgcug

SEQ ID NO: 3302242 - RNA, 19 nt, Mycobacterium tuberculosis H37Rv
cggcgccaccggcgccgcc

SEQ ID NO: 3302243 - RNA, 20 nt, Mycobacterium tuberculosis H37Rv
cggcgccaccggcgccgccc

SEQ ID NO: 3302244 - RNA, 24 nt, Mycobacterium tuberculosis H37Rv
cggcgccaccguugccgaaccacg

SEQ ID NO: 3302245 - RNA, 14 nt, Mycobacterium tuberculosis H37Rv
cggcgccagaucga

SEQ ID NO: 3302246 - RNA, 13 nt, Mycobacterium tuberculosis H37Rv
cggcgccagcaga

SEQ ID NO: 3302247 - RNA, 14 nt, Mycobacterium tuberculosis H37Rv
cggcgccagcgccg

SEQ ID NO: 3302248 - RNA, 16 nt, Mycobacterium tuberculosis H37Rv
cggcgccaggcaccac

SEQ ID NO: 3302249 - RNA, 23 nt, Mycobacterium tuberculosis H37Rv
cggcgccaggcaccacgaccgac

SEQ ID NO: 3302250 - RNA, 16 nt, Mycobacterium tuberculosis H37Rv
cggcgccagugcgguc

SEQ ID NO: 3302251 - RNA, 18 nt, Mycobacterium tuberculosis H37Rv
cggcgccauagccgcgac

SEQ ID NO: 3302252 - RNA, 13 nt, Mycobacterium tuberculosis H37Rv
cggcgccaucggg

SEQ ID NO: 3302253 - RNA, 18 nt, Mycobacterium tuberculosis H37Rv
cggcgccauggaucccac

SEQ ID NO: 3302254 - RNA, 17 nt, Mycobacterium tuberculosis H37Rv
cggcgccauuggcgucc

SEQ ID NO: 3302255 - RNA, 22 nt, Mycobacterium tuberculosis H37Rv
cggcgccauuggcgucccgcaa

SEQ ID NO: 3302256 - RNA, 16 nt, Mycobacterium tuberculosis H37Rv
cggcgcccacaucguc

SEQ ID NO: 3302257 - RNA, 22 nt, Mycobacterium tuberculosis H37Rv
cggcgcccacaucgucggcggg

SEQ ID NO: 3302258 - RNA, 15 nt, Mycobacterium tuberculosis H37Rv
cggcgcccagcgccu

SEQ ID NO: 3302259 - RNA, 21 nt, Mycobacterium tuberculosis H37Rv
cggcgcccagcucgucgagcu

SEQ ID NO: 3302260 - RNA, 12 nt, Mycobacterium tuberculosis H37Rv
cggcgcccagga

SEQ ID NO: 3302261 - RNA, 15 nt, Mycobacterium tuberculosis H37Rv
cggcgcccaggaacu

SEQ ID NO: 3302262 - RNA, 12 nt, Mycobacterium tuberculosis H37Rv
cggcgcccaggc

SEQ ID NO: 3302263 - RNA, 15 nt, Mycobacterium tuberculosis H37Rv
cggcgcccaggccga

SEQ ID NO: 3302264 - RNA, 17 nt, Mycobacterium tuberculosis H37Rv
cggcgcccaggccgauc

SEQ ID NO: 3302265 - RNA, 21 nt, Mycobacterium tuberculosis H37Rv
cggcgcccaggccgaucagcg

SEQ ID NO: 3302266 - RNA, 18 nt, Mycobacterium tuberculosis H37Rv
cggcgcccauagcaccuc

SEQ ID NO: 3302267 - RNA, 21 nt, Mycobacterium tuberculosis H37Rv
cggcgcccauagcaccucgau

SEQ ID NO: 3302268 - RNA, 15 nt, Mycobacterium tuberculosis H37Rv
cggcgcccaucgcga

SEQ ID NO: 3302269 - RNA, 21 nt, Mycobacterium tuberculosis H37Rv
cggcgcccccguuaccgccgu

SEQ ID NO: 3302270 - RNA, 23 nt, Mycobacterium tuberculosis H37Rv
cggcgcccccguuaccgccgucg

SEQ ID NO: 3302271 - RNA, 16 nt, Mycobacterium tuberculosis H37Rv
cggcgcccgccgcgaa

SEQ ID NO: 3302272 - RNA, 17 nt, Mycobacterium tuberculosis H37Rv
cggcgcccgccgcgaac

SEQ ID NO: 3302273 - RNA, 19 nt, Mycobacterium tuberculosis H37Rv
cggcgcccgcucggccgca

SEQ ID NO: 3302274 - RNA, 21 nt, Mycobacterium tuberculosis H37Rv
cggcgcccgcucggccgcagc

SEQ ID NO: 3302275 - RNA, 24 nt, Mycobacterium tuberculosis H37Rv
cggcgcccgcucggccgcagccag

SEQ ID NO: 3302276 - RNA, 19 nt, Mycobacterium tuberculosis H37Rv
cggcgcccggucgagccag

SEQ ID NO: 3302277 - RNA, 17 nt, Mycobacterium tuberculosis H37Rv
cggcgcccuggccgccc

SEQ ID NO: 3302278 - RNA, 21 nt, Mycobacterium tuberculosis H37Rv
cggcgcccuggccgcccuggc

SEQ ID NO: 3302279 - RNA, 17 nt, Mycobacterium tuberculosis H37Rv
cggcgccgaaaccgccg

SEQ ID NO: 3302280 - RNA, 18 nt, Mycobacterium tuberculosis H37Rv
cggcgccgaaaccgccgg

SEQ ID NO: 3302281 - RNA, 20 nt, Mycobacterium tuberculosis H37Rv
cggcgccgaaaccgccggga

SEQ ID NO: 3302282 - RNA, 15 nt, Mycobacterium tuberculosis H37Rv
cggcgccgaacaccg

SEQ ID NO: 3302283 - RNA, 16 nt, Mycobacterium tuberculosis H37Rv
cggcgccgaacccggu

SEQ ID NO: 3302284 - RNA, 15 nt, Mycobacterium tuberculosis H37Rv
cggcgccgcaaugac

SEQ ID NO: 3302285 - RNA, 23 nt, Mycobacterium tuberculosis H37Rv
cggcgccgcaaugacgucgucgg

SEQ ID NO: 3302286 - RNA, 14 nt, Mycobacterium tuberculosis H37Rv
cggcgccgcaccca

SEQ ID NO: 3302287 - RNA, 14 nt, Mycobacterium tuberculosis H37Rv
cggcgccgcagauc

SEQ ID NO: 3302288 - RNA, 20 nt, Mycobacterium tuberculosis H37Rv
cggcgccgcagaucaccgcc

SEQ ID NO: 3302289 - RNA, 22 nt, Mycobacterium tuberculosis H37Rv
cggcgccgcagaucaccgccag

SEQ ID NO: 3302290 - RNA, 21 nt, Mycobacterium tuberculosis H37Rv
cggcgccgccaagggccccuc

SEQ ID NO: 3302291 - RNA, 15 nt, Mycobacterium tuberculosis H37Rv
cggcgccgccacgga

SEQ ID NO: 3302292 - RNA, 16 nt, Mycobacterium tuberculosis H37Rv
cggcgccgccacggau

SEQ ID NO: 3302293 - RNA, 17 nt, Mycobacterium tuberculosis H37Rv
cggcgccgccacggauc

SEQ ID NO: 3302294 - RNA, 23 nt, Mycobacterium tuberculosis H37Rv
cggcgccgccagcaccaccggcu

SEQ ID NO: 3302295 - RNA, 13 nt, Mycobacterium tuberculosis H37Rv
cggcgccgccauu

SEQ ID NO: 3302296 - RNA, 14 nt, Mycobacterium tuberculosis H37Rv
cggcgccgccauug

SEQ ID NO: 3302297 - RNA, 17 nt, Mycobacterium tuberculosis H37Rv
cggcgccgccauugucg

SEQ ID NO: 3302298 - RNA, 11 nt, Mycobacterium tuberculosis H37Rv
cggcgccgccc

SEQ ID NO: 3302299 - RNA, 19 nt, Mycobacterium tuberculosis H37Rv
cggcgccgcccaacgcgag

SEQ ID NO: 3302300 - RNA, 20 nt, Mycobacterium tuberculosis H37Rv
cggcgccgcccaacgcgagc

SEQ ID NO: 3302301 - RNA, 14 nt, Mycobacterium tuberculosis H37Rv
cggcgccgcccagc

SEQ ID NO: 3302302 - RNA, 18 nt, Mycobacterium tuberculosis H37Rv
cggcgccgcccagcaucu

SEQ ID NO: 3302303 - RNA, 18 nt, Mycobacterium tuberculosis H37Rv
cggcgccgcccgcgccgc

SEQ ID NO: 3302304 - RNA, 14 nt, Mycobacterium tuberculosis H37Rv
cggcgccgcccuug

SEQ ID NO: 3302305 - RNA, 14 nt, Mycobacterium tuberculosis H37Rv
cggcgccgccggca

SEQ ID NO: 3302306 - RNA, 20 nt, Mycobacterium tuberculosis H37Rv
cggcgccgccggcaccgggg

SEQ ID NO: 3302307 - RNA, 14 nt, Mycobacterium tuberculosis H37Rv
cggcgccgccggcg

SEQ ID NO: 3302308 - RNA, 20 nt, Mycobacterium tuberculosis H37Rv
cggcgccgccggcgccgccc

SEQ ID NO: 3302309 - RNA, 14 nt, Mycobacterium tuberculosis H37Rv
cggcgccgccggug

SEQ ID NO: 3302310 - RNA, 21 nt, Mycobacterium tuberculosis H37Rv
cggcgccgccggugccaccgg

SEQ ID NO: 3302311 - RNA, 23 nt, Mycobacterium tuberculosis H37Rv
cggcgccgccggugccaccggcu

SEQ ID NO: 3302312 - RNA, 12 nt, Mycobacterium tuberculosis H37Rv
cggcgccgccgu

SEQ ID NO: 3302313 - RNA, 14 nt, Mycobacterium tuberculosis H37Rv
cggcgccgccgucg

SEQ ID NO: 3302314 - RNA, 21 nt, Mycobacterium tuberculosis H37Rv
cggcgccgccgucgccgccgu

SEQ ID NO: 3302315 - RNA, 14 nt, Mycobacterium tuberculosis H37Rv
cggcgccgccguua

SEQ ID NO: 3302316 - RNA, 15 nt, Mycobacterium tuberculosis H37Rv
cggcgccgccuggac

SEQ ID NO: 3302317 - RNA, 14 nt, Mycobacterium tuberculosis H37Rv
cggcgccgcgccgu

SEQ ID NO: 3302318 - RNA, 15 nt, Mycobacterium tuberculosis H37Rv
cggcgccgcgcggcu

SEQ ID NO: 3302319 - RNA, 12 nt, Mycobacterium tuberculosis H37Rv
cggcgccgcggg

SEQ ID NO: 3302320 - RNA, 19 nt, Mycobacterium tuberculosis H37Rv
cggcgccgcgggugcggca

SEQ ID NO: 3302321 - RNA, 16 nt, Mycobacterium tuberculosis H37Rv
cggcgccggagccgcc

SEQ ID NO: 3302322 - RNA, 18 nt, Mycobacterium tuberculosis H37Rv
cggcgccggagccgccca

SEQ ID NO: 3302323 - RNA, 14 nt, Mycobacterium tuberculosis H37Rv
cggcgccggaguug

SEQ ID NO: 3302324 - RNA, 17 nt, Mycobacterium tuberculosis H37Rv
cggcgccggcaucgacg

SEQ ID NO: 3302325 - RNA, 17 nt, Mycobacterium tuberculosis H37Rv
cggcgccggcccgcagc

SEQ ID NO: 3302326 - RNA, 15 nt, Mycobacterium tuberculosis H37Rv
cggcgccggcgccuc

SEQ ID NO: 3302327 - RNA, 17 nt, Mycobacterium tuberculosis H37Rv
cggcgccggcgccucgu

SEQ ID NO: 3302328 - RNA, 13 nt, Mycobacterium tuberculosis H37Rv
cggcgccggcggc

SEQ ID NO: 3302329 - RNA, 15 nt, Mycobacterium tuberculosis H37Rv
cggcgccggcgucgg

SEQ ID NO: 3302330 - RNA, 20 nt, Mycobacterium tuberculosis H37Rv
cggcgccggcgucggcgccc

SEQ ID NO: 3302331 - RNA, 14 nt, Mycobacterium tuberculosis H37Rv
cggcgccggggggc

SEQ ID NO: 3302332 - RNA, 17 nt, Mycobacterium tuberculosis H37Rv
cggcgccggugccgccu

SEQ ID NO: 3302333 - RNA, 13 nt, Mycobacterium tuberculosis H37Rv
cggcgccgguggg

SEQ ID NO: 3302334 - RNA, 12 nt, Mycobacterium tuberculosis H37Rv
cggcgccgucga

SEQ ID NO: 3302335 - RNA, 16 nt, Mycobacterium tuberculosis H37Rv
cggcgccgucgcccag

SEQ ID NO: 3302336 - RNA, 13 nt, Mycobacterium tuberculosis H37Rv
cggcgcugcugcc

SEQ ID NO: 3302337 - RNA, 22 nt, Mycobacterium tuberculosis H37Rv
cggcgcugcugccauugccgau

SEQ ID NO: 3302338 - RNA, 23 nt, Mycobacterium tuberculosis H37Rv
cggcgcuggcaggcuuagcuucc

SEQ ID NO: 3302339 - RNA, 13 nt, Mycobacterium tuberculosis H37Rv
cggcgcuggccag

SEQ ID NO: 3302340 - RNA, 22 nt, Mycobacterium tuberculosis H37Rv
cggcgcuggccgucgaagacga

SEQ ID NO: 3302341 - RNA, 14 nt, Mycobacterium tuberculosis H37Rv
cggcgcuggcgggc

SEQ ID NO: 3302342 - RNA, 17 nt, Mycobacterium tuberculosis H37Rv
cggcgcuggcgggcagc

SEQ ID NO: 3302343 - RNA, 20 nt, Mycobacterium tuberculosis H37Rv
cggcgcuggcgggcgaucuc

SEQ ID NO: 3302344 - RNA, 18 nt, Mycobacterium tuberculosis H37Rv
cggcggaaggacggcagc

SEQ ID NO: 3302345 - RNA, 19 nt, Mycobacterium tuberculosis H37Rv
cggcggacaccucgggcgc

SEQ ID NO: 3302346 - RNA, 17 nt, Mycobacterium tuberculosis H37Rv
cggcggaccccucgacc

SEQ ID NO: 3302347 - RNA, 12 nt, Mycobacterium tuberculosis H37Rv
cggcggacccgg

SEQ ID NO: 3302348 - RNA, 19 nt, Mycobacterium tuberculosis H37Rv
cggcggacccggugacccg

SEQ ID NO: 3302349 - RNA, 20 nt, Mycobacterium tuberculosis H37Rv
cggcggacccggugacccgc

SEQ ID NO: 3302350 - RNA, 14 nt, Mycobacterium tuberculosis H37Rv
cggcggaccgcagc

SEQ ID NO: 3302351 - RNA, 15 nt, Mycobacterium tuberculosis H37Rv
cggcggaccgcagcg

SEQ ID NO: 3302352 - RNA, 18 nt, Mycobacterium tuberculosis H37Rv
cggcggaccgcagcguga

SEQ ID NO: 3302353 - RNA, 14 nt, Mycobacterium tuberculosis H37Rv
cggcggaccguccg

SEQ ID NO: 3302354 - RNA, 13 nt, Mycobacterium tuberculosis H37Rv
cggcggacgacgu

SEQ ID NO: 3302355 - RNA, 18 nt, Mycobacterium tuberculosis H37Rv
cggcggacgcccggcgca

SEQ ID NO: 3302356 - RNA, 14 nt, Mycobacterium tuberculosis H37Rv
cggcggacgcgggu

SEQ ID NO: 3302357 - RNA, 15 nt, Mycobacterium tuberculosis H37Rv
cggcggacgcgggug

SEQ ID NO: 3302358 - RNA, 16 nt, Mycobacterium tuberculosis H37Rv
cggcggacgcgggugc

SEQ ID NO: 3302359 - RNA, 19 nt, Mycobacterium tuberculosis H37Rv
cggcggagcgaugcgggca

SEQ ID NO: 3302360 - RNA, 15 nt, Mycobacterium tuberculosis H37Rv
cggcggagcgggcca

SEQ ID NO: 3302361 - RNA, 17 nt, Mycobacterium tuberculosis H37Rv
cggcggagcgggccagc

SEQ ID NO: 3302362 - RNA, 20 nt, Mycobacterium tuberculosis H37Rv
cggcggagcgggccagcacc

SEQ ID NO: 3302363 - RNA, 14 nt, Mycobacterium tuberculosis H37Rv
cggcggaggcuucg

SEQ ID NO: 3302364 - RNA, 14 nt, Mycobacterium tuberculosis H37Rv
cggcggagucgacg

SEQ ID NO: 3302365 - RNA, 13 nt, Mycobacterium tuberculosis H37Rv
cggcggagugcau

SEQ ID NO: 3302366 - RNA, 19 nt, Mycobacterium tuberculosis H37Rv
cggcggaucccgaggcgcc

SEQ ID NO: 3302367 - RNA, 21 nt, Mycobacterium tuberculosis H37Rv
cggcggaucccgaggcgccca

SEQ ID NO: 3302368 - RNA, 13 nt, Mycobacterium tuberculosis H37Rv
cggcggaucugau

SEQ ID NO: 3302369 - RNA, 21 nt, Mycobacterium tuberculosis H37Rv
cggcggauucgguaucagggg

SEQ ID NO: 3302370 - RNA, 22 nt, Mycobacterium tuberculosis H37Rv
cggcggauucgguaucagggga

SEQ ID NO: 3302371 - RNA, 16 nt, Mycobacterium tuberculosis H37Rv
cggcggcaaccccgag

SEQ ID NO: 3302372 - RNA, 13 nt, Mycobacterium tuberculosis H37Rv
cggcggcacccgg

SEQ ID NO: 3302373 - RNA, 14 nt, Mycobacterium tuberculosis H37Rv
cggcggcacccggg

SEQ ID NO: 3302374 - RNA, 15 nt, Mycobacterium tuberculosis H37Rv
cggcggcacccgggu

SEQ ID NO: 3302375 - RNA, 14 nt, Mycobacterium tuberculosis H37Rv
cggcggcacgcucg

SEQ ID NO: 3302376 - RNA, 19 nt, Mycobacterium tuberculosis H37Rv
cggcggcacuacgcagccg

SEQ ID NO: 3302377 - RNA, 20 nt, Mycobacterium tuberculosis H37Rv
cggcggcacuacgcagccgu

SEQ ID NO: 3302378 - RNA, 18 nt, Mycobacterium tuberculosis H37Rv
cggcggcacuggugcccg

SEQ ID NO: 3302379 - RNA, 20 nt, Mycobacterium tuberculosis H37Rv
cggcggcagcggcgccgccu

SEQ ID NO: 3302380 - RNA, 23 nt, Mycobacterium tuberculosis H37Rv
cggcggcaucaccuggcgugucg

SEQ ID NO: 3302381 - RNA, 16 nt, Mycobacterium tuberculosis H37Rv
cggcggcaugggucgu

SEQ ID NO: 3302382 - RNA, 20 nt, Mycobacterium tuberculosis H37Rv
cggcggccaacagcacccgg

SEQ ID NO: 3302383 - RNA, 12 nt, Mycobacterium tuberculosis H37Rv
cggcggccaacg

SEQ ID NO: 3302384 - RNA, 14 nt, Mycobacterium tuberculosis H37Rv
cggcggccaccagu

SEQ ID NO: 3302385 - RNA, 16 nt, Mycobacterium tuberculosis H37Rv
cggcggccacggccau

SEQ ID NO: 3302386 - RNA, 18 nt, Mycobacterium tuberculosis H37Rv
cggcggccagcgcgucgc

SEQ ID NO: 3302387 - RNA, 16 nt, Mycobacterium tuberculosis H37Rv
cggcggccagcucccg

SEQ ID NO: 3302388 - RNA, 19 nt, Mycobacterium tuberculosis H37Rv
cggcggccaguacgaucuc

SEQ ID NO: 3302389 - RNA, 20 nt, Mycobacterium tuberculosis H37Rv
cggcggccaucccgcguucg

SEQ ID NO: 3302390 - RNA, 17 nt, Mycobacterium tuberculosis H37Rv
cggcggccccaggggca

SEQ ID NO: 3302391 - RNA, 16 nt, Mycobacterium tuberculosis H37Rv
cggcggccccgcgcca

SEQ ID NO: 3302392 - RNA, 13 nt, Mycobacterium tuberculosis H37Rv
cggcggcccgaua

SEQ ID NO: 3302393 - RNA, 14 nt, Mycobacterium tuberculosis H37Rv
cggcggcccgcagc

SEQ ID NO: 3302394 - RNA, 16 nt, Mycobacterium tuberculosis H37Rv
cggcggcccgcagccc

SEQ ID NO: 3302395 - RNA, 20 nt, Mycobacterium tuberculosis H37Rv
cggcggcccguuugccgguu

SEQ ID NO: 3302396 - RNA, 15 nt, Mycobacterium tuberculosis H37Rv
cggcggcccuuucca

SEQ ID NO: 3302397 - RNA, 20 nt, Mycobacterium tuberculosis H37Rv
cggcggcccuuuccagggga

SEQ ID NO: 3302398 - RNA, 22 nt, Mycobacterium tuberculosis H37Rv
cggcggccgagcgcaccgcuga

SEQ ID NO: 3302399 - RNA, 14 nt, Mycobacterium tuberculosis H37Rv
cggcggccgcagcg

SEQ ID NO: 3302400 - RNA, 19 nt, Mycobacterium tuberculosis H37Rv
cggcggccgccaucagccg

SEQ ID NO: 3302401 - RNA, 17 nt, Mycobacterium tuberculosis H37Rv
cggcggccgcccagaug

SEQ ID NO: 3302402 - RNA, 14 nt, Mycobacterium tuberculosis H37Rv
cggcggccgcggug

SEQ ID NO: 3302403 - RNA, 15 nt, Mycobacterium tuberculosis H37Rv
cggcggccgcgugcu

SEQ ID NO: 3302404 - RNA, 19 nt, Mycobacterium tuberculosis H37Rv
cggcggccgcuucggcggu

SEQ ID NO: 3302405 - RNA, 16 nt, Mycobacterium tuberculosis H37Rv
cggcggccgucaccgg

SEQ ID NO: 3302406 - RNA, 14 nt, Mycobacterium tuberculosis H37Rv
cggcggccguggcu

SEQ ID NO: 3302407 - RNA, 19 nt, Mycobacterium tuberculosis H37Rv
cggcggccguggcuggacc

SEQ ID NO: 3302408 - RNA, 16 nt, Mycobacterium tuberculosis H37Rv
cggcggccgugucggg

SEQ ID NO: 3302409 - RNA, 18 nt, Mycobacterium tuberculosis H37Rv
cggcggccuccgcggacg

SEQ ID NO: 3302410 - RNA, 15 nt, Mycobacterium tuberculosis H37Rv
cggcggccucggucu

SEQ ID NO: 3302411 - RNA, 17 nt, Mycobacterium tuberculosis H37Rv
cggcggccugagcgucg

SEQ ID NO: 3302412 - RNA, 20 nt, Mycobacterium tuberculosis H37Rv
cggcggccuggcacccgggg

SEQ ID NO: 3302413 - RNA, 20 nt, Mycobacterium tuberculosis H37Rv
cggcggccugggccagccgc

SEQ ID NO: 3302414 - RNA, 22 nt, Mycobacterium tuberculosis H37Rv
cggcggccuucggccggcgugu

SEQ ID NO: 3302415 - RNA, 21 nt, Mycobacterium tuberculosis H37Rv
cggcggcgaacagccccaggg

SEQ ID NO: 3302416 - RNA, 21 nt, Mycobacterium tuberculosis H37Rv
cggcggcgaacucggcgauga

SEQ ID NO: 3302417 - RNA, 19 nt, Mycobacterium tuberculosis H37Rv
cggcggcgacgagcgcagc

SEQ ID NO: 3302418 - RNA, 20 nt, Mycobacterium tuberculosis H37Rv
cggcggcgacgagcgcagcg

SEQ ID NO: 3302419 - RNA, 16 nt, Mycobacterium tuberculosis H37Rv
cggcggcgacgucugc

SEQ ID NO: 3302420 - RNA, 15 nt, Mycobacterium tuberculosis H37Rv
cggcggcgacguggc

SEQ ID NO: 3302421 - RNA, 19 nt, Mycobacterium tuberculosis H37Rv
cggcggcgaggcgagucac

SEQ ID NO: 3302422 - RNA, 22 nt, Mycobacterium tuberculosis H37Rv
cggcggcgaggcgagucaccgg

SEQ ID NO: 3302423 - RNA, 13 nt, Mycobacterium tuberculosis H37Rv
cggcggcgaugac

SEQ ID NO: 3302424 - RNA, 12 nt, Mycobacterium tuberculosis H37Rv
cggcggcgcccc

SEQ ID NO: 3302425 - RNA, 20 nt, Mycobacterium tuberculosis H37Rv
cggcggcgccgaaaccgccg

SEQ ID NO: 3302426 - RNA, 13 nt, Mycobacterium tuberculosis H37Rv
cggcggcgccgcc

SEQ ID NO: 3302427 - RNA, 15 nt, Mycobacterium tuberculosis H37Rv
cggcggcgccgccca

SEQ ID NO: 3302428 - RNA, 21 nt, Mycobacterium tuberculosis H37Rv
cggcggcgccgcccaacgcga

SEQ ID NO: 3302429 - RNA, 15 nt, Mycobacterium tuberculosis H37Rv
cggcggcgccguucg

SEQ ID NO: 3302430 - RNA, 15 nt, Mycobacterium tuberculosis H37Rv
cggcggcgcucuucg

SEQ ID NO: 3302431 - RNA, 16 nt, Mycobacterium tuberculosis H37Rv
cggcggcgcuggcggg

SEQ ID NO: 3302432 - RNA, 18 nt, Mycobacterium tuberculosis H37Rv
cggcggcgcuggucgcgg

SEQ ID NO: 3302433 - RNA, 16 nt, Mycobacterium tuberculosis H37Rv
cggcggugucacgacc

SEQ ID NO: 3302434 - RNA, 20 nt, Mycobacterium tuberculosis H37Rv
cggcgguguguuccaacucc

SEQ ID NO: 3302435 - RNA, 18 nt, Mycobacterium tuberculosis H37Rv
cggcgguuaucgucgggu

SEQ ID NO: 3302436 - RNA, 18 nt, Mycobacterium tuberculosis H37Rv
cggcgguuccauacagcc

SEQ ID NO: 3302437 - RNA, 16 nt, Mycobacterium tuberculosis H37Rv
cggcgguucgaucccg

SEQ ID NO: 3302438 - RNA, 18 nt, Mycobacterium tuberculosis H37Rv
cggcgguucugcggccgc

SEQ ID NO: 3302439 - RNA, 21 nt, Mycobacterium tuberculosis H37Rv
cggcgguugccccgaccgccg

SEQ ID NO: 3302440 - RNA, 23 nt, Mycobacterium tuberculosis H37Rv
cggcgguuggugcagcgugcagc

SEQ ID NO: 3302441 - RNA, 19 nt, Mycobacterium tuberculosis H37Rv
cggcguacaaaccgucggg

SEQ ID NO: 3302442 - RNA, 16 nt, Mycobacterium tuberculosis H37Rv
cggcguacagcgccug

SEQ ID NO: 3302443 - RNA, 18 nt, Mycobacterium tuberculosis H37Rv
cggcguacgguacggacc

SEQ ID NO: 3302444 - RNA, 15 nt, Mycobacterium tuberculosis H37Rv
cggcguacucgguga

SEQ ID NO: 3302445 - RNA, 23 nt, Mycobacterium tuberculosis H37Rv
cggcguacucgugcaccgucggg

SEQ ID NO: 3302446 - RNA, 23 nt, Mycobacterium tuberculosis H37Rv
cggcguagaucaucagcgacuug

SEQ ID NO: 3302447 - RNA, 20 nt, Mycobacterium tuberculosis H37Rv
cggcguagaugcgcccggcg

SEQ ID NO: 3302448 - RNA, 22 nt, Mycobacterium tuberculosis H37Rv
cggcguagcagaaggccgcggu

SEQ ID NO: 3302449 - RNA, 19 nt, Mycobacterium tuberculosis H37Rv
cggcguagcgagcgggugc

SEQ ID NO: 3302450 - RNA, 21 nt, Mycobacterium tuberculosis H37Rv
cggcguaggcgauggcggcgc

SEQ ID NO: 3302451 - RNA, 15 nt, Mycobacterium tuberculosis H37Rv
cggcguauugcaccg

SEQ ID NO: 3302452 - RNA, 19 nt, Mycobacterium tuberculosis H37Rv
cggcguauugcaccgccag

SEQ ID NO: 3302453 - RNA, 12 nt, Mycobacterium tuberculosis H37Rv
cggcgucacgag

SEQ ID NO: 3302454 - RNA, 18 nt, Mycobacterium tuberculosis H37Rv
cggcgucacggcgugacc

SEQ ID NO: 3302455 - RNA, 19 nt, Mycobacterium tuberculosis H37Rv
cggcgucagccccgacugc

SEQ ID NO: 3302456 - RNA, 21 nt, Mycobacterium tuberculosis H37Rv
cggcgucagccccgacugcgc

SEQ ID NO: 3302457 - RNA, 16 nt, Mycobacterium tuberculosis H37Rv
cggcgucaggcacaac

SEQ ID NO: 3302458 - RNA, 14 nt, Mycobacterium tuberculosis H37Rv
cggcgucauccacc

SEQ ID NO: 3302459 - RNA, 16 nt, Mycobacterium tuberculosis H37Rv
cggcgucauccaccgc

SEQ ID NO: 3302460 - RNA, 13 nt, Mycobacterium tuberculosis H37Rv
cggcguccaagaa

SEQ ID NO: 3302461 - RNA, 15 nt, Mycobacterium tuberculosis H37Rv
cggcguccaccugcu

SEQ ID NO: 3302462 - RNA, 19 nt, Mycobacterium tuberculosis H37Rv
cggcguccaccugcuccgc

SEQ ID NO: 3302463 - RNA, 15 nt, Mycobacterium tuberculosis H37Rv
cggcguccagggcgc

SEQ ID NO: 3302464 - RNA, 13 nt, Mycobacterium tuberculosis H37Rv
cggcguccaucgc

SEQ ID NO: 3302465 - RNA, 24 nt, Mycobacterium tuberculosis H37Rv
cggcguccaucgcgcgccgaccga

SEQ ID NO: 3302466 - RNA, 15 nt, Mycobacterium tuberculosis H37Rv
cggcgucccagggca

SEQ ID NO: 3302467 - RNA, 17 nt, Mycobacterium tuberculosis H37Rv
cggcgucccagggcaca

SEQ ID NO: 3302468 - RNA, 18 nt, Mycobacterium tuberculosis H37Rv
cggcguccccgacaacga

SEQ ID NO: 3302469 - RNA, 23 nt, Mycobacterium tuberculosis H37Rv
cggcguccccgacaacgaaaccg

SEQ ID NO: 3302470 - RNA, 15 nt, Mycobacterium tuberculosis H37Rv
cggcguccgaccggu

SEQ ID NO: 3302471 - RNA, 15 nt, Mycobacterium tuberculosis H37Rv
cggcguccgcccagc

SEQ ID NO: 3302472 - RNA, 16 nt, Mycobacterium tuberculosis H37Rv
cggcguccuugcgcag

SEQ ID NO: 3302473 - RNA, 18 nt, Mycobacterium tuberculosis H37Rv
cggcguccuugcgcagca

SEQ ID NO: 3302474 - RNA, 19 nt, Mycobacterium tuberculosis H37Rv
cggcguccuugcgcagcac

SEQ ID NO: 3302475 - RNA, 11 nt, Mycobacterium tuberculosis H37Rv
cggcgucgaaa

SEQ ID NO: 3302476 - RNA, 20 nt, Mycobacterium tuberculosis H37Rv
cggcgucgaacugccggacu

SEQ ID NO: 3302477 - RNA, 21 nt, Mycobacterium tuberculosis H37Rv
cggcgucgaaggugaccaggc

SEQ ID NO: 3302478 - RNA, 14 nt, Mycobacterium tuberculosis H37Rv
cggcgucgacccag

SEQ ID NO: 3302479 - RNA, 20 nt, Mycobacterium tuberculosis H37Rv
cggcgucgacccugcccagc

SEQ ID NO: 3302480 - RNA, 12 nt, Mycobacterium tuberculosis H37Rv
cggcgucgaccu

SEQ ID NO: 3302481 - RNA, 14 nt, Mycobacterium tuberculosis H37Rv
cggcgucgaccucg

SEQ ID NO: 3302482 - RNA, 15 nt, Mycobacterium tuberculosis H37Rv
cggcgucgaccucgc

SEQ ID NO: 3302483 - RNA, 17 nt, Mycobacterium tuberculosis H37Rv
cggcgucgaccucgcgg

SEQ ID NO: 3302484 - RNA, 13 nt, Mycobacterium tuberculosis H37Rv
cggcgucgacggc

SEQ ID NO: 3302485 - RNA, 23 nt, Mycobacterium tuberculosis H37Rv
cggcgucgacggcuccuccggua

SEQ ID NO: 3302486 - RNA, 12 nt, Mycobacterium tuberculosis H37Rv
cggcgucgacgu

SEQ ID NO: 3302487 - RNA, 17 nt, Mycobacterium tuberculosis H37Rv
cggcgucgacuggccgu

SEQ ID NO: 3302488 - RNA, 13 nt, Mycobacterium tuberculosis H37Rv
cggcgucgagcuc

SEQ ID NO: 3302489 - RNA, 24 nt, Mycobacterium tuberculosis H37Rv
cggcgucgagggagcgccgcaggg

SEQ ID NO: 3302490 - RNA, 19 nt, Mycobacterium tuberculosis H37Rv
cggcgucgaguucgguugc

SEQ ID NO: 3302491 - RNA, 16 nt, Mycobacterium tuberculosis H37Rv
cggcgucgaugacgac

SEQ ID NO: 3302492 - RNA, 18 nt, Mycobacterium tuberculosis H37Rv
cggcgucgaugacgacgc

SEQ ID NO: 3302493 - RNA, 23 nt, Mycobacterium tuberculosis H37Rv
cggcgucgaugacgacgccgucg

SEQ ID NO: 3302494 - RNA, 13 nt, Mycobacterium tuberculosis H37Rv
cggcgucgauguc

SEQ ID NO: 3302495 - RNA, 12 nt, Mycobacterium tuberculosis H37Rv
cggcgucgccgc

SEQ ID NO: 3302496 - RNA, 16 nt, Mycobacterium tuberculosis H37Rv
cggcgucgccgugcug

SEQ ID NO: 3302497 - RNA, 18 nt, Mycobacterium tuberculosis H37Rv
cggcgucgccuuggaacu

SEQ ID NO: 3302498 - RNA, 12 nt, Mycobacterium tuberculosis H37Rv
cggcgucggcca

SEQ ID NO: 3302499 - RNA, 14 nt, Mycobacterium tuberculosis H37Rv
cggcgucggccacc

SEQ ID NO: 3302500 - RNA, 15 nt, Mycobacterium tuberculosis H37Rv
cggcgucggccaccc

SEQ ID NO: 3302501 - RNA, 16 nt, Mycobacterium tuberculosis H37Rv
cggcgucggccaccgc

SEQ ID NO: 3302502 - RNA, 14 nt, Mycobacterium tuberculosis H37Rv
cggcgucggcgccc

SEQ ID NO: 3302503 - RNA, 13 nt, Mycobacterium tuberculosis H37Rv
cggcgucggcgcg

SEQ ID NO: 3302504 - RNA, 21 nt, Mycobacterium tuberculosis H37Rv
cggcgucgggaugcucgaucc

SEQ ID NO: 3302505 - RNA, 14 nt, Mycobacterium tuberculosis H37Rv
cggcgucggucguc

SEQ ID NO: 3302506 - RNA, 16 nt, Mycobacterium tuberculosis H37Rv
cggcgucggugccgcu

SEQ ID NO: 3302507 - RNA, 15 nt, Mycobacterium tuberculosis H37Rv
cggcgucgucgauga

SEQ ID NO: 3302508 - RNA, 20 nt, Mycobacterium tuberculosis H37Rv
cggcgucgucgauggcugcg

SEQ ID NO: 3302509 - RNA, 15 nt, Mycobacterium tuberculosis H37Rv
cggcgucgugguggc

SEQ ID NO: 3302510 - RNA, 19 nt, Mycobacterium tuberculosis H37Rv
cggcgucgugguggccacg

SEQ ID NO: 3302511 - RNA, 12 nt, Mycobacterium tuberculosis H37Rv
cggcgucguuga

SEQ ID NO: 3302512 - RNA, 13 nt, Mycobacterium tuberculosis H37Rv
cggcgucguugac

SEQ ID NO: 3302513 - RNA, 21 nt, Mycobacterium tuberculosis H37Rv
cggcgucguugaggaagcccg

SEQ ID NO: 3302514 - RNA, 23 nt, Mycobacterium tuberculosis H37Rv
cggcgucguugaggaagcccgau

SEQ ID NO: 3302515 - RNA, 23 nt, Mycobacterium tuberculosis H37Rv
cggcgucguugccgggucaaccg

SEQ ID NO: 3302516 - RNA, 14 nt, Mycobacterium tuberculosis H37Rv
cggcgucucgcagc

SEQ ID NO: 3302517 - RNA, 19 nt, Mycobacterium tuberculosis H37Rv
cggcgucuuccucggccac

SEQ ID NO: 3302518 - RNA, 17 nt, Mycobacterium tuberculosis H37Rv
cggcgucuugcaucagc

SEQ ID NO: 3302519 - RNA, 22 nt, Mycobacterium tuberculosis H37Rv
cggcgucuugcaucagcggcgc

SEQ ID NO: 3302520 - RNA, 20 nt, Mycobacterium tuberculosis H37Rv
cggcgugacgucgucggugc

SEQ ID NO: 3302521 - RNA, 12 nt, Mycobacterium tuberculosis H37Rv
cggcgugcagca

SEQ ID NO: 3302522 - RNA, 15 nt, Mycobacterium tuberculosis H37Rv
cggcgugcagcaccc

SEQ ID NO: 3302523 - RNA, 15 nt, Mycobacterium tuberculosis H37Rv
cggcgugcaggguca

SEQ ID NO: 3302524 - RNA, 21 nt, Mycobacterium tuberculosis H37Rv
cggcgugcaugagccgggugc

SEQ ID NO: 3302525 - RNA, 23 nt, Mycobacterium tuberculosis H37Rv
cggcgugcaugagccgggugcga

SEQ ID NO: 3302526 - RNA, 18 nt, Mycobacterium tuberculosis H37Rv
cggcgugcccgucgugcg

SEQ ID NO: 3302527 - RNA, 18 nt, Mycobacterium tuberculosis H37Rv
cggcgugcgcggugaugg

SEQ ID NO: 3302528 - RNA, 14 nt, Mycobacterium tuberculosis H37Rv
cggcgugcggacug

SEQ ID NO: 3302529 - RNA, 13 nt, Mycobacterium tuberculosis H37Rv
cggcgugcucggc

SEQ ID NO: 3302530 - RNA, 12 nt, Mycobacterium tuberculosis H37Rv
cggcgugcuggc

SEQ ID NO: 3302531 - RNA, 15 nt, Mycobacterium tuberculosis H37Rv
cggcgugcuggcgca

SEQ ID NO: 3302532 - RNA, 15 nt, Mycobacterium tuberculosis H37Rv
cggcgugcugugcuc

SEQ ID NO: 3302533 - RNA, 14 nt, Mycobacterium tuberculosis H37Rv
cggcguggauccgu

SEQ ID NO: 3302534 - RNA, 19 nt, Mycobacterium tuberculosis H37Rv
cggcguggcaguacaccgg

SEQ ID NO: 3302535 - RNA, 17 nt, Mycobacterium tuberculosis H37Rv
cggcguggcgccggcca

SEQ ID NO: 3302536 - RNA, 15 nt, Mycobacterium tuberculosis H37Rv
cggcguggcgggggc

SEQ ID NO: 3302537 - RNA, 23 nt, Mycobacterium tuberculosis H37Rv
cggcgugggagguggcgcggggc

SEQ ID NO: 3302538 - RNA, 18 nt, Mycobacterium tuberculosis H37Rv
cggcgugguauccgccgu

SEQ ID NO: 3302539 - RNA, 20 nt, Mycobacterium tuberculosis H37Rv
cggcgugguauccgccguuc

SEQ ID NO: 3302540 - RNA, 15 nt, Mycobacterium tuberculosis H37Rv
cggcguggucggcgg

SEQ ID NO: 3302541 - RNA, 18 nt, Mycobacterium tuberculosis H37Rv
cggcguggucggcgguga

SEQ ID NO: 3302542 - RNA, 17 nt, Mycobacterium tuberculosis H37Rv
cggcguggucucgaugg

SEQ ID NO: 3302543 - RNA, 18 nt, Mycobacterium tuberculosis H37Rv
cggcguggucucgauggu

SEQ ID NO: 3302544 - RNA, 16 nt, Mycobacterium tuberculosis H37Rv
cggcgugucgccgcca

SEQ ID NO: 3302545 - RNA, 20 nt, Mycobacterium tuberculosis H37Rv
cggcgugucgccgccaccag

SEQ ID NO: 3302546 - RNA, 16 nt, Mycobacterium tuberculosis H37Rv
cggcgugucgcgucgc

SEQ ID NO: 3302547 - RNA, 13 nt, Mycobacterium tuberculosis H37Rv
cggcgugucgggg

SEQ ID NO: 3302548 - RNA, 15 nt, Mycobacterium tuberculosis H37Rv
cggcgugucgggggc

SEQ ID NO: 3302549 - RNA, 16 nt, Mycobacterium tuberculosis H37Rv
cggcgugucgggggcu

SEQ ID NO: 3302550 - RNA, 22 nt, Mycobacterium tuberculosis H37Rv
cggcgugucguugccagggcgg

SEQ ID NO: 3302551 - RNA, 23 nt, Mycobacterium tuberculosis H37Rv
cggcguuaagguacccggucggg

SEQ ID NO: 3302552 - RNA, 15 nt, Mycobacterium tuberculosis H37Rv
cggcguuaccaccgu

SEQ ID NO: 3302553 - RNA, 23 nt, Mycobacterium tuberculosis H37Rv
cggcguuaccaccgucaccgccg

SEQ ID NO: 3302554 - RNA, 15 nt, Mycobacterium tuberculosis H37Rv
cggcguuaucgucgg

SEQ ID NO: 3302555 - RNA, 19 nt, Mycobacterium tuberculosis H37Rv
cggcguuccaacucgguuc

SEQ ID NO: 3302556 - RNA, 19 nt, Mycobacterium tuberculosis H37Rv
cggcguucccacuggaggu

SEQ ID NO: 3302557 - RNA, 23 nt, Mycobacterium tuberculosis H37Rv
cggcguuccccgagaacggcggg

SEQ ID NO: 3302558 - RNA, 15 nt, Mycobacterium tuberculosis H37Rv
cggcguucccgccau

SEQ ID NO: 3302559 - RNA, 23 nt, Mycobacterium tuberculosis H37Rv
cggcguucccgccauugccgccg

SEQ ID NO: 3302560 - RNA, 16 nt, Mycobacterium tuberculosis H37Rv
cggcguuccgggccga

SEQ ID NO: 3302561 - RNA, 20 nt, Mycobacterium tuberculosis H37Rv
cggcguuccgggccgaucac

SEQ ID NO: 3302562 - RNA, 13 nt, Mycobacterium tuberculosis H37Rv
cggcguucgccgg

SEQ ID NO: 3302563 - RNA, 23 nt, Mycobacterium tuberculosis H37Rv
cggcguugaucagugccaggugg

SEQ ID NO: 3302564 - RNA, 22 nt, Mycobacterium tuberculosis H37Rv
cggcguugaucgacaucaccac

SEQ ID NO: 3302565 - RNA, 21 nt, Mycobacterium tuberculosis H37Rv
cggcguugccgaaacccgagu

SEQ ID NO: 3302566 - RNA, 15 nt, Mycobacterium tuberculosis H37Rv
cggcguugccgccgu

SEQ ID NO: 3302567 - RNA, 20 nt, Mycobacterium tuberculosis H37Rv
cggcguuggaaaagucgggc

SEQ ID NO: 3302568 - RNA, 17 nt, Mycobacterium tuberculosis H37Rv
cggcguuggcgccguua

SEQ ID NO: 3302569 - RNA, 19 nt, Mycobacterium tuberculosis H37Rv
cggcguuggcgccguuacc

SEQ ID NO: 3302570 - RNA, 21 nt, Mycobacterium tuberculosis H37Rv
cggcguuggugcagucggugc

SEQ ID NO: 3302571 - RNA, 22 nt, Mycobacterium tuberculosis H37Rv
cggcguuguaguugcccacguu

SEQ ID NO: 3302572 - RNA, 16 nt, Mycobacterium tuberculosis H37Rv
cggcguugucccccag

SEQ ID NO: 3302573 - RNA, 15 nt, Mycobacterium tuberculosis H37Rv
cggcguugucgacga

SEQ ID NO: 3302574 - RNA, 12 nt, Mycobacterium tuberculosis H37Rv
cggcguuuauca

SEQ ID NO: 3302575 - RNA, 18 nt, Mycobacterium tuberculosis H37Rv
cggcguuuccuucgacga

SEQ ID NO: 3302576 - RNA, 16 nt, Mycobacterium tuberculosis H37Rv
cggcguuugagaacaa

SEQ ID NO: 3302577 - RNA, 23 nt, Mycobacterium tuberculosis H37Rv
cggcguuuucaauuucacugcga

SEQ ID NO: 3302578 - RNA, 15 nt, Mycobacterium tuberculosis H37Rv
cggcguuuucgguga

SEQ ID NO: 3302579 - RNA, 18 nt, Mycobacterium tuberculosis H37Rv
cggcguuuucggugagca

SEQ ID NO: 3302580 - RNA, 19 nt, Mycobacterium tuberculosis H37Rv
cggcuaagccuucgguguc

SEQ ID NO: 3302581 - RNA, 22 nt, Mycobacterium tuberculosis H37Rv
cggcuaagccuucggugucgcc

SEQ ID NO: 3302582 - RNA, 17 nt, Mycobacterium tuberculosis H37Rv
cggcuaccaccgcaccu

SEQ ID NO: 3302583 - RNA, 13 nt, Mycobacterium tuberculosis H37Rv
cggcuaccgccga

SEQ ID NO: 3302584 - RNA, 15 nt, Mycobacterium tuberculosis H37Rv
cggcuaccgccuugu

SEQ ID NO: 3302585 - RNA, 22 nt, Mycobacterium tuberculosis H37Rv
cggcuaccgcgcucccggcguc

SEQ ID NO: 3302586 - RNA, 19 nt, Mycobacterium tuberculosis H37Rv
cggcuaccuaacccgcgcc

SEQ ID NO: 3302587 - RNA, 17 nt, Mycobacterium tuberculosis H37Rv
cggcuacgccucggcgu

SEQ ID NO: 3302588 - RNA, 18 nt, Mycobacterium tuberculosis H37Rv
cggcuacggccagugcca

SEQ ID NO: 3302589 - RNA, 15 nt, Mycobacterium tuberculosis H37Rv
cggcuacggcgacac

SEQ ID NO: 3302590 - RNA, 21 nt, Mycobacterium tuberculosis H37Rv
cggcuacggcgacacgccagc

SEQ ID NO: 3302591 - RNA, 23 nt, Mycobacterium tuberculosis H37Rv
cggcuagcaacgggucgaugucg

SEQ ID NO: 3302592 - RNA, 22 nt, Mycobacterium tuberculosis H37Rv
cggcuagcugugcuucguuguc

SEQ ID NO: 3302593 - RNA, 20 nt, Mycobacterium tuberculosis H37Rv
cggcuagggcagcagcccgg

SEQ ID NO: 3302594 - RNA, 17 nt, Mycobacterium tuberculosis H37Rv
cggcuauggcgccgcgg

SEQ ID NO: 3302595 - RNA, 18 nt, Mycobacterium tuberculosis H37Rv
cggcuauggguucgcggu

SEQ ID NO: 3302596 - RNA, 15 nt, Mycobacterium tuberculosis H37Rv
cggcuauuagcggcu

SEQ ID NO: 3302597 - RNA, 21 nt, Mycobacterium tuberculosis H37Rv
cggcucaacaccgaguuccuc

SEQ ID NO: 3302598 - RNA, 18 nt, Mycobacterium tuberculosis H37Rv
cggcucaaccucuggcgg

SEQ ID NO: 3302599 - RNA, 19 nt, Mycobacterium tuberculosis H37Rv
cggcucaaccucuggcggc

SEQ ID NO: 3302600 - RNA, 20 nt, Mycobacterium tuberculosis H37Rv
cggcucaaccucuggcggcg

SEQ ID NO: 3302601 - RNA, 21 nt, Mycobacterium tuberculosis H37Rv
cggcucaaggacgcaccgcca

SEQ ID NO: 3302602 - RNA, 19 nt, Mycobacterium tuberculosis H37Rv
cggcucaaucuccuccgcg

SEQ ID NO: 3302603 - RNA, 13 nt, Mycobacterium tuberculosis H37Rv
cggcucacagcac

SEQ ID NO: 3302604 - RNA, 16 nt, Mycobacterium tuberculosis H37Rv
cggcucacagcacagc

SEQ ID NO: 3302605 - RNA, 21 nt, Mycobacterium tuberculosis H37Rv
cggcucacagcacagcgcagc

SEQ ID NO: 3302606 - RNA, 13 nt, Mycobacterium tuberculosis H37Rv
cggcucaccgauc

SEQ ID NO: 3302607 - RNA, 16 nt, Mycobacterium tuberculosis H37Rv
cggcucacgacugcgu

SEQ ID NO: 3302608 - RNA, 21 nt, Mycobacterium tuberculosis H37Rv
cggcucacguaaccagugacc

SEQ ID NO: 3302609 - RNA, 20 nt, Mycobacterium tuberculosis H37Rv
cggcucagaccaaggcgaag

SEQ ID NO: 3302610 - RNA, 13 nt, Mycobacterium tuberculosis H37Rv
cggcucagcgugc

SEQ ID NO: 3302611 - RNA, 19 nt, Mycobacterium tuberculosis H37Rv
cggcucagcgugcgcuggc

SEQ ID NO: 3302612 - RNA, 13 nt, Mycobacterium tuberculosis H37Rv
cggcucaucccga

SEQ ID NO: 3302613 - RNA, 16 nt, Mycobacterium tuberculosis H37Rv
cggcucaucccgaccc

SEQ ID NO: 3302614 - RNA, 14 nt, Mycobacterium tuberculosis H37Rv
cggcuccaacgaug

SEQ ID NO: 3302615 - RNA, 16 nt, Mycobacterium tuberculosis H37Rv
cggcuccaacgaugga

SEQ ID NO: 3302616 - RNA, 18 nt, Mycobacterium tuberculosis H37Rv
cggcuccacccaccugga

SEQ ID NO: 3302617 - RNA, 13 nt, Mycobacterium tuberculosis H37Rv
cggcuccaccggg

SEQ ID NO: 3302618 - RNA, 14 nt, Mycobacterium tuberculosis H37Rv
cggcuccaccgggc

SEQ ID NO: 3302619 - RNA, 15 nt, Mycobacterium tuberculosis H37Rv
cggcuccaccgggcc

SEQ ID NO: 3302620 - RNA, 18 nt, Mycobacterium tuberculosis H37Rv
cggcuccaccgggcccgc

SEQ ID NO: 3302621 - RNA, 17 nt, Mycobacterium tuberculosis H37Rv
cggcucccauggcgcga

SEQ ID NO: 3302622 - RNA, 13 nt, Mycobacterium tuberculosis H37Rv
cggcuccgaugca

SEQ ID NO: 3302623 - RNA, 13 nt, Mycobacterium tuberculosis H37Rv
cggcuccgcaacc

SEQ ID NO: 3302624 - RNA, 13 nt, Mycobacterium tuberculosis H37Rv
cggcuccgcagcg

SEQ ID NO: 3302625 - RNA, 20 nt, Mycobacterium tuberculosis H37Rv
cggcuucucgaugaugucga

SEQ ID NO: 3302626 - RNA, 21 nt, Mycobacterium tuberculosis H37Rv
cggcuucuucuucuugaccgc

SEQ ID NO: 3302627 - RNA, 13 nt, Mycobacterium tuberculosis H37Rv
cggcuugagccgc

SEQ ID NO: 3302628 - RNA, 17 nt, Mycobacterium tuberculosis H37Rv
cggcuugagccgcagca

SEQ ID NO: 3302629 - RNA, 12 nt, Mycobacterium tuberculosis H37Rv
cggcuugccgcc

SEQ ID NO: 3302630 - RNA, 19 nt, Mycobacterium tuberculosis H37Rv
cggcuugcgauuggcuggg

SEQ ID NO: 3302631 - RNA, 12 nt, Mycobacterium tuberculosis H37Rv
cggcuugcugcc

SEQ ID NO: 3302632 - RNA, 20 nt, Mycobacterium tuberculosis H37Rv
cggcuugcugccccauaaac

SEQ ID NO: 3302633 - RNA, 21 nt, Mycobacterium tuberculosis H37Rv
cggcuuggccgccccggccgc

SEQ ID NO: 3302634 - RNA, 22 nt, Mycobacterium tuberculosis H37Rv
cggcuuggccgccccggccgcu

SEQ ID NO: 3302635 - RNA, 20 nt, Mycobacterium tuberculosis H37Rv
cggcuuggccuuugccgucg

SEQ ID NO: 3302636 - RNA, 21 nt, Mycobacterium tuberculosis H37Rv
cggcuuggccuuugccgucga

SEQ ID NO: 3302637 - RNA, 13 nt, Mycobacterium tuberculosis H37Rv
cggcuuggcggcg

SEQ ID NO: 3302638 - RNA, 23 nt, Mycobacterium tuberculosis H37Rv
cggcuugggaaacccggccagcu

SEQ ID NO: 3302639 - RNA, 17 nt, Mycobacterium tuberculosis H37Rv
cggcuugggcagaaucg

SEQ ID NO: 3302640 - RNA, 19 nt, Mycobacterium tuberculosis H37Rv
cggcuuggugaaccgcgcg

SEQ ID NO: 3302641 - RNA, 23 nt, Mycobacterium tuberculosis H37Rv
cggcuuggugaaccgcgcggcga

SEQ ID NO: 3302642 - RNA, 23 nt, Mycobacterium tuberculosis H37Rv
cggcuuguccucacaugcccgga

SEQ ID NO: 3302643 - RNA, 16 nt, Mycobacterium tuberculosis H37Rv
cggcuugucgcggugc

SEQ ID NO: 3302644 - RNA, 17 nt, Mycobacterium tuberculosis H37Rv
cggcuuucccaccgcuu

SEQ ID NO: 3302645 - RNA, 19 nt, Mycobacterium tuberculosis H37Rv
cggcuuucccaccgcuucc

SEQ ID NO: 3302646 - RNA, 19 nt, Mycobacterium tuberculosis H37Rv
cggcuuuggcccgcgagcg

SEQ ID NO: 3302647 - RNA, 18 nt, Mycobacterium tuberculosis H37Rv
cggcuuuggccgccgugg

SEQ ID NO: 3302648 - RNA, 12 nt, Mycobacterium tuberculosis H37Rv
cggcuuuucgac

SEQ ID NO: 3302649 - RNA, 16 nt, Mycobacterium tuberculosis H37Rv
cgggaaaccgaggaug

SEQ ID NO: 3302650 - RNA, 16 nt, Mycobacterium tuberculosis H37Rv
cgggaaagccaccuac

SEQ ID NO: 3302651 - RNA, 19 nt, Mycobacterium tuberculosis H37Rv
cgggaaaguuguaucgcag

SEQ ID NO: 3302652 - RNA, 22 nt, Mycobacterium tuberculosis H37Rv
cgggaaaguuguaucgcagcau

SEQ ID NO: 3302653 - RNA, 17 nt, Mycobacterium tuberculosis H37Rv
cgggaaauaucucggug

SEQ ID NO: 3302654 - RNA, 16 nt, Mycobacterium tuberculosis H37Rv
cgggaaccaacaccag

SEQ ID NO: 3302655 - RNA, 16 nt, Mycobacterium tuberculosis H37Rv
cgggaaccacggucag

SEQ ID NO: 3302656 - RNA, 13 nt, Mycobacterium tuberculosis H37Rv
cgggaaccccagc

SEQ ID NO: 3302657 - RNA, 21 nt, Mycobacterium tuberculosis H37Rv
cgggaaccucgaccgucaccg

SEQ ID NO: 3302658 - RNA, 22 nt, Mycobacterium tuberculosis H37Rv
cgggaacgagccacgccagcgu

SEQ ID NO: 3302659 - RNA, 13 nt, Mycobacterium tuberculosis H37Rv
cgggaacgaugcc

SEQ ID NO: 3302660 - RNA, 15 nt, Mycobacterium tuberculosis H37Rv
cgggaacgaugccgc

SEQ ID NO: 3302661 - RNA, 13 nt, Mycobacterium tuberculosis H37Rv
cgggaacgccgaa

SEQ ID NO: 3302662 - RNA, 16 nt, Mycobacterium tuberculosis H37Rv
cgggaacgcucgucga

SEQ ID NO: 3302663 - RNA, 19 nt, Mycobacterium tuberculosis H37Rv
cgggaacggugccgaucgg

SEQ ID NO: 3302664 - RNA, 17 nt, Mycobacterium tuberculosis H37Rv
cgggaacguccagccgu

SEQ ID NO: 3302665 - RNA, 12 nt, Mycobacterium tuberculosis H37Rv
cgggaaggaacc

SEQ ID NO: 3302666 - RNA, 19 nt, Mycobacterium tuberculosis H37Rv
cgggaaggaaccgggcaaa

SEQ ID NO: 3302667 - RNA, 22 nt, Mycobacterium tuberculosis H37Rv
cgggaaggaaccgggcaaauca

SEQ ID NO: 3302668 - RNA, 14 nt, Mycobacterium tuberculosis H37Rv
cgggaaguacggca

SEQ ID NO: 3302669 - RNA, 13 nt, Mycobacterium tuberculosis H37Rv
cgggaagucgcug

SEQ ID NO: 3302670 - RNA, 16 nt, Mycobacterium tuberculosis H37Rv
cgggaagucgggccgg

SEQ ID NO: 3302671 - RNA, 13 nt, Mycobacterium tuberculosis H37Rv
cgggaauccggug

SEQ ID NO: 3302672 - RNA, 14 nt, Mycobacterium tuberculosis H37Rv
cgggaauccgguga

SEQ ID NO: 3302673 - RNA, 14 nt, Mycobacterium tuberculosis H37Rv
cgggaaucgcucgc

SEQ ID NO: 3302674 - RNA, 21 nt, Mycobacterium tuberculosis H37Rv
cgggaauuucgucggccaugg

SEQ ID NO: 3302675 - RNA, 18 nt, Mycobacterium tuberculosis H37Rv
cgggacaaagccgaacga

SEQ ID NO: 3302676 - RNA, 24 nt, Mycobacterium tuberculosis H37Rv
cgggacaaagccgaacgacagcag

SEQ ID NO: 3302677 - RNA, 15 nt, Mycobacterium tuberculosis H37Rv
cgggacaaccgggcg

SEQ ID NO: 3302678 - RNA, 23 nt, Mycobacterium tuberculosis H37Rv
cgggacaaguucgguagcgaucg

SEQ ID NO: 3302679 - RNA, 15 nt, Mycobacterium tuberculosis H37Rv
cgggacaaucgucca

SEQ ID NO: 3302680 - RNA, 13 nt, Mycobacterium tuberculosis H37Rv
cgggacaccaccg

SEQ ID NO: 3302681 - RNA, 17 nt, Mycobacterium tuberculosis H37Rv
cgggacagcagccggau

SEQ ID NO: 3302682 - RNA, 15 nt, Mycobacterium tuberculosis H37Rv
cgggacagcgccggg

SEQ ID NO: 3302683 - RNA, 22 nt, Mycobacterium tuberculosis H37Rv
cgggacaucaccgcagcaccgg

SEQ ID NO: 3302684 - RNA, 19 nt, Mycobacterium tuberculosis H37Rv
cgggacaucugcccaccgc

SEQ ID NO: 3302685 - RNA, 21 nt, Mycobacterium tuberculosis H37Rv
cgggaccaggccaacggcgcu

SEQ ID NO: 3302686 - RNA, 16 nt, Mycobacterium tuberculosis H37Rv
cgggaccauagucgcc

SEQ ID NO: 3302687 - RNA, 20 nt, Mycobacterium tuberculosis H37Rv
cgggaccauagucgccgucg

SEQ ID NO: 3302688 - RNA, 21 nt, Mycobacterium tuberculosis H37Rv
cgggacccgugagcucgucga

SEQ ID NO: 3302689 - RNA, 21 nt, Mycobacterium tuberculosis H37Rv
cgggaccgaucuuggccaccg

SEQ ID NO: 3302690 - RNA, 22 nt, Mycobacterium tuberculosis H37Rv
cgggaccgaucuuggccaccgc

SEQ ID NO: 3302691 - RNA, 15 nt, Mycobacterium tuberculosis H37Rv
cgggaccgccccggc

SEQ ID NO: 3302692 - RNA, 23 nt, Mycobacterium tuberculosis H37Rv
cgggaccgccccggccaggacau

SEQ ID NO: 3302693 - RNA, 22 nt, Mycobacterium tuberculosis H37Rv
cgggaccgcgaacccgugggcg

SEQ ID NO: 3302694 - RNA, 15 nt, Mycobacterium tuberculosis H37Rv
cgggaccgggaaccc

SEQ ID NO: 3302695 - RNA, 19 nt, Mycobacterium tuberculosis H37Rv
cgggaccggggacgcgccc

SEQ ID NO: 3302696 - RNA, 20 nt, Mycobacterium tuberculosis H37Rv
cgggaccuucgagccgcaca

SEQ ID NO: 3302697 - RNA, 13 nt, Mycobacterium tuberculosis H37Rv
cgggacgaagacc

SEQ ID NO: 3302698 - RNA, 12 nt, Mycobacterium tuberculosis H37Rv
cgggacgccgug

SEQ ID NO: 3302699 - RNA, 20 nt, Mycobacterium tuberculosis H37Rv
cgggacgccuugaucggcga

SEQ ID NO: 3302700 - RNA, 13 nt, Mycobacterium tuberculosis H37Rv
cgggacgucaccg

SEQ ID NO: 3302701 - RNA, 12 nt, Mycobacterium tuberculosis H37Rv
cgggacguuguc

SEQ ID NO: 3302702 - RNA, 13 nt, Mycobacterium tuberculosis H37Rv
cgggacguugucc

SEQ ID NO: 3302703 - RNA, 18 nt, Mycobacterium tuberculosis H37Rv
cgggacguuguccaccgc

SEQ ID NO: 3302704 - RNA, 20 nt, Mycobacterium tuberculosis H37Rv
cgggacguuguccaccgcca

SEQ ID NO: 3302705 - RNA, 16 nt, Mycobacterium tuberculosis H37Rv
cgggacuagguccgau

SEQ ID NO: 3302706 - RNA, 14 nt, Mycobacterium tuberculosis H37Rv
cgggacucggcgag

SEQ ID NO: 3302707 - RNA, 21 nt, Mycobacterium tuberculosis H37Rv
cgggacugacccugaucguga

SEQ ID NO: 3302708 - RNA, 16 nt, Mycobacterium tuberculosis H37Rv
cgggacugcagcgcgg

SEQ ID NO: 3302709 - RNA, 22 nt, Mycobacterium tuberculosis H37Rv
cgggacugcagcgcggugguca

SEQ ID NO: 3302710 - RNA, 14 nt, Mycobacterium tuberculosis H37Rv
cgggagacgcugcg

SEQ ID NO: 3302711 - RNA, 19 nt, Mycobacterium tuberculosis H37Rv
cgggagagugguugcgccc

SEQ ID NO: 3302712 - RNA, 17 nt, Mycobacterium tuberculosis H37Rv
cgggagaucucguccag

SEQ ID NO: 3302713 - RNA, 22 nt, Mycobacterium tuberculosis H37Rv
cgggagcaccgaccagggccgc

SEQ ID NO: 3302714 - RNA, 16 nt, Mycobacterium tuberculosis H37Rv
cgggagcccgagcuca

SEQ ID NO: 3302715 - RNA, 20 nt, Mycobacterium tuberculosis H37Rv
cgggagcccgagcucaccgc

SEQ ID NO: 3302716 - RNA, 20 nt, Mycobacterium tuberculosis H37Rv
cgggagcgugggcgugagcg

SEQ ID NO: 3302717 - RNA, 15 nt, Mycobacterium tuberculosis H37Rv
cgggaggacaccagc

SEQ ID NO: 3302718 - RNA, 22 nt, Mycobacterium tuberculosis H37Rv
cgggaggacaccagcuggaaga

SEQ ID NO: 3302719 - RNA, 17 nt, Mycobacterium tuberculosis H37Rv
cgggaggaugucgagcc

SEQ ID NO: 3302720 - RNA, 13 nt, Mycobacterium tuberculosis H37Rv
cgggaggcguugc

SEQ ID NO: 3302721 - RNA, 19 nt, Mycobacterium tuberculosis H37Rv
cgggcagcaggcgaugcgc

SEQ ID NO: 3302722 - RNA, 16 nt, Mycobacterium tuberculosis H37Rv
cgggcagccccuccgc

SEQ ID NO: 3302723 - RNA, 21 nt, Mycobacterium tuberculosis H37Rv
cgggcagccccuccgcgccga

SEQ ID NO: 3302724 - RNA, 20 nt, Mycobacterium tuberculosis H37Rv
cgggcagccgcacgguucgg

SEQ ID NO: 3302725 - RNA, 15 nt, Mycobacterium tuberculosis H37Rv
cgggcagccugcugc

SEQ ID NO: 3302726 - RNA, 12 nt, Mycobacterium tuberculosis H37Rv
cgggcagcgcuc

SEQ ID NO: 3302727 - RNA, 15 nt, Mycobacterium tuberculosis H37Rv
cgggcagcgcucuca

SEQ ID NO: 3302728 - RNA, 16 nt, Mycobacterium tuberculosis H37Rv
cgggcagcuggcgacg

SEQ ID NO: 3302729 - RNA, 14 nt, Mycobacterium tuberculosis H37Rv
cgggcagcugggca

SEQ ID NO: 3302730 - RNA, 15 nt, Mycobacterium tuberculosis H37Rv
cgggcagcugggcag

SEQ ID NO: 3302731 - RNA, 18 nt, Mycobacterium tuberculosis H37Rv
cgggcagcuguucggcca

SEQ ID NO: 3302732 - RNA, 21 nt, Mycobacterium tuberculosis H37Rv
cgggcagcuguucggccaacc

SEQ ID NO: 3302733 - RNA, 20 nt, Mycobacterium tuberculosis H37Rv
cgggcaggagcagcacgucg

SEQ ID NO: 3302734 - RNA, 21 nt, Mycobacterium tuberculosis H37Rv
cgggcaggagcagcacgucga

SEQ ID NO: 3302735 - RNA, 12 nt, Mycobacterium tuberculosis H37Rv
cgggcaggccgu

SEQ ID NO: 3302736 - RNA, 14 nt, Mycobacterium tuberculosis H37Rv
cgggcaggccgucg

SEQ ID NO: 3302737 - RNA, 15 nt, Mycobacterium tuberculosis H37Rv
cgggcaggccgucga

SEQ ID NO: 3302738 - RNA, 15 nt, Mycobacterium tuberculosis H37Rv
cgggcagggaccgca

SEQ ID NO: 3302739 - RNA, 11 nt, Mycobacterium tuberculosis H37Rv
cgggcagguag

SEQ ID NO: 3302740 - RNA, 15 nt, Mycobacterium tuberculosis H37Rv
cgggcagguagcucg

SEQ ID NO: 3302741 - RNA, 19 nt, Mycobacterium tuberculosis H37Rv
cgggcagguagcucguuga

SEQ ID NO: 3302742 - RNA, 18 nt, Mycobacterium tuberculosis H37Rv
cgggcagguaggucuggg

SEQ ID NO: 3302743 - RNA, 19 nt, Mycobacterium tuberculosis H37Rv
cgggcagguaggucugggc

SEQ ID NO: 3302744 - RNA, 14 nt, Mycobacterium tuberculosis H37Rv
cgggcagguccgcc

SEQ ID NO: 3302745 - RNA, 14 nt, Mycobacterium tuberculosis H37Rv
cgggcaguccaggc

SEQ ID NO: 3302746 - RNA, 15 nt, Mycobacterium tuberculosis H37Rv
cgggcaguccaggca

SEQ ID NO: 3302747 - RNA, 19 nt, Mycobacterium tuberculosis H37Rv
cgggcaguccaggcacucc

SEQ ID NO: 3302748 - RNA, 16 nt, Mycobacterium tuberculosis H37Rv
cgggcagugcgcggcg

SEQ ID NO: 3302749 - RNA, 21 nt, Mycobacterium tuberculosis H37Rv
cgggcagugcgcggcgucguc

SEQ ID NO: 3302750 - RNA, 21 nt, Mycobacterium tuberculosis H37Rv
cgggcaguggcagcccgucgg

SEQ ID NO: 3302751 - RNA, 14 nt, Mycobacterium tuberculosis H37Rv
cgggcagugugguc

SEQ ID NO: 3302752 - RNA, 16 nt, Mycobacterium tuberculosis H37Rv
cgggcaguucacgguu

SEQ ID NO: 3302753 - RNA, 23 nt, Mycobacterium tuberculosis H37Rv
cgggcaguuguugacagacacag

SEQ ID NO: 3302754 - RNA, 19 nt, Mycobacterium tuberculosis H37Rv
cgggcaguuugcgggcgga

SEQ ID NO: 3302755 - RNA, 18 nt, Mycobacterium tuberculosis H37Rv
cgggcaguuuguucgcga

SEQ ID NO: 3302756 - RNA, 20 nt, Mycobacterium tuberculosis H37Rv
cgggcaguuuguucgcgaag

SEQ ID NO: 3302757 - RNA, 21 nt, Mycobacterium tuberculosis H37Rv
cgggcaguuuguucgcgaagc

SEQ ID NO: 3302758 - RNA, 18 nt, Mycobacterium tuberculosis H37Rv
cgggcauccuucaccagc

SEQ ID NO: 3302759 - RNA, 13 nt, Mycobacterium tuberculosis H37Rv
cgggcaucgcgaa

SEQ ID NO: 3302760 - RNA, 16 nt, Mycobacterium tuberculosis H37Rv
cgggcaucggcgguuc

SEQ ID NO: 3302761 - RNA, 14 nt, Mycobacterium tuberculosis H37Rv
cgggcaugaucccc

SEQ ID NO: 3302762 - RNA, 15 nt, Mycobacterium tuberculosis H37Rv
cgggcaugauccccg

SEQ ID NO: 3302763 - RNA, 23 nt, Mycobacterium tuberculosis H37Rv
cgggcaugauccccguugaccca

SEQ ID NO: 3302764 - RNA, 14 nt, Mycobacterium tuberculosis H37Rv
cgggcaugccggcg

SEQ ID NO: 3302765 - RNA, 17 nt, Mycobacterium tuberculosis H37Rv
cgggcaugcucuggcaa

SEQ ID NO: 3302766 - RNA, 16 nt, Mycobacterium tuberculosis H37Rv
cgggcauggucgccgg

SEQ ID NO: 3302767 - RNA, 15 nt, Mycobacterium tuberculosis H37Rv
cgggccaagacggcg

SEQ ID NO: 3302768 - RNA, 20 nt, Mycobacterium tuberculosis H37Rv
cgggccaagacggcgggccc

SEQ ID NO: 3302769 - RNA, 20 nt, Mycobacterium tuberculosis H37Rv
cgggccaaugccguugaucg

SEQ ID NO: 3302770 - RNA, 14 nt, Mycobacterium tuberculosis H37Rv
cgggccacagcaac

SEQ ID NO: 3302771 - RNA, 15 nt, Mycobacterium tuberculosis H37Rv
cgggccaccgcuguc

SEQ ID NO: 3302772 - RNA, 22 nt, Mycobacterium tuberculosis H37Rv
cgggccaccguaaacagcgcgc

SEQ ID NO: 3302773 - RNA, 21 nt, Mycobacterium tuberculosis H37Rv
cgggccacgaucggcugguua

SEQ ID NO: 3302774 - RNA, 16 nt, Mycobacterium tuberculosis H37Rv
cgggccacgucgagca

SEQ ID NO: 3302775 - RNA, 21 nt, Mycobacterium tuberculosis H37Rv
cgggccagaucgaagcgcagc

SEQ ID NO: 3302776 - RNA, 15 nt, Mycobacterium tuberculosis H37Rv
cgggccagcacccgc

SEQ ID NO: 3302777 - RNA, 21 nt, Mycobacterium tuberculosis H37Rv
cgggccagcacccgcuccagc

SEQ ID NO: 3302778 - RNA, 13 nt, Mycobacterium tuberculosis H37Rv
cgggccagcaccu

SEQ ID NO: 3302779 - RNA, 20 nt, Mycobacterium tuberculosis H37Rv
cgggccagcaccucgaccgc

SEQ ID NO: 3302780 - RNA, 20 nt, Mycobacterium tuberculosis H37Rv
cgggccagcgcaucggucac

SEQ ID NO: 3302781 - RNA, 20 nt, Mycobacterium tuberculosis H37Rv
cgggccaggccgaugccgac

SEQ ID NO: 3302782 - RNA, 14 nt, Mycobacterium tuberculosis H37Rv
cgggccaguucguc

SEQ ID NO: 3302783 - RNA, 19 nt, Mycobacterium tuberculosis H37Rv
cgggccaguucgucggcgg

SEQ ID NO: 3302784 - RNA, 22 nt, Mycobacterium tuberculosis H37Rv
cgggccaguucgucggcggugc

SEQ ID NO: 3302785 - RNA, 21 nt, Mycobacterium tuberculosis H37Rv
cgggccaucaagcgauccgag

SEQ ID NO: 3302786 - RNA, 19 nt, Mycobacterium tuberculosis H37Rv
cgggccauggguagccgcc

SEQ ID NO: 3302787 - RNA, 15 nt, Mycobacterium tuberculosis H37Rv
cgggccaugugggga

SEQ ID NO: 3302788 - RNA, 18 nt, Mycobacterium tuberculosis H37Rv
cgggccauucaccgcgca

SEQ ID NO: 3302789 - RNA, 19 nt, Mycobacterium tuberculosis H37Rv
cgggcccacguuggccccg

SEQ ID NO: 3302790 - RNA, 20 nt, Mycobacterium tuberculosis H37Rv
cgggcccacguuggccccgc

SEQ ID NO: 3302791 - RNA, 12 nt, Mycobacterium tuberculosis H37Rv
cgggcccagccg

SEQ ID NO: 3302792 - RNA, 14 nt, Mycobacterium tuberculosis H37Rv
cgggcccagcgcgc

SEQ ID NO: 3302793 - RNA, 17 nt, Mycobacterium tuberculosis H37Rv
cgggcccccggcagcau

SEQ ID NO: 3302794 - RNA, 17 nt, Mycobacterium tuberculosis H37Rv
cgggcccgacgcguggc

SEQ ID NO: 3302795 - RNA, 14 nt, Mycobacterium tuberculosis H37Rv
cgggcccgacguug

SEQ ID NO: 3302796 - RNA, 18 nt, Mycobacterium tuberculosis H37Rv
cgggcccgccggccccgc

SEQ ID NO: 3302797 - RNA, 16 nt, Mycobacterium tuberculosis H37Rv
cgggcccgcguucucg

SEQ ID NO: 3302798 - RNA, 19 nt, Mycobacterium tuberculosis H37Rv
cgggcccggcggccagcuc

SEQ ID NO: 3302799 - RNA, 18 nt, Mycobacterium tuberculosis H37Rv
cgggcccguagccgagcu

SEQ ID NO: 3302800 - RNA, 13 nt, Mycobacterium tuberculosis H37Rv
cgggcccgucguc

SEQ ID NO: 3302801 - RNA, 18 nt, Mycobacterium tuberculosis H37Rv
cgggcccuccacugcgag

SEQ ID NO: 3302802 - RNA, 22 nt, Mycobacterium tuberculosis H37Rv
cgggcccuccacugcgagcgcc

SEQ ID NO: 3302803 - RNA, 18 nt, Mycobacterium tuberculosis H37Rv
cgggcccuccggcgcagc

SEQ ID NO: 3302804 - RNA, 21 nt, Mycobacterium tuberculosis H37Rv
cgggcccuccggcgcagcgac

SEQ ID NO: 3302805 - RNA, 24 nt, Mycobacterium tuberculosis H37Rv
cgggcccucgccauggcguucugc

SEQ ID NO: 3302806 - RNA, 22 nt, Mycobacterium tuberculosis H37Rv
cgggccgagaucacgccgggcg

SEQ ID NO: 3302807 - RNA, 15 nt, Mycobacterium tuberculosis H37Rv
cgggccgaucacccc

SEQ ID NO: 3302808 - RNA, 16 nt, Mycobacterium tuberculosis H37Rv
cgggccgcacggucag

SEQ ID NO: 3302809 - RNA, 18 nt, Mycobacterium tuberculosis H37Rv
cgggccgcacggucagcg

SEQ ID NO: 3302810 - RNA, 21 nt, Mycobacterium tuberculosis H37Rv
cgggccgcacggucagcgcgc

SEQ ID NO: 3302811 - RNA, 15 nt, Mycobacterium tuberculosis H37Rv
cgggccgcaucgucg

SEQ ID NO: 3302812 - RNA, 19 nt, Mycobacterium tuberculosis H37Rv
cgggccgcaucgucgccgc

SEQ ID NO: 3302813 - RNA, 19 nt, Mycobacterium tuberculosis H37Rv
cgggccgccaucucguagg

SEQ ID NO: 3302814 - RNA, 21 nt, Mycobacterium tuberculosis H37Rv
cgggccgccucgaucgacucg

SEQ ID NO: 3302815 - RNA, 15 nt, Mycobacterium tuberculosis H37Rv
cgggccgccuggagc

SEQ ID NO: 3302816 - RNA, 12 nt, Mycobacterium tuberculosis H37Rv
cgggccgcgcgc

SEQ ID NO: 3302817 - RNA, 20 nt, Mycobacterium tuberculosis H37Rv
cgggcggaacgccggcaccg

SEQ ID NO: 3302818 - RNA, 16 nt, Mycobacterium tuberculosis H37Rv
cgggcggaggccgccu

SEQ ID NO: 3302819 - RNA, 19 nt, Mycobacterium tuberculosis H37Rv
cgggcggaucggcccagau

SEQ ID NO: 3302820 - RNA, 19 nt, Mycobacterium tuberculosis H37Rv
cgggcggaugcuguugacc

SEQ ID NO: 3302821 - RNA, 22 nt, Mycobacterium tuberculosis H37Rv
cgggcggaugcuguugacccgu

SEQ ID NO: 3302822 - RNA, 20 nt, Mycobacterium tuberculosis H37Rv
cgggcggcauccugcacgac

SEQ ID NO: 3302823 - RNA, 21 nt, Mycobacterium tuberculosis H37Rv
cgggcggcauccugcacgacc

SEQ ID NO: 3302824 - RNA, 14 nt, Mycobacterium tuberculosis H37Rv
cgggcggcaucgcc

SEQ ID NO: 3302825 - RNA, 14 nt, Mycobacterium tuberculosis H37Rv
cgggcggccaccgc

SEQ ID NO: 3302826 - RNA, 13 nt, Mycobacterium tuberculosis H37Rv
cgggcggccagcu

SEQ ID NO: 3302827 - RNA, 20 nt, Mycobacterium tuberculosis H37Rv
cgggcggcgucgcggaucug

SEQ ID NO: 3302828 - RNA, 16 nt, Mycobacterium tuberculosis H37Rv
cgggcgggagucgucg

SEQ ID NO: 3302829 - RNA, 22 nt, Mycobacterium tuberculosis H37Rv
cgggcgggcguccacgcugacc

SEQ ID NO: 3302830 - RNA, 13 nt, Mycobacterium tuberculosis H37Rv
cgggcgggcuggu

SEQ ID NO: 3302831 - RNA, 16 nt, Mycobacterium tuberculosis H37Rv
cgggcggucgaagacc

SEQ ID NO: 3302832 - RNA, 13 nt, Mycobacterium tuberculosis H37Rv
cgggcggucgaga

SEQ ID NO: 3302833 - RNA, 16 nt, Mycobacterium tuberculosis H37Rv
cgggcggucgagaugu

SEQ ID NO: 3302834 - RNA, 24 nt, Mycobacterium tuberculosis H37Rv
cgggcggucgagcuucaucccgga

SEQ ID NO: 3302835 - RNA, 13 nt, Mycobacterium tuberculosis H37Rv
cgggcggugaaga

SEQ ID NO: 3302836 - RNA, 16 nt, Mycobacterium tuberculosis H37Rv
cgggcggugaggcagc

SEQ ID NO: 3302837 - RNA, 15 nt, Mycobacterium tuberculosis H37Rv
cgggcggugggcagc

SEQ ID NO: 3302838 - RNA, 18 nt, Mycobacterium tuberculosis H37Rv
cgggcggugggcagcagc

SEQ ID NO: 3302839 - RNA, 19 nt, Mycobacterium tuberculosis H37Rv
cgggcguacauucgggcgu

SEQ ID NO: 3302840 - RNA, 20 nt, Mycobacterium tuberculosis H37Rv
cgggcgucacggugcguucg

SEQ ID NO: 3302841 - RNA, 22 nt, Mycobacterium tuberculosis H37Rv
cgggcgucaugaugucgacauc

SEQ ID NO: 3302842 - RNA, 13 nt, Mycobacterium tuberculosis H37Rv
cgggcguccacgc

SEQ ID NO: 3302843 - RNA, 17 nt, Mycobacterium tuberculosis H37Rv
cgggcguccacgcugac

SEQ ID NO: 3302844 - RNA, 16 nt, Mycobacterium tuberculosis H37Rv
cgggcgucccggcggu

SEQ ID NO: 3302845 - RNA, 16 nt, Mycobacterium tuberculosis H37Rv
cgggcguccgccggcg

SEQ ID NO: 3302846 - RNA, 13 nt, Mycobacterium tuberculosis H37Rv
cgggcgucgaggu

SEQ ID NO: 3302847 - RNA, 18 nt, Mycobacterium tuberculosis H37Rv
cgggcgucgucggugauc

SEQ ID NO: 3302848 - RNA, 23 nt, Mycobacterium tuberculosis H37Rv
cgggcgucgucggugaucaccgc

SEQ ID NO: 3302849 - RNA, 14 nt, Mycobacterium tuberculosis H37Rv
cgggcgugccgacc

SEQ ID NO: 3302850 - RNA, 19 nt, Mycobacterium tuberculosis H37Rv
cgggcgugcuacacccgua

SEQ ID NO: 3302851 - RNA, 15 nt, Mycobacterium tuberculosis H37Rv
cgggcgugggccgcu

SEQ ID NO: 3302852 - RNA, 19 nt, Mycobacterium tuberculosis H37Rv
cgggcgugggugucggcga

SEQ ID NO: 3302853 - RNA, 14 nt, Mycobacterium tuberculosis H37Rv
cgggcgugguaacc

SEQ ID NO: 3302854 - RNA, 17 nt, Mycobacterium tuberculosis H37Rv
cgggcgugguaucgccg

SEQ ID NO: 3302855 - RNA, 15 nt, Mycobacterium tuberculosis H37Rv
cgggcgugugcaguc

SEQ ID NO: 3302856 - RNA, 19 nt, Mycobacterium tuberculosis H37Rv
cgggcgugugcaguccgau

SEQ ID NO: 3302857 - RNA, 23 nt, Mycobacterium tuberculosis H37Rv
cgggcguucucgauugucgccgc

SEQ ID NO: 3302858 - RNA, 20 nt, Mycobacterium tuberculosis H37Rv
cgggcguugcccuccuucuc

SEQ ID NO: 3302859 - RNA, 22 nt, Mycobacterium tuberculosis H37Rv
cgggcguuuggacgggcgugcu

SEQ ID NO: 3302860 - RNA, 16 nt, Mycobacterium tuberculosis H37Rv
cgggcuaccggcagcu

SEQ ID NO: 3302861 - RNA, 17 nt, Mycobacterium tuberculosis H37Rv
cgggcucacaugugcgc

SEQ ID NO: 3302862 - RNA, 22 nt, Mycobacterium tuberculosis H37Rv
cgggcucacaugugcgcgucgc

SEQ ID NO: 3302863 - RNA, 21 nt, Mycobacterium tuberculosis H37Rv
cgggcucagacuuucgcccag

SEQ ID NO: 3302864 - RNA, 15 nt, Mycobacterium tuberculosis H37Rv
cgggcucagcggcga

SEQ ID NO: 3302865 - RNA, 14 nt, Mycobacterium tuberculosis H37Rv
cgggcuccaacagg

SEQ ID NO: 3302866 - RNA, 20 nt, Mycobacterium tuberculosis H37Rv
cgggcuccagcagcgccauc

SEQ ID NO: 3302867 - RNA, 17 nt, Mycobacterium tuberculosis H37Rv
cgggcuccccaagucga

SEQ ID NO: 3302868 - RNA, 12 nt, Mycobacterium tuberculosis H37Rv
cgggcuccccgc

SEQ ID NO: 3302869 - RNA, 17 nt, Mycobacterium tuberculosis H37Rv
cgggcuccggcucgaca

SEQ ID NO: 3302870 - RNA, 13 nt, Mycobacterium tuberculosis H37Rv
cgggcucgcaugu

SEQ ID NO: 3302871 - RNA, 18 nt, Mycobacterium tuberculosis H37Rv
cgggcucgcauucggcga

SEQ ID NO: 3302872 - RNA, 15 nt, Mycobacterium tuberculosis H37Rv
cgggcucgcccgcua

SEQ ID NO: 3302873 - RNA, 16 nt, Mycobacterium tuberculosis H37Rv
cgggcucgcugcacca

SEQ ID NO: 3302874 - RNA, 21 nt, Mycobacterium tuberculosis H37Rv
cgggcucgcuucaggcaccgg

SEQ ID NO: 3302875 - RNA, 23 nt, Mycobacterium tuberculosis H37Rv
cgggcucgcuucaggcaccggau

SEQ ID NO: 3302876 - RNA, 15 nt, Mycobacterium tuberculosis H37Rv
cgggcucggcgaagg

SEQ ID NO: 3302877 - RNA, 18 nt, Mycobacterium tuberculosis H37Rv
cgggcucggcgaaggccg

SEQ ID NO: 3302878 - RNA, 15 nt, Mycobacterium tuberculosis H37Rv
cgggcucggcgucgc

SEQ ID NO: 3302879 - RNA, 19 nt, Mycobacterium tuberculosis H37Rv
cgggcucggcguugaugaa

SEQ ID NO: 3302880 - RNA, 17 nt, Mycobacterium tuberculosis H37Rv
cgggcucgguggcggac

SEQ ID NO: 3302881 - RNA, 17 nt, Mycobacterium tuberculosis H37Rv
cgggcucguccagcaac

SEQ ID NO: 3302882 - RNA, 15 nt, Mycobacterium tuberculosis H37Rv
cgggcucguguccgc

SEQ ID NO: 3302883 - RNA, 18 nt, Mycobacterium tuberculosis H37Rv
cgggcucguguccgccgu

SEQ ID NO: 3302884 - RNA, 21 nt, Mycobacterium tuberculosis H37Rv
cgggcucguguccgccgucac

SEQ ID NO: 3302885 - RNA, 18 nt, Mycobacterium tuberculosis H37Rv
cgggcucuaucagacgau

SEQ ID NO: 3302886 - RNA, 20 nt, Mycobacterium tuberculosis H37Rv
cgggcugacgaucuccaccc

SEQ ID NO: 3302887 - RNA, 16 nt, Mycobacterium tuberculosis H37Rv
cgggcugaggcggcga

SEQ ID NO: 3302888 - RNA, 21 nt, Mycobacterium tuberculosis H37Rv
cgggcugaggcggcgacgacc

SEQ ID NO: 3302889 - RNA, 14 nt, Mycobacterium tuberculosis H37Rv
cgggcugcagugac

SEQ ID NO: 3302890 - RNA, 19 nt, Mycobacterium tuberculosis H37Rv
cgggcugcagugacucgau

SEQ ID NO: 3302891 - RNA, 23 nt, Mycobacterium tuberculosis H37Rv
cgggcugcagugacucgaucacc

SEQ ID NO: 3302892 - RNA, 21 nt, Mycobacterium tuberculosis H37Rv
cgggcugccccuccgggcgca

SEQ ID NO: 3302893 - RNA, 23 nt, Mycobacterium tuberculosis H37Rv
cgggcugccgcaugcgcuccggc

SEQ ID NO: 3302894 - RNA, 16 nt, Mycobacterium tuberculosis H37Rv
cgggcugccgcccaug

SEQ ID NO: 3302895 - RNA, 15 nt, Mycobacterium tuberculosis H37Rv
cgggcugcggcagua

SEQ ID NO: 3302896 - RNA, 22 nt, Mycobacterium tuberculosis H37Rv
cgggcuggauaugagccaaccc

SEQ ID NO: 3302897 - RNA, 14 nt, Mycobacterium tuberculosis H37Rv
cgggcuggccgacu

SEQ ID NO: 3302898 - RNA, 12 nt, Mycobacterium tuberculosis H37Rv
cgggcuggcgac

SEQ ID NO: 3302899 - RNA, 13 nt, Mycobacterium tuberculosis H37Rv
cgggcuggcgacg

SEQ ID NO: 3302900 - RNA, 15 nt, Mycobacterium tuberculosis H37Rv
cgggcuggcgacgac

SEQ ID NO: 3302901 - RNA, 14 nt, Mycobacterium tuberculosis H37Rv
cgggcuggcguugc

SEQ ID NO: 3302902 - RNA, 14 nt, Mycobacterium tuberculosis H37Rv
cgggcuggucgguc

SEQ ID NO: 3302903 - RNA, 21 nt, Mycobacterium tuberculosis H37Rv
cgggcuguaggcgaucacgau

SEQ ID NO: 3302904 - RNA, 19 nt, Mycobacterium tuberculosis H37Rv
cgggcugugauccgacagu

SEQ ID NO: 3302905 - RNA, 22 nt, Mycobacterium tuberculosis H37Rv
cgggcugugauccgacaguggc

SEQ ID NO: 3302906 - RNA, 16 nt, Mycobacterium tuberculosis H37Rv
cgggcuuaggccgcgg

SEQ ID NO: 3302907 - RNA, 15 nt, Mycobacterium tuberculosis H37Rv
cgggcuucaacacac

SEQ ID NO: 3302908 - RNA, 16 nt, Mycobacterium tuberculosis H37Rv
cgggcuucagcacgcg

SEQ ID NO: 3302909 - RNA, 22 nt, Mycobacterium tuberculosis H37Rv
cgggcuugacccuugggcacca

SEQ ID NO: 3302910 - RNA, 17 nt, Mycobacterium tuberculosis H37Rv
cgggcuugagcgccgau

SEQ ID NO: 3302911 - RNA, 15 nt, Mycobacterium tuberculosis H37Rv
cgggcuugccguugg

SEQ ID NO: 3302912 - RNA, 15 nt, Mycobacterium tuberculosis H37Rv
cgggcuuggcgucga

SEQ ID NO: 3302913 - RNA, 22 nt, Mycobacterium tuberculosis H37Rv
cggggugaacgcggacaccgcg

SEQ ID NO: 3302914 - RNA, 16 nt, Mycobacterium tuberculosis H37Rv
cggggugacaucgcga

SEQ ID NO: 3302915 - RNA, 15 nt, Mycobacterium tuberculosis H37Rv
cggggugcacaccgu

SEQ ID NO: 3302916 - RNA, 21 nt, Mycobacterium tuberculosis H37Rv
cggggugcacaccgucgcgcu

SEQ ID NO: 3302917 - RNA, 15 nt, Mycobacterium tuberculosis H37Rv
cggggugcaccgucg

SEQ ID NO: 3302918 - RNA, 17 nt, Mycobacterium tuberculosis H37Rv
cggggugcacgaugacg

SEQ ID NO: 3302919 - RNA, 17 nt, Mycobacterium tuberculosis H37Rv
cggggugcgcccaccga

SEQ ID NO: 3302920 - RNA, 12 nt, Mycobacterium tuberculosis H37Rv
cgggguggcacg

SEQ ID NO: 3302921 - RNA, 13 nt, Mycobacterium tuberculosis H37Rv
cgggguggcggca

SEQ ID NO: 3302922 - RNA, 20 nt, Mycobacterium tuberculosis H37Rv
cgggguggcggcgcugcgcg

SEQ ID NO: 3302923 - RNA, 12 nt, Mycobacterium tuberculosis H37Rv
cgggguggugga

SEQ ID NO: 3302924 - RNA, 15 nt, Mycobacterium tuberculosis H37Rv
cggggugguggaagg

SEQ ID NO: 3302925 - RNA, 16 nt, Mycobacterium tuberculosis H37Rv
cgggguucaccgucga

SEQ ID NO: 3302926 - RNA, 23 nt, Mycobacterium tuberculosis H37Rv
cgggguugaccguggucggaggu

SEQ ID NO: 3302927 - RNA, 15 nt, Mycobacterium tuberculosis H37Rv
cgggguugacuggcc

SEQ ID NO: 3302928 - RNA, 15 nt, Mycobacterium tuberculosis H37Rv
cgggguugaucaccg

SEQ ID NO: 3302929 - RNA, 14 nt, Mycobacterium tuberculosis H37Rv
cgggguugcccgcg

SEQ ID NO: 3302930 - RNA, 17 nt, Mycobacterium tuberculosis H37Rv
cgggguugggcggagca

SEQ ID NO: 3302931 - RNA, 18 nt, Mycobacterium tuberculosis H37Rv
cgggguuguccucggcga

SEQ ID NO: 3302932 - RNA, 17 nt, Mycobacterium tuberculosis H37Rv
cgggguuguggucgagu

SEQ ID NO: 3302933 - RNA, 17 nt, Mycobacterium tuberculosis H37Rv
cgggguuguucggcagc

SEQ ID NO: 3302934 - RNA, 14 nt, Mycobacterium tuberculosis H37Rv
cggguaaccggcuc

SEQ ID NO: 3302935 - RNA, 17 nt, Mycobacterium tuberculosis H37Rv
cggguaaccggcuccgg

SEQ ID NO: 3302936 - RNA, 20 nt, Mycobacterium tuberculosis H37Rv
cggguaacguguucacggcc

SEQ ID NO: 3302937 - RNA, 18 nt, Mycobacterium tuberculosis H37Rv
cggguaaugcgacgccgg

SEQ ID NO: 3302938 - RNA, 14 nt, Mycobacterium tuberculosis H37Rv
cggguacaagacga

SEQ ID NO: 3302939 - RNA, 23 nt, Mycobacterium tuberculosis H37Rv
cggguacaagacgauucaccaau

SEQ ID NO: 3302940 - RNA, 16 nt, Mycobacterium tuberculosis H37Rv
cggguacaccacgguu

SEQ ID NO: 3302941 - RNA, 15 nt, Mycobacterium tuberculosis H37Rv
cggguacacccgcuc

SEQ ID NO: 3302942 - RNA, 13 nt, Mycobacterium tuberculosis H37Rv
cggguaccacgcu

SEQ ID NO: 3302943 - RNA, 15 nt, Mycobacterium tuberculosis H37Rv
cggguaccggcggca

SEQ ID NO: 3302944 - RNA, 15 nt, Mycobacterium tuberculosis H37Rv
cggguacgccgggca

SEQ ID NO: 3302945 - RNA, 18 nt, Mycobacterium tuberculosis H37Rv
cggguagacaugggugaa

SEQ ID NO: 3302946 - RNA, 19 nt, Mycobacterium tuberculosis H37Rv
cggguagaccaccugcaug

SEQ ID NO: 3302947 - RNA, 21 nt, Mycobacterium tuberculosis H37Rv
cggguagacccacaucagguc

SEQ ID NO: 3302948 - RNA, 22 nt, Mycobacterium tuberculosis H37Rv
cggguagauguucacgccgccg

SEQ ID NO: 3302949 - RNA, 18 nt, Mycobacterium tuberculosis H37Rv
cggguagcacucgaugcg

SEQ ID NO: 3302950 - RNA, 21 nt, Mycobacterium tuberculosis H37Rv
cggguagcacucgaugcggug

SEQ ID NO: 3302951 - RNA, 19 nt, Mycobacterium tuberculosis H37Rv
cggguagccggcgugcacu

SEQ ID NO: 3302952 - RNA, 13 nt, Mycobacterium tuberculosis H37Rv
cggguagccgucg

SEQ ID NO: 3302953 - RNA, 15 nt, Mycobacterium tuberculosis H37Rv
cggguagccgucgau

SEQ ID NO: 3302954 - RNA, 20 nt, Mycobacterium tuberculosis H37Rv
cggguagccgucgaucccgg

SEQ ID NO: 3302955 - RNA, 22 nt, Mycobacterium tuberculosis H37Rv
cggguagccgucgaucccgguc

SEQ ID NO: 3302956 - RNA, 18 nt, Mycobacterium tuberculosis H37Rv
cggguagugcacggacag

SEQ ID NO: 3302957 - RNA, 13 nt, Mycobacterium tuberculosis H37Rv
cggguaucgccag

SEQ ID NO: 3302958 - RNA, 15 nt, Mycobacterium tuberculosis H37Rv
cggguauggcggcga

SEQ ID NO: 3302959 - RNA, 20 nt, Mycobacterium tuberculosis H37Rv
cgggucaacgccaucacccc

SEQ ID NO: 3302960 - RNA, 22 nt, Mycobacterium tuberculosis H37Rv
cgggucaacgccaucaccccgg

SEQ ID NO: 3302961 - RNA, 23 nt, Mycobacterium tuberculosis H37Rv
cgggucaccagcgcaucggccag

SEQ ID NO: 3302962 - RNA, 15 nt, Mycobacterium tuberculosis H37Rv
cgggucagcaccacc

SEQ ID NO: 3302963 - RNA, 18 nt, Mycobacterium tuberculosis H37Rv
cgggucagcaccaccagc

SEQ ID NO: 3302964 - RNA, 15 nt, Mycobacterium tuberculosis H37Rv
cgggucagcccagcc

SEQ ID NO: 3302965 - RNA, 21 nt, Mycobacterium tuberculosis H37Rv
cgggucagcgccgagagcacc

SEQ ID NO: 3302966 - RNA, 23 nt, Mycobacterium tuberculosis H37Rv
cgggucagcugacgggccgcugu

SEQ ID NO: 3302967 - RNA, 19 nt, Mycobacterium tuberculosis H37Rv
cgggucauccgugucgaga

SEQ ID NO: 3302968 - RNA, 12 nt, Mycobacterium tuberculosis H37Rv
cggguccaccgc

SEQ ID NO: 3302969 - RNA, 19 nt, Mycobacterium tuberculosis H37Rv
cggguccagcggccgccgc

SEQ ID NO: 3302970 - RNA, 15 nt, Mycobacterium tuberculosis H37Rv
cggguccaggcguug

SEQ ID NO: 3302971 - RNA, 21 nt, Mycobacterium tuberculosis H37Rv
cgggucccuuguggucugcca

SEQ ID NO: 3302972 - RNA, 23 nt, Mycobacterium tuberculosis H37Rv
cgggucccuuguggucugccagc

SEQ ID NO: 3302973 - RNA, 19 nt, Mycobacterium tuberculosis H37Rv
cggguccgacagccccggc

SEQ ID NO: 3302974 - RNA, 14 nt, Mycobacterium tuberculosis H37Rv
cggguccgccgggc

SEQ ID NO: 3302975 - RNA, 14 nt, Mycobacterium tuberculosis H37Rv
cggguccgccguug

SEQ ID NO: 3302976 - RNA, 13 nt, Mycobacterium tuberculosis H37Rv
cggguccucgcgg

SEQ ID NO: 3302977 - RNA, 18 nt, Mycobacterium tuberculosis H37Rv
cggguccuucugccggga

SEQ ID NO: 3302978 - RNA, 15 nt, Mycobacterium tuberculosis H37Rv
cggguccuugcggcc

SEQ ID NO: 3302979 - RNA, 18 nt, Mycobacterium tuberculosis H37Rv
cgggucgacguuaccgac

SEQ ID NO: 3302980 - RNA, 19 nt, Mycobacterium tuberculosis H37Rv
cgggucgacguuaccgacc

SEQ ID NO: 3302981 - RNA, 14 nt, Mycobacterium tuberculosis H37Rv
cgggucgaucaccg

SEQ ID NO: 3302982 - RNA, 16 nt, Mycobacterium tuberculosis H37Rv
cgggucgaucaccgac

SEQ ID NO: 3302983 - RNA, 15 nt, Mycobacterium tuberculosis H37Rv
cgggucgaugacgcc

SEQ ID NO: 3302984 - RNA, 16 nt, Mycobacterium tuberculosis H37Rv
cgggucgaugcgcaac

SEQ ID NO: 3302985 - RNA, 18 nt, Mycobacterium tuberculosis H37Rv
cgggucgaugucggcaau

SEQ ID NO: 3302986 - RNA, 22 nt, Mycobacterium tuberculosis H37Rv
cgggucgaugucggggccgucg

SEQ ID NO: 3302987 - RNA, 14 nt, Mycobacterium tuberculosis H37Rv
cgggucgccgccau

SEQ ID NO: 3302988 - RNA, 20 nt, Mycobacterium tuberculosis H37Rv
cgggucgccggacugcggcc

SEQ ID NO: 3302989 - RNA, 20 nt, Mycobacterium tuberculosis H37Rv
cgggucgccgggcccgucgg

SEQ ID NO: 3302990 - RNA, 23 nt, Mycobacterium tuberculosis H37Rv
cgggucgcggcuauggcgccgcg

SEQ ID NO: 3302991 - RNA, 22 nt, Mycobacterium tuberculosis H37Rv
cgggucgcgggguaggcccagc

SEQ ID NO: 3302992 - RNA, 16 nt, Mycobacterium tuberculosis H37Rv
cgggucggcacgaccc

SEQ ID NO: 3302993 - RNA, 18 nt, Mycobacterium tuberculosis H37Rv
cgggucggcacgacccgg

SEQ ID NO: 3302994 - RNA, 20 nt, Mycobacterium tuberculosis H37Rv
cgggucggcacgacccggga

SEQ ID NO: 3302995 - RNA, 22 nt, Mycobacterium tuberculosis H37Rv
cgggucggcacgacccgggaag

SEQ ID NO: 3302996 - RNA, 16 nt, Mycobacterium tuberculosis H37Rv
cgggucggcgaacgcc

SEQ ID NO: 3302997 - RNA, 17 nt, Mycobacterium tuberculosis H37Rv
cgggucggcgaccgcgc

SEQ ID NO: 3302998 - RNA, 16 nt, Mycobacterium tuberculosis H37Rv
cgggucggcgacgaac

SEQ ID NO: 3302999 - RNA, 19 nt, Mycobacterium tuberculosis H37Rv
cgggucggcggccuccgcg

SEQ ID NO: 3303000 - RNA, 15 nt, Mycobacterium tuberculosis H37Rv
cgggucgggcaccgc

SEQ ID NO: 3303001 - RNA, 18 nt, Mycobacterium tuberculosis H37Rv
cgggucgggcaccgcgcg

SEQ ID NO: 3303002 - RNA, 20 nt, Mycobacterium tuberculosis H37Rv
cgggucgggcaccgcgcgcu

SEQ ID NO: 3303003 - RNA, 21 nt, Mycobacterium tuberculosis H37Rv
cgggucgucauacagcgcccu

SEQ ID NO: 3303004 - RNA, 20 nt, Mycobacterium tuberculosis H37Rv
cgggucguccgccugcaccg

SEQ ID NO: 3303005 - RNA, 23 nt, Mycobacterium tuberculosis H37Rv
cgggucguccgccugcaccgccg

SEQ ID NO: 3303006 - RNA, 14 nt, Mycobacterium tuberculosis H37Rv
cgggucgucggcgu

SEQ ID NO: 3303007 - RNA, 16 nt, Mycobacterium tuberculosis H37Rv
cgggucgugccagcag

SEQ ID NO: 3303008 - RNA, 15 nt, Mycobacterium tuberculosis H37Rv
cgggucgugcgacaa

SEQ ID NO: 3303009 - RNA, 23 nt, Mycobacterium tuberculosis H37Rv
cgguacccgauguccuauuugca

SEQ ID NO: 3303010 - RNA, 16 nt, Mycobacterium tuberculosis H37Rv
cgguacccguagcacc

SEQ ID NO: 3303011 - RNA, 13 nt, Mycobacterium tuberculosis H37Rv
cgguaccgcccgc

SEQ ID NO: 3303012 - RNA, 15 nt, Mycobacterium tuberculosis H37Rv
cgguaccgcccgcac

SEQ ID NO: 3303013 - RNA, 12 nt, Mycobacterium tuberculosis H37Rv
cgguaccgccgg

SEQ ID NO: 3303014 - RNA, 15 nt, Mycobacterium tuberculosis H37Rv
cgguaccgccggcuc

SEQ ID NO: 3303015 - RNA, 14 nt, Mycobacterium tuberculosis H37Rv
cgguaccucgucga

SEQ ID NO: 3303016 - RNA, 19 nt, Mycobacterium tuberculosis H37Rv
cgguaccugacagcucacg

SEQ ID NO: 3303017 - RNA, 12 nt, Mycobacterium tuberculosis H37Rv
cgguacgcaacc

SEQ ID NO: 3303018 - RNA, 13 nt, Mycobacterium tuberculosis H37Rv
cgguacugcgcag

SEQ ID NO: 3303019 - RNA, 17 nt, Mycobacterium tuberculosis H37Rv
cgguacugcgcagcgcc

SEQ ID NO: 3303020 - RNA, 18 nt, Mycobacterium tuberculosis H37Rv
cgguagacaagucggcgc

SEQ ID NO: 3303021 - RNA, 21 nt, Mycobacterium tuberculosis H37Rv
cgguagaucuucggccgcacu

SEQ ID NO: 3303022 - RNA, 18 nt, Mycobacterium tuberculosis H37Rv
cgguagcacagcagcaac

SEQ ID NO: 3303023 - RNA, 17 nt, Mycobacterium tuberculosis H37Rv
cgguagccaagcgagcg

SEQ ID NO: 3303024 - RNA, 15 nt, Mycobacterium tuberculosis H37Rv
cgguagccgaccagc

SEQ ID NO: 3303025 - RNA, 18 nt, Mycobacterium tuberculosis H37Rv
cgguagccgaccagcgcu

SEQ ID NO: 3303026 - RNA, 16 nt, Mycobacterium tuberculosis H37Rv
cgguagccuggcuguc

SEQ ID NO: 3303027 - RNA, 19 nt, Mycobacterium tuberculosis H37Rv
cgguagccuggcuguccgc

SEQ ID NO: 3303028 - RNA, 18 nt, Mycobacterium tuberculosis H37Rv
cgguagcgcggguggcuc

SEQ ID NO: 3303029 - RNA, 19 nt, Mycobacterium tuberculosis H37Rv
cgguagcguucgucguagu

SEQ ID NO: 3303030 - RNA, 16 nt, Mycobacterium tuberculosis H37Rv
cgguagcucauugccg

SEQ ID NO: 3303031 - RNA, 21 nt, Mycobacterium tuberculosis H37Rv
cgguagcugaccgugcugaau

SEQ ID NO: 3303032 - RNA, 16 nt, Mycobacterium tuberculosis H37Rv
cgguagcuggguccgu

SEQ ID NO: 3303033 - RNA, 20 nt, Mycobacterium tuberculosis H37Rv
cgguagcuggguccguccau

SEQ ID NO: 3303034 - RNA, 13 nt, Mycobacterium tuberculosis H37Rv
cgguagcuuccgc

SEQ ID NO: 3303035 - RNA, 16 nt, Mycobacterium tuberculosis H37Rv
cgguaggccaucugcu

SEQ ID NO: 3303036 - RNA, 12 nt, Mycobacterium tuberculosis H37Rv
cgguaggcggcc

SEQ ID NO: 3303037 - RNA, 15 nt, Mycobacterium tuberculosis H37Rv
cgguaggggugaucc

SEQ ID NO: 3303038 - RNA, 19 nt, Mycobacterium tuberculosis H37Rv
cgguaggugcaugucgaug

SEQ ID NO: 3303039 - RNA, 16 nt, Mycobacterium tuberculosis H37Rv
cgguaguacuagcacg

SEQ ID NO: 3303040 - RNA, 15 nt, Mycobacterium tuberculosis H37Rv
cgguaguagcugacc

SEQ ID NO: 3303041 - RNA, 14 nt, Mycobacterium tuberculosis H37Rv
cgguagucgccgag

SEQ ID NO: 3303042 - RNA, 16 nt, Mycobacterium tuberculosis H37Rv
cgguagucgccgucgg

SEQ ID NO: 3303043 - RNA, 18 nt, Mycobacterium tuberculosis H37Rv
cgguagucgccgucgggu

SEQ ID NO: 3303044 - RNA, 19 nt, Mycobacterium tuberculosis H37Rv
cgguagucgccgucggguc

SEQ ID NO: 3303045 - RNA, 23 nt, Mycobacterium tuberculosis H37Rv
cgguauagccaagugagcgaucg

SEQ ID NO: 3303046 - RNA, 19 nt, Mycobacterium tuberculosis H37Rv
cgguaucgagggcagccgc

SEQ ID NO: 3303047 - RNA, 18 nt, Mycobacterium tuberculosis H37Rv
cgguaucggcgaccagcu

SEQ ID NO: 3303048 - RNA, 20 nt, Mycobacterium tuberculosis H37Rv
cgguaucgucccggcgaccg

SEQ ID NO: 3303049 - RNA, 13 nt, Mycobacterium tuberculosis H37Rv
cgguauugcccgg

SEQ ID NO: 3303050 - RNA, 22 nt, Mycobacterium tuberculosis H37Rv
cgguauuugaacgcccgcuuca

SEQ ID NO: 3303051 - RNA, 17 nt, Mycobacterium tuberculosis H37Rv
cggucaaacgcgcgcgc

SEQ ID NO: 3303052 - RNA, 18 nt, Mycobacterium tuberculosis H37Rv
cggucaaauccagcagcc

SEQ ID NO: 3303053 - RNA, 20 nt, Mycobacterium tuberculosis H37Rv
cggucaacacccgcccgggc

SEQ ID NO: 3303054 - RNA, 15 nt, Mycobacterium tuberculosis H37Rv
cggucaacgcuagcg

SEQ ID NO: 3303055 - RNA, 18 nt, Mycobacterium tuberculosis H37Rv
cggucaacgcuagcgucg

SEQ ID NO: 3303056 - RNA, 17 nt, Mycobacterium tuberculosis H37Rv
cggucaagccggcgccc

SEQ ID NO: 3303057 - RNA, 20 nt, Mycobacterium tuberculosis H37Rv
cggucaaggugcgccgccau

SEQ ID NO: 3303058 - RNA, 18 nt, Mycobacterium tuberculosis H37Rv
cggucaaucccggccagg

SEQ ID NO: 3303059 - RNA, 23 nt, Mycobacterium tuberculosis H37Rv
cggucaaugccacuaggaaggug

SEQ ID NO: 3303060 - RNA, 12 nt, Mycobacterium tuberculosis H37Rv
cggucaccaccg

SEQ ID NO: 3303061 - RNA, 23 nt, Mycobacterium tuberculosis H37Rv
cggucaccaccgacccgcugcca

SEQ ID NO: 3303062 - RNA, 17 nt, Mycobacterium tuberculosis H37Rv
cggucaccgacgcagaa

SEQ ID NO: 3303063 - RNA, 18 nt, Mycobacterium tuberculosis H37Rv
cggucaccgacgcagaac

SEQ ID NO: 3303064 - RNA, 14 nt, Mycobacterium tuberculosis H37Rv
cggucaccgcgcag

SEQ ID NO: 3303065 - RNA, 15 nt, Mycobacterium tuberculosis H37Rv
cggucaccgcggcau

SEQ ID NO: 3303066 - RNA, 20 nt, Mycobacterium tuberculosis H37Rv
cggucaccggagagccggua

SEQ ID NO: 3303067 - RNA, 13 nt, Mycobacterium tuberculosis H37Rv
cggucaccucgau

SEQ ID NO: 3303068 - RNA, 14 nt, Mycobacterium tuberculosis H37Rv
cggucaccucgaug

SEQ ID NO: 3303069 - RNA, 16 nt, Mycobacterium tuberculosis H37Rv
cggucaccucgaugcg

SEQ ID NO: 3303070 - RNA, 18 nt, Mycobacterium tuberculosis H37Rv
cggucacgaucacgaugu

SEQ ID NO: 3303071 - RNA, 14 nt, Mycobacterium tuberculosis H37Rv
cggucacgguggug

SEQ ID NO: 3303072 - RNA, 21 nt, Mycobacterium tuberculosis H37Rv
cggucagacgccggccgccga

SEQ ID NO: 3303073 - RNA, 16 nt, Mycobacterium tuberculosis H37Rv
cggucagagccgucga

SEQ ID NO: 3303074 - RNA, 18 nt, Mycobacterium tuberculosis H37Rv
cggucagagccgucgaag

SEQ ID NO: 3303075 - RNA, 15 nt, Mycobacterium tuberculosis H37Rv
cggucagaugcgccg

SEQ ID NO: 3303076 - RNA, 13 nt, Mycobacterium tuberculosis H37Rv
cggucagauggcc

SEQ ID NO: 3303077 - RNA, 15 nt, Mycobacterium tuberculosis H37Rv
cggucagcagcgccg

SEQ ID NO: 3303078 - RNA, 19 nt, Mycobacterium tuberculosis H37Rv
cggucagccagcccagggu

SEQ ID NO: 3303079 - RNA, 12 nt, Mycobacterium tuberculosis H37Rv
cggucagccagg

SEQ ID NO: 3303080 - RNA, 12 nt, Mycobacterium tuberculosis H37Rv
cggucagccgcg

SEQ ID NO: 3303081 - RNA, 13 nt, Mycobacterium tuberculosis H37Rv
cggucagccgcgg

SEQ ID NO: 3303082 - RNA, 14 nt, Mycobacterium tuberculosis H37Rv
cggucagccgcggg

SEQ ID NO: 3303083 - RNA, 13 nt, Mycobacterium tuberculosis H37Rv
cggucagcgccga

SEQ ID NO: 3303084 - RNA, 14 nt, Mycobacterium tuberculosis H37Rv
cggucagcgccgac

SEQ ID NO: 3303085 - RNA, 23 nt, Mycobacterium tuberculosis H37Rv
cggucagcgcgcacgacaggauc

SEQ ID NO: 3303086 - RNA, 16 nt, Mycobacterium tuberculosis H37Rv
cggucagcgcgcggcu

SEQ ID NO: 3303087 - RNA, 15 nt, Mycobacterium tuberculosis H37Rv
cggucagcgcggcga

SEQ ID NO: 3303088 - RNA, 17 nt, Mycobacterium tuberculosis H37Rv
cggucagcucgcugacg

SEQ ID NO: 3303089 - RNA, 22 nt, Mycobacterium tuberculosis H37Rv
cggucagcucggcagcaucucc

SEQ ID NO: 3303090 - RNA, 15 nt, Mycobacterium tuberculosis H37Rv
cggucagcucgucgg

SEQ ID NO: 3303091 - RNA, 20 nt, Mycobacterium tuberculosis H37Rv
cggucaggauggggaccacu

SEQ ID NO: 3303092 - RNA, 18 nt, Mycobacterium tuberculosis H37Rv
cggucaggucugacagac

SEQ ID NO: 3303093 - RNA, 16 nt, Mycobacterium tuberculosis H37Rv
cggucaguauggcgac

SEQ ID NO: 3303094 - RNA, 17 nt, Mycobacterium tuberculosis H37Rv
cggucaguauggcgacg

SEQ ID NO: 3303095 - RNA, 17 nt, Mycobacterium tuberculosis H37Rv
cggucagugggacgggc

SEQ ID NO: 3303096 - RNA, 22 nt, Mycobacterium tuberculosis H37Rv
cggucauagucgaauggcaaca

SEQ ID NO: 3303097 - RNA, 15 nt, Mycobacterium tuberculosis H37Rv
cggucauccgggcga

SEQ ID NO: 3303098 - RNA, 16 nt, Mycobacterium tuberculosis H37Rv
cggucaucgagcugac

SEQ ID NO: 3303099 - RNA, 23 nt, Mycobacterium tuberculosis H37Rv
cggucaugggaucaggcugggca

SEQ ID NO: 3303100 - RNA, 16 nt, Mycobacterium tuberculosis H37Rv
cggucaugucggccac

SEQ ID NO: 3303101 - RNA, 17 nt, Mycobacterium tuberculosis H37Rv
cgguccaaaacaccgcc

SEQ ID NO: 3303102 - RNA, 20 nt, Mycobacterium tuberculosis H37Rv
cgguccaaaacaccgccagc

SEQ ID NO: 3303103 - RNA, 17 nt, Mycobacterium tuberculosis H37Rv
cgguccaaucgccgggu

SEQ ID NO: 3303104 - RNA, 19 nt, Mycobacterium tuberculosis H37Rv
cgguccacugucagcgauc

SEQ ID NO: 3303105 - RNA, 21 nt, Mycobacterium tuberculosis H37Rv
cgguccagacccagcucgucg

SEQ ID NO: 3303106 - RNA, 15 nt, Mycobacterium tuberculosis H37Rv
cggucggcgacguag

SEQ ID NO: 3303107 - RNA, 22 nt, Mycobacterium tuberculosis H37Rv
cggucggcgguagccgaccagc

SEQ ID NO: 3303108 - RNA, 21 nt, Mycobacterium tuberculosis H37Rv
cggucggcgucgagauagucg

SEQ ID NO: 3303109 - RNA, 23 nt, Mycobacterium tuberculosis H37Rv
cggucggguuggccgggcuggcg

SEQ ID NO: 3303110 - RNA, 20 nt, Mycobacterium tuberculosis H37Rv
cggucgguacccgcacccgu

SEQ ID NO: 3303111 - RNA, 23 nt, Mycobacterium tuberculosis H37Rv
cggucggucaccauggcgccgcg

SEQ ID NO: 3303112 - RNA, 14 nt, Mycobacterium tuberculosis H37Rv
cggucggugagccg

SEQ ID NO: 3303113 - RNA, 15 nt, Mycobacterium tuberculosis H37Rv
cggucggugagccgu

SEQ ID NO: 3303114 - RNA, 20 nt, Mycobacterium tuberculosis H37Rv
cggucgguguggacugggcc

SEQ ID NO: 3303115 - RNA, 18 nt, Mycobacterium tuberculosis H37Rv
cggucguagcuucggguc

SEQ ID NO: 3303116 - RNA, 14 nt, Mycobacterium tuberculosis H37Rv
cggucgucaccgua

SEQ ID NO: 3303117 - RNA, 12 nt, Mycobacterium tuberculosis H37Rv
cggucgucgcga

SEQ ID NO: 3303118 - RNA, 16 nt, Mycobacterium tuberculosis H37Rv
cggucgugaucagcag

SEQ ID NO: 3303119 - RNA, 18 nt, Mycobacterium tuberculosis H37Rv
cggucgugaucagcagga

SEQ ID NO: 3303120 - RNA, 12 nt, Mycobacterium tuberculosis H37Rv
cggucguggucc

SEQ ID NO: 3303121 - RNA, 23 nt, Mycobacterium tuberculosis H37Rv
cggucguuggauauggucaccgg

SEQ ID NO: 3303122 - RNA, 15 nt, Mycobacterium tuberculosis H37Rv
cggucguuggucggg

SEQ ID NO: 3303123 - RNA, 16 nt, Mycobacterium tuberculosis H37Rv
cggucguuggucgggg

SEQ ID NO: 3303124 - RNA, 16 nt, Mycobacterium tuberculosis H37Rv
cggucuacgccaccga

SEQ ID NO: 3303125 - RNA, 19 nt, Mycobacterium tuberculosis H37Rv
cggucucacguugugagcc

SEQ ID NO: 3303126 - RNA, 17 nt, Mycobacterium tuberculosis H37Rv
cggucucauagugcagg

SEQ ID NO: 3303127 - RNA, 17 nt, Mycobacterium tuberculosis H37Rv
cggucucaugcacccgg

SEQ ID NO: 3303128 - RNA, 22 nt, Mycobacterium tuberculosis H37Rv
cggucuccaccaccgacgagga

SEQ ID NO: 3303129 - RNA, 18 nt, Mycobacterium tuberculosis H37Rv
cggucuccgcccgcgggc

SEQ ID NO: 3303130 - RNA, 18 nt, Mycobacterium tuberculosis H37Rv
cggucucggugccgagca

SEQ ID NO: 3303131 - RNA, 15 nt, Mycobacterium tuberculosis H37Rv
cggucugaccgcguc

SEQ ID NO: 3303132 - RNA, 23 nt, Mycobacterium tuberculosis H37Rv
cggucugaugguggacagcaauu

SEQ ID NO: 3303133 - RNA, 21 nt, Mycobacterium tuberculosis H37Rv
cggucugcgccaaaauccgcc

SEQ ID NO: 3303134 - RNA, 23 nt, Mycobacterium tuberculosis H37Rv
cggucugcgccuucgccagcggc

SEQ ID NO: 3303135 - RNA, 12 nt, Mycobacterium tuberculosis H37Rv
cggucugcucca

SEQ ID NO: 3303136 - RNA, 15 nt, Mycobacterium tuberculosis H37Rv
cggucugcuccaggc

SEQ ID NO: 3303137 - RNA, 21 nt, Mycobacterium tuberculosis H37Rv
cggucuggacaucggccggcg

SEQ ID NO: 3303138 - RNA, 20 nt, Mycobacterium tuberculosis H37Rv
cggucuggcccgcgacaucg

SEQ ID NO: 3303139 - RNA, 13 nt, Mycobacterium tuberculosis H37Rv
cggucuggugguc

SEQ ID NO: 3303140 - RNA, 18 nt, Mycobacterium tuberculosis H37Rv
cggucugguggucggcga

SEQ ID NO: 3303141 - RNA, 21 nt, Mycobacterium tuberculosis H37Rv
cggucugguugggccagcucc

SEQ ID NO: 3303142 - RNA, 20 nt, Mycobacterium tuberculosis H37Rv
cggucugguugucgaucucg

SEQ ID NO: 3303143 - RNA, 14 nt, Mycobacterium tuberculosis H37Rv
cggucuugacaccg

SEQ ID NO: 3303144 - RNA, 15 nt, Mycobacterium tuberculosis H37Rv
cggucuugcaucgcc

SEQ ID NO: 3303145 - RNA, 17 nt, Mycobacterium tuberculosis H37Rv
cggucuugcaucgccga

SEQ ID NO: 3303146 - RNA, 21 nt, Mycobacterium tuberculosis H37Rv
cggucuuggcgauccaggcca

SEQ ID NO: 3303147 - RNA, 17 nt, Mycobacterium tuberculosis H37Rv
cggucuuggcgcgccca

SEQ ID NO: 3303148 - RNA, 19 nt, Mycobacterium tuberculosis H37Rv
cggucuugggcgcgggugc

SEQ ID NO: 3303149 - RNA, 18 nt, Mycobacterium tuberculosis H37Rv
cggugaaaaaggcgacuc

SEQ ID NO: 3303150 - RNA, 16 nt, Mycobacterium tuberculosis H37Rv
cggugaaaucgcacag

SEQ ID NO: 3303151 - RNA, 18 nt, Mycobacterium tuberculosis H37Rv
cggugaaauucgcggcgg

SEQ ID NO: 3303152 - RNA, 14 nt, Mycobacterium tuberculosis H37Rv
cggugaacaccagc

SEQ ID NO: 3303153 - RNA, 18 nt, Mycobacterium tuberculosis H37Rv
cggugaacaccagcagga

SEQ ID NO: 3303154 - RNA, 20 nt, Mycobacterium tuberculosis H37Rv
cggugaacaccagcaggaag

SEQ ID NO: 3303155 - RNA, 16 nt, Mycobacterium tuberculosis H37Rv
cggugaaccaacgcga

SEQ ID NO: 3303156 - RNA, 19 nt, Mycobacterium tuberculosis H37Rv
cggugaaccaacgcgaccg

SEQ ID NO: 3303157 - RNA, 15 nt, Mycobacterium tuberculosis H37Rv
cggugaacgacgggu

SEQ ID NO: 3303158 - RNA, 17 nt, Mycobacterium tuberculosis H37Rv
cggugaacggcagcacg

SEQ ID NO: 3303159 - RNA, 19 nt, Mycobacterium tuberculosis H37Rv
cggugaacggcagcacggu

SEQ ID NO: 3303160 - RNA, 22 nt, Mycobacterium tuberculosis H37Rv
cggugaacuucuccaccagcgu

SEQ ID NO: 3303161 - RNA, 18 nt, Mycobacterium tuberculosis H37Rv
cggugaagaaguucgggu

SEQ ID NO: 3303162 - RNA, 22 nt, Mycobacterium tuberculosis H37Rv
cggugaagccguuugcgcuggc

SEQ ID NO: 3303163 - RNA, 18 nt, Mycobacterium tuberculosis H37Rv
cggugaaguagugcucgc

SEQ ID NO: 3303164 - RNA, 19 nt, Mycobacterium tuberculosis H37Rv
cggugaaguagugcucgca

SEQ ID NO: 3303165 - RNA, 14 nt, Mycobacterium tuberculosis H37Rv
cggugaauucacga

SEQ ID NO: 3303166 - RNA, 15 nt, Mycobacterium tuberculosis H37Rv
cggugaauucggcga

SEQ ID NO: 3303167 - RNA, 19 nt, Mycobacterium tuberculosis H37Rv
cggugacaaauucggcgug

SEQ ID NO: 3303168 - RNA, 18 nt, Mycobacterium tuberculosis H37Rv
cggugacaaggauggucg

SEQ ID NO: 3303169 - RNA, 19 nt, Mycobacterium tuberculosis H37Rv
cggugaccaccccggccaa

SEQ ID NO: 3303170 - RNA, 18 nt, Mycobacterium tuberculosis H37Rv
cggugaccacuugcagca

SEQ ID NO: 3303171 - RNA, 23 nt, Mycobacterium tuberculosis H37Rv
cggugaccagcaaccaccccagg

SEQ ID NO: 3303172 - RNA, 14 nt, Mycobacterium tuberculosis H37Rv
cggugacccccgag

SEQ ID NO: 3303173 - RNA, 15 nt, Mycobacterium tuberculosis H37Rv
cggugacccccgaga

SEQ ID NO: 3303174 - RNA, 17 nt, Mycobacterium tuberculosis H37Rv
cggugacccgcugggcc

SEQ ID NO: 3303175 - RNA, 15 nt, Mycobacterium tuberculosis H37Rv
cggugaccgcgaugu

SEQ ID NO: 3303176 - RNA, 22 nt, Mycobacterium tuberculosis H37Rv
cggugaccgugaacggcucggg

SEQ ID NO: 3303177 - RNA, 14 nt, Mycobacterium tuberculosis H37Rv
cggugaccguucgg

SEQ ID NO: 3303178 - RNA, 15 nt, Mycobacterium tuberculosis H37Rv
cggugaccucaccaa

SEQ ID NO: 3303179 - RNA, 16 nt, Mycobacterium tuberculosis H37Rv
cggugaccucggcgac

SEQ ID NO: 3303180 - RNA, 23 nt, Mycobacterium tuberculosis H37Rv
cggugaccuucgcuauggcggcu

SEQ ID NO: 3303181 - RNA, 18 nt, Mycobacterium tuberculosis H37Rv
cggugacgagcacaugcu

SEQ ID NO: 3303182 - RNA, 19 nt, Mycobacterium tuberculosis H37Rv
cggugacgaugaccgcgcg

SEQ ID NO: 3303183 - RNA, 18 nt, Mycobacterium tuberculosis H37Rv
cggugacgauugccacca

SEQ ID NO: 3303184 - RNA, 16 nt, Mycobacterium tuberculosis H37Rv
cggugacgcaacaucg

SEQ ID NO: 3303185 - RNA, 21 nt, Mycobacterium tuberculosis H37Rv
cggugacgcaacaucggauga

SEQ ID NO: 3303186 - RNA, 23 nt, Mycobacterium tuberculosis H37Rv
cggugacgccagccuggccaucg

SEQ ID NO: 3303187 - RNA, 22 nt, Mycobacterium tuberculosis H37Rv
cggugacggcggcugucggccg

SEQ ID NO: 3303188 - RNA, 21 nt, Mycobacterium tuberculosis H37Rv
cggugacggggcugaccgcca

SEQ ID NO: 3303189 - RNA, 15 nt, Mycobacterium tuberculosis H37Rv
cggugacgucgccgg

SEQ ID NO: 3303190 - RNA, 23 nt, Mycobacterium tuberculosis H37Rv
cggugacucagaacguggccguu

SEQ ID NO: 3303191 - RNA, 16 nt, Mycobacterium tuberculosis H37Rv
cggugacuccgcgcgc

SEQ ID NO: 3303192 - RNA, 17 nt, Mycobacterium tuberculosis H37Rv
cggugacuucacucguu

SEQ ID NO: 3303193 - RNA, 17 nt, Mycobacterium tuberculosis H37Rv
cggugagaagaagccca

SEQ ID NO: 3303194 - RNA, 15 nt, Mycobacterium tuberculosis H37Rv
cggugagaucggguu

SEQ ID NO: 3303195 - RNA, 21 nt, Mycobacterium tuberculosis H37Rv
cggugagcccguugaccugcg

SEQ ID NO: 3303196 - RNA, 22 nt, Mycobacterium tuberculosis H37Rv
cggugagccgccaggaccggga

SEQ ID NO: 3303197 - RNA, 13 nt, Mycobacterium tuberculosis H37Rv
cggugagcgggca

SEQ ID NO: 3303198 - RNA, 19 nt, Mycobacterium tuberculosis H37Rv
cggugagcugcacgccgau

SEQ ID NO: 3303199 - RNA, 15 nt, Mycobacterium tuberculosis H37Rv
cggugaggaagcggc

SEQ ID NO: 3303200 - RNA, 14 nt, Mycobacterium tuberculosis H37Rv
cggugaggugacca

SEQ ID NO: 3303201 - RNA, 15 nt, Mycobacterium tuberculosis H37Rv
cggugaucagcagca

SEQ ID NO: 3303202 - RNA, 18 nt, Mycobacterium tuberculosis H37Rv
cggugcgcgcggcgacca

SEQ ID NO: 3303203 - RNA, 13 nt, Mycobacterium tuberculosis H37Rv
cggugcgcgcuga

SEQ ID NO: 3303204 - RNA, 14 nt, Mycobacterium tuberculosis H37Rv
cggugcgcggcaau

SEQ ID NO: 3303205 - RNA, 19 nt, Mycobacterium tuberculosis H37Rv
cggugcgcgguugcugguc

SEQ ID NO: 3303206 - RNA, 15 nt, Mycobacterium tuberculosis H37Rv
cggugcgcgugacga

SEQ ID NO: 3303207 - RNA, 15 nt, Mycobacterium tuberculosis H37Rv
cggugcgcuggaugu

SEQ ID NO: 3303208 - RNA, 20 nt, Mycobacterium tuberculosis H37Rv
cggugcgcuggcggcgcagc

SEQ ID NO: 3303209 - RNA, 20 nt, Mycobacterium tuberculosis H37Rv
cggugcggaacaccgcccgg

SEQ ID NO: 3303210 - RNA, 19 nt, Mycobacterium tuberculosis H37Rv
cggugcggcaacagcgcca

SEQ ID NO: 3303211 - RNA, 19 nt, Mycobacterium tuberculosis H37Rv
cggugcgguuucaccgacg

SEQ ID NO: 3303212 - RNA, 15 nt, Mycobacterium tuberculosis H37Rv
cggugcgucacagcc

SEQ ID NO: 3303213 - RNA, 17 nt, Mycobacterium tuberculosis H37Rv
cggugcuaaccgacgcu

SEQ ID NO: 3303214 - RNA, 16 nt, Mycobacterium tuberculosis H37Rv
cggugcucgucgagca

SEQ ID NO: 3303215 - RNA, 20 nt, Mycobacterium tuberculosis H37Rv
cggugcugaccccgccggcu

SEQ ID NO: 3303216 - RNA, 13 nt, Mycobacterium tuberculosis H37Rv
cggugcugacgac

SEQ ID NO: 3303217 - RNA, 17 nt, Mycobacterium tuberculosis H37Rv
cggugcugcuucaacgc

SEQ ID NO: 3303218 - RNA, 15 nt, Mycobacterium tuberculosis H37Rv
cggugcugguccagg

SEQ ID NO: 3303219 - RNA, 21 nt, Mycobacterium tuberculosis H37Rv
cggugcugucgacgucggcaa

SEQ ID NO: 3303220 - RNA, 21 nt, Mycobacterium tuberculosis H37Rv
cggugcuguugcgcggucgcg

SEQ ID NO: 3303221 - RNA, 20 nt, Mycobacterium tuberculosis H37Rv
cggugcuguugucgaacaac

SEQ ID NO: 3303222 - RNA, 15 nt, Mycobacterium tuberculosis H37Rv
cgguggaaaaagccc

SEQ ID NO: 3303223 - RNA, 16 nt, Mycobacterium tuberculosis H37Rv
cgguggaaacccugca

SEQ ID NO: 3303224 - RNA, 19 nt, Mycobacterium tuberculosis H37Rv
cgguggaagaguuggggca

SEQ ID NO: 3303225 - RNA, 19 nt, Mycobacterium tuberculosis H37Rv
cgguggaauccaccagccg

SEQ ID NO: 3303226 - RNA, 15 nt, Mycobacterium tuberculosis H37Rv
cgguggacccggcgg

SEQ ID NO: 3303227 - RNA, 22 nt, Mycobacterium tuberculosis H37Rv
cgguggacgagccagaggugga

SEQ ID NO: 3303228 - RNA, 17 nt, Mycobacterium tuberculosis H37Rv
cgguggacgauacgcgc

SEQ ID NO: 3303229 - RNA, 19 nt, Mycobacterium tuberculosis H37Rv
cgguggacgcagagucaac

SEQ ID NO: 3303230 - RNA, 20 nt, Mycobacterium tuberculosis H37Rv
cgguggacgcagagucaaca

SEQ ID NO: 3303231 - RNA, 15 nt, Mycobacterium tuberculosis H37Rv
cgguggagcgcgccu

SEQ ID NO: 3303232 - RNA, 16 nt, Mycobacterium tuberculosis H37Rv
cgguggagggcgagca

SEQ ID NO: 3303233 - RNA, 18 nt, Mycobacterium tuberculosis H37Rv
cgguggcacccgcgucga

SEQ ID NO: 3303234 - RNA, 17 nt, Mycobacterium tuberculosis H37Rv
cgguggcagagccgccg

SEQ ID NO: 3303235 - RNA, 18 nt, Mycobacterium tuberculosis H37Rv
cgguggcagagccgccgu

SEQ ID NO: 3303236 - RNA, 20 nt, Mycobacterium tuberculosis H37Rv
cgguggcagagccgccguug

SEQ ID NO: 3303237 - RNA, 19 nt, Mycobacterium tuberculosis H37Rv
cgguggcagcacagcgucg

SEQ ID NO: 3303238 - RNA, 14 nt, Mycobacterium tuberculosis H37Rv
cgguggcagccugc

SEQ ID NO: 3303239 - RNA, 21 nt, Mycobacterium tuberculosis H37Rv
cgguggcauccuugccaaucg

SEQ ID NO: 3303240 - RNA, 16 nt, Mycobacterium tuberculosis H37Rv
cgguggccaacaccgc

SEQ ID NO: 3303241 - RNA, 17 nt, Mycobacterium tuberculosis H37Rv
cgguggccaacaccgcc

SEQ ID NO: 3303242 - RNA, 14 nt, Mycobacterium tuberculosis H37Rv
cgguggccacccgg

SEQ ID NO: 3303243 - RNA, 16 nt, Mycobacterium tuberculosis H37Rv
cgguggccacccggcc

SEQ ID NO: 3303244 - RNA, 18 nt, Mycobacterium tuberculosis H37Rv
cgguggccacccggccgc

SEQ ID NO: 3303245 - RNA, 15 nt, Mycobacterium tuberculosis H37Rv
cgguggccagcgucg

SEQ ID NO: 3303246 - RNA, 16 nt, Mycobacterium tuberculosis H37Rv
cgguggccaucgcgcg

SEQ ID NO: 3303247 - RNA, 20 nt, Mycobacterium tuberculosis H37Rv
cgguggccaucgcgcggacc

SEQ ID NO: 3303248 - RNA, 21 nt, Mycobacterium tuberculosis H37Rv
cgguggccaucgcgcggacca

SEQ ID NO: 3303249 - RNA, 23 nt, Mycobacterium tuberculosis H37Rv
cgguggccaucgcgcggaccaga

SEQ ID NO: 3303250 - RNA, 17 nt, Mycobacterium tuberculosis H37Rv
cgguggccccgauggcg

SEQ ID NO: 3303251 - RNA, 20 nt, Mycobacterium tuberculosis H37Rv
cgguggcccgccggcaguga

SEQ ID NO: 3303252 - RNA, 20 nt, Mycobacterium tuberculosis H37Rv
cgguggccgcacgauagccg

SEQ ID NO: 3303253 - RNA, 15 nt, Mycobacterium tuberculosis H37Rv
cgguggccgcaucga

SEQ ID NO: 3303254 - RNA, 21 nt, Mycobacterium tuberculosis H37Rv
cgguggccgcaucgacgcuca

SEQ ID NO: 3303255 - RNA, 15 nt, Mycobacterium tuberculosis H37Rv
cgguggccgcggcgg

SEQ ID NO: 3303256 - RNA, 21 nt, Mycobacterium tuberculosis H37Rv
cgguggccgucgggugcagca

SEQ ID NO: 3303257 - RNA, 22 nt, Mycobacterium tuberculosis H37Rv
cgguggcgagguggucacgcag

SEQ ID NO: 3303258 - RNA, 21 nt, Mycobacterium tuberculosis H37Rv
cgguggcgccgaacgccagca

SEQ ID NO: 3303259 - RNA, 15 nt, Mycobacterium tuberculosis H37Rv
cgguggcgccgucgg

SEQ ID NO: 3303260 - RNA, 16 nt, Mycobacterium tuberculosis H37Rv
cgguggcgcggugccg

SEQ ID NO: 3303261 - RNA, 13 nt, Mycobacterium tuberculosis H37Rv
cgguggcgcugau

SEQ ID NO: 3303262 - RNA, 17 nt, Mycobacterium tuberculosis H37Rv
cgguggcggcagcagcg

SEQ ID NO: 3303263 - RNA, 17 nt, Mycobacterium tuberculosis H37Rv
cgguggcggcgagcagc

SEQ ID NO: 3303264 - RNA, 18 nt, Mycobacterium tuberculosis H37Rv
cgguggcggcgagcagca

SEQ ID NO: 3303265 - RNA, 21 nt, Mycobacterium tuberculosis H37Rv
cgguggcggcggugccacgau

SEQ ID NO: 3303266 - RNA, 17 nt, Mycobacterium tuberculosis H37Rv
cgguggcggugucggcg

SEQ ID NO: 3303267 - RNA, 19 nt, Mycobacterium tuberculosis H37Rv
cgguggcguauucggugca

SEQ ID NO: 3303268 - RNA, 19 nt, Mycobacterium tuberculosis H37Rv
cgguggcgucaugcccagg

SEQ ID NO: 3303269 - RNA, 23 nt, Mycobacterium tuberculosis H37Rv
cgguggcgucgucggcgggcugc

SEQ ID NO: 3303270 - RNA, 23 nt, Mycobacterium tuberculosis H37Rv
cgguggcgugguggaaacugaug

SEQ ID NO: 3303271 - RNA, 18 nt, Mycobacterium tuberculosis H37Rv
cgguggcuucgacggcgg

SEQ ID NO: 3303272 - RNA, 17 nt, Mycobacterium tuberculosis H37Rv
cgguggcuugccccgcc

SEQ ID NO: 3303273 - RNA, 20 nt, Mycobacterium tuberculosis H37Rv
cgguggcuuuugcgucugcu

SEQ ID NO: 3303274 - RNA, 17 nt, Mycobacterium tuberculosis H37Rv
cggugggcacagccagu

SEQ ID NO: 3303275 - RNA, 19 nt, Mycobacterium tuberculosis H37Rv
cggugggcggcgagcgcga

SEQ ID NO: 3303276 - RNA, 21 nt, Mycobacterium tuberculosis H37Rv
cggugggcgggugcgcgaggu

SEQ ID NO: 3303277 - RNA, 15 nt, Mycobacterium tuberculosis H37Rv
cggugggcgguccgc

SEQ ID NO: 3303278 - RNA, 22 nt, Mycobacterium tuberculosis H37Rv
cggugggcuuggcgccgaugcc

SEQ ID NO: 3303279 - RNA, 18 nt, Mycobacterium tuberculosis H37Rv
cgguggggccggcgucga

SEQ ID NO: 3303280 - RNA, 18 nt, Mycobacterium tuberculosis H37Rv
cgguggggucgccgucga

SEQ ID NO: 3303281 - RNA, 15 nt, Mycobacterium tuberculosis H37Rv
cgguggguagccagc

SEQ ID NO: 3303282 - RNA, 13 nt, Mycobacterium tuberculosis H37Rv
cggugggugacgu

SEQ ID NO: 3303283 - RNA, 15 nt, Mycobacterium tuberculosis H37Rv
cggugggugcgacac

SEQ ID NO: 3303284 - RNA, 19 nt, Mycobacterium tuberculosis H37Rv
cggugguaacaccggcgag

SEQ ID NO: 3303285 - RNA, 17 nt, Mycobacterium tuberculosis H37Rv
cggugguaagacgccga

SEQ ID NO: 3303286 - RNA, 19 nt, Mycobacterium tuberculosis H37Rv
cggugguaagacgccgaac

SEQ ID NO: 3303287 - RNA, 16 nt, Mycobacterium tuberculosis H37Rv
cggugguaccggcggc

SEQ ID NO: 3303288 - RNA, 19 nt, Mycobacterium tuberculosis H37Rv
cggugguacgugcgagccc

SEQ ID NO: 3303289 - RNA, 16 nt, Mycobacterium tuberculosis H37Rv
cggugguagcgacgau

SEQ ID NO: 3303290 - RNA, 17 nt, Mycobacterium tuberculosis H37Rv
cggugguagcgacgaug

SEQ ID NO: 3303291 - RNA, 18 nt, Mycobacterium tuberculosis H37Rv
cggugguagcgacgaugu

SEQ ID NO: 3303292 - RNA, 22 nt, Mycobacterium tuberculosis H37Rv
cggugguagcggacagcucgcg

SEQ ID NO: 3303293 - RNA, 15 nt, Mycobacterium tuberculosis H37Rv
cgguggucacgccgu

SEQ ID NO: 3303294 - RNA, 14 nt, Mycobacterium tuberculosis H37Rv
cggugguccacacg

SEQ ID NO: 3303295 - RNA, 22 nt, Mycobacterium tuberculosis H37Rv
cggugguccacacgcugcccgc

SEQ ID NO: 3303296 - RNA, 19 nt, Mycobacterium tuberculosis H37Rv
cgguggucccccgcagcca

SEQ ID NO: 3303297 - RNA, 15 nt, Mycobacterium tuberculosis H37Rv
cgguggucccgaugg

SEQ ID NO: 3303298 - RNA, 15 nt, Mycobacterium tuberculosis H37Rv
cgguugccacgccgc

SEQ ID NO: 3303299 - RNA, 19 nt, Mycobacterium tuberculosis H37Rv
cgguugccacgccgccggu

SEQ ID NO: 3303300 - RNA, 15 nt, Mycobacterium tuberculosis H37Rv
cgguugccauccguc

SEQ ID NO: 3303301 - RNA, 15 nt, Mycobacterium tuberculosis H37Rv
cgguugcccccaggg

SEQ ID NO: 3303302 - RNA, 14 nt, Mycobacterium tuberculosis H37Rv
cgguugccccgacc

SEQ ID NO: 3303303 - RNA, 15 nt, Mycobacterium tuberculosis H37Rv
cgguugccccgaccg

SEQ ID NO: 3303304 - RNA, 16 nt, Mycobacterium tuberculosis H37Rv
cgguugccuucuuggc

SEQ ID NO: 3303305 - RNA, 17 nt, Mycobacterium tuberculosis H37Rv
cgguugcggcugcguug

SEQ ID NO: 3303306 - RNA, 22 nt, Mycobacterium tuberculosis H37Rv
cgguugcggucaucggcgccaa

SEQ ID NO: 3303307 - RNA, 15 nt, Mycobacterium tuberculosis H37Rv
cgguugcugcgcgaa

SEQ ID NO: 3303308 - RNA, 18 nt, Mycobacterium tuberculosis H37Rv
cgguugcugugucguggu

SEQ ID NO: 3303309 - RNA, 23 nt, Mycobacterium tuberculosis H37Rv
cgguuggaccacgugaucgacga

SEQ ID NO: 3303310 - RNA, 18 nt, Mycobacterium tuberculosis H37Rv
cgguuggacugacgucga

SEQ ID NO: 3303311 - RNA, 13 nt, Mycobacterium tuberculosis H37Rv
cgguuggaucggc

SEQ ID NO: 3303312 - RNA, 13 nt, Mycobacterium tuberculosis H37Rv
cgguuggcagugg

SEQ ID NO: 3303313 - RNA, 15 nt, Mycobacterium tuberculosis H37Rv
cgguuggccagccac

SEQ ID NO: 3303314 - RNA, 22 nt, Mycobacterium tuberculosis H37Rv
cgguuggccagccacagccgac

SEQ ID NO: 3303315 - RNA, 23 nt, Mycobacterium tuberculosis H37Rv
cgguuggccagccacagccgacc

SEQ ID NO: 3303316 - RNA, 18 nt, Mycobacterium tuberculosis H37Rv
cgguuggccagugacuca

SEQ ID NO: 3303317 - RNA, 16 nt, Mycobacterium tuberculosis H37Rv
cgguuggcggcgaugg

SEQ ID NO: 3303318 - RNA, 19 nt, Mycobacterium tuberculosis H37Rv
cgguuggcucgggccagau

SEQ ID NO: 3303319 - RNA, 17 nt, Mycobacterium tuberculosis H37Rv
cgguuggcugccggcaa

SEQ ID NO: 3303320 - RNA, 18 nt, Mycobacterium tuberculosis H37Rv
cgguugggguggcggugc

SEQ ID NO: 3303321 - RNA, 15 nt, Mycobacterium tuberculosis H37Rv
cgguuggguagcacc

SEQ ID NO: 3303322 - RNA, 18 nt, Mycobacterium tuberculosis H37Rv
cgguuggguagcaccgau

SEQ ID NO: 3303323 - RNA, 18 nt, Mycobacterium tuberculosis H37Rv
cgguuggugcagcgugca

SEQ ID NO: 3303324 - RNA, 17 nt, Mycobacterium tuberculosis H37Rv
cgguugucgcagcgcac

SEQ ID NO: 3303325 - RNA, 17 nt, Mycobacterium tuberculosis H37Rv
cgguugugcgcgcgccc

SEQ ID NO: 3303326 - RNA, 18 nt, Mycobacterium tuberculosis H37Rv
cgguuguggaaccacggc

SEQ ID NO: 3303327 - RNA, 13 nt, Mycobacterium tuberculosis H37Rv
cgguuguggcuga

SEQ ID NO: 3303328 - RNA, 23 nt, Mycobacterium tuberculosis H37Rv
cgguuguggcugaucccggccag

SEQ ID NO: 3303329 - RNA, 21 nt, Mycobacterium tuberculosis H37Rv
cgguuguggucagcugcugcc

SEQ ID NO: 3303330 - RNA, 22 nt, Mycobacterium tuberculosis H37Rv
cgguuguguugggagccaccgg

SEQ ID NO: 3303331 - RNA, 22 nt, Mycobacterium tuberculosis H37Rv
cgguuguuguagaucugcgcca

SEQ ID NO: 3303332 - RNA, 13 nt, Mycobacterium tuberculosis H37Rv
cgguuuagccgcu

SEQ ID NO: 3303333 - RNA, 20 nt, Mycobacterium tuberculosis H37Rv
cgguuuccuccggcagcagc

SEQ ID NO: 3303334 - RNA, 15 nt, Mycobacterium tuberculosis H37Rv
cgguuucgaccugcg

SEQ ID NO: 3303335 - RNA, 17 nt, Mycobacterium tuberculosis H37Rv
cgguuucugguguuuca

SEQ ID NO: 3303336 - RNA, 16 nt, Mycobacterium tuberculosis H37Rv
cgguuucuucggccag

SEQ ID NO: 3303337 - RNA, 13 nt, Mycobacterium tuberculosis H37Rv
cgguuugcagcgg

SEQ ID NO: 3303338 - RNA, 12 nt, Mycobacterium tuberculosis H37Rv
cgguuugccggu

SEQ ID NO: 3303339 - RNA, 19 nt, Mycobacterium tuberculosis H37Rv
cgguuugcguccugguggc

SEQ ID NO: 3303340 - RNA, 21 nt, Mycobacterium tuberculosis H37Rv
cgguuuggccgaacagcaggc

SEQ ID NO: 3303341 - RNA, 16 nt, Mycobacterium tuberculosis H37Rv
cgguuuucggcugccg

SEQ ID NO: 3303342 - RNA, 22 nt, Mycobacterium tuberculosis H37Rv
cgguuuuggucgcgaugacgau

SEQ ID NO: 3303343 - RNA, 17 nt, Mycobacterium tuberculosis H37Rv
cguaaaagccgaugacg

SEQ ID NO: 3303344 - RNA, 13 nt, Mycobacterium tuberculosis H37Rv
cguaaacagcgcg

SEQ ID NO: 3303345 - RNA, 23 nt, Mycobacterium tuberculosis H37Rv
cguaaaccgauaucgcugcggaa

SEQ ID NO: 3303346 - RNA, 12 nt, Mycobacterium tuberculosis H37Rv
cguaaacgucgg

SEQ ID NO: 3303347 - RNA, 15 nt, Mycobacterium tuberculosis H37Rv
cguaaagccaacugg

SEQ ID NO: 3303348 - RNA, 23 nt, Mycobacterium tuberculosis H37Rv
cguaaauagcgcccugccauggg

SEQ ID NO: 3303349 - RNA, 14 nt, Mycobacterium tuberculosis H37Rv
cguaaccacgacga

SEQ ID NO: 3303350 - RNA, 20 nt, Mycobacterium tuberculosis H37Rv
cguaaccggcagcgguaagc

SEQ ID NO: 3303351 - RNA, 16 nt, Mycobacterium tuberculosis H37Rv
cguaacgccgcgguga

SEQ ID NO: 3303352 - RNA, 13 nt, Mycobacterium tuberculosis H37Rv
cguaacgccgcuc

SEQ ID NO: 3303353 - RNA, 16 nt, Mycobacterium tuberculosis H37Rv
cguaacggucggugaa

SEQ ID NO: 3303354 - RNA, 23 nt, Mycobacterium tuberculosis H37Rv
cguaagaccugaguugguucgaa

SEQ ID NO: 3303355 - RNA, 13 nt, Mycobacterium tuberculosis H37Rv
cguaagcaccagc

SEQ ID NO: 3303356 - RNA, 15 nt, Mycobacterium tuberculosis H37Rv
cguaaucaagcagcg

SEQ ID NO: 3303357 - RNA, 21 nt, Mycobacterium tuberculosis H37Rv
cguaaucaauaaucacaucgg

SEQ ID NO: 3303358 - RNA, 19 nt, Mycobacterium tuberculosis H37Rv
cguaaugcugcugcagcaa

SEQ ID NO: 3303359 - RNA, 14 nt, Mycobacterium tuberculosis H37Rv
cguaauuccccagg

SEQ ID NO: 3303360 - RNA, 18 nt, Mycobacterium tuberculosis H37Rv
cguaauuccccaggugug

SEQ ID NO: 3303361 - RNA, 21 nt, Mycobacterium tuberculosis H37Rv
cguacaacagcgcgcgcucgg

SEQ ID NO: 3303362 - RNA, 17 nt, Mycobacterium tuberculosis H37Rv
cguacaaccacccaccc

SEQ ID NO: 3303363 - RNA, 15 nt, Mycobacterium tuberculosis H37Rv
cguacacgccauggu

SEQ ID NO: 3303364 - RNA, 12 nt, Mycobacterium tuberculosis H37Rv
cguacagcgccu

SEQ ID NO: 3303365 - RNA, 21 nt, Mycobacterium tuberculosis H37Rv
cguacaggacgguugagaugg

SEQ ID NO: 3303366 - RNA, 15 nt, Mycobacterium tuberculosis H37Rv
cguacaucagcgcga

SEQ ID NO: 3303367 - RNA, 19 nt, Mycobacterium tuberculosis H37Rv
cguaccagcuggccacuuu

SEQ ID NO: 3303368 - RNA, 17 nt, Mycobacterium tuberculosis H37Rv
cguacccacgacgggcc

SEQ ID NO: 3303369 - RNA, 14 nt, Mycobacterium tuberculosis H37Rv
cguacccgaucagc

SEQ ID NO: 3303370 - RNA, 14 nt, Mycobacterium tuberculosis H37Rv
cguacccggcaacg

SEQ ID NO: 3303371 - RNA, 13 nt, Mycobacterium tuberculosis H37Rv
cguaccgauucca

SEQ ID NO: 3303372 - RNA, 15 nt, Mycobacterium tuberculosis H37Rv
cguaccgcgcguugu

SEQ ID NO: 3303373 - RNA, 13 nt, Mycobacterium tuberculosis H37Rv
cguaccgggcgag

SEQ ID NO: 3303374 - RNA, 21 nt, Mycobacterium tuberculosis H37Rv
cguaccgguggaaacccugca

SEQ ID NO: 3303375 - RNA, 15 nt, Mycobacterium tuberculosis H37Rv
cguaccguucgggcc

SEQ ID NO: 3303376 - RNA, 21 nt, Mycobacterium tuberculosis H37Rv
cguaccguucgggccguccuc

SEQ ID NO: 3303377 - RNA, 17 nt, Mycobacterium tuberculosis H37Rv
cguaccuaaggcucacc

SEQ ID NO: 3303378 - RNA, 20 nt, Mycobacterium tuberculosis H37Rv
cguaccuaaggcucaccagg

SEQ ID NO: 3303379 - RNA, 20 nt, Mycobacterium tuberculosis H37Rv
cguacgcauggcggaauuca

SEQ ID NO: 3303380 - RNA, 14 nt, Mycobacterium tuberculosis H37Rv
cguacgccggcggu

SEQ ID NO: 3303381 - RNA, 11 nt, Mycobacterium tuberculosis H37Rv
cguacgccgua

SEQ ID NO: 3303382 - RNA, 18 nt, Mycobacterium tuberculosis H37Rv
cguacggggucgccggca

SEQ ID NO: 3303383 - RNA, 16 nt, Mycobacterium tuberculosis H37Rv
cguacuccaccgcgcc

SEQ ID NO: 3303384 - RNA, 18 nt, Mycobacterium tuberculosis H37Rv
cguacucggcauccaggc

SEQ ID NO: 3303385 - RNA, 12 nt, Mycobacterium tuberculosis H37Rv
cguacucggcgc

SEQ ID NO: 3303386 - RNA, 22 nt, Mycobacterium tuberculosis H37Rv
cguacucggugaucgcgguggc

SEQ ID NO: 3303387 - RNA, 15 nt, Mycobacterium tuberculosis H37Rv
cguacucgugcaccg

SEQ ID NO: 3303388 - RNA, 15 nt, Mycobacterium tuberculosis H37Rv
cguacugguagcacu

SEQ ID NO: 3303389 - RNA, 21 nt, Mycobacterium tuberculosis H37Rv
cguacugucgucgcccugaca

SEQ ID NO: 3303390 - RNA, 20 nt, Mycobacterium tuberculosis H37Rv
cguacugugaguagcccgcg

SEQ ID NO: 3303391 - RNA, 19 nt, Mycobacterium tuberculosis H37Rv
cguacuucgacagcggcga

SEQ ID NO: 3303392 - RNA, 19 nt, Mycobacterium tuberculosis H37Rv
cguacuucgcuggaaaccu

SEQ ID NO: 3303393 - RNA, 18 nt, Mycobacterium tuberculosis H37Rv
cguagaaggaccgcucgu

SEQ ID NO: 3303394 - RNA, 15 nt, Mycobacterium tuberculosis H37Rv
cgucaaucaccaccg

SEQ ID NO: 3303395 - RNA, 18 nt, Mycobacterium tuberculosis H37Rv
cgucaaucaccaccgcca

SEQ ID NO: 3303396 - RNA, 16 nt, Mycobacterium tuberculosis H37Rv
cgucacaagcugacac

SEQ ID NO: 3303397 - RNA, 17 nt, Mycobacterium tuberculosis H37Rv
cgucacaaugcccaggc

SEQ ID NO: 3303398 - RNA, 12 nt, Mycobacterium tuberculosis H37Rv
cgucacaccgau

SEQ ID NO: 3303399 - RNA, 14 nt, Mycobacterium tuberculosis H37Rv
cgucacaccgaugc

SEQ ID NO: 3303400 - RNA, 15 nt, Mycobacterium tuberculosis H37Rv
cgucacaccgaugcg

SEQ ID NO: 3303401 - RNA, 19 nt, Mycobacterium tuberculosis H37Rv
cgucacaccgaugcguucg

SEQ ID NO: 3303402 - RNA, 21 nt, Mycobacterium tuberculosis H37Rv
cgucacaccgaugcguucggg

SEQ ID NO: 3303403 - RNA, 16 nt, Mycobacterium tuberculosis H37Rv
cgucacaguucugccu

SEQ ID NO: 3303404 - RNA, 18 nt, Mycobacterium tuberculosis H37Rv
cgucaccaaacccgaugg

SEQ ID NO: 3303405 - RNA, 17 nt, Mycobacterium tuberculosis H37Rv
cgucaccaccgccgcca

SEQ ID NO: 3303406 - RNA, 14 nt, Mycobacterium tuberculosis H37Rv
cgucaccacgaucg

SEQ ID NO: 3303407 - RNA, 15 nt, Mycobacterium tuberculosis H37Rv
cgucaccacgaucgc

SEQ ID NO: 3303408 - RNA, 16 nt, Mycobacterium tuberculosis H37Rv
cgucaccacgaucgca

SEQ ID NO: 3303409 - RNA, 12 nt, Mycobacterium tuberculosis H37Rv
cgucacccccga

SEQ ID NO: 3303410 - RNA, 20 nt, Mycobacterium tuberculosis H37Rv
cgucaccccggucccgccga

SEQ ID NO: 3303411 - RNA, 14 nt, Mycobacterium tuberculosis H37Rv
cgucacccgguguc

SEQ ID NO: 3303412 - RNA, 18 nt, Mycobacterium tuberculosis H37Rv
cgucacccugucgcgcac

SEQ ID NO: 3303413 - RNA, 17 nt, Mycobacterium tuberculosis H37Rv
cgucaccgaugcgccgg

SEQ ID NO: 3303414 - RNA, 18 nt, Mycobacterium tuberculosis H37Rv
cgucaccgaugcgccgga

SEQ ID NO: 3303415 - RNA, 17 nt, Mycobacterium tuberculosis H37Rv
cgucaccgccauugcca

SEQ ID NO: 3303416 - RNA, 12 nt, Mycobacterium tuberculosis H37Rv
cgucaccgccga

SEQ ID NO: 3303417 - RNA, 20 nt, Mycobacterium tuberculosis H37Rv
cgucaccgccggcaccgcca

SEQ ID NO: 3303418 - RNA, 13 nt, Mycobacterium tuberculosis H37Rv
cgucaccgcgacc

SEQ ID NO: 3303419 - RNA, 20 nt, Mycobacterium tuberculosis H37Rv
cgucaccgcgaccagccagc

SEQ ID NO: 3303420 - RNA, 15 nt, Mycobacterium tuberculosis H37Rv
cgucaccgcgcggcu

SEQ ID NO: 3303421 - RNA, 20 nt, Mycobacterium tuberculosis H37Rv
cgucaccggaauccccccug

SEQ ID NO: 3303422 - RNA, 23 nt, Mycobacterium tuberculosis H37Rv
cgucaccggaggccgccgcgccg

SEQ ID NO: 3303423 - RNA, 23 nt, Mycobacterium tuberculosis H37Rv
cgucaccggguccggugaacccg

SEQ ID NO: 3303424 - RNA, 23 nt, Mycobacterium tuberculosis H37Rv
cgucaccggucagcgacgcacgc

SEQ ID NO: 3303425 - RNA, 13 nt, Mycobacterium tuberculosis H37Rv
cgucaccguuggc

SEQ ID NO: 3303426 - RNA, 19 nt, Mycobacterium tuberculosis H37Rv
cgucaccguuggccgcgcu

SEQ ID NO: 3303427 - RNA, 17 nt, Mycobacterium tuberculosis H37Rv
cgucaccucaccgaacg

SEQ ID NO: 3303428 - RNA, 12 nt, Mycobacterium tuberculosis H37Rv
cgucacgcaacc

SEQ ID NO: 3303429 - RNA, 21 nt, Mycobacterium tuberculosis H37Rv
cgucacgcggguugcgcggcu

SEQ ID NO: 3303430 - RNA, 20 nt, Mycobacterium tuberculosis H37Rv
cgucacggacccuuccgccg

SEQ ID NO: 3303431 - RNA, 21 nt, Mycobacterium tuberculosis H37Rv
cgucacggaccgccaccuugg

SEQ ID NO: 3303432 - RNA, 18 nt, Mycobacterium tuberculosis H37Rv
cgucacggaccuggaacu

SEQ ID NO: 3303433 - RNA, 14 nt, Mycobacterium tuberculosis H37Rv
cgucacgggcguug

SEQ ID NO: 3303434 - RNA, 19 nt, Mycobacterium tuberculosis H37Rv
cgucacgggguccgaugcg

SEQ ID NO: 3303435 - RNA, 23 nt, Mycobacterium tuberculosis H37Rv
cgucacgucguuuggccucagcc

SEQ ID NO: 3303436 - RNA, 18 nt, Mycobacterium tuberculosis H37Rv
cgucacguggucggccac

SEQ ID NO: 3303437 - RNA, 21 nt, Mycobacterium tuberculosis H37Rv
cgucacguggucggccacccc

SEQ ID NO: 3303438 - RNA, 17 nt, Mycobacterium tuberculosis H37Rv
cgucacgugucccgcau

SEQ ID NO: 3303439 - RNA, 21 nt, Mycobacterium tuberculosis H37Rv
cgucagaccgcgaacagcggg

SEQ ID NO: 3303440 - RNA, 22 nt, Mycobacterium tuberculosis H37Rv
cgucagcaccccgccgccugcu

SEQ ID NO: 3303441 - RNA, 14 nt, Mycobacterium tuberculosis H37Rv
cgucagcaccgcua

SEQ ID NO: 3303442 - RNA, 17 nt, Mycobacterium tuberculosis H37Rv
cgucagcagcaacggau

SEQ ID NO: 3303443 - RNA, 21 nt, Mycobacterium tuberculosis H37Rv
cgucagccccgacugcgccca

SEQ ID NO: 3303444 - RNA, 19 nt, Mycobacterium tuberculosis H37Rv
cgucagcccgauacgggug

SEQ ID NO: 3303445 - RNA, 23 nt, Mycobacterium tuberculosis H37Rv
cgucagcgccgccggaagcgccg

SEQ ID NO: 3303446 - RNA, 18 nt, Mycobacterium tuberculosis H37Rv
cgucagcgccgcgcgcgc

SEQ ID NO: 3303447 - RNA, 14 nt, Mycobacterium tuberculosis H37Rv
cgucagcgccgcug

SEQ ID NO: 3303448 - RNA, 18 nt, Mycobacterium tuberculosis H37Rv
cgucagcggcgagcagag

SEQ ID NO: 3303449 - RNA, 13 nt, Mycobacterium tuberculosis H37Rv
cgucagcggcggc

SEQ ID NO: 3303450 - RNA, 19 nt, Mycobacterium tuberculosis H37Rv
cgucagcggcggccacggc

SEQ ID NO: 3303451 - RNA, 17 nt, Mycobacterium tuberculosis H37Rv
cgucagcgggcagcagg

SEQ ID NO: 3303452 - RNA, 23 nt, Mycobacterium tuberculosis H37Rv
cgucagcuuggacccugcgccgc

SEQ ID NO: 3303453 - RNA, 23 nt, Mycobacterium tuberculosis H37Rv
cgucaggaugaucugcgcggccc

SEQ ID NO: 3303454 - RNA, 17 nt, Mycobacterium tuberculosis H37Rv
cgucaggccagagucgc

SEQ ID NO: 3303455 - RNA, 21 nt, Mycobacterium tuberculosis H37Rv
cgucaggccuccaaaaucgcg

SEQ ID NO: 3303456 - RNA, 16 nt, Mycobacterium tuberculosis H37Rv
cgucaggugcgcgacc

SEQ ID NO: 3303457 - RNA, 19 nt, Mycobacterium tuberculosis H37Rv
cgucaggugcgcgaccagg

SEQ ID NO: 3303458 - RNA, 17 nt, Mycobacterium tuberculosis H37Rv
cgucagguggccaaugc

SEQ ID NO: 3303459 - RNA, 19 nt, Mycobacterium tuberculosis H37Rv
cgucagguggccaaugccu

SEQ ID NO: 3303460 - RNA, 20 nt, Mycobacterium tuberculosis H37Rv
cgucagguucuaccaaaucg

SEQ ID NO: 3303461 - RNA, 23 nt, Mycobacterium tuberculosis H37Rv
cgucagguucuaccaaaucgaca

SEQ ID NO: 3303462 - RNA, 15 nt, Mycobacterium tuberculosis H37Rv
cgucaguagccacgc

SEQ ID NO: 3303463 - RNA, 21 nt, Mycobacterium tuberculosis H37Rv
cgucagucaacucaccgucgg

SEQ ID NO: 3303464 - RNA, 15 nt, Mycobacterium tuberculosis H37Rv
cgucaguccucaucg

SEQ ID NO: 3303465 - RNA, 17 nt, Mycobacterium tuberculosis H37Rv
cgucagugccccgcagc

SEQ ID NO: 3303466 - RNA, 22 nt, Mycobacterium tuberculosis H37Rv
cgucaguucggugugcggcgca

SEQ ID NO: 3303467 - RNA, 18 nt, Mycobacterium tuberculosis H37Rv
cgucauacucgacaccga

SEQ ID NO: 3303468 - RNA, 15 nt, Mycobacterium tuberculosis H37Rv
cgucauccaccgcaa

SEQ ID NO: 3303469 - RNA, 14 nt, Mycobacterium tuberculosis H37Rv
cgucauccauccgg

SEQ ID NO: 3303470 - RNA, 15 nt, Mycobacterium tuberculosis H37Rv
cgucaucgacgagcg

SEQ ID NO: 3303471 - RNA, 21 nt, Mycobacterium tuberculosis H37Rv
cgucaucgaguaacaccccga

SEQ ID NO: 3303472 - RNA, 20 nt, Mycobacterium tuberculosis H37Rv
cgucaucgcguagugauggc

SEQ ID NO: 3303473 - RNA, 15 nt, Mycobacterium tuberculosis H37Rv
cgucaucgucggcgg

SEQ ID NO: 3303474 - RNA, 17 nt, Mycobacterium tuberculosis H37Rv
cgucaucuccgacucga

SEQ ID NO: 3303475 - RNA, 16 nt, Mycobacterium tuberculosis H37Rv
cgucaugaacgaucgg

SEQ ID NO: 3303476 - RNA, 20 nt, Mycobacterium tuberculosis H37Rv
cgucaugaacgaucggacca

SEQ ID NO: 3303477 - RNA, 19 nt, Mycobacterium tuberculosis H37Rv
cgucaugaugucgacaucg

SEQ ID NO: 3303478 - RNA, 14 nt, Mycobacterium tuberculosis H37Rv
cgucaugcccaggu

SEQ ID NO: 3303479 - RNA, 22 nt, Mycobacterium tuberculosis H37Rv
cgucaugcccaucuccaacagg

SEQ ID NO: 3303480 - RNA, 17 nt, Mycobacterium tuberculosis H37Rv
cgucauggcccgaucga

SEQ ID NO: 3303481 - RNA, 17 nt, Mycobacterium tuberculosis H37Rv
cgucaugggcggcuucg

SEQ ID NO: 3303482 - RNA, 14 nt, Mycobacterium tuberculosis H37Rv
cgucauucaccgcg

SEQ ID NO: 3303483 - RNA, 16 nt, Mycobacterium tuberculosis H37Rv
cgucauuuccacaucc

SEQ ID NO: 3303484 - RNA, 20 nt, Mycobacterium tuberculosis H37Rv
cguccaaaccuucaacaacg

SEQ ID NO: 3303485 - RNA, 23 nt, Mycobacterium tuberculosis H37Rv
cguccaaccaaggacgaacgcgc

SEQ ID NO: 3303486 - RNA, 20 nt, Mycobacterium tuberculosis H37Rv
cguccaagaacggaugccgg

SEQ ID NO: 3303487 - RNA, 13 nt, Mycobacterium tuberculosis H37Rv
cguccaagauguc

SEQ ID NO: 3303488 - RNA, 18 nt, Mycobacterium tuberculosis H37Rv
cguccaagccagcguugg

SEQ ID NO: 3303489 - RNA, 21 nt, Mycobacterium tuberculosis H37Rv
cguccaagccagcguuggcgg

SEQ ID NO: 3303490 - RNA, 14 nt, Mycobacterium tuberculosis H37Rv
cguccgucggcgcu

SEQ ID NO: 3303491 - RNA, 21 nt, Mycobacterium tuberculosis H37Rv
cguccucagccgugcccaggc

SEQ ID NO: 3303492 - RNA, 13 nt, Mycobacterium tuberculosis H37Rv
cguccuccucggu

SEQ ID NO: 3303493 - RNA, 12 nt, Mycobacterium tuberculosis H37Rv
cguccucgacga

SEQ ID NO: 3303494 - RNA, 16 nt, Mycobacterium tuberculosis H37Rv
cguccucgccgcacgc

SEQ ID NO: 3303495 - RNA, 16 nt, Mycobacterium tuberculosis H37Rv
cguccucgucuucguc

SEQ ID NO: 3303496 - RNA, 18 nt, Mycobacterium tuberculosis H37Rv
cguccugaaucgguucgg

SEQ ID NO: 3303497 - RNA, 19 nt, Mycobacterium tuberculosis H37Rv
cguccugaaucgguucggc

SEQ ID NO: 3303498 - RNA, 17 nt, Mycobacterium tuberculosis H37Rv
cguccugccaguccgca

SEQ ID NO: 3303499 - RNA, 11 nt, Mycobacterium tuberculosis H37Rv
cguccugcgag

SEQ ID NO: 3303500 - RNA, 23 nt, Mycobacterium tuberculosis H37Rv
cguccugcgagaggugcugcacc

SEQ ID NO: 3303501 - RNA, 19 nt, Mycobacterium tuberculosis H37Rv
cguccugcggguaggugac

SEQ ID NO: 3303502 - RNA, 20 nt, Mycobacterium tuberculosis H37Rv
cguccugguggcgggaucac

SEQ ID NO: 3303503 - RNA, 22 nt, Mycobacterium tuberculosis H37Rv
cguccugguggcgggaucacca

SEQ ID NO: 3303504 - RNA, 17 nt, Mycobacterium tuberculosis H37Rv
cguccuugcgcagcacc

SEQ ID NO: 3303505 - RNA, 18 nt, Mycobacterium tuberculosis H37Rv
cguccuuuuccgccgggc

SEQ ID NO: 3303506 - RNA, 23 nt, Mycobacterium tuberculosis H37Rv
cgucgaaagagaaggcggcgucg

SEQ ID NO: 3303507 - RNA, 15 nt, Mycobacterium tuberculosis H37Rv
cgucgaaauccacaa

SEQ ID NO: 3303508 - RNA, 20 nt, Mycobacterium tuberculosis H37Rv
cgucgaacacgucgggaugc

SEQ ID NO: 3303509 - RNA, 15 nt, Mycobacterium tuberculosis H37Rv
cgucgaacagcaccg

SEQ ID NO: 3303510 - RNA, 21 nt, Mycobacterium tuberculosis H37Rv
cgucgaacauggcacgcggga

SEQ ID NO: 3303511 - RNA, 19 nt, Mycobacterium tuberculosis H37Rv
cgucgaacgguagcacggu

SEQ ID NO: 3303512 - RNA, 17 nt, Mycobacterium tuberculosis H37Rv
cgucgaacugggcgccc

SEQ ID NO: 3303513 - RNA, 17 nt, Mycobacterium tuberculosis H37Rv
cgucgaacuucagcggc

SEQ ID NO: 3303514 - RNA, 13 nt, Mycobacterium tuberculosis H37Rv
cgucgaagcacau

SEQ ID NO: 3303515 - RNA, 19 nt, Mycobacterium tuberculosis H37Rv
cgucgaagcgaacacccgg

SEQ ID NO: 3303516 - RNA, 23 nt, Mycobacterium tuberculosis H37Rv
cgucgaaggugaugaacaccggc

SEQ ID NO: 3303517 - RNA, 20 nt, Mycobacterium tuberculosis H37Rv
cgucgaaguagccgacgucg

SEQ ID NO: 3303518 - RNA, 21 nt, Mycobacterium tuberculosis H37Rv
cgucgaaguagccgacgucgc

SEQ ID NO: 3303519 - RNA, 24 nt, Mycobacterium tuberculosis H37Rv
cgucgaaucuucugagacugccgc

SEQ ID NO: 3303520 - RNA, 14 nt, Mycobacterium tuberculosis H37Rv
cgucgaauuccggc

SEQ ID NO: 3303521 - RNA, 16 nt, Mycobacterium tuberculosis H37Rv
cgucgacaacacgccg

SEQ ID NO: 3303522 - RNA, 16 nt, Mycobacterium tuberculosis H37Rv
cgucgacaacgaucgc

SEQ ID NO: 3303523 - RNA, 18 nt, Mycobacterium tuberculosis H37Rv
cgucgacaacgaucgcgc

SEQ ID NO: 3303524 - RNA, 14 nt, Mycobacterium tuberculosis H37Rv
cgucgacacaccca

SEQ ID NO: 3303525 - RNA, 21 nt, Mycobacterium tuberculosis H37Rv
cgucgacacacccacuggacc

SEQ ID NO: 3303526 - RNA, 24 nt, Mycobacterium tuberculosis H37Rv
cgucgacacacccacuggaccacc

SEQ ID NO: 3303527 - RNA, 23 nt, Mycobacterium tuberculosis H37Rv
cgucgacacccaccaacacccgg

SEQ ID NO: 3303528 - RNA, 14 nt, Mycobacterium tuberculosis H37Rv
cgucgacaccgagg

SEQ ID NO: 3303529 - RNA, 17 nt, Mycobacterium tuberculosis H37Rv
cgucgacaccgcggacc

SEQ ID NO: 3303530 - RNA, 17 nt, Mycobacterium tuberculosis H37Rv
cgucgacagcgucucgc

SEQ ID NO: 3303531 - RNA, 18 nt, Mycobacterium tuberculosis H37Rv
cgucgacagucaacaggg

SEQ ID NO: 3303532 - RNA, 21 nt, Mycobacterium tuberculosis H37Rv
cgucgacagucaacagggcca

SEQ ID NO: 3303533 - RNA, 16 nt, Mycobacterium tuberculosis H37Rv
cgucgacaguucaacg

SEQ ID NO: 3303534 - RNA, 21 nt, Mycobacterium tuberculosis H37Rv
cgucgacaguucaacgggccu

SEQ ID NO: 3303535 - RNA, 21 nt, Mycobacterium tuberculosis H37Rv
cgucgacaucaaagucgaggu

SEQ ID NO: 3303536 - RNA, 15 nt, Mycobacterium tuberculosis H37Rv
cgucgacaucgccau

SEQ ID NO: 3303537 - RNA, 11 nt, Mycobacterium tuberculosis H37Rv
cgucgaccagg

SEQ ID NO: 3303538 - RNA, 14 nt, Mycobacterium tuberculosis H37Rv
cgucgaccaggcca

SEQ ID NO: 3303539 - RNA, 21 nt, Mycobacterium tuberculosis H37Rv
cgucgacccaccaugugcgac

SEQ ID NO: 3303540 - RNA, 23 nt, Mycobacterium tuberculosis H37Rv
cgucgacccgaacugggcgaucg

SEQ ID NO: 3303541 - RNA, 15 nt, Mycobacterium tuberculosis H37Rv
cgucgaccgacgggu

SEQ ID NO: 3303542 - RNA, 12 nt, Mycobacterium tuberculosis H37Rv
cgucgaccggga

SEQ ID NO: 3303543 - RNA, 12 nt, Mycobacterium tuberculosis H37Rv
cgucgaccucgc

SEQ ID NO: 3303544 - RNA, 23 nt, Mycobacterium tuberculosis H37Rv
cgucgaccucgcgggcgaucggc

SEQ ID NO: 3303545 - RNA, 16 nt, Mycobacterium tuberculosis H37Rv
cgucgaccucggcaac

SEQ ID NO: 3303546 - RNA, 22 nt, Mycobacterium tuberculosis H37Rv
cgucgaccuguugucguggcgg

SEQ ID NO: 3303547 - RNA, 14 nt, Mycobacterium tuberculosis H37Rv
cgucgacgagcgcc

SEQ ID NO: 3303548 - RNA, 17 nt, Mycobacterium tuberculosis H37Rv
cgucgacgaucagcgag

SEQ ID NO: 3303549 - RNA, 17 nt, Mycobacterium tuberculosis H37Rv
cgucgacgaugucggca

SEQ ID NO: 3303550 - RNA, 12 nt, Mycobacterium tuberculosis H37Rv
cgucgacgccga

SEQ ID NO: 3303551 - RNA, 18 nt, Mycobacterium tuberculosis H37Rv
cgucgacgccgaucgcgg

SEQ ID NO: 3303552 - RNA, 18 nt, Mycobacterium tuberculosis H37Rv
cgucgacgccggccagcg

SEQ ID NO: 3303553 - RNA, 15 nt, Mycobacterium tuberculosis H37Rv
cgucgacgcgguccu

SEQ ID NO: 3303554 - RNA, 13 nt, Mycobacterium tuberculosis H37Rv
cgucgacgcguug

SEQ ID NO: 3303555 - RNA, 22 nt, Mycobacterium tuberculosis H37Rv
cgucgacggccuggggcagccg

SEQ ID NO: 3303556 - RNA, 14 nt, Mycobacterium tuberculosis H37Rv
cgucgacggcgaug

SEQ ID NO: 3303557 - RNA, 15 nt, Mycobacterium tuberculosis H37Rv
cgucgacggcgaugg

SEQ ID NO: 3303558 - RNA, 20 nt, Mycobacterium tuberculosis H37Rv
cgucgacggcgauggcgcgc

SEQ ID NO: 3303559 - RNA, 16 nt, Mycobacterium tuberculosis H37Rv
cgucgacgucggcccc

SEQ ID NO: 3303560 - RNA, 19 nt, Mycobacterium tuberculosis H37Rv
cgucgacuugcaggcgucc

SEQ ID NO: 3303561 - RNA, 14 nt, Mycobacterium tuberculosis H37Rv
cgucgagacuucgg

SEQ ID NO: 3303562 - RNA, 21 nt, Mycobacterium tuberculosis H37Rv
cgucgagacuucgguguagcc

SEQ ID NO: 3303563 - RNA, 18 nt, Mycobacterium tuberculosis H37Rv
cgucgagagguucgccgu

SEQ ID NO: 3303564 - RNA, 17 nt, Mycobacterium tuberculosis H37Rv
cgucgagauagccgacg

SEQ ID NO: 3303565 - RNA, 18 nt, Mycobacterium tuberculosis H37Rv
cgucgagauagccgacgu

SEQ ID NO: 3303566 - RNA, 20 nt, Mycobacterium tuberculosis H37Rv
cgucgagcacguccucgacc

SEQ ID NO: 3303567 - RNA, 15 nt, Mycobacterium tuberculosis H37Rv
cgucgagcagcacca

SEQ ID NO: 3303568 - RNA, 13 nt, Mycobacterium tuberculosis H37Rv
cgucgagcagccg

SEQ ID NO: 3303569 - RNA, 14 nt, Mycobacterium tuberculosis H37Rv
cgucgagcagcgcc

SEQ ID NO: 3303570 - RNA, 15 nt, Mycobacterium tuberculosis H37Rv
cgucgagccgaccgc

SEQ ID NO: 3303571 - RNA, 17 nt, Mycobacterium tuberculosis H37Rv
cgucgagccgaccgcgg

SEQ ID NO: 3303572 - RNA, 18 nt, Mycobacterium tuberculosis H37Rv
cgucgagccgaucgcccg

SEQ ID NO: 3303573 - RNA, 17 nt, Mycobacterium tuberculosis H37Rv
cgucgagccggacaggc

SEQ ID NO: 3303574 - RNA, 22 nt, Mycobacterium tuberculosis H37Rv
cgucgagcgccuugucgaucuc

SEQ ID NO: 3303575 - RNA, 12 nt, Mycobacterium tuberculosis H37Rv
cgucgagcgcgc

SEQ ID NO: 3303576 - RNA, 14 nt, Mycobacterium tuberculosis H37Rv
cgucgagcgcgcca

SEQ ID NO: 3303577 - RNA, 16 nt, Mycobacterium tuberculosis H37Rv
cgucgagcgcgccacu

SEQ ID NO: 3303578 - RNA, 21 nt, Mycobacterium tuberculosis H37Rv
cgucgagcgcggugccgccac

SEQ ID NO: 3303579 - RNA, 22 nt, Mycobacterium tuberculosis H37Rv
cgucgagcgcggugccgccacc

SEQ ID NO: 3303580 - RNA, 12 nt, Mycobacterium tuberculosis H37Rv
cgucgagcgcgu

SEQ ID NO: 3303581 - RNA, 14 nt, Mycobacterium tuberculosis H37Rv
cgucgagcgcgucg

SEQ ID NO: 3303582 - RNA, 21 nt, Mycobacterium tuberculosis H37Rv
cgucgaggaagaucaccuccc

SEQ ID NO: 3303583 - RNA, 13 nt, Mycobacterium tuberculosis H37Rv
cgucgaggcggca

SEQ ID NO: 3303584 - RNA, 14 nt, Mycobacterium tuberculosis H37Rv
cgucgaggcugacc

SEQ ID NO: 3303585 - RNA, 21 nt, Mycobacterium tuberculosis H37Rv
cgucgagguccucgucgucga

SEQ ID NO: 3303586 - RNA, 17 nt, Mycobacterium tuberculosis H37Rv
cgucgcgccaggcgcga

SEQ ID NO: 3303587 - RNA, 22 nt, Mycobacterium tuberculosis H37Rv
cgucgcgccgcgugguuccggc

SEQ ID NO: 3303588 - RNA, 21 nt, Mycobacterium tuberculosis H37Rv
cgucgcgcgccuuggccagcg

SEQ ID NO: 3303589 - RNA, 20 nt, Mycobacterium tuberculosis H37Rv
cgucgcggaaucgcgacacg

SEQ ID NO: 3303590 - RNA, 22 nt, Mycobacterium tuberculosis H37Rv
cgucgcggaaucgcgacacgcg

SEQ ID NO: 3303591 - RNA, 19 nt, Mycobacterium tuberculosis H37Rv
cgucgcggaguagccgcag

SEQ ID NO: 3303592 - RNA, 22 nt, Mycobacterium tuberculosis H37Rv
cgucgcggaucagcccgcgcag

SEQ ID NO: 3303593 - RNA, 21 nt, Mycobacterium tuberculosis H37Rv
cgucgcggccacggucagcca

SEQ ID NO: 3303594 - RNA, 23 nt, Mycobacterium tuberculosis H37Rv
cgucgcggccggcggccgcccag

SEQ ID NO: 3303595 - RNA, 15 nt, Mycobacterium tuberculosis H37Rv
cgucgcggccgucgc

SEQ ID NO: 3303596 - RNA, 22 nt, Mycobacterium tuberculosis H37Rv
cgucgcggccguggaugucgcg

SEQ ID NO: 3303597 - RNA, 23 nt, Mycobacterium tuberculosis H37Rv
cgucgcgggaaaacgggguggca

SEQ ID NO: 3303598 - RNA, 20 nt, Mycobacterium tuberculosis H37Rv
cgucgcggguaaccggcucc

SEQ ID NO: 3303599 - RNA, 13 nt, Mycobacterium tuberculosis H37Rv
cgucgcgguaggc

SEQ ID NO: 3303600 - RNA, 23 nt, Mycobacterium tuberculosis H37Rv
cgucgcguccgcgaucugcagcg

SEQ ID NO: 3303601 - RNA, 14 nt, Mycobacterium tuberculosis H37Rv
cgucgcgucgccag

SEQ ID NO: 3303602 - RNA, 22 nt, Mycobacterium tuberculosis H37Rv
cgucgcguggaguggugaucca

SEQ ID NO: 3303603 - RNA, 16 nt, Mycobacterium tuberculosis H37Rv
cgucgcuagggugagc

SEQ ID NO: 3303604 - RNA, 17 nt, Mycobacterium tuberculosis H37Rv
cgucgcuagggugagcc

SEQ ID NO: 3303605 - RNA, 18 nt, Mycobacterium tuberculosis H37Rv
cgucgcuagggugagccc

SEQ ID NO: 3303606 - RNA, 20 nt, Mycobacterium tuberculosis H37Rv
cgucgcucgucgucaccgau

SEQ ID NO: 3303607 - RNA, 18 nt, Mycobacterium tuberculosis H37Rv
cgucgcugaacagacggc

SEQ ID NO: 3303608 - RNA, 13 nt, Mycobacterium tuberculosis H37Rv
cgucgcugaccgc

SEQ ID NO: 3303609 - RNA, 15 nt, Mycobacterium tuberculosis H37Rv
cgucgcugaccgcgu

SEQ ID NO: 3303610 - RNA, 19 nt, Mycobacterium tuberculosis H37Rv
cgucgcugacgcccuccug

SEQ ID NO: 3303611 - RNA, 15 nt, Mycobacterium tuberculosis H37Rv
cgucgcugagcagcg

SEQ ID NO: 3303612 - RNA, 22 nt, Mycobacterium tuberculosis H37Rv
cgucgcugcccaucacacccgg

SEQ ID NO: 3303613 - RNA, 22 nt, Mycobacterium tuberculosis H37Rv
cgucgcugccccuugggcucga

SEQ ID NO: 3303614 - RNA, 13 nt, Mycobacterium tuberculosis H37Rv
cgucgcuugcugg

SEQ ID NO: 3303615 - RNA, 22 nt, Mycobacterium tuberculosis H37Rv
cgucgcuuggaucgucgcugug

SEQ ID NO: 3303616 - RNA, 19 nt, Mycobacterium tuberculosis H37Rv
cgucggaacugaccacguc

SEQ ID NO: 3303617 - RNA, 17 nt, Mycobacterium tuberculosis H37Rv
cgucggaauacaacagc

SEQ ID NO: 3303618 - RNA, 15 nt, Mycobacterium tuberculosis H37Rv
cgucggacagcuuuc

SEQ ID NO: 3303619 - RNA, 14 nt, Mycobacterium tuberculosis H37Rv
cgucggaccagcug

SEQ ID NO: 3303620 - RNA, 12 nt, Mycobacterium tuberculosis H37Rv
cgucggagccgg

SEQ ID NO: 3303621 - RNA, 16 nt, Mycobacterium tuberculosis H37Rv
cgucggagccggccac

SEQ ID NO: 3303622 - RNA, 14 nt, Mycobacterium tuberculosis H37Rv
cgucggagccgggc

SEQ ID NO: 3303623 - RNA, 14 nt, Mycobacterium tuberculosis H37Rv
cgucggagucggug

SEQ ID NO: 3303624 - RNA, 15 nt, Mycobacterium tuberculosis H37Rv
cgucggagucggugg

SEQ ID NO: 3303625 - RNA, 22 nt, Mycobacterium tuberculosis H37Rv
cgucggcaaagaaggcgacccg

SEQ ID NO: 3303626 - RNA, 19 nt, Mycobacterium tuberculosis H37Rv
cgucggcaaccauuagcgc

SEQ ID NO: 3303627 - RNA, 17 nt, Mycobacterium tuberculosis H37Rv
cgucggcaacgcuggca

SEQ ID NO: 3303628 - RNA, 17 nt, Mycobacterium tuberculosis H37Rv
cgucggcaccagcagcc

SEQ ID NO: 3303629 - RNA, 11 nt, Mycobacterium tuberculosis H37Rv
cgucggcaccg

SEQ ID NO: 3303630 - RNA, 17 nt, Mycobacterium tuberculosis H37Rv
cgucggcaccgauccug

SEQ ID NO: 3303631 - RNA, 20 nt, Mycobacterium tuberculosis H37Rv
cgucggcaccgguuuucgcc

SEQ ID NO: 3303632 - RNA, 22 nt, Mycobacterium tuberculosis H37Rv
cgucggcagcagcggugcagcc

SEQ ID NO: 3303633 - RNA, 14 nt, Mycobacterium tuberculosis H37Rv
cgucggcaucgacg

SEQ ID NO: 3303634 - RNA, 17 nt, Mycobacterium tuberculosis H37Rv
cgucggcaucgacgcgu

SEQ ID NO: 3303635 - RNA, 20 nt, Mycobacterium tuberculosis H37Rv
cgucggcaugggccggcgcc

SEQ ID NO: 3303636 - RNA, 23 nt, Mycobacterium tuberculosis H37Rv
cgucggcaugggccggcgccgca

SEQ ID NO: 3303637 - RNA, 13 nt, Mycobacterium tuberculosis H37Rv
cgucggccaaaga

SEQ ID NO: 3303638 - RNA, 16 nt, Mycobacterium tuberculosis H37Rv
cgucggccaccgccug

SEQ ID NO: 3303639 - RNA, 14 nt, Mycobacterium tuberculosis H37Rv
cgucggccaccgcg

SEQ ID NO: 3303640 - RNA, 13 nt, Mycobacterium tuberculosis H37Rv
cgucggccagcag

SEQ ID NO: 3303641 - RNA, 14 nt, Mycobacterium tuberculosis H37Rv
cgucggccagcaga

SEQ ID NO: 3303642 - RNA, 15 nt, Mycobacterium tuberculosis H37Rv
cgucggccagcagau

SEQ ID NO: 3303643 - RNA, 12 nt, Mycobacterium tuberculosis H37Rv
cgucggccagga

SEQ ID NO: 3303644 - RNA, 12 nt, Mycobacterium tuberculosis H37Rv
cgucggccagug

SEQ ID NO: 3303645 - RNA, 22 nt, Mycobacterium tuberculosis H37Rv
cgucggccccacaagucgcgcg

SEQ ID NO: 3303646 - RNA, 13 nt, Mycobacterium tuberculosis H37Rv
cgucggcccggug

SEQ ID NO: 3303647 - RNA, 17 nt, Mycobacterium tuberculosis H37Rv
cgucggccgaacaaccu

SEQ ID NO: 3303648 - RNA, 16 nt, Mycobacterium tuberculosis H37Rv
cgucggccgacaccgc

SEQ ID NO: 3303649 - RNA, 15 nt, Mycobacterium tuberculosis H37Rv
cgucggccgcgcugc

SEQ ID NO: 3303650 - RNA, 20 nt, Mycobacterium tuberculosis H37Rv
cgucggccgcgcugcugacc

SEQ ID NO: 3303651 - RNA, 15 nt, Mycobacterium tuberculosis H37Rv
cgucggccggcaccc

SEQ ID NO: 3303652 - RNA, 20 nt, Mycobacterium tuberculosis H37Rv
cgucggcgaauccgccgccu

SEQ ID NO: 3303653 - RNA, 16 nt, Mycobacterium tuberculosis H37Rv
cgucggcgacguccag

SEQ ID NO: 3303654 - RNA, 13 nt, Mycobacterium tuberculosis H37Rv
cgucggcgagcag

SEQ ID NO: 3303655 - RNA, 15 nt, Mycobacterium tuberculosis H37Rv
cgucggcgagcgcgg

SEQ ID NO: 3303656 - RNA, 17 nt, Mycobacterium tuberculosis H37Rv
cgucggcgaugaacagc

SEQ ID NO: 3303657 - RNA, 15 nt, Mycobacterium tuberculosis H37Rv
cgucggcgcgcaccu

SEQ ID NO: 3303658 - RNA, 16 nt, Mycobacterium tuberculosis H37Rv
cgucggcggcgaacag

SEQ ID NO: 3303659 - RNA, 15 nt, Mycobacterium tuberculosis H37Rv
cgucggcgggcggca

SEQ ID NO: 3303660 - RNA, 19 nt, Mycobacterium tuberculosis H37Rv
cgucggcgggcugcaguga

SEQ ID NO: 3303661 - RNA, 21 nt, Mycobacterium tuberculosis H37Rv
cgucggcguggucgcgcggca

SEQ ID NO: 3303662 - RNA, 15 nt, Mycobacterium tuberculosis H37Rv
cgucggcugccgcgg

SEQ ID NO: 3303663 - RNA, 17 nt, Mycobacterium tuberculosis H37Rv
cgucgggacgccgcccc

SEQ ID NO: 3303664 - RNA, 17 nt, Mycobacterium tuberculosis H37Rv
cgucgggacggccaaca

SEQ ID NO: 3303665 - RNA, 22 nt, Mycobacterium tuberculosis H37Rv
cgucgggacggccaacagggcg

SEQ ID NO: 3303666 - RNA, 16 nt, Mycobacterium tuberculosis H37Rv
cgucgggaugcccgcu

SEQ ID NO: 3303667 - RNA, 14 nt, Mycobacterium tuberculosis H37Rv
cgucgggaugcucg

SEQ ID NO: 3303668 - RNA, 14 nt, Mycobacterium tuberculosis H37Rv
cgucgggcacaccg

SEQ ID NO: 3303669 - RNA, 23 nt, Mycobacterium tuberculosis H37Rv
cgucgggcaccgccaaaaacgcc

SEQ ID NO: 3303670 - RNA, 15 nt, Mycobacterium tuberculosis H37Rv
cgucgggccgcaacu

SEQ ID NO: 3303671 - RNA, 22 nt, Mycobacterium tuberculosis H37Rv
cgucgggcgucccggcggucag

SEQ ID NO: 3303672 - RNA, 19 nt, Mycobacterium tuberculosis H37Rv
cgucggggaguucgcgcag

SEQ ID NO: 3303673 - RNA, 20 nt, Mycobacterium tuberculosis H37Rv
cgucgggguguucgaugggu

SEQ ID NO: 3303674 - RNA, 13 nt, Mycobacterium tuberculosis H37Rv
cgucggguagugc

SEQ ID NO: 3303675 - RNA, 22 nt, Mycobacterium tuberculosis H37Rv
cgucgggucaaugcuggcagcg

SEQ ID NO: 3303676 - RNA, 14 nt, Mycobacterium tuberculosis H37Rv
cgucgggucaccca

SEQ ID NO: 3303677 - RNA, 15 nt, Mycobacterium tuberculosis H37Rv
cgucgggucacccag

SEQ ID NO: 3303678 - RNA, 23 nt, Mycobacterium tuberculosis H37Rv
cgucgggugcagcacggcgccgc

SEQ ID NO: 3303679 - RNA, 21 nt, Mycobacterium tuberculosis H37Rv
cgucgguaaagggcucgaugg

SEQ ID NO: 3303680 - RNA, 15 nt, Mycobacterium tuberculosis H37Rv
cgucggucaccgaau

SEQ ID NO: 3303681 - RNA, 16 nt, Mycobacterium tuberculosis H37Rv
cgucggucaccuggcg

SEQ ID NO: 3303682 - RNA, 21 nt, Mycobacterium tuberculosis H37Rv
cgucucgccgggaaacaccgg

SEQ ID NO: 3303683 - RNA, 19 nt, Mycobacterium tuberculosis H37Rv
cgucucggcaugcucgaca

SEQ ID NO: 3303684 - RNA, 12 nt, Mycobacterium tuberculosis H37Rv
cgucucggccag

SEQ ID NO: 3303685 - RNA, 14 nt, Mycobacterium tuberculosis H37Rv
cgucucggccagcu

SEQ ID NO: 3303686 - RNA, 20 nt, Mycobacterium tuberculosis H37Rv
cgucucggccagcucggccu

SEQ ID NO: 3303687 - RNA, 23 nt, Mycobacterium tuberculosis H37Rv
cgucucggccagcucggccuggu

SEQ ID NO: 3303688 - RNA, 19 nt, Mycobacterium tuberculosis H37Rv
cgucucggguggggaucac

SEQ ID NO: 3303689 - RNA, 16 nt, Mycobacterium tuberculosis H37Rv
cgucucggugcagcag

SEQ ID NO: 3303690 - RNA, 16 nt, Mycobacterium tuberculosis H37Rv
cgucugacaucgucga

SEQ ID NO: 3303691 - RNA, 15 nt, Mycobacterium tuberculosis H37Rv
cgucugacccaccgc

SEQ ID NO: 3303692 - RNA, 19 nt, Mycobacterium tuberculosis H37Rv
cgucugcacguacucggcc

SEQ ID NO: 3303693 - RNA, 22 nt, Mycobacterium tuberculosis H37Rv
cgucugcacguacucggccagc

SEQ ID NO: 3303694 - RNA, 17 nt, Mycobacterium tuberculosis H37Rv
cgucugccaggcgcagc

SEQ ID NO: 3303695 - RNA, 22 nt, Mycobacterium tuberculosis H37Rv
cgucugcccaguguccggcgac

SEQ ID NO: 3303696 - RNA, 18 nt, Mycobacterium tuberculosis H37Rv
cgucugcgaucccgaucg

SEQ ID NO: 3303697 - RNA, 23 nt, Mycobacterium tuberculosis H37Rv
cgucugcgaucccgaucgcgcug

SEQ ID NO: 3303698 - RNA, 16 nt, Mycobacterium tuberculosis H37Rv
cgucugcggaccggcg

SEQ ID NO: 3303699 - RNA, 18 nt, Mycobacterium tuberculosis H37Rv
cgucugcggggugaguga

SEQ ID NO: 3303700 - RNA, 13 nt, Mycobacterium tuberculosis H37Rv
cgucugcucacca

SEQ ID NO: 3303701 - RNA, 15 nt, Mycobacterium tuberculosis H37Rv
cgucugcucaccagc

SEQ ID NO: 3303702 - RNA, 11 nt, Mycobacterium tuberculosis H37Rv
cgucugcucgc

SEQ ID NO: 3303703 - RNA, 14 nt, Mycobacterium tuberculosis H37Rv
cgucugcucgccag

SEQ ID NO: 3303704 - RNA, 21 nt, Mycobacterium tuberculosis H37Rv
cgucugcucgccagccggccu

SEQ ID NO: 3303705 - RNA, 16 nt, Mycobacterium tuberculosis H37Rv
cgucugcucgccaggc

SEQ ID NO: 3303706 - RNA, 18 nt, Mycobacterium tuberculosis H37Rv
cgucugcucgccgggcuu

SEQ ID NO: 3303707 - RNA, 12 nt, Mycobacterium tuberculosis H37Rv
cgucugcucgcg

SEQ ID NO: 3303708 - RNA, 22 nt, Mycobacterium tuberculosis H37Rv
cgucugcucgcgaggcucgcgu

SEQ ID NO: 3303709 - RNA, 14 nt, Mycobacterium tuberculosis H37Rv
cgucugcucgcgca

SEQ ID NO: 3303710 - RNA, 15 nt, Mycobacterium tuberculosis H37Rv
cgucugcucggcgca

SEQ ID NO: 3303711 - RNA, 15 nt, Mycobacterium tuberculosis H37Rv
cgucugcucggcgcu

SEQ ID NO: 3303712 - RNA, 13 nt, Mycobacterium tuberculosis H37Rv
cgucuggaguucg

SEQ ID NO: 3303713 - RNA, 15 nt, Mycobacterium tuberculosis H37Rv
cgucuggucagccgc

SEQ ID NO: 3303714 - RNA, 15 nt, Mycobacterium tuberculosis H37Rv
cgucugguggcagcg

SEQ ID NO: 3303715 - RNA, 22 nt, Mycobacterium tuberculosis H37Rv
cgucugguggcagcgcacccgg

SEQ ID NO: 3303716 - RNA, 21 nt, Mycobacterium tuberculosis H37Rv
cgucuuaccugaagccgcgcu

SEQ ID NO: 3303717 - RNA, 23 nt, Mycobacterium tuberculosis H37Rv
cgucuuaccugaagccgcgcugc

SEQ ID NO: 3303718 - RNA, 15 nt, Mycobacterium tuberculosis H37Rv
cgucuuccagccagg

SEQ ID NO: 3303719 - RNA, 21 nt, Mycobacterium tuberculosis H37Rv
cgucuucgggcucguccagca

SEQ ID NO: 3303720 - RNA, 16 nt, Mycobacterium tuberculosis H37Rv
cgucuucgucauggcc

SEQ ID NO: 3303721 - RNA, 22 nt, Mycobacterium tuberculosis H37Rv
cgucuucgucggagucuucguc

SEQ ID NO: 3303722 - RNA, 21 nt, Mycobacterium tuberculosis H37Rv
cgucuugcaucagcggcgcca

SEQ ID NO: 3303723 - RNA, 18 nt, Mycobacterium tuberculosis H37Rv
cgucuugcguccauccgc

SEQ ID NO: 3303724 - RNA, 17 nt, Mycobacterium tuberculosis H37Rv
cgucuuggcggcggugc

SEQ ID NO: 3303725 - RNA, 23 nt, Mycobacterium tuberculosis H37Rv
cgucuugggccgggaugaagcca

SEQ ID NO: 3303726 - RNA, 22 nt, Mycobacterium tuberculosis H37Rv
cgucuuggugcgcgucagccgc

SEQ ID NO: 3303727 - RNA, 18 nt, Mycobacterium tuberculosis H37Rv
cgucuuuggugccgagca

SEQ ID NO: 3303728 - RNA, 20 nt, Mycobacterium tuberculosis H37Rv
cgugaaagccgaccagcgcg

SEQ ID NO: 3303729 - RNA, 21 nt, Mycobacterium tuberculosis H37Rv
cgugaacggcgcgggccacca

SEQ ID NO: 3303730 - RNA, 17 nt, Mycobacterium tuberculosis H37Rv
cgugaagggauccggaa

SEQ ID NO: 3303731 - RNA, 20 nt, Mycobacterium tuberculosis H37Rv
cgugacaccggggacgucga

SEQ ID NO: 3303732 - RNA, 13 nt, Mycobacterium tuberculosis H37Rv
cgugacagcggcg

SEQ ID NO: 3303733 - RNA, 15 nt, Mycobacterium tuberculosis H37Rv
cgugacagcggcgau

SEQ ID NO: 3303734 - RNA, 18 nt, Mycobacterium tuberculosis H37Rv
cgugacagcggcgaucuc

SEQ ID NO: 3303735 - RNA, 19 nt, Mycobacterium tuberculosis H37Rv
cgugaccaccgccgacagg

SEQ ID NO: 3303736 - RNA, 18 nt, Mycobacterium tuberculosis H37Rv
cgugacccauucucggcc

SEQ ID NO: 3303737 - RNA, 19 nt, Mycobacterium tuberculosis H37Rv
cgugacccccagcagggug

SEQ ID NO: 3303738 - RNA, 21 nt, Mycobacterium tuberculosis H37Rv
cgugacccggauaucgaccac

SEQ ID NO: 3303739 - RNA, 20 nt, Mycobacterium tuberculosis H37Rv
cgugacccucagcaccgcug

SEQ ID NO: 3303740 - RNA, 21 nt, Mycobacterium tuberculosis H37Rv
cgugacccugggguugcauca

SEQ ID NO: 3303741 - RNA, 16 nt, Mycobacterium tuberculosis H37Rv
cgugaccgaccgccau

SEQ ID NO: 3303742 - RNA, 14 nt, Mycobacterium tuberculosis H37Rv
cgugaccgacugcg

SEQ ID NO: 3303743 - RNA, 17 nt, Mycobacterium tuberculosis H37Rv
cgugaccgagccgcgau

SEQ ID NO: 3303744 - RNA, 21 nt, Mycobacterium tuberculosis H37Rv
cgugaccggcaaccgccgugu

SEQ ID NO: 3303745 - RNA, 13 nt, Mycobacterium tuberculosis H37Rv
cgugaccggcaau

SEQ ID NO: 3303746 - RNA, 21 nt, Mycobacterium tuberculosis H37Rv
cgugaccgugccgucggcgug

SEQ ID NO: 3303747 - RNA, 16 nt, Mycobacterium tuberculosis H37Rv
cgugacgaccagcccc

SEQ ID NO: 3303748 - RNA, 19 nt, Mycobacterium tuberculosis H37Rv
cgugacgaguucgcugacc

SEQ ID NO: 3303749 - RNA, 16 nt, Mycobacterium tuberculosis H37Rv
cgugacgauucgagca

SEQ ID NO: 3303750 - RNA, 17 nt, Mycobacterium tuberculosis H37Rv
cgugacguaccacggcg

SEQ ID NO: 3303751 - RNA, 19 nt, Mycobacterium tuberculosis H37Rv
cgugacguaccacggcgau

SEQ ID NO: 3303752 - RNA, 20 nt, Mycobacterium tuberculosis H37Rv
cgugacguagggcagcgcca

SEQ ID NO: 3303753 - RNA, 21 nt, Mycobacterium tuberculosis H37Rv
cgugacguagggcagcgccag

SEQ ID NO: 3303754 - RNA, 13 nt, Mycobacterium tuberculosis H37Rv
cgugacucggccg

SEQ ID NO: 3303755 - RNA, 15 nt, Mycobacterium tuberculosis H37Rv
cgugacucggccgac

SEQ ID NO: 3303756 - RNA, 17 nt, Mycobacterium tuberculosis H37Rv
cgugacucggccgacga

SEQ ID NO: 3303757 - RNA, 14 nt, Mycobacterium tuberculosis H37Rv
cgugagccagcuug

SEQ ID NO: 3303758 - RNA, 16 nt, Mycobacterium tuberculosis H37Rv
cgugagccaugccgcu

SEQ ID NO: 3303759 - RNA, 13 nt, Mycobacterium tuberculosis H37Rv
cgugagccccagc

SEQ ID NO: 3303760 - RNA, 22 nt, Mycobacterium tuberculosis H37Rv
cgugagcccggcgaucagcagc

SEQ ID NO: 3303761 - RNA, 16 nt, Mycobacterium tuberculosis H37Rv
cgugagcgcgcgcagu

SEQ ID NO: 3303762 - RNA, 15 nt, Mycobacterium tuberculosis H37Rv
cgugagcggccaggu

SEQ ID NO: 3303763 - RNA, 20 nt, Mycobacterium tuberculosis H37Rv
cgugagcuaugcuggcagcu

SEQ ID NO: 3303764 - RNA, 17 nt, Mycobacterium tuberculosis H37Rv
cgugagcucgucgaggc

SEQ ID NO: 3303765 - RNA, 18 nt, Mycobacterium tuberculosis H37Rv
cgugaggucccggcuggg

SEQ ID NO: 3303766 - RNA, 21 nt, Mycobacterium tuberculosis H37Rv
cgugaggucccggcugggauc

SEQ ID NO: 3303767 - RNA, 20 nt, Mycobacterium tuberculosis H37Rv
cgugaguacucggucaacgu

SEQ ID NO: 3303768 - RNA, 16 nt, Mycobacterium tuberculosis H37Rv
cgugagugccggcgug

SEQ ID NO: 3303769 - RNA, 18 nt, Mycobacterium tuberculosis H37Rv
cgugagugccggcgugcg

SEQ ID NO: 3303770 - RNA, 17 nt, Mycobacterium tuberculosis H37Rv
cgugauacagcucggug

SEQ ID NO: 3303771 - RNA, 19 nt, Mycobacterium tuberculosis H37Rv
cgugauacagcucggugca

SEQ ID NO: 3303772 - RNA, 23 nt, Mycobacterium tuberculosis H37Rv
cgugauauccuuugccgccgaac

SEQ ID NO: 3303773 - RNA, 12 nt, Mycobacterium tuberculosis H37Rv
cgugaucgaccg

SEQ ID NO: 3303774 - RNA, 20 nt, Mycobacterium tuberculosis H37Rv
cgugaucgcgguccaacagc

SEQ ID NO: 3303775 - RNA, 17 nt, Mycobacterium tuberculosis H37Rv
cgugaucgcuggcgacc

SEQ ID NO: 3303776 - RNA, 14 nt, Mycobacterium tuberculosis H37Rv
cgugaucggcgaac

SEQ ID NO: 3303777 - RNA, 15 nt, Mycobacterium tuberculosis H37Rv
cgugaucuggccgaa

SEQ ID NO: 3303778 - RNA, 20 nt, Mycobacterium tuberculosis H37Rv
cgugcgggcgggcguccacg

SEQ ID NO: 3303779 - RNA, 22 nt, Mycobacterium tuberculosis H37Rv
cgugcgggggacgggucgccgc

SEQ ID NO: 3303780 - RNA, 19 nt, Mycobacterium tuberculosis H37Rv
cgugcggguaauacggcgc

SEQ ID NO: 3303781 - RNA, 21 nt, Mycobacterium tuberculosis H37Rv
cgugcggguaauacggcgccu

SEQ ID NO: 3303782 - RNA, 19 nt, Mycobacterium tuberculosis H37Rv
cgugcgguauuugaacgcc

SEQ ID NO: 3303783 - RNA, 15 nt, Mycobacterium tuberculosis H37Rv
cgugcggucgcgccc

SEQ ID NO: 3303784 - RNA, 17 nt, Mycobacterium tuberculosis H37Rv
cgugcggucgugccccg

SEQ ID NO: 3303785 - RNA, 15 nt, Mycobacterium tuberculosis H37Rv
cgugcgucggcccgg

SEQ ID NO: 3303786 - RNA, 15 nt, Mycobacterium tuberculosis H37Rv
cgugcgugcgggggc

SEQ ID NO: 3303787 - RNA, 17 nt, Mycobacterium tuberculosis H37Rv
cgugcuacccauucggc

SEQ ID NO: 3303788 - RNA, 13 nt, Mycobacterium tuberculosis H37Rv
cgugcuccugccc

SEQ ID NO: 3303789 - RNA, 14 nt, Mycobacterium tuberculosis H37Rv
cgugcuccugcccg

SEQ ID NO: 3303790 - RNA, 23 nt, Mycobacterium tuberculosis H37Rv
cgugcucgccguaagcaccagcc

SEQ ID NO: 3303791 - RNA, 14 nt, Mycobacterium tuberculosis H37Rv
cgugcucggccugu

SEQ ID NO: 3303792 - RNA, 14 nt, Mycobacterium tuberculosis H37Rv
cgugcucucggcga

SEQ ID NO: 3303793 - RNA, 18 nt, Mycobacterium tuberculosis H37Rv
cgugcugaacuccgccgc

SEQ ID NO: 3303794 - RNA, 20 nt, Mycobacterium tuberculosis H37Rv
cgugcugaacuccgccgcga

SEQ ID NO: 3303795 - RNA, 19 nt, Mycobacterium tuberculosis H37Rv
cgugcugccauugccgcau

SEQ ID NO: 3303796 - RNA, 19 nt, Mycobacterium tuberculosis H37Rv
cgugcugcccgcaacacug

SEQ ID NO: 3303797 - RNA, 21 nt, Mycobacterium tuberculosis H37Rv
cgugcugccgauagcgcggca

SEQ ID NO: 3303798 - RNA, 21 nt, Mycobacterium tuberculosis H37Rv
cgugcugccgccuuggucgcg

SEQ ID NO: 3303799 - RNA, 20 nt, Mycobacterium tuberculosis H37Rv
cgugcugccggagacacccg

SEQ ID NO: 3303800 - RNA, 12 nt, Mycobacterium tuberculosis H37Rv
cgugcuggcgac

SEQ ID NO: 3303801 - RNA, 14 nt, Mycobacterium tuberculosis H37Rv
cgugcugggccgac

SEQ ID NO: 3303802 - RNA, 19 nt, Mycobacterium tuberculosis H37Rv
cgugcugggugacaccggu

SEQ ID NO: 3303803 - RNA, 15 nt, Mycobacterium tuberculosis H37Rv
cgugcugugcucacg

SEQ ID NO: 3303804 - RNA, 19 nt, Mycobacterium tuberculosis H37Rv
cgugcuguggaugccgacg

SEQ ID NO: 3303805 - RNA, 21 nt, Mycobacterium tuberculosis H37Rv
cgugcuguggaugccgacggc

SEQ ID NO: 3303806 - RNA, 21 nt, Mycobacterium tuberculosis H37Rv
cgugcuuaacacaugcaaguc

SEQ ID NO: 3303807 - RNA, 13 nt, Mycobacterium tuberculosis H37Rv
cgugcuuccauuc

SEQ ID NO: 3303808 - RNA, 16 nt, Mycobacterium tuberculosis H37Rv
cgugcuuccauucgcg

SEQ ID NO: 3303809 - RNA, 19 nt, Mycobacterium tuberculosis H37Rv
cgugcuuuccuugcgcgcc

SEQ ID NO: 3303810 - RNA, 20 nt, Mycobacterium tuberculosis H37Rv
cguggaaaccggugguagcg

SEQ ID NO: 3303811 - RNA, 15 nt, Mycobacterium tuberculosis H37Rv
cguggaagacgucga

SEQ ID NO: 3303812 - RNA, 23 nt, Mycobacterium tuberculosis H37Rv
cguggaagauguugccgccgguc

SEQ ID NO: 3303813 - RNA, 17 nt, Mycobacterium tuberculosis H37Rv
cguggacaucgggcggc

SEQ ID NO: 3303814 - RNA, 19 nt, Mycobacterium tuberculosis H37Rv
cguggagcgcaaguugagc

SEQ ID NO: 3303815 - RNA, 13 nt, Mycobacterium tuberculosis H37Rv
cguggagcgcuug

SEQ ID NO: 3303816 - RNA, 22 nt, Mycobacterium tuberculosis H37Rv
cguggaucaucccgaccagcag

SEQ ID NO: 3303817 - RNA, 15 nt, Mycobacterium tuberculosis H37Rv
cguggauccagccau

SEQ ID NO: 3303818 - RNA, 16 nt, Mycobacterium tuberculosis H37Rv
cguggaucggcagccc

SEQ ID NO: 3303819 - RNA, 17 nt, Mycobacterium tuberculosis H37Rv
cguggauggccgccagg

SEQ ID NO: 3303820 - RNA, 16 nt, Mycobacterium tuberculosis H37Rv
cguggcacugacgcgc

SEQ ID NO: 3303821 - RNA, 20 nt, Mycobacterium tuberculosis H37Rv
cguggcacugacgcgcccga

SEQ ID NO: 3303822 - RNA, 16 nt, Mycobacterium tuberculosis H37Rv
cguggcaguacaccgg

SEQ ID NO: 3303823 - RNA, 13 nt, Mycobacterium tuberculosis H37Rv
cguggcagugcag

SEQ ID NO: 3303824 - RNA, 15 nt, Mycobacterium tuberculosis H37Rv
cguggcauccagcag

SEQ ID NO: 3303825 - RNA, 17 nt, Mycobacterium tuberculosis H37Rv
cguggccaauccggcgg

SEQ ID NO: 3303826 - RNA, 19 nt, Mycobacterium tuberculosis H37Rv
cguggccaauccggcggcg

SEQ ID NO: 3303827 - RNA, 22 nt, Mycobacterium tuberculosis H37Rv
cguggccaauccggcggcgacg

SEQ ID NO: 3303828 - RNA, 19 nt, Mycobacterium tuberculosis H37Rv
cguggccacggcauucgac

SEQ ID NO: 3303829 - RNA, 21 nt, Mycobacterium tuberculosis H37Rv
cguggcccaguccgcuggcca

SEQ ID NO: 3303830 - RNA, 21 nt, Mycobacterium tuberculosis H37Rv
cguggcccgcucccugcaccc

SEQ ID NO: 3303831 - RNA, 20 nt, Mycobacterium tuberculosis H37Rv
cguggccgcacugcugguca

SEQ ID NO: 3303832 - RNA, 14 nt, Mycobacterium tuberculosis H37Rv
cguggccggaccca

SEQ ID NO: 3303833 - RNA, 21 nt, Mycobacterium tuberculosis H37Rv
cguggccggucacguccgcgg

SEQ ID NO: 3303834 - RNA, 20 nt, Mycobacterium tuberculosis H37Rv
cguggccugaaacggcugca

SEQ ID NO: 3303835 - RNA, 20 nt, Mycobacterium tuberculosis H37Rv
cguggcgaaugacggccagu

SEQ ID NO: 3303836 - RNA, 21 nt, Mycobacterium tuberculosis H37Rv
cguggcgaaugacggccaguu

SEQ ID NO: 3303837 - RNA, 15 nt, Mycobacterium tuberculosis H37Rv
cguggcgaccacgau

SEQ ID NO: 3303838 - RNA, 16 nt, Mycobacterium tuberculosis H37Rv
cguggcgcaccaccgc

SEQ ID NO: 3303839 - RNA, 17 nt, Mycobacterium tuberculosis H37Rv
cguggcgcaccaccgcc

SEQ ID NO: 3303840 - RNA, 22 nt, Mycobacterium tuberculosis H37Rv
cguggcgcccgucuccagcacc

SEQ ID NO: 3303841 - RNA, 15 nt, Mycobacterium tuberculosis H37Rv
cguggcgcccgugcc

SEQ ID NO: 3303842 - RNA, 17 nt, Mycobacterium tuberculosis H37Rv
cguggcgcccgugccgc

SEQ ID NO: 3303843 - RNA, 18 nt, Mycobacterium tuberculosis H37Rv
cguggcgccggccacgag

SEQ ID NO: 3303844 - RNA, 14 nt, Mycobacterium tuberculosis H37Rv
cguggcgcucggcg

SEQ ID NO: 3303845 - RNA, 19 nt, Mycobacterium tuberculosis H37Rv
cguggcgcucggcgagcaa

SEQ ID NO: 3303846 - RNA, 15 nt, Mycobacterium tuberculosis H37Rv
cguggcggaucgcga

SEQ ID NO: 3303847 - RNA, 20 nt, Mycobacterium tuberculosis H37Rv
cguggcggaucgcgagcgcc

SEQ ID NO: 3303848 - RNA, 16 nt, Mycobacterium tuberculosis H37Rv
cguggcggccuccucc

SEQ ID NO: 3303849 - RNA, 13 nt, Mycobacterium tuberculosis H37Rv
cguggcggcgcgc

SEQ ID NO: 3303850 - RNA, 22 nt, Mycobacterium tuberculosis H37Rv
cguggcgggcugcagccgacag

SEQ ID NO: 3303851 - RNA, 16 nt, Mycobacterium tuberculosis H37Rv
cguggcggugagccgc

SEQ ID NO: 3303852 - RNA, 17 nt, Mycobacterium tuberculosis H37Rv
cguggcggugagccgcc

SEQ ID NO: 3303853 - RNA, 15 nt, Mycobacterium tuberculosis H37Rv
cguggcugcguucgc

SEQ ID NO: 3303854 - RNA, 18 nt, Mycobacterium tuberculosis H37Rv
cguggcuggcaccucccg

SEQ ID NO: 3303855 - RNA, 23 nt, Mycobacterium tuberculosis H37Rv
cguggcuggcaugccggcgugcg

SEQ ID NO: 3303856 - RNA, 23 nt, Mycobacterium tuberculosis H37Rv
cgugggagguggcgcggggccgc

SEQ ID NO: 3303857 - RNA, 16 nt, Mycobacterium tuberculosis H37Rv
cgugggcacucaucga

SEQ ID NO: 3303858 - RNA, 16 nt, Mycobacterium tuberculosis H37Rv
cgugggcaugcggauu

SEQ ID NO: 3303859 - RNA, 23 nt, Mycobacterium tuberculosis H37Rv
cgugggcaugcggauucgcgcug

SEQ ID NO: 3303860 - RNA, 20 nt, Mycobacterium tuberculosis H37Rv
cgugggccacuugaugcucg

SEQ ID NO: 3303861 - RNA, 23 nt, Mycobacterium tuberculosis H37Rv
cgugggccacuugaugcucgaug

SEQ ID NO: 3303862 - RNA, 18 nt, Mycobacterium tuberculosis H37Rv
cgugggcgcggcgccaga

SEQ ID NO: 3303863 - RNA, 20 nt, Mycobacterium tuberculosis H37Rv
cgugggcgugcaggcugguu

SEQ ID NO: 3303864 - RNA, 17 nt, Mycobacterium tuberculosis H37Rv
cguggggacuggcaggc

SEQ ID NO: 3303865 - RNA, 17 nt, Mycobacterium tuberculosis H37Rv
cgugggguguggcggcg

SEQ ID NO: 3303866 - RNA, 16 nt, Mycobacterium tuberculosis H37Rv
cguggguaccgagcag

SEQ ID NO: 3303867 - RNA, 22 nt, Mycobacterium tuberculosis H37Rv
cguggguacgcaucucgagcau

SEQ ID NO: 3303868 - RNA, 20 nt, Mycobacterium tuberculosis H37Rv
cgugggugucgguggccgcg

SEQ ID NO: 3303869 - RNA, 17 nt, Mycobacterium tuberculosis H37Rv
cgugguaaccagggcag

SEQ ID NO: 3303870 - RNA, 22 nt, Mycobacterium tuberculosis H37Rv
cgugguaccgcuuguccaccgu

SEQ ID NO: 3303871 - RNA, 19 nt, Mycobacterium tuberculosis H37Rv
cgugguacuuucacgcucg

SEQ ID NO: 3303872 - RNA, 14 nt, Mycobacterium tuberculosis H37Rv
cgugguagccggcg

SEQ ID NO: 3303873 - RNA, 15 nt, Mycobacterium tuberculosis H37Rv
cguuccgccgccucg

SEQ ID NO: 3303874 - RNA, 21 nt, Mycobacterium tuberculosis H37Rv
cguuccgcgacagcggcgucg

SEQ ID NO: 3303875 - RNA, 14 nt, Mycobacterium tuberculosis H37Rv
cguuccgcucgccg

SEQ ID NO: 3303876 - RNA, 16 nt, Mycobacterium tuberculosis H37Rv
cguuccgggccgauca

SEQ ID NO: 3303877 - RNA, 14 nt, Mycobacterium tuberculosis H37Rv
cguuccgggccggc

SEQ ID NO: 3303878 - RNA, 17 nt, Mycobacterium tuberculosis H37Rv
cguuccgggccggcgag

SEQ ID NO: 3303879 - RNA, 16 nt, Mycobacterium tuberculosis H37Rv
cguuccguugugcgcc

SEQ ID NO: 3303880 - RNA, 21 nt, Mycobacterium tuberculosis H37Rv
cguuccucgacguaggccagg

SEQ ID NO: 3303881 - RNA, 21 nt, Mycobacterium tuberculosis H37Rv
cguuccugaucgagcgccagc

SEQ ID NO: 3303882 - RNA, 18 nt, Mycobacterium tuberculosis H37Rv
cguucgaacuggcuggug

SEQ ID NO: 3303883 - RNA, 16 nt, Mycobacterium tuberculosis H37Rv
cguucgaaggccaccc

SEQ ID NO: 3303884 - RNA, 22 nt, Mycobacterium tuberculosis H37Rv
cguucgacucgaccgcgacggc

SEQ ID NO: 3303885 - RNA, 18 nt, Mycobacterium tuberculosis H37Rv
cguucgagagccccgacc

SEQ ID NO: 3303886 - RNA, 21 nt, Mycobacterium tuberculosis H37Rv
cguucgagagccccgaccagc

SEQ ID NO: 3303887 - RNA, 14 nt, Mycobacterium tuberculosis H37Rv
cguucgcccgcccg

SEQ ID NO: 3303888 - RNA, 15 nt, Mycobacterium tuberculosis H37Rv
cguucgcccgcccgu

SEQ ID NO: 3303889 - RNA, 23 nt, Mycobacterium tuberculosis H37Rv
cguucgccgaguauuggucggug

SEQ ID NO: 3303890 - RNA, 12 nt, Mycobacterium tuberculosis H37Rv
cguucgccgccc

SEQ ID NO: 3303891 - RNA, 14 nt, Mycobacterium tuberculosis H37Rv
cguucgccgcccgg

SEQ ID NO: 3303892 - RNA, 15 nt, Mycobacterium tuberculosis H37Rv
cguucgccgucggug

SEQ ID NO: 3303893 - RNA, 18 nt, Mycobacterium tuberculosis H37Rv
cguucgccgucggugaug

SEQ ID NO: 3303894 - RNA, 22 nt, Mycobacterium tuberculosis H37Rv
cguucgcgggcgucccgcauac

SEQ ID NO: 3303895 - RNA, 16 nt, Mycobacterium tuberculosis H37Rv
cguucggcaccugguu

SEQ ID NO: 3303896 - RNA, 15 nt, Mycobacterium tuberculosis H37Rv
cguucggccgggccg

SEQ ID NO: 3303897 - RNA, 15 nt, Mycobacterium tuberculosis H37Rv
cguucggcgacgcgc

SEQ ID NO: 3303898 - RNA, 19 nt, Mycobacterium tuberculosis H37Rv
cguucggcgacgcgccggu

SEQ ID NO: 3303899 - RNA, 15 nt, Mycobacterium tuberculosis H37Rv
cguucggcgcccgcu

SEQ ID NO: 3303900 - RNA, 15 nt, Mycobacterium tuberculosis H37Rv
cguucggcugccgcg

SEQ ID NO: 3303901 - RNA, 16 nt, Mycobacterium tuberculosis H37Rv
cguucgggcccguagc

SEQ ID NO: 3303902 - RNA, 18 nt, Mycobacterium tuberculosis H37Rv
cguucgggccguccuccc

SEQ ID NO: 3303903 - RNA, 16 nt, Mycobacterium tuberculosis H37Rv
cguucgggcuccagca

SEQ ID NO: 3303904 - RNA, 20 nt, Mycobacterium tuberculosis H37Rv
cguucggggccccgcggcgc

SEQ ID NO: 3303905 - RNA, 23 nt, Mycobacterium tuberculosis H37Rv
cguucggggccccgcggcgccgc

SEQ ID NO: 3303906 - RNA, 15 nt, Mycobacterium tuberculosis H37Rv
cguucgggucgagcc

SEQ ID NO: 3303907 - RNA, 13 nt, Mycobacterium tuberculosis H37Rv
cguucgggugagc

SEQ ID NO: 3303908 - RNA, 16 nt, Mycobacterium tuberculosis H37Rv
cguucgucaccacgau

SEQ ID NO: 3303909 - RNA, 16 nt, Mycobacterium tuberculosis H37Rv
cguucgucguggaucc

SEQ ID NO: 3303910 - RNA, 14 nt, Mycobacterium tuberculosis H37Rv
cguucgugagcggc

SEQ ID NO: 3303911 - RNA, 17 nt, Mycobacterium tuberculosis H37Rv
cguucucgauugucgcc

SEQ ID NO: 3303912 - RNA, 16 nt, Mycobacterium tuberculosis H37Rv
cguucucggcacccuc

SEQ ID NO: 3303913 - RNA, 20 nt, Mycobacterium tuberculosis H37Rv
cguucucggcacccucagcg

SEQ ID NO: 3303914 - RNA, 17 nt, Mycobacterium tuberculosis H37Rv
cguucuugggaccgacu

SEQ ID NO: 3303915 - RNA, 15 nt, Mycobacterium tuberculosis H37Rv
cguugaacgcgugcu

SEQ ID NO: 3303916 - RNA, 17 nt, Mycobacterium tuberculosis H37Rv
cguugaacggcaccagc

SEQ ID NO: 3303917 - RNA, 18 nt, Mycobacterium tuberculosis H37Rv
cguugaagaauccggccc

SEQ ID NO: 3303918 - RNA, 17 nt, Mycobacterium tuberculosis H37Rv
cguugaagcccaacagc

SEQ ID NO: 3303919 - RNA, 17 nt, Mycobacterium tuberculosis H37Rv
cguugaaggcgccggug

SEQ ID NO: 3303920 - RNA, 14 nt, Mycobacterium tuberculosis H37Rv
cguugaccucuucg

SEQ ID NO: 3303921 - RNA, 14 nt, Mycobacterium tuberculosis H37Rv
cguugaccugcaga

SEQ ID NO: 3303922 - RNA, 22 nt, Mycobacterium tuberculosis H37Rv
cguugacggcuucggcagccgc

SEQ ID NO: 3303923 - RNA, 20 nt, Mycobacterium tuberculosis H37Rv
cguugacgguugccccggcg

SEQ ID NO: 3303924 - RNA, 12 nt, Mycobacterium tuberculosis H37Rv
cguugacgucaa

SEQ ID NO: 3303925 - RNA, 17 nt, Mycobacterium tuberculosis H37Rv
cguugacguccaacagc

SEQ ID NO: 3303926 - RNA, 17 nt, Mycobacterium tuberculosis H37Rv
cguugacucugcgucca

SEQ ID NO: 3303927 - RNA, 19 nt, Mycobacterium tuberculosis H37Rv
cguugacucugcguccacc

SEQ ID NO: 3303928 - RNA, 20 nt, Mycobacterium tuberculosis H37Rv
cguugacucugcguccacca

SEQ ID NO: 3303929 - RNA, 15 nt, Mycobacterium tuberculosis H37Rv
cguugagaagcguca

SEQ ID NO: 3303930 - RNA, 22 nt, Mycobacterium tuberculosis H37Rv
cguugagaagcgucacaguccc

SEQ ID NO: 3303931 - RNA, 11 nt, Mycobacterium tuberculosis H37Rv
cguugaggccg

SEQ ID NO: 3303932 - RNA, 21 nt, Mycobacterium tuberculosis H37Rv
cguugagguaggugagcgcgc

SEQ ID NO: 3303933 - RNA, 23 nt, Mycobacterium tuberculosis H37Rv
cguugagguaggugagcgcgcuc

SEQ ID NO: 3303934 - RNA, 21 nt, Mycobacterium tuberculosis H37Rv
cguugagguucuucugcgcca

SEQ ID NO: 3303935 - RNA, 20 nt, Mycobacterium tuberculosis H37Rv
cguugaucacauucagcacg

SEQ ID NO: 3303936 - RNA, 17 nt, Mycobacterium tuberculosis H37Rv
cguugauccccagcucc

SEQ ID NO: 3303937 - RNA, 17 nt, Mycobacterium tuberculosis H37Rv
cguugaucccgaaccgu

SEQ ID NO: 3303938 - RNA, 16 nt, Mycobacterium tuberculosis H37Rv
cguugaucgucucggc

SEQ ID NO: 3303939 - RNA, 17 nt, Mycobacterium tuberculosis H37Rv
cguugaugaccgccgcc

SEQ ID NO: 3303940 - RNA, 20 nt, Mycobacterium tuberculosis H37Rv
cguugaugaugccggcguug

SEQ ID NO: 3303941 - RNA, 24 nt, Mycobacterium tuberculosis H37Rv
cguugaugccgccggagucgaaca

SEQ ID NO: 3303942 - RNA, 16 nt, Mycobacterium tuberculosis H37Rv
cguugaugucggccag

SEQ ID NO: 3303943 - RNA, 15 nt, Mycobacterium tuberculosis H37Rv
cguugauucgggagg

SEQ ID NO: 3303944 - RNA, 15 nt, Mycobacterium tuberculosis H37Rv
cguugcacagcuugg

SEQ ID NO: 3303945 - RNA, 13 nt, Mycobacterium tuberculosis H37Rv
cguugcaccauuc

SEQ ID NO: 3303946 - RNA, 21 nt, Mycobacterium tuberculosis H37Rv
cguugcaggacgcccacaugc

SEQ ID NO: 3303947 - RNA, 11 nt, Mycobacterium tuberculosis H37Rv
cguugcaggug

SEQ ID NO: 3303948 - RNA, 15 nt, Mycobacterium tuberculosis H37Rv
cguugcaucagcacg

SEQ ID NO: 3303949 - RNA, 16 nt, Mycobacterium tuberculosis H37Rv
cguugccaaagcccac

SEQ ID NO: 3303950 - RNA, 20 nt, Mycobacterium tuberculosis H37Rv
cguugccaacaacaucagcg

SEQ ID NO: 3303951 - RNA, 20 nt, Mycobacterium tuberculosis H37Rv
cguugccaagcagcugggca

SEQ ID NO: 3303952 - RNA, 22 nt, Mycobacterium tuberculosis H37Rv
cguugccaccggugccggcgac

SEQ ID NO: 3303953 - RNA, 12 nt, Mycobacterium tuberculosis H37Rv
cguugccaccgu

SEQ ID NO: 3303954 - RNA, 16 nt, Mycobacterium tuberculosis H37Rv
cguugccagggcgggc

SEQ ID NO: 3303955 - RNA, 13 nt, Mycobacterium tuberculosis H37Rv
cguugccauugcc

SEQ ID NO: 3303956 - RNA, 16 nt, Mycobacterium tuberculosis H37Rv
cguugcccccauugcc

SEQ ID NO: 3303957 - RNA, 22 nt, Mycobacterium tuberculosis H37Rv
cguugcccccauugccgccguc

SEQ ID NO: 3303958 - RNA, 20 nt, Mycobacterium tuberculosis H37Rv
cguugcccccguugccgccc

SEQ ID NO: 3303959 - RNA, 17 nt, Mycobacterium tuberculosis H37Rv
cguugcccgcgaaggca

SEQ ID NO: 3303960 - RNA, 19 nt, Mycobacterium tuberculosis H37Rv
cguugccgaaacccgaguu

SEQ ID NO: 3303961 - RNA, 18 nt, Mycobacterium tuberculosis H37Rv
cguugccgaucagcccgg

SEQ ID NO: 3303962 - RNA, 20 nt, Mycobacterium tuberculosis H37Rv
cguugccgaucugcucgccg

SEQ ID NO: 3303963 - RNA, 14 nt, Mycobacterium tuberculosis H37Rv
cguugccgcagacg

SEQ ID NO: 3303964 - RNA, 19 nt, Mycobacterium tuberculosis H37Rv
cguugccgcccacuagcag

SEQ ID NO: 3303965 - RNA, 16 nt, Mycobacterium tuberculosis H37Rv
cguugccgcccguccc

SEQ ID NO: 3303966 - RNA, 18 nt, Mycobacterium tuberculosis H37Rv
cguugccgccgaagccga

SEQ ID NO: 3303967 - RNA, 16 nt, Mycobacterium tuberculosis H37Rv
cguugccgccggcgcc

SEQ ID NO: 3303968 - RNA, 14 nt, Mycobacterium tuberculosis H37Rv
cguugccgccggug

SEQ ID NO: 3303969 - RNA, 16 nt, Mycobacterium tuberculosis H37Rv
cuaacggcagccaccg

SEQ ID NO: 3303970 - RNA, 17 nt, Mycobacterium tuberculosis H37Rv
cuaacggcagccaccgu

SEQ ID NO: 3303971 - RNA, 20 nt, Mycobacterium tuberculosis H37Rv
cuaacgucgaucucggcgca

SEQ ID NO: 3303972 - RNA, 12 nt, Mycobacterium tuberculosis H37Rv
cuaacucccccg

SEQ ID NO: 3303973 - RNA, 22 nt, Mycobacterium tuberculosis H37Rv
cuaacucgacccguaauugguu

SEQ ID NO: 3303974 - RNA, 15 nt, Mycobacterium tuberculosis H37Rv
cuaacuggcccggac

SEQ ID NO: 3303975 - RNA, 16 nt, Mycobacterium tuberculosis H37Rv
cuaaggcucaccaggc

SEQ ID NO: 3303976 - RNA, 16 nt, Mycobacterium tuberculosis H37Rv
cuaaggugggcacagc

SEQ ID NO: 3303977 - RNA, 13 nt, Mycobacterium tuberculosis H37Rv
cuaaucagccagg

SEQ ID NO: 3303978 - RNA, 15 nt, Mycobacterium tuberculosis H37Rv
cuaauucgccucgcc

SEQ ID NO: 3303979 - RNA, 18 nt, Mycobacterium tuberculosis H37Rv
cuacaucgaucagaugcg

SEQ ID NO: 3303980 - RNA, 22 nt, Mycobacterium tuberculosis H37Rv
cuacaugggggcguuggcgggc

SEQ ID NO: 3303981 - RNA, 20 nt, Mycobacterium tuberculosis H37Rv
cuaccaaccgguacuccugg

SEQ ID NO: 3303982 - RNA, 14 nt, Mycobacterium tuberculosis H37Rv
cuaccccggugaca

SEQ ID NO: 3303983 - RNA, 19 nt, Mycobacterium tuberculosis H37Rv
cuacccgcgcgaccugaau

SEQ ID NO: 3303984 - RNA, 21 nt, Mycobacterium tuberculosis H37Rv
cuacccgcgcgaccugaaugc

SEQ ID NO: 3303985 - RNA, 13 nt, Mycobacterium tuberculosis H37Rv
cuacccgggccag

SEQ ID NO: 3303986 - RNA, 15 nt, Mycobacterium tuberculosis H37Rv
cuacccgggccaggc

SEQ ID NO: 3303987 - RNA, 23 nt, Mycobacterium tuberculosis H37Rv
cuaccgaacaguaggccuccgcu

SEQ ID NO: 3303988 - RNA, 17 nt, Mycobacterium tuberculosis H37Rv
cuaccgagaucaccgcc

SEQ ID NO: 3303989 - RNA, 19 nt, Mycobacterium tuberculosis H37Rv
cuaccgagaucaccgccac

SEQ ID NO: 3303990 - RNA, 20 nt, Mycobacterium tuberculosis H37Rv
cuaccgagaucaccgccacc

SEQ ID NO: 3303991 - RNA, 21 nt, Mycobacterium tuberculosis H37Rv
cuaccgagaucaccgccacca

SEQ ID NO: 3303992 - RNA, 20 nt, Mycobacterium tuberculosis H37Rv
cuaccgagauugggcuggga

SEQ ID NO: 3303993 - RNA, 17 nt, Mycobacterium tuberculosis H37Rv
cuaccgcaggugccacc

SEQ ID NO: 3303994 - RNA, 18 nt, Mycobacterium tuberculosis H37Rv
cuaccgcccgcgccaccg

SEQ ID NO: 3303995 - RNA, 23 nt, Mycobacterium tuberculosis H37Rv
cuaccgccggcggcggccgcagc

SEQ ID NO: 3303996 - RNA, 18 nt, Mycobacterium tuberculosis H37Rv
cuaccggccuuuccagca

SEQ ID NO: 3303997 - RNA, 23 nt, Mycobacterium tuberculosis H37Rv
cuaccggccuuuccagcaccccg

SEQ ID NO: 3303998 - RNA, 23 nt, Mycobacterium tuberculosis H37Rv
cuaccggcuuggcgggaccguga

SEQ ID NO: 3303999 - RNA, 19 nt, Mycobacterium tuberculosis H37Rv
cuaccguacgcagcgugug

SEQ ID NO: 3304000 - RNA, 16 nt, Mycobacterium tuberculosis H37Rv
cuaccgucaguagcca

SEQ ID NO: 3304001 - RNA, 13 nt, Mycobacterium tuberculosis H37Rv
cuaccgucgacca

SEQ ID NO: 3304002 - RNA, 16 nt, Mycobacterium tuberculosis H37Rv
cuaccguuguugagga

SEQ ID NO: 3304003 - RNA, 13 nt, Mycobacterium tuberculosis H37Rv
cuaccuaacccgc

SEQ ID NO: 3304004 - RNA, 16 nt, Mycobacterium tuberculosis H37Rv
cuaccugcacccaggc

SEQ ID NO: 3304005 - RNA, 17 nt, Mycobacterium tuberculosis H37Rv
cuaccugcacccaggca

SEQ ID NO: 3304006 - RNA, 22 nt, Mycobacterium tuberculosis H37Rv
cuaccuguguugagcggcagcc

SEQ ID NO: 3304007 - RNA, 20 nt, Mycobacterium tuberculosis H37Rv
cuacgcagccguagcugggc

SEQ ID NO: 3304008 - RNA, 15 nt, Mycobacterium tuberculosis H37Rv
cuacgcagcgcggcu

SEQ ID NO: 3304009 - RNA, 14 nt, Mycobacterium tuberculosis H37Rv
cuacgccccacugc

SEQ ID NO: 3304010 - RNA, 22 nt, Mycobacterium tuberculosis H37Rv
cuacgccgggaauuucgacacg

SEQ ID NO: 3304011 - RNA, 17 nt, Mycobacterium tuberculosis H37Rv
cuacgcgcgcucgcuca

SEQ ID NO: 3304012 - RNA, 21 nt, Mycobacterium tuberculosis H37Rv
cuacgcgcgcucgcucaccgg

SEQ ID NO: 3304013 - RNA, 22 nt, Mycobacterium tuberculosis H37Rv
cuacgcgcgcucgcucaccggc

SEQ ID NO: 3304014 - RNA, 14 nt, Mycobacterium tuberculosis H37Rv
cuacggccuggcca

SEQ ID NO: 3304015 - RNA, 19 nt, Mycobacterium tuberculosis H37Rv
cuacggcugcccguucugc

SEQ ID NO: 3304016 - RNA, 22 nt, Mycobacterium tuberculosis H37Rv
cuacggggaucuauuggaugcg

SEQ ID NO: 3304017 - RNA, 23 nt, Mycobacterium tuberculosis H37Rv
cuacucauccagaagccggccac

SEQ ID NO: 3304018 - RNA, 18 nt, Mycobacterium tuberculosis H37Rv
cuacuccaacugaucccg

SEQ ID NO: 3304019 - RNA, 12 nt, Mycobacterium tuberculosis H37Rv
cuacucgcggcc

SEQ ID NO: 3304020 - RNA, 15 nt, Mycobacterium tuberculosis H37Rv
cuacucgcggccggc

SEQ ID NO: 3304021 - RNA, 13 nt, Mycobacterium tuberculosis H37Rv
cuacugcgaucgc

SEQ ID NO: 3304022 - RNA, 15 nt, Mycobacterium tuberculosis H37Rv
cuacuuuuccacccg

SEQ ID NO: 3304023 - RNA, 17 nt, Mycobacterium tuberculosis H37Rv
cuagaccgggcgguugg

SEQ ID NO: 3304024 - RNA, 15 nt, Mycobacterium tuberculosis H37Rv
cuagacugcugguca

SEQ ID NO: 3304025 - RNA, 22 nt, Mycobacterium tuberculosis H37Rv
cuagaggcggcccccggcagcg

SEQ ID NO: 3304026 - RNA, 16 nt, Mycobacterium tuberculosis H37Rv
cuagaucgccgagcgu

SEQ ID NO: 3304027 - RNA, 13 nt, Mycobacterium tuberculosis H37Rv
cuagcaccgcgcc

SEQ ID NO: 3304028 - RNA, 19 nt, Mycobacterium tuberculosis H37Rv
cuagcacggggaccgggcu

SEQ ID NO: 3304029 - RNA, 16 nt, Mycobacterium tuberculosis H37Rv
cuagcagagacaugcc

SEQ ID NO: 3304030 - RNA, 20 nt, Mycobacterium tuberculosis H37Rv
cuagcagcagcccgacagug

SEQ ID NO: 3304031 - RNA, 16 nt, Mycobacterium tuberculosis H37Rv
cuagcagcgcugcgau

SEQ ID NO: 3304032 - RNA, 18 nt, Mycobacterium tuberculosis H37Rv
cuagcagguacucgcccc

SEQ ID NO: 3304033 - RNA, 15 nt, Mycobacterium tuberculosis H37Rv
cuagcccggcagcac

SEQ ID NO: 3304034 - RNA, 16 nt, Mycobacterium tuberculosis H37Rv
cuagcccggcagcacg

SEQ ID NO: 3304035 - RNA, 14 nt, Mycobacterium tuberculosis H37Rv
cuagcccggcggcg

SEQ ID NO: 3304036 - RNA, 19 nt, Mycobacterium tuberculosis H37Rv
cuagcccgguaucgucccg

SEQ ID NO: 3304037 - RNA, 12 nt, Mycobacterium tuberculosis H37Rv
cuagccgaagcg

SEQ ID NO: 3304038 - RNA, 17 nt, Mycobacterium tuberculosis H37Rv
cuagccgcggcaccgcc

SEQ ID NO: 3304039 - RNA, 19 nt, Mycobacterium tuberculosis H37Rv
cuagccgggcgcgccggcc

SEQ ID NO: 3304040 - RNA, 19 nt, Mycobacterium tuberculosis H37Rv
cuagcgagcgcacaccggc

SEQ ID NO: 3304041 - RNA, 16 nt, Mycobacterium tuberculosis H37Rv
cuagcgccaaauccgg

SEQ ID NO: 3304042 - RNA, 21 nt, Mycobacterium tuberculosis H37Rv
cuagcgcccgaaccccgggcg

SEQ ID NO: 3304043 - RNA, 17 nt, Mycobacterium tuberculosis H37Rv
cuagcgccucgccggcc

SEQ ID NO: 3304044 - RNA, 11 nt, Mycobacterium tuberculosis H37Rv
cuagcgcggcg

SEQ ID NO: 3304045 - RNA, 16 nt, Mycobacterium tuberculosis H37Rv
cuagcgcggcgacgau

SEQ ID NO: 3304046 - RNA, 17 nt, Mycobacterium tuberculosis H37Rv
cuagcgcgggcucggug

SEQ ID NO: 3304047 - RNA, 18 nt, Mycobacterium tuberculosis H37Rv
cuagcgcuugcgaccccg

SEQ ID NO: 3304048 - RNA, 15 nt, Mycobacterium tuberculosis H37Rv
cuagcggcucaccgc

SEQ ID NO: 3304049 - RNA, 17 nt, Mycobacterium tuberculosis H37Rv
cuagcggcucaccgcgc

SEQ ID NO: 3304050 - RNA, 15 nt, Mycobacterium tuberculosis H37Rv
cuagcugcugaugcg

SEQ ID NO: 3304051 - RNA, 18 nt, Mycobacterium tuberculosis H37Rv
cuagcuugacaacccugu

SEQ ID NO: 3304052 - RNA, 20 nt, Mycobacterium tuberculosis H37Rv
cuagcuuggcggccagcgug

SEQ ID NO: 3304053 - RNA, 15 nt, Mycobacterium tuberculosis H37Rv
cuaggaacgccaccc

SEQ ID NO: 3304054 - RNA, 23 nt, Mycobacterium tuberculosis H37Rv
cuaggaagguggcccgcgcguac

SEQ ID NO: 3304055 - RNA, 21 nt, Mycobacterium tuberculosis H37Rv
cuaggaccaccagcgcuccag

SEQ ID NO: 3304056 - RNA, 23 nt, Mycobacterium tuberculosis H37Rv
cuaggacgccgcccucucacggc

SEQ ID NO: 3304057 - RNA, 13 nt, Mycobacterium tuberculosis H37Rv
cuaggcaugccac

SEQ ID NO: 3304058 - RNA, 16 nt, Mycobacterium tuberculosis H37Rv
cuaggcaugccacaca

SEQ ID NO: 3304059 - RNA, 20 nt, Mycobacterium tuberculosis H37Rv
cuaggccaaaccccugcacg

SEQ ID NO: 3304060 - RNA, 19 nt, Mycobacterium tuberculosis H37Rv
cuaggccaagccgcggcua

SEQ ID NO: 3304061 - RNA, 19 nt, Mycobacterium tuberculosis H37Rv
cuaggccaccggcgaccga

SEQ ID NO: 3304062 - RNA, 16 nt, Mycobacterium tuberculosis H37Rv
cuaggccagcacggcg

SEQ ID NO: 3304063 - RNA, 14 nt, Mycobacterium tuberculosis H37Rv
cuaggcccagcacg

SEQ ID NO: 3304064 - RNA, 14 nt, Mycobacterium tuberculosis H37Rv
cuagggugagcccg

SEQ ID NO: 3304065 - RNA, 15 nt, Mycobacterium tuberculosis H37Rv
cucagcggcucgccu

SEQ ID NO: 3304066 - RNA, 14 nt, Mycobacterium tuberculosis H37Rv
cucagcgguagagc

SEQ ID NO: 3304067 - RNA, 18 nt, Mycobacterium tuberculosis H37Rv
cucagcgguagagcucug

SEQ ID NO: 3304068 - RNA, 20 nt, Mycobacterium tuberculosis H37Rv
cucagcgguggcguggugga

SEQ ID NO: 3304069 - RNA, 14 nt, Mycobacterium tuberculosis H37Rv
cucaggccgguacc

SEQ ID NO: 3304070 - RNA, 14 nt, Mycobacterium tuberculosis H37Rv
cucaggucaccggc

SEQ ID NO: 3304071 - RNA, 12 nt, Mycobacterium tuberculosis H37Rv
cucaggucaucg

SEQ ID NO: 3304072 - RNA, 19 nt, Mycobacterium tuberculosis H37Rv
cucaggucgacaggugcca

SEQ ID NO: 3304073 - RNA, 14 nt, Mycobacterium tuberculosis H37Rv
cucagucacgcacu

SEQ ID NO: 3304074 - RNA, 16 nt, Mycobacterium tuberculosis H37Rv
cucagucgcucucggg

SEQ ID NO: 3304075 - RNA, 17 nt, Mycobacterium tuberculosis H37Rv
cucaguucacguucggc

SEQ ID NO: 3304076 - RNA, 21 nt, Mycobacterium tuberculosis H37Rv
cucaguucugcacagugcggc

SEQ ID NO: 3304077 - RNA, 16 nt, Mycobacterium tuberculosis H37Rv
cucaguuuggcgggug

SEQ ID NO: 3304078 - RNA, 16 nt, Mycobacterium tuberculosis H37Rv
cucaguuuuccccugu

SEQ ID NO: 3304079 - RNA, 23 nt, Mycobacterium tuberculosis H37Rv
cucauagcgacggcgcucggcga

SEQ ID NO: 3304080 - RNA, 20 nt, Mycobacterium tuberculosis H37Rv
cucauaggccugcagccgau

SEQ ID NO: 3304081 - RNA, 23 nt, Mycobacterium tuberculosis H37Rv
cucaucaaacccccggggcgcuc

SEQ ID NO: 3304082 - RNA, 15 nt, Mycobacterium tuberculosis H37Rv
cucauccgccgggcc

SEQ ID NO: 3304083 - RNA, 22 nt, Mycobacterium tuberculosis H37Rv
cucaucgaagcuucggccuucu

SEQ ID NO: 3304084 - RNA, 18 nt, Mycobacterium tuberculosis H37Rv
cucaucgacucgacccgg

SEQ ID NO: 3304085 - RNA, 13 nt, Mycobacterium tuberculosis H37Rv
cucaucgcagacg

SEQ ID NO: 3304086 - RNA, 20 nt, Mycobacterium tuberculosis H37Rv
cucaucgcagacggcugcca

SEQ ID NO: 3304087 - RNA, 13 nt, Mycobacterium tuberculosis H37Rv
cucaucgccgcua

SEQ ID NO: 3304088 - RNA, 16 nt, Mycobacterium tuberculosis H37Rv
cucaucgcggucgcca

SEQ ID NO: 3304089 - RNA, 18 nt, Mycobacterium tuberculosis H37Rv
cucaucgcggucgccacc

SEQ ID NO: 3304090 - RNA, 17 nt, Mycobacterium tuberculosis H37Rv
cucaucggacagcgccu

SEQ ID NO: 3304091 - RNA, 20 nt, Mycobacterium tuberculosis H37Rv
cucaucggacagcgccuggc

SEQ ID NO: 3304092 - RNA, 19 nt, Mycobacterium tuberculosis H37Rv
cucaucguggggaucgacc

SEQ ID NO: 3304093 - RNA, 24 nt, Mycobacterium tuberculosis H37Rv
cucaugaugccggacgccaugccc

SEQ ID NO: 3304094 - RNA, 15 nt, Mycobacterium tuberculosis H37Rv
cucaugcacccggua

SEQ ID NO: 3304095 - RNA, 16 nt, Mycobacterium tuberculosis H37Rv
cucaugccgagcgacc

SEQ ID NO: 3304096 - RNA, 18 nt, Mycobacterium tuberculosis H37Rv
cucaugccgagcgaccgu

SEQ ID NO: 3304097 - RNA, 14 nt, Mycobacterium tuberculosis H37Rv
cucaugggcgccau

SEQ ID NO: 3304098 - RNA, 15 nt, Mycobacterium tuberculosis H37Rv
cucauguucucgacc

SEQ ID NO: 3304099 - RNA, 19 nt, Mycobacterium tuberculosis H37Rv
cucauugccguucucgucg

SEQ ID NO: 3304100 - RNA, 17 nt, Mycobacterium tuberculosis H37Rv
cucauuggcauugccca

SEQ ID NO: 3304101 - RNA, 20 nt, Mycobacterium tuberculosis H37Rv
cuccaaaagccucagccgcu

SEQ ID NO: 3304102 - RNA, 19 nt, Mycobacterium tuberculosis H37Rv
cuccaaaaucgcggccaca

SEQ ID NO: 3304103 - RNA, 16 nt, Mycobacterium tuberculosis H37Rv
cuccaacugaucccgu

SEQ ID NO: 3304104 - RNA, 21 nt, Mycobacterium tuberculosis H37Rv
cuccaagcaauuccaccgccg

SEQ ID NO: 3304105 - RNA, 22 nt, Mycobacterium tuberculosis H37Rv
cuccaagccgggugggagcagc

SEQ ID NO: 3304106 - RNA, 21 nt, Mycobacterium tuberculosis H37Rv
cuccaagcgcgguugcgcuac

SEQ ID NO: 3304107 - RNA, 14 nt, Mycobacterium tuberculosis H37Rv
cuccaagcucgaca

SEQ ID NO: 3304108 - RNA, 16 nt, Mycobacterium tuberculosis H37Rv
cuccaagcucgacaac

SEQ ID NO: 3304109 - RNA, 17 nt, Mycobacterium tuberculosis H37Rv
cuccaaggcggucacca

SEQ ID NO: 3304110 - RNA, 21 nt, Mycobacterium tuberculosis H37Rv
cuccaaggcggucaccaccgu

SEQ ID NO: 3304111 - RNA, 18 nt, Mycobacterium tuberculosis H37Rv
cuccaauugcggccgcgc

SEQ ID NO: 3304112 - RNA, 22 nt, Mycobacterium tuberculosis H37Rv
cuccacauacgcggcggccuga

SEQ ID NO: 3304113 - RNA, 23 nt, Mycobacterium tuberculosis H37Rv
cuccacauacgcggcggccugag

SEQ ID NO: 3304114 - RNA, 14 nt, Mycobacterium tuberculosis H37Rv
cuccaccaccgacg

SEQ ID NO: 3304115 - RNA, 18 nt, Mycobacterium tuberculosis H37Rv
cuccaccaccgucgagcc

SEQ ID NO: 3304116 - RNA, 17 nt, Mycobacterium tuberculosis H37Rv
cuccaccaggacguggu

SEQ ID NO: 3304117 - RNA, 22 nt, Mycobacterium tuberculosis H37Rv
cuccacccaccuggaucagcgu

SEQ ID NO: 3304118 - RNA, 14 nt, Mycobacterium tuberculosis H37Rv
cuccacccaggccg

SEQ ID NO: 3304119 - RNA, 21 nt, Mycobacterium tuberculosis H37Rv
cuccacccccacgcugcagau

SEQ ID NO: 3304120 - RNA, 21 nt, Mycobacterium tuberculosis H37Rv
cuccaccgaaaaguccgccgc

SEQ ID NO: 3304121 - RNA, 15 nt, Mycobacterium tuberculosis H37Rv
cuccaccgcgaugac

SEQ ID NO: 3304122 - RNA, 15 nt, Mycobacterium tuberculosis H37Rv
cuccaccgcgccguc

SEQ ID NO: 3304123 - RNA, 20 nt, Mycobacterium tuberculosis H37Rv
cuccaccgcgccgucgucga

SEQ ID NO: 3304124 - RNA, 19 nt, Mycobacterium tuberculosis H37Rv
cuccaccgcguccaggugc

SEQ ID NO: 3304125 - RNA, 13 nt, Mycobacterium tuberculosis H37Rv
cuccaccgcuggc

SEQ ID NO: 3304126 - RNA, 13 nt, Mycobacterium tuberculosis H37Rv
cuccaccgggccc

SEQ ID NO: 3304127 - RNA, 15 nt, Mycobacterium tuberculosis H37Rv
cuccaccgggcccgc

SEQ ID NO: 3304128 - RNA, 23 nt, Mycobacterium tuberculosis H37Rv
cuccaccgggcccgccguccccg

SEQ ID NO: 3304129 - RNA, 23 nt, Mycobacterium tuberculosis H37Rv
cuccaccgucgcaccagcgaacg

SEQ ID NO: 3304130 - RNA, 23 nt, Mycobacterium tuberculosis H37Rv
cuccacgagguugggccgguuga

SEQ ID NO: 3304131 - RNA, 13 nt, Mycobacterium tuberculosis H37Rv
cuccacgaucggc

SEQ ID NO: 3304132 - RNA, 16 nt, Mycobacterium tuberculosis H37Rv
cuccacgccguugauc

SEQ ID NO: 3304133 - RNA, 16 nt, Mycobacterium tuberculosis H37Rv
cuccacgcuggcgccc

SEQ ID NO: 3304134 - RNA, 19 nt, Mycobacterium tuberculosis H37Rv
cuccacggcgggaacggug

SEQ ID NO: 3304135 - RNA, 23 nt, Mycobacterium tuberculosis H37Rv
cuccacggucaggcguagguccu

SEQ ID NO: 3304136 - RNA, 21 nt, Mycobacterium tuberculosis H37Rv
cuccacgucaucuggcgcugc

SEQ ID NO: 3304137 - RNA, 17 nt, Mycobacterium tuberculosis H37Rv
cuccacuuggggcgcca

SEQ ID NO: 3304138 - RNA, 18 nt, Mycobacterium tuberculosis H37Rv
cuccacuuucugcgguca

SEQ ID NO: 3304139 - RNA, 23 nt, Mycobacterium tuberculosis H37Rv
cuccagaaccgaagccucggcau

SEQ ID NO: 3304140 - RNA, 17 nt, Mycobacterium tuberculosis H37Rv
cuccagagacagcgcca

SEQ ID NO: 3304141 - RNA, 17 nt, Mycobacterium tuberculosis H37Rv
cuccagauaccaccgcc

SEQ ID NO: 3304142 - RNA, 15 nt, Mycobacterium tuberculosis H37Rv
cuccagauccacgcc

SEQ ID NO: 3304143 - RNA, 21 nt, Mycobacterium tuberculosis H37Rv
cuccagauccacgccgaccau

SEQ ID NO: 3304144 - RNA, 22 nt, Mycobacterium tuberculosis H37Rv
cuccagauccgggcaugcgccg

SEQ ID NO: 3304145 - RNA, 15 nt, Mycobacterium tuberculosis H37Rv
cuccagauucgccgc

SEQ ID NO: 3304146 - RNA, 16 nt, Mycobacterium tuberculosis H37Rv
cuccagcaaggccagc

SEQ ID NO: 3304147 - RNA, 14 nt, Mycobacterium tuberculosis H37Rv
cuccagcaccaccg

SEQ ID NO: 3304148 - RNA, 18 nt, Mycobacterium tuberculosis H37Rv
cuccagcaccaccggaac

SEQ ID NO: 3304149 - RNA, 15 nt, Mycobacterium tuberculosis H37Rv
cuccagcaccacggc

SEQ ID NO: 3304150 - RNA, 16 nt, Mycobacterium tuberculosis H37Rv
cuccagcaccacggcg

SEQ ID NO: 3304151 - RNA, 22 nt, Mycobacterium tuberculosis H37Rv
cuccagcaccacggcgcgcgcg

SEQ ID NO: 3304152 - RNA, 15 nt, Mycobacterium tuberculosis H37Rv
cuccagcaccagcac

SEQ ID NO: 3304153 - RNA, 17 nt, Mycobacterium tuberculosis H37Rv
cuccagcaccagcacgg

SEQ ID NO: 3304154 - RNA, 13 nt, Mycobacterium tuberculosis H37Rv
cuccagcacccgg

SEQ ID NO: 3304155 - RNA, 22 nt, Mycobacterium tuberculosis H37Rv
cuccagcacccggucgauucgg

SEQ ID NO: 3304156 - RNA, 14 nt, Mycobacterium tuberculosis H37Rv
cuccagcagcgcca

SEQ ID NO: 3304157 - RNA, 16 nt, Mycobacterium tuberculosis H37Rv
cuccagcgcccgguca

SEQ ID NO: 3304158 - RNA, 19 nt, Mycobacterium tuberculosis H37Rv
cuccagcgcgcgccgcagc

SEQ ID NO: 3304159 - RNA, 14 nt, Mycobacterium tuberculosis H37Rv
cuccagcucggcca

SEQ ID NO: 3304160 - RNA, 20 nt, Mycobacterium tuberculosis H37Rv
cuccagcucggccagugccg

SEQ ID NO: 3304161 - RNA, 14 nt, Mycobacterium tuberculosis H37Rv
cuccgcggcgcgca

SEQ ID NO: 3304162 - RNA, 21 nt, Mycobacterium tuberculosis H37Rv
cuccgcggcucaaucuccucc

SEQ ID NO: 3304163 - RNA, 22 nt, Mycobacterium tuberculosis H37Rv
cuccgcgggguugauugacccg

SEQ ID NO: 3304164 - RNA, 19 nt, Mycobacterium tuberculosis H37Rv
cuccgcgguuguuucggcg

SEQ ID NO: 3304165 - RNA, 15 nt, Mycobacterium tuberculosis H37Rv
cuccgcguugggcac

SEQ ID NO: 3304166 - RNA, 19 nt, Mycobacterium tuberculosis H37Rv
cuccgcugaugagccgcag

SEQ ID NO: 3304167 - RNA, 14 nt, Mycobacterium tuberculosis H37Rv
cuccgcugccgccc

SEQ ID NO: 3304168 - RNA, 16 nt, Mycobacterium tuberculosis H37Rv
cuccgcugccgcccgc

SEQ ID NO: 3304169 - RNA, 19 nt, Mycobacterium tuberculosis H37Rv
cuccggacaccccgcacgg

SEQ ID NO: 3304170 - RNA, 22 nt, Mycobacterium tuberculosis H37Rv
cuccggacccuuacccggcgcg

SEQ ID NO: 3304171 - RNA, 19 nt, Mycobacterium tuberculosis H37Rv
cuccggagaauccgggacg

SEQ ID NO: 3304172 - RNA, 18 nt, Mycobacterium tuberculosis H37Rv
cuccggauaacccagcgg

SEQ ID NO: 3304173 - RNA, 19 nt, Mycobacterium tuberculosis H37Rv
cuccggauaacccagcggc

SEQ ID NO: 3304174 - RNA, 20 nt, Mycobacterium tuberculosis H37Rv
cuccggauccucggccgcca

SEQ ID NO: 3304175 - RNA, 16 nt, Mycobacterium tuberculosis H37Rv
cuccggaucgccgaau

SEQ ID NO: 3304176 - RNA, 22 nt, Mycobacterium tuberculosis H37Rv
cuccggcaagcacaccgccagc

SEQ ID NO: 3304177 - RNA, 19 nt, Mycobacterium tuberculosis H37Rv
cuccggcaccaacgccacc

SEQ ID NO: 3304178 - RNA, 12 nt, Mycobacterium tuberculosis H37Rv
cuccggccaggg

SEQ ID NO: 3304179 - RNA, 22 nt, Mycobacterium tuberculosis H37Rv
cuccggccaggggaucaccggc

SEQ ID NO: 3304180 - RNA, 21 nt, Mycobacterium tuberculosis H37Rv
cuccggcccugccgccggccc

SEQ ID NO: 3304181 - RNA, 22 nt, Mycobacterium tuberculosis H37Rv
cuccggcgcaccugggcugccg

SEQ ID NO: 3304182 - RNA, 16 nt, Mycobacterium tuberculosis H37Rv
cuccggcgcagcgacc

SEQ ID NO: 3304183 - RNA, 16 nt, Mycobacterium tuberculosis H37Rv
cuccggcgccgcccga

SEQ ID NO: 3304184 - RNA, 22 nt, Mycobacterium tuberculosis H37Rv
cuccggcgccgcccgaggcacc

SEQ ID NO: 3304185 - RNA, 22 nt, Mycobacterium tuberculosis H37Rv
cuccggcggcgaagaagccggc

SEQ ID NO: 3304186 - RNA, 16 nt, Mycobacterium tuberculosis H37Rv
cuccgggaugaagcuc

SEQ ID NO: 3304187 - RNA, 22 nt, Mycobacterium tuberculosis H37Rv
cuccggggugaacgcggacacc

SEQ ID NO: 3304188 - RNA, 19 nt, Mycobacterium tuberculosis H37Rv
cuccggguauggcggcgac

SEQ ID NO: 3304189 - RNA, 14 nt, Mycobacterium tuberculosis H37Rv
cuccggguggcggc

SEQ ID NO: 3304190 - RNA, 17 nt, Mycobacterium tuberculosis H37Rv
cuccggguggcggcggc

SEQ ID NO: 3304191 - RNA, 17 nt, Mycobacterium tuberculosis H37Rv
cuccggguuggcgacga

SEQ ID NO: 3304192 - RNA, 14 nt, Mycobacterium tuberculosis H37Rv
cuccgguaucggcg

SEQ ID NO: 3304193 - RNA, 23 nt, Mycobacterium tuberculosis H37Rv
cuccgguaucggcgaccagcugu

SEQ ID NO: 3304194 - RNA, 16 nt, Mycobacterium tuberculosis H37Rv
cuccggucccgcauac

SEQ ID NO: 3304195 - RNA, 22 nt, Mycobacterium tuberculosis H37Rv
cuccguaaacgaggucgccgca

SEQ ID NO: 3304196 - RNA, 22 nt, Mycobacterium tuberculosis H37Rv
cuccguaacgccaagcucggcc

SEQ ID NO: 3304197 - RNA, 23 nt, Mycobacterium tuberculosis H37Rv
cuccguaacgccaagcucggccc

SEQ ID NO: 3304198 - RNA, 16 nt, Mycobacterium tuberculosis H37Rv
cuccgucggccaggcc

SEQ ID NO: 3304199 - RNA, 14 nt, Mycobacterium tuberculosis H37Rv
cuccgucguaguug

SEQ ID NO: 3304200 - RNA, 16 nt, Mycobacterium tuberculosis H37Rv
cuccgugaucgaggcg

SEQ ID NO: 3304201 - RNA, 16 nt, Mycobacterium tuberculosis H37Rv
cuccguuuggcugccg

SEQ ID NO: 3304202 - RNA, 23 nt, Mycobacterium tuberculosis H37Rv
cuccuagccaacgagcgcgcugc

SEQ ID NO: 3304203 - RNA, 19 nt, Mycobacterium tuberculosis H37Rv
cuccucacggauccgccgg

SEQ ID NO: 3304204 - RNA, 18 nt, Mycobacterium tuberculosis H37Rv
cuccuccggaaagcucuc

SEQ ID NO: 3304205 - RNA, 14 nt, Mycobacterium tuberculosis H37Rv
cuccuccggcacca

SEQ ID NO: 3304206 - RNA, 15 nt, Mycobacterium tuberculosis H37Rv
cuccuccggcaccaa

SEQ ID NO: 3304207 - RNA, 20 nt, Mycobacterium tuberculosis H37Rv
cuccuccguuuggcugccga

SEQ ID NO: 3304208 - RNA, 23 nt, Mycobacterium tuberculosis H37Rv
cuccuccuugagccgggcaacca

SEQ ID NO: 3304209 - RNA, 19 nt, Mycobacterium tuberculosis H37Rv
cuccucgaauucgcgcucu

SEQ ID NO: 3304210 - RNA, 21 nt, Mycobacterium tuberculosis H37Rv
cuccucgaauucgcgcucugg

SEQ ID NO: 3304211 - RNA, 18 nt, Mycobacterium tuberculosis H37Rv
cuccucgaccguggcggc

SEQ ID NO: 3304212 - RNA, 19 nt, Mycobacterium tuberculosis H37Rv
cuccucgauagcggcgccu

SEQ ID NO: 3304213 - RNA, 22 nt, Mycobacterium tuberculosis H37Rv
cuccucgauagcggcgccugac

SEQ ID NO: 3304214 - RNA, 14 nt, Mycobacterium tuberculosis H37Rv
cuccucggccagcg

SEQ ID NO: 3304215 - RNA, 17 nt, Mycobacterium tuberculosis H37Rv
cuccucgucgacgucgg

SEQ ID NO: 3304216 - RNA, 19 nt, Mycobacterium tuberculosis H37Rv
cuccucgucgacgucggca

SEQ ID NO: 3304217 - RNA, 14 nt, Mycobacterium tuberculosis H37Rv
cuccucgucgcucc

SEQ ID NO: 3304218 - RNA, 21 nt, Mycobacterium tuberculosis H37Rv
cuccucgucgguuccgggcgc

SEQ ID NO: 3304219 - RNA, 15 nt, Mycobacterium tuberculosis H37Rv
cuccucgugcacgca

SEQ ID NO: 3304220 - RNA, 17 nt, Mycobacterium tuberculosis H37Rv
cuccucgugcacgcaca

SEQ ID NO: 3304221 - RNA, 14 nt, Mycobacterium tuberculosis H37Rv
cuccugaacgaaau

SEQ ID NO: 3304222 - RNA, 19 nt, Mycobacterium tuberculosis H37Rv
cuccugagaugcggccaug

SEQ ID NO: 3304223 - RNA, 21 nt, Mycobacterium tuberculosis H37Rv
cuccugaguugcggugugccg

SEQ ID NO: 3304224 - RNA, 12 nt, Mycobacterium tuberculosis H37Rv
cuccugcacaca

SEQ ID NO: 3304225 - RNA, 13 nt, Mycobacterium tuberculosis H37Rv
cuccugcagcccg

SEQ ID NO: 3304226 - RNA, 13 nt, Mycobacterium tuberculosis H37Rv
cuccugcccuccg

SEQ ID NO: 3304227 - RNA, 17 nt, Mycobacterium tuberculosis H37Rv
cuccugcuggcccugcu

SEQ ID NO: 3304228 - RNA, 22 nt, Mycobacterium tuberculosis H37Rv
cuccuggaaaggacggccggcc

SEQ ID NO: 3304229 - RNA, 16 nt, Mycobacterium tuberculosis H37Rv
cuccuggcaaccgaau

SEQ ID NO: 3304230 - RNA, 18 nt, Mycobacterium tuberculosis H37Rv
cuccuggcgaaugucgcu

SEQ ID NO: 3304231 - RNA, 20 nt, Mycobacterium tuberculosis H37Rv
cuccuguaacugcuccuggu

SEQ ID NO: 3304232 - RNA, 17 nt, Mycobacterium tuberculosis H37Rv
cuccuugaaccgggaca

SEQ ID NO: 3304233 - RNA, 14 nt, Mycobacterium tuberculosis H37Rv
cuccuugaggucac

SEQ ID NO: 3304234 - RNA, 17 nt, Mycobacterium tuberculosis H37Rv
cuccuuggccguucggc

SEQ ID NO: 3304235 - RNA, 23 nt, Mycobacterium tuberculosis H37Rv
cuccuugggcgacgcggcgccgc

SEQ ID NO: 3304236 - RNA, 16 nt, Mycobacterium tuberculosis H37Rv
cuccuugugccugcug

SEQ ID NO: 3304237 - RNA, 21 nt, Mycobacterium tuberculosis H37Rv
cuccuuugcgggacuaggucc

SEQ ID NO: 3304238 - RNA, 19 nt, Mycobacterium tuberculosis H37Rv
cucgaaacgcuuacccagc

SEQ ID NO: 3304239 - RNA, 21 nt, Mycobacterium tuberculosis H37Rv
cucgaacaucggaacgugacc

SEQ ID NO: 3304240 - RNA, 14 nt, Mycobacterium tuberculosis H37Rv
cucgaacgccgccc

SEQ ID NO: 3304241 - RNA, 16 nt, Mycobacterium tuberculosis H37Rv
cucgaacucggcggcc

SEQ ID NO: 3304242 - RNA, 20 nt, Mycobacterium tuberculosis H37Rv
cucgaacucggcggccagcg

SEQ ID NO: 3304243 - RNA, 19 nt, Mycobacterium tuberculosis H37Rv
cucgaacugggucggcacg

SEQ ID NO: 3304244 - RNA, 19 nt, Mycobacterium tuberculosis H37Rv
cucgaaggccgccaaccgu

SEQ ID NO: 3304245 - RNA, 16 nt, Mycobacterium tuberculosis H37Rv
cucgaaggcguucgac

SEQ ID NO: 3304246 - RNA, 21 nt, Mycobacterium tuberculosis H37Rv
cucgaaggcguucgacucgac

SEQ ID NO: 3304247 - RNA, 13 nt, Mycobacterium tuberculosis H37Rv
cucgaagugcagg

SEQ ID NO: 3304248 - RNA, 17 nt, Mycobacterium tuberculosis H37Rv
cucgaaugucacaccgg

SEQ ID NO: 3304249 - RNA, 19 nt, Mycobacterium tuberculosis H37Rv
cucgacaacugcccgauga

SEQ ID NO: 3304250 - RNA, 17 nt, Mycobacterium tuberculosis H37Rv
cucgacacccagccgca

SEQ ID NO: 3304251 - RNA, 12 nt, Mycobacterium tuberculosis H37Rv
cucgacaccgac

SEQ ID NO: 3304252 - RNA, 14 nt, Mycobacterium tuberculosis H37Rv
cucgacacgccggu

SEQ ID NO: 3304253 - RNA, 16 nt, Mycobacterium tuberculosis H37Rv
cucgacacgccgugcg

SEQ ID NO: 3304254 - RNA, 19 nt, Mycobacterium tuberculosis H37Rv
cucgacauccucgauggac

SEQ ID NO: 3304255 - RNA, 17 nt, Mycobacterium tuberculosis H37Rv
cucgaccaccgccggcc

SEQ ID NO: 3304256 - RNA, 20 nt, Mycobacterium tuberculosis H37Rv
cucgaccaccgccggcccgc

SEQ ID NO: 3304257 - RNA, 13 nt, Mycobacterium tuberculosis H37Rv
cucgcccaccacc

SEQ ID NO: 3304258 - RNA, 17 nt, Mycobacterium tuberculosis H37Rv
cucgcccaccaccacug

SEQ ID NO: 3304259 - RNA, 22 nt, Mycobacterium tuberculosis H37Rv
cucgcccaccaccacugcggcc

SEQ ID NO: 3304260 - RNA, 15 nt, Mycobacterium tuberculosis H37Rv
cucgcccaccuccug

SEQ ID NO: 3304261 - RNA, 21 nt, Mycobacterium tuberculosis H37Rv
cucgcccaccuccugguugac

SEQ ID NO: 3304262 - RNA, 11 nt, Mycobacterium tuberculosis H37Rv
cucgcccaggg

SEQ ID NO: 3304263 - RNA, 15 nt, Mycobacterium tuberculosis H37Rv
cucgcccgcaccagc

SEQ ID NO: 3304264 - RNA, 23 nt, Mycobacterium tuberculosis H37Rv
cucgcccugacgucacguucggc

SEQ ID NO: 3304265 - RNA, 22 nt, Mycobacterium tuberculosis H37Rv
cucgcccugagaacacguucgg

SEQ ID NO: 3304266 - RNA, 13 nt, Mycobacterium tuberculosis H37Rv
cucgcccugcaga

SEQ ID NO: 3304267 - RNA, 16 nt, Mycobacterium tuberculosis H37Rv
cucgcccuugaccgaa

SEQ ID NO: 3304268 - RNA, 21 nt, Mycobacterium tuberculosis H37Rv
cucgccgaaaagggcgacagc

SEQ ID NO: 3304269 - RNA, 12 nt, Mycobacterium tuberculosis H37Rv
cucgccgaagcg

SEQ ID NO: 3304270 - RNA, 14 nt, Mycobacterium tuberculosis H37Rv
cucgccgaccagcu

SEQ ID NO: 3304271 - RNA, 19 nt, Mycobacterium tuberculosis H37Rv
cucgccgacggcaagggca

SEQ ID NO: 3304272 - RNA, 14 nt, Mycobacterium tuberculosis H37Rv
cucgccgagcucgg

SEQ ID NO: 3304273 - RNA, 14 nt, Mycobacterium tuberculosis H37Rv
cucgccgagcugug

SEQ ID NO: 3304274 - RNA, 21 nt, Mycobacterium tuberculosis H37Rv
cucgccgagcugugcgcagac

SEQ ID NO: 3304275 - RNA, 23 nt, Mycobacterium tuberculosis H37Rv
cucgccgaggccuaccaggcgcg

SEQ ID NO: 3304276 - RNA, 17 nt, Mycobacterium tuberculosis H37Rv
cucgccgcacgccggca

SEQ ID NO: 3304277 - RNA, 18 nt, Mycobacterium tuberculosis H37Rv
cucgccgcacgccggcau

SEQ ID NO: 3304278 - RNA, 19 nt, Mycobacterium tuberculosis H37Rv
cucgccgcacgccggcaug

SEQ ID NO: 3304279 - RNA, 14 nt, Mycobacterium tuberculosis H37Rv
cucgccgccgcugu

SEQ ID NO: 3304280 - RNA, 12 nt, Mycobacterium tuberculosis H37Rv
cucgccgcgcgu

SEQ ID NO: 3304281 - RNA, 22 nt, Mycobacterium tuberculosis H37Rv
cucgccggaucguucgcgugcc

SEQ ID NO: 3304282 - RNA, 14 nt, Mycobacterium tuberculosis H37Rv
cucgccggcacgca

SEQ ID NO: 3304283 - RNA, 14 nt, Mycobacterium tuberculosis H37Rv
cucgccggccaacu

SEQ ID NO: 3304284 - RNA, 16 nt, Mycobacterium tuberculosis H37Rv
cucgccggccacccgc

SEQ ID NO: 3304285 - RNA, 18 nt, Mycobacterium tuberculosis H37Rv
cucgccggccgccagccg

SEQ ID NO: 3304286 - RNA, 23 nt, Mycobacterium tuberculosis H37Rv
cucgccggcgaagaccgccggga

SEQ ID NO: 3304287 - RNA, 15 nt, Mycobacterium tuberculosis H37Rv
cucgccggcgcgcac

SEQ ID NO: 3304288 - RNA, 22 nt, Mycobacterium tuberculosis H37Rv
cucgccgggaaacaccggcuug

SEQ ID NO: 3304289 - RNA, 13 nt, Mycobacterium tuberculosis H37Rv
cucgccgggcagc

SEQ ID NO: 3304290 - RNA, 15 nt, Mycobacterium tuberculosis H37Rv
cucgccgggcagcua

SEQ ID NO: 3304291 - RNA, 19 nt, Mycobacterium tuberculosis H37Rv
cucgccgguaggcggccag

SEQ ID NO: 3304292 - RNA, 13 nt, Mycobacterium tuberculosis H37Rv
cucgccggugacg

SEQ ID NO: 3304293 - RNA, 16 nt, Mycobacterium tuberculosis H37Rv
cucgccggugcgcgcu

SEQ ID NO: 3304294 - RNA, 18 nt, Mycobacterium tuberculosis H37Rv
cucgccguaagcaccagc

SEQ ID NO: 3304295 - RNA, 21 nt, Mycobacterium tuberculosis H37Rv
cucgccguaagcaccagccag

SEQ ID NO: 3304296 - RNA, 20 nt, Mycobacterium tuberculosis H37Rv
cucgccgucauagcaggccu

SEQ ID NO: 3304297 - RNA, 13 nt, Mycobacterium tuberculosis H37Rv
cucgccgugacca

SEQ ID NO: 3304298 - RNA, 15 nt, Mycobacterium tuberculosis H37Rv
cucgccugcacgccc

SEQ ID NO: 3304299 - RNA, 19 nt, Mycobacterium tuberculosis H37Rv
cucgccugcccgaaccacc

SEQ ID NO: 3304300 - RNA, 16 nt, Mycobacterium tuberculosis H37Rv
cucgcgaagaucagcg

SEQ ID NO: 3304301 - RNA, 18 nt, Mycobacterium tuberculosis H37Rv
cucgcgacaucaccgaac

SEQ ID NO: 3304302 - RNA, 19 nt, Mycobacterium tuberculosis H37Rv
cucgcgaucgcagugagca

SEQ ID NO: 3304303 - RNA, 23 nt, Mycobacterium tuberculosis H37Rv
cucgcgaucgcagugagcagccg

SEQ ID NO: 3304304 - RNA, 22 nt, Mycobacterium tuberculosis H37Rv
cucgcgaucugcucguagcggc

SEQ ID NO: 3304305 - RNA, 16 nt, Mycobacterium tuberculosis H37Rv
cucgcgcaagcggacc

SEQ ID NO: 3304306 - RNA, 18 nt, Mycobacterium tuberculosis H37Rv
cucgcgcaaggcgccgca

SEQ ID NO: 3304307 - RNA, 19 nt, Mycobacterium tuberculosis H37Rv
cucgcgcaaggcgccgcag

SEQ ID NO: 3304308 - RNA, 17 nt, Mycobacterium tuberculosis H37Rv
cucgcgcacgucgacga

SEQ ID NO: 3304309 - RNA, 19 nt, Mycobacterium tuberculosis H37Rv
cucgcgcaggucgccuucu

SEQ ID NO: 3304310 - RNA, 23 nt, Mycobacterium tuberculosis H37Rv
cucgcgcgccacggugucgucga

SEQ ID NO: 3304311 - RNA, 14 nt, Mycobacterium tuberculosis H37Rv
cucgcgcgucgcga

SEQ ID NO: 3304312 - RNA, 21 nt, Mycobacterium tuberculosis H37Rv
cucgcgcgucgucgcgcugaa

SEQ ID NO: 3304313 - RNA, 20 nt, Mycobacterium tuberculosis H37Rv
cucgcggaugagcucggcca

SEQ ID NO: 3304314 - RNA, 14 nt, Mycobacterium tuberculosis H37Rv
cucgcggcgaccau

SEQ ID NO: 3304315 - RNA, 14 nt, Mycobacterium tuberculosis H37Rv
cucgcggcgcggcc

SEQ ID NO: 3304316 - RNA, 12 nt, Mycobacterium tuberculosis H37Rv
cucgcggcguuc

SEQ ID NO: 3304317 - RNA, 22 nt, Mycobacterium tuberculosis H37Rv
cucgcgggcagggccucggucg

SEQ ID NO: 3304318 - RNA, 15 nt, Mycobacterium tuberculosis H37Rv
cucgcgggcggcgug

SEQ ID NO: 3304319 - RNA, 18 nt, Mycobacterium tuberculosis H37Rv
cucgcgguaguugucccg

SEQ ID NO: 3304320 - RNA, 20 nt, Mycobacterium tuberculosis H37Rv
cucgcggugcggcaacagcg

SEQ ID NO: 3304321 - RNA, 23 nt, Mycobacterium tuberculosis H37Rv
cucgcggugcggcaacagcgcca

SEQ ID NO: 3304322 - RNA, 19 nt, Mycobacterium tuberculosis H37Rv
cucgcgguuuuggucgcga

SEQ ID NO: 3304323 - RNA, 20 nt, Mycobacterium tuberculosis H37Rv
cucgcguagggccagcgccu

SEQ ID NO: 3304324 - RNA, 19 nt, Mycobacterium tuberculosis H37Rv
cucgcguccucggggaggu

SEQ ID NO: 3304325 - RNA, 14 nt, Mycobacterium tuberculosis H37Rv
cucgcguggccgcc

SEQ ID NO: 3304326 - RNA, 15 nt, Mycobacterium tuberculosis H37Rv
cucgcguggccgccg

SEQ ID NO: 3304327 - RNA, 12 nt, Mycobacterium tuberculosis H37Rv
cucgcucaccgg

SEQ ID NO: 3304328 - RNA, 12 nt, Mycobacterium tuberculosis H37Rv
cucgcucgacgu

SEQ ID NO: 3304329 - RNA, 15 nt, Mycobacterium tuberculosis H37Rv
cucgcucgccgagcu

SEQ ID NO: 3304330 - RNA, 21 nt, Mycobacterium tuberculosis H37Rv
cucgcucgccgagcugugcgc

SEQ ID NO: 3304331 - RNA, 19 nt, Mycobacterium tuberculosis H37Rv
cucgcucugcgcggcuucg

SEQ ID NO: 3304332 - RNA, 22 nt, Mycobacterium tuberculosis H37Rv
cucgcugaucuggggcaccacg

SEQ ID NO: 3304333 - RNA, 18 nt, Mycobacterium tuberculosis H37Rv
cucgcugcaccagcugcu

SEQ ID NO: 3304334 - RNA, 19 nt, Mycobacterium tuberculosis H37Rv
cucgcugcaccagcugcuc

SEQ ID NO: 3304335 - RNA, 20 nt, Mycobacterium tuberculosis H37Rv
cucgcugcagcagggcuucg

SEQ ID NO: 3304336 - RNA, 13 nt, Mycobacterium tuberculosis H37Rv
cucgcuggccgca

SEQ ID NO: 3304337 - RNA, 15 nt, Mycobacterium tuberculosis H37Rv
cucgcuggugaacca

SEQ ID NO: 3304338 - RNA, 19 nt, Mycobacterium tuberculosis H37Rv
cucgcuguugaagccgccc

SEQ ID NO: 3304339 - RNA, 20 nt, Mycobacterium tuberculosis H37Rv
cucgcuguugaagccgcccg

SEQ ID NO: 3304340 - RNA, 19 nt, Mycobacterium tuberculosis H37Rv
cucgcuuaggucgcugccc

SEQ ID NO: 3304341 - RNA, 15 nt, Mycobacterium tuberculosis H37Rv
cucgcuucaggcacc

SEQ ID NO: 3304342 - RNA, 18 nt, Mycobacterium tuberculosis H37Rv
cucgcuucaggcaccgga

SEQ ID NO: 3304343 - RNA, 17 nt, Mycobacterium tuberculosis H37Rv
cucggaaacggaccucc

SEQ ID NO: 3304344 - RNA, 14 nt, Mycobacterium tuberculosis H37Rv
cucggaauucggcg

SEQ ID NO: 3304345 - RNA, 23 nt, Mycobacterium tuberculosis H37Rv
cucggacaaagccgucgcgacgu

SEQ ID NO: 3304346 - RNA, 18 nt, Mycobacterium tuberculosis H37Rv
cucggaccagacccacga

SEQ ID NO: 3304347 - RNA, 20 nt, Mycobacterium tuberculosis H37Rv
cucggagaucgagaucaccu

SEQ ID NO: 3304348 - RNA, 19 nt, Mycobacterium tuberculosis H37Rv
cucggagaugaacucggcg

SEQ ID NO: 3304349 - RNA, 14 nt, Mycobacterium tuberculosis H37Rv
cucggaggcgauca

SEQ ID NO: 3304350 - RNA, 19 nt, Mycobacterium tuberculosis H37Rv
cucggaggcgaucaggaug

SEQ ID NO: 3304351 - RNA, 15 nt, Mycobacterium tuberculosis H37Rv
cucggaguugagcug

SEQ ID NO: 3304352 - RNA, 19 nt, Mycobacterium tuberculosis H37Rv
cucggauaacgucacaccg

SEQ ID NO: 3304353 - RNA, 17 nt, Mycobacterium tuberculosis H37Rv
cucgggcaggccccacu

SEQ ID NO: 3304354 - RNA, 20 nt, Mycobacterium tuberculosis H37Rv
cucgggcaggcggccagcga

SEQ ID NO: 3304355 - RNA, 12 nt, Mycobacterium tuberculosis H37Rv
cucgggccagau

SEQ ID NO: 3304356 - RNA, 19 nt, Mycobacterium tuberculosis H37Rv
cucgggcgggucggcggcc

SEQ ID NO: 3304357 - RNA, 16 nt, Mycobacterium tuberculosis H37Rv
cucggggcugucggcg

SEQ ID NO: 3304358 - RNA, 19 nt, Mycobacterium tuberculosis H37Rv
cucggguccaaccacgagc

SEQ ID NO: 3304359 - RNA, 22 nt, Mycobacterium tuberculosis H37Rv
cucgguaccaccggcacgguga

SEQ ID NO: 3304360 - RNA, 18 nt, Mycobacterium tuberculosis H37Rv
cucgguauauccggguga

SEQ ID NO: 3304361 - RNA, 19 nt, Mycobacterium tuberculosis H37Rv
cucggucaccacggcggcg

SEQ ID NO: 3304362 - RNA, 18 nt, Mycobacterium tuberculosis H37Rv
cucggucagagccgucga

SEQ ID NO: 3304363 - RNA, 21 nt, Mycobacterium tuberculosis H37Rv
cucggucagagccgucgaagc

SEQ ID NO: 3304364 - RNA, 19 nt, Mycobacterium tuberculosis H37Rv
cucggucagcucgucggcg

SEQ ID NO: 3304365 - RNA, 20 nt, Mycobacterium tuberculosis H37Rv
cucggucccguugccgccca

SEQ ID NO: 3304366 - RNA, 13 nt, Mycobacterium tuberculosis H37Rv
cucggucgccacc

SEQ ID NO: 3304367 - RNA, 14 nt, Mycobacterium tuberculosis H37Rv
cucggucucgucgc

SEQ ID NO: 3304368 - RNA, 14 nt, Mycobacterium tuberculosis H37Rv
cucggucugcaugc

SEQ ID NO: 3304369 - RNA, 15 nt, Mycobacterium tuberculosis H37Rv
cucggugaacgccgc

SEQ ID NO: 3304370 - RNA, 22 nt, Mycobacterium tuberculosis H37Rv
cucggugaagauuccaugcgac

SEQ ID NO: 3304371 - RNA, 17 nt, Mycobacterium tuberculosis H37Rv
cucggugaaggucaccg

SEQ ID NO: 3304372 - RNA, 18 nt, Mycobacterium tuberculosis H37Rv
cucggugaaguggcgcac

SEQ ID NO: 3304373 - RNA, 23 nt, Mycobacterium tuberculosis H37Rv
cucggugaaguggcgcaccaccu

SEQ ID NO: 3304374 - RNA, 14 nt, Mycobacterium tuberculosis H37Rv
cucggugaccaggc

SEQ ID NO: 3304375 - RNA, 16 nt, Mycobacterium tuberculosis H37Rv
cucggugaccaggccg

SEQ ID NO: 3304376 - RNA, 19 nt, Mycobacterium tuberculosis H37Rv
cucggugaccaggccggcc

SEQ ID NO: 3304377 - RNA, 14 nt, Mycobacterium tuberculosis H37Rv
cucggugacgauga

SEQ ID NO: 3304378 - RNA, 20 nt, Mycobacterium tuberculosis H37Rv
cucggugagcagcucgguga

SEQ ID NO: 3304379 - RNA, 22 nt, Mycobacterium tuberculosis H37Rv
cucggugagcagcucggugaca

SEQ ID NO: 3304380 - RNA, 17 nt, Mycobacterium tuberculosis H37Rv
cucggugaucaccauga

SEQ ID NO: 3304381 - RNA, 14 nt, Mycobacterium tuberculosis H37Rv
cucggugaucucgc

SEQ ID NO: 3304382 - RNA, 23 nt, Mycobacterium tuberculosis H37Rv
cucggugauguagggcugcuccu

SEQ ID NO: 3304383 - RNA, 18 nt, Mycobacterium tuberculosis H37Rv
cucggugccacugccggu

SEQ ID NO: 3304384 - RNA, 13 nt, Mycobacterium tuberculosis H37Rv
cucggugccccca

SEQ ID NO: 3304385 - RNA, 13 nt, Mycobacterium tuberculosis H37Rv
cucggugccggcc

SEQ ID NO: 3304386 - RNA, 16 nt, Mycobacterium tuberculosis H37Rv
cucggugccggccgca

SEQ ID NO: 3304387 - RNA, 18 nt, Mycobacterium tuberculosis H37Rv
cucggugcggaacaccgc

SEQ ID NO: 3304388 - RNA, 13 nt, Mycobacterium tuberculosis H37Rv
cucggugcggcug

SEQ ID NO: 3304389 - RNA, 19 nt, Mycobacterium tuberculosis H37Rv
cucggugcggugauuccag

SEQ ID NO: 3304390 - RNA, 21 nt, Mycobacterium tuberculosis H37Rv
cucgguggucuuggcccggcg

SEQ ID NO: 3304391 - RNA, 22 nt, Mycobacterium tuberculosis H37Rv
cucgguguacaccgcgcccgcc

SEQ ID NO: 3304392 - RNA, 17 nt, Mycobacterium tuberculosis H37Rv
cucggugucggccgcgu

SEQ ID NO: 3304393 - RNA, 19 nt, Mycobacterium tuberculosis H37Rv
cucggugugcucgccgacc

SEQ ID NO: 3304394 - RNA, 22 nt, Mycobacterium tuberculosis H37Rv
cucggugugcucgccgaccagc

SEQ ID NO: 3304395 - RNA, 18 nt, Mycobacterium tuberculosis H37Rv
cucgguugguccucggcg

SEQ ID NO: 3304396 - RNA, 13 nt, Mycobacterium tuberculosis H37Rv
cucguacccggcc

SEQ ID NO: 3304397 - RNA, 14 nt, Mycobacterium tuberculosis H37Rv
cucguacggaccgu

SEQ ID NO: 3304398 - RNA, 23 nt, Mycobacterium tuberculosis H37Rv
cucguacggaccgucgccgguga

SEQ ID NO: 3304399 - RNA, 17 nt, Mycobacterium tuberculosis H37Rv
cucguagaaucggcuca

SEQ ID NO: 3304400 - RNA, 14 nt, Mycobacterium tuberculosis H37Rv
cucguagagcaccg

SEQ ID NO: 3304401 - RNA, 19 nt, Mycobacterium tuberculosis H37Rv
cucguaggcguacaccagg

SEQ ID NO: 3304402 - RNA, 20 nt, Mycobacterium tuberculosis H37Rv
cucguaggugaagagcacgu

SEQ ID NO: 3304403 - RNA, 21 nt, Mycobacterium tuberculosis H37Rv
cucguaggugccgaagaugac

SEQ ID NO: 3304404 - RNA, 17 nt, Mycobacterium tuberculosis H37Rv
cucguaguaguccagca

SEQ ID NO: 3304405 - RNA, 22 nt, Mycobacterium tuberculosis H37Rv
cucguaguaguccagcacggcc

SEQ ID NO: 3304406 - RNA, 20 nt, Mycobacterium tuberculosis H37Rv
cucguauacccgggcggucg

SEQ ID NO: 3304407 - RNA, 19 nt, Mycobacterium tuberculosis H37Rv
cucgucaaccugcgcauca

SEQ ID NO: 3304408 - RNA, 22 nt, Mycobacterium tuberculosis H37Rv
cucgucaaucaccaccgccagc

SEQ ID NO: 3304409 - RNA, 13 nt, Mycobacterium tuberculosis H37Rv
cucgucacccggu

SEQ ID NO: 3304410 - RNA, 23 nt, Mycobacterium tuberculosis H37Rv
cucgucacccgguguccagugca

SEQ ID NO: 3304411 - RNA, 18 nt, Mycobacterium tuberculosis H37Rv
cucgucaccgcgaccagc

SEQ ID NO: 3304412 - RNA, 11 nt, Mycobacterium tuberculosis H37Rv
cucgucaccgg

SEQ ID NO: 3304413 - RNA, 21 nt, Mycobacterium tuberculosis H37Rv
cucgucacgggguccgaugcg

SEQ ID NO: 3304414 - RNA, 16 nt, Mycobacterium tuberculosis H37Rv
cucguccaagccggcc

SEQ ID NO: 3304415 - RNA, 13 nt, Mycobacterium tuberculosis H37Rv
cucguccagcaac

SEQ ID NO: 3304416 - RNA, 15 nt, Mycobacterium tuberculosis H37Rv
cucguccagcaaccu

SEQ ID NO: 3304417 - RNA, 22 nt, Mycobacterium tuberculosis H37Rv
cucguccaggucggccgccucg

SEQ ID NO: 3304418 - RNA, 15 nt, Mycobacterium tuberculosis H37Rv
cucgucccacagguu

SEQ ID NO: 3304419 - RNA, 21 nt, Mycobacterium tuberculosis H37Rv
cucgucccacagguuugcgcc

SEQ ID NO: 3304420 - RNA, 21 nt, Mycobacterium tuberculosis H37Rv
cucguccggugcgaucccacc

SEQ ID NO: 3304421 - RNA, 18 nt, Mycobacterium tuberculosis H37Rv
cucgucgaacauggcacg

SEQ ID NO: 3304422 - RNA, 16 nt, Mycobacterium tuberculosis H37Rv
cucgucgacgucggca

SEQ ID NO: 3304423 - RNA, 15 nt, Mycobacterium tuberculosis H37Rv
cucgucgagccgacc

SEQ ID NO: 3304424 - RNA, 23 nt, Mycobacterium tuberculosis H37Rv
cucgucgaggaagaucaccuccc

SEQ ID NO: 3304425 - RNA, 18 nt, Mycobacterium tuberculosis H37Rv
cucgucgaggucagcucc

SEQ ID NO: 3304426 - RNA, 13 nt, Mycobacterium tuberculosis H37Rv
cucgucgaggucc

SEQ ID NO: 3304427 - RNA, 18 nt, Mycobacterium tuberculosis H37Rv
cucgucgagguccucguc

SEQ ID NO: 3304428 - RNA, 18 nt, Mycobacterium tuberculosis H37Rv
cucgucgaugucgacguc

SEQ ID NO: 3304429 - RNA, 20 nt, Mycobacterium tuberculosis H37Rv
cucgucgaugucguuggcca

SEQ ID NO: 3304430 - RNA, 15 nt, Mycobacterium tuberculosis H37Rv
cucgucgcaucacca

SEQ ID NO: 3304431 - RNA, 14 nt, Mycobacterium tuberculosis H37Rv
cucgucgccccguu

SEQ ID NO: 3304432 - RNA, 16 nt, Mycobacterium tuberculosis H37Rv
cucgucgccgcgguag

SEQ ID NO: 3304433 - RNA, 16 nt, Mycobacterium tuberculosis H37Rv
cucgucgccgguggca

SEQ ID NO: 3304434 - RNA, 23 nt, Mycobacterium tuberculosis H37Rv
cucgucgcgggccaccgcuguca

SEQ ID NO: 3304435 - RNA, 17 nt, Mycobacterium tuberculosis H37Rv
cucgucgcgggcgaugg

SEQ ID NO: 3304436 - RNA, 13 nt, Mycobacterium tuberculosis H37Rv
cucgucgcgucgc

SEQ ID NO: 3304437 - RNA, 15 nt, Mycobacterium tuberculosis H37Rv
cucgucgcgucgcca

SEQ ID NO: 3304438 - RNA, 13 nt, Mycobacterium tuberculosis H37Rv
cucgucggccacc

SEQ ID NO: 3304439 - RNA, 14 nt, Mycobacterium tuberculosis H37Rv
cucgucggccaccg

SEQ ID NO: 3304440 - RNA, 12 nt, Mycobacterium tuberculosis H37Rv
cucgucggccag

SEQ ID NO: 3304441 - RNA, 15 nt, Mycobacterium tuberculosis H37Rv
cucgucggccgacac

SEQ ID NO: 3304442 - RNA, 24 nt, Mycobacterium tuberculosis H37Rv
cucgucggccugguacucccgcga

SEQ ID NO: 3304443 - RNA, 13 nt, Mycobacterium tuberculosis H37Rv
cucgucggcgaug

SEQ ID NO: 3304444 - RNA, 21 nt, Mycobacterium tuberculosis H37Rv
cucgucggcgauggccagcac

SEQ ID NO: 3304445 - RNA, 12 nt, Mycobacterium tuberculosis H37Rv
cucgucggcgcc

SEQ ID NO: 3304446 - RNA, 17 nt, Mycobacterium tuberculosis H37Rv
cucgucggcgucgagcu

SEQ ID NO: 3304447 - RNA, 15 nt, Mycobacterium tuberculosis H37Rv
cucgucggugcgcgc

SEQ ID NO: 3304448 - RNA, 22 nt, Mycobacterium tuberculosis H37Rv
cucgucggugucgguucggucg

SEQ ID NO: 3304449 - RNA, 15 nt, Mycobacterium tuberculosis H37Rv
cugaacucaacacca

SEQ ID NO: 3304450 - RNA, 17 nt, Mycobacterium tuberculosis H37Rv
cugaacucaacaccagc

SEQ ID NO: 3304451 - RNA, 13 nt, Mycobacterium tuberculosis H37Rv
cugaagagcaaug

SEQ ID NO: 3304452 - RNA, 15 nt, Mycobacterium tuberculosis H37Rv
cugaagagcggagcc

SEQ ID NO: 3304453 - RNA, 20 nt, Mycobacterium tuberculosis H37Rv
cugaagccaaaugcgcuguc

SEQ ID NO: 3304454 - RNA, 12 nt, Mycobacterium tuberculosis H37Rv
cugaagccagcg

SEQ ID NO: 3304455 - RNA, 13 nt, Mycobacterium tuberculosis H37Rv
cugaagccagcgc

SEQ ID NO: 3304456 - RNA, 15 nt, Mycobacterium tuberculosis H37Rv
cugaagccagcgcaa

SEQ ID NO: 3304457 - RNA, 18 nt, Mycobacterium tuberculosis H37Rv
cugaagccagcgcagcac

SEQ ID NO: 3304458 - RNA, 20 nt, Mycobacterium tuberculosis H37Rv
cugaagguggcgaacccggu

SEQ ID NO: 3304459 - RNA, 22 nt, Mycobacterium tuberculosis H37Rv
cugaagguggcgaacccgguca

SEQ ID NO: 3304460 - RNA, 22 nt, Mycobacterium tuberculosis H37Rv
cugaaguggcacaagcugggga

SEQ ID NO: 3304461 - RNA, 19 nt, Mycobacterium tuberculosis H37Rv
cugaaugcuugcgcagcac

SEQ ID NO: 3304462 - RNA, 14 nt, Mycobacterium tuberculosis H37Rv
cugacaacggccac

SEQ ID NO: 3304463 - RNA, 21 nt, Mycobacterium tuberculosis H37Rv
cugacaacggccacaugccac

SEQ ID NO: 3304464 - RNA, 20 nt, Mycobacterium tuberculosis H37Rv
cugacaagccuuaccccgca

SEQ ID NO: 3304465 - RNA, 16 nt, Mycobacterium tuberculosis H37Rv
cugacacccgcagcug

SEQ ID NO: 3304466 - RNA, 18 nt, Mycobacterium tuberculosis H37Rv
cugacaccgauccggccg

SEQ ID NO: 3304467 - RNA, 20 nt, Mycobacterium tuberculosis H37Rv
cugacagaccgggcaccaga

SEQ ID NO: 3304468 - RNA, 21 nt, Mycobacterium tuberculosis H37Rv
cugacagaccgggcaccagaa

SEQ ID NO: 3304469 - RNA, 18 nt, Mycobacterium tuberculosis H37Rv
cugacaguccccagacag

SEQ ID NO: 3304470 - RNA, 13 nt, Mycobacterium tuberculosis H37Rv
cugacauuuccac

SEQ ID NO: 3304471 - RNA, 17 nt, Mycobacterium tuberculosis H37Rv
cugacauuuccaccacg

SEQ ID NO: 3304472 - RNA, 22 nt, Mycobacterium tuberculosis H37Rv
cugaccacgucggacagcuuuc

SEQ ID NO: 3304473 - RNA, 13 nt, Mycobacterium tuberculosis H37Rv
cugaccagcgucc

SEQ ID NO: 3304474 - RNA, 14 nt, Mycobacterium tuberculosis H37Rv
cugaccaugaccgg

SEQ ID NO: 3304475 - RNA, 20 nt, Mycobacterium tuberculosis H37Rv
cugaccaugaccgggcuggc

SEQ ID NO: 3304476 - RNA, 14 nt, Mycobacterium tuberculosis H37Rv
cugacccaccgccc

SEQ ID NO: 3304477 - RNA, 23 nt, Mycobacterium tuberculosis H37Rv
cugacccagcagcggcacgucgg

SEQ ID NO: 3304478 - RNA, 22 nt, Mycobacterium tuberculosis H37Rv
cugacccauggucaccagcugg

SEQ ID NO: 3304479 - RNA, 16 nt, Mycobacterium tuberculosis H37Rv
cugacccccgaccccg

SEQ ID NO: 3304480 - RNA, 18 nt, Mycobacterium tuberculosis H37Rv
cugacccccugacggcau

SEQ ID NO: 3304481 - RNA, 18 nt, Mycobacterium tuberculosis H37Rv
cugaccccgccggcugcg

SEQ ID NO: 3304482 - RNA, 15 nt, Mycobacterium tuberculosis H37Rv
cugaccccggcagcg

SEQ ID NO: 3304483 - RNA, 23 nt, Mycobacterium tuberculosis H37Rv
cugacccggagccgccaggugcu

SEQ ID NO: 3304484 - RNA, 16 nt, Mycobacterium tuberculosis H37Rv
cugacccggcgccgaa

SEQ ID NO: 3304485 - RNA, 13 nt, Mycobacterium tuberculosis H37Rv
cugaccgaauggc

SEQ ID NO: 3304486 - RNA, 11 nt, Mycobacterium tuberculosis H37Rv
cugaccgccac

SEQ ID NO: 3304487 - RNA, 13 nt, Mycobacterium tuberculosis H37Rv
cugaccgccaccc

SEQ ID NO: 3304488 - RNA, 13 nt, Mycobacterium tuberculosis H37Rv
cugaccgccagcg

SEQ ID NO: 3304489 - RNA, 14 nt, Mycobacterium tuberculosis H37Rv
cugaccgccagcgg

SEQ ID NO: 3304490 - RNA, 22 nt, Mycobacterium tuberculosis H37Rv
cugaccggggcgcccggccagg

SEQ ID NO: 3304491 - RNA, 20 nt, Mycobacterium tuberculosis H37Rv
cugaccucgucaaucaccac

SEQ ID NO: 3304492 - RNA, 21 nt, Mycobacterium tuberculosis H37Rv
cugaccucgucaaucaccacc

SEQ ID NO: 3304493 - RNA, 15 nt, Mycobacterium tuberculosis H37Rv
cugaccuucaggccc

SEQ ID NO: 3304494 - RNA, 17 nt, Mycobacterium tuberculosis H37Rv
cugaccuucaggcccug

SEQ ID NO: 3304495 - RNA, 19 nt, Mycobacterium tuberculosis H37Rv
cugaccuucaggcccugcc

SEQ ID NO: 3304496 - RNA, 21 nt, Mycobacterium tuberculosis H37Rv
cugaccuucucacgcaccaug

SEQ ID NO: 3304497 - RNA, 21 nt, Mycobacterium tuberculosis H37Rv
cugacgaaggucuccggcaag

SEQ ID NO: 3304498 - RNA, 21 nt, Mycobacterium tuberculosis H37Rv
cugacgacgagggccagcagc

SEQ ID NO: 3304499 - RNA, 14 nt, Mycobacterium tuberculosis H37Rv
cugacgacugggcg

SEQ ID NO: 3304500 - RNA, 20 nt, Mycobacterium tuberculosis H37Rv
cugacgacugggcgcccaag

SEQ ID NO: 3304501 - RNA, 21 nt, Mycobacterium tuberculosis H37Rv
cugacgagcagcuagcccggc

SEQ ID NO: 3304502 - RNA, 20 nt, Mycobacterium tuberculosis H37Rv
cugacgaucauugcacccac

SEQ ID NO: 3304503 - RNA, 13 nt, Mycobacterium tuberculosis H37Rv
cugacgccauuca

SEQ ID NO: 3304504 - RNA, 18 nt, Mycobacterium tuberculosis H37Rv
cugacgccccgccacaau

SEQ ID NO: 3304505 - RNA, 17 nt, Mycobacterium tuberculosis H37Rv
cugacgcccuccuggcg

SEQ ID NO: 3304506 - RNA, 19 nt, Mycobacterium tuberculosis H37Rv
cugacgccgagcugguuga

SEQ ID NO: 3304507 - RNA, 22 nt, Mycobacterium tuberculosis H37Rv
cugacgcgcccgacgaacagcg

SEQ ID NO: 3304508 - RNA, 15 nt, Mycobacterium tuberculosis H37Rv
cugacgcggccgggc

SEQ ID NO: 3304509 - RNA, 16 nt, Mycobacterium tuberculosis H37Rv
cugacgcggccgggcg

SEQ ID NO: 3304510 - RNA, 14 nt, Mycobacterium tuberculosis H37Rv
cugacgcgucagcg

SEQ ID NO: 3304511 - RNA, 17 nt, Mycobacterium tuberculosis H37Rv
cugacgcuacgacagug

SEQ ID NO: 3304512 - RNA, 14 nt, Mycobacterium tuberculosis H37Rv
cugacgcucggucg

SEQ ID NO: 3304513 - RNA, 17 nt, Mycobacterium tuberculosis H37Rv
cugacgcucggucgcca

SEQ ID NO: 3304514 - RNA, 19 nt, Mycobacterium tuberculosis H37Rv
cugacgcucggucgccacc

SEQ ID NO: 3304515 - RNA, 21 nt, Mycobacterium tuberculosis H37Rv
cugacgcucggucgccaccgc

SEQ ID NO: 3304516 - RNA, 22 nt, Mycobacterium tuberculosis H37Rv
cugacggaaguacuccauggca

SEQ ID NO: 3304517 - RNA, 12 nt, Mycobacterium tuberculosis H37Rv
cugacggcaucu

SEQ ID NO: 3304518 - RNA, 11 nt, Mycobacterium tuberculosis H37Rv
cugacggccau

SEQ ID NO: 3304519 - RNA, 18 nt, Mycobacterium tuberculosis H37Rv
cugacggccauggacgcc

SEQ ID NO: 3304520 - RNA, 15 nt, Mycobacterium tuberculosis H37Rv
cugacggcuuccaac

SEQ ID NO: 3304521 - RNA, 19 nt, Mycobacterium tuberculosis H37Rv
cugacggcuugcgugaugg

SEQ ID NO: 3304522 - RNA, 16 nt, Mycobacterium tuberculosis H37Rv
cugacgguacagcucc

SEQ ID NO: 3304523 - RNA, 17 nt, Mycobacterium tuberculosis H37Rv
cugacggugcaggacca

SEQ ID NO: 3304524 - RNA, 13 nt, Mycobacterium tuberculosis H37Rv
cugacggugguga

SEQ ID NO: 3304525 - RNA, 16 nt, Mycobacterium tuberculosis H37Rv
cugacgguggugaccg

SEQ ID NO: 3304526 - RNA, 14 nt, Mycobacterium tuberculosis H37Rv
cugacgguucgguc

SEQ ID NO: 3304527 - RNA, 22 nt, Mycobacterium tuberculosis H37Rv
cugacgguucggucggggagcu

SEQ ID NO: 3304528 - RNA, 12 nt, Mycobacterium tuberculosis H37Rv
cugacgucacca

SEQ ID NO: 3304529 - RNA, 15 nt, Mycobacterium tuberculosis H37Rv
cugacgugaagcaga

SEQ ID NO: 3304530 - RNA, 13 nt, Mycobacterium tuberculosis H37Rv
cugacgugucggc

SEQ ID NO: 3304531 - RNA, 16 nt, Mycobacterium tuberculosis H37Rv
cugacguuaccgccgc

SEQ ID NO: 3304532 - RNA, 17 nt, Mycobacterium tuberculosis H37Rv
cugacuaccgucaucga

SEQ ID NO: 3304533 - RNA, 16 nt, Mycobacterium tuberculosis H37Rv
cugacuagggucaccg

SEQ ID NO: 3304534 - RNA, 17 nt, Mycobacterium tuberculosis H37Rv
cugacuagggucaccga

SEQ ID NO: 3304535 - RNA, 15 nt, Mycobacterium tuberculosis H37Rv
cugacuccugcggca

SEQ ID NO: 3304536 - RNA, 14 nt, Mycobacterium tuberculosis H37Rv
cugagacucgucga

SEQ ID NO: 3304537 - RNA, 18 nt, Mycobacterium tuberculosis H37Rv
cugagaugaugcgugacc

SEQ ID NO: 3304538 - RNA, 15 nt, Mycobacterium tuberculosis H37Rv
cugagaugggccacc

SEQ ID NO: 3304539 - RNA, 17 nt, Mycobacterium tuberculosis H37Rv
cugagaugggccacccg

SEQ ID NO: 3304540 - RNA, 17 nt, Mycobacterium tuberculosis H37Rv
cugagcacggcgcggcg

SEQ ID NO: 3304541 - RNA, 15 nt, Mycobacterium tuberculosis H37Rv
cugagcagcgcggcc

SEQ ID NO: 3304542 - RNA, 23 nt, Mycobacterium tuberculosis H37Rv
cugagcagcgcggccagagccgc

SEQ ID NO: 3304543 - RNA, 18 nt, Mycobacterium tuberculosis H37Rv
cugagccaccaacaccgc

SEQ ID NO: 3304544 - RNA, 11 nt, Mycobacterium tuberculosis H37Rv
cugagcccgcc

SEQ ID NO: 3304545 - RNA, 24 nt, Mycobacterium tuberculosis H37Rv
cugagcccgccgcgaccacgcacc

SEQ ID NO: 3304546 - RNA, 15 nt, Mycobacterium tuberculosis H37Rv
cugcacggccaugau

SEQ ID NO: 3304547 - RNA, 15 nt, Mycobacterium tuberculosis H37Rv
cugcacggcgcugac

SEQ ID NO: 3304548 - RNA, 16 nt, Mycobacterium tuberculosis H37Rv
cugcacggcgcugacg

SEQ ID NO: 3304549 - RNA, 19 nt, Mycobacterium tuberculosis H37Rv
cugcacggugcccagggcg

SEQ ID NO: 3304550 - RNA, 16 nt, Mycobacterium tuberculosis H37Rv
cugcacguacucggcc

SEQ ID NO: 3304551 - RNA, 18 nt, Mycobacterium tuberculosis H37Rv
cugcacgugacccugggg

SEQ ID NO: 3304552 - RNA, 16 nt, Mycobacterium tuberculosis H37Rv
cugcagaaacagccgc

SEQ ID NO: 3304553 - RNA, 19 nt, Mycobacterium tuberculosis H37Rv
cugcagaaaggccaacugg

SEQ ID NO: 3304554 - RNA, 13 nt, Mycobacterium tuberculosis H37Rv
cugcagacccguu

SEQ ID NO: 3304555 - RNA, 13 nt, Mycobacterium tuberculosis H37Rv
cugcagacgcccc

SEQ ID NO: 3304556 - RNA, 15 nt, Mycobacterium tuberculosis H37Rv
cugcagacgguccgc

SEQ ID NO: 3304557 - RNA, 22 nt, Mycobacterium tuberculosis H37Rv
cugcagaucguagugcgcgcca

SEQ ID NO: 3304558 - RNA, 19 nt, Mycobacterium tuberculosis H37Rv
cugcagcacgacgugcguc

SEQ ID NO: 3304559 - RNA, 18 nt, Mycobacterium tuberculosis H37Rv
cugcagcaggucgaugcu

SEQ ID NO: 3304560 - RNA, 15 nt, Mycobacterium tuberculosis H37Rv
cugcagcccgggcag

SEQ ID NO: 3304561 - RNA, 20 nt, Mycobacterium tuberculosis H37Rv
cugcagcccgggcagcacca

SEQ ID NO: 3304562 - RNA, 19 nt, Mycobacterium tuberculosis H37Rv
cugcagcgaaacaccggcc

SEQ ID NO: 3304563 - RNA, 15 nt, Mycobacterium tuberculosis H37Rv
cugcagcgagaccuc

SEQ ID NO: 3304564 - RNA, 14 nt, Mycobacterium tuberculosis H37Rv
cugcagcgaugcgg

SEQ ID NO: 3304565 - RNA, 15 nt, Mycobacterium tuberculosis H37Rv
cugcagcgaugcggc

SEQ ID NO: 3304566 - RNA, 15 nt, Mycobacterium tuberculosis H37Rv
cugcagcgccucgau

SEQ ID NO: 3304567 - RNA, 18 nt, Mycobacterium tuberculosis H37Rv
cugcagcgccucgauccg

SEQ ID NO: 3304568 - RNA, 16 nt, Mycobacterium tuberculosis H37Rv
cugcagcgcgacccgu

SEQ ID NO: 3304569 - RNA, 13 nt, Mycobacterium tuberculosis H37Rv
cugcagcgcggcc

SEQ ID NO: 3304570 - RNA, 14 nt, Mycobacterium tuberculosis H37Rv
cugcagcgcggccg

SEQ ID NO: 3304571 - RNA, 21 nt, Mycobacterium tuberculosis H37Rv
cugcagcgucaagggcugggu

SEQ ID NO: 3304572 - RNA, 21 nt, Mycobacterium tuberculosis H37Rv
cugcaggaaggcuucggugac

SEQ ID NO: 3304573 - RNA, 11 nt, Mycobacterium tuberculosis H37Rv
cugcaggcugu

SEQ ID NO: 3304574 - RNA, 16 nt, Mycobacterium tuberculosis H37Rv
cugcagguccagggug

SEQ ID NO: 3304575 - RNA, 20 nt, Mycobacterium tuberculosis H37Rv
cugcagguucuugaccagca

SEQ ID NO: 3304576 - RNA, 20 nt, Mycobacterium tuberculosis H37Rv
cugcagguuguuucguucga

SEQ ID NO: 3304577 - RNA, 13 nt, Mycobacterium tuberculosis H37Rv
cugcagugaucgu

SEQ ID NO: 3304578 - RNA, 21 nt, Mycobacterium tuberculosis H37Rv
cugcaguguuuuugcagacuc

SEQ ID NO: 3304579 - RNA, 20 nt, Mycobacterium tuberculosis H37Rv
cugcauaggcgcggucaccg

SEQ ID NO: 3304580 - RNA, 14 nt, Mycobacterium tuberculosis H37Rv
cugcaucaccacug

SEQ ID NO: 3304581 - RNA, 17 nt, Mycobacterium tuberculosis H37Rv
cugcaucacgccgucgc

SEQ ID NO: 3304582 - RNA, 13 nt, Mycobacterium tuberculosis H37Rv
cugcauccuccuc

SEQ ID NO: 3304583 - RNA, 16 nt, Mycobacterium tuberculosis H37Rv
cugcauccuccucguc

SEQ ID NO: 3304584 - RNA, 16 nt, Mycobacterium tuberculosis H37Rv
cugccaaaagggcggc

SEQ ID NO: 3304585 - RNA, 22 nt, Mycobacterium tuberculosis H37Rv
cugccaaaagggcggcagcgag

SEQ ID NO: 3304586 - RNA, 20 nt, Mycobacterium tuberculosis H37Rv
cugccaaacuaacggcagcc

SEQ ID NO: 3304587 - RNA, 16 nt, Mycobacterium tuberculosis H37Rv
cugccaacgcccgugu

SEQ ID NO: 3304588 - RNA, 19 nt, Mycobacterium tuberculosis H37Rv
cugccaacgcccguguuga

SEQ ID NO: 3304589 - RNA, 20 nt, Mycobacterium tuberculosis H37Rv
cugccaacgcccguguugaa

SEQ ID NO: 3304590 - RNA, 14 nt, Mycobacterium tuberculosis H37Rv
cugccaagcgaccu

SEQ ID NO: 3304591 - RNA, 16 nt, Mycobacterium tuberculosis H37Rv
cugccaagcgaccucg

SEQ ID NO: 3304592 - RNA, 15 nt, Mycobacterium tuberculosis H37Rv
cugccacaggcguuu

SEQ ID NO: 3304593 - RNA, 13 nt, Mycobacterium tuberculosis H37Rv
cugccaccagaca

SEQ ID NO: 3304594 - RNA, 19 nt, Mycobacterium tuberculosis H37Rv
cugccaccagacaacgccg

SEQ ID NO: 3304595 - RNA, 20 nt, Mycobacterium tuberculosis H37Rv
cugccaccagacaacgccgu

SEQ ID NO: 3304596 - RNA, 21 nt, Mycobacterium tuberculosis H37Rv
cugccacccagcacgcgcgcg

SEQ ID NO: 3304597 - RNA, 17 nt, Mycobacterium tuberculosis H37Rv
cugccaccgugugcacg

SEQ ID NO: 3304598 - RNA, 18 nt, Mycobacterium tuberculosis H37Rv
cugccacguugaucccga

SEQ ID NO: 3304599 - RNA, 12 nt, Mycobacterium tuberculosis H37Rv
cugccagccugg

SEQ ID NO: 3304600 - RNA, 13 nt, Mycobacterium tuberculosis H37Rv
cugccagccugga

SEQ ID NO: 3304601 - RNA, 14 nt, Mycobacterium tuberculosis H37Rv
cugccaggagcacg

SEQ ID NO: 3304602 - RNA, 17 nt, Mycobacterium tuberculosis H37Rv
cugccagugccgcccac

SEQ ID NO: 3304603 - RNA, 17 nt, Mycobacterium tuberculosis H37Rv
cugccaguucuuggcga

SEQ ID NO: 3304604 - RNA, 15 nt, Mycobacterium tuberculosis H37Rv
cugccaucacgcgcu

SEQ ID NO: 3304605 - RNA, 14 nt, Mycobacterium tuberculosis H37Rv
cugccaugcgggug

SEQ ID NO: 3304606 - RNA, 13 nt, Mycobacterium tuberculosis H37Rv
cugccauugccug

SEQ ID NO: 3304607 - RNA, 21 nt, Mycobacterium tuberculosis H37Rv
cugccauugccugggcgaccg

SEQ ID NO: 3304608 - RNA, 18 nt, Mycobacterium tuberculosis H37Rv
cugcccaaaaggaagacc

SEQ ID NO: 3304609 - RNA, 16 nt, Mycobacterium tuberculosis H37Rv
cugcccaaccggucaa

SEQ ID NO: 3304610 - RNA, 22 nt, Mycobacterium tuberculosis H37Rv
cugcccaccgcagcaucccugg

SEQ ID NO: 3304611 - RNA, 16 nt, Mycobacterium tuberculosis H37Rv
cugcccacgggccggc

SEQ ID NO: 3304612 - RNA, 22 nt, Mycobacterium tuberculosis H37Rv
cugcccacgggccggccgagcg

SEQ ID NO: 3304613 - RNA, 14 nt, Mycobacterium tuberculosis H37Rv
cugcccagcaccac

SEQ ID NO: 3304614 - RNA, 20 nt, Mycobacterium tuberculosis H37Rv
cugcccaggcaaaccgauca

SEQ ID NO: 3304615 - RNA, 15 nt, Mycobacterium tuberculosis H37Rv
cugcccaguauaauu

SEQ ID NO: 3304616 - RNA, 20 nt, Mycobacterium tuberculosis H37Rv
cugcccaguguccggcgacg

SEQ ID NO: 3304617 - RNA, 18 nt, Mycobacterium tuberculosis H37Rv
cugcccaucacacccggu

SEQ ID NO: 3304618 - RNA, 14 nt, Mycobacterium tuberculosis H37Rv
cugcccccgccggc

SEQ ID NO: 3304619 - RNA, 14 nt, Mycobacterium tuberculosis H37Rv
cugcccccgcgcgc

SEQ ID NO: 3304620 - RNA, 15 nt, Mycobacterium tuberculosis H37Rv
cugcccccgcgcgca

SEQ ID NO: 3304621 - RNA, 18 nt, Mycobacterium tuberculosis H37Rv
cugcccccggcgcggcgg

SEQ ID NO: 3304622 - RNA, 20 nt, Mycobacterium tuberculosis H37Rv
cugcccccguucuggaaccc

SEQ ID NO: 3304623 - RNA, 15 nt, Mycobacterium tuberculosis H37Rv
cugccccgccaccuc

SEQ ID NO: 3304624 - RNA, 16 nt, Mycobacterium tuberculosis H37Rv
cugcccgaaccaccac

SEQ ID NO: 3304625 - RNA, 18 nt, Mycobacterium tuberculosis H37Rv
cugcccgagguccgcccu

SEQ ID NO: 3304626 - RNA, 16 nt, Mycobacterium tuberculosis H37Rv
cugcccgaguucgcga

SEQ ID NO: 3304627 - RNA, 21 nt, Mycobacterium tuberculosis H37Rv
cugcccgauacccggugaugg

SEQ ID NO: 3304628 - RNA, 22 nt, Mycobacterium tuberculosis H37Rv
cugcccgaugaucugugccgcu

SEQ ID NO: 3304629 - RNA, 21 nt, Mycobacterium tuberculosis H37Rv
cugcccgauggcuaccuugga

SEQ ID NO: 3304630 - RNA, 16 nt, Mycobacterium tuberculosis H37Rv
cugcccgccagcgccg

SEQ ID NO: 3304631 - RNA, 20 nt, Mycobacterium tuberculosis H37Rv
cugcccgccagcgccgccgc

SEQ ID NO: 3304632 - RNA, 15 nt, Mycobacterium tuberculosis H37Rv
cugcccgcccagccc

SEQ ID NO: 3304633 - RNA, 23 nt, Mycobacterium tuberculosis H37Rv
cugcccgcccagcccggcguugu

SEQ ID NO: 3304634 - RNA, 13 nt, Mycobacterium tuberculosis H37Rv
cugcccgccguua

SEQ ID NO: 3304635 - RNA, 13 nt, Mycobacterium tuberculosis H37Rv
cugcccgcggcgg

SEQ ID NO: 3304636 - RNA, 19 nt, Mycobacterium tuberculosis H37Rv
cugcccguucugcccaggc

SEQ ID NO: 3304637 - RNA, 21 nt, Mycobacterium tuberculosis H37Rv
cugcccuguucguagucucga

SEQ ID NO: 3304638 - RNA, 18 nt, Mycobacterium tuberculosis H37Rv
cugccgaagcggccaccg

SEQ ID NO: 3304639 - RNA, 20 nt, Mycobacterium tuberculosis H37Rv
cugccgaaguugaagaagcc

SEQ ID NO: 3304640 - RNA, 21 nt, Mycobacterium tuberculosis H37Rv
cugccgaaguugaagaagcca

SEQ ID NO: 3304641 - RNA, 16 nt, Mycobacterium tuberculosis H37Rv
cugccgaccagcgcgc

SEQ ID NO: 3304642 - RNA, 15 nt, Mycobacterium tuberculosis H37Rv
cugccgacgcuccag

SEQ ID NO: 3304643 - RNA, 14 nt, Mycobacterium tuberculosis H37Rv
cugcgcagcggcau

SEQ ID NO: 3304644 - RNA, 21 nt, Mycobacterium tuberculosis H37Rv
cugcgcagcggcauccacacc

SEQ ID NO: 3304645 - RNA, 22 nt, Mycobacterium tuberculosis H37Rv
cugcgcagguggucgaucaggu

SEQ ID NO: 3304646 - RNA, 21 nt, Mycobacterium tuberculosis H37Rv
cugcgcagugaauugcccaag

SEQ ID NO: 3304647 - RNA, 13 nt, Mycobacterium tuberculosis H37Rv
cugcgcaucacca

SEQ ID NO: 3304648 - RNA, 14 nt, Mycobacterium tuberculosis H37Rv
cugcgcaucaccac

SEQ ID NO: 3304649 - RNA, 14 nt, Mycobacterium tuberculosis H37Rv
cugcgcaucgccac

SEQ ID NO: 3304650 - RNA, 15 nt, Mycobacterium tuberculosis H37Rv
cugcgcaucggucca

SEQ ID NO: 3304651 - RNA, 19 nt, Mycobacterium tuberculosis H37Rv
cugcgcaucgguccaaagc

SEQ ID NO: 3304652 - RNA, 17 nt, Mycobacterium tuberculosis H37Rv
cugcgccaaaauccgcc

SEQ ID NO: 3304653 - RNA, 17 nt, Mycobacterium tuberculosis H37Rv
cugcgccacgucgacgg

SEQ ID NO: 3304654 - RNA, 14 nt, Mycobacterium tuberculosis H37Rv
cugcgccagaaucc

SEQ ID NO: 3304655 - RNA, 17 nt, Mycobacterium tuberculosis H37Rv
cugcgccagaaucccgc

SEQ ID NO: 3304656 - RNA, 18 nt, Mycobacterium tuberculosis H37Rv
cugcgccagaaucccgcu

SEQ ID NO: 3304657 - RNA, 14 nt, Mycobacterium tuberculosis H37Rv
cugcgccagcaaca

SEQ ID NO: 3304658 - RNA, 17 nt, Mycobacterium tuberculosis H37Rv
cugcgccagcaacagcg

SEQ ID NO: 3304659 - RNA, 22 nt, Mycobacterium tuberculosis H37Rv
cugcgccaggaauugcccugac

SEQ ID NO: 3304660 - RNA, 15 nt, Mycobacterium tuberculosis H37Rv
cugcgccaggcggca

SEQ ID NO: 3304661 - RNA, 13 nt, Mycobacterium tuberculosis H37Rv
cugcgccaucaca

SEQ ID NO: 3304662 - RNA, 20 nt, Mycobacterium tuberculosis H37Rv
cugcgccaucacaucggccu

SEQ ID NO: 3304663 - RNA, 14 nt, Mycobacterium tuberculosis H37Rv
cugcgcccauagcu

SEQ ID NO: 3304664 - RNA, 17 nt, Mycobacterium tuberculosis H37Rv
cugcgcccauagcugcc

SEQ ID NO: 3304665 - RNA, 15 nt, Mycobacterium tuberculosis H37Rv
cugcgcccgccacgu

SEQ ID NO: 3304666 - RNA, 16 nt, Mycobacterium tuberculosis H37Rv
cugcgcccggaccacu

SEQ ID NO: 3304667 - RNA, 17 nt, Mycobacterium tuberculosis H37Rv
cugcgcccguccgcgcg

SEQ ID NO: 3304668 - RNA, 14 nt, Mycobacterium tuberculosis H37Rv
cugcgccgaacacc

SEQ ID NO: 3304669 - RNA, 18 nt, Mycobacterium tuberculosis H37Rv
cugcgccgacccgcgcgc

SEQ ID NO: 3304670 - RNA, 19 nt, Mycobacterium tuberculosis H37Rv
cugcgccgacccgcgcgcc

SEQ ID NO: 3304671 - RNA, 22 nt, Mycobacterium tuberculosis H37Rv
cugcgccgauacccagcggguc

SEQ ID NO: 3304672 - RNA, 16 nt, Mycobacterium tuberculosis H37Rv
cugcgccgccacagca

SEQ ID NO: 3304673 - RNA, 20 nt, Mycobacterium tuberculosis H37Rv
cugcgccgccacagcaccca

SEQ ID NO: 3304674 - RNA, 16 nt, Mycobacterium tuberculosis H37Rv
cugcgccgccagcgcc

SEQ ID NO: 3304675 - RNA, 20 nt, Mycobacterium tuberculosis H37Rv
cugcgccgcccgcgccaccg

SEQ ID NO: 3304676 - RNA, 21 nt, Mycobacterium tuberculosis H37Rv
cugcgccgcccgcgccaccga

SEQ ID NO: 3304677 - RNA, 14 nt, Mycobacterium tuberculosis H37Rv
cugcgccgccggcg

SEQ ID NO: 3304678 - RNA, 16 nt, Mycobacterium tuberculosis H37Rv
cugcgccgcgcgcggc

SEQ ID NO: 3304679 - RNA, 13 nt, Mycobacterium tuberculosis H37Rv
cugcgccggccgc

SEQ ID NO: 3304680 - RNA, 15 nt, Mycobacterium tuberculosis H37Rv
cugcgccgggcucgc

SEQ ID NO: 3304681 - RNA, 21 nt, Mycobacterium tuberculosis H37Rv
cugcgccgggcucgcgaucgu

SEQ ID NO: 3304682 - RNA, 19 nt, Mycobacterium tuberculosis H37Rv
cugcgccgguaacuguccg

SEQ ID NO: 3304683 - RNA, 15 nt, Mycobacterium tuberculosis H37Rv
cugcgccgucgcagc

SEQ ID NO: 3304684 - RNA, 18 nt, Mycobacterium tuberculosis H37Rv
cugcgccgucgcagccag

SEQ ID NO: 3304685 - RNA, 16 nt, Mycobacterium tuberculosis H37Rv
cugcgccgugacccau

SEQ ID NO: 3304686 - RNA, 14 nt, Mycobacterium tuberculosis H37Rv
cugcgccguucgcu

SEQ ID NO: 3304687 - RNA, 14 nt, Mycobacterium tuberculosis H37Rv
cugcgccuaacccc

SEQ ID NO: 3304688 - RNA, 23 nt, Mycobacterium tuberculosis H37Rv
cugcgccuaaccccggcucgacg

SEQ ID NO: 3304689 - RNA, 22 nt, Mycobacterium tuberculosis H37Rv
cugcgccucggcggccagcucg

SEQ ID NO: 3304690 - RNA, 15 nt, Mycobacterium tuberculosis H37Rv
cugcgccuucgccag

SEQ ID NO: 3304691 - RNA, 16 nt, Mycobacterium tuberculosis H37Rv
cugcgccuucgccagc

SEQ ID NO: 3304692 - RNA, 16 nt, Mycobacterium tuberculosis H37Rv
cugcgcgaagccacca

SEQ ID NO: 3304693 - RNA, 16 nt, Mycobacterium tuberculosis H37Rv
cugcgcgaaggggacg

SEQ ID NO: 3304694 - RNA, 19 nt, Mycobacterium tuberculosis H37Rv
cugcgcgaaggggacgugc

SEQ ID NO: 3304695 - RNA, 14 nt, Mycobacterium tuberculosis H37Rv
cugcgcgaccgacc

SEQ ID NO: 3304696 - RNA, 17 nt, Mycobacterium tuberculosis H37Rv
cugcgcgaccgaccagc

SEQ ID NO: 3304697 - RNA, 18 nt, Mycobacterium tuberculosis H37Rv
cugcgcgaccgaccagcc

SEQ ID NO: 3304698 - RNA, 18 nt, Mycobacterium tuberculosis H37Rv
cugcgcgacgacauuggu

SEQ ID NO: 3304699 - RNA, 21 nt, Mycobacterium tuberculosis H37Rv
cugcgcgaugcccacgcacag

SEQ ID NO: 3304700 - RNA, 14 nt, Mycobacterium tuberculosis H37Rv
cugcgcgauggccg

SEQ ID NO: 3304701 - RNA, 20 nt, Mycobacterium tuberculosis H37Rv
cugcgcgauggccguugcca

SEQ ID NO: 3304702 - RNA, 13 nt, Mycobacterium tuberculosis H37Rv
cugcgcgccagac

SEQ ID NO: 3304703 - RNA, 13 nt, Mycobacterium tuberculosis H37Rv
cugcgcgccguuc

SEQ ID NO: 3304704 - RNA, 17 nt, Mycobacterium tuberculosis H37Rv
cugcgcgcggccgcgcu

SEQ ID NO: 3304705 - RNA, 23 nt, Mycobacterium tuberculosis H37Rv
cugcgcgcggccgcgcugcagca

SEQ ID NO: 3304706 - RNA, 18 nt, Mycobacterium tuberculosis H37Rv
cugcgcgcguugcgguca

SEQ ID NO: 3304707 - RNA, 15 nt, Mycobacterium tuberculosis H37Rv
cugcgcggcugccgu

SEQ ID NO: 3304708 - RNA, 22 nt, Mycobacterium tuberculosis H37Rv
cugcgcggugccggccguucgu

SEQ ID NO: 3304709 - RNA, 18 nt, Mycobacterium tuberculosis H37Rv
cugcgcgucgagcagcac

SEQ ID NO: 3304710 - RNA, 22 nt, Mycobacterium tuberculosis H37Rv
cugcgcucgggcugccgcaugc

SEQ ID NO: 3304711 - RNA, 17 nt, Mycobacterium tuberculosis H37Rv
cugcgcuguucggcacg

SEQ ID NO: 3304712 - RNA, 17 nt, Mycobacterium tuberculosis H37Rv
cugcgcuuugcacagcg

SEQ ID NO: 3304713 - RNA, 14 nt, Mycobacterium tuberculosis H37Rv
cugcggaagccacc

SEQ ID NO: 3304714 - RNA, 22 nt, Mycobacterium tuberculosis H37Rv
cugcggacaagucggcaccggu

SEQ ID NO: 3304715 - RNA, 13 nt, Mycobacterium tuberculosis H37Rv
cugcggacuggca

SEQ ID NO: 3304716 - RNA, 13 nt, Mycobacterium tuberculosis H37Rv
cugcggaggcggg

SEQ ID NO: 3304717 - RNA, 15 nt, Mycobacterium tuberculosis H37Rv
cugcggaggcgggug

SEQ ID NO: 3304718 - RNA, 16 nt, Mycobacterium tuberculosis H37Rv
cugcggauccaccacg

SEQ ID NO: 3304719 - RNA, 23 nt, Mycobacterium tuberculosis H37Rv
cugcggauuaagucggcggccuu

SEQ ID NO: 3304720 - RNA, 19 nt, Mycobacterium tuberculosis H37Rv
cugcggcaacggcucgucg

SEQ ID NO: 3304721 - RNA, 11 nt, Mycobacterium tuberculosis H37Rv
cugcggcacca

SEQ ID NO: 3304722 - RNA, 14 nt, Mycobacterium tuberculosis H37Rv
cugcggcaccggcu

SEQ ID NO: 3304723 - RNA, 12 nt, Mycobacterium tuberculosis H37Rv
cugcggcaccuc

SEQ ID NO: 3304724 - RNA, 18 nt, Mycobacterium tuberculosis H37Rv
cugcggcagcgcggccaa

SEQ ID NO: 3304725 - RNA, 20 nt, Mycobacterium tuberculosis H37Rv
cugcggcaguaccccucgca

SEQ ID NO: 3304726 - RNA, 20 nt, Mycobacterium tuberculosis H37Rv
cugcggccacgccgaugcgg

SEQ ID NO: 3304727 - RNA, 15 nt, Mycobacterium tuberculosis H37Rv
cugcggccagcgcgg

SEQ ID NO: 3304728 - RNA, 17 nt, Mycobacterium tuberculosis H37Rv
cugcggccagcgcggcg

SEQ ID NO: 3304729 - RNA, 12 nt, Mycobacterium tuberculosis H37Rv
cugcggccaggg

SEQ ID NO: 3304730 - RNA, 18 nt, Mycobacterium tuberculosis H37Rv
cugcggcccacaccagcg

SEQ ID NO: 3304731 - RNA, 20 nt, Mycobacterium tuberculosis H37Rv
cugcggcccacaccagcgca

SEQ ID NO: 3304732 - RNA, 17 nt, Mycobacterium tuberculosis H37Rv
cugcggcccaugaucuc

SEQ ID NO: 3304733 - RNA, 18 nt, Mycobacterium tuberculosis H37Rv
cugcggcccaugaucucg

SEQ ID NO: 3304734 - RNA, 19 nt, Mycobacterium tuberculosis H37Rv
cugcggcccaugaucucgg

SEQ ID NO: 3304735 - RNA, 21 nt, Mycobacterium tuberculosis H37Rv
cugcggccgauauccaaugcc

SEQ ID NO: 3304736 - RNA, 15 nt, Mycobacterium tuberculosis H37Rv
cugcggccgcgaggu

SEQ ID NO: 3304737 - RNA, 13 nt, Mycobacterium tuberculosis H37Rv
cugcggccgcgcc

SEQ ID NO: 3304738 - RNA, 13 nt, Mycobacterium tuberculosis H37Rv
cugcggcggccau

SEQ ID NO: 3304739 - RNA, 12 nt, Mycobacterium tuberculosis H37Rv
cugcggcggcuu

SEQ ID NO: 3304740 - RNA, 16 nt, Mycobacterium tuberculosis H37Rv
cugcugcgagaucuug

SEQ ID NO: 3304741 - RNA, 20 nt, Mycobacterium tuberculosis H37Rv
cugcugcgagaucuugaugc

SEQ ID NO: 3304742 - RNA, 16 nt, Mycobacterium tuberculosis H37Rv
cugcugcggcagcgcg

SEQ ID NO: 3304743 - RNA, 19 nt, Mycobacterium tuberculosis H37Rv
cugcugcggcagcgcggcc

SEQ ID NO: 3304744 - RNA, 13 nt, Mycobacterium tuberculosis H37Rv
cugcugcggccag

SEQ ID NO: 3304745 - RNA, 16 nt, Mycobacterium tuberculosis H37Rv
cugcugcucggccugg

SEQ ID NO: 3304746 - RNA, 16 nt, Mycobacterium tuberculosis H37Rv
cugcuggaucucggug

SEQ ID NO: 3304747 - RNA, 17 nt, Mycobacterium tuberculosis H37Rv
cugcuggaucucggugg

SEQ ID NO: 3304748 - RNA, 18 nt, Mycobacterium tuberculosis H37Rv
cugcuggcccugcuccuc

SEQ ID NO: 3304749 - RNA, 12 nt, Mycobacterium tuberculosis H37Rv
cugcuggcgcuc

SEQ ID NO: 3304750 - RNA, 21 nt, Mycobacterium tuberculosis H37Rv
cugcuggcgcuuugggcugcc

SEQ ID NO: 3304751 - RNA, 18 nt, Mycobacterium tuberculosis H37Rv
cugcugguaccgggcucc

SEQ ID NO: 3304752 - RNA, 22 nt, Mycobacterium tuberculosis H37Rv
cugcuggugacgaaagcgccca

SEQ ID NO: 3304753 - RNA, 19 nt, Mycobacterium tuberculosis H37Rv
cugcugucaccgcaaccga

SEQ ID NO: 3304754 - RNA, 16 nt, Mycobacterium tuberculosis H37Rv
cugcugugggauucgg

SEQ ID NO: 3304755 - RNA, 21 nt, Mycobacterium tuberculosis H37Rv
cugcuguuccaucaaggucau

SEQ ID NO: 3304756 - RNA, 17 nt, Mycobacterium tuberculosis H37Rv
cugcuguuucggcagga

SEQ ID NO: 3304757 - RNA, 22 nt, Mycobacterium tuberculosis H37Rv
cugcuucuccgagaucagcggc

SEQ ID NO: 3304758 - RNA, 13 nt, Mycobacterium tuberculosis H37Rv
cugcuugacuccg

SEQ ID NO: 3304759 - RNA, 19 nt, Mycobacterium tuberculosis H37Rv
cugcuugacuccgcgcgcu

SEQ ID NO: 3304760 - RNA, 21 nt, Mycobacterium tuberculosis H37Rv
cugcuugagcucgcugaucag

SEQ ID NO: 3304761 - RNA, 23 nt, Mycobacterium tuberculosis H37Rv
cugcuugaugguguccucgucga

SEQ ID NO: 3304762 - RNA, 23 nt, Mycobacterium tuberculosis H37Rv
cugcuuggucgcccagccacuga

SEQ ID NO: 3304763 - RNA, 22 nt, Mycobacterium tuberculosis H37Rv
cugcuugguggucuuggccggu

SEQ ID NO: 3304764 - RNA, 15 nt, Mycobacterium tuberculosis H37Rv
cuggaaagggccgcc

SEQ ID NO: 3304765 - RNA, 17 nt, Mycobacterium tuberculosis H37Rv
cuggaaagggccgccgc

SEQ ID NO: 3304766 - RNA, 14 nt, Mycobacterium tuberculosis H37Rv
cuggaaccccgagc

SEQ ID NO: 3304767 - RNA, 16 nt, Mycobacterium tuberculosis H37Rv
cuggaagcggcgacua

SEQ ID NO: 3304768 - RNA, 20 nt, Mycobacterium tuberculosis H37Rv
cuggaaggcgggcaguugac

SEQ ID NO: 3304769 - RNA, 19 nt, Mycobacterium tuberculosis H37Rv
cuggaaguacacggcggcc

SEQ ID NO: 3304770 - RNA, 14 nt, Mycobacterium tuberculosis H37Rv
cuggaaguaguccc

SEQ ID NO: 3304771 - RNA, 22 nt, Mycobacterium tuberculosis H37Rv
cuggaauggcucacgcuccgcc

SEQ ID NO: 3304772 - RNA, 17 nt, Mycobacterium tuberculosis H37Rv
cuggacaaccucgucga

SEQ ID NO: 3304773 - RNA, 20 nt, Mycobacterium tuberculosis H37Rv
cuggacauaccggcccgggu

SEQ ID NO: 3304774 - RNA, 18 nt, Mycobacterium tuberculosis H37Rv
cuggaccacagccgcgcc

SEQ ID NO: 3304775 - RNA, 19 nt, Mycobacterium tuberculosis H37Rv
cuggaccacucgccggcgg

SEQ ID NO: 3304776 - RNA, 16 nt, Mycobacterium tuberculosis H37Rv
cuggacccgcauggcg

SEQ ID NO: 3304777 - RNA, 15 nt, Mycobacterium tuberculosis H37Rv
cuggacccgcccagg

SEQ ID NO: 3304778 - RNA, 13 nt, Mycobacterium tuberculosis H37Rv
cuggaccgcggug

SEQ ID NO: 3304779 - RNA, 11 nt, Mycobacterium tuberculosis H37Rv
cuggaccuccg

SEQ ID NO: 3304780 - RNA, 18 nt, Mycobacterium tuberculosis H37Rv
cuggacggaucuggaugu

SEQ ID NO: 3304781 - RNA, 15 nt, Mycobacterium tuberculosis H37Rv
cuggacggcgggccg

SEQ ID NO: 3304782 - RNA, 20 nt, Mycobacterium tuberculosis H37Rv
cuggacggucauccggccgu

SEQ ID NO: 3304783 - RNA, 14 nt, Mycobacterium tuberculosis H37Rv
cuggacgucggcga

SEQ ID NO: 3304784 - RNA, 19 nt, Mycobacterium tuberculosis H37Rv
cuggacuccggucagcgcg

SEQ ID NO: 3304785 - RNA, 17 nt, Mycobacterium tuberculosis H37Rv
cuggacugcagcccugc

SEQ ID NO: 3304786 - RNA, 21 nt, Mycobacterium tuberculosis H37Rv
cuggacugcagcccugcgcag

SEQ ID NO: 3304787 - RNA, 19 nt, Mycobacterium tuberculosis H37Rv
cuggacuuccgguucaucg

SEQ ID NO: 3304788 - RNA, 20 nt, Mycobacterium tuberculosis H37Rv
cuggagaaaccacuggaugg

SEQ ID NO: 3304789 - RNA, 13 nt, Mycobacterium tuberculosis H37Rv
cuggagaucacgc

SEQ ID NO: 3304790 - RNA, 16 nt, Mycobacterium tuberculosis H37Rv
cuggagcagccacgau

SEQ ID NO: 3304791 - RNA, 23 nt, Mycobacterium tuberculosis H37Rv
cuggaggggcaacaggggaaaac

SEQ ID NO: 3304792 - RNA, 21 nt, Mycobacterium tuberculosis H37Rv
cuggaggugaacucguucagc

SEQ ID NO: 3304793 - RNA, 19 nt, Mycobacterium tuberculosis H37Rv
cuggagguguuugacgcgc

SEQ ID NO: 3304794 - RNA, 14 nt, Mycobacterium tuberculosis H37Rv
cuggagugaggcug

SEQ ID NO: 3304795 - RNA, 19 nt, Mycobacterium tuberculosis H37Rv
cuggauacccagcgcccgg

SEQ ID NO: 3304796 - RNA, 13 nt, Mycobacterium tuberculosis H37Rv
cuggaucagcguc

SEQ ID NO: 3304797 - RNA, 18 nt, Mycobacterium tuberculosis H37Rv
cuggaucagcgucggugg

SEQ ID NO: 3304798 - RNA, 19 nt, Mycobacterium tuberculosis H37Rv
cuggaucgacuucggugga

SEQ ID NO: 3304799 - RNA, 12 nt, Mycobacterium tuberculosis H37Rv
cuggaucgagcu

SEQ ID NO: 3304800 - RNA, 17 nt, Mycobacterium tuberculosis H37Rv
cuggaucgcgauggccu

SEQ ID NO: 3304801 - RNA, 20 nt, Mycobacterium tuberculosis H37Rv
cuggaucgcgcccugagcca

SEQ ID NO: 3304802 - RNA, 15 nt, Mycobacterium tuberculosis H37Rv
cuggaugccgaucgg

SEQ ID NO: 3304803 - RNA, 20 nt, Mycobacterium tuberculosis H37Rv
cuggauggcgcccugcgcca

SEQ ID NO: 3304804 - RNA, 23 nt, Mycobacterium tuberculosis H37Rv
cuggauguaguuggcgaccugcg

SEQ ID NO: 3304805 - RNA, 17 nt, Mycobacterium tuberculosis H37Rv
cuggcaaaguaucgcag

SEQ ID NO: 3304806 - RNA, 13 nt, Mycobacterium tuberculosis H37Rv
cuggcaacgacac

SEQ ID NO: 3304807 - RNA, 14 nt, Mycobacterium tuberculosis H37Rv
cuggcaacgacacg

SEQ ID NO: 3304808 - RNA, 18 nt, Mycobacterium tuberculosis H37Rv
cuggcaacgccgcgccgu

SEQ ID NO: 3304809 - RNA, 20 nt, Mycobacterium tuberculosis H37Rv
cuggcaaguccggucgcgga

SEQ ID NO: 3304810 - RNA, 22 nt, Mycobacterium tuberculosis H37Rv
cuggcacccggggugcccggcc

SEQ ID NO: 3304811 - RNA, 13 nt, Mycobacterium tuberculosis H37Rv
cuggcaccgccag

SEQ ID NO: 3304812 - RNA, 14 nt, Mycobacterium tuberculosis H37Rv
cuggcaccgccagc

SEQ ID NO: 3304813 - RNA, 17 nt, Mycobacterium tuberculosis H37Rv
cuggcaccgccagccac

SEQ ID NO: 3304814 - RNA, 18 nt, Mycobacterium tuberculosis H37Rv
cuggcaccucgcccuccc

SEQ ID NO: 3304815 - RNA, 16 nt, Mycobacterium tuberculosis H37Rv
cuggcagaccaacgcu

SEQ ID NO: 3304816 - RNA, 15 nt, Mycobacterium tuberculosis H37Rv
cuggcagcggccucc

SEQ ID NO: 3304817 - RNA, 16 nt, Mycobacterium tuberculosis H37Rv
cuggcaggccagcaug

SEQ ID NO: 3304818 - RNA, 14 nt, Mycobacterium tuberculosis H37Rv
cuggcaggccggcg

SEQ ID NO: 3304819 - RNA, 22 nt, Mycobacterium tuberculosis H37Rv
cuggcagugugggggucagggg

SEQ ID NO: 3304820 - RNA, 13 nt, Mycobacterium tuberculosis H37Rv
cuggcauaucccu

SEQ ID NO: 3304821 - RNA, 18 nt, Mycobacterium tuberculosis H37Rv
cuggcauaucccuugccg

SEQ ID NO: 3304822 - RNA, 20 nt, Mycobacterium tuberculosis H37Rv
cuggcaucccgggcagucca

SEQ ID NO: 3304823 - RNA, 14 nt, Mycobacterium tuberculosis H37Rv
cuggccaaccgggu

SEQ ID NO: 3304824 - RNA, 13 nt, Mycobacterium tuberculosis H37Rv
cuggccacccaga

SEQ ID NO: 3304825 - RNA, 15 nt, Mycobacterium tuberculosis H37Rv
cuggccacgauccgc

SEQ ID NO: 3304826 - RNA, 20 nt, Mycobacterium tuberculosis H37Rv
cuggccacggggcugccggu

SEQ ID NO: 3304827 - RNA, 15 nt, Mycobacterium tuberculosis H37Rv
cuggccacucacauu

SEQ ID NO: 3304828 - RNA, 23 nt, Mycobacterium tuberculosis H37Rv
cuggccacucacauuggccaggu

SEQ ID NO: 3304829 - RNA, 21 nt, Mycobacterium tuberculosis H37Rv
cuggccacucccagccaaccc

SEQ ID NO: 3304830 - RNA, 20 nt, Mycobacterium tuberculosis H37Rv
cuggccacuuucagaucgau

SEQ ID NO: 3304831 - RNA, 14 nt, Mycobacterium tuberculosis H37Rv
cuggccagcacacc

SEQ ID NO: 3304832 - RNA, 17 nt, Mycobacterium tuberculosis H37Rv
cuggccagcagagcggc

SEQ ID NO: 3304833 - RNA, 19 nt, Mycobacterium tuberculosis H37Rv
cuggccagcagagcggcac

SEQ ID NO: 3304834 - RNA, 15 nt, Mycobacterium tuberculosis H37Rv
cuggccagcaggguu

SEQ ID NO: 3304835 - RNA, 14 nt, Mycobacterium tuberculosis H37Rv
cuggccagguugcc

SEQ ID NO: 3304836 - RNA, 19 nt, Mycobacterium tuberculosis H37Rv
cuggcuaucugauccagcc

SEQ ID NO: 3304837 - RNA, 24 nt, Mycobacterium tuberculosis H37Rv
cuggcuaucugauccagccgcguc

SEQ ID NO: 3304838 - RNA, 15 nt, Mycobacterium tuberculosis H37Rv
cuggcucaucgaagc

SEQ ID NO: 3304839 - RNA, 16 nt, Mycobacterium tuberculosis H37Rv
cuggcuccggccaggg

SEQ ID NO: 3304840 - RNA, 15 nt, Mycobacterium tuberculosis H37Rv
cuggcuggaccacuc

SEQ ID NO: 3304841 - RNA, 22 nt, Mycobacterium tuberculosis H37Rv
cuggcuggaccacucgccggcg

SEQ ID NO: 3304842 - RNA, 23 nt, Mycobacterium tuberculosis H37Rv
cuggcuggaccacucgccggcgg

SEQ ID NO: 3304843 - RNA, 13 nt, Mycobacterium tuberculosis H37Rv
cuggcuggucagg

SEQ ID NO: 3304844 - RNA, 18 nt, Mycobacterium tuberculosis H37Rv
cuggcuggugauggccau

SEQ ID NO: 3304845 - RNA, 19 nt, Mycobacterium tuberculosis H37Rv
cuggcuggugauggccauc

SEQ ID NO: 3304846 - RNA, 16 nt, Mycobacterium tuberculosis H37Rv
cuggcuguccgcgggc

SEQ ID NO: 3304847 - RNA, 23 nt, Mycobacterium tuberculosis H37Rv
cuggcuugggccagcgcaucuuu

SEQ ID NO: 3304848 - RNA, 16 nt, Mycobacterium tuberculosis H37Rv
cugggaaacugggucu

SEQ ID NO: 3304849 - RNA, 16 nt, Mycobacterium tuberculosis H37Rv
cugggaggcggcgcca

SEQ ID NO: 3304850 - RNA, 19 nt, Mycobacterium tuberculosis H37Rv
cugggagggaccacccggu

SEQ ID NO: 3304851 - RNA, 16 nt, Mycobacterium tuberculosis H37Rv
cugggauguucgauca

SEQ ID NO: 3304852 - RNA, 21 nt, Mycobacterium tuberculosis H37Rv
cugggauguucgaucagcgac

SEQ ID NO: 3304853 - RNA, 21 nt, Mycobacterium tuberculosis H37Rv
cugggauguucuuggucaccg

SEQ ID NO: 3304854 - RNA, 19 nt, Mycobacterium tuberculosis H37Rv
cugggcaaacugggcaccg

SEQ ID NO: 3304855 - RNA, 19 nt, Mycobacterium tuberculosis H37Rv
cugggcaacauaggucaug

SEQ ID NO: 3304856 - RNA, 15 nt, Mycobacterium tuberculosis H37Rv
cugggcaagaccgcg

SEQ ID NO: 3304857 - RNA, 15 nt, Mycobacterium tuberculosis H37Rv
cugggcaccggcggu

SEQ ID NO: 3304858 - RNA, 20 nt, Mycobacterium tuberculosis H37Rv
cugggcaccggcggucugca

SEQ ID NO: 3304859 - RNA, 19 nt, Mycobacterium tuberculosis H37Rv
cugggcacggagaccgugg

SEQ ID NO: 3304860 - RNA, 14 nt, Mycobacterium tuberculosis H37Rv
cugggcagaccgau

SEQ ID NO: 3304861 - RNA, 19 nt, Mycobacterium tuberculosis H37Rv
cugggcagaccgaucggca

SEQ ID NO: 3304862 - RNA, 17 nt, Mycobacterium tuberculosis H37Rv
cugggcaggaucgaggc

SEQ ID NO: 3304863 - RNA, 18 nt, Mycobacterium tuberculosis H37Rv
cugggcaucaccgacgcg

SEQ ID NO: 3304864 - RNA, 23 nt, Mycobacterium tuberculosis H37Rv
cugggcaucaccgccgcggccgc

SEQ ID NO: 3304865 - RNA, 16 nt, Mycobacterium tuberculosis H37Rv
cugggccaacacagcg

SEQ ID NO: 3304866 - RNA, 15 nt, Mycobacterium tuberculosis H37Rv
cugggccagccgcuc

SEQ ID NO: 3304867 - RNA, 19 nt, Mycobacterium tuberculosis H37Rv
cugggcccgagcgcgcgcu

SEQ ID NO: 3304868 - RNA, 16 nt, Mycobacterium tuberculosis H37Rv
cugggcccgccagccc

SEQ ID NO: 3304869 - RNA, 18 nt, Mycobacterium tuberculosis H37Rv
cugggcccgccagcccag

SEQ ID NO: 3304870 - RNA, 18 nt, Mycobacterium tuberculosis H37Rv
cugggcccgccgucaccg

SEQ ID NO: 3304871 - RNA, 19 nt, Mycobacterium tuberculosis H37Rv
cugggcccgccgucaccgc

SEQ ID NO: 3304872 - RNA, 16 nt, Mycobacterium tuberculosis H37Rv
cugggccgagcgcgcc

SEQ ID NO: 3304873 - RNA, 13 nt, Mycobacterium tuberculosis H37Rv
cugggccgcacaa

SEQ ID NO: 3304874 - RNA, 14 nt, Mycobacterium tuberculosis H37Rv
cugggccggggagg

SEQ ID NO: 3304875 - RNA, 19 nt, Mycobacterium tuberculosis H37Rv
cugggccggggaggcuagg

SEQ ID NO: 3304876 - RNA, 22 nt, Mycobacterium tuberculosis H37Rv
cugggccggugcgaauggugca

SEQ ID NO: 3304877 - RNA, 14 nt, Mycobacterium tuberculosis H37Rv
cugggccugcggca

SEQ ID NO: 3304878 - RNA, 20 nt, Mycobacterium tuberculosis H37Rv
cugggcgauauuggacgcgc

SEQ ID NO: 3304879 - RNA, 18 nt, Mycobacterium tuberculosis H37Rv
cugggcgcccgcgguccg

SEQ ID NO: 3304880 - RNA, 23 nt, Mycobacterium tuberculosis H37Rv
cugggcgcccgcgguccggcgaa

SEQ ID NO: 3304881 - RNA, 22 nt, Mycobacterium tuberculosis H37Rv
cugggcgcgaccccaggcgcuc

SEQ ID NO: 3304882 - RNA, 17 nt, Mycobacterium tuberculosis H37Rv
cugggcgcgcucaucga

SEQ ID NO: 3304883 - RNA, 14 nt, Mycobacterium tuberculosis H37Rv
cugggcgcgcuggc

SEQ ID NO: 3304884 - RNA, 15 nt, Mycobacterium tuberculosis H37Rv
cugggcgcgcuggcg

SEQ ID NO: 3304885 - RNA, 15 nt, Mycobacterium tuberculosis H37Rv
cugggcgcuggaggc

SEQ ID NO: 3304886 - RNA, 22 nt, Mycobacterium tuberculosis H37Rv
cugggcgcuggaggccaccacc

SEQ ID NO: 3304887 - RNA, 14 nt, Mycobacterium tuberculosis H37Rv
cugggcggccgggc

SEQ ID NO: 3304888 - RNA, 12 nt, Mycobacterium tuberculosis H37Rv
cugggcucgguc

SEQ ID NO: 3304889 - RNA, 14 nt, Mycobacterium tuberculosis H37Rv
cugggcugccggcc

SEQ ID NO: 3304890 - RNA, 20 nt, Mycobacterium tuberculosis H37Rv
cugggcugccuugauugccg

SEQ ID NO: 3304891 - RNA, 15 nt, Mycobacterium tuberculosis H37Rv
cugggcugcggccgc

SEQ ID NO: 3304892 - RNA, 23 nt, Mycobacterium tuberculosis H37Rv
cugggcuuucugcacccgccagg

SEQ ID NO: 3304893 - RNA, 18 nt, Mycobacterium tuberculosis H37Rv
cuggggaacagcagcgca

SEQ ID NO: 3304894 - RNA, 21 nt, Mycobacterium tuberculosis H37Rv
cuggggaugcgauggcccggg

SEQ ID NO: 3304895 - RNA, 12 nt, Mycobacterium tuberculosis H37Rv
cuggggccacca

SEQ ID NO: 3304896 - RNA, 16 nt, Mycobacterium tuberculosis H37Rv
cuggggcccggccgcc

SEQ ID NO: 3304897 - RNA, 21 nt, Mycobacterium tuberculosis H37Rv
cuggggcgcccgagaccgggc

SEQ ID NO: 3304898 - RNA, 14 nt, Mycobacterium tuberculosis H37Rv
cugggggauaccgc

SEQ ID NO: 3304899 - RNA, 16 nt, Mycobacterium tuberculosis H37Rv
cuggggguaccucccg

SEQ ID NO: 3304900 - RNA, 20 nt, Mycobacterium tuberculosis H37Rv
cuggggguggcagcgcggcc

SEQ ID NO: 3304901 - RNA, 16 nt, Mycobacterium tuberculosis H37Rv
cuggggugaacuccau

SEQ ID NO: 3304902 - RNA, 20 nt, Mycobacterium tuberculosis H37Rv
cuggggugacugcgggccgc

SEQ ID NO: 3304903 - RNA, 20 nt, Mycobacterium tuberculosis H37Rv
cuggggugcugcgcgcggcg

SEQ ID NO: 3304904 - RNA, 19 nt, Mycobacterium tuberculosis H37Rv
cugggguuggcucggcgca

SEQ ID NO: 3304905 - RNA, 16 nt, Mycobacterium tuberculosis H37Rv
cuggguaguucaccgc

SEQ ID NO: 3304906 - RNA, 14 nt, Mycobacterium tuberculosis H37Rv
cuggguauccaccg

SEQ ID NO: 3304907 - RNA, 17 nt, Mycobacterium tuberculosis H37Rv
cuggguauccaccgcga

SEQ ID NO: 3304908 - RNA, 16 nt, Mycobacterium tuberculosis H37Rv
cuggguccacgcgcuc

SEQ ID NO: 3304909 - RNA, 14 nt, Mycobacterium tuberculosis H37Rv
cugggugaccagga

SEQ ID NO: 3304910 - RNA, 15 nt, Mycobacterium tuberculosis H37Rv
cugggugccgcagcu

SEQ ID NO: 3304911 - RNA, 19 nt, Mycobacterium tuberculosis H37Rv
cugggugccggcagcggcg

SEQ ID NO: 3304912 - RNA, 13 nt, Mycobacterium tuberculosis H37Rv
cugggugccggug

SEQ ID NO: 3304913 - RNA, 15 nt, Mycobacterium tuberculosis H37Rv
cugggugcgcgaagg

SEQ ID NO: 3304914 - RNA, 17 nt, Mycobacterium tuberculosis H37Rv
cugggugcgcggccgcc

SEQ ID NO: 3304915 - RNA, 13 nt, Mycobacterium tuberculosis H37Rv
cuggguggcgucg

SEQ ID NO: 3304916 - RNA, 14 nt, Mycobacterium tuberculosis H37Rv
cuggguggcgucgc

SEQ ID NO: 3304917 - RNA, 14 nt, Mycobacterium tuberculosis H37Rv
cuggguuggcaucc

SEQ ID NO: 3304918 - RNA, 22 nt, Mycobacterium tuberculosis H37Rv
cuggguuggugauugcggccgc

SEQ ID NO: 3304919 - RNA, 13 nt, Mycobacterium tuberculosis H37Rv
cugguacaccagg

SEQ ID NO: 3304920 - RNA, 19 nt, Mycobacterium tuberculosis H37Rv
cugguagaggcggcgaugg

SEQ ID NO: 3304921 - RNA, 13 nt, Mycobacterium tuberculosis H37Rv
cugguagcgcacc

SEQ ID NO: 3304922 - RNA, 14 nt, Mycobacterium tuberculosis H37Rv
cugguaggucaccg

SEQ ID NO: 3304923 - RNA, 12 nt, Mycobacterium tuberculosis H37Rv
cugguagucgcc

SEQ ID NO: 3304924 - RNA, 12 nt, Mycobacterium tuberculosis H37Rv
cuggucaacagc

SEQ ID NO: 3304925 - RNA, 12 nt, Mycobacterium tuberculosis H37Rv
cuggucaaccgc

SEQ ID NO: 3304926 - RNA, 15 nt, Mycobacterium tuberculosis H37Rv
cuggucaagacccgc

SEQ ID NO: 3304927 - RNA, 17 nt, Mycobacterium tuberculosis H37Rv
cuggucaccagccaccg

SEQ ID NO: 3304928 - RNA, 14 nt, Mycobacterium tuberculosis H37Rv
cuggucacugcccu

SEQ ID NO: 3304929 - RNA, 22 nt, Mycobacterium tuberculosis H37Rv
cuggucagccgcggcggcagca

SEQ ID NO: 3304930 - RNA, 21 nt, Mycobacterium tuberculosis H37Rv
cuggucauggccgaacauucc

SEQ ID NO: 3304931 - RNA, 13 nt, Mycobacterium tuberculosis H37Rv
cugguccaaucgc

SEQ ID NO: 3304932 - RNA, 14 nt, Mycobacterium tuberculosis H37Rv
cugguccagcaccg

SEQ ID NO: 3304933 - RNA, 20 nt, Mycobacterium tuberculosis H37Rv
cugucgauggacaaggugug

SEQ ID NO: 3304934 - RNA, 21 nt, Mycobacterium tuberculosis H37Rv
cugucgauggacaaggugugg

SEQ ID NO: 3304935 - RNA, 20 nt, Mycobacterium tuberculosis H37Rv
cugucgauuucgccgucgcu

SEQ ID NO: 3304936 - RNA, 13 nt, Mycobacterium tuberculosis H37Rv
cugucgcaccaga

SEQ ID NO: 3304937 - RNA, 20 nt, Mycobacterium tuberculosis H37Rv
cugucgccagggagcgcagc

SEQ ID NO: 3304938 - RNA, 16 nt, Mycobacterium tuberculosis H37Rv
cugucgcccucgaucg

SEQ ID NO: 3304939 - RNA, 23 nt, Mycobacterium tuberculosis H37Rv
cugucgcccucgaucgccacgac

SEQ ID NO: 3304940 - RNA, 22 nt, Mycobacterium tuberculosis H37Rv
cugucgccuuugagggcgacga

SEQ ID NO: 3304941 - RNA, 15 nt, Mycobacterium tuberculosis H37Rv
cugucgcgcaccgga

SEQ ID NO: 3304942 - RNA, 14 nt, Mycobacterium tuberculosis H37Rv
cugucgcgccggug

SEQ ID NO: 3304943 - RNA, 22 nt, Mycobacterium tuberculosis H37Rv
cugucgcgccgguggucagguu

SEQ ID NO: 3304944 - RNA, 17 nt, Mycobacterium tuberculosis H37Rv
cugucggcaugccgguc

SEQ ID NO: 3304945 - RNA, 19 nt, Mycobacterium tuberculosis H37Rv
cugucguaccgcggaucgg

SEQ ID NO: 3304946 - RNA, 16 nt, Mycobacterium tuberculosis H37Rv
cugucguagcgcgaga

SEQ ID NO: 3304947 - RNA, 22 nt, Mycobacterium tuberculosis H37Rv
cugucgugauacagcucggugc

SEQ ID NO: 3304948 - RNA, 21 nt, Mycobacterium tuberculosis H37Rv
cugucgugccucucgggggcc

SEQ ID NO: 3304949 - RNA, 14 nt, Mycobacterium tuberculosis H37Rv
cugucguuugacga

SEQ ID NO: 3304950 - RNA, 20 nt, Mycobacterium tuberculosis H37Rv
cugucuggucggcuacggcc

SEQ ID NO: 3304951 - RNA, 17 nt, Mycobacterium tuberculosis H37Rv
cugugaacagcgcgucg

SEQ ID NO: 3304952 - RNA, 21 nt, Mycobacterium tuberculosis H37Rv
cugugaaucucacgacgccuu

SEQ ID NO: 3304953 - RNA, 22 nt, Mycobacterium tuberculosis H37Rv
cugugaaucugacgacgcgaca

SEQ ID NO: 3304954 - RNA, 19 nt, Mycobacterium tuberculosis H37Rv
cugugacacccgagggccu

SEQ ID NO: 3304955 - RNA, 20 nt, Mycobacterium tuberculosis H37Rv
cugugacacccgagggccug

SEQ ID NO: 3304956 - RNA, 23 nt, Mycobacterium tuberculosis H37Rv
cugugacacccgagggccugacg

SEQ ID NO: 3304957 - RNA, 18 nt, Mycobacterium tuberculosis H37Rv
cugugacgccgggcuggg

SEQ ID NO: 3304958 - RNA, 19 nt, Mycobacterium tuberculosis H37Rv
cugugacuaaggucacaga

SEQ ID NO: 3304959 - RNA, 11 nt, Mycobacterium tuberculosis H37Rv
cugugagguca

SEQ ID NO: 3304960 - RNA, 14 nt, Mycobacterium tuberculosis H37Rv
cugugaggucauug

SEQ ID NO: 3304961 - RNA, 16 nt, Mycobacterium tuberculosis H37Rv
cugugauccgacagug

SEQ ID NO: 3304962 - RNA, 18 nt, Mycobacterium tuberculosis H37Rv
cugugauccgacaguggc

SEQ ID NO: 3304963 - RNA, 15 nt, Mycobacterium tuberculosis H37Rv
cugugccagcagcag

SEQ ID NO: 3304964 - RNA, 16 nt, Mycobacterium tuberculosis H37Rv
cugugcccgaucagcc

SEQ ID NO: 3304965 - RNA, 22 nt, Mycobacterium tuberculosis H37Rv
cugugcccggcuccuccccggc

SEQ ID NO: 3304966 - RNA, 21 nt, Mycobacterium tuberculosis H37Rv
cugugccgcugcauccgcagc

SEQ ID NO: 3304967 - RNA, 13 nt, Mycobacterium tuberculosis H37Rv
cugugcgacccgc

SEQ ID NO: 3304968 - RNA, 15 nt, Mycobacterium tuberculosis H37Rv
cugugcgcagacauc

SEQ ID NO: 3304969 - RNA, 14 nt, Mycobacterium tuberculosis H37Rv
cugugcuauggccg

SEQ ID NO: 3304970 - RNA, 20 nt, Mycobacterium tuberculosis H37Rv
cugugcuauggccgcaccga

SEQ ID NO: 3304971 - RNA, 19 nt, Mycobacterium tuberculosis H37Rv
cugugcuucguugucggcg

SEQ ID NO: 3304972 - RNA, 22 nt, Mycobacterium tuberculosis H37Rv
cuguggaagcccgucgcggccg

SEQ ID NO: 3304973 - RNA, 14 nt, Mycobacterium tuberculosis H37Rv
cuguggaugccgac

SEQ ID NO: 3304974 - RNA, 12 nt, Mycobacterium tuberculosis H37Rv
cuguggcgcgca

SEQ ID NO: 3304975 - RNA, 14 nt, Mycobacterium tuberculosis H37Rv
cuguggcucgacga

SEQ ID NO: 3304976 - RNA, 20 nt, Mycobacterium tuberculosis H37Rv
cugugggcgagucgggggcc

SEQ ID NO: 3304977 - RNA, 22 nt, Mycobacterium tuberculosis H37Rv
cuguggucgcugcugccgcacc

SEQ ID NO: 3304978 - RNA, 21 nt, Mycobacterium tuberculosis H37Rv
cuguggucggugccagcacca

SEQ ID NO: 3304979 - RNA, 17 nt, Mycobacterium tuberculosis H37Rv
cugugucccgucgaugu

SEQ ID NO: 3304980 - RNA, 18 nt, Mycobacterium tuberculosis H37Rv
cugugucccgucgaugug

SEQ ID NO: 3304981 - RNA, 15 nt, Mycobacterium tuberculosis H37Rv
cugugucguggucga

SEQ ID NO: 3304982 - RNA, 22 nt, Mycobacterium tuberculosis H37Rv
cuguguuugcggcuucggcaga

SEQ ID NO: 3304983 - RNA, 14 nt, Mycobacterium tuberculosis H37Rv
cuguuacuccgacg

SEQ ID NO: 3304984 - RNA, 21 nt, Mycobacterium tuberculosis H37Rv
cuguuacuccgacggcccggu

SEQ ID NO: 3304985 - RNA, 16 nt, Mycobacterium tuberculosis H37Rv
cuguuccagcgucugc

SEQ ID NO: 3304986 - RNA, 14 nt, Mycobacterium tuberculosis H37Rv
cuguucccacaucg

SEQ ID NO: 3304987 - RNA, 19 nt, Mycobacterium tuberculosis H37Rv
cuguuccuugugaccccgg

SEQ ID NO: 3304988 - RNA, 21 nt, Mycobacterium tuberculosis H37Rv
cuguucggccaacccgggccg

SEQ ID NO: 3304989 - RNA, 16 nt, Mycobacterium tuberculosis H37Rv
cuguugaagaagcccg

SEQ ID NO: 3304990 - RNA, 17 nt, Mycobacterium tuberculosis H37Rv
cuguugaagaagcccga

SEQ ID NO: 3304991 - RNA, 20 nt, Mycobacterium tuberculosis H37Rv
cuguugaagaagcccgaaga

SEQ ID NO: 3304992 - RNA, 23 nt, Mycobacterium tuberculosis H37Rv
cuguugacgccacgacgcccacc

SEQ ID NO: 3304993 - RNA, 19 nt, Mycobacterium tuberculosis H37Rv
cuguugacucugcguccac

SEQ ID NO: 3304994 - RNA, 18 nt, Mycobacterium tuberculosis H37Rv
cuguugcaucgccgcgau

SEQ ID NO: 3304995 - RNA, 13 nt, Mycobacterium tuberculosis H37Rv
cuguugccccucc

SEQ ID NO: 3304996 - RNA, 16 nt, Mycobacterium tuberculosis H37Rv
cuguugcggcggcgcu

SEQ ID NO: 3304997 - RNA, 15 nt, Mycobacterium tuberculosis H37Rv
cuguugcguagcgcg

SEQ ID NO: 3304998 - RNA, 22 nt, Mycobacterium tuberculosis H37Rv
cuguuggcaugccgcccgcucc

SEQ ID NO: 3304999 - RNA, 13 nt, Mycobacterium tuberculosis H37Rv
cuguuggccacca

SEQ ID NO: 3305000 - RNA, 14 nt, Mycobacterium tuberculosis H37Rv
cuguuggccagccg

SEQ ID NO: 3305001 - RNA, 20 nt, Mycobacterium tuberculosis H37Rv
cuguuggugccgccaccacc

SEQ ID NO: 3305002 - RNA, 15 nt, Mycobacterium tuberculosis H37Rv
cuguuguacggccca

SEQ ID NO: 3305003 - RNA, 13 nt, Mycobacterium tuberculosis H37Rv
cuguuguggugcg

SEQ ID NO: 3305004 - RNA, 17 nt, Mycobacterium tuberculosis H37Rv
cuguuguugucgguguc

SEQ ID NO: 3305005 - RNA, 14 nt, Mycobacterium tuberculosis H37Rv
cuguuucugagcgc

SEQ ID NO: 3305006 - RNA, 22 nt, Mycobacterium tuberculosis H37Rv
cuuaaacgggcucuucgcagcg

SEQ ID NO: 3305007 - RNA, 16 nt, Mycobacterium tuberculosis H37Rv
cuuaacacaugcaagu

SEQ ID NO: 3305008 - RNA, 19 nt, Mycobacterium tuberculosis H37Rv
cuuaaccgagccgaccggc

SEQ ID NO: 3305009 - RNA, 19 nt, Mycobacterium tuberculosis H37Rv
cuuaaccugaaccggccgc

SEQ ID NO: 3305010 - RNA, 17 nt, Mycobacterium tuberculosis H37Rv
cuuaagccggcgcggcg

SEQ ID NO: 3305011 - RNA, 21 nt, Mycobacterium tuberculosis H37Rv
cuuaagcgaacccgagccgcc

SEQ ID NO: 3305012 - RNA, 15 nt, Mycobacterium tuberculosis H37Rv
cuuacacgccuggcu

SEQ ID NO: 3305013 - RNA, 18 nt, Mycobacterium tuberculosis H37Rv
cuuacuugaucucggcga

SEQ ID NO: 3305014 - RNA, 20 nt, Mycobacterium tuberculosis H37Rv
cuuagccauuuccuuggcgc

SEQ ID NO: 3305015 - RNA, 14 nt, Mycobacterium tuberculosis H37Rv
cuuagcccgauggu

SEQ ID NO: 3305016 - RNA, 14 nt, Mycobacterium tuberculosis H37Rv
cuuagcggcuuggc

SEQ ID NO: 3305017 - RNA, 14 nt, Mycobacterium tuberculosis H37Rv
cuuagcugccgucg

SEQ ID NO: 3305018 - RNA, 18 nt, Mycobacterium tuberculosis H37Rv
cuuaggacccaauguggu

SEQ ID NO: 3305019 - RNA, 18 nt, Mycobacterium tuberculosis H37Rv
cuuagggcgcccgccccg

SEQ ID NO: 3305020 - RNA, 19 nt, Mycobacterium tuberculosis H37Rv
cuuaucgaacgucucggcc

SEQ ID NO: 3305021 - RNA, 17 nt, Mycobacterium tuberculosis H37Rv
cuuaucgucgacgccga

SEQ ID NO: 3305022 - RNA, 12 nt, Mycobacterium tuberculosis H37Rv
cuuaucuccggc

SEQ ID NO: 3305023 - RNA, 14 nt, Mycobacterium tuberculosis H37Rv
cuuaugcacgacgg

SEQ ID NO: 3305024 - RNA, 12 nt, Mycobacterium tuberculosis H37Rv
cuuaugcgcggu

SEQ ID NO: 3305025 - RNA, 14 nt, Mycobacterium tuberculosis H37Rv
cuuaugcgcgguga

SEQ ID NO: 3305026 - RNA, 20 nt, Mycobacterium tuberculosis H37Rv
cuuauuggacugcagcgugu

SEQ ID NO: 3305027 - RNA, 21 nt, Mycobacterium tuberculosis H37Rv
cuucaagauuaccgaagcccg

SEQ ID NO: 3305028 - RNA, 18 nt, Mycobacterium tuberculosis H37Rv
cuucaaggaagccgcggc

SEQ ID NO: 3305029 - RNA, 18 nt, Mycobacterium tuberculosis H37Rv
cuucgcucgggucaucuu

SEQ ID NO: 3305030 - RNA, 18 nt, Mycobacterium tuberculosis H37Rv
cuucgcugcggugggcca

SEQ ID NO: 3305031 - RNA, 14 nt, Mycobacterium tuberculosis H37Rv
cuucgcuggaaacc

SEQ ID NO: 3305032 - RNA, 18 nt, Mycobacterium tuberculosis H37Rv
cuucggacagcagccggc

SEQ ID NO: 3305033 - RNA, 19 nt, Mycobacterium tuberculosis H37Rv
cuucggacagcagccggcg

SEQ ID NO: 3305034 - RNA, 15 nt, Mycobacterium tuberculosis H37Rv
cuucggcagaccggc

SEQ ID NO: 3305035 - RNA, 18 nt, Mycobacterium tuberculosis H37Rv
cuucggccaaccaugcug

SEQ ID NO: 3305036 - RNA, 15 nt, Mycobacterium tuberculosis H37Rv
cuucggccagcuccc

SEQ ID NO: 3305037 - RNA, 12 nt, Mycobacterium tuberculosis H37Rv
cuucggccgcac

SEQ ID NO: 3305038 - RNA, 21 nt, Mycobacterium tuberculosis H37Rv
cuucggccugugcgggcaggu

SEQ ID NO: 3305039 - RNA, 15 nt, Mycobacterium tuberculosis H37Rv
cuucggccuucuuga

SEQ ID NO: 3305040 - RNA, 19 nt, Mycobacterium tuberculosis H37Rv
cuucggccuucuugaggua

SEQ ID NO: 3305041 - RNA, 14 nt, Mycobacterium tuberculosis H37Rv
cuucggcgacaggc

SEQ ID NO: 3305042 - RNA, 16 nt, Mycobacterium tuberculosis H37Rv
cuucggcgagcguacc

SEQ ID NO: 3305043 - RNA, 14 nt, Mycobacterium tuberculosis H37Rv
cuucggcuagguca

SEQ ID NO: 3305044 - RNA, 14 nt, Mycobacterium tuberculosis H37Rv
cuucggcugguagg

SEQ ID NO: 3305045 - RNA, 12 nt, Mycobacterium tuberculosis H37Rv
cuucgggcggcg

SEQ ID NO: 3305046 - RNA, 18 nt, Mycobacterium tuberculosis H37Rv
cuucgggcucguccagca

SEQ ID NO: 3305047 - RNA, 17 nt, Mycobacterium tuberculosis H37Rv
cuucgggguaaccggcg

SEQ ID NO: 3305048 - RNA, 19 nt, Mycobacterium tuberculosis H37Rv
cuucgggguaaccggcgga

SEQ ID NO: 3305049 - RNA, 13 nt, Mycobacterium tuberculosis H37Rv
cuucggguccagc

SEQ ID NO: 3305050 - RNA, 15 nt, Mycobacterium tuberculosis H37Rv
cuucggguccagcgg

SEQ ID NO: 3305051 - RNA, 19 nt, Mycobacterium tuberculosis H37Rv
cuucggguccagcggccgc

SEQ ID NO: 3305052 - RNA, 22 nt, Mycobacterium tuberculosis H37Rv
cuucggguccagcggccgccgc

SEQ ID NO: 3305053 - RNA, 17 nt, Mycobacterium tuberculosis H37Rv
cuucgggugcagccaga

SEQ ID NO: 3305054 - RNA, 17 nt, Mycobacterium tuberculosis H37Rv
cuucgggugugacgcgc

SEQ ID NO: 3305055 - RNA, 19 nt, Mycobacterium tuberculosis H37Rv
cuucggguguucgcgcgcg

SEQ ID NO: 3305056 - RNA, 14 nt, Mycobacterium tuberculosis H37Rv
cuucgguggcgggc

SEQ ID NO: 3305057 - RNA, 23 nt, Mycobacterium tuberculosis H37Rv
cuucgguggcgggcuugccgucu

SEQ ID NO: 3305058 - RNA, 22 nt, Mycobacterium tuberculosis H37Rv
cuucggugguuccggcuggugg

SEQ ID NO: 3305059 - RNA, 16 nt, Mycobacterium tuberculosis H37Rv
cuucgguguagcccag

SEQ ID NO: 3305060 - RNA, 17 nt, Mycobacterium tuberculosis H37Rv
cuucggugucgccgaac

SEQ ID NO: 3305061 - RNA, 14 nt, Mycobacterium tuberculosis H37Rv
cuucgguguggcac

SEQ ID NO: 3305062 - RNA, 15 nt, Mycobacterium tuberculosis H37Rv
cuucguagcggccgc

SEQ ID NO: 3305063 - RNA, 17 nt, Mycobacterium tuberculosis H37Rv
cuucguauaggcgaugu

SEQ ID NO: 3305064 - RNA, 21 nt, Mycobacterium tuberculosis H37Rv
cuucguauaggcgauguucga

SEQ ID NO: 3305065 - RNA, 18 nt, Mycobacterium tuberculosis H37Rv
cuucgucaaccaccagga

SEQ ID NO: 3305066 - RNA, 17 nt, Mycobacterium tuberculosis H37Rv
cuucgucauggccggcc

SEQ ID NO: 3305067 - RNA, 21 nt, Mycobacterium tuberculosis H37Rv
cuucgucauggccggccaucg

SEQ ID NO: 3305068 - RNA, 12 nt, Mycobacterium tuberculosis H37Rv
cuucgucggccg

SEQ ID NO: 3305069 - RNA, 15 nt, Mycobacterium tuberculosis H37Rv
cuucgucggccggca

SEQ ID NO: 3305070 - RNA, 22 nt, Mycobacterium tuberculosis H37Rv
cuucgucggccggcaccccacg

SEQ ID NO: 3305071 - RNA, 14 nt, Mycobacterium tuberculosis H37Rv
cuucgugcaccaca

SEQ ID NO: 3305072 - RNA, 16 nt, Mycobacterium tuberculosis H37Rv
cuucuaccccggugac

SEQ ID NO: 3305073 - RNA, 14 nt, Mycobacterium tuberculosis H37Rv
cuucuccaccaccg

SEQ ID NO: 3305074 - RNA, 20 nt, Mycobacterium tuberculosis H37Rv
cuucuccaccagcguggacg

SEQ ID NO: 3305075 - RNA, 19 nt, Mycobacterium tuberculosis H37Rv
cuucuccccgaucagcacc

SEQ ID NO: 3305076 - RNA, 15 nt, Mycobacterium tuberculosis H37Rv
cuucuccgagaucag

SEQ ID NO: 3305077 - RNA, 23 nt, Mycobacterium tuberculosis H37Rv
cuucuccguccccgcagcgccua

SEQ ID NO: 3305078 - RNA, 14 nt, Mycobacterium tuberculosis H37Rv
cuucucgagccgcc

SEQ ID NO: 3305079 - RNA, 15 nt, Mycobacterium tuberculosis H37Rv
cuucucgagccgccg

SEQ ID NO: 3305080 - RNA, 18 nt, Mycobacterium tuberculosis H37Rv
cuucucggcgggucaggc

SEQ ID NO: 3305081 - RNA, 18 nt, Mycobacterium tuberculosis H37Rv
cuucucguaacgcggcac

SEQ ID NO: 3305082 - RNA, 21 nt, Mycobacterium tuberculosis H37Rv
cuucugcacgaacgccugcuc

SEQ ID NO: 3305083 - RNA, 13 nt, Mycobacterium tuberculosis H37Rv
cuucugccgggag

SEQ ID NO: 3305084 - RNA, 14 nt, Mycobacterium tuberculosis H37Rv
cuucugccugcgca

SEQ ID NO: 3305085 - RNA, 17 nt, Mycobacterium tuberculosis H37Rv
cuucugcgucugcucgc

SEQ ID NO: 3305086 - RNA, 18 nt, Mycobacterium tuberculosis H37Rv
cuucuggcaggugaacug

SEQ ID NO: 3305087 - RNA, 15 nt, Mycobacterium tuberculosis H37Rv
cuucugguccagcac

SEQ ID NO: 3305088 - RNA, 18 nt, Mycobacterium tuberculosis H37Rv
cuucuuaccgcgggccgc

SEQ ID NO: 3305089 - RNA, 20 nt, Mycobacterium tuberculosis H37Rv
cuucuucaccgccuugguca

SEQ ID NO: 3305090 - RNA, 14 nt, Mycobacterium tuberculosis H37Rv
cuucuucacuggcg

SEQ ID NO: 3305091 - RNA, 16 nt, Mycobacterium tuberculosis H37Rv
cuucuucgcuaccuuc

SEQ ID NO: 3305092 - RNA, 21 nt, Mycobacterium tuberculosis H37Rv
cuucuucggucaccucgaugc

SEQ ID NO: 3305093 - RNA, 22 nt, Mycobacterium tuberculosis H37Rv
cuucuugacacccaccucgcca

SEQ ID NO: 3305094 - RNA, 19 nt, Mycobacterium tuberculosis H37Rv
cuucuuggcggccuuuguc

SEQ ID NO: 3305095 - RNA, 22 nt, Mycobacterium tuberculosis H37Rv
cuucuuggcggccuuugucgcc

SEQ ID NO: 3305096 - RNA, 18 nt, Mycobacterium tuberculosis H37Rv
cuucuuggcugcacuggc

SEQ ID NO: 3305097 - RNA, 20 nt, Mycobacterium tuberculosis H37Rv
cuucuuggcugcacuggccc

SEQ ID NO: 3305098 - RNA, 16 nt, Mycobacterium tuberculosis H37Rv
cuucuuguuggcagcg

SEQ ID NO: 3305099 - RNA, 14 nt, Mycobacterium tuberculosis H37Rv
cuucuuugccggcg

SEQ ID NO: 3305100 - RNA, 13 nt, Mycobacterium tuberculosis H37Rv
cuugaaacccagg

SEQ ID NO: 3305101 - RNA, 23 nt, Mycobacterium tuberculosis H37Rv
cuugaaacggugucucgcccacc

SEQ ID NO: 3305102 - RNA, 19 nt, Mycobacterium tuberculosis H37Rv
cuugacagcuuucuuggcg

SEQ ID NO: 3305103 - RNA, 13 nt, Mycobacterium tuberculosis H37Rv
cuugaccagagca

SEQ ID NO: 3305104 - RNA, 14 nt, Mycobacterium tuberculosis H37Rv
cuugaccagcagcu

SEQ ID NO: 3305105 - RNA, 17 nt, Mycobacterium tuberculosis H37Rv
cuugaccagcagcugaa

SEQ ID NO: 3305106 - RNA, 21 nt, Mycobacterium tuberculosis H37Rv
cuugacccuugggcaccaccc

SEQ ID NO: 3305107 - RNA, 14 nt, Mycobacterium tuberculosis H37Rv
cuugaccgcaccgg

SEQ ID NO: 3305108 - RNA, 12 nt, Mycobacterium tuberculosis H37Rv
cuugaccgccug

SEQ ID NO: 3305109 - RNA, 22 nt, Mycobacterium tuberculosis H37Rv
cuugaccgcggugacucggccu

SEQ ID NO: 3305110 - RNA, 17 nt, Mycobacterium tuberculosis H37Rv
cuugacgcgcaacgccg

SEQ ID NO: 3305111 - RNA, 22 nt, Mycobacterium tuberculosis H37Rv
cuugacgcggccacauaccacc

SEQ ID NO: 3305112 - RNA, 16 nt, Mycobacterium tuberculosis H37Rv
cuugacggcgccaggc

SEQ ID NO: 3305113 - RNA, 21 nt, Mycobacterium tuberculosis H37Rv
cuugagcaaaauggccaccgg

SEQ ID NO: 3305114 - RNA, 23 nt, Mycobacterium tuberculosis H37Rv
cuugagcacacguccggcgauga

SEQ ID NO: 3305115 - RNA, 17 nt, Mycobacterium tuberculosis H37Rv
cuugagcacuccgucgu

SEQ ID NO: 3305116 - RNA, 19 nt, Mycobacterium tuberculosis H37Rv
cuugagccgggcaaccagc

SEQ ID NO: 3305117 - RNA, 20 nt, Mycobacterium tuberculosis H37Rv
cuugagccgggcaaccagca

SEQ ID NO: 3305118 - RNA, 14 nt, Mycobacterium tuberculosis H37Rv
cuugaggucaccca

SEQ ID NO: 3305119 - RNA, 15 nt, Mycobacterium tuberculosis H37Rv
cuugaucgacggcca

SEQ ID NO: 3305120 - RNA, 13 nt, Mycobacterium tuberculosis H37Rv
cuugaucgagcag

SEQ ID NO: 3305121 - RNA, 15 nt, Mycobacterium tuberculosis H37Rv
cuugaucgagcaggg

SEQ ID NO: 3305122 - RNA, 20 nt, Mycobacterium tuberculosis H37Rv
cuugaucucggcgagcaccg

SEQ ID NO: 3305123 - RNA, 13 nt, Mycobacterium tuberculosis H37Rv
cuugaugccgcac

SEQ ID NO: 3305124 - RNA, 14 nt, Mycobacterium tuberculosis H37Rv
cuugaugcucgaug

SEQ ID NO: 3305125 - RNA, 15 nt, Mycobacterium tuberculosis H37Rv
cuugaugcucgaugc

SEQ ID NO: 3305126 - RNA, 17 nt, Mycobacterium tuberculosis H37Rv
gaaaaccccggccacca

SEQ ID NO: 3305127 - RNA, 23 nt, Mycobacterium tuberculosis H37Rv
gaaaacccggucggcgaaaggcc

SEQ ID NO: 3305128 - RNA, 21 nt, Mycobacterium tuberculosis H37Rv
gaaaaccgucgcagaaaccau

SEQ ID NO: 3305129 - RNA, 19 nt, Mycobacterium tuberculosis H37Rv
gaaaaccucggacugcagc

SEQ ID NO: 3305130 - RNA, 18 nt, Mycobacterium tuberculosis H37Rv
gaaaagaacccgggaucg

SEQ ID NO: 3305131 - RNA, 14 nt, Mycobacterium tuberculosis H37Rv
gaaaagacugcgcc

SEQ ID NO: 3305132 - RNA, 15 nt, Mycobacterium tuberculosis H37Rv
gaaaagcgccucggu

SEQ ID NO: 3305133 - RNA, 21 nt, Mycobacterium tuberculosis H37Rv
gaaaaucgguuguggucagcu

SEQ ID NO: 3305134 - RNA, 23 nt, Mycobacterium tuberculosis H37Rv
gaaaaucugcuagcuuggcggcc

SEQ ID NO: 3305135 - RNA, 23 nt, Mycobacterium tuberculosis H37Rv
gaaaauugacccccuagaccggg

SEQ ID NO: 3305136 - RNA, 16 nt, Mycobacterium tuberculosis H37Rv
gaaaauugcuccacca

SEQ ID NO: 3305137 - RNA, 17 nt, Mycobacterium tuberculosis H37Rv
gaaacaagcaagcgugu

SEQ ID NO: 3305138 - RNA, 14 nt, Mycobacterium tuberculosis H37Rv
gaaacacgacagcc

SEQ ID NO: 3305139 - RNA, 17 nt, Mycobacterium tuberculosis H37Rv
gaaacacgacagccagu

SEQ ID NO: 3305140 - RNA, 23 nt, Mycobacterium tuberculosis H37Rv
gaaacagcacccagacgauggcc

SEQ ID NO: 3305141 - RNA, 15 nt, Mycobacterium tuberculosis H37Rv
gaaacagcacgcccg

SEQ ID NO: 3305142 - RNA, 14 nt, Mycobacterium tuberculosis H37Rv
gaaacagcauggcg

SEQ ID NO: 3305143 - RNA, 14 nt, Mycobacterium tuberculosis H37Rv
gaaacagcgaucgc

SEQ ID NO: 3305144 - RNA, 15 nt, Mycobacterium tuberculosis H37Rv
gaaacagcuugcugc

SEQ ID NO: 3305145 - RNA, 12 nt, Mycobacterium tuberculosis H37Rv
gaaacaggccac

SEQ ID NO: 3305146 - RNA, 17 nt, Mycobacterium tuberculosis H37Rv
gaaacagguaagcagcc

SEQ ID NO: 3305147 - RNA, 21 nt, Mycobacterium tuberculosis H37Rv
gaaacagguaagcagccagca

SEQ ID NO: 3305148 - RNA, 22 nt, Mycobacterium tuberculosis H37Rv
gaaacagguaagcagccagcaa

SEQ ID NO: 3305149 - RNA, 20 nt, Mycobacterium tuberculosis H37Rv
gaaacagugguuagucggcc

SEQ ID NO: 3305150 - RNA, 13 nt, Mycobacterium tuberculosis H37Rv
gaaacauccccga

SEQ ID NO: 3305151 - RNA, 21 nt, Mycobacterium tuberculosis H37Rv
gaaacaucucggcgcagccgg

SEQ ID NO: 3305152 - RNA, 20 nt, Mycobacterium tuberculosis H37Rv
gaaaccacugcacccgaucg

SEQ ID NO: 3305153 - RNA, 12 nt, Mycobacterium tuberculosis H37Rv
gaaaccacugga

SEQ ID NO: 3305154 - RNA, 14 nt, Mycobacterium tuberculosis H37Rv
gaaaccaucgccag

SEQ ID NO: 3305155 - RNA, 21 nt, Mycobacterium tuberculosis H37Rv
gaaaccaugccgccgaagccg

SEQ ID NO: 3305156 - RNA, 15 nt, Mycobacterium tuberculosis H37Rv
gaaaccauucggcga

SEQ ID NO: 3305157 - RNA, 21 nt, Mycobacterium tuberculosis H37Rv
gaaacccgaaguagaacgggu

SEQ ID NO: 3305158 - RNA, 17 nt, Mycobacterium tuberculosis H37Rv
gaaacccgccgcgauga

SEQ ID NO: 3305159 - RNA, 15 nt, Mycobacterium tuberculosis H37Rv
gaaaccgcagucgcg

SEQ ID NO: 3305160 - RNA, 19 nt, Mycobacterium tuberculosis H37Rv
gaaaccgcugggggcgguc

SEQ ID NO: 3305161 - RNA, 21 nt, Mycobacterium tuberculosis H37Rv
gaaaccguggccaucgauccc

SEQ ID NO: 3305162 - RNA, 18 nt, Mycobacterium tuberculosis H37Rv
gaaaccucuucgggugca

SEQ ID NO: 3305163 - RNA, 14 nt, Mycobacterium tuberculosis H37Rv
gaaacgagccggug

SEQ ID NO: 3305164 - RNA, 15 nt, Mycobacterium tuberculosis H37Rv
gaaacgaucgcgcca

SEQ ID NO: 3305165 - RNA, 18 nt, Mycobacterium tuberculosis H37Rv
gaaacgauugcugcggcu

SEQ ID NO: 3305166 - RNA, 22 nt, Mycobacterium tuberculosis H37Rv
gaaacgccaggggacccggggc

SEQ ID NO: 3305167 - RNA, 18 nt, Mycobacterium tuberculosis H37Rv
gaaacgccauacgucgcc

SEQ ID NO: 3305168 - RNA, 13 nt, Mycobacterium tuberculosis H37Rv
gaaacgccgagcg

SEQ ID NO: 3305169 - RNA, 22 nt, Mycobacterium tuberculosis H37Rv
gaaacgccgcaauggaccgaac

SEQ ID NO: 3305170 - RNA, 20 nt, Mycobacterium tuberculosis H37Rv
gaaacgccggguucgccgga

SEQ ID NO: 3305171 - RNA, 17 nt, Mycobacterium tuberculosis H37Rv
gaaacgcgaugguggcc

SEQ ID NO: 3305172 - RNA, 15 nt, Mycobacterium tuberculosis H37Rv
gaaacgcgcggaucg

SEQ ID NO: 3305173 - RNA, 23 nt, Mycobacterium tuberculosis H37Rv
gaaacgcguaucccagauacauc

SEQ ID NO: 3305174 - RNA, 19 nt, Mycobacterium tuberculosis H37Rv
gaaacggaccuccucgccc

SEQ ID NO: 3305175 - RNA, 17 nt, Mycobacterium tuberculosis H37Rv
gaaacggauuggucgac

SEQ ID NO: 3305176 - RNA, 20 nt, Mycobacterium tuberculosis H37Rv
gaaacggauuggucgaccga

SEQ ID NO: 3305177 - RNA, 17 nt, Mycobacterium tuberculosis H37Rv
gaaacggcaccggaucc

SEQ ID NO: 3305178 - RNA, 20 nt, Mycobacterium tuberculosis H37Rv
gaaacggggggcgucgccgu

SEQ ID NO: 3305179 - RNA, 17 nt, Mycobacterium tuberculosis H37Rv
gaaacggugucucgccc

SEQ ID NO: 3305180 - RNA, 19 nt, Mycobacterium tuberculosis H37Rv
gaaacggugucucgcccac

SEQ ID NO: 3305181 - RNA, 18 nt, Mycobacterium tuberculosis H37Rv
gaaacguaugacgcccac

SEQ ID NO: 3305182 - RNA, 17 nt, Mycobacterium tuberculosis H37Rv
gaaacguccuugaacgu

SEQ ID NO: 3305183 - RNA, 21 nt, Mycobacterium tuberculosis H37Rv
gaaacucaagccacgucgucg

SEQ ID NO: 3305184 - RNA, 18 nt, Mycobacterium tuberculosis H37Rv
gaaacucaccagcacccc

SEQ ID NO: 3305185 - RNA, 12 nt, Mycobacterium tuberculosis H37Rv
gaaacugacccg

SEQ ID NO: 3305186 - RNA, 22 nt, Mycobacterium tuberculosis H37Rv
gaaacugcucggauccggccag

SEQ ID NO: 3305187 - RNA, 15 nt, Mycobacterium tuberculosis H37Rv
gaaagacaacccgcu

SEQ ID NO: 3305188 - RNA, 16 nt, Mycobacterium tuberculosis H37Rv
gaaagacgcuguccag

SEQ ID NO: 3305189 - RNA, 15 nt, Mycobacterium tuberculosis H37Rv
gaaagcagcagcggc

SEQ ID NO: 3305190 - RNA, 14 nt, Mycobacterium tuberculosis H37Rv
gaaagccaauagca

SEQ ID NO: 3305191 - RNA, 12 nt, Mycobacterium tuberculosis H37Rv
gaaagccaggcg

SEQ ID NO: 3305192 - RNA, 12 nt, Mycobacterium tuberculosis H37Rv
gaaagccgacca

SEQ ID NO: 3305193 - RNA, 20 nt, Mycobacterium tuberculosis H37Rv
gaaagccugcuucaggaucg

SEQ ID NO: 3305194 - RNA, 17 nt, Mycobacterium tuberculosis H37Rv
gaaagcgccgaaacagc

SEQ ID NO: 3305195 - RNA, 20 nt, Mycobacterium tuberculosis H37Rv
gaaagcgccgaaacagcacc

SEQ ID NO: 3305196 - RNA, 21 nt, Mycobacterium tuberculosis H37Rv
gaaagcgccgaaacagcaccc

SEQ ID NO: 3305197 - RNA, 15 nt, Mycobacterium tuberculosis H37Rv
gaaaggccgcgguga

SEQ ID NO: 3305198 - RNA, 21 nt, Mycobacterium tuberculosis H37Rv
gaaaggccgcggugaugggcc

SEQ ID NO: 3305199 - RNA, 13 nt, Mycobacterium tuberculosis H37Rv
gaaaggcuuccgc

SEQ ID NO: 3305200 - RNA, 18 nt, Mycobacterium tuberculosis H37Rv
gaaaggucggccugcgac

SEQ ID NO: 3305201 - RNA, 17 nt, Mycobacterium tuberculosis H37Rv
gaaaguagcgugcgaca

SEQ ID NO: 3305202 - RNA, 15 nt, Mycobacterium tuberculosis H37Rv
gaaagucgcgcgcga

SEQ ID NO: 3305203 - RNA, 22 nt, Mycobacterium tuberculosis H37Rv
gaaaguguggaauggaccagcg

SEQ ID NO: 3305204 - RNA, 16 nt, Mycobacterium tuberculosis H37Rv
gaaaguuguaucgcag

SEQ ID NO: 3305205 - RNA, 21 nt, Mycobacterium tuberculosis H37Rv
gaaaguuguaucgcagcauca

SEQ ID NO: 3305206 - RNA, 19 nt, Mycobacterium tuberculosis H37Rv
gaaauaacggagcggccua

SEQ ID NO: 3305207 - RNA, 16 nt, Mycobacterium tuberculosis H37Rv
gaaauaagggccggcg

SEQ ID NO: 3305208 - RNA, 21 nt, Mycobacterium tuberculosis H37Rv
gaaauacccagcgcagcagcg

SEQ ID NO: 3305209 - RNA, 17 nt, Mycobacterium tuberculosis H37Rv
gaaauagcugcggaggg

SEQ ID NO: 3305210 - RNA, 15 nt, Mycobacterium tuberculosis H37Rv
gaaauauuggcccgu

SEQ ID NO: 3305211 - RNA, 15 nt, Mycobacterium tuberculosis H37Rv
gaaaucaccucacca

SEQ ID NO: 3305212 - RNA, 15 nt, Mycobacterium tuberculosis H37Rv
gaaauccgagccgcg

SEQ ID NO: 3305213 - RNA, 17 nt, Mycobacterium tuberculosis H37Rv
gaaauccgagccgcgau

SEQ ID NO: 3305214 - RNA, 19 nt, Mycobacterium tuberculosis H37Rv
gaaauccugguggcagaca

SEQ ID NO: 3305215 - RNA, 16 nt, Mycobacterium tuberculosis H37Rv
gaaaucgcacagcgca

SEQ ID NO: 3305216 - RNA, 17 nt, Mycobacterium tuberculosis H37Rv
gaaaucgcccugacccg

SEQ ID NO: 3305217 - RNA, 19 nt, Mycobacterium tuberculosis H37Rv
gaaaucgcccugacccgga

SEQ ID NO: 3305218 - RNA, 14 nt, Mycobacterium tuberculosis H37Rv
gaaaucggccagcu

SEQ ID NO: 3305219 - RNA, 22 nt, Mycobacterium tuberculosis H37Rv
gaaaucggcggcguccagcagc

SEQ ID NO: 3305220 - RNA, 21 nt, Mycobacterium tuberculosis H37Rv
gaaaucgucggguaccagcac

SEQ ID NO: 3305221 - RNA, 23 nt, Mycobacterium tuberculosis H37Rv
gaaaugguucgcacaccuccucg

SEQ ID NO: 3305222 - RNA, 18 nt, Mycobacterium tuberculosis H37Rv
gaacccgaucgucgagcc

SEQ ID NO: 3305223 - RNA, 13 nt, Mycobacterium tuberculosis H37Rv
gaacccgccggca

SEQ ID NO: 3305224 - RNA, 20 nt, Mycobacterium tuberculosis H37Rv
gaacccgccgucaccgcgcg

SEQ ID NO: 3305225 - RNA, 18 nt, Mycobacterium tuberculosis H37Rv
gaacccgcgagcaucgac

SEQ ID NO: 3305226 - RNA, 22 nt, Mycobacterium tuberculosis H37Rv
gaacccgcgagguugaccacca

SEQ ID NO: 3305227 - RNA, 20 nt, Mycobacterium tuberculosis H37Rv
gaacccgcguugaaggcgcc

SEQ ID NO: 3305228 - RNA, 14 nt, Mycobacterium tuberculosis H37Rv
gaacccuccgcagc

SEQ ID NO: 3305229 - RNA, 16 nt, Mycobacterium tuberculosis H37Rv
gaaccgaagccgucga

SEQ ID NO: 3305230 - RNA, 19 nt, Mycobacterium tuberculosis H37Rv
gaaccgcagacccucgucg

SEQ ID NO: 3305231 - RNA, 16 nt, Mycobacterium tuberculosis H37Rv
gaaccgcagucaacgc

SEQ ID NO: 3305232 - RNA, 17 nt, Mycobacterium tuberculosis H37Rv
gaaccgcagucaacgca

SEQ ID NO: 3305233 - RNA, 14 nt, Mycobacterium tuberculosis H37Rv
gaaccgccccggug

SEQ ID NO: 3305234 - RNA, 11 nt, Mycobacterium tuberculosis H37Rv
gaaccgcccgc

SEQ ID NO: 3305235 - RNA, 20 nt, Mycobacterium tuberculosis H37Rv
gaaccgcggaucgaccgcca

SEQ ID NO: 3305236 - RNA, 18 nt, Mycobacterium tuberculosis H37Rv
gaaccggaucaucgccgc

SEQ ID NO: 3305237 - RNA, 20 nt, Mycobacterium tuberculosis H37Rv
gaaccggccaucgaccgucc

SEQ ID NO: 3305238 - RNA, 14 nt, Mycobacterium tuberculosis H37Rv
gaaccggccgacga

SEQ ID NO: 3305239 - RNA, 14 nt, Mycobacterium tuberculosis H37Rv
gaaccggccgcgac

SEQ ID NO: 3305240 - RNA, 14 nt, Mycobacterium tuberculosis H37Rv
gaaccggccgucga

SEQ ID NO: 3305241 - RNA, 22 nt, Mycobacterium tuberculosis H37Rv
gaaccggcgcauucccuugucg

SEQ ID NO: 3305242 - RNA, 13 nt, Mycobacterium tuberculosis H37Rv
gaaccggcugggc

SEQ ID NO: 3305243 - RNA, 18 nt, Mycobacterium tuberculosis H37Rv
gaaccggcugggcgccac

SEQ ID NO: 3305244 - RNA, 14 nt, Mycobacterium tuberculosis H37Rv
gaaccgggacacca

SEQ ID NO: 3305245 - RNA, 17 nt, Mycobacterium tuberculosis H37Rv
gaaccgggcaaaucaag

SEQ ID NO: 3305246 - RNA, 16 nt, Mycobacterium tuberculosis H37Rv
gaaccgguagucgccg

SEQ ID NO: 3305247 - RNA, 17 nt, Mycobacterium tuberculosis H37Rv
gaaccgguagucgccgu

SEQ ID NO: 3305248 - RNA, 16 nt, Mycobacterium tuberculosis H37Rv
gaaccgguaucgccaa

SEQ ID NO: 3305249 - RNA, 15 nt, Mycobacterium tuberculosis H37Rv
gaaccgguccacugu

SEQ ID NO: 3305250 - RNA, 16 nt, Mycobacterium tuberculosis H37Rv
gaaccgucucggcgac

SEQ ID NO: 3305251 - RNA, 19 nt, Mycobacterium tuberculosis H37Rv
gaaccgugcugggcaucac

SEQ ID NO: 3305252 - RNA, 15 nt, Mycobacterium tuberculosis H37Rv
gaaccgugucgccgc

SEQ ID NO: 3305253 - RNA, 18 nt, Mycobacterium tuberculosis H37Rv
gaaccguucggcgacagc

SEQ ID NO: 3305254 - RNA, 12 nt, Mycobacterium tuberculosis H37Rv
gaaccucacagc

SEQ ID NO: 3305255 - RNA, 21 nt, Mycobacterium tuberculosis H37Rv
gaaccucacagcuugagcaca

SEQ ID NO: 3305256 - RNA, 19 nt, Mycobacterium tuberculosis H37Rv
gaaccucaccugacacgcc

SEQ ID NO: 3305257 - RNA, 12 nt, Mycobacterium tuberculosis H37Rv
gaaccugcggca

SEQ ID NO: 3305258 - RNA, 16 nt, Mycobacterium tuberculosis H37Rv
gaaccugcggcagcgg

SEQ ID NO: 3305259 - RNA, 19 nt, Mycobacterium tuberculosis H37Rv
gaaccugcucggccgugca

SEQ ID NO: 3305260 - RNA, 18 nt, Mycobacterium tuberculosis H37Rv
gaaccuugaccgaccagc

SEQ ID NO: 3305261 - RNA, 20 nt, Mycobacterium tuberculosis H37Rv
gaacgaaagucuccggaacc

SEQ ID NO: 3305262 - RNA, 14 nt, Mycobacterium tuberculosis H37Rv
gaacgaaccgccgc

SEQ ID NO: 3305263 - RNA, 15 nt, Mycobacterium tuberculosis H37Rv
gaacgaagucgacga

SEQ ID NO: 3305264 - RNA, 15 nt, Mycobacterium tuberculosis H37Rv
gaacgacauccggcc

SEQ ID NO: 3305265 - RNA, 16 nt, Mycobacterium tuberculosis H37Rv
gaacgaccaggcgcac

SEQ ID NO: 3305266 - RNA, 11 nt, Mycobacterium tuberculosis H37Rv
gaacgaccucu

SEQ ID NO: 3305267 - RNA, 18 nt, Mycobacterium tuberculosis H37Rv
gaacgacgcuuucccgau

SEQ ID NO: 3305268 - RNA, 14 nt, Mycobacterium tuberculosis H37Rv
gaacgacucgacgu

SEQ ID NO: 3305269 - RNA, 14 nt, Mycobacterium tuberculosis H37Rv
gaacgaugccggca

SEQ ID NO: 3305270 - RNA, 22 nt, Mycobacterium tuberculosis H37Rv
gaacgaugccggcaagccugcg

SEQ ID NO: 3305271 - RNA, 16 nt, Mycobacterium tuberculosis H37Rv
gaacgauggacgccca

SEQ ID NO: 3305272 - RNA, 15 nt, Mycobacterium tuberculosis H37Rv
gaacgcaacagccga

SEQ ID NO: 3305273 - RNA, 18 nt, Mycobacterium tuberculosis H37Rv
gaacgcaaccgagggcau

SEQ ID NO: 3305274 - RNA, 20 nt, Mycobacterium tuberculosis H37Rv
gaacgcaccgaaacgccgac

SEQ ID NO: 3305275 - RNA, 16 nt, Mycobacterium tuberculosis H37Rv
gaacgcagccagcgcc

SEQ ID NO: 3305276 - RNA, 17 nt, Mycobacterium tuberculosis H37Rv
gaacgcagccagcgcca

SEQ ID NO: 3305277 - RNA, 18 nt, Mycobacterium tuberculosis H37Rv
gaacgcagccagcgccau

SEQ ID NO: 3305278 - RNA, 16 nt, Mycobacterium tuberculosis H37Rv
gaacgccaccaccucc

SEQ ID NO: 3305279 - RNA, 22 nt, Mycobacterium tuberculosis H37Rv
gaacgccaccaccuccgcgucg

SEQ ID NO: 3305280 - RNA, 14 nt, Mycobacterium tuberculosis H37Rv
gaacgccacgacgu

SEQ ID NO: 3305281 - RNA, 14 nt, Mycobacterium tuberculosis H37Rv
gaacgccagcagcg

SEQ ID NO: 3305282 - RNA, 17 nt, Mycobacterium tuberculosis H37Rv
gaacgccagcagcgcga

SEQ ID NO: 3305283 - RNA, 18 nt, Mycobacterium tuberculosis H37Rv
gaacgccagcagcgcgau

SEQ ID NO: 3305284 - RNA, 18 nt, Mycobacterium tuberculosis H37Rv
gaacgcccgcugcagacg

SEQ ID NO: 3305285 - RNA, 12 nt, Mycobacterium tuberculosis H37Rv
gaacgccgaaca

SEQ ID NO: 3305286 - RNA, 14 nt, Mycobacterium tuberculosis H37Rv
gaacgccgccagca

SEQ ID NO: 3305287 - RNA, 19 nt, Mycobacterium tuberculosis H37Rv
gaacgccgcccgcugggcu

SEQ ID NO: 3305288 - RNA, 15 nt, Mycobacterium tuberculosis H37Rv
gaacgccggcaucgc

SEQ ID NO: 3305289 - RNA, 17 nt, Mycobacterium tuberculosis H37Rv
gaacgccggcaucgcgc

SEQ ID NO: 3305290 - RNA, 18 nt, Mycobacterium tuberculosis H37Rv
gaacgccggcaucgcgcg

SEQ ID NO: 3305291 - RNA, 18 nt, Mycobacterium tuberculosis H37Rv
gaacgccggugcgcugga

SEQ ID NO: 3305292 - RNA, 13 nt, Mycobacterium tuberculosis H37Rv
gaacgccgucaga

SEQ ID NO: 3305293 - RNA, 20 nt, Mycobacterium tuberculosis H37Rv
gaacgccgucagaacaccgg

SEQ ID NO: 3305294 - RNA, 23 nt, Mycobacterium tuberculosis H37Rv
gaacgccgucagaacaccggcca

SEQ ID NO: 3305295 - RNA, 22 nt, Mycobacterium tuberculosis H37Rv
gaacgccucaccgacgucgcca

SEQ ID NO: 3305296 - RNA, 16 nt, Mycobacterium tuberculosis H37Rv
gaacgccucaggggcg

SEQ ID NO: 3305297 - RNA, 16 nt, Mycobacterium tuberculosis H37Rv
gaacgccucgccggcc

SEQ ID NO: 3305298 - RNA, 13 nt, Mycobacterium tuberculosis H37Rv
gaacgccugcugg

SEQ ID NO: 3305299 - RNA, 15 nt, Mycobacterium tuberculosis H37Rv
gaacgccugcuggua

SEQ ID NO: 3305300 - RNA, 22 nt, Mycobacterium tuberculosis H37Rv
gaacgcgaauaccagaccggcc

SEQ ID NO: 3305301 - RNA, 21 nt, Mycobacterium tuberculosis H37Rv
gaacgcgaaugucgcgcuguu

SEQ ID NO: 3305302 - RNA, 13 nt, Mycobacterium tuberculosis H37Rv
gaacgcgagcgcu

SEQ ID NO: 3305303 - RNA, 20 nt, Mycobacterium tuberculosis H37Rv
gaacgcgaggugauugguca

SEQ ID NO: 3305304 - RNA, 18 nt, Mycobacterium tuberculosis H37Rv
gaacgcgaucgaccuugg

SEQ ID NO: 3305305 - RNA, 17 nt, Mycobacterium tuberculosis H37Rv
gaacgcggacaccgcgg

SEQ ID NO: 3305306 - RNA, 20 nt, Mycobacterium tuberculosis H37Rv
gaacgcggccaccacaacgc

SEQ ID NO: 3305307 - RNA, 19 nt, Mycobacterium tuberculosis H37Rv
gaacgcggcgaaugccagu

SEQ ID NO: 3305308 - RNA, 21 nt, Mycobacterium tuberculosis H37Rv
gaacgcggcgucgauaaccug

SEQ ID NO: 3305309 - RNA, 19 nt, Mycobacterium tuberculosis H37Rv
gaacgcgucggucgacugu

SEQ ID NO: 3305310 - RNA, 21 nt, Mycobacterium tuberculosis H37Rv
gaacgcgucguugucgucgcc

SEQ ID NO: 3305311 - RNA, 22 nt, Mycobacterium tuberculosis H37Rv
gaacgcuagcgccaaauccggc

SEQ ID NO: 3305312 - RNA, 14 nt, Mycobacterium tuberculosis H37Rv
gaacgcuccaggcc

SEQ ID NO: 3305313 - RNA, 22 nt, Mycobacterium tuberculosis H37Rv
gaacgcugaggaagcggcggca

SEQ ID NO: 3305314 - RNA, 19 nt, Mycobacterium tuberculosis H37Rv
gaacggaauucagcgacgc

SEQ ID NO: 3305315 - RNA, 14 nt, Mycobacterium tuberculosis H37Rv
gaacggaugccggu

SEQ ID NO: 3305316 - RNA, 12 nt, Mycobacterium tuberculosis H37Rv
gaacggcagcac

SEQ ID NO: 3305317 - RNA, 16 nt, Mycobacterium tuberculosis H37Rv
gaacggcgcaguuggc

SEQ ID NO: 3305318 - RNA, 15 nt, Mycobacterium tuberculosis H37Rv
gaacggcgguguggu

SEQ ID NO: 3305319 - RNA, 12 nt, Mycobacterium tuberculosis H37Rv
gaagcacacugu

SEQ ID NO: 3305320 - RNA, 13 nt, Mycobacterium tuberculosis H37Rv
gaagcaccucccg

SEQ ID NO: 3305321 - RNA, 14 nt, Mycobacterium tuberculosis H37Rv
gaagcacgucgucg

SEQ ID NO: 3305322 - RNA, 18 nt, Mycobacterium tuberculosis H37Rv
gaagcagggauucuggau

SEQ ID NO: 3305323 - RNA, 20 nt, Mycobacterium tuberculosis H37Rv
gaagcaggugaaacaggacg

SEQ ID NO: 3305324 - RNA, 18 nt, Mycobacterium tuberculosis H37Rv
gaagccagaucgcuagga

SEQ ID NO: 3305325 - RNA, 16 nt, Mycobacterium tuberculosis H37Rv
gaagcccagaucuugc

SEQ ID NO: 3305326 - RNA, 18 nt, Mycobacterium tuberculosis H37Rv
gaagcccagaucuugcag

SEQ ID NO: 3305327 - RNA, 22 nt, Mycobacterium tuberculosis H37Rv
gaagcccagcaccaccacccga

SEQ ID NO: 3305328 - RNA, 19 nt, Mycobacterium tuberculosis H37Rv
gaagccccgguggcaggga

SEQ ID NO: 3305329 - RNA, 14 nt, Mycobacterium tuberculosis H37Rv
gaagccgaccaccg

SEQ ID NO: 3305330 - RNA, 16 nt, Mycobacterium tuberculosis H37Rv
gaagccgacgaccagc

SEQ ID NO: 3305331 - RNA, 18 nt, Mycobacterium tuberculosis H37Rv
gaagccgacgaccagcag

SEQ ID NO: 3305332 - RNA, 13 nt, Mycobacterium tuberculosis H37Rv
gaagccgacgauc

SEQ ID NO: 3305333 - RNA, 19 nt, Mycobacterium tuberculosis H37Rv
gaagccgacguugaagccg

SEQ ID NO: 3305334 - RNA, 22 nt, Mycobacterium tuberculosis H37Rv
gaagccgacguugaagccgccg

SEQ ID NO: 3305335 - RNA, 15 nt, Mycobacterium tuberculosis H37Rv
gaagccgagcaucag

SEQ ID NO: 3305336 - RNA, 21 nt, Mycobacterium tuberculosis H37Rv
gaagccgcaccgcuguugcau

SEQ ID NO: 3305337 - RNA, 18 nt, Mycobacterium tuberculosis H37Rv
gaagccgcgagcgcgcga

SEQ ID NO: 3305338 - RNA, 19 nt, Mycobacterium tuberculosis H37Rv
gaagccggccacuacggcc

SEQ ID NO: 3305339 - RNA, 20 nt, Mycobacterium tuberculosis H37Rv
gaagccgggucucggugcgg

SEQ ID NO: 3305340 - RNA, 16 nt, Mycobacterium tuberculosis H37Rv
gaagccgguucgccca

SEQ ID NO: 3305341 - RNA, 18 nt, Mycobacterium tuberculosis H37Rv
gaagccuguagucccuca

SEQ ID NO: 3305342 - RNA, 16 nt, Mycobacterium tuberculosis H37Rv
gaagccuugcagcgcc

SEQ ID NO: 3305343 - RNA, 17 nt, Mycobacterium tuberculosis H37Rv
gaagccuugcagcgccc

SEQ ID NO: 3305344 - RNA, 13 nt, Mycobacterium tuberculosis H37Rv
gaagcgaccgucg

SEQ ID NO: 3305345 - RNA, 22 nt, Mycobacterium tuberculosis H37Rv
gaagcgaugagggugcucguca

SEQ ID NO: 3305346 - RNA, 15 nt, Mycobacterium tuberculosis H37Rv
gaagcgaugccgugc

SEQ ID NO: 3305347 - RNA, 20 nt, Mycobacterium tuberculosis H37Rv
gaagcgaugccgugcugggc

SEQ ID NO: 3305348 - RNA, 13 nt, Mycobacterium tuberculosis H37Rv
gaagcgccaaccc

SEQ ID NO: 3305349 - RNA, 16 nt, Mycobacterium tuberculosis H37Rv
gaagcgccaacccggc

SEQ ID NO: 3305350 - RNA, 17 nt, Mycobacterium tuberculosis H37Rv
gaagcgccggccgaucg

SEQ ID NO: 3305351 - RNA, 15 nt, Mycobacterium tuberculosis H37Rv
gaagcgcuccagcug

SEQ ID NO: 3305352 - RNA, 16 nt, Mycobacterium tuberculosis H37Rv
gaagcgcucggcagcc

SEQ ID NO: 3305353 - RNA, 18 nt, Mycobacterium tuberculosis H37Rv
gaagcgcucggcagccgg

SEQ ID NO: 3305354 - RNA, 20 nt, Mycobacterium tuberculosis H37Rv
gaagcgcucggcagccggcu

SEQ ID NO: 3305355 - RNA, 13 nt, Mycobacterium tuberculosis H37Rv
gaagcggccaccg

SEQ ID NO: 3305356 - RNA, 19 nt, Mycobacterium tuberculosis H37Rv
gaagcggcgacuacccagc

SEQ ID NO: 3305357 - RNA, 21 nt, Mycobacterium tuberculosis H37Rv
gaagcggcugcugcgcggugc

SEQ ID NO: 3305358 - RNA, 23 nt, Mycobacterium tuberculosis H37Rv
gaagcgucuggucagccgcggcg

SEQ ID NO: 3305359 - RNA, 15 nt, Mycobacterium tuberculosis H37Rv
gaagcucaucaccgg

SEQ ID NO: 3305360 - RNA, 22 nt, Mycobacterium tuberculosis H37Rv
gaagcucaucaccggcgcaccg

SEQ ID NO: 3305361 - RNA, 16 nt, Mycobacterium tuberculosis H37Rv
gaagcucgaccgcccg

SEQ ID NO: 3305362 - RNA, 15 nt, Mycobacterium tuberculosis H37Rv
gaagcugaccagaca

SEQ ID NO: 3305363 - RNA, 21 nt, Mycobacterium tuberculosis H37Rv
gaagcuggcgccgcagguuca

SEQ ID NO: 3305364 - RNA, 19 nt, Mycobacterium tuberculosis H37Rv
gaagcuggcgugcagcagg

SEQ ID NO: 3305365 - RNA, 17 nt, Mycobacterium tuberculosis H37Rv
gaagcuguaggcgacca

SEQ ID NO: 3305366 - RNA, 19 nt, Mycobacterium tuberculosis H37Rv
gaagcuguaggcgaccaga

SEQ ID NO: 3305367 - RNA, 19 nt, Mycobacterium tuberculosis H37Rv
gaagcuuaggcgugguucc

SEQ ID NO: 3305368 - RNA, 22 nt, Mycobacterium tuberculosis H37Rv
gaaggaaccgggcaaaucaagc

SEQ ID NO: 3305369 - RNA, 20 nt, Mycobacterium tuberculosis H37Rv
gaaggagaucccccaggcga

SEQ ID NO: 3305370 - RNA, 22 nt, Mycobacterium tuberculosis H37Rv
gaaggagaucccccaggcgaac

SEQ ID NO: 3305371 - RNA, 18 nt, Mycobacterium tuberculosis H37Rv
gaaggaucagcgcacugg

SEQ ID NO: 3305372 - RNA, 20 nt, Mycobacterium tuberculosis H37Rv
gaaggauucgaagccgagcu

SEQ ID NO: 3305373 - RNA, 21 nt, Mycobacterium tuberculosis H37Rv
gaaggauuuggagcuuuuugc

SEQ ID NO: 3305374 - RNA, 23 nt, Mycobacterium tuberculosis H37Rv
gaaggauuuggagcuuuuugcgu

SEQ ID NO: 3305375 - RNA, 15 nt, Mycobacterium tuberculosis H37Rv
gaaggcaaacaccag

SEQ ID NO: 3305376 - RNA, 15 nt, Mycobacterium tuberculosis H37Rv
gaaggccgcaccgcc

SEQ ID NO: 3305377 - RNA, 17 nt, Mycobacterium tuberculosis H37Rv
gaaggccgcgcgcaggg

SEQ ID NO: 3305378 - RNA, 20 nt, Mycobacterium tuberculosis H37Rv
gaaggccgcgcgcagggcgu

SEQ ID NO: 3305379 - RNA, 22 nt, Mycobacterium tuberculosis H37Rv
gaaggccgcgcgcagggcgucg

SEQ ID NO: 3305380 - RNA, 22 nt, Mycobacterium tuberculosis H37Rv
gaaggcgacaucaccaccgacc

SEQ ID NO: 3305381 - RNA, 23 nt, Mycobacterium tuberculosis H37Rv
gaaggcgacaucaccaccgaccu

SEQ ID NO: 3305382 - RNA, 19 nt, Mycobacterium tuberculosis H37Rv
gaaggcgacccgcuggguc

SEQ ID NO: 3305383 - RNA, 18 nt, Mycobacterium tuberculosis H37Rv
gaaggcgcgggcgacguc

SEQ ID NO: 3305384 - RNA, 15 nt, Mycobacterium tuberculosis H37Rv
gaaggcggcgauacc

SEQ ID NO: 3305385 - RNA, 19 nt, Mycobacterium tuberculosis H37Rv
gaaggcggcgauacccauc

SEQ ID NO: 3305386 - RNA, 16 nt, Mycobacterium tuberculosis H37Rv
gaaggcggcuccaccg

SEQ ID NO: 3305387 - RNA, 15 nt, Mycobacterium tuberculosis H37Rv
gaaggcguggguguc

SEQ ID NO: 3305388 - RNA, 16 nt, Mycobacterium tuberculosis H37Rv
gaaggcguucgacucg

SEQ ID NO: 3305389 - RNA, 13 nt, Mycobacterium tuberculosis H37Rv
gaaggcugucagu

SEQ ID NO: 3305390 - RNA, 22 nt, Mycobacterium tuberculosis H37Rv
gaaggcugucaguucccgcuug

SEQ ID NO: 3305391 - RNA, 12 nt, Mycobacterium tuberculosis H37Rv
gaaggggcucag

SEQ ID NO: 3305392 - RNA, 16 nt, Mycobacterium tuberculosis H37Rv
gaaggguauccgugug

SEQ ID NO: 3305393 - RNA, 18 nt, Mycobacterium tuberculosis H37Rv
gaaggucaauagcgucgu

SEQ ID NO: 3305394 - RNA, 17 nt, Mycobacterium tuberculosis H37Rv
gaaggucuggccugccc

SEQ ID NO: 3305395 - RNA, 20 nt, Mycobacterium tuberculosis H37Rv
gaaggucuggccugccccag

SEQ ID NO: 3305396 - RNA, 16 nt, Mycobacterium tuberculosis H37Rv
gaaggugaaucgacug

SEQ ID NO: 3305397 - RNA, 18 nt, Mycobacterium tuberculosis H37Rv
gaaggugacgacgagggc

SEQ ID NO: 3305398 - RNA, 18 nt, Mycobacterium tuberculosis H37Rv
gaagguggcgaacccggu

SEQ ID NO: 3305399 - RNA, 16 nt, Mycobacterium tuberculosis H37Rv
gaagguguccgcuggu

SEQ ID NO: 3305400 - RNA, 18 nt, Mycobacterium tuberculosis H37Rv
gaagguguuggugcgggg

SEQ ID NO: 3305401 - RNA, 14 nt, Mycobacterium tuberculosis H37Rv
gaagguuucccgcu

SEQ ID NO: 3305402 - RNA, 16 nt, Mycobacterium tuberculosis H37Rv
gaaguaauagcuguug

SEQ ID NO: 3305403 - RNA, 17 nt, Mycobacterium tuberculosis H37Rv
gaaguaauggaacggcu

SEQ ID NO: 3305404 - RNA, 14 nt, Mycobacterium tuberculosis H37Rv
gaaguacacggcgg

SEQ ID NO: 3305405 - RNA, 15 nt, Mycobacterium tuberculosis H37Rv
gaaguacacggcggc

SEQ ID NO: 3305406 - RNA, 15 nt, Mycobacterium tuberculosis H37Rv
gaaguacaucugccg

SEQ ID NO: 3305407 - RNA, 16 nt, Mycobacterium tuberculosis H37Rv
gaaguacgacgacccg

SEQ ID NO: 3305408 - RNA, 23 nt, Mycobacterium tuberculosis H37Rv
gaaguacuggccgccgcgcaccg

SEQ ID NO: 3305409 - RNA, 14 nt, Mycobacterium tuberculosis H37Rv
gaaguagccgagcc

SEQ ID NO: 3305410 - RNA, 20 nt, Mycobacterium tuberculosis H37Rv
gaaguagguuuucggcggcu

SEQ ID NO: 3305411 - RNA, 17 nt, Mycobacterium tuberculosis H37Rv
gaaguccacgcaccacg

SEQ ID NO: 3305412 - RNA, 23 nt, Mycobacterium tuberculosis H37Rv
gaagucgacgaacucgcccaggg

SEQ ID NO: 3305413 - RNA, 14 nt, Mycobacterium tuberculosis H37Rv
gaagucgaucgccg

SEQ ID NO: 3305414 - RNA, 15 nt, Mycobacterium tuberculosis H37Rv
gaagucgaucgccga

SEQ ID NO: 3305415 - RNA, 19 nt, Mycobacterium tuberculosis H37Rv
gaaugucuuuggucgccgg

SEQ ID NO: 3305416 - RNA, 20 nt, Mycobacterium tuberculosis H37Rv
gaauguugcgaucugcggcg

SEQ ID NO: 3305417 - RNA, 21 nt, Mycobacterium tuberculosis H37Rv
gaauguugcgaucugcggcgc

SEQ ID NO: 3305418 - RNA, 18 nt, Mycobacterium tuberculosis H37Rv
gaauguugguuugccggc

SEQ ID NO: 3305419 - RNA, 19 nt, Mycobacterium tuberculosis H37Rv
gaauuaaagccaccagaau

SEQ ID NO: 3305420 - RNA, 20 nt, Mycobacterium tuberculosis H37Rv
gaauuaaagccaccagaauc

SEQ ID NO: 3305421 - RNA, 15 nt, Mycobacterium tuberculosis H37Rv
gaauucacgaugcuc

SEQ ID NO: 3305422 - RNA, 14 nt, Mycobacterium tuberculosis H37Rv
gaauucaugccggu

SEQ ID NO: 3305423 - RNA, 22 nt, Mycobacterium tuberculosis H37Rv
gaauuccagccagccgcccuga

SEQ ID NO: 3305424 - RNA, 18 nt, Mycobacterium tuberculosis H37Rv
gaauucccaugcugcgca

SEQ ID NO: 3305425 - RNA, 17 nt, Mycobacterium tuberculosis H37Rv
gaauuccccagccgcau

SEQ ID NO: 3305426 - RNA, 16 nt, Mycobacterium tuberculosis H37Rv
gaauuccgcuaccgca

SEQ ID NO: 3305427 - RNA, 14 nt, Mycobacterium tuberculosis H37Rv
gaauuccggcugcu

SEQ ID NO: 3305428 - RNA, 14 nt, Mycobacterium tuberculosis H37Rv
gaauuccuuccugg

SEQ ID NO: 3305429 - RNA, 14 nt, Mycobacterium tuberculosis H37Rv
gaauucggccggcg

SEQ ID NO: 3305430 - RNA, 14 nt, Mycobacterium tuberculosis H37Rv
gaauucggcgucgu

SEQ ID NO: 3305431 - RNA, 22 nt, Mycobacterium tuberculosis H37Rv
gacaaaaucagcagccccccgc

SEQ ID NO: 3305432 - RNA, 13 nt, Mycobacterium tuberculosis H37Rv
gacaaacagcgcc

SEQ ID NO: 3305433 - RNA, 19 nt, Mycobacterium tuberculosis H37Rv
gacaaacggcgacccagcg

SEQ ID NO: 3305434 - RNA, 21 nt, Mycobacterium tuberculosis H37Rv
gacaaacguguugaccggguc

SEQ ID NO: 3305435 - RNA, 23 nt, Mycobacterium tuberculosis H37Rv
gacaaagcgcgcuggcuacccac

SEQ ID NO: 3305436 - RNA, 17 nt, Mycobacterium tuberculosis H37Rv
gacaaaucggucgacga

SEQ ID NO: 3305437 - RNA, 15 nt, Mycobacterium tuberculosis H37Rv
gacaacaaacccggc

SEQ ID NO: 3305438 - RNA, 19 nt, Mycobacterium tuberculosis H37Rv
gacaacaaacccggccucg

SEQ ID NO: 3305439 - RNA, 14 nt, Mycobacterium tuberculosis H37Rv
gacaacaccacggu

SEQ ID NO: 3305440 - RNA, 16 nt, Mycobacterium tuberculosis H37Rv
gacaacacgccgucga

SEQ ID NO: 3305441 - RNA, 23 nt, Mycobacterium tuberculosis H37Rv
gacaacagagucaccgcgcuggu

SEQ ID NO: 3305442 - RNA, 12 nt, Mycobacterium tuberculosis H37Rv
gacaacagcaag

SEQ ID NO: 3305443 - RNA, 22 nt, Mycobacterium tuberculosis H37Rv
gacaacagcaagauuauggcga

SEQ ID NO: 3305444 - RNA, 13 nt, Mycobacterium tuberculosis H37Rv
gacaacagccagc

SEQ ID NO: 3305445 - RNA, 16 nt, Mycobacterium tuberculosis H37Rv
gacaacagucgacaau

SEQ ID NO: 3305446 - RNA, 17 nt, Mycobacterium tuberculosis H37Rv
gacaaccccgccaggau

SEQ ID NO: 3305447 - RNA, 18 nt, Mycobacterium tuberculosis H37Rv
gacaaccccuugccuucc

SEQ ID NO: 3305448 - RNA, 19 nt, Mycobacterium tuberculosis H37Rv
gacaaccgcccgccaggcc

SEQ ID NO: 3305449 - RNA, 19 nt, Mycobacterium tuberculosis H37Rv
gacaaccggccagauggug

SEQ ID NO: 3305450 - RNA, 22 nt, Mycobacterium tuberculosis H37Rv
gacaaccgggcgggacucggcg

SEQ ID NO: 3305451 - RNA, 18 nt, Mycobacterium tuberculosis H37Rv
gacaaccucgucgaucuc

SEQ ID NO: 3305452 - RNA, 11 nt, Mycobacterium tuberculosis H37Rv
gacaaccuggg

SEQ ID NO: 3305453 - RNA, 17 nt, Mycobacterium tuberculosis H37Rv
gacaacgacgucgccga

SEQ ID NO: 3305454 - RNA, 15 nt, Mycobacterium tuberculosis H37Rv
gacaacgaugucacc

SEQ ID NO: 3305455 - RNA, 14 nt, Mycobacterium tuberculosis H37Rv
gacaacgccgucga

SEQ ID NO: 3305456 - RNA, 17 nt, Mycobacterium tuberculosis H37Rv
gacaacgcugggcggcu

SEQ ID NO: 3305457 - RNA, 13 nt, Mycobacterium tuberculosis H37Rv
gacaacggcgguc

SEQ ID NO: 3305458 - RNA, 19 nt, Mycobacterium tuberculosis H37Rv
gacaacuaucgucgugucg

SEQ ID NO: 3305459 - RNA, 13 nt, Mycobacterium tuberculosis H37Rv
gacaagccgagcc

SEQ ID NO: 3305460 - RNA, 16 nt, Mycobacterium tuberculosis H37Rv
gacaaggcgauugucg

SEQ ID NO: 3305461 - RNA, 16 nt, Mycobacterium tuberculosis H37Rv
gacaaggugcgcuggg

SEQ ID NO: 3305462 - RNA, 13 nt, Mycobacterium tuberculosis H37Rv
gacaagucaagau

SEQ ID NO: 3305463 - RNA, 17 nt, Mycobacterium tuberculosis H37Rv
gacaaguccgcgauggc

SEQ ID NO: 3305464 - RNA, 19 nt, Mycobacterium tuberculosis H37Rv
gacaagugccggcgcggag

SEQ ID NO: 3305465 - RNA, 20 nt, Mycobacterium tuberculosis H37Rv
gacaagugccggcgcggagu

SEQ ID NO: 3305466 - RNA, 13 nt, Mycobacterium tuberculosis H37Rv
gacaaucucggcg

SEQ ID NO: 3305467 - RNA, 14 nt, Mycobacterium tuberculosis H37Rv
gacaauucacgagg

SEQ ID NO: 3305468 - RNA, 17 nt, Mycobacterium tuberculosis H37Rv
gacacaccgcgucggcc

SEQ ID NO: 3305469 - RNA, 14 nt, Mycobacterium tuberculosis H37Rv
gacacagaaucgcc

SEQ ID NO: 3305470 - RNA, 19 nt, Mycobacterium tuberculosis H37Rv
gacacagcaccguccucgg

SEQ ID NO: 3305471 - RNA, 21 nt, Mycobacterium tuberculosis H37Rv
gacacagcccacaggcggcgc

SEQ ID NO: 3305472 - RNA, 17 nt, Mycobacterium tuberculosis H37Rv
gacacauagugcggcac

SEQ ID NO: 3305473 - RNA, 21 nt, Mycobacterium tuberculosis H37Rv
gacacauagugcggcaccgcc

SEQ ID NO: 3305474 - RNA, 14 nt, Mycobacterium tuberculosis H37Rv
gacacauugaccag

SEQ ID NO: 3305475 - RNA, 15 nt, Mycobacterium tuberculosis H37Rv
gacacauugaccagg

SEQ ID NO: 3305476 - RNA, 16 nt, Mycobacterium tuberculosis H37Rv
gacacauugaccaggu

SEQ ID NO: 3305477 - RNA, 15 nt, Mycobacterium tuberculosis H37Rv
gacaccaccgcccgc

SEQ ID NO: 3305478 - RNA, 13 nt, Mycobacterium tuberculosis H37Rv
gacaccaccggcg

SEQ ID NO: 3305479 - RNA, 17 nt, Mycobacterium tuberculosis H37Rv
gacaccacgucccggaa

SEQ ID NO: 3305480 - RNA, 12 nt, Mycobacterium tuberculosis H37Rv
gacaccaggccc

SEQ ID NO: 3305481 - RNA, 23 nt, Mycobacterium tuberculosis H37Rv
gacaccaucuccgccgucgccac

SEQ ID NO: 3305482 - RNA, 23 nt, Mycobacterium tuberculosis H37Rv
gacaccauuggccuaggacaccg

SEQ ID NO: 3305483 - RNA, 17 nt, Mycobacterium tuberculosis H37Rv
gacacccaccaacaccc

SEQ ID NO: 3305484 - RNA, 21 nt, Mycobacterium tuberculosis H37Rv
gacacccaccaacacccgggc

SEQ ID NO: 3305485 - RNA, 20 nt, Mycobacterium tuberculosis H37Rv
gacacccaccucgccaucga

SEQ ID NO: 3305486 - RNA, 17 nt, Mycobacterium tuberculosis H37Rv
gacacccagccgcagcc

SEQ ID NO: 3305487 - RNA, 17 nt, Mycobacterium tuberculosis H37Rv
gacaccccacaccgucu

SEQ ID NO: 3305488 - RNA, 15 nt, Mycobacterium tuberculosis H37Rv
gacaccccggaaucc

SEQ ID NO: 3305489 - RNA, 18 nt, Mycobacterium tuberculosis H37Rv
gacaccccggaaucccca

SEQ ID NO: 3305490 - RNA, 16 nt, Mycobacterium tuberculosis H37Rv
gacacccgagggccug

SEQ ID NO: 3305491 - RNA, 23 nt, Mycobacterium tuberculosis H37Rv
gacacccguugagcauaugacgu

SEQ ID NO: 3305492 - RNA, 16 nt, Mycobacterium tuberculosis H37Rv
gacacccucgggcccg

SEQ ID NO: 3305493 - RNA, 16 nt, Mycobacterium tuberculosis H37Rv
gacacccugggugccg

SEQ ID NO: 3305494 - RNA, 22 nt, Mycobacterium tuberculosis H37Rv
gacaccgaaccgccgcugccgc

SEQ ID NO: 3305495 - RNA, 22 nt, Mycobacterium tuberculosis H37Rv
gacaccgagccacgacccagca

SEQ ID NO: 3305496 - RNA, 18 nt, Mycobacterium tuberculosis H37Rv
gacaccgaggaccucguc

SEQ ID NO: 3305497 - RNA, 17 nt, Mycobacterium tuberculosis H37Rv
gacaccgaggucggcca

SEQ ID NO: 3305498 - RNA, 21 nt, Mycobacterium tuberculosis H37Rv
gacaccgauccggccgccgau

SEQ ID NO: 3305499 - RNA, 13 nt, Mycobacterium tuberculosis H37Rv
gacaccgaucugc

SEQ ID NO: 3305500 - RNA, 18 nt, Mycobacterium tuberculosis H37Rv
gacaccgcaacgcgugcg

SEQ ID NO: 3305501 - RNA, 19 nt, Mycobacterium tuberculosis H37Rv
gacaccgccaccacgccgu

SEQ ID NO: 3305502 - RNA, 21 nt, Mycobacterium tuberculosis H37Rv
gacaccgccccgccgcgacgg

SEQ ID NO: 3305503 - RNA, 16 nt, Mycobacterium tuberculosis H37Rv
gacaccgcgaucacca

SEQ ID NO: 3305504 - RNA, 11 nt, Mycobacterium tuberculosis H37Rv
gacaccgcgca

SEQ ID NO: 3305505 - RNA, 15 nt, Mycobacterium tuberculosis H37Rv
gacaccgcggacccg

SEQ ID NO: 3305506 - RNA, 18 nt, Mycobacterium tuberculosis H37Rv
gacaccgcggcgaucugc

SEQ ID NO: 3305507 - RNA, 19 nt, Mycobacterium tuberculosis H37Rv
gacaccgcggugccccgga

SEQ ID NO: 3305508 - RNA, 19 nt, Mycobacterium tuberculosis H37Rv
gacaccggccgcgacggau

SEQ ID NO: 3305509 - RNA, 15 nt, Mycobacterium tuberculosis H37Rv
gacaccggcggcauc

SEQ ID NO: 3305510 - RNA, 14 nt, Mycobacterium tuberculosis H37Rv
gacaccggcugacc

SEQ ID NO: 3305511 - RNA, 22 nt, Mycobacterium tuberculosis H37Rv
gacauccacaccgcggcggcgc

SEQ ID NO: 3305512 - RNA, 19 nt, Mycobacterium tuberculosis H37Rv
gacauccagaugcccagca

SEQ ID NO: 3305513 - RNA, 21 nt, Mycobacterium tuberculosis H37Rv
gacauccagaugcccagcagg

SEQ ID NO: 3305514 - RNA, 21 nt, Mycobacterium tuberculosis H37Rv
gacaucccugacgaaggucuc

SEQ ID NO: 3305515 - RNA, 14 nt, Mycobacterium tuberculosis H37Rv
gacauccgaugcgu

SEQ ID NO: 3305516 - RNA, 15 nt, Mycobacterium tuberculosis H37Rv
gacauccgcuuacgg

SEQ ID NO: 3305517 - RNA, 20 nt, Mycobacterium tuberculosis H37Rv
gacauccgcuuacggguguc

SEQ ID NO: 3305518 - RNA, 17 nt, Mycobacterium tuberculosis H37Rv
gacauccgggccgagcg

SEQ ID NO: 3305519 - RNA, 18 nt, Mycobacterium tuberculosis H37Rv
gacauccgggccgagcgc

SEQ ID NO: 3305520 - RNA, 18 nt, Mycobacterium tuberculosis H37Rv
gacauccucgauggaccg

SEQ ID NO: 3305521 - RNA, 15 nt, Mycobacterium tuberculosis H37Rv
gacaucgcugcgacu

SEQ ID NO: 3305522 - RNA, 19 nt, Mycobacterium tuberculosis H37Rv
gacaucgggccgccgagcu

SEQ ID NO: 3305523 - RNA, 15 nt, Mycobacterium tuberculosis H37Rv
gacaucggugacggu

SEQ ID NO: 3305524 - RNA, 23 nt, Mycobacterium tuberculosis H37Rv
gacaucgguggcggccuccgagg

SEQ ID NO: 3305525 - RNA, 17 nt, Mycobacterium tuberculosis H37Rv
gacaucguaggccggca

SEQ ID NO: 3305526 - RNA, 18 nt, Mycobacterium tuberculosis H37Rv
gacaucguaggccggcau

SEQ ID NO: 3305527 - RNA, 17 nt, Mycobacterium tuberculosis H37Rv
gacaucgucaucagcgc

SEQ ID NO: 3305528 - RNA, 15 nt, Mycobacterium tuberculosis H37Rv
gacaucgucgacgac

SEQ ID NO: 3305529 - RNA, 18 nt, Mycobacterium tuberculosis H37Rv
gacaucguuggccgggca

SEQ ID NO: 3305530 - RNA, 21 nt, Mycobacterium tuberculosis H37Rv
gacaugagcgccacgccgagg

SEQ ID NO: 3305531 - RNA, 22 nt, Mycobacterium tuberculosis H37Rv
gacaugagcgccacgccgaggc

SEQ ID NO: 3305532 - RNA, 20 nt, Mycobacterium tuberculosis H37Rv
gacaugccauaugggggaaa

SEQ ID NO: 3305533 - RNA, 23 nt, Mycobacterium tuberculosis H37Rv
gacaugccauaugggggaaagcu

SEQ ID NO: 3305534 - RNA, 15 nt, Mycobacterium tuberculosis H37Rv
gacaugcccgccaau

SEQ ID NO: 3305535 - RNA, 13 nt, Mycobacterium tuberculosis H37Rv
gacaugcgcacca

SEQ ID NO: 3305536 - RNA, 15 nt, Mycobacterium tuberculosis H37Rv
gacaugggucggcug

SEQ ID NO: 3305537 - RNA, 18 nt, Mycobacterium tuberculosis H37Rv
gacaugguccgaccagcg

SEQ ID NO: 3305538 - RNA, 20 nt, Mycobacterium tuberculosis H37Rv
gacaugguccgaccagcggc

SEQ ID NO: 3305539 - RNA, 21 nt, Mycobacterium tuberculosis H37Rv
gacaugucgaacgccccccac

SEQ ID NO: 3305540 - RNA, 17 nt, Mycobacterium tuberculosis H37Rv
gacaugucgcugccgcc

SEQ ID NO: 3305541 - RNA, 15 nt, Mycobacterium tuberculosis H37Rv
gacauuggagacgac

SEQ ID NO: 3305542 - RNA, 18 nt, Mycobacterium tuberculosis H37Rv
gacauuuccaccacgcgc

SEQ ID NO: 3305543 - RNA, 21 nt, Mycobacterium tuberculosis H37Rv
gaccaaaauccuucgcgcuca

SEQ ID NO: 3305544 - RNA, 13 nt, Mycobacterium tuberculosis H37Rv
gaccaaaccgcug

SEQ ID NO: 3305545 - RNA, 24 nt, Mycobacterium tuberculosis H37Rv
gaccaaaccgcuguaaccgguaac

SEQ ID NO: 3305546 - RNA, 20 nt, Mycobacterium tuberculosis H37Rv
gaccaacaccccccccaccc

SEQ ID NO: 3305547 - RNA, 23 nt, Mycobacterium tuberculosis H37Rv
gaccaacggggcagucaacuccc

SEQ ID NO: 3305548 - RNA, 13 nt, Mycobacterium tuberculosis H37Rv
gaccaacggugcu

SEQ ID NO: 3305549 - RNA, 16 nt, Mycobacterium tuberculosis H37Rv
gaccaacggugcucgu

SEQ ID NO: 3305550 - RNA, 17 nt, Mycobacterium tuberculosis H37Rv
gaccaagcccgucgucg

SEQ ID NO: 3305551 - RNA, 20 nt, Mycobacterium tuberculosis H37Rv
gaccaagguguccagcaccu

SEQ ID NO: 3305552 - RNA, 22 nt, Mycobacterium tuberculosis H37Rv
gaccaaugucagugccccgccc

SEQ ID NO: 3305553 - RNA, 16 nt, Mycobacterium tuberculosis H37Rv
gaccaauucgaccgcg

SEQ ID NO: 3305554 - RNA, 21 nt, Mycobacterium tuberculosis H37Rv
gaccaauucgaccgcgcggau

SEQ ID NO: 3305555 - RNA, 20 nt, Mycobacterium tuberculosis H37Rv
gaccacaaccgugagcacca

SEQ ID NO: 3305556 - RNA, 17 nt, Mycobacterium tuberculosis H37Rv
gaccacaccacgauggc

SEQ ID NO: 3305557 - RNA, 20 nt, Mycobacterium tuberculosis H37Rv
gaccacagccgcgccgaccu

SEQ ID NO: 3305558 - RNA, 13 nt, Mycobacterium tuberculosis H37Rv
gaccaccaccgag

SEQ ID NO: 3305559 - RNA, 14 nt, Mycobacterium tuberculosis H37Rv
gaccaccaccgagc

SEQ ID NO: 3305560 - RNA, 13 nt, Mycobacterium tuberculosis H37Rv
gaccaccaccgcc

SEQ ID NO: 3305561 - RNA, 21 nt, Mycobacterium tuberculosis H37Rv
gaccaccacuaggucgccggc

SEQ ID NO: 3305562 - RNA, 22 nt, Mycobacterium tuberculosis H37Rv
gaccaccagcaucguggccgca

SEQ ID NO: 3305563 - RNA, 15 nt, Mycobacterium tuberculosis H37Rv
gaccaccagcgccga

SEQ ID NO: 3305564 - RNA, 14 nt, Mycobacterium tuberculosis H37Rv
gaccaccagcgcuc

SEQ ID NO: 3305565 - RNA, 19 nt, Mycobacterium tuberculosis H37Rv
gaccaccccguagcggucu

SEQ ID NO: 3305566 - RNA, 21 nt, Mycobacterium tuberculosis H37Rv
gaccacccgguccugcucgca

SEQ ID NO: 3305567 - RNA, 15 nt, Mycobacterium tuberculosis H37Rv
gaccaccgccggccc

SEQ ID NO: 3305568 - RNA, 18 nt, Mycobacterium tuberculosis H37Rv
gaccaccgcgaaagcacc

SEQ ID NO: 3305569 - RNA, 14 nt, Mycobacterium tuberculosis H37Rv
gaccaccgcucgcc

SEQ ID NO: 3305570 - RNA, 13 nt, Mycobacterium tuberculosis H37Rv
gaccaccgcugag

SEQ ID NO: 3305571 - RNA, 16 nt, Mycobacterium tuberculosis H37Rv
gaccaccgcugagccg

SEQ ID NO: 3305572 - RNA, 23 nt, Mycobacterium tuberculosis H37Rv
gaccaccgggccgacagcacgcc

SEQ ID NO: 3305573 - RNA, 12 nt, Mycobacterium tuberculosis H37Rv
gaccaccgggua

SEQ ID NO: 3305574 - RNA, 19 nt, Mycobacterium tuberculosis H37Rv
gaccaccggguagccggcg

SEQ ID NO: 3305575 - RNA, 20 nt, Mycobacterium tuberculosis H37Rv
gaccaccucagcugcggacu

SEQ ID NO: 3305576 - RNA, 19 nt, Mycobacterium tuberculosis H37Rv
gaccaccucgaugccgccc

SEQ ID NO: 3305577 - RNA, 16 nt, Mycobacterium tuberculosis H37Rv
gaccaccugcaugugu

SEQ ID NO: 3305578 - RNA, 12 nt, Mycobacterium tuberculosis H37Rv
gaccaccugguu

SEQ ID NO: 3305579 - RNA, 13 nt, Mycobacterium tuberculosis H37Rv
gaccaccugguuu

SEQ ID NO: 3305580 - RNA, 16 nt, Mycobacterium tuberculosis H37Rv
gaccacgaaccgggug

SEQ ID NO: 3305581 - RNA, 16 nt, Mycobacterium tuberculosis H37Rv
gaccacgaacgcgcgc

SEQ ID NO: 3305582 - RNA, 14 nt, Mycobacterium tuberculosis H37Rv
gaccacgaccgucu

SEQ ID NO: 3305583 - RNA, 15 nt, Mycobacterium tuberculosis H37Rv
gaccacgaccgucuc

SEQ ID NO: 3305584 - RNA, 21 nt, Mycobacterium tuberculosis H37Rv
gaccacgcaagggaauccgaa

SEQ ID NO: 3305585 - RNA, 16 nt, Mycobacterium tuberculosis H37Rv
gaccacgcaccgcccc

SEQ ID NO: 3305586 - RNA, 18 nt, Mycobacterium tuberculosis H37Rv
gaccacgcaccgccccgc

SEQ ID NO: 3305587 - RNA, 22 nt, Mycobacterium tuberculosis H37Rv
gaccacgcaccgccccgccguu

SEQ ID NO: 3305588 - RNA, 12 nt, Mycobacterium tuberculosis H37Rv
gaccacgccgac

SEQ ID NO: 3305589 - RNA, 20 nt, Mycobacterium tuberculosis H37Rv
gaccacgccgccggcgcuga

SEQ ID NO: 3305590 - RNA, 13 nt, Mycobacterium tuberculosis H37Rv
gaccacggcaccg

SEQ ID NO: 3305591 - RNA, 13 nt, Mycobacterium tuberculosis H37Rv
gaccacggcguug

SEQ ID NO: 3305592 - RNA, 23 nt, Mycobacterium tuberculosis H37Rv
gaccacgggaugcaugucuugug

SEQ ID NO: 3305593 - RNA, 23 nt, Mycobacterium tuberculosis H37Rv
gaccacgguagacaagucggcgc

SEQ ID NO: 3305594 - RNA, 17 nt, Mycobacterium tuberculosis H37Rv
gaccacggugaguuggc

SEQ ID NO: 3305595 - RNA, 17 nt, Mycobacterium tuberculosis H37Rv
gaccacuccacgcagcc

SEQ ID NO: 3305596 - RNA, 17 nt, Mycobacterium tuberculosis H37Rv
gaccacucgagcgcuca

SEQ ID NO: 3305597 - RNA, 15 nt, Mycobacterium tuberculosis H37Rv
gaccacugaucggca

SEQ ID NO: 3305598 - RNA, 21 nt, Mycobacterium tuberculosis H37Rv
gaccacugcccgggguccauc

SEQ ID NO: 3305599 - RNA, 23 nt, Mycobacterium tuberculosis H37Rv
gaccacuguuggugccgccacca

SEQ ID NO: 3305600 - RNA, 21 nt, Mycobacterium tuberculosis H37Rv
gaccacuuagcuggcgggggu

SEQ ID NO: 3305601 - RNA, 18 nt, Mycobacterium tuberculosis H37Rv
gaccacuucgauggcgca

SEQ ID NO: 3305602 - RNA, 15 nt, Mycobacterium tuberculosis H37Rv
gaccagaacgccaga

SEQ ID NO: 3305603 - RNA, 16 nt, Mycobacterium tuberculosis H37Rv
gaccagaaucucgccg

SEQ ID NO: 3305604 - RNA, 19 nt, Mycobacterium tuberculosis H37Rv
gaccagagccaacgaugau

SEQ ID NO: 3305605 - RNA, 16 nt, Mycobacterium tuberculosis H37Rv
gaccagagcuucgccg

SEQ ID NO: 3305606 - RNA, 13 nt, Mycobacterium tuberculosis H37Rv
gaccagcaaccac

SEQ ID NO: 3305607 - RNA, 16 nt, Mycobacterium tuberculosis H37Rv
gaccccucacccagcu

SEQ ID NO: 3305608 - RNA, 15 nt, Mycobacterium tuberculosis H37Rv
gaccccuggccgccg

SEQ ID NO: 3305609 - RNA, 20 nt, Mycobacterium tuberculosis H37Rv
gaccccuggccgccggcgcc

SEQ ID NO: 3305610 - RNA, 15 nt, Mycobacterium tuberculosis H37Rv
gacccgaagccgacc

SEQ ID NO: 3305611 - RNA, 14 nt, Mycobacterium tuberculosis H37Rv
gacccgacaugguc

SEQ ID NO: 3305612 - RNA, 18 nt, Mycobacterium tuberculosis H37Rv
gacccgacaugguccgac

SEQ ID NO: 3305613 - RNA, 19 nt, Mycobacterium tuberculosis H37Rv
gacccgacaugguccgacc

SEQ ID NO: 3305614 - RNA, 22 nt, Mycobacterium tuberculosis H37Rv
gacccgacgaugccggcccgca

SEQ ID NO: 3305615 - RNA, 15 nt, Mycobacterium tuberculosis H37Rv
gacccgagcgcucga

SEQ ID NO: 3305616 - RNA, 23 nt, Mycobacterium tuberculosis H37Rv
gacccgaugacccacugcaggcu

SEQ ID NO: 3305617 - RNA, 16 nt, Mycobacterium tuberculosis H37Rv
gacccgcagaccgcca

SEQ ID NO: 3305618 - RNA, 14 nt, Mycobacterium tuberculosis H37Rv
gacccgcauaccgu

SEQ ID NO: 3305619 - RNA, 17 nt, Mycobacterium tuberculosis H37Rv
gacccgcauccacgucg

SEQ ID NO: 3305620 - RNA, 18 nt, Mycobacterium tuberculosis H37Rv
gacccgcauccacgucgc

SEQ ID NO: 3305621 - RNA, 12 nt, Mycobacterium tuberculosis H37Rv
gacccgccaggg

SEQ ID NO: 3305622 - RNA, 20 nt, Mycobacterium tuberculosis H37Rv
gacccgccagggcacguggc

SEQ ID NO: 3305623 - RNA, 19 nt, Mycobacterium tuberculosis H37Rv
gacccgcccuugccgccga

SEQ ID NO: 3305624 - RNA, 17 nt, Mycobacterium tuberculosis H37Rv
gacccgccgacgaccgc

SEQ ID NO: 3305625 - RNA, 21 nt, Mycobacterium tuberculosis H37Rv
gacccgccgcgcccggcgcaa

SEQ ID NO: 3305626 - RNA, 15 nt, Mycobacterium tuberculosis H37Rv
gacccgccggcgacu

SEQ ID NO: 3305627 - RNA, 22 nt, Mycobacterium tuberculosis H37Rv
gacccgcgcaaccggccgucca

SEQ ID NO: 3305628 - RNA, 15 nt, Mycobacterium tuberculosis H37Rv
gacccgcgcgucgcc

SEQ ID NO: 3305629 - RNA, 12 nt, Mycobacterium tuberculosis H37Rv
gacccgcgguag

SEQ ID NO: 3305630 - RNA, 16 nt, Mycobacterium tuberculosis H37Rv
gacccgcuacgacggu

SEQ ID NO: 3305631 - RNA, 17 nt, Mycobacterium tuberculosis H37Rv
gacccgcucgcggcgac

SEQ ID NO: 3305632 - RNA, 18 nt, Mycobacterium tuberculosis H37Rv
gacccgcuggcucaucga

SEQ ID NO: 3305633 - RNA, 16 nt, Mycobacterium tuberculosis H37Rv
gacccgcugggccgca

SEQ ID NO: 3305634 - RNA, 13 nt, Mycobacterium tuberculosis H37Rv
gacccgcuucgcc

SEQ ID NO: 3305635 - RNA, 17 nt, Mycobacterium tuberculosis H37Rv
gacccgcuucgcccggc

SEQ ID NO: 3305636 - RNA, 17 nt, Mycobacterium tuberculosis H37Rv
gacccggaccugggcga

SEQ ID NO: 3305637 - RNA, 20 nt, Mycobacterium tuberculosis H37Rv
gacccggaccuucggcggug

SEQ ID NO: 3305638 - RNA, 21 nt, Mycobacterium tuberculosis H37Rv
gacccggaccuucggcggugc

SEQ ID NO: 3305639 - RNA, 14 nt, Mycobacterium tuberculosis H37Rv
gacccggagccgcc

SEQ ID NO: 3305640 - RNA, 22 nt, Mycobacterium tuberculosis H37Rv
gacccggagccgccaggugcuc

SEQ ID NO: 3305641 - RNA, 15 nt, Mycobacterium tuberculosis H37Rv
gacccggccagcggc

SEQ ID NO: 3305642 - RNA, 16 nt, Mycobacterium tuberculosis H37Rv
gacccggccagcggca

SEQ ID NO: 3305643 - RNA, 23 nt, Mycobacterium tuberculosis H37Rv
gacccggcccagcgcccccagca

SEQ ID NO: 3305644 - RNA, 14 nt, Mycobacterium tuberculosis H37Rv
gacccggccggccc

SEQ ID NO: 3305645 - RNA, 22 nt, Mycobacterium tuberculosis H37Rv
gacccggcgaugcagccgggaa

SEQ ID NO: 3305646 - RNA, 13 nt, Mycobacterium tuberculosis H37Rv
gacccggcgcagc

SEQ ID NO: 3305647 - RNA, 16 nt, Mycobacterium tuberculosis H37Rv
gacccggcgcagcaac

SEQ ID NO: 3305648 - RNA, 14 nt, Mycobacterium tuberculosis H37Rv
gacccgggaaggaa

SEQ ID NO: 3305649 - RNA, 17 nt, Mycobacterium tuberculosis H37Rv
gacccgggaaggaaccg

SEQ ID NO: 3305650 - RNA, 22 nt, Mycobacterium tuberculosis H37Rv
gacccgggaaggaaccgggcaa

SEQ ID NO: 3305651 - RNA, 19 nt, Mycobacterium tuberculosis H37Rv
gacccgggccgcggcggcc

SEQ ID NO: 3305652 - RNA, 12 nt, Mycobacterium tuberculosis H37Rv
gacccggggccg

SEQ ID NO: 3305653 - RNA, 16 nt, Mycobacterium tuberculosis H37Rv
gacccggguggucgau

SEQ ID NO: 3305654 - RNA, 17 nt, Mycobacterium tuberculosis H37Rv
gacccggugacccgcug

SEQ ID NO: 3305655 - RNA, 14 nt, Mycobacterium tuberculosis H37Rv
gacccguaccagcc

SEQ ID NO: 3305656 - RNA, 15 nt, Mycobacterium tuberculosis H37Rv
gacccgucgagcagc

SEQ ID NO: 3305657 - RNA, 21 nt, Mycobacterium tuberculosis H37Rv
gacccguugaacucgaagacc

SEQ ID NO: 3305658 - RNA, 17 nt, Mycobacterium tuberculosis H37Rv
gacccuaacucccccgc

SEQ ID NO: 3305659 - RNA, 17 nt, Mycobacterium tuberculosis H37Rv
gacccuaguucagcgcc

SEQ ID NO: 3305660 - RNA, 14 nt, Mycobacterium tuberculosis H37Rv
gacccuccagcacg

SEQ ID NO: 3305661 - RNA, 16 nt, Mycobacterium tuberculosis H37Rv
gacccuccagcacgcc

SEQ ID NO: 3305662 - RNA, 22 nt, Mycobacterium tuberculosis H37Rv
gacccugaucgugaacacgucg

SEQ ID NO: 3305663 - RNA, 19 nt, Mycobacterium tuberculosis H37Rv
gacccugcgccgccacagc

SEQ ID NO: 3305664 - RNA, 19 nt, Mycobacterium tuberculosis H37Rv
gacccugggguccagcguc

SEQ ID NO: 3305665 - RNA, 14 nt, Mycobacterium tuberculosis H37Rv
gacccuuccgccgc

SEQ ID NO: 3305666 - RNA, 12 nt, Mycobacterium tuberculosis H37Rv
gaccgaaagccg

SEQ ID NO: 3305667 - RNA, 17 nt, Mycobacterium tuberculosis H37Rv
gaccgaaagccgcacca

SEQ ID NO: 3305668 - RNA, 22 nt, Mycobacterium tuberculosis H37Rv
gaccgaaauggucguucccgcc

SEQ ID NO: 3305669 - RNA, 19 nt, Mycobacterium tuberculosis H37Rv
gaccgaacaacagcggcaa

SEQ ID NO: 3305670 - RNA, 23 nt, Mycobacterium tuberculosis H37Rv
gaccgaacaacagcggcaacgcc

SEQ ID NO: 3305671 - RNA, 13 nt, Mycobacterium tuberculosis H37Rv
gaccgaacagcgg

SEQ ID NO: 3305672 - RNA, 18 nt, Mycobacterium tuberculosis H37Rv
gaccgaaccuggucuuga

SEQ ID NO: 3305673 - RNA, 13 nt, Mycobacterium tuberculosis H37Rv
gaccgaagaagcc

SEQ ID NO: 3305674 - RNA, 14 nt, Mycobacterium tuberculosis H37Rv
gaccgaagaagccc

SEQ ID NO: 3305675 - RNA, 17 nt, Mycobacterium tuberculosis H37Rv
gaccgaauggccgccgc

SEQ ID NO: 3305676 - RNA, 21 nt, Mycobacterium tuberculosis H37Rv
gaccgaauggccgccgcagcu

SEQ ID NO: 3305677 - RNA, 14 nt, Mycobacterium tuberculosis H37Rv
gaccgacaccacca

SEQ ID NO: 3305678 - RNA, 19 nt, Mycobacterium tuberculosis H37Rv
gaccgacagcggcaccggg

SEQ ID NO: 3305679 - RNA, 14 nt, Mycobacterium tuberculosis H37Rv
gaccgaccacgcga

SEQ ID NO: 3305680 - RNA, 19 nt, Mycobacterium tuberculosis H37Rv
gaccgacccggaccugggc

SEQ ID NO: 3305681 - RNA, 14 nt, Mycobacterium tuberculosis H37Rv
gaccgaccucggcg

SEQ ID NO: 3305682 - RNA, 15 nt, Mycobacterium tuberculosis H37Rv
gaccgacgucgccca

SEQ ID NO: 3305683 - RNA, 23 nt, Mycobacterium tuberculosis H37Rv
gaccgacugcgggccagcgcauc

SEQ ID NO: 3305684 - RNA, 18 nt, Mycobacterium tuberculosis H37Rv
gaccgagcuuccaaaccc

SEQ ID NO: 3305685 - RNA, 18 nt, Mycobacterium tuberculosis H37Rv
gaccgaggcacgucgaaa

SEQ ID NO: 3305686 - RNA, 22 nt, Mycobacterium tuberculosis H37Rv
gaccgaguaccgauagccugcg

SEQ ID NO: 3305687 - RNA, 15 nt, Mycobacterium tuberculosis H37Rv
gaccgauaacacccg

SEQ ID NO: 3305688 - RNA, 20 nt, Mycobacterium tuberculosis H37Rv
gaccgaucggcaggccgcuu

SEQ ID NO: 3305689 - RNA, 13 nt, Mycobacterium tuberculosis H37Rv
gaccgaucggcgc

SEQ ID NO: 3305690 - RNA, 20 nt, Mycobacterium tuberculosis H37Rv
gaccgaucggcgcgucgauc

SEQ ID NO: 3305691 - RNA, 16 nt, Mycobacterium tuberculosis H37Rv
gaccgaucuuggccac

SEQ ID NO: 3305692 - RNA, 18 nt, Mycobacterium tuberculosis H37Rv
gaccgaugacgaucggcg

SEQ ID NO: 3305693 - RNA, 18 nt, Mycobacterium tuberculosis H37Rv
gaccgauugucggcaacg

SEQ ID NO: 3305694 - RNA, 18 nt, Mycobacterium tuberculosis H37Rv
gaccgcaacgacggccgu

SEQ ID NO: 3305695 - RNA, 18 nt, Mycobacterium tuberculosis H37Rv
gaccgcaccgaccugagu

SEQ ID NO: 3305696 - RNA, 16 nt, Mycobacterium tuberculosis H37Rv
gaccgcaccggccgcu

SEQ ID NO: 3305697 - RNA, 18 nt, Mycobacterium tuberculosis H37Rv
gaccgcagcgacgggaaa

SEQ ID NO: 3305698 - RNA, 15 nt, Mycobacterium tuberculosis H37Rv
gaccgcagcuggggc

SEQ ID NO: 3305699 - RNA, 16 nt, Mycobacterium tuberculosis H37Rv
gaccgcagggaccggu

SEQ ID NO: 3305700 - RNA, 17 nt, Mycobacterium tuberculosis H37Rv
gaccgcagucgcugggu

SEQ ID NO: 3305701 - RNA, 21 nt, Mycobacterium tuberculosis H37Rv
gaccgcauccggucucggccg

SEQ ID NO: 3305702 - RNA, 16 nt, Mycobacterium tuberculosis H37Rv
gaccgccacacggggc

SEQ ID NO: 3305703 - RNA, 16 nt, Mycobacterium tuberculosis H37Rv
gaccgggucgccgaug

SEQ ID NO: 3305704 - RNA, 23 nt, Mycobacterium tuberculosis H37Rv
gaccgggucgucauacagcgccc

SEQ ID NO: 3305705 - RNA, 17 nt, Mycobacterium tuberculosis H37Rv
gaccgguacccguagca

SEQ ID NO: 3305706 - RNA, 18 nt, Mycobacterium tuberculosis H37Rv
gaccggucacccgugcuu

SEQ ID NO: 3305707 - RNA, 12 nt, Mycobacterium tuberculosis H37Rv
gaccggucgaca

SEQ ID NO: 3305708 - RNA, 23 nt, Mycobacterium tuberculosis H37Rv
gaccggucgacagcgaaggcgcc

SEQ ID NO: 3305709 - RNA, 20 nt, Mycobacterium tuberculosis H37Rv
gaccggucggugaugguuuc

SEQ ID NO: 3305710 - RNA, 14 nt, Mycobacterium tuberculosis H37Rv
gaccggucugaucg

SEQ ID NO: 3305711 - RNA, 16 nt, Mycobacterium tuberculosis H37Rv
gaccggugccagcagu

SEQ ID NO: 3305712 - RNA, 15 nt, Mycobacterium tuberculosis H37Rv
gaccggugcugucga

SEQ ID NO: 3305713 - RNA, 16 nt, Mycobacterium tuberculosis H37Rv
gaccggugcugucgac

SEQ ID NO: 3305714 - RNA, 21 nt, Mycobacterium tuberculosis H37Rv
gaccgguggcgucaugcccag

SEQ ID NO: 3305715 - RNA, 13 nt, Mycobacterium tuberculosis H37Rv
gaccggugggucu

SEQ ID NO: 3305716 - RNA, 18 nt, Mycobacterium tuberculosis H37Rv
gaccgguucccgggcagc

SEQ ID NO: 3305717 - RNA, 21 nt, Mycobacterium tuberculosis H37Rv
gaccgguuucuucggccagcu

SEQ ID NO: 3305718 - RNA, 16 nt, Mycobacterium tuberculosis H37Rv
gaccguaccgauccag

SEQ ID NO: 3305719 - RNA, 22 nt, Mycobacterium tuberculosis H37Rv
gaccguagccgugacaaggugc

SEQ ID NO: 3305720 - RNA, 16 nt, Mycobacterium tuberculosis H37Rv
gaccguauugaccagc

SEQ ID NO: 3305721 - RNA, 18 nt, Mycobacterium tuberculosis H37Rv
gaccgucacaagucgaca

SEQ ID NO: 3305722 - RNA, 20 nt, Mycobacterium tuberculosis H37Rv
gaccgucacaagucgacacg

SEQ ID NO: 3305723 - RNA, 23 nt, Mycobacterium tuberculosis H37Rv
gaccgucacaagucgacacgccg

SEQ ID NO: 3305724 - RNA, 13 nt, Mycobacterium tuberculosis H37Rv
gaccgucacugau

SEQ ID NO: 3305725 - RNA, 11 nt, Mycobacterium tuberculosis H37Rv
gaccgucagcc

SEQ ID NO: 3305726 - RNA, 12 nt, Mycobacterium tuberculosis H37Rv
gaccgucagccc

SEQ ID NO: 3305727 - RNA, 16 nt, Mycobacterium tuberculosis H37Rv
gaccguccaccgacgu

SEQ ID NO: 3305728 - RNA, 21 nt, Mycobacterium tuberculosis H37Rv
gaccguccagcaacagcgagc

SEQ ID NO: 3305729 - RNA, 18 nt, Mycobacterium tuberculosis H37Rv
gaccgucccagcgccgca

SEQ ID NO: 3305730 - RNA, 14 nt, Mycobacterium tuberculosis H37Rv
gaccgucccggccu

SEQ ID NO: 3305731 - RNA, 20 nt, Mycobacterium tuberculosis H37Rv
gaccgucccggccucgaugu

SEQ ID NO: 3305732 - RNA, 17 nt, Mycobacterium tuberculosis H37Rv
gaccguccgacggcgga

SEQ ID NO: 3305733 - RNA, 15 nt, Mycobacterium tuberculosis H37Rv
gaccgucgcgcugcc

SEQ ID NO: 3305734 - RNA, 18 nt, Mycobacterium tuberculosis H37Rv
gaccgucgcgcugccggc

SEQ ID NO: 3305735 - RNA, 15 nt, Mycobacterium tuberculosis H37Rv
gaccgucguggcggu

SEQ ID NO: 3305736 - RNA, 17 nt, Mycobacterium tuberculosis H37Rv
gaccgucugcgacccgg

SEQ ID NO: 3305737 - RNA, 21 nt, Mycobacterium tuberculosis H37Rv
gaccgucuggaguucgucacc

SEQ ID NO: 3305738 - RNA, 23 nt, Mycobacterium tuberculosis H37Rv
gaccgucuggaguucgucaccgu

SEQ ID NO: 3305739 - RNA, 22 nt, Mycobacterium tuberculosis H37Rv
gaccgucuuuggugccgagcag

SEQ ID NO: 3305740 - RNA, 23 nt, Mycobacterium tuberculosis H37Rv
gaccgugacguagggcagcgcca

SEQ ID NO: 3305741 - RNA, 13 nt, Mycobacterium tuberculosis H37Rv
gaccgugaucagc

SEQ ID NO: 3305742 - RNA, 15 nt, Mycobacterium tuberculosis H37Rv
gaccgugaucagcgc

SEQ ID NO: 3305743 - RNA, 17 nt, Mycobacterium tuberculosis H37Rv
gaccgugaucagcgcgu

SEQ ID NO: 3305744 - RNA, 21 nt, Mycobacterium tuberculosis H37Rv
gaccgugaucagcgcguagcc

SEQ ID NO: 3305745 - RNA, 22 nt, Mycobacterium tuberculosis H37Rv
gaccgugccgucggcgugcagc

SEQ ID NO: 3305746 - RNA, 18 nt, Mycobacterium tuberculosis H37Rv
gaccgugcgucgauggcg

SEQ ID NO: 3305747 - RNA, 17 nt, Mycobacterium tuberculosis H37Rv
gaccguggcgccggucg

SEQ ID NO: 3305748 - RNA, 19 nt, Mycobacterium tuberculosis H37Rv
gaccguggcgccggucgcc

SEQ ID NO: 3305749 - RNA, 15 nt, Mycobacterium tuberculosis H37Rv
gaccguggcggccuc

SEQ ID NO: 3305750 - RNA, 15 nt, Mycobacterium tuberculosis H37Rv
gaccguggcggggaa

SEQ ID NO: 3305751 - RNA, 12 nt, Mycobacterium tuberculosis H37Rv
gaccguggucgg

SEQ ID NO: 3305752 - RNA, 16 nt, Mycobacterium tuberculosis H37Rv
gaccguuacaccauca

SEQ ID NO: 3305753 - RNA, 15 nt, Mycobacterium tuberculosis H37Rv
gaccguucggcgguc

SEQ ID NO: 3305754 - RNA, 21 nt, Mycobacterium tuberculosis H37Rv
gaccguuucgaucucgagcag

SEQ ID NO: 3305755 - RNA, 19 nt, Mycobacterium tuberculosis H37Rv
gaccucaccaaccgcccga

SEQ ID NO: 3305756 - RNA, 15 nt, Mycobacterium tuberculosis H37Rv
gaccucacugcggcg

SEQ ID NO: 3305757 - RNA, 17 nt, Mycobacterium tuberculosis H37Rv
gaccucagccggcggcu

SEQ ID NO: 3305758 - RNA, 18 nt, Mycobacterium tuberculosis H37Rv
gaccucagccggcggcug

SEQ ID NO: 3305759 - RNA, 14 nt, Mycobacterium tuberculosis H37Rv
gaccuccaccaaug

SEQ ID NO: 3305760 - RNA, 14 nt, Mycobacterium tuberculosis H37Rv
gaccuccacgcccu

SEQ ID NO: 3305761 - RNA, 23 nt, Mycobacterium tuberculosis H37Rv
gaccuccggauaacccagcggcg

SEQ ID NO: 3305762 - RNA, 21 nt, Mycobacterium tuberculosis H37Rv
gaccucgaacggggugagcca

SEQ ID NO: 3305763 - RNA, 16 nt, Mycobacterium tuberculosis H37Rv
gaccucgaagcccagc

SEQ ID NO: 3305764 - RNA, 17 nt, Mycobacterium tuberculosis H37Rv
gaccucgaagcccagca

SEQ ID NO: 3305765 - RNA, 20 nt, Mycobacterium tuberculosis H37Rv
gaccucgaagcccagcacca

SEQ ID NO: 3305766 - RNA, 20 nt, Mycobacterium tuberculosis H37Rv
gaccucgagcuugccgucgc

SEQ ID NO: 3305767 - RNA, 23 nt, Mycobacterium tuberculosis H37Rv
gaccucgagcuugccgucgcuga

SEQ ID NO: 3305768 - RNA, 14 nt, Mycobacterium tuberculosis H37Rv
gaccucgcccauga

SEQ ID NO: 3305769 - RNA, 20 nt, Mycobacterium tuberculosis H37Rv
gaccucgccgcgcgugacag

SEQ ID NO: 3305770 - RNA, 23 nt, Mycobacterium tuberculosis H37Rv
gaccucgccgcggcggaaggcgu

SEQ ID NO: 3305771 - RNA, 19 nt, Mycobacterium tuberculosis H37Rv
gaccucgcgggcgaucggc

SEQ ID NO: 3305772 - RNA, 18 nt, Mycobacterium tuberculosis H37Rv
gaccucggcaaccaccuc

SEQ ID NO: 3305773 - RNA, 20 nt, Mycobacterium tuberculosis H37Rv
gaccucggcaaccaccucgu

SEQ ID NO: 3305774 - RNA, 13 nt, Mycobacterium tuberculosis H37Rv
gaccucggcgaug

SEQ ID NO: 3305775 - RNA, 17 nt, Mycobacterium tuberculosis H37Rv
gaccucggcgaugucgc

SEQ ID NO: 3305776 - RNA, 19 nt, Mycobacterium tuberculosis H37Rv
gaccucggguugcagcagc

SEQ ID NO: 3305777 - RNA, 22 nt, Mycobacterium tuberculosis H37Rv
gaccucgucaccggucagcgac

SEQ ID NO: 3305778 - RNA, 24 nt, Mycobacterium tuberculosis H37Rv
gaccucgucgaccgggaacagggu

SEQ ID NO: 3305779 - RNA, 20 nt, Mycobacterium tuberculosis H37Rv
gaccucgugguucugcaggu

SEQ ID NO: 3305780 - RNA, 16 nt, Mycobacterium tuberculosis H37Rv
gaccucguucgucacc

SEQ ID NO: 3305781 - RNA, 18 nt, Mycobacterium tuberculosis H37Rv
gaccucguugcugccggc

SEQ ID NO: 3305782 - RNA, 20 nt, Mycobacterium tuberculosis H37Rv
gaccucguugcugccggcgu

SEQ ID NO: 3305783 - RNA, 20 nt, Mycobacterium tuberculosis H37Rv
gaccucucugcgccaggcgg

SEQ ID NO: 3305784 - RNA, 16 nt, Mycobacterium tuberculosis H37Rv
gaccucugcacggccg

SEQ ID NO: 3305785 - RNA, 19 nt, Mycobacterium tuberculosis H37Rv
gaccugauccggccgguug

SEQ ID NO: 3305786 - RNA, 21 nt, Mycobacterium tuberculosis H37Rv
gaccugaugagcucaccgggg

SEQ ID NO: 3305787 - RNA, 21 nt, Mycobacterium tuberculosis H37Rv
gaccugcagcgcauccgguuu

SEQ ID NO: 3305788 - RNA, 22 nt, Mycobacterium tuberculosis H37Rv
gaccugcagcgcauccgguuug

SEQ ID NO: 3305789 - RNA, 21 nt, Mycobacterium tuberculosis H37Rv
gaccugcaugggcagcuggua

SEQ ID NO: 3305790 - RNA, 17 nt, Mycobacterium tuberculosis H37Rv
gaccugcgagaucggau

SEQ ID NO: 3305791 - RNA, 16 nt, Mycobacterium tuberculosis H37Rv
gaccugcgcgagguug

SEQ ID NO: 3305792 - RNA, 19 nt, Mycobacterium tuberculosis H37Rv
gaccugcucauccaccucg

SEQ ID NO: 3305793 - RNA, 16 nt, Mycobacterium tuberculosis H37Rv
gaccugguugaccucg

SEQ ID NO: 3305794 - RNA, 20 nt, Mycobacterium tuberculosis H37Rv
gaccuguuuggggcugugca

SEQ ID NO: 3305795 - RNA, 23 nt, Mycobacterium tuberculosis H37Rv
gaccuguuuggggcugugcaggc

SEQ ID NO: 3305796 - RNA, 14 nt, Mycobacterium tuberculosis H37Rv
gaccuucaccugga

SEQ ID NO: 3305797 - RNA, 23 nt, Mycobacterium tuberculosis H37Rv
gaccuucgcuauggcggcuucga

SEQ ID NO: 3305798 - RNA, 17 nt, Mycobacterium tuberculosis H37Rv
gacgaugugccaggugc

SEQ ID NO: 3305799 - RNA, 13 nt, Mycobacterium tuberculosis H37Rv
gacgauguggucc

SEQ ID NO: 3305800 - RNA, 17 nt, Mycobacterium tuberculosis H37Rv
gacgaugugguccaucg

SEQ ID NO: 3305801 - RNA, 22 nt, Mycobacterium tuberculosis H37Rv
gacgauuaccagcggcaccgcg

SEQ ID NO: 3305802 - RNA, 14 nt, Mycobacterium tuberculosis H37Rv
gacgauucggcggc

SEQ ID NO: 3305803 - RNA, 13 nt, Mycobacterium tuberculosis H37Rv
gacgauucucgag

SEQ ID NO: 3305804 - RNA, 24 nt, Mycobacterium tuberculosis H37Rv
gacgcaaaagccaccgcacguucg

SEQ ID NO: 3305805 - RNA, 17 nt, Mycobacterium tuberculosis H37Rv
gacgcaaaagcccccua

SEQ ID NO: 3305806 - RNA, 21 nt, Mycobacterium tuberculosis H37Rv
gacgcaaaauccccucgcaac

SEQ ID NO: 3305807 - RNA, 16 nt, Mycobacterium tuberculosis H37Rv
gacgcaaaaucgccca

SEQ ID NO: 3305808 - RNA, 16 nt, Mycobacterium tuberculosis H37Rv
gacgcaaaaucgcccg

SEQ ID NO: 3305809 - RNA, 13 nt, Mycobacterium tuberculosis H37Rv
gacgcaacacccg

SEQ ID NO: 3305810 - RNA, 19 nt, Mycobacterium tuberculosis H37Rv
gacgcacgacugugcgccg

SEQ ID NO: 3305811 - RNA, 21 nt, Mycobacterium tuberculosis H37Rv
gacgcacgacugugcgccgca

SEQ ID NO: 3305812 - RNA, 15 nt, Mycobacterium tuberculosis H37Rv
gacgcacgauccgca

SEQ ID NO: 3305813 - RNA, 15 nt, Mycobacterium tuberculosis H37Rv
gacgcagaagccccc

SEQ ID NO: 3305814 - RNA, 21 nt, Mycobacterium tuberculosis H37Rv
gacgcagaaucgcacgcgaaa

SEQ ID NO: 3305815 - RNA, 16 nt, Mycobacterium tuberculosis H37Rv
gacgcagaaucgccca

SEQ ID NO: 3305816 - RNA, 16 nt, Mycobacterium tuberculosis H37Rv
gacgcagagucaacag

SEQ ID NO: 3305817 - RNA, 22 nt, Mycobacterium tuberculosis H37Rv
gacgcaggaucacacuggccug

SEQ ID NO: 3305818 - RNA, 19 nt, Mycobacterium tuberculosis H37Rv
gacgcaggugaacgccggu

SEQ ID NO: 3305819 - RNA, 16 nt, Mycobacterium tuberculosis H37Rv
gacgcagugcccgauc

SEQ ID NO: 3305820 - RNA, 17 nt, Mycobacterium tuberculosis H37Rv
gacgcauaagcccccga

SEQ ID NO: 3305821 - RNA, 17 nt, Mycobacterium tuberculosis H37Rv
gacgcauaagcccccgc

SEQ ID NO: 3305822 - RNA, 21 nt, Mycobacterium tuberculosis H37Rv
gacgcaugucgggccaggcga

SEQ ID NO: 3305823 - RNA, 15 nt, Mycobacterium tuberculosis H37Rv
gacgccaacgccagc

SEQ ID NO: 3305824 - RNA, 21 nt, Mycobacterium tuberculosis H37Rv
gacgccaaugccgcggaggcg

SEQ ID NO: 3305825 - RNA, 23 nt, Mycobacterium tuberculosis H37Rv
gacgccaccgccaccacccaggc

SEQ ID NO: 3305826 - RNA, 18 nt, Mycobacterium tuberculosis H37Rv
gacgccacugccagccgu

SEQ ID NO: 3305827 - RNA, 15 nt, Mycobacterium tuberculosis H37Rv
gacgccagccuggcc

SEQ ID NO: 3305828 - RNA, 13 nt, Mycobacterium tuberculosis H37Rv
gacgccagcugcc

SEQ ID NO: 3305829 - RNA, 14 nt, Mycobacterium tuberculosis H37Rv
gacgccagcugccc

SEQ ID NO: 3305830 - RNA, 17 nt, Mycobacterium tuberculosis H37Rv
gacgccauucaucggca

SEQ ID NO: 3305831 - RNA, 22 nt, Mycobacterium tuberculosis H37Rv
gacgcccacaugcucagggcag

SEQ ID NO: 3305832 - RNA, 16 nt, Mycobacterium tuberculosis H37Rv
gacgcccagggcgucg

SEQ ID NO: 3305833 - RNA, 17 nt, Mycobacterium tuberculosis H37Rv
gacgccccgaucggcca

SEQ ID NO: 3305834 - RNA, 17 nt, Mycobacterium tuberculosis H37Rv
gacgcccgcccgcacga

SEQ ID NO: 3305835 - RNA, 18 nt, Mycobacterium tuberculosis H37Rv
gacgcccggcgcaccauc

SEQ ID NO: 3305836 - RNA, 17 nt, Mycobacterium tuberculosis H37Rv
gacgcccgggcaccggc

SEQ ID NO: 3305837 - RNA, 17 nt, Mycobacterium tuberculosis H37Rv
gacgccgaacgcgaggu

SEQ ID NO: 3305838 - RNA, 14 nt, Mycobacterium tuberculosis H37Rv
gacgccgacgauga

SEQ ID NO: 3305839 - RNA, 17 nt, Mycobacterium tuberculosis H37Rv
gacgccgagaccgccgc

SEQ ID NO: 3305840 - RNA, 21 nt, Mycobacterium tuberculosis H37Rv
gacgccgagcuagaucacgga

SEQ ID NO: 3305841 - RNA, 18 nt, Mycobacterium tuberculosis H37Rv
gacgccgagcugguugac

SEQ ID NO: 3305842 - RNA, 18 nt, Mycobacterium tuberculosis H37Rv
gacgccgaucgcggcggc

SEQ ID NO: 3305843 - RNA, 21 nt, Mycobacterium tuberculosis H37Rv
gacgccgccacccggcgggcg

SEQ ID NO: 3305844 - RNA, 17 nt, Mycobacterium tuberculosis H37Rv
gacgccgcccccguggg

SEQ ID NO: 3305845 - RNA, 16 nt, Mycobacterium tuberculosis H37Rv
gacgccgccgcugccg

SEQ ID NO: 3305846 - RNA, 14 nt, Mycobacterium tuberculosis H37Rv
gacgccgccggccc

SEQ ID NO: 3305847 - RNA, 15 nt, Mycobacterium tuberculosis H37Rv
gacgccgccggcccc

SEQ ID NO: 3305848 - RNA, 19 nt, Mycobacterium tuberculosis H37Rv
gacgccgccggccccgccg

SEQ ID NO: 3305849 - RNA, 24 nt, Mycobacterium tuberculosis H37Rv
gacgccgccguuguugaggaugac

SEQ ID NO: 3305850 - RNA, 16 nt, Mycobacterium tuberculosis H37Rv
gacgccgcgcagccgg

SEQ ID NO: 3305851 - RNA, 19 nt, Mycobacterium tuberculosis H37Rv
gacgccgcgccggcgggcg

SEQ ID NO: 3305852 - RNA, 15 nt, Mycobacterium tuberculosis H37Rv
gacgccgcucccgca

SEQ ID NO: 3305853 - RNA, 21 nt, Mycobacterium tuberculosis H37Rv
gacgccgcuggagaucacgcc

SEQ ID NO: 3305854 - RNA, 14 nt, Mycobacterium tuberculosis H37Rv
gacgccggccgccg

SEQ ID NO: 3305855 - RNA, 14 nt, Mycobacterium tuberculosis H37Rv
gacgccggccuggc

SEQ ID NO: 3305856 - RNA, 15 nt, Mycobacterium tuberculosis H37Rv
gacgccggccuggcc

SEQ ID NO: 3305857 - RNA, 19 nt, Mycobacterium tuberculosis H37Rv
gacgccggccuggccgcca

SEQ ID NO: 3305858 - RNA, 12 nt, Mycobacterium tuberculosis H37Rv
gacgccgguccc

SEQ ID NO: 3305859 - RNA, 23 nt, Mycobacterium tuberculosis H37Rv
gacgccgguggcagagccgccgu

SEQ ID NO: 3305860 - RNA, 12 nt, Mycobacterium tuberculosis H37Rv
gacgccgucagc

SEQ ID NO: 3305861 - RNA, 24 nt, Mycobacterium tuberculosis H37Rv
gacgccgucaugcccaucuccaac

SEQ ID NO: 3305862 - RNA, 13 nt, Mycobacterium tuberculosis H37Rv
gacgccguccucg

SEQ ID NO: 3305863 - RNA, 16 nt, Mycobacterium tuberculosis H37Rv
gacgccgucgacgucg

SEQ ID NO: 3305864 - RNA, 23 nt, Mycobacterium tuberculosis H37Rv
gacgccgucgacgucgauggugc

SEQ ID NO: 3305865 - RNA, 13 nt, Mycobacterium tuberculosis H37Rv
gacgccgucggac

SEQ ID NO: 3305866 - RNA, 14 nt, Mycobacterium tuberculosis H37Rv
gacgccgucggcgc

SEQ ID NO: 3305867 - RNA, 21 nt, Mycobacterium tuberculosis H37Rv
gacgccgucggcgcgcaccuc

SEQ ID NO: 3305868 - RNA, 15 nt, Mycobacterium tuberculosis H37Rv
gacgccgugugcauc

SEQ ID NO: 3305869 - RNA, 17 nt, Mycobacterium tuberculosis H37Rv
gacgccguugccgccgu

SEQ ID NO: 3305870 - RNA, 15 nt, Mycobacterium tuberculosis H37Rv
gacgccugcggcggu

SEQ ID NO: 3305871 - RNA, 21 nt, Mycobacterium tuberculosis H37Rv
gacgccuugucggcgugucgc

SEQ ID NO: 3305872 - RNA, 15 nt, Mycobacterium tuberculosis H37Rv
gacgcgaaauccccc

SEQ ID NO: 3305873 - RNA, 19 nt, Mycobacterium tuberculosis H37Rv
gacgcgaaaucccccgaca

SEQ ID NO: 3305874 - RNA, 13 nt, Mycobacterium tuberculosis H37Rv
gacgcgaacagcu

SEQ ID NO: 3305875 - RNA, 16 nt, Mycobacterium tuberculosis H37Rv
gacgcgaacgcggcca

SEQ ID NO: 3305876 - RNA, 21 nt, Mycobacterium tuberculosis H37Rv
gacgcgaguaacggugaugac

SEQ ID NO: 3305877 - RNA, 19 nt, Mycobacterium tuberculosis H37Rv
gacgcgagugcgugaucug

SEQ ID NO: 3305878 - RNA, 16 nt, Mycobacterium tuberculosis H37Rv
gacgcgaucggcguca

SEQ ID NO: 3305879 - RNA, 17 nt, Mycobacterium tuberculosis H37Rv
gacgcgaugaccgcacc

SEQ ID NO: 3305880 - RNA, 20 nt, Mycobacterium tuberculosis H37Rv
gacgcgaugaucaugaacgc

SEQ ID NO: 3305881 - RNA, 14 nt, Mycobacterium tuberculosis H37Rv
gacgcgauggccgc

SEQ ID NO: 3305882 - RNA, 19 nt, Mycobacterium tuberculosis H37Rv
gacgcgcaacgccgccagc

SEQ ID NO: 3305883 - RNA, 20 nt, Mycobacterium tuberculosis H37Rv
gacgcgcaacgccgccagcc

SEQ ID NO: 3305884 - RNA, 24 nt, Mycobacterium tuberculosis H37Rv
gacgcgcaggaagccggcgugcuc

SEQ ID NO: 3305885 - RNA, 15 nt, Mycobacterium tuberculosis H37Rv
gacgcgccggcgugc

SEQ ID NO: 3305886 - RNA, 15 nt, Mycobacterium tuberculosis H37Rv
gacgcgcggccagcc

SEQ ID NO: 3305887 - RNA, 19 nt, Mycobacterium tuberculosis H37Rv
gacgcggaaucgcaccgug

SEQ ID NO: 3305888 - RNA, 22 nt, Mycobacterium tuberculosis H37Rv
gacgcggaaucgcaucggcggg

SEQ ID NO: 3305889 - RNA, 13 nt, Mycobacterium tuberculosis H37Rv
gacgcggacagga

SEQ ID NO: 3305890 - RNA, 23 nt, Mycobacterium tuberculosis H37Rv
gacgcggccacauaccaccacgu

SEQ ID NO: 3305891 - RNA, 19 nt, Mycobacterium tuberculosis H37Rv
gacgcggccggccgcccgc

SEQ ID NO: 3305892 - RNA, 16 nt, Mycobacterium tuberculosis H37Rv
gacgcggcgaccgucg

SEQ ID NO: 3305893 - RNA, 19 nt, Mycobacterium tuberculosis H37Rv
gacgcgggagucaucgcgg

SEQ ID NO: 3305894 - RNA, 21 nt, Mycobacterium tuberculosis H37Rv
gacgcgggagucaucgcggcg

SEQ ID NO: 3305895 - RNA, 14 nt, Mycobacterium tuberculosis H37Rv
gacgcgggccgacc

SEQ ID NO: 3305896 - RNA, 15 nt, Mycobacterium tuberculosis H37Rv
gacgcgggugccaga

SEQ ID NO: 3305897 - RNA, 21 nt, Mycobacterium tuberculosis H37Rv
gacgcggucaucgagcugacc

SEQ ID NO: 3305898 - RNA, 17 nt, Mycobacterium tuberculosis H37Rv
gacgcgguccucgagcc

SEQ ID NO: 3305899 - RNA, 15 nt, Mycobacterium tuberculosis H37Rv
gacgcguagcucgcg

SEQ ID NO: 3305900 - RNA, 18 nt, Mycobacterium tuberculosis H37Rv
gacgcgucagcggcgagc

SEQ ID NO: 3305901 - RNA, 17 nt, Mycobacterium tuberculosis H37Rv
gacgcguccggugcacc

SEQ ID NO: 3305902 - RNA, 14 nt, Mycobacterium tuberculosis H37Rv
gacgcgucgagccg

SEQ ID NO: 3305903 - RNA, 16 nt, Mycobacterium tuberculosis H37Rv
gacgcgucggcgacgc

SEQ ID NO: 3305904 - RNA, 20 nt, Mycobacterium tuberculosis H37Rv
gacgcguucaacaccgccga

SEQ ID NO: 3305905 - RNA, 22 nt, Mycobacterium tuberculosis H37Rv
gacgcguucaacaccgccgacc

SEQ ID NO: 3305906 - RNA, 16 nt, Mycobacterium tuberculosis H37Rv
gacgcguugcucgaaa

SEQ ID NO: 3305907 - RNA, 18 nt, Mycobacterium tuberculosis H37Rv
gacgcuaacgucgaucuc

SEQ ID NO: 3305908 - RNA, 14 nt, Mycobacterium tuberculosis H37Rv
gacgcuaccgccgg

SEQ ID NO: 3305909 - RNA, 14 nt, Mycobacterium tuberculosis H37Rv
gacgcucggucgcc

SEQ ID NO: 3305910 - RNA, 16 nt, Mycobacterium tuberculosis H37Rv
gacgcucggucgccac

SEQ ID NO: 3305911 - RNA, 20 nt, Mycobacterium tuberculosis H37Rv
gacgcugacacccacggcgc

SEQ ID NO: 3305912 - RNA, 18 nt, Mycobacterium tuberculosis H37Rv
gacgcugcauuggcggcg

SEQ ID NO: 3305913 - RNA, 12 nt, Mycobacterium tuberculosis H37Rv
gacgcugccgca

SEQ ID NO: 3305914 - RNA, 14 nt, Mycobacterium tuberculosis H37Rv
gacgcugcgcgcca

SEQ ID NO: 3305915 - RNA, 18 nt, Mycobacterium tuberculosis H37Rv
gacgcugcgcgccagaca

SEQ ID NO: 3305916 - RNA, 12 nt, Mycobacterium tuberculosis H37Rv
gacgcuggccac

SEQ ID NO: 3305917 - RNA, 13 nt, Mycobacterium tuberculosis H37Rv
gacgcuggucggc

SEQ ID NO: 3305918 - RNA, 16 nt, Mycobacterium tuberculosis H37Rv
gacgcuguggcucgac

SEQ ID NO: 3305919 - RNA, 17 nt, Mycobacterium tuberculosis H37Rv
gacgcuguggcucgacg

SEQ ID NO: 3305920 - RNA, 18 nt, Mycobacterium tuberculosis H37Rv
gacgcuguggcucgacga

SEQ ID NO: 3305921 - RNA, 16 nt, Mycobacterium tuberculosis H37Rv
gacgcuuucccgauga

SEQ ID NO: 3305922 - RNA, 14 nt, Mycobacterium tuberculosis H37Rv
gacggacucccucg

SEQ ID NO: 3305923 - RNA, 14 nt, Mycobacterium tuberculosis H37Rv
gacggagcccaaaa

SEQ ID NO: 3305924 - RNA, 22 nt, Mycobacterium tuberculosis H37Rv
gacggagguccuacgugcugcg

SEQ ID NO: 3305925 - RNA, 18 nt, Mycobacterium tuberculosis H37Rv
gacggagguguggucgag

SEQ ID NO: 3305926 - RNA, 20 nt, Mycobacterium tuberculosis H37Rv
gacggagguguggucgagcg

SEQ ID NO: 3305927 - RNA, 17 nt, Mycobacterium tuberculosis H37Rv
gacggaguucgacgucg

SEQ ID NO: 3305928 - RNA, 22 nt, Mycobacterium tuberculosis H37Rv
gacggaucgucgugcacggcgg

SEQ ID NO: 3305929 - RNA, 11 nt, Mycobacterium tuberculosis H37Rv
gacggaucugg

SEQ ID NO: 3305930 - RNA, 21 nt, Mycobacterium tuberculosis H37Rv
gacggcaagccauucacgagc

SEQ ID NO: 3305931 - RNA, 14 nt, Mycobacterium tuberculosis H37Rv
gacggcaagggcau

SEQ ID NO: 3305932 - RNA, 17 nt, Mycobacterium tuberculosis H37Rv
gacggcacccccgacga

SEQ ID NO: 3305933 - RNA, 16 nt, Mycobacterium tuberculosis H37Rv
gacggcagccaccagc

SEQ ID NO: 3305934 - RNA, 18 nt, Mycobacterium tuberculosis H37Rv
gacggcagccaccagcga

SEQ ID NO: 3305935 - RNA, 19 nt, Mycobacterium tuberculosis H37Rv
gacggcaucaacgcgggcg

SEQ ID NO: 3305936 - RNA, 20 nt, Mycobacterium tuberculosis H37Rv
gacggcauguaccgaccgcg

SEQ ID NO: 3305937 - RNA, 22 nt, Mycobacterium tuberculosis H37Rv
gacggcauguaccgaccgcguu

SEQ ID NO: 3305938 - RNA, 19 nt, Mycobacterium tuberculosis H37Rv
gacggcauuucagcgcgcc

SEQ ID NO: 3305939 - RNA, 23 nt, Mycobacterium tuberculosis H37Rv
gacggcauuucagcgcgccgcgu

SEQ ID NO: 3305940 - RNA, 18 nt, Mycobacterium tuberculosis H37Rv
gacggccaccccgucggg

SEQ ID NO: 3305941 - RNA, 15 nt, Mycobacterium tuberculosis H37Rv
gacggccaccggggu

SEQ ID NO: 3305942 - RNA, 21 nt, Mycobacterium tuberculosis H37Rv
gacggccacgguggagcgcgc

SEQ ID NO: 3305943 - RNA, 22 nt, Mycobacterium tuberculosis H37Rv
gacggccacguaagcgguuguc

SEQ ID NO: 3305944 - RNA, 20 nt, Mycobacterium tuberculosis H37Rv
gacggccagcaagacgauga

SEQ ID NO: 3305945 - RNA, 14 nt, Mycobacterium tuberculosis H37Rv
gacggccagcagga

SEQ ID NO: 3305946 - RNA, 16 nt, Mycobacterium tuberculosis H37Rv
gacggccagcccagca

SEQ ID NO: 3305947 - RNA, 17 nt, Mycobacterium tuberculosis H37Rv
gacggccagugcgcaga

SEQ ID NO: 3305948 - RNA, 15 nt, Mycobacterium tuberculosis H37Rv
gacggccauauccaa

SEQ ID NO: 3305949 - RNA, 18 nt, Mycobacterium tuberculosis H37Rv
gacggccaucgccagccu

SEQ ID NO: 3305950 - RNA, 23 nt, Mycobacterium tuberculosis H37Rv
gacggccaucgccagccugugcu

SEQ ID NO: 3305951 - RNA, 12 nt, Mycobacterium tuberculosis H37Rv
gacggcccgauc

SEQ ID NO: 3305952 - RNA, 16 nt, Mycobacterium tuberculosis H37Rv
gacggcccgaucccga

SEQ ID NO: 3305953 - RNA, 14 nt, Mycobacterium tuberculosis H37Rv
gacggcccgccguc

SEQ ID NO: 3305954 - RNA, 18 nt, Mycobacterium tuberculosis H37Rv
gacggccgacaacccggc

SEQ ID NO: 3305955 - RNA, 16 nt, Mycobacterium tuberculosis H37Rv
gacggccggccgcggu

SEQ ID NO: 3305956 - RNA, 12 nt, Mycobacterium tuberculosis H37Rv
gacggccgggac

SEQ ID NO: 3305957 - RNA, 18 nt, Mycobacterium tuberculosis H37Rv
gacggccuggggcagccg

SEQ ID NO: 3305958 - RNA, 15 nt, Mycobacterium tuberculosis H37Rv
gacggccuuggcgac

SEQ ID NO: 3305959 - RNA, 19 nt, Mycobacterium tuberculosis H37Rv
gacggccuuggcgacgucg

SEQ ID NO: 3305960 - RNA, 19 nt, Mycobacterium tuberculosis H37Rv
gacggcgaacccgccgaug

SEQ ID NO: 3305961 - RNA, 18 nt, Mycobacterium tuberculosis H37Rv
gacggcgaagucgagugc

SEQ ID NO: 3305962 - RNA, 21 nt, Mycobacterium tuberculosis H37Rv
gacggcgacgugaaugguggu

SEQ ID NO: 3305963 - RNA, 13 nt, Mycobacterium tuberculosis H37Rv
gacggcgccgcuc

SEQ ID NO: 3305964 - RNA, 15 nt, Mycobacterium tuberculosis H37Rv
gacggcgccggcauc

SEQ ID NO: 3305965 - RNA, 12 nt, Mycobacterium tuberculosis H37Rv
gacggcgccguc

SEQ ID NO: 3305966 - RNA, 15 nt, Mycobacterium tuberculosis H37Rv
gacggcgcucggcga

SEQ ID NO: 3305967 - RNA, 19 nt, Mycobacterium tuberculosis H37Rv
gacggcggauaaccggcau

SEQ ID NO: 3305968 - RNA, 21 nt, Mycobacterium tuberculosis H37Rv
gacggcggccacguggucggc

SEQ ID NO: 3305969 - RNA, 14 nt, Mycobacterium tuberculosis H37Rv
gacggcggccagga

SEQ ID NO: 3305970 - RNA, 18 nt, Mycobacterium tuberculosis H37Rv
gacggcggccaggaccaa

SEQ ID NO: 3305971 - RNA, 15 nt, Mycobacterium tuberculosis H37Rv
gacggcggccgcgau

SEQ ID NO: 3305972 - RNA, 20 nt, Mycobacterium tuberculosis H37Rv
gacggcggccgcgauggcgu

SEQ ID NO: 3305973 - RNA, 14 nt, Mycobacterium tuberculosis H37Rv
gacggcgggcccgg

SEQ ID NO: 3305974 - RNA, 22 nt, Mycobacterium tuberculosis H37Rv
gacggcgggcgaucuuggcgac

SEQ ID NO: 3305975 - RNA, 14 nt, Mycobacterium tuberculosis H37Rv
gacggcgucacccg

SEQ ID NO: 3305976 - RNA, 16 nt, Mycobacterium tuberculosis H37Rv
gacggcgucgaccucg

SEQ ID NO: 3305977 - RNA, 15 nt, Mycobacterium tuberculosis H37Rv
gacggcguugucgac

SEQ ID NO: 3305978 - RNA, 20 nt, Mycobacterium tuberculosis H37Rv
gacggcucagcgugcgcugg

SEQ ID NO: 3305979 - RNA, 16 nt, Mycobacterium tuberculosis H37Rv
gacggcugccacgcgu

SEQ ID NO: 3305980 - RNA, 22 nt, Mycobacterium tuberculosis H37Rv
gacggcugccgucagccguucg

SEQ ID NO: 3305981 - RNA, 22 nt, Mycobacterium tuberculosis H37Rv
gacggcuuccaacucggcggcc

SEQ ID NO: 3305982 - RNA, 20 nt, Mycobacterium tuberculosis H37Rv
gacgggaaacuccgcggcgc

SEQ ID NO: 3305983 - RNA, 23 nt, Mycobacterium tuberculosis H37Rv
gacgggaaacuccgcggcgcgca

SEQ ID NO: 3305984 - RNA, 13 nt, Mycobacterium tuberculosis H37Rv
gacgggacccggg

SEQ ID NO: 3305985 - RNA, 19 nt, Mycobacterium tuberculosis H37Rv
gacgggauagccguucggc

SEQ ID NO: 3305986 - RNA, 16 nt, Mycobacterium tuberculosis H37Rv
gacgggaucgucggca

SEQ ID NO: 3305987 - RNA, 18 nt, Mycobacterium tuberculosis H37Rv
gacgggaucgucggcaac

SEQ ID NO: 3305988 - RNA, 17 nt, Mycobacterium tuberculosis H37Rv
gacgggcacaaccagau

SEQ ID NO: 3305989 - RNA, 15 nt, Mycobacterium tuberculosis H37Rv
gacgggccacgaugc

SEQ ID NO: 3305990 - RNA, 18 nt, Mycobacterium tuberculosis H37Rv
gacgugaguuucaccacu

SEQ ID NO: 3305991 - RNA, 14 nt, Mycobacterium tuberculosis H37Rv
gacgugcaaccucg

SEQ ID NO: 3305992 - RNA, 17 nt, Mycobacterium tuberculosis H37Rv
gacgugcaaccucggcu

SEQ ID NO: 3305993 - RNA, 15 nt, Mycobacterium tuberculosis H37Rv
gacgugcaggaacac

SEQ ID NO: 3305994 - RNA, 18 nt, Mycobacterium tuberculosis H37Rv
gacgugcaggaacaccca

SEQ ID NO: 3305995 - RNA, 17 nt, Mycobacterium tuberculosis H37Rv
gacgugccggucccccc

SEQ ID NO: 3305996 - RNA, 15 nt, Mycobacterium tuberculosis H37Rv
gacguggaugguggu

SEQ ID NO: 3305997 - RNA, 14 nt, Mycobacterium tuberculosis H37Rv
gacguggcuugagu

SEQ ID NO: 3305998 - RNA, 22 nt, Mycobacterium tuberculosis H37Rv
gacgugguguaucgacggcggc

SEQ ID NO: 3305999 - RNA, 23 nt, Mycobacterium tuberculosis H37Rv
gacgugguguaucgacggcggcc

SEQ ID NO: 3306000 - RNA, 18 nt, Mycobacterium tuberculosis H37Rv
gacgugguugccccgcag

SEQ ID NO: 3306001 - RNA, 16 nt, Mycobacterium tuberculosis H37Rv
gacguuaucgguucgc

SEQ ID NO: 3306002 - RNA, 19 nt, Mycobacterium tuberculosis H37Rv
gacguuaucgguucgcucg

SEQ ID NO: 3306003 - RNA, 23 nt, Mycobacterium tuberculosis H37Rv
gacguucaucuucaccacgccgu

SEQ ID NO: 3306004 - RNA, 17 nt, Mycobacterium tuberculosis H37Rv
gacguucgggucgagcc

SEQ ID NO: 3306005 - RNA, 13 nt, Mycobacterium tuberculosis H37Rv
gacguugaagccg

SEQ ID NO: 3306006 - RNA, 15 nt, Mycobacterium tuberculosis H37Rv
gacguugaagccgcc

SEQ ID NO: 3306007 - RNA, 15 nt, Mycobacterium tuberculosis H37Rv
gacguugcagccggc

SEQ ID NO: 3306008 - RNA, 21 nt, Mycobacterium tuberculosis H37Rv
gacguugccgaagccggaugc

SEQ ID NO: 3306009 - RNA, 23 nt, Mycobacterium tuberculosis H37Rv
gacguugccgaagccggaugcgc

SEQ ID NO: 3306010 - RNA, 20 nt, Mycobacterium tuberculosis H37Rv
gacguuggcgugcaccgcau

SEQ ID NO: 3306011 - RNA, 20 nt, Mycobacterium tuberculosis H37Rv
gacguuguagauucccgaga

SEQ ID NO: 3306012 - RNA, 22 nt, Mycobacterium tuberculosis H37Rv
gacguugucgccaacccgguug

SEQ ID NO: 3306013 - RNA, 17 nt, Mycobacterium tuberculosis H37Rv
gacguugugccuuagcu

SEQ ID NO: 3306014 - RNA, 20 nt, Mycobacterium tuberculosis H37Rv
gacguuucccaggcccgaca

SEQ ID NO: 3306015 - RNA, 15 nt, Mycobacterium tuberculosis H37Rv
gacuaccaccgcguu

SEQ ID NO: 3306016 - RNA, 17 nt, Mycobacterium tuberculosis H37Rv
gacuaccaucgccgccc

SEQ ID NO: 3306017 - RNA, 16 nt, Mycobacterium tuberculosis H37Rv
gacuacccagccagcc

SEQ ID NO: 3306018 - RNA, 19 nt, Mycobacterium tuberculosis H37Rv
gacuacccagccagccgcg

SEQ ID NO: 3306019 - RNA, 15 nt, Mycobacterium tuberculosis H37Rv
gacuagcugggguca

SEQ ID NO: 3306020 - RNA, 15 nt, Mycobacterium tuberculosis H37Rv
gacucacccacccgc

SEQ ID NO: 3306021 - RNA, 21 nt, Mycobacterium tuberculosis H37Rv
gacucaccgugaaccgcccgc

SEQ ID NO: 3306022 - RNA, 18 nt, Mycobacterium tuberculosis H37Rv
gacucaggucggugcggu

SEQ ID NO: 3306023 - RNA, 21 nt, Mycobacterium tuberculosis H37Rv
gacucaucggccgcggucggc

SEQ ID NO: 3306024 - RNA, 20 nt, Mycobacterium tuberculosis H37Rv
gacucaucggcgugcuugcc

SEQ ID NO: 3306025 - RNA, 22 nt, Mycobacterium tuberculosis H37Rv
gacuccaaagccgugccagccc

SEQ ID NO: 3306026 - RNA, 20 nt, Mycobacterium tuberculosis H37Rv
gacuccagcaaggccagcac

SEQ ID NO: 3306027 - RNA, 22 nt, Mycobacterium tuberculosis H37Rv
gacuccagcaaggccagcacgg

SEQ ID NO: 3306028 - RNA, 23 nt, Mycobacterium tuberculosis H37Rv
gacuccagcaaggccagcacggc

SEQ ID NO: 3306029 - RNA, 16 nt, Mycobacterium tuberculosis H37Rv
gacuccagcaccagca

SEQ ID NO: 3306030 - RNA, 20 nt, Mycobacterium tuberculosis H37Rv
gacuccagcaccagcacggc

SEQ ID NO: 3306031 - RNA, 22 nt, Mycobacterium tuberculosis H37Rv
gacucccccucuaccuccgcca

SEQ ID NO: 3306032 - RNA, 20 nt, Mycobacterium tuberculosis H37Rv
gacucccucgaucacggcgg

SEQ ID NO: 3306033 - RNA, 21 nt, Mycobacterium tuberculosis H37Rv
gacucccucgaucacggcggc

SEQ ID NO: 3306034 - RNA, 16 nt, Mycobacterium tuberculosis H37Rv
gacuccgcgcgcggac

SEQ ID NO: 3306035 - RNA, 14 nt, Mycobacterium tuberculosis H37Rv
gacuccgcgcgcug

SEQ ID NO: 3306036 - RNA, 17 nt, Mycobacterium tuberculosis H37Rv
gacuccgcgcgcugggc

SEQ ID NO: 3306037 - RNA, 13 nt, Mycobacterium tuberculosis H37Rv
gacuccggcaggc

SEQ ID NO: 3306038 - RNA, 16 nt, Mycobacterium tuberculosis H37Rv
gacuccggccgcacgc

SEQ ID NO: 3306039 - RNA, 20 nt, Mycobacterium tuberculosis H37Rv
gacuccggccgcacgccgac

SEQ ID NO: 3306040 - RNA, 22 nt, Mycobacterium tuberculosis H37Rv
gacuccggccggccuagccgau

SEQ ID NO: 3306041 - RNA, 22 nt, Mycobacterium tuberculosis H37Rv
gacuccgguguaguacagcgca

SEQ ID NO: 3306042 - RNA, 13 nt, Mycobacterium tuberculosis H37Rv
gacuccugcggca

SEQ ID NO: 3306043 - RNA, 17 nt, Mycobacterium tuberculosis H37Rv
gacuccugcggcaccgc

SEQ ID NO: 3306044 - RNA, 19 nt, Mycobacterium tuberculosis H37Rv
gacuccugcggcaccgcug

SEQ ID NO: 3306045 - RNA, 21 nt, Mycobacterium tuberculosis H37Rv
gacuccugggccaacacagcg

SEQ ID NO: 3306046 - RNA, 18 nt, Mycobacterium tuberculosis H37Rv
gacucgaccgcgacggca

SEQ ID NO: 3306047 - RNA, 20 nt, Mycobacterium tuberculosis H37Rv
gacucgaccgcgacggcaaa

SEQ ID NO: 3306048 - RNA, 21 nt, Mycobacterium tuberculosis H37Rv
gacucgcaauugcucguagcc

SEQ ID NO: 3306049 - RNA, 22 nt, Mycobacterium tuberculosis H37Rv
gacucgccacauuucaccaccg

SEQ ID NO: 3306050 - RNA, 18 nt, Mycobacterium tuberculosis H37Rv
gacucggacgcgccggcg

SEQ ID NO: 3306051 - RNA, 16 nt, Mycobacterium tuberculosis H37Rv
gacucggccgacgaga

SEQ ID NO: 3306052 - RNA, 17 nt, Mycobacterium tuberculosis H37Rv
gacucggccgcaccagc

SEQ ID NO: 3306053 - RNA, 17 nt, Mycobacterium tuberculosis H37Rv
gacucggccucuagcuu

SEQ ID NO: 3306054 - RNA, 18 nt, Mycobacterium tuberculosis H37Rv
gacucgggcaggccccac

SEQ ID NO: 3306055 - RNA, 21 nt, Mycobacterium tuberculosis H37Rv
gacucggucucauagugcagg

SEQ ID NO: 3306056 - RNA, 15 nt, Mycobacterium tuberculosis H37Rv
gacucggugcgguga

SEQ ID NO: 3306057 - RNA, 20 nt, Mycobacterium tuberculosis H37Rv
gacucgguugaggacgaggu

SEQ ID NO: 3306058 - RNA, 19 nt, Mycobacterium tuberculosis H37Rv
gacucgucgaugcgguggu

SEQ ID NO: 3306059 - RNA, 19 nt, Mycobacterium tuberculosis H37Rv
gacucugcguccaccacgc

SEQ ID NO: 3306060 - RNA, 16 nt, Mycobacterium tuberculosis H37Rv
gacugaagccgcgagc

SEQ ID NO: 3306061 - RNA, 21 nt, Mycobacterium tuberculosis H37Rv
gacugaucaagugccagcgug

SEQ ID NO: 3306062 - RNA, 19 nt, Mycobacterium tuberculosis H37Rv
gacugauccucgaugacau

SEQ ID NO: 3306063 - RNA, 18 nt, Mycobacterium tuberculosis H37Rv
gacugaucuguggguggu

SEQ ID NO: 3306064 - RNA, 22 nt, Mycobacterium tuberculosis H37Rv
gacugaucugugggugguugug

SEQ ID NO: 3306065 - RNA, 14 nt, Mycobacterium tuberculosis H37Rv
gacugcacaccacc

SEQ ID NO: 3306066 - RNA, 17 nt, Mycobacterium tuberculosis H37Rv
gacugcacaccaccgcc

SEQ ID NO: 3306067 - RNA, 18 nt, Mycobacterium tuberculosis H37Rv
gacugcagaaacagccgc

SEQ ID NO: 3306068 - RNA, 14 nt, Mycobacterium tuberculosis H37Rv
gacugcagcccugc

SEQ ID NO: 3306069 - RNA, 22 nt, Mycobacterium tuberculosis H37Rv
gacugcagcccugcgcagccgc

SEQ ID NO: 3306070 - RNA, 15 nt, Mycobacterium tuberculosis H37Rv
gacugcagcgaagcc

SEQ ID NO: 3306071 - RNA, 15 nt, Mycobacterium tuberculosis H37Rv
gacugcagcgccucg

SEQ ID NO: 3306072 - RNA, 14 nt, Mycobacterium tuberculosis H37Rv
gacugcagugccgu

SEQ ID NO: 3306073 - RNA, 17 nt, Mycobacterium tuberculosis H37Rv
gacugccguucagcggc

SEQ ID NO: 3306074 - RNA, 18 nt, Mycobacterium tuberculosis H37Rv
gacugcgaaaauccgugc

SEQ ID NO: 3306075 - RNA, 22 nt, Mycobacterium tuberculosis H37Rv
gacugcgaaaauccgugccgaa

SEQ ID NO: 3306076 - RNA, 16 nt, Mycobacterium tuberculosis H37Rv
gacugcgaaugcuggg

SEQ ID NO: 3306077 - RNA, 17 nt, Mycobacterium tuberculosis H37Rv
gacugcgaaugcugggc

SEQ ID NO: 3306078 - RNA, 15 nt, Mycobacterium tuberculosis H37Rv
gacugcgcggcacuu

SEQ ID NO: 3306079 - RNA, 12 nt, Mycobacterium tuberculosis H37Rv
gacugcgcggcu

SEQ ID NO: 3306080 - RNA, 14 nt, Mycobacterium tuberculosis H37Rv
gacugcggaagcca

SEQ ID NO: 3306081 - RNA, 18 nt, Mycobacterium tuberculosis H37Rv
gacugcggauaggugccg

SEQ ID NO: 3306082 - RNA, 13 nt, Mycobacterium tuberculosis H37Rv
gacugcgggccag

SEQ ID NO: 3306083 - RNA, 21 nt, Mycobacterium tuberculosis H37Rv
gacugcgggccgcucgguagg

SEQ ID NO: 3306084 - RNA, 16 nt, Mycobacterium tuberculosis H37Rv
gacuggaccgcgguga

SEQ ID NO: 3306085 - RNA, 17 nt, Mycobacterium tuberculosis H37Rv
gagaucaccgccaccac

SEQ ID NO: 3306086 - RNA, 21 nt, Mycobacterium tuberculosis H37Rv
gagaucagcaccgugacagcg

SEQ ID NO: 3306087 - RNA, 22 nt, Mycobacterium tuberculosis H37Rv
gagaucagcaccgugacagcgg

SEQ ID NO: 3306088 - RNA, 11 nt, Mycobacterium tuberculosis H37Rv
gagaucagcgg

SEQ ID NO: 3306089 - RNA, 15 nt, Mycobacterium tuberculosis H37Rv
gagaucaugagguga

SEQ ID NO: 3306090 - RNA, 17 nt, Mycobacterium tuberculosis H37Rv
gagauccacgccagagc

SEQ ID NO: 3306091 - RNA, 20 nt, Mycobacterium tuberculosis H37Rv
gagauccugguaaggccggc

SEQ ID NO: 3306092 - RNA, 12 nt, Mycobacterium tuberculosis H37Rv
gagaucgcccga

SEQ ID NO: 3306093 - RNA, 17 nt, Mycobacterium tuberculosis H37Rv
gagaucgcccgaguuga

SEQ ID NO: 3306094 - RNA, 16 nt, Mycobacterium tuberculosis H37Rv
gagaucgccgccggcg

SEQ ID NO: 3306095 - RNA, 20 nt, Mycobacterium tuberculosis H37Rv
gagaucgcggcgacccgguc

SEQ ID NO: 3306096 - RNA, 16 nt, Mycobacterium tuberculosis H37Rv
gagaucguagggacgc

SEQ ID NO: 3306097 - RNA, 17 nt, Mycobacterium tuberculosis H37Rv
gagaucgucgcgaccuu

SEQ ID NO: 3306098 - RNA, 21 nt, Mycobacterium tuberculosis H37Rv
gagaucucugagcgggcgggc

SEQ ID NO: 3306099 - RNA, 16 nt, Mycobacterium tuberculosis H37Rv
gagaugccaucgguga

SEQ ID NO: 3306100 - RNA, 21 nt, Mycobacterium tuberculosis H37Rv
gagaugccgcgaucgugcagg

SEQ ID NO: 3306101 - RNA, 15 nt, Mycobacterium tuberculosis H37Rv
gagauggucgggcgg

SEQ ID NO: 3306102 - RNA, 19 nt, Mycobacterium tuberculosis H37Rv
gagaugucggugaucacgg

SEQ ID NO: 3306103 - RNA, 19 nt, Mycobacterium tuberculosis H37Rv
gagauugggcugggauagc

SEQ ID NO: 3306104 - RNA, 16 nt, Mycobacterium tuberculosis H37Rv
gagauuggguccagcg

SEQ ID NO: 3306105 - RNA, 22 nt, Mycobacterium tuberculosis H37Rv
gagcaaaccagauugccgagcc

SEQ ID NO: 3306106 - RNA, 14 nt, Mycobacterium tuberculosis H37Rv
gagcaaguccugca

SEQ ID NO: 3306107 - RNA, 15 nt, Mycobacterium tuberculosis H37Rv
gagcaauuccucagc

SEQ ID NO: 3306108 - RNA, 16 nt, Mycobacterium tuberculosis H37Rv
gagcacaccgucgucg

SEQ ID NO: 3306109 - RNA, 13 nt, Mycobacterium tuberculosis H37Rv
gagcacacgucgg

SEQ ID NO: 3306110 - RNA, 14 nt, Mycobacterium tuberculosis H37Rv
gagcacaucgccac

SEQ ID NO: 3306111 - RNA, 14 nt, Mycobacterium tuberculosis H37Rv
gagcaccaccccag

SEQ ID NO: 3306112 - RNA, 14 nt, Mycobacterium tuberculosis H37Rv
gagcaccacgugcg

SEQ ID NO: 3306113 - RNA, 14 nt, Mycobacterium tuberculosis H37Rv
gagcaccagcagca

SEQ ID NO: 3306114 - RNA, 18 nt, Mycobacterium tuberculosis H37Rv
gagcacccggggggccuc

SEQ ID NO: 3306115 - RNA, 22 nt, Mycobacterium tuberculosis H37Rv
gagcaccgcgaacagcacauau

SEQ ID NO: 3306116 - RNA, 15 nt, Mycobacterium tuberculosis H37Rv
gagcaccgcgcccuu

SEQ ID NO: 3306117 - RNA, 20 nt, Mycobacterium tuberculosis H37Rv
gagcaccgcgguagccgagc

SEQ ID NO: 3306118 - RNA, 20 nt, Mycobacterium tuberculosis H37Rv
gagcaccgcucgguccagcc

SEQ ID NO: 3306119 - RNA, 15 nt, Mycobacterium tuberculosis H37Rv
gagcaccucggccuc

SEQ ID NO: 3306120 - RNA, 18 nt, Mycobacterium tuberculosis H37Rv
gagcaccucuaccguggc

SEQ ID NO: 3306121 - RNA, 11 nt, Mycobacterium tuberculosis H37Rv
gagcaccugac

SEQ ID NO: 3306122 - RNA, 17 nt, Mycobacterium tuberculosis H37Rv
gagcaccugaccguuga

SEQ ID NO: 3306123 - RNA, 15 nt, Mycobacterium tuberculosis H37Rv
gagcaccugggcgcg

SEQ ID NO: 3306124 - RNA, 16 nt, Mycobacterium tuberculosis H37Rv
gagcaccugggcgcgc

SEQ ID NO: 3306125 - RNA, 19 nt, Mycobacterium tuberculosis H37Rv
gagcaccuuggggugggcg

SEQ ID NO: 3306126 - RNA, 23 nt, Mycobacterium tuberculosis H37Rv
gagcacgccaacguugcgccagc

SEQ ID NO: 3306127 - RNA, 14 nt, Mycobacterium tuberculosis H37Rv
gagcacgccgacca

SEQ ID NO: 3306128 - RNA, 14 nt, Mycobacterium tuberculosis H37Rv
gagcacgccgagcc

SEQ ID NO: 3306129 - RNA, 20 nt, Mycobacterium tuberculosis H37Rv
gagcacgcgcggcgucgugg

SEQ ID NO: 3306130 - RNA, 21 nt, Mycobacterium tuberculosis H37Rv
gagcacggugagccgguggcc

SEQ ID NO: 3306131 - RNA, 14 nt, Mycobacterium tuberculosis H37Rv
gagcacgucaacag

SEQ ID NO: 3306132 - RNA, 16 nt, Mycobacterium tuberculosis H37Rv
gagcacgucaacagcc

SEQ ID NO: 3306133 - RNA, 18 nt, Mycobacterium tuberculosis H37Rv
gagcacguccucgacccg

SEQ ID NO: 3306134 - RNA, 16 nt, Mycobacterium tuberculosis H37Rv
gagcacuccgucguag

SEQ ID NO: 3306135 - RNA, 16 nt, Mycobacterium tuberculosis H37Rv
gagcacugccaguagu

SEQ ID NO: 3306136 - RNA, 20 nt, Mycobacterium tuberculosis H37Rv
gagcagaaacaacgucgccg

SEQ ID NO: 3306137 - RNA, 21 nt, Mycobacterium tuberculosis H37Rv
gagcagacacuaaagcccucg

SEQ ID NO: 3306138 - RNA, 21 nt, Mycobacterium tuberculosis H37Rv
gagcagacgcaaaaucgccca

SEQ ID NO: 3306139 - RNA, 18 nt, Mycobacterium tuberculosis H37Rv
gagcagacgcagaaucgc

SEQ ID NO: 3306140 - RNA, 17 nt, Mycobacterium tuberculosis H37Rv
gagcagacgcauaagcc

SEQ ID NO: 3306141 - RNA, 20 nt, Mycobacterium tuberculosis H37Rv
gagcagacgcauaagccccc

SEQ ID NO: 3306142 - RNA, 21 nt, Mycobacterium tuberculosis H37Rv
gagcagacgcauaagcccccg

SEQ ID NO: 3306143 - RNA, 15 nt, Mycobacterium tuberculosis H37Rv
gagcagacgccgcgu

SEQ ID NO: 3306144 - RNA, 14 nt, Mycobacterium tuberculosis H37Rv
gagcagacguaaaa

SEQ ID NO: 3306145 - RNA, 21 nt, Mycobacterium tuberculosis H37Rv
gagcagacguaaaagcccccg

SEQ ID NO: 3306146 - RNA, 12 nt, Mycobacterium tuberculosis H37Rv
gagcagcaagcc

SEQ ID NO: 3306147 - RNA, 12 nt, Mycobacterium tuberculosis H37Rv
gagcagcaaucc

SEQ ID NO: 3306148 - RNA, 20 nt, Mycobacterium tuberculosis H37Rv
gagcagcagaaacggcgacu

SEQ ID NO: 3306149 - RNA, 16 nt, Mycobacterium tuberculosis H37Rv
gagcagccagccaccg

SEQ ID NO: 3306150 - RNA, 18 nt, Mycobacterium tuberculosis H37Rv
gagcagccgaaccggcac

SEQ ID NO: 3306151 - RNA, 13 nt, Mycobacterium tuberculosis H37Rv
gagcagccgaugc

SEQ ID NO: 3306152 - RNA, 22 nt, Mycobacterium tuberculosis H37Rv
gagcagccggaccguguacugg

SEQ ID NO: 3306153 - RNA, 11 nt, Mycobacterium tuberculosis H37Rv
gagcagcgcac

SEQ ID NO: 3306154 - RNA, 13 nt, Mycobacterium tuberculosis H37Rv
gagcagcucgcac

SEQ ID NO: 3306155 - RNA, 20 nt, Mycobacterium tuberculosis H37Rv
gagcagcucggugacaagcg

SEQ ID NO: 3306156 - RNA, 24 nt, Mycobacterium tuberculosis H37Rv
gagcagcuuagucagggccgaggu

SEQ ID NO: 3306157 - RNA, 16 nt, Mycobacterium tuberculosis H37Rv
gagcaggcgcaccagg

SEQ ID NO: 3306158 - RNA, 17 nt, Mycobacterium tuberculosis H37Rv
gagcagggccggcaccg

SEQ ID NO: 3306159 - RNA, 16 nt, Mycobacterium tuberculosis H37Rv
gagcagggcucgucca

SEQ ID NO: 3306160 - RNA, 17 nt, Mycobacterium tuberculosis H37Rv
gagcagggcucguccau

SEQ ID NO: 3306161 - RNA, 21 nt, Mycobacterium tuberculosis H37Rv
gagcagggcucguccaucagc

SEQ ID NO: 3306162 - RNA, 23 nt, Mycobacterium tuberculosis H37Rv
gagcaggggaguugcuugcaggg

SEQ ID NO: 3306163 - RNA, 20 nt, Mycobacterium tuberculosis H37Rv
gagcagguaggcgcgauaca

SEQ ID NO: 3306164 - RNA, 19 nt, Mycobacterium tuberculosis H37Rv
gagcaggucucguaucgca

SEQ ID NO: 3306165 - RNA, 23 nt, Mycobacterium tuberculosis H37Rv
gagcagguuccgcacgaucaggg

SEQ ID NO: 3306166 - RNA, 17 nt, Mycobacterium tuberculosis H37Rv
gagcaguuccagcucgc

SEQ ID NO: 3306167 - RNA, 22 nt, Mycobacterium tuberculosis H37Rv
gagcaguuccagcucgcggugg

SEQ ID NO: 3306168 - RNA, 22 nt, Mycobacterium tuberculosis H37Rv
gagcaguucucggucccgccgg

SEQ ID NO: 3306169 - RNA, 15 nt, Mycobacterium tuberculosis H37Rv
gagcauaccgccgcu

SEQ ID NO: 3306170 - RNA, 18 nt, Mycobacterium tuberculosis H37Rv
gagcaucuccucgccugc

SEQ ID NO: 3306171 - RNA, 14 nt, Mycobacterium tuberculosis H37Rv
gagcaucucgucgg

SEQ ID NO: 3306172 - RNA, 16 nt, Mycobacterium tuberculosis H37Rv
gagcaucucgucgucg

SEQ ID NO: 3306173 - RNA, 23 nt, Mycobacterium tuberculosis H37Rv
gagcaugccgcccgcgccgccgg

SEQ ID NO: 3306174 - RNA, 16 nt, Mycobacterium tuberculosis H37Rv
gagcaugccguugaca

SEQ ID NO: 3306175 - RNA, 18 nt, Mycobacterium tuberculosis H37Rv
gagcaugcgacgucaggg

SEQ ID NO: 3306176 - RNA, 22 nt, Mycobacterium tuberculosis H37Rv
gagcaugcuggaccucgcgacc

SEQ ID NO: 3306177 - RNA, 15 nt, Mycobacterium tuberculosis H37Rv
gagccaacgcgcaga

SEQ ID NO: 3306178 - RNA, 16 nt, Mycobacterium tuberculosis H37Rv
gagccaccaacaccgc

SEQ ID NO: 3306179 - RNA, 15 nt, Mycobacterium tuberculosis H37Rv
gagccacgacccagc

SEQ ID NO: 3306180 - RNA, 13 nt, Mycobacterium tuberculosis H37Rv
gagccacgccagc

SEQ ID NO: 3306181 - RNA, 13 nt, Mycobacterium tuberculosis H37Rv
gagcgcaccgcga

SEQ ID NO: 3306182 - RNA, 12 nt, Mycobacterium tuberculosis H37Rv
gagcgcaccgcu

SEQ ID NO: 3306183 - RNA, 20 nt, Mycobacterium tuberculosis H37Rv
gagcgcaccgcugaccgcaa

SEQ ID NO: 3306184 - RNA, 21 nt, Mycobacterium tuberculosis H37Rv
gagcgcaccugaaggcggcga

SEQ ID NO: 3306185 - RNA, 15 nt, Mycobacterium tuberculosis H37Rv
gagcgcacucaccuu

SEQ ID NO: 3306186 - RNA, 16 nt, Mycobacterium tuberculosis H37Rv
gagcgcacucaccuug

SEQ ID NO: 3306187 - RNA, 14 nt, Mycobacterium tuberculosis H37Rv
gagcgcaucggcca

SEQ ID NO: 3306188 - RNA, 13 nt, Mycobacterium tuberculosis H37Rv
gagcgccagcgcc

SEQ ID NO: 3306189 - RNA, 12 nt, Mycobacterium tuberculosis H37Rv
gagcgccaggcc

SEQ ID NO: 3306190 - RNA, 17 nt, Mycobacterium tuberculosis H37Rv
gagcgccaggccgcaca

SEQ ID NO: 3306191 - RNA, 20 nt, Mycobacterium tuberculosis H37Rv
gagcgccaggccgcacagca

SEQ ID NO: 3306192 - RNA, 22 nt, Mycobacterium tuberculosis H37Rv
gagcgccaggccgcacagcacc

SEQ ID NO: 3306193 - RNA, 15 nt, Mycobacterium tuberculosis H37Rv
gagcgcccgcagcgc

SEQ ID NO: 3306194 - RNA, 19 nt, Mycobacterium tuberculosis H37Rv
gagcgcccgucguaggugg

SEQ ID NO: 3306195 - RNA, 23 nt, Mycobacterium tuberculosis H37Rv
gagcgcccgucguagguggccgg

SEQ ID NO: 3306196 - RNA, 14 nt, Mycobacterium tuberculosis H37Rv
gagcgcccuccucg

SEQ ID NO: 3306197 - RNA, 15 nt, Mycobacterium tuberculosis H37Rv
gagcgcccuccucga

SEQ ID NO: 3306198 - RNA, 12 nt, Mycobacterium tuberculosis H37Rv
gagcgccgagcu

SEQ ID NO: 3306199 - RNA, 15 nt, Mycobacterium tuberculosis H37Rv
gagcgcgccggccau

SEQ ID NO: 3306200 - RNA, 13 nt, Mycobacterium tuberculosis H37Rv
gagcgcgccguug

SEQ ID NO: 3306201 - RNA, 20 nt, Mycobacterium tuberculosis H37Rv
gagcgcgccuaugggccugc

SEQ ID NO: 3306202 - RNA, 22 nt, Mycobacterium tuberculosis H37Rv
gagcgcgcgcaacccugccgcg

SEQ ID NO: 3306203 - RNA, 19 nt, Mycobacterium tuberculosis H37Rv
gagcgcgcguagcggggga

SEQ ID NO: 3306204 - RNA, 16 nt, Mycobacterium tuberculosis H37Rv
gagcgcgcucagguca

SEQ ID NO: 3306205 - RNA, 12 nt, Mycobacterium tuberculosis H37Rv
gagcgcggccug

SEQ ID NO: 3306206 - RNA, 19 nt, Mycobacterium tuberculosis H37Rv
gagcgcggccugcaccagc

SEQ ID NO: 3306207 - RNA, 21 nt, Mycobacterium tuberculosis H37Rv
gagcgcggcggagccggguga

SEQ ID NO: 3306208 - RNA, 14 nt, Mycobacterium tuberculosis H37Rv
gagcgcggcggcgg

SEQ ID NO: 3306209 - RNA, 15 nt, Mycobacterium tuberculosis H37Rv
gagcgcggcggcgga

SEQ ID NO: 3306210 - RNA, 16 nt, Mycobacterium tuberculosis H37Rv
gagcgcuaucaccgcc

SEQ ID NO: 3306211 - RNA, 19 nt, Mycobacterium tuberculosis H37Rv
gagcgcucgaucacggcgg

SEQ ID NO: 3306212 - RNA, 20 nt, Mycobacterium tuberculosis H37Rv
gagcgcucgaucacggcggg

SEQ ID NO: 3306213 - RNA, 14 nt, Mycobacterium tuberculosis H37Rv
gagcgcugcgccga

SEQ ID NO: 3306214 - RNA, 15 nt, Mycobacterium tuberculosis H37Rv
gagcgcuucgucgcc

SEQ ID NO: 3306215 - RNA, 15 nt, Mycobacterium tuberculosis H37Rv
gagcggaaaaucacc

SEQ ID NO: 3306216 - RNA, 21 nt, Mycobacterium tuberculosis H37Rv
gagcggaauggaggccgccga

SEQ ID NO: 3306217 - RNA, 15 nt, Mycobacterium tuberculosis H37Rv
gagcggacucgaguc

SEQ ID NO: 3306218 - RNA, 16 nt, Mycobacterium tuberculosis H37Rv
gagcggagccgccgac

SEQ ID NO: 3306219 - RNA, 14 nt, Mycobacterium tuberculosis H37Rv
gagcggagccggcg

SEQ ID NO: 3306220 - RNA, 19 nt, Mycobacterium tuberculosis H37Rv
gagcggaucgucgucgugu

SEQ ID NO: 3306221 - RNA, 18 nt, Mycobacterium tuberculosis H37Rv
gagcggaugaaaucggca

SEQ ID NO: 3306222 - RNA, 18 nt, Mycobacterium tuberculosis H37Rv
gagcggauuccuggggug

SEQ ID NO: 3306223 - RNA, 23 nt, Mycobacterium tuberculosis H37Rv
gagcggcagccaagcgagcggcg

SEQ ID NO: 3306224 - RNA, 15 nt, Mycobacterium tuberculosis H37Rv
gagcggcaucgguca

SEQ ID NO: 3306225 - RNA, 22 nt, Mycobacterium tuberculosis H37Rv
gagcggccaccguagccagcag

SEQ ID NO: 3306226 - RNA, 15 nt, Mycobacterium tuberculosis H37Rv
gagcggccaggucgg

SEQ ID NO: 3306227 - RNA, 12 nt, Mycobacterium tuberculosis H37Rv
gagcggccgcgc

SEQ ID NO: 3306228 - RNA, 16 nt, Mycobacterium tuberculosis H37Rv
gagcggccguggcaug

SEQ ID NO: 3306229 - RNA, 15 nt, Mycobacterium tuberculosis H37Rv
gagcggccuccagca

SEQ ID NO: 3306230 - RNA, 18 nt, Mycobacterium tuberculosis H37Rv
gagcggccucgggacucc

SEQ ID NO: 3306231 - RNA, 21 nt, Mycobacterium tuberculosis H37Rv
gagcggcgaacucgggcgacu

SEQ ID NO: 3306232 - RNA, 15 nt, Mycobacterium tuberculosis H37Rv
gagcggcgcgggggu

SEQ ID NO: 3306233 - RNA, 17 nt, Mycobacterium tuberculosis H37Rv
gagcggcgcgggggugg

SEQ ID NO: 3306234 - RNA, 12 nt, Mycobacterium tuberculosis H37Rv
gagcggcugcgg

SEQ ID NO: 3306235 - RNA, 16 nt, Mycobacterium tuberculosis H37Rv
gagcggcuugcggugg

SEQ ID NO: 3306236 - RNA, 17 nt, Mycobacterium tuberculosis H37Rv
gagcggcuugcgguggc

SEQ ID NO: 3306237 - RNA, 19 nt, Mycobacterium tuberculosis H37Rv
gagcggcuugcgguggcgg

SEQ ID NO: 3306238 - RNA, 13 nt, Mycobacterium tuberculosis H37Rv
gagcgggaucggg

SEQ ID NO: 3306239 - RNA, 22 nt, Mycobacterium tuberculosis H37Rv
gagcggggaaguuggcugagca

SEQ ID NO: 3306240 - RNA, 14 nt, Mycobacterium tuberculosis H37Rv
gagcgggugcgggc

SEQ ID NO: 3306241 - RNA, 16 nt, Mycobacterium tuberculosis H37Rv
gagcggguggccggga

SEQ ID NO: 3306242 - RNA, 18 nt, Mycobacterium tuberculosis H37Rv
gagcggucaacgaguugc

SEQ ID NO: 3306243 - RNA, 18 nt, Mycobacterium tuberculosis H37Rv
gagcggucagcgucgauc

SEQ ID NO: 3306244 - RNA, 16 nt, Mycobacterium tuberculosis H37Rv
gagcggucgacguguu

SEQ ID NO: 3306245 - RNA, 20 nt, Mycobacterium tuberculosis H37Rv
gagcgguggcgucgucggcg

SEQ ID NO: 3306246 - RNA, 14 nt, Mycobacterium tuberculosis H37Rv
gagcgguggugagu

SEQ ID NO: 3306247 - RNA, 15 nt, Mycobacterium tuberculosis H37Rv
gagcgguugaucgcg

SEQ ID NO: 3306248 - RNA, 16 nt, Mycobacterium tuberculosis H37Rv
gagcgguugccuucuu

SEQ ID NO: 3306249 - RNA, 22 nt, Mycobacterium tuberculosis H37Rv
gagcgguugccuucuuggcggg

SEQ ID NO: 3306250 - RNA, 18 nt, Mycobacterium tuberculosis H37Rv
gagcguaaugcugcugca

SEQ ID NO: 3306251 - RNA, 13 nt, Mycobacterium tuberculosis H37Rv
gagcguaggccag

SEQ ID NO: 3306252 - RNA, 15 nt, Mycobacterium tuberculosis H37Rv
gagcguaggccagcg

SEQ ID NO: 3306253 - RNA, 19 nt, Mycobacterium tuberculosis H37Rv
gagcguaguucaccaacgc

SEQ ID NO: 3306254 - RNA, 17 nt, Mycobacterium tuberculosis H37Rv
gagcgucaaccacggcc

SEQ ID NO: 3306255 - RNA, 15 nt, Mycobacterium tuberculosis H37Rv
gagcgucgucgccgg

SEQ ID NO: 3306256 - RNA, 14 nt, Mycobacterium tuberculosis H37Rv
gagcgugaaccugg

SEQ ID NO: 3306257 - RNA, 18 nt, Mycobacterium tuberculosis H37Rv
gagcgugaaccuggcgac

SEQ ID NO: 3306258 - RNA, 22 nt, Mycobacterium tuberculosis H37Rv
gagcgugaaccuggcgacgcga

SEQ ID NO: 3306259 - RNA, 19 nt, Mycobacterium tuberculosis H37Rv
gagcgugagccaugccgcu

SEQ ID NO: 3306260 - RNA, 14 nt, Mycobacterium tuberculosis H37Rv
gagcgugagcgccg

SEQ ID NO: 3306261 - RNA, 14 nt, Mycobacterium tuberculosis H37Rv
gagcguucagcacg

SEQ ID NO: 3306262 - RNA, 19 nt, Mycobacterium tuberculosis H37Rv
gagcuaccgcuucccccgg

SEQ ID NO: 3306263 - RNA, 14 nt, Mycobacterium tuberculosis H37Rv
gagcuacgacgagu

SEQ ID NO: 3306264 - RNA, 20 nt, Mycobacterium tuberculosis H37Rv
gagcuauucggugucgccac

SEQ ID NO: 3306265 - RNA, 16 nt, Mycobacterium tuberculosis H37Rv
gagcucaacacgagcg

SEQ ID NO: 3306266 - RNA, 22 nt, Mycobacterium tuberculosis H37Rv
gagcucaccgcacaccugcgcg

SEQ ID NO: 3306267 - RNA, 20 nt, Mycobacterium tuberculosis H37Rv
gagcucagcgaugcggcccu

SEQ ID NO: 3306268 - RNA, 14 nt, Mycobacterium tuberculosis H37Rv
gagcucaucgacga

SEQ ID NO: 3306269 - RNA, 15 nt, Mycobacterium tuberculosis H37Rv
gagcuccucacggau

SEQ ID NO: 3306270 - RNA, 16 nt, Mycobacterium tuberculosis H37Rv
gagcuccucacggauc

SEQ ID NO: 3306271 - RNA, 18 nt, Mycobacterium tuberculosis H37Rv
gagcuccucacggauccg

SEQ ID NO: 3306272 - RNA, 16 nt, Mycobacterium tuberculosis H37Rv
gagcucgaaguuggcu

SEQ ID NO: 3306273 - RNA, 22 nt, Mycobacterium tuberculosis H37Rv
gagcucggcgaacggcaccaga

SEQ ID NO: 3306274 - RNA, 17 nt, Mycobacterium tuberculosis H37Rv
gagcucggucaccacgg

SEQ ID NO: 3306275 - RNA, 20 nt, Mycobacterium tuberculosis H37Rv
gagcucguagaggucaucag

SEQ ID NO: 3306276 - RNA, 22 nt, Mycobacterium tuberculosis H37Rv
gagcucguagaggucaucagcg

SEQ ID NO: 3306277 - RNA, 16 nt, Mycobacterium tuberculosis H37Rv
gagcucguugaccagg

SEQ ID NO: 3306278 - RNA, 15 nt, Mycobacterium tuberculosis H37Rv
gagggagcgccgcag

SEQ ID NO: 3306279 - RNA, 19 nt, Mycobacterium tuberculosis H37Rv
gagggagcgccgcaggguc

SEQ ID NO: 3306280 - RNA, 16 nt, Mycobacterium tuberculosis H37Rv
gagggauguagugcug

SEQ ID NO: 3306281 - RNA, 23 nt, Mycobacterium tuberculosis H37Rv
gagggauguagugcugcucgaca

SEQ ID NO: 3306282 - RNA, 20 nt, Mycobacterium tuberculosis H37Rv
gagggccgucacaggccgcc

SEQ ID NO: 3306283 - RNA, 17 nt, Mycobacterium tuberculosis H37Rv
gagggcgccgggggcgc

SEQ ID NO: 3306284 - RNA, 21 nt, Mycobacterium tuberculosis H37Rv
gagggcgccgggggcgccgcc

SEQ ID NO: 3306285 - RNA, 20 nt, Mycobacterium tuberculosis H37Rv
gagggcggaaaaucggcugg

SEQ ID NO: 3306286 - RNA, 18 nt, Mycobacterium tuberculosis H37Rv
gagggcggucagcggcca

SEQ ID NO: 3306287 - RNA, 16 nt, Mycobacterium tuberculosis H37Rv
gagggcuaccggcgcc

SEQ ID NO: 3306288 - RNA, 18 nt, Mycobacterium tuberculosis H37Rv
gagggcuaccggcgccgc

SEQ ID NO: 3306289 - RNA, 23 nt, Mycobacterium tuberculosis H37Rv
gagggcuguugacgccacgacgc

SEQ ID NO: 3306290 - RNA, 20 nt, Mycobacterium tuberculosis H37Rv
gagggcuuuagugucugcuc

SEQ ID NO: 3306291 - RNA, 14 nt, Mycobacterium tuberculosis H37Rv
gagggggacgcuga

SEQ ID NO: 3306292 - RNA, 20 nt, Mycobacterium tuberculosis H37Rv
gagggggguguugaggccgg

SEQ ID NO: 3306293 - RNA, 21 nt, Mycobacterium tuberculosis H37Rv
gagggggguguugaggccggu

SEQ ID NO: 3306294 - RNA, 24 nt, Mycobacterium tuberculosis H37Rv
gagggggguguugaggccggugaa

SEQ ID NO: 3306295 - RNA, 15 nt, Mycobacterium tuberculosis H37Rv
gaggggguggucgaa

SEQ ID NO: 3306296 - RNA, 17 nt, Mycobacterium tuberculosis H37Rv
gaggguagacggggcga

SEQ ID NO: 3306297 - RNA, 14 nt, Mycobacterium tuberculosis H37Rv
gagggucccacggc

SEQ ID NO: 3306298 - RNA, 23 nt, Mycobacterium tuberculosis H37Rv
gagggucgggcauuccggugugc

SEQ ID NO: 3306299 - RNA, 13 nt, Mycobacterium tuberculosis H37Rv
gagggugcccgag

SEQ ID NO: 3306300 - RNA, 14 nt, Mycobacterium tuberculosis H37Rv
gagggugcguugga

SEQ ID NO: 3306301 - RNA, 16 nt, Mycobacterium tuberculosis H37Rv
gaggguggaccggucg

SEQ ID NO: 3306302 - RNA, 21 nt, Mycobacterium tuberculosis H37Rv
gaggguucgccgaagccggac

SEQ ID NO: 3306303 - RNA, 17 nt, Mycobacterium tuberculosis H37Rv
gagguaauccgcggggu

SEQ ID NO: 3306304 - RNA, 15 nt, Mycobacterium tuberculosis H37Rv
gagguaauucgcggc

SEQ ID NO: 3306305 - RNA, 21 nt, Mycobacterium tuberculosis H37Rv
gagguacccaucgucgagccg

SEQ ID NO: 3306306 - RNA, 18 nt, Mycobacterium tuberculosis H37Rv
gaggucaaaaucagggug

SEQ ID NO: 3306307 - RNA, 22 nt, Mycobacterium tuberculosis H37Rv
gaggucacccaucaacgccggc

SEQ ID NO: 3306308 - RNA, 19 nt, Mycobacterium tuberculosis H37Rv
gaggucaccggcgaccggu

SEQ ID NO: 3306309 - RNA, 22 nt, Mycobacterium tuberculosis H37Rv
gaggucagagaaagccaauagc

SEQ ID NO: 3306310 - RNA, 16 nt, Mycobacterium tuberculosis H37Rv
gaggucauaucgacgg

SEQ ID NO: 3306311 - RNA, 13 nt, Mycobacterium tuberculosis H37Rv
gagguccagcaug

SEQ ID NO: 3306312 - RNA, 16 nt, Mycobacterium tuberculosis H37Rv
gaggucccggcuggga

SEQ ID NO: 3306313 - RNA, 14 nt, Mycobacterium tuberculosis H37Rv
gagguccucgacga

SEQ ID NO: 3306314 - RNA, 15 nt, Mycobacterium tuberculosis H37Rv
gaggucgaaccgccg

SEQ ID NO: 3306315 - RNA, 17 nt, Mycobacterium tuberculosis H37Rv
gaggucgccaacccgau

SEQ ID NO: 3306316 - RNA, 13 nt, Mycobacterium tuberculosis H37Rv
gaggucgccgcau

SEQ ID NO: 3306317 - RNA, 16 nt, Mycobacterium tuberculosis H37Rv
gaggucgccggcacac

SEQ ID NO: 3306318 - RNA, 23 nt, Mycobacterium tuberculosis H37Rv
gaggucgcggucuuugagccggu

SEQ ID NO: 3306319 - RNA, 13 nt, Mycobacterium tuberculosis H37Rv
gaggucggagagc

SEQ ID NO: 3306320 - RNA, 17 nt, Mycobacterium tuberculosis H37Rv
gaggucggccagcagca

SEQ ID NO: 3306321 - RNA, 20 nt, Mycobacterium tuberculosis H37Rv
gaggucggccagcagcagug

SEQ ID NO: 3306322 - RNA, 15 nt, Mycobacterium tuberculosis H37Rv
gaggucggucagcca

SEQ ID NO: 3306323 - RNA, 20 nt, Mycobacterium tuberculosis H37Rv
gaggucggucagccaccuga

SEQ ID NO: 3306324 - RNA, 21 nt, Mycobacterium tuberculosis H37Rv
gaggugauggucgucauccug

SEQ ID NO: 3306325 - RNA, 22 nt, Mycobacterium tuberculosis H37Rv
gaggugauguuggccgccacac

SEQ ID NO: 3306326 - RNA, 19 nt, Mycobacterium tuberculosis H37Rv
gaggugcccaaggccagga

SEQ ID NO: 3306327 - RNA, 21 nt, Mycobacterium tuberculosis H37Rv
gaggugcccaaggccaggauc

SEQ ID NO: 3306328 - RNA, 18 nt, Mycobacterium tuberculosis H37Rv
gaggugccgcgcagcugc

SEQ ID NO: 3306329 - RNA, 22 nt, Mycobacterium tuberculosis H37Rv
gaggugccgcgcagcugccgca

SEQ ID NO: 3306330 - RNA, 14 nt, Mycobacterium tuberculosis H37Rv
gaggugcugcaccu

SEQ ID NO: 3306331 - RNA, 16 nt, Mycobacterium tuberculosis H37Rv
gaggugguucacgggg

SEQ ID NO: 3306332 - RNA, 12 nt, Mycobacterium tuberculosis H37Rv
gagguucccgaa

SEQ ID NO: 3306333 - RNA, 22 nt, Mycobacterium tuberculosis H37Rv
gagguucuccgccuccugcggg

SEQ ID NO: 3306334 - RNA, 18 nt, Mycobacterium tuberculosis H37Rv
gagguuggagcgccagcc

SEQ ID NO: 3306335 - RNA, 16 nt, Mycobacterium tuberculosis H37Rv
gagguugggccgguug

SEQ ID NO: 3306336 - RNA, 14 nt, Mycobacterium tuberculosis H37Rv
gaguaccggccagc

SEQ ID NO: 3306337 - RNA, 15 nt, Mycobacterium tuberculosis H37Rv
gaguaccggccagcc

SEQ ID NO: 3306338 - RNA, 17 nt, Mycobacterium tuberculosis H37Rv
gaguacggccugccgcu

SEQ ID NO: 3306339 - RNA, 18 nt, Mycobacterium tuberculosis H37Rv
gaguacggcgaugcgguc

SEQ ID NO: 3306340 - RNA, 19 nt, Mycobacterium tuberculosis H37Rv
gaguagaucccaccaccgg

SEQ ID NO: 3306341 - RNA, 22 nt, Mycobacterium tuberculosis H37Rv
gaguagccgcuaggaucggaug

SEQ ID NO: 3306342 - RNA, 15 nt, Mycobacterium tuberculosis H37Rv
gaguaggugugcggg

SEQ ID NO: 3306343 - RNA, 18 nt, Mycobacterium tuberculosis H37Rv
gaguagucgcuggccaga

SEQ ID NO: 3306344 - RNA, 13 nt, Mycobacterium tuberculosis H37Rv
gaguagugguggg

SEQ ID NO: 3306345 - RNA, 23 nt, Mycobacterium tuberculosis H37Rv
gaguauccggcagaccggugcug

SEQ ID NO: 3306346 - RNA, 22 nt, Mycobacterium tuberculosis H37Rv
gaguauugcaggaaaucguccu

SEQ ID NO: 3306347 - RNA, 15 nt, Mycobacterium tuberculosis H37Rv
gaguauuggucggug

SEQ ID NO: 3306348 - RNA, 20 nt, Mycobacterium tuberculosis H37Rv
gaguauuggucgguggggua

SEQ ID NO: 3306349 - RNA, 16 nt, Mycobacterium tuberculosis H37Rv
gagucaagcagcagca

SEQ ID NO: 3306350 - RNA, 20 nt, Mycobacterium tuberculosis H37Rv
gagucacccggccguugggc

SEQ ID NO: 3306351 - RNA, 23 nt, Mycobacterium tuberculosis H37Rv
gaguccagcgcaucguugccgca

SEQ ID NO: 3306352 - RNA, 16 nt, Mycobacterium tuberculosis H37Rv
gaguccaggccggcag

SEQ ID NO: 3306353 - RNA, 23 nt, Mycobacterium tuberculosis H37Rv
gaguccccaggugggcagcaggc

SEQ ID NO: 3306354 - RNA, 21 nt, Mycobacterium tuberculosis H37Rv
gaguccgacaguccgcgccgg

SEQ ID NO: 3306355 - RNA, 17 nt, Mycobacterium tuberculosis H37Rv
gaguccgcugagcgggc

SEQ ID NO: 3306356 - RNA, 22 nt, Mycobacterium tuberculosis H37Rv
gaguccgcugcuucuccgagau

SEQ ID NO: 3306357 - RNA, 18 nt, Mycobacterium tuberculosis H37Rv
gaguccggccgacccgga

SEQ ID NO: 3306358 - RNA, 20 nt, Mycobacterium tuberculosis H37Rv
gaguccgguagcuguggugg

SEQ ID NO: 3306359 - RNA, 19 nt, Mycobacterium tuberculosis H37Rv
gaguccugguaccccagca

SEQ ID NO: 3306360 - RNA, 22 nt, Mycobacterium tuberculosis H37Rv
gagucgaaccagguaaucaccu

SEQ ID NO: 3306361 - RNA, 16 nt, Mycobacterium tuberculosis H37Rv
gagucgacgugugccg

SEQ ID NO: 3306362 - RNA, 13 nt, Mycobacterium tuberculosis H37Rv
gagucgcccgcac

SEQ ID NO: 3306363 - RNA, 15 nt, Mycobacterium tuberculosis H37Rv
gagucgcccgcacac

SEQ ID NO: 3306364 - RNA, 17 nt, Mycobacterium tuberculosis H37Rv
gagucgcgaacucaugc

SEQ ID NO: 3306365 - RNA, 19 nt, Mycobacterium tuberculosis H37Rv
gagucggcggggcggacuc

SEQ ID NO: 3306366 - RNA, 13 nt, Mycobacterium tuberculosis H37Rv
gagucggcgucga

SEQ ID NO: 3306367 - RNA, 14 nt, Mycobacterium tuberculosis H37Rv
gagucggcuggucc

SEQ ID NO: 3306368 - RNA, 14 nt, Mycobacterium tuberculosis H37Rv
gagucgggcuccgu

SEQ ID NO: 3306369 - RNA, 15 nt, Mycobacterium tuberculosis H37Rv
gagucgggggccgcg

SEQ ID NO: 3306370 - RNA, 20 nt, Mycobacterium tuberculosis H37Rv
gagucgguggucucggcauc

SEQ ID NO: 3306371 - RNA, 22 nt, Mycobacterium tuberculosis H37Rv
gagucgguucagccacgcagca

SEQ ID NO: 3306372 - RNA, 21 nt, Mycobacterium tuberculosis H37Rv
gagucguaguaggcgccgcga

SEQ ID NO: 3306373 - RNA, 14 nt, Mycobacterium tuberculosis H37Rv
gaucaccaacccgu

SEQ ID NO: 3306374 - RNA, 23 nt, Mycobacterium tuberculosis H37Rv
gaucaccaugaucagcgccgugg

SEQ ID NO: 3306375 - RNA, 15 nt, Mycobacterium tuberculosis H37Rv
gaucaccccgccaug

SEQ ID NO: 3306376 - RNA, 14 nt, Mycobacterium tuberculosis H37Rv
gaucaccgacaccg

SEQ ID NO: 3306377 - RNA, 18 nt, Mycobacterium tuberculosis H37Rv
gaucaccgcgcccgccgc

SEQ ID NO: 3306378 - RNA, 21 nt, Mycobacterium tuberculosis H37Rv
gaucaccgcguaguccaggcc

SEQ ID NO: 3306379 - RNA, 12 nt, Mycobacterium tuberculosis H37Rv
gaucaccggcau

SEQ ID NO: 3306380 - RNA, 13 nt, Mycobacterium tuberculosis H37Rv
gaucaccggcaug

SEQ ID NO: 3306381 - RNA, 14 nt, Mycobacterium tuberculosis H37Rv
gaucaccgggguug

SEQ ID NO: 3306382 - RNA, 14 nt, Mycobacterium tuberculosis H37Rv
gaucaccgucgaca

SEQ ID NO: 3306383 - RNA, 20 nt, Mycobacterium tuberculosis H37Rv
gaucaccucccgcggcaccu

SEQ ID NO: 3306384 - RNA, 13 nt, Mycobacterium tuberculosis H37Rv
gaucaccugcagc

SEQ ID NO: 3306385 - RNA, 14 nt, Mycobacterium tuberculosis H37Rv
gaucaccugcagca

SEQ ID NO: 3306386 - RNA, 23 nt, Mycobacterium tuberculosis H37Rv
gaucaccuucggccgaccgggcu

SEQ ID NO: 3306387 - RNA, 17 nt, Mycobacterium tuberculosis H37Rv
gaucaccuucgucgcgg

SEQ ID NO: 3306388 - RNA, 15 nt, Mycobacterium tuberculosis H37Rv
gaucacgccaccauc

SEQ ID NO: 3306389 - RNA, 15 nt, Mycobacterium tuberculosis H37Rv
gaucacgccgacgau

SEQ ID NO: 3306390 - RNA, 16 nt, Mycobacterium tuberculosis H37Rv
gaucacgccggccucg

SEQ ID NO: 3306391 - RNA, 24 nt, Mycobacterium tuberculosis H37Rv
gaucacgcgaaugacgauccagcc

SEQ ID NO: 3306392 - RNA, 15 nt, Mycobacterium tuberculosis H37Rv
gaucacggagcucuu

SEQ ID NO: 3306393 - RNA, 23 nt, Mycobacterium tuberculosis H37Rv
gaucacggcgggaugcagcugcc

SEQ ID NO: 3306394 - RNA, 19 nt, Mycobacterium tuberculosis H37Rv
gaucacgggcuaccggcag

SEQ ID NO: 3306395 - RNA, 18 nt, Mycobacterium tuberculosis H37Rv
gaucacgucgucucggcg

SEQ ID NO: 3306396 - RNA, 12 nt, Mycobacterium tuberculosis H37Rv
gaucacugucgg

SEQ ID NO: 3306397 - RNA, 14 nt, Mycobacterium tuberculosis H37Rv
gaucacuguuccgg

SEQ ID NO: 3306398 - RNA, 16 nt, Mycobacterium tuberculosis H37Rv
gaucagaaucugccuc

SEQ ID NO: 3306399 - RNA, 16 nt, Mycobacterium tuberculosis H37Rv
gaucagacccagcgcg

SEQ ID NO: 3306400 - RNA, 19 nt, Mycobacterium tuberculosis H37Rv
gaucagcaacggcagcgag

SEQ ID NO: 3306401 - RNA, 22 nt, Mycobacterium tuberculosis H37Rv
gaucagcaacggcagcgaggcc

SEQ ID NO: 3306402 - RNA, 17 nt, Mycobacterium tuberculosis H37Rv
gaucagcaacucggcca

SEQ ID NO: 3306403 - RNA, 14 nt, Mycobacterium tuberculosis H37Rv
gaucagcagccgcc

SEQ ID NO: 3306404 - RNA, 18 nt, Mycobacterium tuberculosis H37Rv
gaucagcagccgccgaug

SEQ ID NO: 3306405 - RNA, 17 nt, Mycobacterium tuberculosis H37Rv
gaucagcagcggcgacc

SEQ ID NO: 3306406 - RNA, 15 nt, Mycobacterium tuberculosis H37Rv
gaucagcaggaucgg

SEQ ID NO: 3306407 - RNA, 21 nt, Mycobacterium tuberculosis H37Rv
gaucagcaugccuucggccaa

SEQ ID NO: 3306408 - RNA, 15 nt, Mycobacterium tuberculosis H37Rv
gaucagccagaccaa

SEQ ID NO: 3306409 - RNA, 14 nt, Mycobacterium tuberculosis H37Rv
gaucagcccgcgca

SEQ ID NO: 3306410 - RNA, 14 nt, Mycobacterium tuberculosis H37Rv
gaucagcccggacg

SEQ ID NO: 3306411 - RNA, 21 nt, Mycobacterium tuberculosis H37Rv
gaucagccguggcagucgcac

SEQ ID NO: 3306412 - RNA, 21 nt, Mycobacterium tuberculosis H37Rv
gaucagcgaaccaccggcgcc

SEQ ID NO: 3306413 - RNA, 15 nt, Mycobacterium tuberculosis H37Rv
gaucagcgcggcgcc

SEQ ID NO: 3306414 - RNA, 13 nt, Mycobacterium tuberculosis H37Rv
gaucagcggcgaa

SEQ ID NO: 3306415 - RNA, 19 nt, Mycobacterium tuberculosis H37Rv
gaucagcguauuggacgcu

SEQ ID NO: 3306416 - RNA, 21 nt, Mycobacterium tuberculosis H37Rv
gaucagcgucgguggcagcgg

SEQ ID NO: 3306417 - RNA, 19 nt, Mycobacterium tuberculosis H37Rv
gaucagcgugucgccgaua

SEQ ID NO: 3306418 - RNA, 21 nt, Mycobacterium tuberculosis H37Rv
gaucagcucgcgcacgucgac

SEQ ID NO: 3306419 - RNA, 14 nt, Mycobacterium tuberculosis H37Rv
gaucagcucggucu

SEQ ID NO: 3306420 - RNA, 14 nt, Mycobacterium tuberculosis H37Rv
gaucaggacgcgau

SEQ ID NO: 3306421 - RNA, 15 nt, Mycobacterium tuberculosis H37Rv
gaucaggccccacac

SEQ ID NO: 3306422 - RNA, 19 nt, Mycobacterium tuberculosis H37Rv
gaucaggccuugggauagg

SEQ ID NO: 3306423 - RNA, 16 nt, Mycobacterium tuberculosis H37Rv
gaucaggggcccaccc

SEQ ID NO: 3306424 - RNA, 16 nt, Mycobacterium tuberculosis H37Rv
gaucagggucagcgcc

SEQ ID NO: 3306425 - RNA, 14 nt, Mycobacterium tuberculosis H37Rv
gaucaggguggcgc

SEQ ID NO: 3306426 - RNA, 17 nt, Mycobacterium tuberculosis H37Rv
gaucaggguggcgcggu

SEQ ID NO: 3306427 - RNA, 23 nt, Mycobacterium tuberculosis H37Rv
gaucagggugucgaagagcaggc

SEQ ID NO: 3306428 - RNA, 17 nt, Mycobacterium tuberculosis H37Rv
gaucaggucgucacgcc

SEQ ID NO: 3306429 - RNA, 15 nt, Mycobacterium tuberculosis H37Rv
gaucaggucuucgau

SEQ ID NO: 3306430 - RNA, 16 nt, Mycobacterium tuberculosis H37Rv
gaucagguuggcggcu

SEQ ID NO: 3306431 - RNA, 22 nt, Mycobacterium tuberculosis H37Rv
gaucagguuggcggcugcacgc

SEQ ID NO: 3306432 - RNA, 14 nt, Mycobacterium tuberculosis H37Rv
gaucaguccggcgu

SEQ ID NO: 3306433 - RNA, 17 nt, Mycobacterium tuberculosis H37Rv
gaucaguucguggcugg

SEQ ID NO: 3306434 - RNA, 20 nt, Mycobacterium tuberculosis H37Rv
gaucaguucguggcuggcau

SEQ ID NO: 3306435 - RNA, 21 nt, Mycobacterium tuberculosis H37Rv
gaucaguuugccaucgggacc

SEQ ID NO: 3306436 - RNA, 16 nt, Mycobacterium tuberculosis H37Rv
gaucaucaccggcaua

SEQ ID NO: 3306437 - RNA, 17 nt, Mycobacterium tuberculosis H37Rv
gaucaucaugucggcgc

SEQ ID NO: 3306438 - RNA, 16 nt, Mycobacterium tuberculosis H37Rv
gaucaucccgaccagc

SEQ ID NO: 3306439 - RNA, 13 nt, Mycobacterium tuberculosis H37Rv
gaucaucccggcg

SEQ ID NO: 3306440 - RNA, 21 nt, Mycobacterium tuberculosis H37Rv
gaucaucgacgauuccaggua

SEQ ID NO: 3306441 - RNA, 24 nt, Mycobacterium tuberculosis H37Rv
gaucaucgggaugcggacucagcg

SEQ ID NO: 3306442 - RNA, 23 nt, Mycobacterium tuberculosis H37Rv
gaucaucgggguggccaccagcg

SEQ ID NO: 3306443 - RNA, 20 nt, Mycobacterium tuberculosis H37Rv
gaucaugaacgccagcagcg

SEQ ID NO: 3306444 - RNA, 18 nt, Mycobacterium tuberculosis H37Rv
gaucaugacgagccgagc

SEQ ID NO: 3306445 - RNA, 17 nt, Mycobacterium tuberculosis H37Rv
gaucaugagcagcacgu

SEQ ID NO: 3306446 - RNA, 16 nt, Mycobacterium tuberculosis H37Rv
gaucauggcgagcguu

SEQ ID NO: 3306447 - RNA, 18 nt, Mycobacterium tuberculosis H37Rv
gaucauguucggccacca

SEQ ID NO: 3306448 - RNA, 17 nt, Mycobacterium tuberculosis H37Rv
gaucauugcacccaccc

SEQ ID NO: 3306449 - RNA, 21 nt, Mycobacterium tuberculosis H37Rv
gauccacaacagcccguagca

SEQ ID NO: 3306450 - RNA, 16 nt, Mycobacterium tuberculosis H37Rv
gauccaccaagcucgc

SEQ ID NO: 3306451 - RNA, 15 nt, Mycobacterium tuberculosis H37Rv
gauccacccagugcc

SEQ ID NO: 3306452 - RNA, 13 nt, Mycobacterium tuberculosis H37Rv
gauccaccggucc

SEQ ID NO: 3306453 - RNA, 13 nt, Mycobacterium tuberculosis H37Rv
gauccacgccaga

SEQ ID NO: 3306454 - RNA, 13 nt, Mycobacterium tuberculosis H37Rv
gauccacgccgac

SEQ ID NO: 3306455 - RNA, 17 nt, Mycobacterium tuberculosis H37Rv
gauccacuccggcgauc

SEQ ID NO: 3306456 - RNA, 16 nt, Mycobacterium tuberculosis H37Rv
gauccacucggcgauc

SEQ ID NO: 3306457 - RNA, 21 nt, Mycobacterium tuberculosis H37Rv
gauccacuguagggccgguga

SEQ ID NO: 3306458 - RNA, 13 nt, Mycobacterium tuberculosis H37Rv
gauccagccaugc

SEQ ID NO: 3306459 - RNA, 17 nt, Mycobacterium tuberculosis H37Rv
gauccagcccaugcgcc

SEQ ID NO: 3306460 - RNA, 18 nt, Mycobacterium tuberculosis H37Rv
gauccagcccaugcgcca

SEQ ID NO: 3306461 - RNA, 13 nt, Mycobacterium tuberculosis H37Rv
gauccagcccgac

SEQ ID NO: 3306462 - RNA, 15 nt, Mycobacterium tuberculosis H37Rv
gauccagcccgacgc

SEQ ID NO: 3306463 - RNA, 19 nt, Mycobacterium tuberculosis H37Rv
gauccagcccgacgcccga

SEQ ID NO: 3306464 - RNA, 19 nt, Mycobacterium tuberculosis H37Rv
gauccagccgucggcgcug

SEQ ID NO: 3306465 - RNA, 12 nt, Mycobacterium tuberculosis H37Rv
gauccagcugua

SEQ ID NO: 3306466 - RNA, 18 nt, Mycobacterium tuberculosis H37Rv
gauccagggagcggcugc

SEQ ID NO: 3306467 - RNA, 17 nt, Mycobacterium tuberculosis H37Rv
gauccauuagcacaucg

SEQ ID NO: 3306468 - RNA, 23 nt, Mycobacterium tuberculosis H37Rv
gaucccaacgcccgggcgaaucc

SEQ ID NO: 3306469 - RNA, 13 nt, Mycobacterium tuberculosis H37Rv
gaucccacccucg

SEQ ID NO: 3306470 - RNA, 14 nt, Mycobacterium tuberculosis H37Rv
gaucgcggucagcg

SEQ ID NO: 3306471 - RNA, 15 nt, Mycobacterium tuberculosis H37Rv
gaucgcgguccgagc

SEQ ID NO: 3306472 - RNA, 20 nt, Mycobacterium tuberculosis H37Rv
gaucgcgguccgagcggcau

SEQ ID NO: 3306473 - RNA, 21 nt, Mycobacterium tuberculosis H37Rv
gaucgcggucuugacaccgcc

SEQ ID NO: 3306474 - RNA, 19 nt, Mycobacterium tuberculosis H37Rv
gaucgcggugggccccgau

SEQ ID NO: 3306475 - RNA, 17 nt, Mycobacterium tuberculosis H37Rv
gaucgcgugccacagca

SEQ ID NO: 3306476 - RNA, 17 nt, Mycobacterium tuberculosis H37Rv
gaucgcgugcgacgaua

SEQ ID NO: 3306477 - RNA, 15 nt, Mycobacterium tuberculosis H37Rv
gaucgcgugcggugc

SEQ ID NO: 3306478 - RNA, 20 nt, Mycobacterium tuberculosis H37Rv
gaucgcugcgaagccgagca

SEQ ID NO: 3306479 - RNA, 16 nt, Mycobacterium tuberculosis H37Rv
gaucgcuuccucguag

SEQ ID NO: 3306480 - RNA, 20 nt, Mycobacterium tuberculosis H37Rv
gaucggaacgaucauuccug

SEQ ID NO: 3306481 - RNA, 14 nt, Mycobacterium tuberculosis H37Rv
gaucggaagaaacg

SEQ ID NO: 3306482 - RNA, 16 nt, Mycobacterium tuberculosis H37Rv
gaucggacccgcggga

SEQ ID NO: 3306483 - RNA, 17 nt, Mycobacterium tuberculosis H37Rv
gaucggaggcccgccac

SEQ ID NO: 3306484 - RNA, 22 nt, Mycobacterium tuberculosis H37Rv
gaucggauggugugucggguug

SEQ ID NO: 3306485 - RNA, 20 nt, Mycobacterium tuberculosis H37Rv
gaucggauuuuccgcgugua

SEQ ID NO: 3306486 - RNA, 17 nt, Mycobacterium tuberculosis H37Rv
gaucggcaacccgcacc

SEQ ID NO: 3306487 - RNA, 22 nt, Mycobacterium tuberculosis H37Rv
gaucggcaacccgcaccagggu

SEQ ID NO: 3306488 - RNA, 16 nt, Mycobacterium tuberculosis H37Rv
gaucggcaacggcggc

SEQ ID NO: 3306489 - RNA, 19 nt, Mycobacterium tuberculosis H37Rv
gaucggcaacggcggcgug

SEQ ID NO: 3306490 - RNA, 16 nt, Mycobacterium tuberculosis H37Rv
gaucggcaaucgacuc

SEQ ID NO: 3306491 - RNA, 19 nt, Mycobacterium tuberculosis H37Rv
gaucggcacuuagcccgau

SEQ ID NO: 3306492 - RNA, 15 nt, Mycobacterium tuberculosis H37Rv
gaucggcaggccgcu

SEQ ID NO: 3306493 - RNA, 22 nt, Mycobacterium tuberculosis H37Rv
gaucggcagucccagcgccgca

SEQ ID NO: 3306494 - RNA, 14 nt, Mycobacterium tuberculosis H37Rv
gaucggccaccauc

SEQ ID NO: 3306495 - RNA, 15 nt, Mycobacterium tuberculosis H37Rv
gaucggccaccaucg

SEQ ID NO: 3306496 - RNA, 17 nt, Mycobacterium tuberculosis H37Rv
gaucggccugcagcgau

SEQ ID NO: 3306497 - RNA, 20 nt, Mycobacterium tuberculosis H37Rv
gaucggcgauugcaccaugg

SEQ ID NO: 3306498 - RNA, 14 nt, Mycobacterium tuberculosis H37Rv
gaucggcgccgcau

SEQ ID NO: 3306499 - RNA, 17 nt, Mycobacterium tuberculosis H37Rv
gaucggcgcgccgaucg

SEQ ID NO: 3306500 - RNA, 22 nt, Mycobacterium tuberculosis H37Rv
gaucggcgcgccgaucggcacc

SEQ ID NO: 3306501 - RNA, 13 nt, Mycobacterium tuberculosis H37Rv
gaucggcgcggcc

SEQ ID NO: 3306502 - RNA, 20 nt, Mycobacterium tuberculosis H37Rv
gaucggcgcggccguagugc

SEQ ID NO: 3306503 - RNA, 14 nt, Mycobacterium tuberculosis H37Rv
gaucggcgcgucga

SEQ ID NO: 3306504 - RNA, 18 nt, Mycobacterium tuberculosis H37Rv
gaucggcggaccgcagcg

SEQ ID NO: 3306505 - RNA, 16 nt, Mycobacterium tuberculosis H37Rv
gaucggcggccgcgac

SEQ ID NO: 3306506 - RNA, 20 nt, Mycobacterium tuberculosis H37Rv
gaucggcggccgcgaccagc

SEQ ID NO: 3306507 - RNA, 23 nt, Mycobacterium tuberculosis H37Rv
gaucggcggguggcgccaguucg

SEQ ID NO: 3306508 - RNA, 21 nt, Mycobacterium tuberculosis H37Rv
gaucggcucaccgaacgcgau

SEQ ID NO: 3306509 - RNA, 12 nt, Mycobacterium tuberculosis H37Rv
gaucggcucacg

SEQ ID NO: 3306510 - RNA, 13 nt, Mycobacterium tuberculosis H37Rv
gaucggcucacga

SEQ ID NO: 3306511 - RNA, 13 nt, Mycobacterium tuberculosis H37Rv
gaucggcucgcca

SEQ ID NO: 3306512 - RNA, 16 nt, Mycobacterium tuberculosis H37Rv
gaucggcugcgcgcuc

SEQ ID NO: 3306513 - RNA, 19 nt, Mycobacterium tuberculosis H37Rv
gaucggcuucuucuucuug

SEQ ID NO: 3306514 - RNA, 18 nt, Mycobacterium tuberculosis H37Rv
gaucggcuugggaaaccc

SEQ ID NO: 3306515 - RNA, 22 nt, Mycobacterium tuberculosis H37Rv
gaucgggcccaccgcugcggca

SEQ ID NO: 3306516 - RNA, 13 nt, Mycobacterium tuberculosis H37Rv
gaucgggccgauc

SEQ ID NO: 3306517 - RNA, 17 nt, Mycobacterium tuberculosis H37Rv
gaucgggcuucggccag

SEQ ID NO: 3306518 - RNA, 15 nt, Mycobacterium tuberculosis H37Rv
gaucggggcgcugca

SEQ ID NO: 3306519 - RNA, 18 nt, Mycobacterium tuberculosis H37Rv
gaucggggcgcugcagcu

SEQ ID NO: 3306520 - RNA, 21 nt, Mycobacterium tuberculosis H37Rv
gaucgggucguuggcggcggu

SEQ ID NO: 3306521 - RNA, 15 nt, Mycobacterium tuberculosis H37Rv
gaucggguggcgggu

SEQ ID NO: 3306522 - RNA, 14 nt, Mycobacterium tuberculosis H37Rv
gaucggucggccaa

SEQ ID NO: 3306523 - RNA, 15 nt, Mycobacterium tuberculosis H37Rv
gaucggucggcgugc

SEQ ID NO: 3306524 - RNA, 22 nt, Mycobacterium tuberculosis H37Rv
gaucggucuuggcgauccaggc

SEQ ID NO: 3306525 - RNA, 19 nt, Mycobacterium tuberculosis H37Rv
gaucggugcgaucaggcug

SEQ ID NO: 3306526 - RNA, 17 nt, Mycobacterium tuberculosis H37Rv
gaucggugggcgggugc

SEQ ID NO: 3306527 - RNA, 16 nt, Mycobacterium tuberculosis H37Rv
gaucggugucgggcug

SEQ ID NO: 3306528 - RNA, 17 nt, Mycobacterium tuberculosis H37Rv
gaucgguugaucggcca

SEQ ID NO: 3306529 - RNA, 21 nt, Mycobacterium tuberculosis H37Rv
gaucgguuucugcggccccga

SEQ ID NO: 3306530 - RNA, 17 nt, Mycobacterium tuberculosis H37Rv
gaucguagggacgccga

SEQ ID NO: 3306531 - RNA, 19 nt, Mycobacterium tuberculosis H37Rv
gaucguagggacgccgagc

SEQ ID NO: 3306532 - RNA, 15 nt, Mycobacterium tuberculosis H37Rv
gaucgucaagccggg

SEQ ID NO: 3306533 - RNA, 14 nt, Mycobacterium tuberculosis H37Rv
gaucgucacggggu

SEQ ID NO: 3306534 - RNA, 15 nt, Mycobacterium tuberculosis H37Rv
gaucgucacucccga

SEQ ID NO: 3306535 - RNA, 16 nt, Mycobacterium tuberculosis H37Rv
gaucgucacucccgac

SEQ ID NO: 3306536 - RNA, 19 nt, Mycobacterium tuberculosis H37Rv
gaucgucaguuacgcaucg

SEQ ID NO: 3306537 - RNA, 17 nt, Mycobacterium tuberculosis H37Rv
gaucguccaccgccgac

SEQ ID NO: 3306538 - RNA, 14 nt, Mycobacterium tuberculosis H37Rv
gaucguccagccca

SEQ ID NO: 3306539 - RNA, 19 nt, Mycobacterium tuberculosis H37Rv
gaucguccagcccagaucc

SEQ ID NO: 3306540 - RNA, 14 nt, Mycobacterium tuberculosis H37Rv
gaucguccggccgg

SEQ ID NO: 3306541 - RNA, 19 nt, Mycobacterium tuberculosis H37Rv
gaucgucgaacagcaccgc

SEQ ID NO: 3306542 - RNA, 12 nt, Mycobacterium tuberculosis H37Rv
gaucgucgacgc

SEQ ID NO: 3306543 - RNA, 18 nt, Mycobacterium tuberculosis H37Rv
gaucgucgaggcacgagc

SEQ ID NO: 3306544 - RNA, 15 nt, Mycobacterium tuberculosis H37Rv
gaucgucggcaacca

SEQ ID NO: 3306545 - RNA, 14 nt, Mycobacterium tuberculosis H37Rv
gaucgucgggagca

SEQ ID NO: 3306546 - RNA, 11 nt, Mycobacterium tuberculosis H37Rv
gaucgucgggu

SEQ ID NO: 3306547 - RNA, 18 nt, Mycobacterium tuberculosis H37Rv
gaucgucgugcacggcgg

SEQ ID NO: 3306548 - RNA, 20 nt, Mycobacterium tuberculosis H37Rv
gaucgucgugcacggcggcc

SEQ ID NO: 3306549 - RNA, 14 nt, Mycobacterium tuberculosis H37Rv
gaucgucguuguca

SEQ ID NO: 3306550 - RNA, 17 nt, Mycobacterium tuberculosis H37Rv
gaucgucucgcgcaccu

SEQ ID NO: 3306551 - RNA, 17 nt, Mycobacterium tuberculosis H37Rv
gaucgugaacacgucgc

SEQ ID NO: 3306552 - RNA, 19 nt, Mycobacterium tuberculosis H37Rv
gaucgugaacacgucgcgg

SEQ ID NO: 3306553 - RNA, 17 nt, Mycobacterium tuberculosis H37Rv
gaucgugagacgccguc

SEQ ID NO: 3306554 - RNA, 14 nt, Mycobacterium tuberculosis H37Rv
gaucgugccggcga

SEQ ID NO: 3306555 - RNA, 14 nt, Mycobacterium tuberculosis H37Rv
gaucgugccgggac

SEQ ID NO: 3306556 - RNA, 20 nt, Mycobacterium tuberculosis H37Rv
gaucguggcgaccacgauga

SEQ ID NO: 3306557 - RNA, 23 nt, Mycobacterium tuberculosis H37Rv
gaucguguccaccggaccgacca

SEQ ID NO: 3306558 - RNA, 20 nt, Mycobacterium tuberculosis H37Rv
gaucguuccaggccgcgucg

SEQ ID NO: 3306559 - RNA, 19 nt, Mycobacterium tuberculosis H37Rv
gaucguuccgauccggugg

SEQ ID NO: 3306560 - RNA, 16 nt, Mycobacterium tuberculosis H37Rv
gaucguugccucgucg

SEQ ID NO: 3306561 - RNA, 18 nt, Mycobacterium tuberculosis H37Rv
gaucguugccucgucgcc

SEQ ID NO: 3306562 - RNA, 20 nt, Mycobacterium tuberculosis H37Rv
gaucguugccucgucgccgc

SEQ ID NO: 3306563 - RNA, 22 nt, Mycobacterium tuberculosis H37Rv
gaucucaccacccgucggcccg

SEQ ID NO: 3306564 - RNA, 21 nt, Mycobacterium tuberculosis H37Rv
gaucucacccagcucgcgcac

SEQ ID NO: 3306565 - RNA, 23 nt, Mycobacterium tuberculosis H37Rv
gaucucacccagcucgcgcaccc

SEQ ID NO: 3306566 - RNA, 15 nt, Mycobacterium tuberculosis H37Rv
gaugaucccggucuu

SEQ ID NO: 3306567 - RNA, 19 nt, Mycobacterium tuberculosis H37Rv
gaugaucgguucgggacgc

SEQ ID NO: 3306568 - RNA, 17 nt, Mycobacterium tuberculosis H37Rv
gaugaugcaacgccaaa

SEQ ID NO: 3306569 - RNA, 12 nt, Mycobacterium tuberculosis H37Rv
gaugaugccgga

SEQ ID NO: 3306570 - RNA, 14 nt, Mycobacterium tuberculosis H37Rv
gaugaugccggcgu

SEQ ID NO: 3306571 - RNA, 22 nt, Mycobacterium tuberculosis H37Rv
gaugaugccggcguuguaguug

SEQ ID NO: 3306572 - RNA, 20 nt, Mycobacterium tuberculosis H37Rv
gaugauggcgcgaucggugc

SEQ ID NO: 3306573 - RNA, 15 nt, Mycobacterium tuberculosis H37Rv
gaugauuucgccgag

SEQ ID NO: 3306574 - RNA, 16 nt, Mycobacterium tuberculosis H37Rv
gaugauuucgccgagc

SEQ ID NO: 3306575 - RNA, 16 nt, Mycobacterium tuberculosis H37Rv
gaugcaacgccaaaau

SEQ ID NO: 3306576 - RNA, 18 nt, Mycobacterium tuberculosis H37Rv
gaugcaacgccaaaaugg

SEQ ID NO: 3306577 - RNA, 15 nt, Mycobacterium tuberculosis H37Rv
gaugcaacgcggcga

SEQ ID NO: 3306578 - RNA, 17 nt, Mycobacterium tuberculosis H37Rv
gaugcacaggccgacga

SEQ ID NO: 3306579 - RNA, 14 nt, Mycobacterium tuberculosis H37Rv
gaugcagccacaua

SEQ ID NO: 3306580 - RNA, 17 nt, Mycobacterium tuberculosis H37Rv
gaugcagcgggucgccg

SEQ ID NO: 3306581 - RNA, 22 nt, Mycobacterium tuberculosis H37Rv
gaugcagcgguccagacaucag

SEQ ID NO: 3306582 - RNA, 19 nt, Mycobacterium tuberculosis H37Rv
gaugcagcugcccggcgug

SEQ ID NO: 3306583 - RNA, 13 nt, Mycobacterium tuberculosis H37Rv
gaugcaucggugc

SEQ ID NO: 3306584 - RNA, 22 nt, Mycobacterium tuberculosis H37Rv
gaugcaugucuugugguggaaa

SEQ ID NO: 3306585 - RNA, 19 nt, Mycobacterium tuberculosis H37Rv
gaugccacccagaugcagc

SEQ ID NO: 3306586 - RNA, 15 nt, Mycobacterium tuberculosis H37Rv
gaugccacggcgucg

SEQ ID NO: 3306587 - RNA, 21 nt, Mycobacterium tuberculosis H37Rv
gaugcccaagcccucgacguc

SEQ ID NO: 3306588 - RNA, 20 nt, Mycobacterium tuberculosis H37Rv
gaugcccacggugccggcac

SEQ ID NO: 3306589 - RNA, 14 nt, Mycobacterium tuberculosis H37Rv
gaugcccagcagga

SEQ ID NO: 3306590 - RNA, 13 nt, Mycobacterium tuberculosis H37Rv
gaugcccagcgcc

SEQ ID NO: 3306591 - RNA, 19 nt, Mycobacterium tuberculosis H37Rv
gaugcccaucacgccccag

SEQ ID NO: 3306592 - RNA, 15 nt, Mycobacterium tuberculosis H37Rv
gaugccccacggugc

SEQ ID NO: 3306593 - RNA, 14 nt, Mycobacterium tuberculosis H37Rv
gaugcccgacaccg

SEQ ID NO: 3306594 - RNA, 19 nt, Mycobacterium tuberculosis H37Rv
gaugcccggcaucgcgauc

SEQ ID NO: 3306595 - RNA, 21 nt, Mycobacterium tuberculosis H37Rv
gaugcccgguuucuucuucaa

SEQ ID NO: 3306596 - RNA, 21 nt, Mycobacterium tuberculosis H37Rv
gaugcccguagacgccgagca

SEQ ID NO: 3306597 - RNA, 21 nt, Mycobacterium tuberculosis H37Rv
gaugcccucgauggccaggcu

SEQ ID NO: 3306598 - RNA, 15 nt, Mycobacterium tuberculosis H37Rv
gaugccgaaccgcug

SEQ ID NO: 3306599 - RNA, 15 nt, Mycobacterium tuberculosis H37Rv
gaugccgaagccccc

SEQ ID NO: 3306600 - RNA, 23 nt, Mycobacterium tuberculosis H37Rv
gaugccgaccuuuugcggcaagc

SEQ ID NO: 3306601 - RNA, 14 nt, Mycobacterium tuberculosis H37Rv
gaugccgacggcgc

SEQ ID NO: 3306602 - RNA, 16 nt, Mycobacterium tuberculosis H37Rv
gaugccgacggcgggc

SEQ ID NO: 3306603 - RNA, 13 nt, Mycobacterium tuberculosis H37Rv
gaugccgaugacc

SEQ ID NO: 3306604 - RNA, 16 nt, Mycobacterium tuberculosis H37Rv
gaugccgaugcgacgc

SEQ ID NO: 3306605 - RNA, 18 nt, Mycobacterium tuberculosis H37Rv
gaugccgcacccgaucga

SEQ ID NO: 3306606 - RNA, 23 nt, Mycobacterium tuberculosis H37Rv
gaugccgcacccgaucgacgguc

SEQ ID NO: 3306607 - RNA, 20 nt, Mycobacterium tuberculosis H37Rv
gaugccgccccgcagcugcg

SEQ ID NO: 3306608 - RNA, 12 nt, Mycobacterium tuberculosis H37Rv
gaugccgcccgu

SEQ ID NO: 3306609 - RNA, 21 nt, Mycobacterium tuberculosis H37Rv
gaugccgcccgugagauccuc

SEQ ID NO: 3306610 - RNA, 23 nt, Mycobacterium tuberculosis H37Rv
gaugccgcccgugagauccucca

SEQ ID NO: 3306611 - RNA, 20 nt, Mycobacterium tuberculosis H37Rv
gaugccgccgaagaggagaa

SEQ ID NO: 3306612 - RNA, 18 nt, Mycobacterium tuberculosis H37Rv
gaugccgccggcaccgcc

SEQ ID NO: 3306613 - RNA, 14 nt, Mycobacterium tuberculosis H37Rv
gaugccgccggccc

SEQ ID NO: 3306614 - RNA, 15 nt, Mycobacterium tuberculosis H37Rv
gaugccggaaagcau

SEQ ID NO: 3306615 - RNA, 16 nt, Mycobacterium tuberculosis H37Rv
gaugccggcgagggcc

SEQ ID NO: 3306616 - RNA, 17 nt, Mycobacterium tuberculosis H37Rv
gaugccggcgagggcca

SEQ ID NO: 3306617 - RNA, 13 nt, Mycobacterium tuberculosis H37Rv
gaugccggcguug

SEQ ID NO: 3306618 - RNA, 18 nt, Mycobacterium tuberculosis H37Rv
gaugccggcugccgcacc

SEQ ID NO: 3306619 - RNA, 14 nt, Mycobacterium tuberculosis H37Rv
gaugccgggugugu

SEQ ID NO: 3306620 - RNA, 12 nt, Mycobacterium tuberculosis H37Rv
gaugccguaggc

SEQ ID NO: 3306621 - RNA, 22 nt, Mycobacterium tuberculosis H37Rv
gaugccguaggcggccaguugc

SEQ ID NO: 3306622 - RNA, 21 nt, Mycobacterium tuberculosis H37Rv
gaugccguaguaaggagccgg

SEQ ID NO: 3306623 - RNA, 21 nt, Mycobacterium tuberculosis H37Rv
gaugccguucaugccauggau

SEQ ID NO: 3306624 - RNA, 22 nt, Mycobacterium tuberculosis H37Rv
gaugccucggcggccucgcugc

SEQ ID NO: 3306625 - RNA, 18 nt, Mycobacterium tuberculosis H37Rv
gaugccugcuagcagcag

SEQ ID NO: 3306626 - RNA, 22 nt, Mycobacterium tuberculosis H37Rv
gaugccugcuagcagcagcccg

SEQ ID NO: 3306627 - RNA, 14 nt, Mycobacterium tuberculosis H37Rv
gaugccuuccgacg

SEQ ID NO: 3306628 - RNA, 16 nt, Mycobacterium tuberculosis H37Rv
gaugccuuccgacgac

SEQ ID NO: 3306629 - RNA, 16 nt, Mycobacterium tuberculosis H37Rv
gaugcgaaacaucucg

SEQ ID NO: 3306630 - RNA, 18 nt, Mycobacterium tuberculosis H37Rv
gaugcgacagcgcugggc

SEQ ID NO: 3306631 - RNA, 14 nt, Mycobacterium tuberculosis H37Rv
gaugcgaucgacga

SEQ ID NO: 3306632 - RNA, 23 nt, Mycobacterium tuberculosis H37Rv
gaugcgcaacuucuucagcagcg

SEQ ID NO: 3306633 - RNA, 22 nt, Mycobacterium tuberculosis H37Rv
gaugcgcacucccggcucggcc

SEQ ID NO: 3306634 - RNA, 23 nt, Mycobacterium tuberculosis H37Rv
gaugcgcacucccggcucggcca

SEQ ID NO: 3306635 - RNA, 20 nt, Mycobacterium tuberculosis H37Rv
gaugcgcagugcaccgcguc

SEQ ID NO: 3306636 - RNA, 21 nt, Mycobacterium tuberculosis H37Rv
gaugcgcagugcaccgcgucg

SEQ ID NO: 3306637 - RNA, 16 nt, Mycobacterium tuberculosis H37Rv
gaugcgccaggcugaa

SEQ ID NO: 3306638 - RNA, 17 nt, Mycobacterium tuberculosis H37Rv
gaugcgccaggcugaag

SEQ ID NO: 3306639 - RNA, 19 nt, Mycobacterium tuberculosis H37Rv
gaugcgcccggcgugguga

SEQ ID NO: 3306640 - RNA, 14 nt, Mycobacterium tuberculosis H37Rv
gaugcgcgcccgac

SEQ ID NO: 3306641 - RNA, 16 nt, Mycobacterium tuberculosis H37Rv
gaugcgcgucucgagc

SEQ ID NO: 3306642 - RNA, 17 nt, Mycobacterium tuberculosis H37Rv
gaugcgcgucucgagcg

SEQ ID NO: 3306643 - RNA, 21 nt, Mycobacterium tuberculosis H37Rv
gaugcgcguuacccaucgcca

SEQ ID NO: 3306644 - RNA, 14 nt, Mycobacterium tuberculosis H37Rv
gaugcgcuaggugc

SEQ ID NO: 3306645 - RNA, 13 nt, Mycobacterium tuberculosis H37Rv
gaugcgcucggcc

SEQ ID NO: 3306646 - RNA, 15 nt, Mycobacterium tuberculosis H37Rv
gaugcgcucggccug

SEQ ID NO: 3306647 - RNA, 20 nt, Mycobacterium tuberculosis H37Rv
gaugcgcugcucacgcagca

SEQ ID NO: 3306648 - RNA, 18 nt, Mycobacterium tuberculosis H37Rv
gaugcgcuuccaucgcca

SEQ ID NO: 3306649 - RNA, 23 nt, Mycobacterium tuberculosis H37Rv
gaugcgcuuccaucgccacuguu

SEQ ID NO: 3306650 - RNA, 18 nt, Mycobacterium tuberculosis H37Rv
gaugcggacucagcggcg

SEQ ID NO: 3306651 - RNA, 19 nt, Mycobacterium tuberculosis H37Rv
gaugcggacucagcggcgu

SEQ ID NO: 3306652 - RNA, 18 nt, Mycobacterium tuberculosis H37Rv
gaugcggcuauuggccug

SEQ ID NO: 3306653 - RNA, 23 nt, Mycobacterium tuberculosis H37Rv
gaugcgggcggcaagcucgacga

SEQ ID NO: 3306654 - RNA, 15 nt, Mycobacterium tuberculosis H37Rv
gaugcgggcucggcu

SEQ ID NO: 3306655 - RNA, 14 nt, Mycobacterium tuberculosis H37Rv
gaugcgggcuguga

SEQ ID NO: 3306656 - RNA, 23 nt, Mycobacterium tuberculosis H37Rv
gaugcgguaucggucgacuggga

SEQ ID NO: 3306657 - RNA, 17 nt, Mycobacterium tuberculosis H37Rv
gaugcggugucgggcug

SEQ ID NO: 3306658 - RNA, 22 nt, Mycobacterium tuberculosis H37Rv
gaugcguagacauuggcuccga

SEQ ID NO: 3306659 - RNA, 18 nt, Mycobacterium tuberculosis H37Rv
gaugcguagugcggcgug

SEQ ID NO: 3306660 - RNA, 20 nt, Mycobacterium tuberculosis H37Rv
gaugcguccgcccagccgca

SEQ ID NO: 3306661 - RNA, 17 nt, Mycobacterium tuberculosis H37Rv
gaugcgucucgcgcgau

SEQ ID NO: 3306662 - RNA, 16 nt, Mycobacterium tuberculosis H37Rv
gauguaugacagguca

SEQ ID NO: 3306663 - RNA, 18 nt, Mycobacterium tuberculosis H37Rv
gauguaugacaggucacg

SEQ ID NO: 3306664 - RNA, 21 nt, Mycobacterium tuberculosis H37Rv
gauguccaggagugcgggcau

SEQ ID NO: 3306665 - RNA, 17 nt, Mycobacterium tuberculosis H37Rv
gaugucccaugcacggc

SEQ ID NO: 3306666 - RNA, 16 nt, Mycobacterium tuberculosis H37Rv
gauguccccgacggac

SEQ ID NO: 3306667 - RNA, 20 nt, Mycobacterium tuberculosis H37Rv
gauguccccggcggcagcau

SEQ ID NO: 3306668 - RNA, 12 nt, Mycobacterium tuberculosis H37Rv
gauguccgacgc

SEQ ID NO: 3306669 - RNA, 17 nt, Mycobacterium tuberculosis H37Rv
gauguccgacgcaccaa

SEQ ID NO: 3306670 - RNA, 17 nt, Mycobacterium tuberculosis H37Rv
gauguccgcggccacca

SEQ ID NO: 3306671 - RNA, 19 nt, Mycobacterium tuberculosis H37Rv
gauguccucgaugcgggcg

SEQ ID NO: 3306672 - RNA, 15 nt, Mycobacterium tuberculosis H37Rv
gauguccuugcgguc

SEQ ID NO: 3306673 - RNA, 14 nt, Mycobacterium tuberculosis H37Rv
gaugucgaagucgu

SEQ ID NO: 3306674 - RNA, 16 nt, Mycobacterium tuberculosis H37Rv
gaugucgcccaaccga

SEQ ID NO: 3306675 - RNA, 12 nt, Mycobacterium tuberculosis H37Rv
gaugucgccgau

SEQ ID NO: 3306676 - RNA, 17 nt, Mycobacterium tuberculosis H37Rv
gaugucggcaccauagc

SEQ ID NO: 3306677 - RNA, 14 nt, Mycobacterium tuberculosis H37Rv
gaugucggcaggua

SEQ ID NO: 3306678 - RNA, 23 nt, Mycobacterium tuberculosis H37Rv
gaugucggcgaaccacggcagcc

SEQ ID NO: 3306679 - RNA, 14 nt, Mycobacterium tuberculosis H37Rv
gaugucggcuggug

SEQ ID NO: 3306680 - RNA, 23 nt, Mycobacterium tuberculosis H37Rv
gaugucggggccgucgucgguca

SEQ ID NO: 3306681 - RNA, 15 nt, Mycobacterium tuberculosis H37Rv
gaugucggugcgucc

SEQ ID NO: 3306682 - RNA, 20 nt, Mycobacterium tuberculosis H37Rv
gaugucggugcguccggugc

SEQ ID NO: 3306683 - RNA, 17 nt, Mycobacterium tuberculosis H37Rv
gaugucgucgacaucaa

SEQ ID NO: 3306684 - RNA, 18 nt, Mycobacterium tuberculosis H37Rv
gaugucgucgaccaggcc

SEQ ID NO: 3306685 - RNA, 22 nt, Mycobacterium tuberculosis H37Rv
gaugucgugcgggcgcaccagg

SEQ ID NO: 3306686 - RNA, 15 nt, Mycobacterium tuberculosis H37Rv
gaugucguuggccac

SEQ ID NO: 3306687 - RNA, 19 nt, Mycobacterium tuberculosis H37Rv
gaugucguuggccaccucg

SEQ ID NO: 3306688 - RNA, 15 nt, Mycobacterium tuberculosis H37Rv
gaugucucggcacca

SEQ ID NO: 3306689 - RNA, 16 nt, Mycobacterium tuberculosis H37Rv
gaugucucggcaccac

SEQ ID NO: 3306690 - RNA, 24 nt, Mycobacterium tuberculosis H37Rv
gaugucucggcaccacagugaaau

SEQ ID NO: 3306691 - RNA, 17 nt, Mycobacterium tuberculosis H37Rv
gaugugcacggugugca

SEQ ID NO: 3306692 - RNA, 16 nt, Mycobacterium tuberculosis H37Rv
gaugugcgccaccucg

SEQ ID NO: 3306693 - RNA, 20 nt, Mycobacterium tuberculosis H37Rv
gaugugcgccaccucgacgc

SEQ ID NO: 3306694 - RNA, 22 nt, Mycobacterium tuberculosis H37Rv
gaugugcggcugcaccggcuug

SEQ ID NO: 3306695 - RNA, 23 nt, Mycobacterium tuberculosis H37Rv
gauguggaugacgcagucgccca

SEQ ID NO: 3306696 - RNA, 20 nt, Mycobacterium tuberculosis H37Rv
gauguggcgcuccggcgugc

SEQ ID NO: 3306697 - RNA, 20 nt, Mycobacterium tuberculosis H37Rv
gaugugggcgccgucgccgu

SEQ ID NO: 3306698 - RNA, 23 nt, Mycobacterium tuberculosis H37Rv
gauguguagguggggcacuucca

SEQ ID NO: 3306699 - RNA, 16 nt, Mycobacterium tuberculosis H37Rv
gauguguucuccugcc

SEQ ID NO: 3306700 - RNA, 19 nt, Mycobacterium tuberculosis H37Rv
gauguucagcgccacgucc

SEQ ID NO: 3306701 - RNA, 18 nt, Mycobacterium tuberculosis H37Rv
gauguugccggaguugaa

SEQ ID NO: 3306702 - RNA, 21 nt, Mycobacterium tuberculosis H37Rv
gauguuggccggcgccaccga

SEQ ID NO: 3306703 - RNA, 21 nt, Mycobacterium tuberculosis H37Rv
gauguuuuccccgcccuugcc

SEQ ID NO: 3306704 - RNA, 16 nt, Mycobacterium tuberculosis H37Rv
gauuaagucggcggcc

SEQ ID NO: 3306705 - RNA, 19 nt, Mycobacterium tuberculosis H37Rv
gauuacaugucacacccac

SEQ ID NO: 3306706 - RNA, 16 nt, Mycobacterium tuberculosis H37Rv
gauuaccagcggcacc

SEQ ID NO: 3306707 - RNA, 21 nt, Mycobacterium tuberculosis H37Rv
gauuacggccagugucagcac

SEQ ID NO: 3306708 - RNA, 19 nt, Mycobacterium tuberculosis H37Rv
gauucacacucgggcggcu

SEQ ID NO: 3306709 - RNA, 18 nt, Mycobacterium tuberculosis H37Rv
gauucaucaacacgacgu

SEQ ID NO: 3306710 - RNA, 16 nt, Mycobacterium tuberculosis H37Rv
gauuccaauugggcga

SEQ ID NO: 3306711 - RNA, 22 nt, Mycobacterium tuberculosis H37Rv
gauuccaauugggcgaugcggc

SEQ ID NO: 3306712 - RNA, 14 nt, Mycobacterium tuberculosis H37Rv
gauuccaccgccga

SEQ ID NO: 3306713 - RNA, 13 nt, Mycobacterium tuberculosis H37Rv
gauucccagucca

SEQ ID NO: 3306714 - RNA, 15 nt, Mycobacterium tuberculosis H37Rv
gauucccaguccagg

SEQ ID NO: 3306715 - RNA, 18 nt, Mycobacterium tuberculosis H37Rv
gauucccggcgcgguggc

SEQ ID NO: 3306716 - RNA, 23 nt, Mycobacterium tuberculosis H37Rv
gauuccgaacuggucgacgccga

SEQ ID NO: 3306717 - RNA, 20 nt, Mycobacterium tuberculosis H37Rv
gauuccgcgucugcucgcga

SEQ ID NO: 3306718 - RNA, 21 nt, Mycobacterium tuberculosis H37Rv
gauuccggcggccacgccggc

SEQ ID NO: 3306719 - RNA, 17 nt, Mycobacterium tuberculosis H37Rv
gauuccucuucaggccc

SEQ ID NO: 3306720 - RNA, 20 nt, Mycobacterium tuberculosis H37Rv
gauuccuugaugccuuccga

SEQ ID NO: 3306721 - RNA, 22 nt, Mycobacterium tuberculosis H37Rv
gauucgaagccgagcuccucca

SEQ ID NO: 3306722 - RNA, 18 nt, Mycobacterium tuberculosis H37Rv
gauucgauguccucgaca

SEQ ID NO: 3306723 - RNA, 15 nt, Mycobacterium tuberculosis H37Rv
gauucgcggcagccg

SEQ ID NO: 3306724 - RNA, 18 nt, Mycobacterium tuberculosis H37Rv
gauucgcggcagccggcg

SEQ ID NO: 3306725 - RNA, 17 nt, Mycobacterium tuberculosis H37Rv
gauucggacucgccgac

SEQ ID NO: 3306726 - RNA, 13 nt, Mycobacterium tuberculosis H37Rv
gauucggccagac

SEQ ID NO: 3306727 - RNA, 14 nt, Mycobacterium tuberculosis H37Rv
gauucggcccaucu

SEQ ID NO: 3306728 - RNA, 19 nt, Mycobacterium tuberculosis H37Rv
gauucggccugagcggcca

SEQ ID NO: 3306729 - RNA, 17 nt, Mycobacterium tuberculosis H37Rv
gauucggcgacgacggg

SEQ ID NO: 3306730 - RNA, 15 nt, Mycobacterium tuberculosis H37Rv
gauucggcggucgcu

SEQ ID NO: 3306731 - RNA, 18 nt, Mycobacterium tuberculosis H37Rv
gauucgggaggcaaccca

SEQ ID NO: 3306732 - RNA, 15 nt, Mycobacterium tuberculosis H37Rv
gauucgguaucaggg

SEQ ID NO: 3306733 - RNA, 15 nt, Mycobacterium tuberculosis H37Rv
gauucggugccagca

SEQ ID NO: 3306734 - RNA, 18 nt, Mycobacterium tuberculosis H37Rv
gauucguugucgagcacg

SEQ ID NO: 3306735 - RNA, 16 nt, Mycobacterium tuberculosis H37Rv
gauucugcgucugcuc

SEQ ID NO: 3306736 - RNA, 20 nt, Mycobacterium tuberculosis H37Rv
gauucugcgucugcucgcga

SEQ ID NO: 3306737 - RNA, 19 nt, Mycobacterium tuberculosis H37Rv
gauucugggcuucaucggc

SEQ ID NO: 3306738 - RNA, 20 nt, Mycobacterium tuberculosis H37Rv
gauucugugucugcucgcgc

SEQ ID NO: 3306739 - RNA, 21 nt, Mycobacterium tuberculosis H37Rv
gauucugugucugcucggcga

SEQ ID NO: 3306740 - RNA, 16 nt, Mycobacterium tuberculosis H37Rv
gauucuucgaugaugc

SEQ ID NO: 3306741 - RNA, 16 nt, Mycobacterium tuberculosis H37Rv
gauugaagcuggccac

SEQ ID NO: 3306742 - RNA, 22 nt, Mycobacterium tuberculosis H37Rv
gauugaccaacccucgccgguc

SEQ ID NO: 3306743 - RNA, 15 nt, Mycobacterium tuberculosis H37Rv
gauugaccgcggccg

SEQ ID NO: 3306744 - RNA, 11 nt, Mycobacterium tuberculosis H37Rv
gauugacggug

SEQ ID NO: 3306745 - RNA, 23 nt, Mycobacterium tuberculosis H37Rv
gauugcaccauggcgcgaccucc

SEQ ID NO: 3306746 - RNA, 18 nt, Mycobacterium tuberculosis H37Rv
gauugccaggaccgcgcc

SEQ ID NO: 3306747 - RNA, 13 nt, Mycobacterium tuberculosis H37Rv
gauugccccgcau

SEQ ID NO: 3306748 - RNA, 20 nt, Mycobacterium tuberculosis H37Rv
gauugccugacaacucccga

SEQ ID NO: 3306749 - RNA, 19 nt, Mycobacterium tuberculosis H37Rv
gauugcgcgggcaucgucg

SEQ ID NO: 3306750 - RNA, 14 nt, Mycobacterium tuberculosis H37Rv
gauugcggcacgga

SEQ ID NO: 3306751 - RNA, 20 nt, Mycobacterium tuberculosis H37Rv
gauugcggcacggaugcgau

SEQ ID NO: 3306752 - RNA, 18 nt, Mycobacterium tuberculosis H37Rv
gauugcguagcgggucag

SEQ ID NO: 3306753 - RNA, 17 nt, Mycobacterium tuberculosis H37Rv
gauugcguucaucaucc

SEQ ID NO: 3306754 - RNA, 23 nt, Mycobacterium tuberculosis H37Rv
gauugcugcggcuuucagcgcuu

SEQ ID NO: 3306755 - RNA, 18 nt, Mycobacterium tuberculosis H37Rv
gauuggaaugguggugcc

SEQ ID NO: 3306756 - RNA, 16 nt, Mycobacterium tuberculosis H37Rv
gauuggccaaccccau

SEQ ID NO: 3306757 - RNA, 15 nt, Mycobacterium tuberculosis H37Rv
gauuggcucgccgaa

SEQ ID NO: 3306758 - RNA, 17 nt, Mycobacterium tuberculosis H37Rv
gcaacgacggccgucgc

SEQ ID NO: 3306759 - RNA, 19 nt, Mycobacterium tuberculosis H37Rv
gcaacgacggccgucgccc

SEQ ID NO: 3306760 - RNA, 19 nt, Mycobacterium tuberculosis H37Rv
gcaacgacgucgucgccgc

SEQ ID NO: 3306761 - RNA, 24 nt, Mycobacterium tuberculosis H37Rv
gcaacgacucucaucgacucgacc

SEQ ID NO: 3306762 - RNA, 14 nt, Mycobacterium tuberculosis H37Rv
gcaacgaucgacac

SEQ ID NO: 3306763 - RNA, 19 nt, Mycobacterium tuberculosis H37Rv
gcaacgauuuuagcggcug

SEQ ID NO: 3306764 - RNA, 18 nt, Mycobacterium tuberculosis H37Rv
gcaacgccaaaauggugc

SEQ ID NO: 3306765 - RNA, 20 nt, Mycobacterium tuberculosis H37Rv
gcaacgcccaacgucgccag

SEQ ID NO: 3306766 - RNA, 24 nt, Mycobacterium tuberculosis H37Rv
gcaacgcccaacgucgccagguca

SEQ ID NO: 3306767 - RNA, 15 nt, Mycobacterium tuberculosis H37Rv
gcaacgccgauggcu

SEQ ID NO: 3306768 - RNA, 16 nt, Mycobacterium tuberculosis H37Rv
gcaacgccgcggacca

SEQ ID NO: 3306769 - RNA, 13 nt, Mycobacterium tuberculosis H37Rv
gcaacgcgaaccg

SEQ ID NO: 3306770 - RNA, 16 nt, Mycobacterium tuberculosis H37Rv
gcaacgcggucugcuc

SEQ ID NO: 3306771 - RNA, 17 nt, Mycobacterium tuberculosis H37Rv
gcaacgcggucugcucc

SEQ ID NO: 3306772 - RNA, 20 nt, Mycobacterium tuberculosis H37Rv
gcaacgcgguggaccgcucg

SEQ ID NO: 3306773 - RNA, 21 nt, Mycobacterium tuberculosis H37Rv
gcaacgcgguggaccgcucga

SEQ ID NO: 3306774 - RNA, 14 nt, Mycobacterium tuberculosis H37Rv
gcaacgcgucgucg

SEQ ID NO: 3306775 - RNA, 17 nt, Mycobacterium tuberculosis H37Rv
gcaacgcuggcaagucc

SEQ ID NO: 3306776 - RNA, 22 nt, Mycobacterium tuberculosis H37Rv
gcaacggaaucgguuucgaccu

SEQ ID NO: 3306777 - RNA, 17 nt, Mycobacterium tuberculosis H37Rv
gcaacggacgggaucgc

SEQ ID NO: 3306778 - RNA, 20 nt, Mycobacterium tuberculosis H37Rv
gcaacggacgggaucgccca

SEQ ID NO: 3306779 - RNA, 21 nt, Mycobacterium tuberculosis H37Rv
gcaacggauuggugggccagc

SEQ ID NO: 3306780 - RNA, 15 nt, Mycobacterium tuberculosis H37Rv
gcaacggcagcgagg

SEQ ID NO: 3306781 - RNA, 18 nt, Mycobacterium tuberculosis H37Rv
gcaacggccagcgcugcu

SEQ ID NO: 3306782 - RNA, 15 nt, Mycobacterium tuberculosis H37Rv
gcaacggcgcgccga

SEQ ID NO: 3306783 - RNA, 17 nt, Mycobacterium tuberculosis H37Rv
gcaacggcggcguggga

SEQ ID NO: 3306784 - RNA, 13 nt, Mycobacterium tuberculosis H37Rv
gcaacggcggggc

SEQ ID NO: 3306785 - RNA, 14 nt, Mycobacterium tuberculosis H37Rv
gcaacggcggggcc

SEQ ID NO: 3306786 - RNA, 15 nt, Mycobacterium tuberculosis H37Rv
gcaacggcggggccg

SEQ ID NO: 3306787 - RNA, 20 nt, Mycobacterium tuberculosis H37Rv
gcaacggcggggccggcggc

SEQ ID NO: 3306788 - RNA, 14 nt, Mycobacterium tuberculosis H37Rv
gcaacggcguuggc

SEQ ID NO: 3306789 - RNA, 23 nt, Mycobacterium tuberculosis H37Rv
gcaacggguacacccgcucgccc

SEQ ID NO: 3306790 - RNA, 22 nt, Mycobacterium tuberculosis H37Rv
gcaacgggucgaugucggcaau

SEQ ID NO: 3306791 - RNA, 22 nt, Mycobacterium tuberculosis H37Rv
gcaacgggucgguccacuucag

SEQ ID NO: 3306792 - RNA, 20 nt, Mycobacterium tuberculosis H37Rv
gcaacguagccagcagcggc

SEQ ID NO: 3306793 - RNA, 19 nt, Mycobacterium tuberculosis H37Rv
gcaacgucuugcuggucga

SEQ ID NO: 3306794 - RNA, 17 nt, Mycobacterium tuberculosis H37Rv
gcaacgugugcaccauc

SEQ ID NO: 3306795 - RNA, 21 nt, Mycobacterium tuberculosis H37Rv
gcaacgugugcaccaucauca

SEQ ID NO: 3306796 - RNA, 17 nt, Mycobacterium tuberculosis H37Rv
gcaacguguuaaccggg

SEQ ID NO: 3306797 - RNA, 20 nt, Mycobacterium tuberculosis H37Rv
gcaacguguuaaccgggcac

SEQ ID NO: 3306798 - RNA, 21 nt, Mycobacterium tuberculosis H37Rv
gcaacuagccgcugccuggcc

SEQ ID NO: 3306799 - RNA, 23 nt, Mycobacterium tuberculosis H37Rv
gcaacuccggucaacacccgccc

SEQ ID NO: 3306800 - RNA, 16 nt, Mycobacterium tuberculosis H37Rv
gcaacucgaucgccug

SEQ ID NO: 3306801 - RNA, 21 nt, Mycobacterium tuberculosis H37Rv
gcaacucgcauaugccgccgg

SEQ ID NO: 3306802 - RNA, 20 nt, Mycobacterium tuberculosis H37Rv
gcaacucgccgaaaucggcc

SEQ ID NO: 3306803 - RNA, 21 nt, Mycobacterium tuberculosis H37Rv
gcaacucgccgaaaucggcca

SEQ ID NO: 3306804 - RNA, 22 nt, Mycobacterium tuberculosis H37Rv
gcaacucgccgaaaucggccag

SEQ ID NO: 3306805 - RNA, 13 nt, Mycobacterium tuberculosis H37Rv
gcaacucggccac

SEQ ID NO: 3306806 - RNA, 22 nt, Mycobacterium tuberculosis H37Rv
gcaacucggccacggcgucggc

SEQ ID NO: 3306807 - RNA, 16 nt, Mycobacterium tuberculosis H37Rv
gcaacucguccagcag

SEQ ID NO: 3306808 - RNA, 23 nt, Mycobacterium tuberculosis H37Rv
gcaacugcagguucuugaccagc

SEQ ID NO: 3306809 - RNA, 15 nt, Mycobacterium tuberculosis H37Rv
gcaacugcucgacga

SEQ ID NO: 3306810 - RNA, 14 nt, Mycobacterium tuberculosis H37Rv
gcaacugggcggcc

SEQ ID NO: 3306811 - RNA, 16 nt, Mycobacterium tuberculosis H37Rv
gcaacugggcggccug

SEQ ID NO: 3306812 - RNA, 23 nt, Mycobacterium tuberculosis H37Rv
gcaagaaaguuccacgacaaccg

SEQ ID NO: 3306813 - RNA, 16 nt, Mycobacterium tuberculosis H37Rv
gcaagaaucagcagca

SEQ ID NO: 3306814 - RNA, 17 nt, Mycobacterium tuberculosis H37Rv
gcaagaaucagcagcag

SEQ ID NO: 3306815 - RNA, 14 nt, Mycobacterium tuberculosis H37Rv
gcaagaaugccgcc

SEQ ID NO: 3306816 - RNA, 16 nt, Mycobacterium tuberculosis H37Rv
gcaagaaugccgccga

SEQ ID NO: 3306817 - RNA, 18 nt, Mycobacterium tuberculosis H37Rv
gcaagacgcggucgacga

SEQ ID NO: 3306818 - RNA, 15 nt, Mycobacterium tuberculosis H37Rv
gcaagagccgcagcc

SEQ ID NO: 3306819 - RNA, 21 nt, Mycobacterium tuberculosis H37Rv
gcaagaucaccuucgucgcgg

SEQ ID NO: 3306820 - RNA, 21 nt, Mycobacterium tuberculosis H37Rv
gcaagauuauggcgagcgcgc

SEQ ID NO: 3306821 - RNA, 15 nt, Mycobacterium tuberculosis H37Rv
gcaagcacaccgcca

SEQ ID NO: 3306822 - RNA, 15 nt, Mycobacterium tuberculosis H37Rv
gcaagccaaccagcc

SEQ ID NO: 3306823 - RNA, 20 nt, Mycobacterium tuberculosis H37Rv
gcaagccaaccagcccggcc

SEQ ID NO: 3306824 - RNA, 23 nt, Mycobacterium tuberculosis H37Rv
gcaagccacgccggucgcgguca

SEQ ID NO: 3306825 - RNA, 22 nt, Mycobacterium tuberculosis H37Rv
gcaagcccaaaaagaccgccgc

SEQ ID NO: 3306826 - RNA, 15 nt, Mycobacterium tuberculosis H37Rv
gcaagccgaacaccg

SEQ ID NO: 3306827 - RNA, 20 nt, Mycobacterium tuberculosis H37Rv
gcaagccgaacaccgucagc

SEQ ID NO: 3306828 - RNA, 19 nt, Mycobacterium tuberculosis H37Rv
gcaagccggacagaucaac

SEQ ID NO: 3306829 - RNA, 22 nt, Mycobacterium tuberculosis H37Rv
gcaagccguugcacggccggga

SEQ ID NO: 3306830 - RNA, 15 nt, Mycobacterium tuberculosis H37Rv
gcaagcgccgcgcuu

SEQ ID NO: 3306831 - RNA, 16 nt, Mycobacterium tuberculosis H37Rv
gcaagcgccgcgcuug

SEQ ID NO: 3306832 - RNA, 13 nt, Mycobacterium tuberculosis H37Rv
gcaagcgcggcga

SEQ ID NO: 3306833 - RNA, 21 nt, Mycobacterium tuberculosis H37Rv
gcaagcggacccgaccgucgu

SEQ ID NO: 3306834 - RNA, 12 nt, Mycobacterium tuberculosis H37Rv
gcaagcggaugu

SEQ ID NO: 3306835 - RNA, 16 nt, Mycobacterium tuberculosis H37Rv
gcaagcugucgucgcc

SEQ ID NO: 3306836 - RNA, 17 nt, Mycobacterium tuberculosis H37Rv
gcaaggacaagccgcug

SEQ ID NO: 3306837 - RNA, 15 nt, Mycobacterium tuberculosis H37Rv
gcaaggacguggcgc

SEQ ID NO: 3306838 - RNA, 21 nt, Mycobacterium tuberculosis H37Rv
gcaaggcauccaacgcggcgc

SEQ ID NO: 3306839 - RNA, 21 nt, Mycobacterium tuberculosis H37Rv
gcaaggccaaccgggccgccu

SEQ ID NO: 3306840 - RNA, 12 nt, Mycobacterium tuberculosis H37Rv
gcaaggccagca

SEQ ID NO: 3306841 - RNA, 14 nt, Mycobacterium tuberculosis H37Rv
gcaagggccgacgu

SEQ ID NO: 3306842 - RNA, 22 nt, Mycobacterium tuberculosis H37Rv
gcaaggucgcugcuugcgggcu

SEQ ID NO: 3306843 - RNA, 16 nt, Mycobacterium tuberculosis H37Rv
gcaagguugccaacgc

SEQ ID NO: 3306844 - RNA, 21 nt, Mycobacterium tuberculosis H37Rv
gcaagguugccaacgccuuga

SEQ ID NO: 3306845 - RNA, 15 nt, Mycobacterium tuberculosis H37Rv
gcaagucauccaggu

SEQ ID NO: 3306846 - RNA, 17 nt, Mycobacterium tuberculosis H37Rv
gcaaguccggucgcgga

SEQ ID NO: 3306847 - RNA, 18 nt, Mycobacterium tuberculosis H37Rv
gcaaguccugcagcuggc

SEQ ID NO: 3306848 - RNA, 14 nt, Mycobacterium tuberculosis H37Rv
gcaagucgaacgga

SEQ ID NO: 3306849 - RNA, 15 nt, Mycobacterium tuberculosis H37Rv
gcaagucgcccagcc

SEQ ID NO: 3306850 - RNA, 20 nt, Mycobacterium tuberculosis H37Rv
gcaagucgcccagccgagcg

SEQ ID NO: 3306851 - RNA, 18 nt, Mycobacterium tuberculosis H37Rv
gcaagugaauaccccaga

SEQ ID NO: 3306852 - RNA, 17 nt, Mycobacterium tuberculosis H37Rv
gcaagugggugccggca

SEQ ID NO: 3306853 - RNA, 17 nt, Mycobacterium tuberculosis H37Rv
gcaaguuccacgggugg

SEQ ID NO: 3306854 - RNA, 14 nt, Mycobacterium tuberculosis H37Rv
gcacagcggcaucg

SEQ ID NO: 3306855 - RNA, 16 nt, Mycobacterium tuberculosis H37Rv
gcacaggaucacccac

SEQ ID NO: 3306856 - RNA, 18 nt, Mycobacterium tuberculosis H37Rv
gcacaggauuggccgcug

SEQ ID NO: 3306857 - RNA, 14 nt, Mycobacterium tuberculosis H37Rv
gcacaggauuuucu

SEQ ID NO: 3306858 - RNA, 16 nt, Mycobacterium tuberculosis H37Rv
gcacaggcaucguccg

SEQ ID NO: 3306859 - RNA, 21 nt, Mycobacterium tuberculosis H37Rv
gcacaggcauuuucacugugc

SEQ ID NO: 3306860 - RNA, 15 nt, Mycobacterium tuberculosis H37Rv
gcacaggcggccagc

SEQ ID NO: 3306861 - RNA, 15 nt, Mycobacterium tuberculosis H37Rv
gcacaggucagcgcu

SEQ ID NO: 3306862 - RNA, 22 nt, Mycobacterium tuberculosis H37Rv
gcacaggucagcgcugccaccg

SEQ ID NO: 3306863 - RNA, 15 nt, Mycobacterium tuberculosis H37Rv
gcacagugcggcccc

SEQ ID NO: 3306864 - RNA, 19 nt, Mycobacterium tuberculosis H37Rv
gcacaguucgccggaucga

SEQ ID NO: 3306865 - RNA, 20 nt, Mycobacterium tuberculosis H37Rv
gcacauacgauuucgacgac

SEQ ID NO: 3306866 - RNA, 15 nt, Mycobacterium tuberculosis H37Rv
gcacauccugcagcu

SEQ ID NO: 3306867 - RNA, 19 nt, Mycobacterium tuberculosis H37Rv
gcacaucugcgggacgucg

SEQ ID NO: 3306868 - RNA, 20 nt, Mycobacterium tuberculosis H37Rv
gcacaugcucgacgcccgcc

SEQ ID NO: 3306869 - RNA, 22 nt, Mycobacterium tuberculosis H37Rv
gcacaugcucgacgcccgccac

SEQ ID NO: 3306870 - RNA, 21 nt, Mycobacterium tuberculosis H37Rv
gcacauggugggucgacgauc

SEQ ID NO: 3306871 - RNA, 13 nt, Mycobacterium tuberculosis H37Rv
gcacauucagcgc

SEQ ID NO: 3306872 - RNA, 15 nt, Mycobacterium tuberculosis H37Rv
gcacauucagcgccg

SEQ ID NO: 3306873 - RNA, 21 nt, Mycobacterium tuberculosis H37Rv
gcacauucugcagcgucuccu

SEQ ID NO: 3306874 - RNA, 19 nt, Mycobacterium tuberculosis H37Rv
gcacauugaucgacggcca

SEQ ID NO: 3306875 - RNA, 17 nt, Mycobacterium tuberculosis H37Rv
gcacauugguguccacc

SEQ ID NO: 3306876 - RNA, 21 nt, Mycobacterium tuberculosis H37Rv
gcacauugguguccaccaccg

SEQ ID NO: 3306877 - RNA, 22 nt, Mycobacterium tuberculosis H37Rv
gcacauugguguccaccaccgg

SEQ ID NO: 3306878 - RNA, 19 nt, Mycobacterium tuberculosis H37Rv
gcaccaaaugccccgaacc

SEQ ID NO: 3306879 - RNA, 13 nt, Mycobacterium tuberculosis H37Rv
gcaccaacaccag

SEQ ID NO: 3306880 - RNA, 14 nt, Mycobacterium tuberculosis H37Rv
gcaccaacgccacc

SEQ ID NO: 3306881 - RNA, 15 nt, Mycobacterium tuberculosis H37Rv
gcaccaacgccaccg

SEQ ID NO: 3306882 - RNA, 20 nt, Mycobacterium tuberculosis H37Rv
gcaccaacguugugccgcuu

SEQ ID NO: 3306883 - RNA, 19 nt, Mycobacterium tuberculosis H37Rv
gcaccaaggccgugaugcc

SEQ ID NO: 3306884 - RNA, 20 nt, Mycobacterium tuberculosis H37Rv
gcaccaaggccgugaugcca

SEQ ID NO: 3306885 - RNA, 20 nt, Mycobacterium tuberculosis H37Rv
gcaccacaaacaccccacac

SEQ ID NO: 3306886 - RNA, 18 nt, Mycobacterium tuberculosis H37Rv
gcaccacaacgucggcac

SEQ ID NO: 3306887 - RNA, 18 nt, Mycobacterium tuberculosis H37Rv
gcaccacaccacgguggc

SEQ ID NO: 3306888 - RNA, 22 nt, Mycobacterium tuberculosis H37Rv
gcaccacagugaaauccgagcc

SEQ ID NO: 3306889 - RNA, 12 nt, Mycobacterium tuberculosis H37Rv
gcaccacaucgg

SEQ ID NO: 3306890 - RNA, 18 nt, Mycobacterium tuberculosis H37Rv
gcaccacaucggugccac

SEQ ID NO: 3306891 - RNA, 23 nt, Mycobacterium tuberculosis H37Rv
gcaccacauuggcgaucagcagc

SEQ ID NO: 3306892 - RNA, 23 nt, Mycobacterium tuberculosis H37Rv
gcaccaccaagguguggccuugc

SEQ ID NO: 3306893 - RNA, 16 nt, Mycobacterium tuberculosis H37Rv
gcaccaccccgaggcc

SEQ ID NO: 3306894 - RNA, 12 nt, Mycobacterium tuberculosis H37Rv
gcaccacccgau

SEQ ID NO: 3306895 - RNA, 13 nt, Mycobacterium tuberculosis H37Rv
gcaccacccgggc

SEQ ID NO: 3306896 - RNA, 19 nt, Mycobacterium tuberculosis H37Rv
gcaccacccuugccgauga

SEQ ID NO: 3306897 - RNA, 16 nt, Mycobacterium tuberculosis H37Rv
gcaccaccgagccgau

SEQ ID NO: 3306898 - RNA, 14 nt, Mycobacterium tuberculosis H37Rv
gcaccaccggcccc

SEQ ID NO: 3306899 - RNA, 17 nt, Mycobacterium tuberculosis H37Rv
gcaccaccggccccacc

SEQ ID NO: 3306900 - RNA, 18 nt, Mycobacterium tuberculosis H37Rv
gcaccaccggccccaccg

SEQ ID NO: 3306901 - RNA, 13 nt, Mycobacterium tuberculosis H37Rv
gcaccaccggcuc

SEQ ID NO: 3306902 - RNA, 12 nt, Mycobacterium tuberculosis H37Rv
gcaccaccgucu

SEQ ID NO: 3306903 - RNA, 17 nt, Mycobacterium tuberculosis H37Rv
gcaccaccuccccgauc

SEQ ID NO: 3306904 - RNA, 14 nt, Mycobacterium tuberculosis H37Rv
gcaccacgaccgac

SEQ ID NO: 3306905 - RNA, 14 nt, Mycobacterium tuberculosis H37Rv
gcaccacgagcagc

SEQ ID NO: 3306906 - RNA, 15 nt, Mycobacterium tuberculosis H37Rv
gcaccacgagcagcc

SEQ ID NO: 3306907 - RNA, 19 nt, Mycobacterium tuberculosis H37Rv
gcaccacgcugugcucgac

SEQ ID NO: 3306908 - RNA, 14 nt, Mycobacterium tuberculosis H37Rv
gcaccacggccagc

SEQ ID NO: 3306909 - RNA, 15 nt, Mycobacterium tuberculosis H37Rv
gcaccacggccagcg

SEQ ID NO: 3306910 - RNA, 17 nt, Mycobacterium tuberculosis H37Rv
gcaccacggcggccacc

SEQ ID NO: 3306911 - RNA, 22 nt, Mycobacterium tuberculosis H37Rv
gcaccacggcggccaccugcug

SEQ ID NO: 3306912 - RNA, 16 nt, Mycobacterium tuberculosis H37Rv
gcaccacgucgaccaa

SEQ ID NO: 3306913 - RNA, 23 nt, Mycobacterium tuberculosis H37Rv
gcaccacgucgaccaauaccagu

SEQ ID NO: 3306914 - RNA, 21 nt, Mycobacterium tuberculosis H37Rv
gcaccagauagaucgugaucg

SEQ ID NO: 3306915 - RNA, 13 nt, Mycobacterium tuberculosis H37Rv
gcaccagaucagg

SEQ ID NO: 3306916 - RNA, 19 nt, Mycobacterium tuberculosis H37Rv
gcaccagaucgucgggcac

SEQ ID NO: 3306917 - RNA, 18 nt, Mycobacterium tuberculosis H37Rv
gcaccagcacggcaacca

SEQ ID NO: 3306918 - RNA, 20 nt, Mycobacterium tuberculosis H37Rv
gcaccagcauucucgccgac

SEQ ID NO: 3306919 - RNA, 22 nt, Mycobacterium tuberculosis H37Rv
gcaccagcauucucgccgacgg

SEQ ID NO: 3306920 - RNA, 17 nt, Mycobacterium tuberculosis H37Rv
gcaccagcgaauccagc

SEQ ID NO: 3306921 - RNA, 20 nt, Mycobacterium tuberculosis H37Rv
gcaccagcgaauccagccgc

SEQ ID NO: 3306922 - RNA, 23 nt, Mycobacterium tuberculosis H37Rv
gcaccagcgccuugaccagcagc

SEQ ID NO: 3306923 - RNA, 16 nt, Mycobacterium tuberculosis H37Rv
gcaccagcggcugacc

SEQ ID NO: 3306924 - RNA, 12 nt, Mycobacterium tuberculosis H37Rv
gcaccagcgggu

SEQ ID NO: 3306925 - RNA, 20 nt, Mycobacterium tuberculosis H37Rv
gcaccagcgggucggcggug

SEQ ID NO: 3306926 - RNA, 19 nt, Mycobacterium tuberculosis H37Rv
gcaccagcucacccggagc

SEQ ID NO: 3306927 - RNA, 12 nt, Mycobacterium tuberculosis H37Rv
gcaccagcucgg

SEQ ID NO: 3306928 - RNA, 13 nt, Mycobacterium tuberculosis H37Rv
gcaccagcucggu

SEQ ID NO: 3306929 - RNA, 21 nt, Mycobacterium tuberculosis H37Rv
gcaccagcucggugaucacca

SEQ ID NO: 3306930 - RNA, 20 nt, Mycobacterium tuberculosis H37Rv
gcaccagcugucgggcagcu

SEQ ID NO: 3306931 - RNA, 14 nt, Mycobacterium tuberculosis H37Rv
gcaccagggccucg

SEQ ID NO: 3306932 - RNA, 15 nt, Mycobacterium tuberculosis H37Rv
gcaccaggggcgcgu

SEQ ID NO: 3306933 - RNA, 22 nt, Mycobacterium tuberculosis H37Rv
gcaccagguguccccgcccggc

SEQ ID NO: 3306934 - RNA, 20 nt, Mycobacterium tuberculosis H37Rv
gcaccagguugcaaccuugg

SEQ ID NO: 3306935 - RNA, 18 nt, Mycobacterium tuberculosis H37Rv
gcaccagguugccgaggu

SEQ ID NO: 3306936 - RNA, 13 nt, Mycobacterium tuberculosis H37Rv
gcaccaguccagc

SEQ ID NO: 3306937 - RNA, 13 nt, Mycobacterium tuberculosis H37Rv
gcaccagucgccc

SEQ ID NO: 3306938 - RNA, 22 nt, Mycobacterium tuberculosis H37Rv
gcaccaguguggcgaugaccac

SEQ ID NO: 3306939 - RNA, 17 nt, Mycobacterium tuberculosis H37Rv
gcaccauaauggucguc

SEQ ID NO: 3306940 - RNA, 20 nt, Mycobacterium tuberculosis H37Rv
gcaccauccggucccgccgu

SEQ ID NO: 3306941 - RNA, 23 nt, Mycobacterium tuberculosis H37Rv
gcaccaucgguaucgagggcagc

SEQ ID NO: 3306942 - RNA, 23 nt, Mycobacterium tuberculosis H37Rv
gcaccaugggucuggcaggccag

SEQ ID NO: 3306943 - RNA, 16 nt, Mycobacterium tuberculosis H37Rv
gcaccauguacaggcu

SEQ ID NO: 3306944 - RNA, 19 nt, Mycobacterium tuberculosis H37Rv
gcaccauuguuccgucccc

SEQ ID NO: 3306945 - RNA, 12 nt, Mycobacterium tuberculosis H37Rv
gcacccaaccag

SEQ ID NO: 3306946 - RNA, 15 nt, Mycobacterium tuberculosis H37Rv
gcacccaaccaggcc

SEQ ID NO: 3306947 - RNA, 17 nt, Mycobacterium tuberculosis H37Rv
gcacccaaccaggccgc

SEQ ID NO: 3306948 - RNA, 17 nt, Mycobacterium tuberculosis H37Rv
gcacccaacccggcggc

SEQ ID NO: 3306949 - RNA, 15 nt, Mycobacterium tuberculosis H37Rv
gcacccaacuccauc

SEQ ID NO: 3306950 - RNA, 18 nt, Mycobacterium tuberculosis H37Rv
gcaccgaggccgccgaga

SEQ ID NO: 3306951 - RNA, 14 nt, Mycobacterium tuberculosis H37Rv
gcaccgaucaacgg

SEQ ID NO: 3306952 - RNA, 12 nt, Mycobacterium tuberculosis H37Rv
gcaccgaugccg

SEQ ID NO: 3306953 - RNA, 21 nt, Mycobacterium tuberculosis H37Rv
gcaccgaugccgaagcccccg

SEQ ID NO: 3306954 - RNA, 23 nt, Mycobacterium tuberculosis H37Rv
gcaccgaugccgaagcccccgac

SEQ ID NO: 3306955 - RNA, 12 nt, Mycobacterium tuberculosis H37Rv
gcaccgaugccu

SEQ ID NO: 3306956 - RNA, 22 nt, Mycobacterium tuberculosis H37Rv
gcaccgaugccuugaccgcggu

SEQ ID NO: 3306957 - RNA, 18 nt, Mycobacterium tuberculosis H37Rv
gcaccgaugcugacgaug

SEQ ID NO: 3306958 - RNA, 15 nt, Mycobacterium tuberculosis H37Rv
gcaccgauggcgcac

SEQ ID NO: 3306959 - RNA, 21 nt, Mycobacterium tuberculosis H37Rv
gcaccgauggcgcaccggcgu

SEQ ID NO: 3306960 - RNA, 20 nt, Mycobacterium tuberculosis H37Rv
gcaccgauuccagcggaagc

SEQ ID NO: 3306961 - RNA, 18 nt, Mycobacterium tuberculosis H37Rv
gcaccgauuuuggcaagc

SEQ ID NO: 3306962 - RNA, 23 nt, Mycobacterium tuberculosis H37Rv
gcaccgcauaacgcgaacccgcg

SEQ ID NO: 3306963 - RNA, 18 nt, Mycobacterium tuberculosis H37Rv
gcaccgcccccgucggcc

SEQ ID NO: 3306964 - RNA, 20 nt, Mycobacterium tuberculosis H37Rv
gcaccgcccccgucggccuu

SEQ ID NO: 3306965 - RNA, 15 nt, Mycobacterium tuberculosis H37Rv
gcaccgccccgccgu

SEQ ID NO: 3306966 - RNA, 15 nt, Mycobacterium tuberculosis H37Rv
gcaccgccgcaucgu

SEQ ID NO: 3306967 - RNA, 12 nt, Mycobacterium tuberculosis H37Rv
gcaccgccgccc

SEQ ID NO: 3306968 - RNA, 22 nt, Mycobacterium tuberculosis H37Rv
gcaccgccgcccaaaacgucac

SEQ ID NO: 3306969 - RNA, 21 nt, Mycobacterium tuberculosis H37Rv
gcaccgccgcccccgccggcc

SEQ ID NO: 3306970 - RNA, 14 nt, Mycobacterium tuberculosis H37Rv
gcaccgccgcgccg

SEQ ID NO: 3306971 - RNA, 16 nt, Mycobacterium tuberculosis H37Rv
gcaccgccgcgccggc

SEQ ID NO: 3306972 - RNA, 20 nt, Mycobacterium tuberculosis H37Rv
gcaccgccgcgccggcggcc

SEQ ID NO: 3306973 - RNA, 14 nt, Mycobacterium tuberculosis H37Rv
gcaccgccggcgac

SEQ ID NO: 3306974 - RNA, 15 nt, Mycobacterium tuberculosis H37Rv
gcaccgccggcgccc

SEQ ID NO: 3306975 - RNA, 19 nt, Mycobacterium tuberculosis H37Rv
gcaccgccggcgcccaggc

SEQ ID NO: 3306976 - RNA, 20 nt, Mycobacterium tuberculosis H37Rv
gcaccgccggcgcccaggcc

SEQ ID NO: 3306977 - RNA, 23 nt, Mycobacterium tuberculosis H37Rv
gcaccgccggcgcccaggccgau

SEQ ID NO: 3306978 - RNA, 17 nt, Mycobacterium tuberculosis H37Rv
gcaccgccggcgccccc

SEQ ID NO: 3306979 - RNA, 19 nt, Mycobacterium tuberculosis H37Rv
gcaccgccggcgccgccgu

SEQ ID NO: 3306980 - RNA, 17 nt, Mycobacterium tuberculosis H37Rv
gcaccgccggcuccgcc

SEQ ID NO: 3306981 - RNA, 16 nt, Mycobacterium tuberculosis H37Rv
gcaccgccgguggcgc

SEQ ID NO: 3306982 - RNA, 21 nt, Mycobacterium tuberculosis H37Rv
gcaccgccgguggcgccgggg

SEQ ID NO: 3306983 - RNA, 18 nt, Mycobacterium tuberculosis H37Rv
gcaccgccugcgccgccc

SEQ ID NO: 3306984 - RNA, 16 nt, Mycobacterium tuberculosis H37Rv
gcaccgccugcgccuu

SEQ ID NO: 3306985 - RNA, 19 nt, Mycobacterium tuberculosis H37Rv
gcaccgcgaaagaacaucu

SEQ ID NO: 3306986 - RNA, 18 nt, Mycobacterium tuberculosis H37Rv
gcaccgcgaacauggugc

SEQ ID NO: 3306987 - RNA, 13 nt, Mycobacterium tuberculosis H37Rv
gcaccgcgaccgc

SEQ ID NO: 3306988 - RNA, 18 nt, Mycobacterium tuberculosis H37Rv
gcaccgcgacgacgaggu

SEQ ID NO: 3306989 - RNA, 15 nt, Mycobacterium tuberculosis H37Rv
gcaccgcgccgaaca

SEQ ID NO: 3306990 - RNA, 16 nt, Mycobacterium tuberculosis H37Rv
gcaccgcgccgcgccg

SEQ ID NO: 3306991 - RNA, 14 nt, Mycobacterium tuberculosis H37Rv
gcaccgcgccggcg

SEQ ID NO: 3306992 - RNA, 14 nt, Mycobacterium tuberculosis H37Rv
gcaccgcggccagc

SEQ ID NO: 3306993 - RNA, 17 nt, Mycobacterium tuberculosis H37Rv
gcaccgcggccagcacc

SEQ ID NO: 3306994 - RNA, 19 nt, Mycobacterium tuberculosis H37Rv
gcaccgcggccagcgggaa

SEQ ID NO: 3306995 - RNA, 20 nt, Mycobacterium tuberculosis H37Rv
gcaccgcgggaucgguggcg

SEQ ID NO: 3306996 - RNA, 23 nt, Mycobacterium tuberculosis H37Rv
gcaccgcgggaucgguggcggca

SEQ ID NO: 3306997 - RNA, 17 nt, Mycobacterium tuberculosis H37Rv
gcaccgcgguacgccgg

SEQ ID NO: 3306998 - RNA, 18 nt, Mycobacterium tuberculosis H37Rv
gcaccgcgguacgccggu

SEQ ID NO: 3306999 - RNA, 16 nt, Mycobacterium tuberculosis H37Rv
gcaccgcgguagccga

SEQ ID NO: 3307000 - RNA, 22 nt, Mycobacterium tuberculosis H37Rv
gcaccgcgguggggucgacgca

SEQ ID NO: 3307001 - RNA, 17 nt, Mycobacterium tuberculosis H37Rv
gcaccgcucgguccagc

SEQ ID NO: 3307002 - RNA, 18 nt, Mycobacterium tuberculosis H37Rv
gcaccgcucgguccagcc

SEQ ID NO: 3307003 - RNA, 18 nt, Mycobacterium tuberculosis H37Rv
gcaccgcuucaggcgcca

SEQ ID NO: 3307004 - RNA, 21 nt, Mycobacterium tuberculosis H37Rv
gcaccggagaacgggucgacg

SEQ ID NO: 3307005 - RNA, 21 nt, Mycobacterium tuberculosis H37Rv
gcaccggagucgcccgguccg

SEQ ID NO: 3307006 - RNA, 19 nt, Mycobacterium tuberculosis H37Rv
gcaccggagucggcgucga

SEQ ID NO: 3307007 - RNA, 17 nt, Mycobacterium tuberculosis H37Rv
gcaccggauacagccac

SEQ ID NO: 3307008 - RNA, 14 nt, Mycobacterium tuberculosis H37Rv
gcaccggaucgccg

SEQ ID NO: 3307009 - RNA, 20 nt, Mycobacterium tuberculosis H37Rv
gcaccggaucgccgucgcga

SEQ ID NO: 3307010 - RNA, 14 nt, Mycobacterium tuberculosis H37Rv
gcaccggaucggcu

SEQ ID NO: 3307011 - RNA, 19 nt, Mycobacterium tuberculosis H37Rv
gcaccggcacccgcacggc

SEQ ID NO: 3307012 - RNA, 22 nt, Mycobacterium tuberculosis H37Rv
gcaccggcccgaagaucuccuc

SEQ ID NO: 3307013 - RNA, 12 nt, Mycobacterium tuberculosis H37Rv
gcaccggccgcu

SEQ ID NO: 3307014 - RNA, 14 nt, Mycobacterium tuberculosis H37Rv
gcaccggccgggug

SEQ ID NO: 3307015 - RNA, 19 nt, Mycobacterium tuberculosis H37Rv
gcaccggccgugccgccga

SEQ ID NO: 3307016 - RNA, 22 nt, Mycobacterium tuberculosis H37Rv
gcaccggccgugccgccgacac

SEQ ID NO: 3307017 - RNA, 21 nt, Mycobacterium tuberculosis H37Rv
gcaccggcgcaacucgaccac

SEQ ID NO: 3307018 - RNA, 22 nt, Mycobacterium tuberculosis H37Rv
gcaccggcgcgggcacgcccuc

SEQ ID NO: 3307019 - RNA, 16 nt, Mycobacterium tuberculosis H37Rv
gcaccggcggcgccga

SEQ ID NO: 3307020 - RNA, 16 nt, Mycobacterium tuberculosis H37Rv
gcaccggcgucggcgc

SEQ ID NO: 3307021 - RNA, 20 nt, Mycobacterium tuberculosis H37Rv
gcaccggcgucggcgcggcc

SEQ ID NO: 3307022 - RNA, 17 nt, Mycobacterium tuberculosis H37Rv
gcaccggcuggcccagc

SEQ ID NO: 3307023 - RNA, 21 nt, Mycobacterium tuberculosis H37Rv
gcaccggcuugggccaggccc

SEQ ID NO: 3307024 - RNA, 14 nt, Mycobacterium tuberculosis H37Rv
gcaccgggcucaga

SEQ ID NO: 3307025 - RNA, 20 nt, Mycobacterium tuberculosis H37Rv
gcaccggggcugcccgcgga

SEQ ID NO: 3307026 - RNA, 19 nt, Mycobacterium tuberculosis H37Rv
gcaccggggugugcgggcg

SEQ ID NO: 3307027 - RNA, 23 nt, Mycobacterium tuberculosis H37Rv
gcaccggggugugcgggcggugc

SEQ ID NO: 3307028 - RNA, 15 nt, Mycobacterium tuberculosis H37Rv
gcaccgggucaacgc

SEQ ID NO: 3307029 - RNA, 18 nt, Mycobacterium tuberculosis H37Rv
gcaccggguugagccgcc

SEQ ID NO: 3307030 - RNA, 17 nt, Mycobacterium tuberculosis H37Rv
gcaccggugcccaccac

SEQ ID NO: 3307031 - RNA, 17 nt, Mycobacterium tuberculosis H37Rv
gcaccggugcucgucga

SEQ ID NO: 3307032 - RNA, 18 nt, Mycobacterium tuberculosis H37Rv
gcaccgguuugacgucca

SEQ ID NO: 3307033 - RNA, 19 nt, Mycobacterium tuberculosis H37Rv
gcaccgguuugacguccag

SEQ ID NO: 3307034 - RNA, 20 nt, Mycobacterium tuberculosis H37Rv
gcaccgguuugacguccagg

SEQ ID NO: 3307035 - RNA, 18 nt, Mycobacterium tuberculosis H37Rv
gcaccgguuuucgccggc

SEQ ID NO: 3307036 - RNA, 21 nt, Mycobacterium tuberculosis H37Rv
gcaccguagagcaugccgccc

SEQ ID NO: 3307037 - RNA, 23 nt, Mycobacterium tuberculosis H37Rv
gcaccgucagcccgacguugcgu

SEQ ID NO: 3307038 - RNA, 18 nt, Mycobacterium tuberculosis H37Rv
gcaccguccucggucacg

SEQ ID NO: 3307039 - RNA, 14 nt, Mycobacterium tuberculosis H37Rv
gcaccgucggaacu

SEQ ID NO: 3307040 - RNA, 20 nt, Mycobacterium tuberculosis H37Rv
gcaccgucggaacugaccac

SEQ ID NO: 3307041 - RNA, 20 nt, Mycobacterium tuberculosis H37Rv
gcaccgucggcaccagcagc

SEQ ID NO: 3307042 - RNA, 14 nt, Mycobacterium tuberculosis H37Rv
gcaccgucgucacc

SEQ ID NO: 3307043 - RNA, 17 nt, Mycobacterium tuberculosis H37Rv
gcaccgucucgcaccgc

SEQ ID NO: 3307044 - RNA, 15 nt, Mycobacterium tuberculosis H37Rv
gcaccgugccgacgc

SEQ ID NO: 3307045 - RNA, 17 nt, Mycobacterium tuberculosis H37Rv
gcaccgugccgacgccc

SEQ ID NO: 3307046 - RNA, 14 nt, Mycobacterium tuberculosis H37Rv
gcacgcucguuugg

SEQ ID NO: 3307047 - RNA, 14 nt, Mycobacterium tuberculosis H37Rv
gcacgcucugcgcc

SEQ ID NO: 3307048 - RNA, 18 nt, Mycobacterium tuberculosis H37Rv
gcacgcucugcgccacag

SEQ ID NO: 3307049 - RNA, 13 nt, Mycobacterium tuberculosis H37Rv
gcacgcugaccac

SEQ ID NO: 3307050 - RNA, 21 nt, Mycobacterium tuberculosis H37Rv
gcacgcugagcguccgacaac

SEQ ID NO: 3307051 - RNA, 19 nt, Mycobacterium tuberculosis H37Rv
gcacgcugaguccccaggu

SEQ ID NO: 3307052 - RNA, 23 nt, Mycobacterium tuberculosis H37Rv
gcacgcugaguccccaggugggc

SEQ ID NO: 3307053 - RNA, 15 nt, Mycobacterium tuberculosis H37Rv
gcacgcugcugcggg

SEQ ID NO: 3307054 - RNA, 16 nt, Mycobacterium tuberculosis H37Rv
gcacgcuggcgggcac

SEQ ID NO: 3307055 - RNA, 18 nt, Mycobacterium tuberculosis H37Rv
gcacgcuugcggcugccc

SEQ ID NO: 3307056 - RNA, 17 nt, Mycobacterium tuberculosis H37Rv
gcacggaaggcccggcg

SEQ ID NO: 3307057 - RNA, 20 nt, Mycobacterium tuberculosis H37Rv
gcacggaaguacuccaccca

SEQ ID NO: 3307058 - RNA, 17 nt, Mycobacterium tuberculosis H37Rv
gcacggaaucgcaucua

SEQ ID NO: 3307059 - RNA, 23 nt, Mycobacterium tuberculosis H37Rv
gcacggaaucgcaucuagguuca

SEQ ID NO: 3307060 - RNA, 20 nt, Mycobacterium tuberculosis H37Rv
gcacggacaguuccccgggc

SEQ ID NO: 3307061 - RNA, 18 nt, Mycobacterium tuberculosis H37Rv
gcacggaugcgauggccg

SEQ ID NO: 3307062 - RNA, 13 nt, Mycobacterium tuberculosis H37Rv
gcacggaugucgc

SEQ ID NO: 3307063 - RNA, 18 nt, Mycobacterium tuberculosis H37Rv
gcacggcaaccagcgagc

SEQ ID NO: 3307064 - RNA, 13 nt, Mycobacterium tuberculosis H37Rv
gcacggcacccac

SEQ ID NO: 3307065 - RNA, 22 nt, Mycobacterium tuberculosis H37Rv
gcacggccaccgcgcaacccgg

SEQ ID NO: 3307066 - RNA, 14 nt, Mycobacterium tuberculosis H37Rv
gcacggccccugcc

SEQ ID NO: 3307067 - RNA, 18 nt, Mycobacterium tuberculosis H37Rv
gcacggccccugccacga

SEQ ID NO: 3307068 - RNA, 21 nt, Mycobacterium tuberculosis H37Rv
gcacggccccugccacgacga

SEQ ID NO: 3307069 - RNA, 13 nt, Mycobacterium tuberculosis H37Rv
gcacggccgagca

SEQ ID NO: 3307070 - RNA, 17 nt, Mycobacterium tuberculosis H37Rv
gcacggccgcagccgau

SEQ ID NO: 3307071 - RNA, 12 nt, Mycobacterium tuberculosis H37Rv
gcacggccgggu

SEQ ID NO: 3307072 - RNA, 14 nt, Mycobacterium tuberculosis H37Rv
gcacggccgggucg

SEQ ID NO: 3307073 - RNA, 13 nt, Mycobacterium tuberculosis H37Rv
gcacggccgucga

SEQ ID NO: 3307074 - RNA, 17 nt, Mycobacterium tuberculosis H37Rv
gcacggccuccggaccg

SEQ ID NO: 3307075 - RNA, 15 nt, Mycobacterium tuberculosis H37Rv
gcacggcgacgccag

SEQ ID NO: 3307076 - RNA, 18 nt, Mycobacterium tuberculosis H37Rv
gcacggcgacgccagugu

SEQ ID NO: 3307077 - RNA, 16 nt, Mycobacterium tuberculosis H37Rv
gcacggcgaucgguga

SEQ ID NO: 3307078 - RNA, 19 nt, Mycobacterium tuberculosis H37Rv
gcacggcgauugcccgugc

SEQ ID NO: 3307079 - RNA, 14 nt, Mycobacterium tuberculosis H37Rv
gcacggcgccgcca

SEQ ID NO: 3307080 - RNA, 13 nt, Mycobacterium tuberculosis H37Rv
gcacggcgcggcg

SEQ ID NO: 3307081 - RNA, 15 nt, Mycobacterium tuberculosis H37Rv
gcacggcgcggcgga

SEQ ID NO: 3307082 - RNA, 17 nt, Mycobacterium tuberculosis H37Rv
gcacggcgcuaccagcc

SEQ ID NO: 3307083 - RNA, 15 nt, Mycobacterium tuberculosis H37Rv
gcacggcggccacgu

SEQ ID NO: 3307084 - RNA, 12 nt, Mycobacterium tuberculosis H37Rv
gcacggcggugu

SEQ ID NO: 3307085 - RNA, 13 nt, Mycobacterium tuberculosis H37Rv
gcacggcgucggc

SEQ ID NO: 3307086 - RNA, 14 nt, Mycobacterium tuberculosis H37Rv
gcacggcgugucga

SEQ ID NO: 3307087 - RNA, 20 nt, Mycobacterium tuberculosis H37Rv
gcacggcgugucgagggcuu

SEQ ID NO: 3307088 - RNA, 13 nt, Mycobacterium tuberculosis H37Rv
gcacggcuucggc

SEQ ID NO: 3307089 - RNA, 16 nt, Mycobacterium tuberculosis H37Rv
gcacggcuucggcgag

SEQ ID NO: 3307090 - RNA, 18 nt, Mycobacterium tuberculosis H37Rv
gcacggcuucggcgagcg

SEQ ID NO: 3307091 - RNA, 20 nt, Mycobacterium tuberculosis H37Rv
gcacggcuucggcgagcgca

SEQ ID NO: 3307092 - RNA, 18 nt, Mycobacterium tuberculosis H37Rv
gcacggcuugggucuccg

SEQ ID NO: 3307093 - RNA, 20 nt, Mycobacterium tuberculosis H37Rv
gcacggcuuuucgacgcugu

SEQ ID NO: 3307094 - RNA, 19 nt, Mycobacterium tuberculosis H37Rv
gcacgggaaucgcucgcgc

SEQ ID NO: 3307095 - RNA, 15 nt, Mycobacterium tuberculosis H37Rv
gcacgggcacgaucg

SEQ ID NO: 3307096 - RNA, 17 nt, Mycobacterium tuberculosis H37Rv
gcacggggaccgggcug

SEQ ID NO: 3307097 - RNA, 19 nt, Mycobacterium tuberculosis H37Rv
gcacggguagcguccaggu

SEQ ID NO: 3307098 - RNA, 20 nt, Mycobacterium tuberculosis H37Rv
gcacgggucgucaugccagu

SEQ ID NO: 3307099 - RNA, 21 nt, Mycobacterium tuberculosis H37Rv
gcacgggugagcaccacgugc

SEQ ID NO: 3307100 - RNA, 17 nt, Mycobacterium tuberculosis H37Rv
gcacggucaacgauccc

SEQ ID NO: 3307101 - RNA, 18 nt, Mycobacterium tuberculosis H37Rv
gcacgguccacgguggcg

SEQ ID NO: 3307102 - RNA, 23 nt, Mycobacterium tuberculosis H37Rv
gcacggucugggucuuggauccg

SEQ ID NO: 3307103 - RNA, 18 nt, Mycobacterium tuberculosis H37Rv
gcacggugaccacgccgu

SEQ ID NO: 3307104 - RNA, 14 nt, Mycobacterium tuberculosis H37Rv
gcacggugaucagc

SEQ ID NO: 3307105 - RNA, 18 nt, Mycobacterium tuberculosis H37Rv
gcacggugaucagcagca

SEQ ID NO: 3307106 - RNA, 16 nt, Mycobacterium tuberculosis H37Rv
gcacggugcccagggc

SEQ ID NO: 3307107 - RNA, 12 nt, Mycobacterium tuberculosis H37Rv
gcacgguggcaa

SEQ ID NO: 3307108 - RNA, 14 nt, Mycobacterium tuberculosis H37Rv
gcacgguggcaaug

SEQ ID NO: 3307109 - RNA, 20 nt, Mycobacterium tuberculosis H37Rv
gcacgguggcuucgacggcg

SEQ ID NO: 3307110 - RNA, 22 nt, Mycobacterium tuberculosis H37Rv
gcacgguggcuucgacggcggc

SEQ ID NO: 3307111 - RNA, 23 nt, Mycobacterium tuberculosis H37Rv
gcacgguggcuucgacggcggcc

SEQ ID NO: 3307112 - RNA, 19 nt, Mycobacterium tuberculosis H37Rv
gcacggugggcgcuggguc

SEQ ID NO: 3307113 - RNA, 19 nt, Mycobacterium tuberculosis H37Rv
gcacgguguacgcccgcuc

SEQ ID NO: 3307114 - RNA, 20 nt, Mycobacterium tuberculosis H37Rv
gcacgguguugcgcacccgc

SEQ ID NO: 3307115 - RNA, 18 nt, Mycobacterium tuberculosis H37Rv
gcacgguucuuggcgucu

SEQ ID NO: 3307116 - RNA, 22 nt, Mycobacterium tuberculosis H37Rv
gcacgguuguuguagaucugcg

SEQ ID NO: 3307117 - RNA, 15 nt, Mycobacterium tuberculosis H37Rv
gcacguaacgccgcu

SEQ ID NO: 3307118 - RNA, 13 nt, Mycobacterium tuberculosis H37Rv
gcacguacgggca

SEQ ID NO: 3307119 - RNA, 17 nt, Mycobacterium tuberculosis H37Rv
gcacguacucggccagc

SEQ ID NO: 3307120 - RNA, 18 nt, Mycobacterium tuberculosis H37Rv
gcacguacucggccagcu

SEQ ID NO: 3307121 - RNA, 22 nt, Mycobacterium tuberculosis H37Rv
gcacguagaaguaggcggcgac

SEQ ID NO: 3307122 - RNA, 18 nt, Mycobacterium tuberculosis H37Rv
gcacguagacggugucac

SEQ ID NO: 3307123 - RNA, 18 nt, Mycobacterium tuberculosis H37Rv
gcacguauccacggucga

SEQ ID NO: 3307124 - RNA, 16 nt, Mycobacterium tuberculosis H37Rv
gcacgucaacagccag

SEQ ID NO: 3307125 - RNA, 15 nt, Mycobacterium tuberculosis H37Rv
gcacguccgaucggc

SEQ ID NO: 3307126 - RNA, 22 nt, Mycobacterium tuberculosis H37Rv
gcacguccgaucggcgcgccga

SEQ ID NO: 3307127 - RNA, 23 nt, Mycobacterium tuberculosis H37Rv
gcacguccgcggagcucaaccac

SEQ ID NO: 3307128 - RNA, 21 nt, Mycobacterium tuberculosis H37Rv
gcacguccucgacccggcgca

SEQ ID NO: 3307129 - RNA, 16 nt, Mycobacterium tuberculosis H37Rv
gcacgucgaaaucggu

SEQ ID NO: 3307130 - RNA, 14 nt, Mycobacterium tuberculosis H37Rv
gcacgucgaacucg

SEQ ID NO: 3307131 - RNA, 18 nt, Mycobacterium tuberculosis H37Rv
gcacgucgacccccugcc

SEQ ID NO: 3307132 - RNA, 13 nt, Mycobacterium tuberculosis H37Rv
gcacgucgagcag

SEQ ID NO: 3307133 - RNA, 13 nt, Mycobacterium tuberculosis H37Rv
gcacgucgaggcg

SEQ ID NO: 3307134 - RNA, 24 nt, Mycobacterium tuberculosis H37Rv
gcacgucgcggccguggaugucgc

SEQ ID NO: 3307135 - RNA, 23 nt, Mycobacterium tuberculosis H37Rv
gcacgucggcccauaacagcugg

SEQ ID NO: 3307136 - RNA, 15 nt, Mycobacterium tuberculosis H37Rv
gcacgucggcgggcg

SEQ ID NO: 3307137 - RNA, 21 nt, Mycobacterium tuberculosis H37Rv
gcacgucggcgggcgugugca

SEQ ID NO: 3307138 - RNA, 24 nt, Mycobacterium tuberculosis H37Rv
gcacgucugcguccacgugagugc

SEQ ID NO: 3307139 - RNA, 19 nt, Mycobacterium tuberculosis H37Rv
gcacgucuugcugcacgcu

SEQ ID NO: 3307140 - RNA, 18 nt, Mycobacterium tuberculosis H37Rv
gcacgugaaagccgacca

SEQ ID NO: 3307141 - RNA, 20 nt, Mycobacterium tuberculosis H37Rv
gcacgugaugcccugggggu

SEQ ID NO: 3307142 - RNA, 19 nt, Mycobacterium tuberculosis H37Rv
gcagacgcaaaaucgccca

SEQ ID NO: 3307143 - RNA, 19 nt, Mycobacterium tuberculosis H37Rv
gcagacgcaaaaucgcccg

SEQ ID NO: 3307144 - RNA, 19 nt, Mycobacterium tuberculosis H37Rv
gcagacgcagaaucgcaca

SEQ ID NO: 3307145 - RNA, 20 nt, Mycobacterium tuberculosis H37Rv
gcagacgcagaaucgcacgc

SEQ ID NO: 3307146 - RNA, 20 nt, Mycobacterium tuberculosis H37Rv
gcagacgcagaaucgcauga

SEQ ID NO: 3307147 - RNA, 20 nt, Mycobacterium tuberculosis H37Rv
gcagacgcagaaucgcauug

SEQ ID NO: 3307148 - RNA, 21 nt, Mycobacterium tuberculosis H37Rv
gcagacgcagagucgcacugc

SEQ ID NO: 3307149 - RNA, 17 nt, Mycobacterium tuberculosis H37Rv
gcagacgccgacuccgc

SEQ ID NO: 3307150 - RNA, 14 nt, Mycobacterium tuberculosis H37Rv
gcagacgccgcguu

SEQ ID NO: 3307151 - RNA, 18 nt, Mycobacterium tuberculosis H37Rv
gcagacgcguuucgucga

SEQ ID NO: 3307152 - RNA, 15 nt, Mycobacterium tuberculosis H37Rv
gcagacggcugccac

SEQ ID NO: 3307153 - RNA, 16 nt, Mycobacterium tuberculosis H37Rv
gcagacggcugccacg

SEQ ID NO: 3307154 - RNA, 15 nt, Mycobacterium tuberculosis H37Rv
gcagacgucaugcgg

SEQ ID NO: 3307155 - RNA, 19 nt, Mycobacterium tuberculosis H37Rv
gcagacgugguagccggcg

SEQ ID NO: 3307156 - RNA, 21 nt, Mycobacterium tuberculosis H37Rv
gcagacgugguagccggcgac

SEQ ID NO: 3307157 - RNA, 21 nt, Mycobacterium tuberculosis H37Rv
gcagacucgauaugcagcucg

SEQ ID NO: 3307158 - RNA, 13 nt, Mycobacterium tuberculosis H37Rv
gcagacucgccac

SEQ ID NO: 3307159 - RNA, 15 nt, Mycobacterium tuberculosis H37Rv
gcagacucgccaccg

SEQ ID NO: 3307160 - RNA, 19 nt, Mycobacterium tuberculosis H37Rv
gcagacucgccaccgcggc

SEQ ID NO: 3307161 - RNA, 12 nt, Mycobacterium tuberculosis H37Rv
gcagacugccga

SEQ ID NO: 3307162 - RNA, 13 nt, Mycobacterium tuberculosis H37Rv
gcagagaccaagg

SEQ ID NO: 3307163 - RNA, 17 nt, Mycobacterium tuberculosis H37Rv
gcagagcacgcgcggcg

SEQ ID NO: 3307164 - RNA, 17 nt, Mycobacterium tuberculosis H37Rv
gcagagccaacgcgcga

SEQ ID NO: 3307165 - RNA, 18 nt, Mycobacterium tuberculosis H37Rv
gcagagccccggcaagcg

SEQ ID NO: 3307166 - RNA, 16 nt, Mycobacterium tuberculosis H37Rv
gcagagucaacagaua

SEQ ID NO: 3307167 - RNA, 21 nt, Mycobacterium tuberculosis H37Rv
gcagagucgcacugcgccggc

SEQ ID NO: 3307168 - RNA, 15 nt, Mycobacterium tuberculosis H37Rv
gcagaguucccugau

SEQ ID NO: 3307169 - RNA, 16 nt, Mycobacterium tuberculosis H37Rv
gcagauacucggcgac

SEQ ID NO: 3307170 - RNA, 19 nt, Mycobacterium tuberculosis H37Rv
gcagauaugacggcagacc

SEQ ID NO: 3307171 - RNA, 19 nt, Mycobacterium tuberculosis H37Rv
gcagauauugccugccacc

SEQ ID NO: 3307172 - RNA, 20 nt, Mycobacterium tuberculosis H37Rv
gcagaucgaaaucagcccgc

SEQ ID NO: 3307173 - RNA, 14 nt, Mycobacterium tuberculosis H37Rv
gcagaucgauaccg

SEQ ID NO: 3307174 - RNA, 19 nt, Mycobacterium tuberculosis H37Rv
gcagaucgccccagccaug

SEQ ID NO: 3307175 - RNA, 18 nt, Mycobacterium tuberculosis H37Rv
gcagaucggccggauacg

SEQ ID NO: 3307176 - RNA, 23 nt, Mycobacterium tuberculosis H37Rv
gcagaucguggggaccucggcgc

SEQ ID NO: 3307177 - RNA, 18 nt, Mycobacterium tuberculosis H37Rv
gcagaucuuccgagcacu

SEQ ID NO: 3307178 - RNA, 14 nt, Mycobacterium tuberculosis H37Rv
gcagaugagcgcgg

SEQ ID NO: 3307179 - RNA, 19 nt, Mycobacterium tuberculosis H37Rv
gcagaugaugccguucgga

SEQ ID NO: 3307180 - RNA, 20 nt, Mycobacterium tuberculosis H37Rv
gcagauggcauugcgcccac

SEQ ID NO: 3307181 - RNA, 13 nt, Mycobacterium tuberculosis H37Rv
gcagaugggccuc

SEQ ID NO: 3307182 - RNA, 14 nt, Mycobacterium tuberculosis H37Rv
gcagauggugaacg

SEQ ID NO: 3307183 - RNA, 23 nt, Mycobacterium tuberculosis H37Rv
gcagauggugaacgugccuuccu

SEQ ID NO: 3307184 - RNA, 13 nt, Mycobacterium tuberculosis H37Rv
gcagauggugguc

SEQ ID NO: 3307185 - RNA, 15 nt, Mycobacterium tuberculosis H37Rv
gcagauuccucuuca

SEQ ID NO: 3307186 - RNA, 17 nt, Mycobacterium tuberculosis H37Rv
gcagcaaaaaccagcgu

SEQ ID NO: 3307187 - RNA, 20 nt, Mycobacterium tuberculosis H37Rv
gcagcaaaacccgagccugg

SEQ ID NO: 3307188 - RNA, 23 nt, Mycobacterium tuberculosis H37Rv
gcagcaacaucuugccgucggcc

SEQ ID NO: 3307189 - RNA, 14 nt, Mycobacterium tuberculosis H37Rv
gcagcaacgacccg

SEQ ID NO: 3307190 - RNA, 22 nt, Mycobacterium tuberculosis H37Rv
gcagcaacgacccgaagccgac

SEQ ID NO: 3307191 - RNA, 14 nt, Mycobacterium tuberculosis H37Rv
gcagcaacgacguc

SEQ ID NO: 3307192 - RNA, 18 nt, Mycobacterium tuberculosis H37Rv
gcagcaacgacgucgucg

SEQ ID NO: 3307193 - RNA, 18 nt, Mycobacterium tuberculosis H37Rv
gcagcaacgcggugccgg

SEQ ID NO: 3307194 - RNA, 21 nt, Mycobacterium tuberculosis H37Rv
gcagcaacggcggcgucgcgg

SEQ ID NO: 3307195 - RNA, 16 nt, Mycobacterium tuberculosis H37Rv
gcagcaacugggcggc

SEQ ID NO: 3307196 - RNA, 13 nt, Mycobacterium tuberculosis H37Rv
gcagcaagccgcc

SEQ ID NO: 3307197 - RNA, 14 nt, Mycobacterium tuberculosis H37Rv
gcagcaagccgccg

SEQ ID NO: 3307198 - RNA, 21 nt, Mycobacterium tuberculosis H37Rv
gcagcaauccaaggcucagca

SEQ ID NO: 3307199 - RNA, 17 nt, Mycobacterium tuberculosis H37Rv
gcagcacauccugcagc

SEQ ID NO: 3307200 - RNA, 23 nt, Mycobacterium tuberculosis H37Rv
gcagcacauccugcagcucgggc

SEQ ID NO: 3307201 - RNA, 15 nt, Mycobacterium tuberculosis H37Rv
gcagcaccaaggucu

SEQ ID NO: 3307202 - RNA, 21 nt, Mycobacterium tuberculosis H37Rv
gcagcaccagcgccuugacca

SEQ ID NO: 3307203 - RNA, 16 nt, Mycobacterium tuberculosis H37Rv
gcagcacccccucggc

SEQ ID NO: 3307204 - RNA, 13 nt, Mycobacterium tuberculosis H37Rv
gcagcacccgcgc

SEQ ID NO: 3307205 - RNA, 17 nt, Mycobacterium tuberculosis H37Rv
gcagcacccgcgccagu

SEQ ID NO: 3307206 - RNA, 18 nt, Mycobacterium tuberculosis H37Rv
gcagcaccgcugcggcca

SEQ ID NO: 3307207 - RNA, 15 nt, Mycobacterium tuberculosis H37Rv
gcagcaccggcucga

SEQ ID NO: 3307208 - RNA, 13 nt, Mycobacterium tuberculosis H37Rv
gcagcaccgguca

SEQ ID NO: 3307209 - RNA, 18 nt, Mycobacterium tuberculosis H37Rv
gcagcaccggugaccucg

SEQ ID NO: 3307210 - RNA, 13 nt, Mycobacterium tuberculosis H37Rv
gcagcaccgucgg

SEQ ID NO: 3307211 - RNA, 20 nt, Mycobacterium tuberculosis H37Rv
gcagcaccgucgggcccagc

SEQ ID NO: 3307212 - RNA, 15 nt, Mycobacterium tuberculosis H37Rv
gcagcaccucgucga

SEQ ID NO: 3307213 - RNA, 14 nt, Mycobacterium tuberculosis H37Rv
gcagcacgauccag

SEQ ID NO: 3307214 - RNA, 16 nt, Mycobacterium tuberculosis H37Rv
gcagcacgauccagcu

SEQ ID NO: 3307215 - RNA, 17 nt, Mycobacterium tuberculosis H37Rv
gcagcacggcggccacg

SEQ ID NO: 3307216 - RNA, 19 nt, Mycobacterium tuberculosis H37Rv
gcagcacggcuucgaccau

SEQ ID NO: 3307217 - RNA, 21 nt, Mycobacterium tuberculosis H37Rv
gcagcacgggugagcaccacg

SEQ ID NO: 3307218 - RNA, 15 nt, Mycobacterium tuberculosis H37Rv
gcagcacgucaaccu

SEQ ID NO: 3307219 - RNA, 17 nt, Mycobacterium tuberculosis H37Rv
gcagcacgucaaccucg

SEQ ID NO: 3307220 - RNA, 14 nt, Mycobacterium tuberculosis H37Rv
gcagcacgucgaac

SEQ ID NO: 3307221 - RNA, 17 nt, Mycobacterium tuberculosis H37Rv
gcagcacgucgaacucg

SEQ ID NO: 3307222 - RNA, 17 nt, Mycobacterium tuberculosis H37Rv
gcagcacgucugcgucc

SEQ ID NO: 3307223 - RNA, 23 nt, Mycobacterium tuberculosis H37Rv
gcagcacucgcccaagcgcagcc

SEQ ID NO: 3307224 - RNA, 16 nt, Mycobacterium tuberculosis H37Rv
gcagcacugcggcagc

SEQ ID NO: 3307225 - RNA, 20 nt, Mycobacterium tuberculosis H37Rv
gcagcacuuccaagccgacc

SEQ ID NO: 3307226 - RNA, 16 nt, Mycobacterium tuberculosis H37Rv
gcagcagaaacggcga

SEQ ID NO: 3307227 - RNA, 17 nt, Mycobacterium tuberculosis H37Rv
gcagcagaaacggcgac

SEQ ID NO: 3307228 - RNA, 18 nt, Mycobacterium tuberculosis H37Rv
gcagcagacccgguggcg

SEQ ID NO: 3307229 - RNA, 20 nt, Mycobacterium tuberculosis H37Rv
gcagcagacgacgaucagcc

SEQ ID NO: 3307230 - RNA, 22 nt, Mycobacterium tuberculosis H37Rv
gcagcagacgacgaucagcccc

SEQ ID NO: 3307231 - RNA, 21 nt, Mycobacterium tuberculosis H37Rv
gcagcagaugcgaaaguggug

SEQ ID NO: 3307232 - RNA, 13 nt, Mycobacterium tuberculosis H37Rv
gcagcagccggcg

SEQ ID NO: 3307233 - RNA, 19 nt, Mycobacterium tuberculosis H37Rv
gcagcagcgccgcguggcu

SEQ ID NO: 3307234 - RNA, 16 nt, Mycobacterium tuberculosis H37Rv
gcagcagcgcgcggau

SEQ ID NO: 3307235 - RNA, 12 nt, Mycobacterium tuberculosis H37Rv
gcagcagcggca

SEQ ID NO: 3307236 - RNA, 13 nt, Mycobacterium tuberculosis H37Rv
gcagcagcgggcg

SEQ ID NO: 3307237 - RNA, 17 nt, Mycobacterium tuberculosis H37Rv
gcagcagcgggcgcgcu

SEQ ID NO: 3307238 - RNA, 17 nt, Mycobacterium tuberculosis H37Rv
gcagccgguccagcgcc

SEQ ID NO: 3307239 - RNA, 13 nt, Mycobacterium tuberculosis H37Rv
gcagccugcagcg

SEQ ID NO: 3307240 - RNA, 13 nt, Mycobacterium tuberculosis H37Rv
gcagccugcugca

SEQ ID NO: 3307241 - RNA, 14 nt, Mycobacterium tuberculosis H37Rv
gcagccugcugcac

SEQ ID NO: 3307242 - RNA, 20 nt, Mycobacterium tuberculosis H37Rv
gcagcgaaaaccgucgcaga

SEQ ID NO: 3307243 - RNA, 20 nt, Mycobacterium tuberculosis H37Rv
gcagcgaaacaccggccagc

SEQ ID NO: 3307244 - RNA, 20 nt, Mycobacterium tuberculosis H37Rv
gcagcgaaagcgucgagcug

SEQ ID NO: 3307245 - RNA, 15 nt, Mycobacterium tuberculosis H37Rv
gcagcgaagccgggu

SEQ ID NO: 3307246 - RNA, 15 nt, Mycobacterium tuberculosis H37Rv
gcagcgacacguugg

SEQ ID NO: 3307247 - RNA, 12 nt, Mycobacterium tuberculosis H37Rv
gcagcgaccagc

SEQ ID NO: 3307248 - RNA, 14 nt, Mycobacterium tuberculosis H37Rv
gcagcgaccgucgu

SEQ ID NO: 3307249 - RNA, 16 nt, Mycobacterium tuberculosis H37Rv
gcagcgaccgucgucc

SEQ ID NO: 3307250 - RNA, 20 nt, Mycobacterium tuberculosis H37Rv
gcagcgaccgucguccagac

SEQ ID NO: 3307251 - RNA, 16 nt, Mycobacterium tuberculosis H37Rv
gcagcgacgacgccca

SEQ ID NO: 3307252 - RNA, 13 nt, Mycobacterium tuberculosis H37Rv
gcagcgacgcgau

SEQ ID NO: 3307253 - RNA, 16 nt, Mycobacterium tuberculosis H37Rv
gcagcgacgcugccgc

SEQ ID NO: 3307254 - RNA, 15 nt, Mycobacterium tuberculosis H37Rv
gcagcgacggucagg

SEQ ID NO: 3307255 - RNA, 22 nt, Mycobacterium tuberculosis H37Rv
gcagcgagaccucucugcgcca

SEQ ID NO: 3307256 - RNA, 23 nt, Mycobacterium tuberculosis H37Rv
gcagcgagacuucgacgcggcga

SEQ ID NO: 3307257 - RNA, 15 nt, Mycobacterium tuberculosis H37Rv
gcagcgaguggccga

SEQ ID NO: 3307258 - RNA, 21 nt, Mycobacterium tuberculosis H37Rv
gcagcgaucuugguggccuca

SEQ ID NO: 3307259 - RNA, 15 nt, Mycobacterium tuberculosis H37Rv
gcagcgaugacgacc

SEQ ID NO: 3307260 - RNA, 17 nt, Mycobacterium tuberculosis H37Rv
gcagcgcaaacaucuug

SEQ ID NO: 3307261 - RNA, 19 nt, Mycobacterium tuberculosis H37Rv
gcagcgcaaacaucuuguc

SEQ ID NO: 3307262 - RNA, 15 nt, Mycobacterium tuberculosis H37Rv
gcagcgcaacaucga

SEQ ID NO: 3307263 - RNA, 17 nt, Mycobacterium tuberculosis H37Rv
gcagcgcaaugcaucgc

SEQ ID NO: 3307264 - RNA, 23 nt, Mycobacterium tuberculosis H37Rv
gcagcgcaaugcaucgcggcggc

SEQ ID NO: 3307265 - RNA, 21 nt, Mycobacterium tuberculosis H37Rv
gcagcgcacugcccggggugc

SEQ ID NO: 3307266 - RNA, 23 nt, Mycobacterium tuberculosis H37Rv
gcagcgcacugcccggggugcug

SEQ ID NO: 3307267 - RNA, 19 nt, Mycobacterium tuberculosis H37Rv
gcagcgccacccgcgucag

SEQ ID NO: 3307268 - RNA, 18 nt, Mycobacterium tuberculosis H37Rv
gcagcgccaccgaccgag

SEQ ID NO: 3307269 - RNA, 14 nt, Mycobacterium tuberculosis H37Rv
gcagcgccagcagc

SEQ ID NO: 3307270 - RNA, 21 nt, Mycobacterium tuberculosis H37Rv
gcagcgccaucaucuuggcgc

SEQ ID NO: 3307271 - RNA, 16 nt, Mycobacterium tuberculosis H37Rv
gcagcgcccccgcugc

SEQ ID NO: 3307272 - RNA, 20 nt, Mycobacterium tuberculosis H37Rv
gcagcgcccuuggacgcgau

SEQ ID NO: 3307273 - RNA, 22 nt, Mycobacterium tuberculosis H37Rv
gcagcgcccuuggacgcgauga

SEQ ID NO: 3307274 - RNA, 14 nt, Mycobacterium tuberculosis H37Rv
gcagcgccgacagc

SEQ ID NO: 3307275 - RNA, 13 nt, Mycobacterium tuberculosis H37Rv
gcagcgccgcgcg

SEQ ID NO: 3307276 - RNA, 17 nt, Mycobacterium tuberculosis H37Rv
gcagcgccgcguucagg

SEQ ID NO: 3307277 - RNA, 18 nt, Mycobacterium tuberculosis H37Rv
gcagcgccggcaccgaca

SEQ ID NO: 3307278 - RNA, 20 nt, Mycobacterium tuberculosis H37Rv
gcagcgccggcgggcucggu

SEQ ID NO: 3307279 - RNA, 22 nt, Mycobacterium tuberculosis H37Rv
gcagcgccggcgggcucggucc

SEQ ID NO: 3307280 - RNA, 14 nt, Mycobacterium tuberculosis H37Rv
gcagcgccgucagc

SEQ ID NO: 3307281 - RNA, 15 nt, Mycobacterium tuberculosis H37Rv
gcagcgccuaccagc

SEQ ID NO: 3307282 - RNA, 18 nt, Mycobacterium tuberculosis H37Rv
gcagcgccuaccagcacc

SEQ ID NO: 3307283 - RNA, 23 nt, Mycobacterium tuberculosis H37Rv
gcagcgccuaccagcaccgggau

SEQ ID NO: 3307284 - RNA, 21 nt, Mycobacterium tuberculosis H37Rv
gcagcgccucauccuccaguu

SEQ ID NO: 3307285 - RNA, 16 nt, Mycobacterium tuberculosis H37Rv
gcagcgccucgauccg

SEQ ID NO: 3307286 - RNA, 21 nt, Mycobacterium tuberculosis H37Rv
gcagcgccucgauccgcauca

SEQ ID NO: 3307287 - RNA, 14 nt, Mycobacterium tuberculosis H37Rv
gcagcgccugcggc

SEQ ID NO: 3307288 - RNA, 18 nt, Mycobacterium tuberculosis H37Rv
gcagcgccugcggcagca

SEQ ID NO: 3307289 - RNA, 22 nt, Mycobacterium tuberculosis H37Rv
gcagcgcgacccguagcuuggc

SEQ ID NO: 3307290 - RNA, 14 nt, Mycobacterium tuberculosis H37Rv
gcagcgcgacgguu

SEQ ID NO: 3307291 - RNA, 16 nt, Mycobacterium tuberculosis H37Rv
gcagcgcgaucaccga

SEQ ID NO: 3307292 - RNA, 14 nt, Mycobacterium tuberculosis H37Rv
gcagcgcgaucugc

SEQ ID NO: 3307293 - RNA, 18 nt, Mycobacterium tuberculosis H37Rv
gcagcgcgcccgacaccc

SEQ ID NO: 3307294 - RNA, 19 nt, Mycobacterium tuberculosis H37Rv
gcagcgcgcccgacacccg

SEQ ID NO: 3307295 - RNA, 15 nt, Mycobacterium tuberculosis H37Rv
gcagcgcgcggaugg

SEQ ID NO: 3307296 - RNA, 21 nt, Mycobacterium tuberculosis H37Rv
gcagcgcggaugucggcaucg

SEQ ID NO: 3307297 - RNA, 16 nt, Mycobacterium tuberculosis H37Rv
gcagcgcggauucggu

SEQ ID NO: 3307298 - RNA, 14 nt, Mycobacterium tuberculosis H37Rv
gcagcgcgggaucu

SEQ ID NO: 3307299 - RNA, 15 nt, Mycobacterium tuberculosis H37Rv
gcagcgcgggaucug

SEQ ID NO: 3307300 - RNA, 15 nt, Mycobacterium tuberculosis H37Rv
gcagcgcucguuccg

SEQ ID NO: 3307301 - RNA, 14 nt, Mycobacterium tuberculosis H37Rv
gcagcgcuggcuac

SEQ ID NO: 3307302 - RNA, 22 nt, Mycobacterium tuberculosis H37Rv
gcagcgcuggcuacgccuccuu

SEQ ID NO: 3307303 - RNA, 20 nt, Mycobacterium tuberculosis H37Rv
gcagcggaccgcugccugcc

SEQ ID NO: 3307304 - RNA, 23 nt, Mycobacterium tuberculosis H37Rv
gcagcggaccgcugccugccgcg

SEQ ID NO: 3307305 - RNA, 23 nt, Mycobacterium tuberculosis H37Rv
gcagcggcaaggucaacgggagg

SEQ ID NO: 3307306 - RNA, 17 nt, Mycobacterium tuberculosis H37Rv
gcagcggcacgucggcg

SEQ ID NO: 3307307 - RNA, 15 nt, Mycobacterium tuberculosis H37Rv
gcagcggcauccagc

SEQ ID NO: 3307308 - RNA, 17 nt, Mycobacterium tuberculosis H37Rv
gcagcggcauccagcuu

SEQ ID NO: 3307309 - RNA, 23 nt, Mycobacterium tuberculosis H37Rv
gcagcggccagcccagccgggag

SEQ ID NO: 3307310 - RNA, 17 nt, Mycobacterium tuberculosis H37Rv
gcagcggcgaccgcggu

SEQ ID NO: 3307311 - RNA, 20 nt, Mycobacterium tuberculosis H37Rv
gcagcggcgaccgcggucgc

SEQ ID NO: 3307312 - RNA, 22 nt, Mycobacterium tuberculosis H37Rv
gcagcggcgaccgcggucgcca

SEQ ID NO: 3307313 - RNA, 16 nt, Mycobacterium tuberculosis H37Rv
gcagcggcgcgcugca

SEQ ID NO: 3307314 - RNA, 11 nt, Mycobacterium tuberculosis H37Rv
gcagcggcgga

SEQ ID NO: 3307315 - RNA, 23 nt, Mycobacterium tuberculosis H37Rv
gcagcggcggaaggacggcagcc

SEQ ID NO: 3307316 - RNA, 18 nt, Mycobacterium tuberculosis H37Rv
gcagcggcgggcgaugac

SEQ ID NO: 3307317 - RNA, 22 nt, Mycobacterium tuberculosis H37Rv
gcagcgggaucaugaccaucga

SEQ ID NO: 3307318 - RNA, 19 nt, Mycobacterium tuberculosis H37Rv
gcagcgggccacugagcca

SEQ ID NO: 3307319 - RNA, 23 nt, Mycobacterium tuberculosis H37Rv
gcagcgggcuccccggauuccuc

SEQ ID NO: 3307320 - RNA, 17 nt, Mycobacterium tuberculosis H37Rv
gcagcggguccgucagc

SEQ ID NO: 3307321 - RNA, 18 nt, Mycobacterium tuberculosis H37Rv
gcagcggguggugccagg

SEQ ID NO: 3307322 - RNA, 23 nt, Mycobacterium tuberculosis H37Rv
gcagcggguggugccaggucggc

SEQ ID NO: 3307323 - RNA, 15 nt, Mycobacterium tuberculosis H37Rv
gcagcgguccagaca

SEQ ID NO: 3307324 - RNA, 14 nt, Mycobacterium tuberculosis H37Rv
gcagcggugcagcc

SEQ ID NO: 3307325 - RNA, 17 nt, Mycobacterium tuberculosis H37Rv
gcagcggugcagcccgc

SEQ ID NO: 3307326 - RNA, 19 nt, Mycobacterium tuberculosis H37Rv
gcagcgguggcccgccggc

SEQ ID NO: 3307327 - RNA, 15 nt, Mycobacterium tuberculosis H37Rv
gcagcgguggucggc

SEQ ID NO: 3307328 - RNA, 20 nt, Mycobacterium tuberculosis H37Rv
gcagcgguuuuaggcagccc

SEQ ID NO: 3307329 - RNA, 12 nt, Mycobacterium tuberculosis H37Rv
gcagcguccagc

SEQ ID NO: 3307330 - RNA, 20 nt, Mycobacterium tuberculosis H37Rv
gcagcguccgaaccaccugu

SEQ ID NO: 3307331 - RNA, 21 nt, Mycobacterium tuberculosis H37Rv
gcagcgucggugccaccacgc

SEQ ID NO: 3307332 - RNA, 15 nt, Mycobacterium tuberculosis H37Rv
gcagcgucgucuagc

SEQ ID NO: 3307333 - RNA, 13 nt, Mycobacterium tuberculosis H37Rv
gcagcgucuccuu

SEQ ID NO: 3307334 - RNA, 21 nt, Mycobacterium tuberculosis H37Rv
gcaggccuccucuugggucca

SEQ ID NO: 3307335 - RNA, 14 nt, Mycobacterium tuberculosis H37Rv
gcaggccucggcgc

SEQ ID NO: 3307336 - RNA, 20 nt, Mycobacterium tuberculosis H37Rv
gcaggccuuuuggcgaaccg

SEQ ID NO: 3307337 - RNA, 14 nt, Mycobacterium tuberculosis H37Rv
gcaggcgagcaguc

SEQ ID NO: 3307338 - RNA, 12 nt, Mycobacterium tuberculosis H37Rv
gcaggcgaguga

SEQ ID NO: 3307339 - RNA, 19 nt, Mycobacterium tuberculosis H37Rv
gcaggcgaguuaggccgcc

SEQ ID NO: 3307340 - RNA, 22 nt, Mycobacterium tuberculosis H37Rv
gcaggcgaguuaggccgccagc

SEQ ID NO: 3307341 - RNA, 23 nt, Mycobacterium tuberculosis H37Rv
gcaggcgaguuaggccgccagcc

SEQ ID NO: 3307342 - RNA, 15 nt, Mycobacterium tuberculosis H37Rv
gcaggcgcaccaggc

SEQ ID NO: 3307343 - RNA, 16 nt, Mycobacterium tuberculosis H37Rv
gcaggcgcagcugggu

SEQ ID NO: 3307344 - RNA, 17 nt, Mycobacterium tuberculosis H37Rv
gcaggcggccagcgaac

SEQ ID NO: 3307345 - RNA, 15 nt, Mycobacterium tuberculosis H37Rv
gcaggcggccgccgg

SEQ ID NO: 3307346 - RNA, 21 nt, Mycobacterium tuberculosis H37Rv
gcaggcgggaacgaucgauga

SEQ ID NO: 3307347 - RNA, 19 nt, Mycobacterium tuberculosis H37Rv
gcaggcgggggaucggugg

SEQ ID NO: 3307348 - RNA, 20 nt, Mycobacterium tuberculosis H37Rv
gcaggcgucccagccgauca

SEQ ID NO: 3307349 - RNA, 21 nt, Mycobacterium tuberculosis H37Rv
gcaggcgucccagccgaucac

SEQ ID NO: 3307350 - RNA, 21 nt, Mycobacterium tuberculosis H37Rv
gcaggcgugcuugaccgccug

SEQ ID NO: 3307351 - RNA, 23 nt, Mycobacterium tuberculosis H37Rv
gcaggcgugcuugaccgccugga

SEQ ID NO: 3307352 - RNA, 12 nt, Mycobacterium tuberculosis H37Rv
gcaggcugucga

SEQ ID NO: 3307353 - RNA, 22 nt, Mycobacterium tuberculosis H37Rv
gcaggcugucgagucgguccug

SEQ ID NO: 3307354 - RNA, 20 nt, Mycobacterium tuberculosis H37Rv
gcaggcuuccagccacagcc

SEQ ID NO: 3307355 - RNA, 22 nt, Mycobacterium tuberculosis H37Rv
gcaggcuucugggguuggcucg

SEQ ID NO: 3307356 - RNA, 17 nt, Mycobacterium tuberculosis H37Rv
gcaggcuuucauugaca

SEQ ID NO: 3307357 - RNA, 21 nt, Mycobacterium tuberculosis H37Rv
gcaggcuuucauugacacugu

SEQ ID NO: 3307358 - RNA, 14 nt, Mycobacterium tuberculosis H37Rv
gcagggaucacccc

SEQ ID NO: 3307359 - RNA, 16 nt, Mycobacterium tuberculosis H37Rv
gcagggaucaccccgg

SEQ ID NO: 3307360 - RNA, 22 nt, Mycobacterium tuberculosis H37Rv
gcagggaucaccccggccggcu

SEQ ID NO: 3307361 - RNA, 14 nt, Mycobacterium tuberculosis H37Rv
gcagggcagcccgg

SEQ ID NO: 3307362 - RNA, 19 nt, Mycobacterium tuberculosis H37Rv
gcagggcauugcggcccgc

SEQ ID NO: 3307363 - RNA, 14 nt, Mycobacterium tuberculosis H37Rv
gcagggccagcggc

SEQ ID NO: 3307364 - RNA, 15 nt, Mycobacterium tuberculosis H37Rv
gcagggccggcaccg

SEQ ID NO: 3307365 - RNA, 20 nt, Mycobacterium tuberculosis H37Rv
gcagggccggcaccgcagcg

SEQ ID NO: 3307366 - RNA, 18 nt, Mycobacterium tuberculosis H37Rv
gcagggccucggucgcca

SEQ ID NO: 3307367 - RNA, 20 nt, Mycobacterium tuberculosis H37Rv
gcagggccucggucgccaug

SEQ ID NO: 3307368 - RNA, 21 nt, Mycobacterium tuberculosis H37Rv
gcagggccucggucgccaugu

SEQ ID NO: 3307369 - RNA, 15 nt, Mycobacterium tuberculosis H37Rv
gcagggcgcgcaucu

SEQ ID NO: 3307370 - RNA, 13 nt, Mycobacterium tuberculosis H37Rv
gcagggcggcgaa

SEQ ID NO: 3307371 - RNA, 14 nt, Mycobacterium tuberculosis H37Rv
gcagggcggcgaac

SEQ ID NO: 3307372 - RNA, 13 nt, Mycobacterium tuberculosis H37Rv
gcagggcgucggc

SEQ ID NO: 3307373 - RNA, 17 nt, Mycobacterium tuberculosis H37Rv
gcagggcgucggcgaau

SEQ ID NO: 3307374 - RNA, 22 nt, Mycobacterium tuberculosis H37Rv
gcagggcgucggcgaauuccuc

SEQ ID NO: 3307375 - RNA, 14 nt, Mycobacterium tuberculosis H37Rv
gcaggggacgggcg

SEQ ID NO: 3307376 - RNA, 14 nt, Mycobacterium tuberculosis H37Rv
gcagggugaccagg

SEQ ID NO: 3307377 - RNA, 14 nt, Mycobacterium tuberculosis H37Rv
gcagggugccggcg

SEQ ID NO: 3307378 - RNA, 18 nt, Mycobacterium tuberculosis H37Rv
gcagggugccggcgccgc

SEQ ID NO: 3307379 - RNA, 17 nt, Mycobacterium tuberculosis H37Rv
gcaggguggccagcagg

SEQ ID NO: 3307380 - RNA, 18 nt, Mycobacterium tuberculosis H37Rv
gcaggguggccagcaggc

SEQ ID NO: 3307381 - RNA, 14 nt, Mycobacterium tuberculosis H37Rv
gcaggguuccccau

SEQ ID NO: 3307382 - RNA, 15 nt, Mycobacterium tuberculosis H37Rv
gcagguaggcgcgau

SEQ ID NO: 3307383 - RNA, 18 nt, Mycobacterium tuberculosis H37Rv
gcagguauuugccgugcu

SEQ ID NO: 3307384 - RNA, 20 nt, Mycobacterium tuberculosis H37Rv
gcaggucauagccccgcaga

SEQ ID NO: 3307385 - RNA, 19 nt, Mycobacterium tuberculosis H37Rv
gcagguccaggguggucgu

SEQ ID NO: 3307386 - RNA, 16 nt, Mycobacterium tuberculosis H37Rv
gcaggucgacggccac

SEQ ID NO: 3307387 - RNA, 22 nt, Mycobacterium tuberculosis H37Rv
gcaggucgagcgcccacuggug

SEQ ID NO: 3307388 - RNA, 12 nt, Mycobacterium tuberculosis H37Rv
gcaggucgaugc

SEQ ID NO: 3307389 - RNA, 23 nt, Mycobacterium tuberculosis H37Rv
gcaggucgaugcugccagccaug

SEQ ID NO: 3307390 - RNA, 13 nt, Mycobacterium tuberculosis H37Rv
gcaggucgccugc

SEQ ID NO: 3307391 - RNA, 17 nt, Mycobacterium tuberculosis H37Rv
gcaggucguccaucgcg

SEQ ID NO: 3307392 - RNA, 20 nt, Mycobacterium tuberculosis H37Rv
gcaggucgucggcgucgcgg

SEQ ID NO: 3307393 - RNA, 21 nt, Mycobacterium tuberculosis H37Rv
gcaggucgucguaccggccuu

SEQ ID NO: 3307394 - RNA, 16 nt, Mycobacterium tuberculosis H37Rv
gcaggucucguaucgc

SEQ ID NO: 3307395 - RNA, 16 nt, Mycobacterium tuberculosis H37Rv
gcaggucuucaagcuc

SEQ ID NO: 3307396 - RNA, 19 nt, Mycobacterium tuberculosis H37Rv
gcaggugaacaacagcgcu

SEQ ID NO: 3307397 - RNA, 19 nt, Mycobacterium tuberculosis H37Rv
gcaggugaacgccggugcg

SEQ ID NO: 3307398 - RNA, 16 nt, Mycobacterium tuberculosis H37Rv
gcaggugacgaucagg

SEQ ID NO: 3307399 - RNA, 14 nt, Mycobacterium tuberculosis H37Rv
gcaggugagugcgg

SEQ ID NO: 3307400 - RNA, 17 nt, Mycobacterium tuberculosis H37Rv
gcaggugauguucagcg

SEQ ID NO: 3307401 - RNA, 13 nt, Mycobacterium tuberculosis H37Rv
gcaggugcaucgc

SEQ ID NO: 3307402 - RNA, 12 nt, Mycobacterium tuberculosis H37Rv
gcaggugcccau

SEQ ID NO: 3307403 - RNA, 16 nt, Mycobacterium tuberculosis H37Rv
gcaggugcccgaggug

SEQ ID NO: 3307404 - RNA, 22 nt, Mycobacterium tuberculosis H37Rv
gcaggugcccggccaaaauggc

SEQ ID NO: 3307405 - RNA, 13 nt, Mycobacterium tuberculosis H37Rv
gcaggugccuucu

SEQ ID NO: 3307406 - RNA, 16 nt, Mycobacterium tuberculosis H37Rv
gcaggugccuuucggc

SEQ ID NO: 3307407 - RNA, 14 nt, Mycobacterium tuberculosis H37Rv
gcaggugcugggcg

SEQ ID NO: 3307408 - RNA, 15 nt, Mycobacterium tuberculosis H37Rv
gcaggugcugguugc

SEQ ID NO: 3307409 - RNA, 19 nt, Mycobacterium tuberculosis H37Rv
gcagguggagugcacagac

SEQ ID NO: 3307410 - RNA, 18 nt, Mycobacterium tuberculosis H37Rv
gcagguggccgucgccga

SEQ ID NO: 3307411 - RNA, 16 nt, Mycobacterium tuberculosis H37Rv
gcagguuaggguccag

SEQ ID NO: 3307412 - RNA, 12 nt, Mycobacterium tuberculosis H37Rv
gcagguucaacc

SEQ ID NO: 3307413 - RNA, 18 nt, Mycobacterium tuberculosis H37Rv
gcagguuccgcacgauca

SEQ ID NO: 3307414 - RNA, 22 nt, Mycobacterium tuberculosis H37Rv
gcagguucgagggugaccccca

SEQ ID NO: 3307415 - RNA, 18 nt, Mycobacterium tuberculosis H37Rv
gcagguucucggugccga

SEQ ID NO: 3307416 - RNA, 19 nt, Mycobacterium tuberculosis H37Rv
gcagguucuugaccagcag

SEQ ID NO: 3307417 - RNA, 20 nt, Mycobacterium tuberculosis H37Rv
gcagguucuugaccagcagc

SEQ ID NO: 3307418 - RNA, 15 nt, Mycobacterium tuberculosis H37Rv
gcagguugcccucac

SEQ ID NO: 3307419 - RNA, 18 nt, Mycobacterium tuberculosis H37Rv
gcagguugcguugcagga

SEQ ID NO: 3307420 - RNA, 22 nt, Mycobacterium tuberculosis H37Rv
gcagguuggauacggugcgacg

SEQ ID NO: 3307421 - RNA, 17 nt, Mycobacterium tuberculosis H37Rv
gcagguuggccaccgcc

SEQ ID NO: 3307422 - RNA, 22 nt, Mycobacterium tuberculosis H37Rv
gcagguuggccaccgcccagug

SEQ ID NO: 3307423 - RNA, 17 nt, Mycobacterium tuberculosis H37Rv
gcagguuggucaccacc

SEQ ID NO: 3307424 - RNA, 20 nt, Mycobacterium tuberculosis H37Rv
gcagguuggucaccaccugg

SEQ ID NO: 3307425 - RNA, 13 nt, Mycobacterium tuberculosis H37Rv
gcagguuuccggc

SEQ ID NO: 3307426 - RNA, 14 nt, Mycobacterium tuberculosis H37Rv
gcaguacaccgccc

SEQ ID NO: 3307427 - RNA, 16 nt, Mycobacterium tuberculosis H37Rv
gcaguacaccgcccgg

SEQ ID NO: 3307428 - RNA, 23 nt, Mycobacterium tuberculosis H37Rv
gcaguacuaacaacaccaccagc

SEQ ID NO: 3307429 - RNA, 13 nt, Mycobacterium tuberculosis H37Rv
gcaguagccgacc

SEQ ID NO: 3307430 - RNA, 22 nt, Mycobacterium tuberculosis H37Rv
gcaucgacgcguuccucgacgu

SEQ ID NO: 3307431 - RNA, 17 nt, Mycobacterium tuberculosis H37Rv
gcaucgacguagcgaag

SEQ ID NO: 3307432 - RNA, 21 nt, Mycobacterium tuberculosis H37Rv
gcaucgacgugcgcggcauuc

SEQ ID NO: 3307433 - RNA, 15 nt, Mycobacterium tuberculosis H37Rv
gcaucgagacgagcc

SEQ ID NO: 3307434 - RNA, 16 nt, Mycobacterium tuberculosis H37Rv
gcaucgagacgagcca

SEQ ID NO: 3307435 - RNA, 21 nt, Mycobacterium tuberculosis H37Rv
gcaucgagacgcacggccacc

SEQ ID NO: 3307436 - RNA, 17 nt, Mycobacterium tuberculosis H37Rv
gcaucgagcccggacga

SEQ ID NO: 3307437 - RNA, 21 nt, Mycobacterium tuberculosis H37Rv
gcaucgagcgucgggcacauc

SEQ ID NO: 3307438 - RNA, 14 nt, Mycobacterium tuberculosis H37Rv
gcaucgaggccagc

SEQ ID NO: 3307439 - RNA, 18 nt, Mycobacterium tuberculosis H37Rv
gcaucgaggccagcagcu

SEQ ID NO: 3307440 - RNA, 23 nt, Mycobacterium tuberculosis H37Rv
gcaucgaguugucucgcaucggc

SEQ ID NO: 3307441 - RNA, 23 nt, Mycobacterium tuberculosis H37Rv
gcaucgauaauggccgaguccgg

SEQ ID NO: 3307442 - RNA, 13 nt, Mycobacterium tuberculosis H37Rv
gcaucgaucaccg

SEQ ID NO: 3307443 - RNA, 15 nt, Mycobacterium tuberculosis H37Rv
gcaucgccaccauca

SEQ ID NO: 3307444 - RNA, 20 nt, Mycobacterium tuberculosis H37Rv
gcaucgccaccaucaccgcc

SEQ ID NO: 3307445 - RNA, 21 nt, Mycobacterium tuberculosis H37Rv
gcaucgccaccaucaccgccu

SEQ ID NO: 3307446 - RNA, 22 nt, Mycobacterium tuberculosis H37Rv
gcaucgccaccaucaccgccuu

SEQ ID NO: 3307447 - RNA, 23 nt, Mycobacterium tuberculosis H37Rv
gcaucgcccaacaacgcuucggc

SEQ ID NO: 3307448 - RNA, 18 nt, Mycobacterium tuberculosis H37Rv
gcaucgccgacagcgccu

SEQ ID NO: 3307449 - RNA, 22 nt, Mycobacterium tuberculosis H37Rv
gcaucgccgagguggacaaauc

SEQ ID NO: 3307450 - RNA, 19 nt, Mycobacterium tuberculosis H37Rv
gcaucgccggcacggugaa

SEQ ID NO: 3307451 - RNA, 13 nt, Mycobacterium tuberculosis H37Rv
gcaucgccgucaa

SEQ ID NO: 3307452 - RNA, 21 nt, Mycobacterium tuberculosis H37Rv
gcaucgccgucaacgccucug

SEQ ID NO: 3307453 - RNA, 18 nt, Mycobacterium tuberculosis H37Rv
gcaucgccuccaggcgcc

SEQ ID NO: 3307454 - RNA, 18 nt, Mycobacterium tuberculosis H37Rv
gcaucgccuccucgacgu

SEQ ID NO: 3307455 - RNA, 22 nt, Mycobacterium tuberculosis H37Rv
gcaucgccuccucgacgucggc

SEQ ID NO: 3307456 - RNA, 22 nt, Mycobacterium tuberculosis H37Rv
gcaucgccugcgccuuggucgc

SEQ ID NO: 3307457 - RNA, 20 nt, Mycobacterium tuberculosis H37Rv
gcaucgcgauuccggcggcc

SEQ ID NO: 3307458 - RNA, 14 nt, Mycobacterium tuberculosis H37Rv
gcaucgcggcggcg

SEQ ID NO: 3307459 - RNA, 15 nt, Mycobacterium tuberculosis H37Rv
gcaucgcgggcggcg

SEQ ID NO: 3307460 - RNA, 18 nt, Mycobacterium tuberculosis H37Rv
gcaucggagauacgggcc

SEQ ID NO: 3307461 - RNA, 18 nt, Mycobacterium tuberculosis H37Rv
gcaucggcaaggcggauc

SEQ ID NO: 3307462 - RNA, 16 nt, Mycobacterium tuberculosis H37Rv
gcaucggcagcagcgc

SEQ ID NO: 3307463 - RNA, 12 nt, Mycobacterium tuberculosis H37Rv
gcaucggcgaac

SEQ ID NO: 3307464 - RNA, 21 nt, Mycobacterium tuberculosis H37Rv
gcaucggcggcgucuucgucg

SEQ ID NO: 3307465 - RNA, 14 nt, Mycobacterium tuberculosis H37Rv
gcaucggcggugaa

SEQ ID NO: 3307466 - RNA, 15 nt, Mycobacterium tuberculosis H37Rv
gcaucggcggugaac

SEQ ID NO: 3307467 - RNA, 21 nt, Mycobacterium tuberculosis H37Rv
gcaucggcgguuccauacagc

SEQ ID NO: 3307468 - RNA, 19 nt, Mycobacterium tuberculosis H37Rv
gcaucgggcgagcucgucg

SEQ ID NO: 3307469 - RNA, 20 nt, Mycobacterium tuberculosis H37Rv
gcaucgggcgagcucgucga

SEQ ID NO: 3307470 - RNA, 17 nt, Mycobacterium tuberculosis H37Rv
gcaucggucaaugccac

SEQ ID NO: 3307471 - RNA, 16 nt, Mycobacterium tuberculosis H37Rv
gcaucggugcagcccg

SEQ ID NO: 3307472 - RNA, 18 nt, Mycobacterium tuberculosis H37Rv
gcaucggugcagcccgcc

SEQ ID NO: 3307473 - RNA, 15 nt, Mycobacterium tuberculosis H37Rv
gcaucggugguaaca

SEQ ID NO: 3307474 - RNA, 21 nt, Mycobacterium tuberculosis H37Rv
gcaucgguucguagcgggcaa

SEQ ID NO: 3307475 - RNA, 22 nt, Mycobacterium tuberculosis H37Rv
gcaucgucgaaagccuggaaaa

SEQ ID NO: 3307476 - RNA, 20 nt, Mycobacterium tuberculosis H37Rv
gcaucgucgacgaugucggc

SEQ ID NO: 3307477 - RNA, 18 nt, Mycobacterium tuberculosis H37Rv
gcaucgucgacgcccgau

SEQ ID NO: 3307478 - RNA, 19 nt, Mycobacterium tuberculosis H37Rv
gcaucgucgccaagcccag

SEQ ID NO: 3307479 - RNA, 24 nt, Mycobacterium tuberculosis H37Rv
gcaucgucgccaagcccaggcgau

SEQ ID NO: 3307480 - RNA, 15 nt, Mycobacterium tuberculosis H37Rv
gcaucgucgccgacc

SEQ ID NO: 3307481 - RNA, 17 nt, Mycobacterium tuberculosis H37Rv
gcaucgucgccgaccgu

SEQ ID NO: 3307482 - RNA, 16 nt, Mycobacterium tuberculosis H37Rv
gcaucgucgccgagcg

SEQ ID NO: 3307483 - RNA, 15 nt, Mycobacterium tuberculosis H37Rv
gcaucguggccgcac

SEQ ID NO: 3307484 - RNA, 21 nt, Mycobacterium tuberculosis H37Rv
gcaucgugugguuaacacccu

SEQ ID NO: 3307485 - RNA, 14 nt, Mycobacterium tuberculosis H37Rv
gcaucguugccgac

SEQ ID NO: 3307486 - RNA, 15 nt, Mycobacterium tuberculosis H37Rv
gcaucguugccgacc

SEQ ID NO: 3307487 - RNA, 19 nt, Mycobacterium tuberculosis H37Rv
gcaucguugccgaccguca

SEQ ID NO: 3307488 - RNA, 17 nt, Mycobacterium tuberculosis H37Rv
gcaucguuuucgccgau

SEQ ID NO: 3307489 - RNA, 23 nt, Mycobacterium tuberculosis H37Rv
gcaucguuuucgccgaucccggc

SEQ ID NO: 3307490 - RNA, 17 nt, Mycobacterium tuberculosis H37Rv
gcaucuccaccgucgcc

SEQ ID NO: 3307491 - RNA, 15 nt, Mycobacterium tuberculosis H37Rv
gcaucuccgucggcc

SEQ ID NO: 3307492 - RNA, 23 nt, Mycobacterium tuberculosis H37Rv
gcaucuccgucggccaggccacg

SEQ ID NO: 3307493 - RNA, 23 nt, Mycobacterium tuberculosis H37Rv
gcaucucggccuugacgcacgac

SEQ ID NO: 3307494 - RNA, 19 nt, Mycobacterium tuberculosis H37Rv
gcaucucgggcgaagccgc

SEQ ID NO: 3307495 - RNA, 20 nt, Mycobacterium tuberculosis H37Rv
gcaucucgggcgaagccgcu

SEQ ID NO: 3307496 - RNA, 17 nt, Mycobacterium tuberculosis H37Rv
gcaucugcucggcaucg

SEQ ID NO: 3307497 - RNA, 18 nt, Mycobacterium tuberculosis H37Rv
gcaucugcucggcaucga

SEQ ID NO: 3307498 - RNA, 21 nt, Mycobacterium tuberculosis H37Rv
gcaucugugagauaccgacgc

SEQ ID NO: 3307499 - RNA, 18 nt, Mycobacterium tuberculosis H37Rv
gcaucuuuggcggccgca

SEQ ID NO: 3307500 - RNA, 14 nt, Mycobacterium tuberculosis H37Rv
gcaugaagucccgg

SEQ ID NO: 3307501 - RNA, 23 nt, Mycobacterium tuberculosis H37Rv
gcaugaagugaaaguucaugcca

SEQ ID NO: 3307502 - RNA, 18 nt, Mycobacterium tuberculosis H37Rv
gcaugacauacagcgggc

SEQ ID NO: 3307503 - RNA, 19 nt, Mycobacterium tuberculosis H37Rv
gcaugacauacagcgggcg

SEQ ID NO: 3307504 - RNA, 22 nt, Mycobacterium tuberculosis H37Rv
gcaugaccccgucagcgggcag

SEQ ID NO: 3307505 - RNA, 23 nt, Mycobacterium tuberculosis H37Rv
gcaugauccccguugacccagac

SEQ ID NO: 3307506 - RNA, 15 nt, Mycobacterium tuberculosis H37Rv
gcaugauccgcucgu

SEQ ID NO: 3307507 - RNA, 15 nt, Mycobacterium tuberculosis H37Rv
gcaugauccgcuggg

SEQ ID NO: 3307508 - RNA, 19 nt, Mycobacterium tuberculosis H37Rv
gcaugcaaacggaugguuc

SEQ ID NO: 3307509 - RNA, 21 nt, Mycobacterium tuberculosis H37Rv
gcaugcacgucaucggcuggc

SEQ ID NO: 3307510 - RNA, 17 nt, Mycobacterium tuberculosis H37Rv
gcaugcagccccacuuc

SEQ ID NO: 3307511 - RNA, 14 nt, Mycobacterium tuberculosis H37Rv
gcaugccacacacu

SEQ ID NO: 3307512 - RNA, 20 nt, Mycobacterium tuberculosis H37Rv
gcaugcccagaaaaccgccg

SEQ ID NO: 3307513 - RNA, 12 nt, Mycobacterium tuberculosis H37Rv
gcaugcccagcg

SEQ ID NO: 3307514 - RNA, 14 nt, Mycobacterium tuberculosis H37Rv
gcaugcccgccauc

SEQ ID NO: 3307515 - RNA, 13 nt, Mycobacterium tuberculosis H37Rv
gcaugccgcccgc

SEQ ID NO: 3307516 - RNA, 14 nt, Mycobacterium tuberculosis H37Rv
gcaugccgggaagg

SEQ ID NO: 3307517 - RNA, 13 nt, Mycobacterium tuberculosis H37Rv
gcaugccuucggc

SEQ ID NO: 3307518 - RNA, 14 nt, Mycobacterium tuberculosis H37Rv
gcaugcgacgucag

SEQ ID NO: 3307519 - RNA, 17 nt, Mycobacterium tuberculosis H37Rv
gcaugcgaggggcggca

SEQ ID NO: 3307520 - RNA, 18 nt, Mycobacterium tuberculosis H37Rv
gcaugcgaggggcggcaa

SEQ ID NO: 3307521 - RNA, 16 nt, Mycobacterium tuberculosis H37Rv
gcaugcggaucggcgg

SEQ ID NO: 3307522 - RNA, 22 nt, Mycobacterium tuberculosis H37Rv
gcaugcgugacccgacaugguc

SEQ ID NO: 3307523 - RNA, 14 nt, Mycobacterium tuberculosis H37Rv
gcaugcgugccggc

SEQ ID NO: 3307524 - RNA, 17 nt, Mycobacterium tuberculosis H37Rv
gcaugcguuggggcacg

SEQ ID NO: 3307525 - RNA, 22 nt, Mycobacterium tuberculosis H37Rv
gccaacggcuccgggcgcucgg

SEQ ID NO: 3307526 - RNA, 22 nt, Mycobacterium tuberculosis H37Rv
gccaacgggaacaacggcguaa

SEQ ID NO: 3307527 - RNA, 22 nt, Mycobacterium tuberculosis H37Rv
gccaacgguaguugcgcggcau

SEQ ID NO: 3307528 - RNA, 18 nt, Mycobacterium tuberculosis H37Rv
gccaacgugacgccggcc

SEQ ID NO: 3307529 - RNA, 21 nt, Mycobacterium tuberculosis H37Rv
gccaacgugacgccggccagu

SEQ ID NO: 3307530 - RNA, 15 nt, Mycobacterium tuberculosis H37Rv
gccaacguugcgcca

SEQ ID NO: 3307531 - RNA, 15 nt, Mycobacterium tuberculosis H37Rv
gccaacucaggccgg

SEQ ID NO: 3307532 - RNA, 17 nt, Mycobacterium tuberculosis H37Rv
gccaacuccucagccgc

SEQ ID NO: 3307533 - RNA, 15 nt, Mycobacterium tuberculosis H37Rv
gccaacucgaccgac

SEQ ID NO: 3307534 - RNA, 15 nt, Mycobacterium tuberculosis H37Rv
gccaacugggccgag

SEQ ID NO: 3307535 - RNA, 17 nt, Mycobacterium tuberculosis H37Rv
gccaacugggccgagcg

SEQ ID NO: 3307536 - RNA, 18 nt, Mycobacterium tuberculosis H37Rv
gccaacugggccgagcgc

SEQ ID NO: 3307537 - RNA, 19 nt, Mycobacterium tuberculosis H37Rv
gccaacuuggcggccagcc

SEQ ID NO: 3307538 - RNA, 18 nt, Mycobacterium tuberculosis H37Rv
gccaagaaugugggcgac

SEQ ID NO: 3307539 - RNA, 22 nt, Mycobacterium tuberculosis H37Rv
gccaagaccgcggcccgcacgg

SEQ ID NO: 3307540 - RNA, 14 nt, Mycobacterium tuberculosis H37Rv
gccaagacgucggc

SEQ ID NO: 3307541 - RNA, 19 nt, Mycobacterium tuberculosis H37Rv
gccaagcccaggcgaucgc

SEQ ID NO: 3307542 - RNA, 20 nt, Mycobacterium tuberculosis H37Rv
gccaagcccaggcgaucgcc

SEQ ID NO: 3307543 - RNA, 19 nt, Mycobacterium tuberculosis H37Rv
gccaagccgcggcuaggcc

SEQ ID NO: 3307544 - RNA, 18 nt, Mycobacterium tuberculosis H37Rv
gccaagccgugccgcaca

SEQ ID NO: 3307545 - RNA, 20 nt, Mycobacterium tuberculosis H37Rv
gccaagccgugccgcacagc

SEQ ID NO: 3307546 - RNA, 17 nt, Mycobacterium tuberculosis H37Rv
gccaagcgacucgccgg

SEQ ID NO: 3307547 - RNA, 22 nt, Mycobacterium tuberculosis H37Rv
gccaagcgacucgccggcgaau

SEQ ID NO: 3307548 - RNA, 15 nt, Mycobacterium tuberculosis H37Rv
gccaagcgagcgguc

SEQ ID NO: 3307549 - RNA, 14 nt, Mycobacterium tuberculosis H37Rv
gccaagcucggccc

SEQ ID NO: 3307550 - RNA, 18 nt, Mycobacterium tuberculosis H37Rv
gccaagcucggcccagcg

SEQ ID NO: 3307551 - RNA, 15 nt, Mycobacterium tuberculosis H37Rv
gccaaggcgaugguc

SEQ ID NO: 3307552 - RNA, 17 nt, Mycobacterium tuberculosis H37Rv
gccaagggccccuccgg

SEQ ID NO: 3307553 - RNA, 15 nt, Mycobacterium tuberculosis H37Rv
gccaaguacgcgacc

SEQ ID NO: 3307554 - RNA, 15 nt, Mycobacterium tuberculosis H37Rv
gccaaguccgcccgc

SEQ ID NO: 3307555 - RNA, 18 nt, Mycobacterium tuberculosis H37Rv
gccaagugcagggcugcu

SEQ ID NO: 3307556 - RNA, 14 nt, Mycobacterium tuberculosis H37Rv
gccaauagaagcac

SEQ ID NO: 3307557 - RNA, 18 nt, Mycobacterium tuberculosis H37Rv
gccaauagaagcacgucg

SEQ ID NO: 3307558 - RNA, 12 nt, Mycobacterium tuberculosis H37Rv
gccaaucaccgu

SEQ ID NO: 3307559 - RNA, 22 nt, Mycobacterium tuberculosis H37Rv
gccaaucaccguaauuucuuca

SEQ ID NO: 3307560 - RNA, 14 nt, Mycobacterium tuberculosis H37Rv
gccaauccggcggc

SEQ ID NO: 3307561 - RNA, 17 nt, Mycobacterium tuberculosis H37Rv
gccaauccggcggcgac

SEQ ID NO: 3307562 - RNA, 18 nt, Mycobacterium tuberculosis H37Rv
gccaaucgccgucagcac

SEQ ID NO: 3307563 - RNA, 19 nt, Mycobacterium tuberculosis H37Rv
gccaaucugcacgcgcucg

SEQ ID NO: 3307564 - RNA, 21 nt, Mycobacterium tuberculosis H37Rv
gccaaugacgucggaccagcu

SEQ ID NO: 3307565 - RNA, 23 nt, Mycobacterium tuberculosis H37Rv
gccaaugacgucggaccagcugc

SEQ ID NO: 3307566 - RNA, 19 nt, Mycobacterium tuberculosis H37Rv
gccaaugacuuggccagca

SEQ ID NO: 3307567 - RNA, 23 nt, Mycobacterium tuberculosis H37Rv
gccaaugauucggcacgccgggc

SEQ ID NO: 3307568 - RNA, 19 nt, Mycobacterium tuberculosis H37Rv
gccaaugcccuuggccagc

SEQ ID NO: 3307569 - RNA, 20 nt, Mycobacterium tuberculosis H37Rv
gccaaugcccuuggccagca

SEQ ID NO: 3307570 - RNA, 22 nt, Mycobacterium tuberculosis H37Rv
gccaaugcccuuggccagcagg

SEQ ID NO: 3307571 - RNA, 23 nt, Mycobacterium tuberculosis H37Rv
gccaaugcccuuggccagcaggg

SEQ ID NO: 3307572 - RNA, 17 nt, Mycobacterium tuberculosis H37Rv
gccaaugccgcggaggc

SEQ ID NO: 3307573 - RNA, 15 nt, Mycobacterium tuberculosis H37Rv
gccaaugcugcaggu

SEQ ID NO: 3307574 - RNA, 12 nt, Mycobacterium tuberculosis H37Rv
gccaauggccug

SEQ ID NO: 3307575 - RNA, 21 nt, Mycobacterium tuberculosis H37Rv
gccaauugugcugaccugucc

SEQ ID NO: 3307576 - RNA, 14 nt, Mycobacterium tuberculosis H37Rv
gccacaaccucguc

SEQ ID NO: 3307577 - RNA, 18 nt, Mycobacterium tuberculosis H37Rv
gccacaaccucgucguca

SEQ ID NO: 3307578 - RNA, 20 nt, Mycobacterium tuberculosis H37Rv
gccacaacgccucgauggcg

SEQ ID NO: 3307579 - RNA, 14 nt, Mycobacterium tuberculosis H37Rv
gccacaacgcgcgg

SEQ ID NO: 3307580 - RNA, 17 nt, Mycobacterium tuberculosis H37Rv
gccacacacugccggac

SEQ ID NO: 3307581 - RNA, 13 nt, Mycobacterium tuberculosis H37Rv
gccacacaggcgu

SEQ ID NO: 3307582 - RNA, 13 nt, Mycobacterium tuberculosis H37Rv
gccacaccaacgu

SEQ ID NO: 3307583 - RNA, 12 nt, Mycobacterium tuberculosis H37Rv
gccacaccauga

SEQ ID NO: 3307584 - RNA, 22 nt, Mycobacterium tuberculosis H37Rv
gccacaccaugauugccaggac

SEQ ID NO: 3307585 - RNA, 12 nt, Mycobacterium tuberculosis H37Rv
gccacacccggc

SEQ ID NO: 3307586 - RNA, 22 nt, Mycobacterium tuberculosis H37Rv
gccacacccggcgugagcuccg

SEQ ID NO: 3307587 - RNA, 15 nt, Mycobacterium tuberculosis H37Rv
gccacaccgccgcca

SEQ ID NO: 3307588 - RNA, 16 nt, Mycobacterium tuberculosis H37Rv
gccacaccggggcggc

SEQ ID NO: 3307589 - RNA, 18 nt, Mycobacterium tuberculosis H37Rv
gccacaccgucacgccac

SEQ ID NO: 3307590 - RNA, 19 nt, Mycobacterium tuberculosis H37Rv
gccacaccgucacgccacc

SEQ ID NO: 3307591 - RNA, 21 nt, Mycobacterium tuberculosis H37Rv
gccacaccgucacgccaccgc

SEQ ID NO: 3307592 - RNA, 18 nt, Mycobacterium tuberculosis H37Rv
gccacaccuuggccgccg

SEQ ID NO: 3307593 - RNA, 19 nt, Mycobacterium tuberculosis H37Rv
gccacaccuuggccgccgg

SEQ ID NO: 3307594 - RNA, 20 nt, Mycobacterium tuberculosis H37Rv
gccacaccuuggccgccggc

SEQ ID NO: 3307595 - RNA, 14 nt, Mycobacterium tuberculosis H37Rv
gccacacggggccg

SEQ ID NO: 3307596 - RNA, 19 nt, Mycobacterium tuberculosis H37Rv
gccacacggggccgccagc

SEQ ID NO: 3307597 - RNA, 20 nt, Mycobacterium tuberculosis H37Rv
gccacacggggccgccagcu

SEQ ID NO: 3307598 - RNA, 17 nt, Mycobacterium tuberculosis H37Rv
gccacacucgccagggc

SEQ ID NO: 3307599 - RNA, 21 nt, Mycobacterium tuberculosis H37Rv
gccacacucgccagggccauc

SEQ ID NO: 3307600 - RNA, 21 nt, Mycobacterium tuberculosis H37Rv
gccacagcagcguugacggcu

SEQ ID NO: 3307601 - RNA, 17 nt, Mycobacterium tuberculosis H37Rv
gccacagcauaaagauc

SEQ ID NO: 3307602 - RNA, 14 nt, Mycobacterium tuberculosis H37Rv
gccacagccccagg

SEQ ID NO: 3307603 - RNA, 18 nt, Mycobacterium tuberculosis H37Rv
gccacagccccagggugc

SEQ ID NO: 3307604 - RNA, 17 nt, Mycobacterium tuberculosis H37Rv
gccacagcccggcggcg

SEQ ID NO: 3307605 - RNA, 17 nt, Mycobacterium tuberculosis H37Rv
gccacagccgaccucga

SEQ ID NO: 3307606 - RNA, 16 nt, Mycobacterium tuberculosis H37Rv
gccacagcgacagcgu

SEQ ID NO: 3307607 - RNA, 18 nt, Mycobacterium tuberculosis H37Rv
gccacaggcguuuccgcu

SEQ ID NO: 3307608 - RNA, 15 nt, Mycobacterium tuberculosis H37Rv
gccacagggaagcaa

SEQ ID NO: 3307609 - RNA, 22 nt, Mycobacterium tuberculosis H37Rv
gccacagucgucgagcgcuccc

SEQ ID NO: 3307610 - RNA, 20 nt, Mycobacterium tuberculosis H37Rv
gccacagugcauacgguuga

SEQ ID NO: 3307611 - RNA, 20 nt, Mycobacterium tuberculosis H37Rv
gccacauccagcgcuucggc

SEQ ID NO: 3307612 - RNA, 16 nt, Mycobacterium tuberculosis H37Rv
gccacaucgccagcag

SEQ ID NO: 3307613 - RNA, 22 nt, Mycobacterium tuberculosis H37Rv
gccacaucguucaugaucggca

SEQ ID NO: 3307614 - RNA, 13 nt, Mycobacterium tuberculosis H37Rv
gccacaugccaca

SEQ ID NO: 3307615 - RNA, 14 nt, Mycobacterium tuberculosis H37Rv
gccacaugccacag

SEQ ID NO: 3307616 - RNA, 18 nt, Mycobacterium tuberculosis H37Rv
gccacauuucaccaccgu

SEQ ID NO: 3307617 - RNA, 12 nt, Mycobacterium tuberculosis H37Rv
gccaccaaacgc

SEQ ID NO: 3307618 - RNA, 13 nt, Mycobacterium tuberculosis H37Rv
gccaccaacaccg

SEQ ID NO: 3307619 - RNA, 23 nt, Mycobacterium tuberculosis H37Rv
gccaccaaccucaucgcggucgc

SEQ ID NO: 3307620 - RNA, 14 nt, Mycobacterium tuberculosis H37Rv
gccaccacaugcga

SEQ ID NO: 3307621 - RNA, 23 nt, Mycobacterium tuberculosis H37Rv
gccaccgcgggcggcaucgccga

SEQ ID NO: 3307622 - RNA, 20 nt, Mycobacterium tuberculosis H37Rv
gccaccgcggucaccgacgc

SEQ ID NO: 3307623 - RNA, 16 nt, Mycobacterium tuberculosis H37Rv
gccaccgcggucagcu

SEQ ID NO: 3307624 - RNA, 18 nt, Mycobacterium tuberculosis H37Rv
gccaccgcuggaucgacu

SEQ ID NO: 3307625 - RNA, 23 nt, Mycobacterium tuberculosis H37Rv
gccaccggaauccgggccgccgc

SEQ ID NO: 3307626 - RNA, 18 nt, Mycobacterium tuberculosis H37Rv
gccaccggcaaucggcgg

SEQ ID NO: 3307627 - RNA, 14 nt, Mycobacterium tuberculosis H37Rv
gccaccggcgccac

SEQ ID NO: 3307628 - RNA, 18 nt, Mycobacterium tuberculosis H37Rv
gccaccggcgccaccggc

SEQ ID NO: 3307629 - RNA, 16 nt, Mycobacterium tuberculosis H37Rv
gccaccggcgccgccc

SEQ ID NO: 3307630 - RNA, 20 nt, Mycobacterium tuberculosis H37Rv
gccaccggcgccgcccgcgc

SEQ ID NO: 3307631 - RNA, 23 nt, Mycobacterium tuberculosis H37Rv
gccaccggcgccgccgucgccgc

SEQ ID NO: 3307632 - RNA, 17 nt, Mycobacterium tuberculosis H37Rv
gccaccggcgcgaccgc

SEQ ID NO: 3307633 - RNA, 18 nt, Mycobacterium tuberculosis H37Rv
gccaccggcgcgaccgcg

SEQ ID NO: 3307634 - RNA, 16 nt, Mycobacterium tuberculosis H37Rv
gccaccggcgucgacg

SEQ ID NO: 3307635 - RNA, 16 nt, Mycobacterium tuberculosis H37Rv
gccaccggcugcaacc

SEQ ID NO: 3307636 - RNA, 17 nt, Mycobacterium tuberculosis H37Rv
gccaccggcugcaacca

SEQ ID NO: 3307637 - RNA, 22 nt, Mycobacterium tuberculosis H37Rv
gccaccggcugcaaccagcggc

SEQ ID NO: 3307638 - RNA, 17 nt, Mycobacterium tuberculosis H37Rv
gccaccgggcgugcggc

SEQ ID NO: 3307639 - RNA, 20 nt, Mycobacterium tuberculosis H37Rv
gccaccgggcgugcggcggc

SEQ ID NO: 3307640 - RNA, 15 nt, Mycobacterium tuberculosis H37Rv
gccaccggggucacc

SEQ ID NO: 3307641 - RNA, 20 nt, Mycobacterium tuberculosis H37Rv
gccaccggguucaccgaggu

SEQ ID NO: 3307642 - RNA, 19 nt, Mycobacterium tuberculosis H37Rv
gccaccgguaccgaucagc

SEQ ID NO: 3307643 - RNA, 21 nt, Mycobacterium tuberculosis H37Rv
gccaccgguaccgaucagcag

SEQ ID NO: 3307644 - RNA, 21 nt, Mycobacterium tuberculosis H37Rv
gccaccgguaccgccggcucc

SEQ ID NO: 3307645 - RNA, 17 nt, Mycobacterium tuberculosis H37Rv
gccaccgguaccggcga

SEQ ID NO: 3307646 - RNA, 18 nt, Mycobacterium tuberculosis H37Rv
gccaccgguaccggcgac

SEQ ID NO: 3307647 - RNA, 22 nt, Mycobacterium tuberculosis H37Rv
gccaccggugagcgcagcuuga

SEQ ID NO: 3307648 - RNA, 18 nt, Mycobacterium tuberculosis H37Rv
gccaccggugccggcgac

SEQ ID NO: 3307649 - RNA, 24 nt, Mycobacterium tuberculosis H37Rv
gccaccgguuuggagcucaucgac

SEQ ID NO: 3307650 - RNA, 23 nt, Mycobacterium tuberculosis H37Rv
gccaccguagccgaggguagacg

SEQ ID NO: 3307651 - RNA, 18 nt, Mycobacterium tuberculosis H37Rv
gccaccgucacccaucga

SEQ ID NO: 3307652 - RNA, 16 nt, Mycobacterium tuberculosis H37Rv
gccaccgucagcgcga

SEQ ID NO: 3307653 - RNA, 15 nt, Mycobacterium tuberculosis H37Rv
gccaccgucauggcg

SEQ ID NO: 3307654 - RNA, 19 nt, Mycobacterium tuberculosis H37Rv
gccaccgucgcggcggcac

SEQ ID NO: 3307655 - RNA, 15 nt, Mycobacterium tuberculosis H37Rv
gccaccgucgcugcc

SEQ ID NO: 3307656 - RNA, 20 nt, Mycobacterium tuberculosis H37Rv
gccaccguggccgcagggcc

SEQ ID NO: 3307657 - RNA, 20 nt, Mycobacterium tuberculosis H37Rv
gccaccgugguucggcggcg

SEQ ID NO: 3307658 - RNA, 13 nt, Mycobacterium tuberculosis H37Rv
gccaccgugugca

SEQ ID NO: 3307659 - RNA, 16 nt, Mycobacterium tuberculosis H37Rv
gccaccguuaccggug

SEQ ID NO: 3307660 - RNA, 22 nt, Mycobacterium tuberculosis H37Rv
gccaccguuugcgcaccgguca

SEQ ID NO: 3307661 - RNA, 16 nt, Mycobacterium tuberculosis H37Rv
gccaccucccacgccg

SEQ ID NO: 3307662 - RNA, 19 nt, Mycobacterium tuberculosis H37Rv
gccaccucccacgccgccg

SEQ ID NO: 3307663 - RNA, 19 nt, Mycobacterium tuberculosis H37Rv
gccaccuccgaggccgcca

SEQ ID NO: 3307664 - RNA, 15 nt, Mycobacterium tuberculosis H37Rv
gccaccucgacgcac

SEQ ID NO: 3307665 - RNA, 22 nt, Mycobacterium tuberculosis H37Rv
gccaccucggguguggucacca

SEQ ID NO: 3307666 - RNA, 23 nt, Mycobacterium tuberculosis H37Rv
gccaccucggugcggaacaccgc

SEQ ID NO: 3307667 - RNA, 18 nt, Mycobacterium tuberculosis H37Rv
gccaccucuucucggaca

SEQ ID NO: 3307668 - RNA, 16 nt, Mycobacterium tuberculosis H37Rv
gccaccugacaaacgg

SEQ ID NO: 3307669 - RNA, 18 nt, Mycobacterium tuberculosis H37Rv
gccaccugacuaccguca

SEQ ID NO: 3307670 - RNA, 14 nt, Mycobacterium tuberculosis H37Rv
gccaccugcuggcc

SEQ ID NO: 3307671 - RNA, 23 nt, Mycobacterium tuberculosis H37Rv
gccaccugguuuacccgcaugga

SEQ ID NO: 3307672 - RNA, 15 nt, Mycobacterium tuberculosis H37Rv
gccaccuguugcccu

SEQ ID NO: 3307673 - RNA, 22 nt, Mycobacterium tuberculosis H37Rv
gccaccuguugcccuugcgcaa

SEQ ID NO: 3307674 - RNA, 22 nt, Mycobacterium tuberculosis H37Rv
gccaccuguuggcaugccgccc

SEQ ID NO: 3307675 - RNA, 21 nt, Mycobacterium tuberculosis H37Rv
gccaccuuagcgcuugccgcu

SEQ ID NO: 3307676 - RNA, 22 nt, Mycobacterium tuberculosis H37Rv
gccaccuuggacaccacgagcg

SEQ ID NO: 3307677 - RNA, 22 nt, Mycobacterium tuberculosis H37Rv
gccaccuuggcguugaccagca

SEQ ID NO: 3307678 - RNA, 17 nt, Mycobacterium tuberculosis H37Rv
gccaccuugugcaggcc

SEQ ID NO: 3307679 - RNA, 20 nt, Mycobacterium tuberculosis H37Rv
gccaccuugugcaggcccaa

SEQ ID NO: 3307680 - RNA, 13 nt, Mycobacterium tuberculosis H37Rv
gccacgacccagc

SEQ ID NO: 3307681 - RNA, 16 nt, Mycobacterium tuberculosis H37Rv
gccacgacccagcaug

SEQ ID NO: 3307682 - RNA, 15 nt, Mycobacterium tuberculosis H37Rv
gccacgaccgccgau

SEQ ID NO: 3307683 - RNA, 12 nt, Mycobacterium tuberculosis H37Rv
gccacgaccgcg

SEQ ID NO: 3307684 - RNA, 18 nt, Mycobacterium tuberculosis H37Rv
gccacgaccucgggaucg

SEQ ID NO: 3307685 - RNA, 19 nt, Mycobacterium tuberculosis H37Rv
gccacgacgaacaccagcg

SEQ ID NO: 3307686 - RNA, 18 nt, Mycobacterium tuberculosis H37Rv
gccacgagcaacgggcga

SEQ ID NO: 3307687 - RNA, 14 nt, Mycobacterium tuberculosis H37Rv
gccacgaucggcgg

SEQ ID NO: 3307688 - RNA, 20 nt, Mycobacterium tuberculosis H37Rv
gccacgaugucgucgaugaa

SEQ ID NO: 3307689 - RNA, 17 nt, Mycobacterium tuberculosis H37Rv
gccacgcacccggcaau

SEQ ID NO: 3307690 - RNA, 15 nt, Mycobacterium tuberculosis H37Rv
gccacgcaccgggug

SEQ ID NO: 3307691 - RNA, 17 nt, Mycobacterium tuberculosis H37Rv
gccacgcaugggccagg

SEQ ID NO: 3307692 - RNA, 18 nt, Mycobacterium tuberculosis H37Rv
gccacgcaugggccaggu

SEQ ID NO: 3307693 - RNA, 14 nt, Mycobacterium tuberculosis H37Rv
gccacgccaccgcg

SEQ ID NO: 3307694 - RNA, 16 nt, Mycobacterium tuberculosis H37Rv
gccacgccaccgcggu

SEQ ID NO: 3307695 - RNA, 21 nt, Mycobacterium tuberculosis H37Rv
gccacgccaccgcggucaccg

SEQ ID NO: 3307696 - RNA, 17 nt, Mycobacterium tuberculosis H37Rv
gccacgccacguccaac

SEQ ID NO: 3307697 - RNA, 17 nt, Mycobacterium tuberculosis H37Rv
gccacgccagccaggcg

SEQ ID NO: 3307698 - RNA, 12 nt, Mycobacterium tuberculosis H37Rv
gccacgccagcg

SEQ ID NO: 3307699 - RNA, 14 nt, Mycobacterium tuberculosis H37Rv
gccacgccagcguc

SEQ ID NO: 3307700 - RNA, 20 nt, Mycobacterium tuberculosis H37Rv
gccacgccagcgucgaccaa

SEQ ID NO: 3307701 - RNA, 17 nt, Mycobacterium tuberculosis H37Rv
gccacgccagcucgccg

SEQ ID NO: 3307702 - RNA, 19 nt, Mycobacterium tuberculosis H37Rv
gccacgccagcucgccggc

SEQ ID NO: 3307703 - RNA, 20 nt, Mycobacterium tuberculosis H37Rv
gccacgccagcucgccggcc

SEQ ID NO: 3307704 - RNA, 13 nt, Mycobacterium tuberculosis H37Rv
gccacgcccacag

SEQ ID NO: 3307705 - RNA, 16 nt, Mycobacterium tuberculosis H37Rv
gccacgcccaggcaag

SEQ ID NO: 3307706 - RNA, 14 nt, Mycobacterium tuberculosis H37Rv
gccacgcccgacgc

SEQ ID NO: 3307707 - RNA, 16 nt, Mycobacterium tuberculosis H37Rv
gccacgcccgacgcca

SEQ ID NO: 3307708 - RNA, 21 nt, Mycobacterium tuberculosis H37Rv
gccacgcccgacgccagcugc

SEQ ID NO: 3307709 - RNA, 13 nt, Mycobacterium tuberculosis H37Rv
gccacgccgauca

SEQ ID NO: 3307710 - RNA, 18 nt, Mycobacterium tuberculosis H37Rv
gccacgccgaugcggugc

SEQ ID NO: 3307711 - RNA, 19 nt, Mycobacterium tuberculosis H37Rv
gccacgccgaugggaaccg

SEQ ID NO: 3307712 - RNA, 13 nt, Mycobacterium tuberculosis H37Rv
gccacgccgccgg

SEQ ID NO: 3307713 - RNA, 15 nt, Mycobacterium tuberculosis H37Rv
gccacgccggucgcg

SEQ ID NO: 3307714 - RNA, 18 nt, Mycobacterium tuberculosis H37Rv
gccacgccugagccacca

SEQ ID NO: 3307715 - RNA, 16 nt, Mycobacterium tuberculosis H37Rv
gccacgcgggcgcggu

SEQ ID NO: 3307716 - RNA, 16 nt, Mycobacterium tuberculosis H37Rv
gccacgcucggcggcc

SEQ ID NO: 3307717 - RNA, 21 nt, Mycobacterium tuberculosis H37Rv
gccagaucgaacgcagccagc

SEQ ID NO: 3307718 - RNA, 15 nt, Mycobacterium tuberculosis H37Rv
gccagaucgacgcca

SEQ ID NO: 3307719 - RNA, 21 nt, Mycobacterium tuberculosis H37Rv
gccagaucggccaacuugcuc

SEQ ID NO: 3307720 - RNA, 20 nt, Mycobacterium tuberculosis H37Rv
gccagaucggcggguggcgc

SEQ ID NO: 3307721 - RNA, 21 nt, Mycobacterium tuberculosis H37Rv
gccagaucuccccgaccgcgc

SEQ ID NO: 3307722 - RNA, 19 nt, Mycobacterium tuberculosis H37Rv
gccagaucucgcgcgcggc

SEQ ID NO: 3307723 - RNA, 22 nt, Mycobacterium tuberculosis H37Rv
gccagaucucgcgcgcggcgac

SEQ ID NO: 3307724 - RNA, 15 nt, Mycobacterium tuberculosis H37Rv
gccagauuggcgcug

SEQ ID NO: 3307725 - RNA, 19 nt, Mycobacterium tuberculosis H37Rv
gccagauuggcgcugcccg

SEQ ID NO: 3307726 - RNA, 18 nt, Mycobacterium tuberculosis H37Rv
gccagauuucugggagcc

SEQ ID NO: 3307727 - RNA, 14 nt, Mycobacterium tuberculosis H37Rv
gccagcaaaccuuc

SEQ ID NO: 3307728 - RNA, 16 nt, Mycobacterium tuberculosis H37Rv
gccagcaacagcgcgg

SEQ ID NO: 3307729 - RNA, 14 nt, Mycobacterium tuberculosis H37Rv
gccagcaacccugc

SEQ ID NO: 3307730 - RNA, 14 nt, Mycobacterium tuberculosis H37Rv
gccagcaagugcgg

SEQ ID NO: 3307731 - RNA, 15 nt, Mycobacterium tuberculosis H37Rv
gccagcaagugcggg

SEQ ID NO: 3307732 - RNA, 15 nt, Mycobacterium tuberculosis H37Rv
gccagcaaugcccgc

SEQ ID NO: 3307733 - RNA, 13 nt, Mycobacterium tuberculosis H37Rv
gccagcaccaccg

SEQ ID NO: 3307734 - RNA, 15 nt, Mycobacterium tuberculosis H37Rv
gccagcaccaccggc

SEQ ID NO: 3307735 - RNA, 20 nt, Mycobacterium tuberculosis H37Rv
gccagcaccaccggcucccg

SEQ ID NO: 3307736 - RNA, 13 nt, Mycobacterium tuberculosis H37Rv
gccagcaccacgg

SEQ ID NO: 3307737 - RNA, 14 nt, Mycobacterium tuberculosis H37Rv
gccagcaccacggc

SEQ ID NO: 3307738 - RNA, 20 nt, Mycobacterium tuberculosis H37Rv
gccagcaccacggccagcgg

SEQ ID NO: 3307739 - RNA, 16 nt, Mycobacterium tuberculosis H37Rv
gccagcaccacgucga

SEQ ID NO: 3307740 - RNA, 14 nt, Mycobacterium tuberculosis H37Rv
gccagcaccagcgu

SEQ ID NO: 3307741 - RNA, 17 nt, Mycobacterium tuberculosis H37Rv
gccagcacccugaugug

SEQ ID NO: 3307742 - RNA, 16 nt, Mycobacterium tuberculosis H37Rv
gccagcaccucggcca

SEQ ID NO: 3307743 - RNA, 16 nt, Mycobacterium tuberculosis H37Rv
gccagcacgaccucgc

SEQ ID NO: 3307744 - RNA, 14 nt, Mycobacterium tuberculosis H37Rv
gccagcacgccgcc

SEQ ID NO: 3307745 - RNA, 14 nt, Mycobacterium tuberculosis H37Rv
gccagcacggcgac

SEQ ID NO: 3307746 - RNA, 17 nt, Mycobacterium tuberculosis H37Rv
gccagcacggcuugggu

SEQ ID NO: 3307747 - RNA, 16 nt, Mycobacterium tuberculosis H37Rv
gccagcacuccaccgc

SEQ ID NO: 3307748 - RNA, 15 nt, Mycobacterium tuberculosis H37Rv
gccagcagaucaggu

SEQ ID NO: 3307749 - RNA, 20 nt, Mycobacterium tuberculosis H37Rv
gccagcagauuaccgagcug

SEQ ID NO: 3307750 - RNA, 21 nt, Mycobacterium tuberculosis H37Rv
gccagcagcaaacaucgcagg

SEQ ID NO: 3307751 - RNA, 21 nt, Mycobacterium tuberculosis H37Rv
gccagcagcaaucagccgccu

SEQ ID NO: 3307752 - RNA, 20 nt, Mycobacterium tuberculosis H37Rv
gccagcagcaaugcgguacc

SEQ ID NO: 3307753 - RNA, 17 nt, Mycobacterium tuberculosis H37Rv
gccagcagcagaugcga

SEQ ID NO: 3307754 - RNA, 12 nt, Mycobacterium tuberculosis H37Rv
gccagcagcagc

SEQ ID NO: 3307755 - RNA, 19 nt, Mycobacterium tuberculosis H37Rv
gccagcagcagcgccgcgu

SEQ ID NO: 3307756 - RNA, 19 nt, Mycobacterium tuberculosis H37Rv
gccagcagcagugccaccg

SEQ ID NO: 3307757 - RNA, 17 nt, Mycobacterium tuberculosis H37Rv
gccagcagccacccgac

SEQ ID NO: 3307758 - RNA, 21 nt, Mycobacterium tuberculosis H37Rv
gccagcagccacccgacaacg

SEQ ID NO: 3307759 - RNA, 11 nt, Mycobacterium tuberculosis H37Rv
gccagcagccg

SEQ ID NO: 3307760 - RNA, 15 nt, Mycobacterium tuberculosis H37Rv
gccagcagccguuca

SEQ ID NO: 3307761 - RNA, 13 nt, Mycobacterium tuberculosis H37Rv
gccagcagcgacu

SEQ ID NO: 3307762 - RNA, 17 nt, Mycobacterium tuberculosis H37Rv
gccagcagcgacuccag

SEQ ID NO: 3307763 - RNA, 18 nt, Mycobacterium tuberculosis H37Rv
gccagcagcgacuccagc

SEQ ID NO: 3307764 - RNA, 15 nt, Mycobacterium tuberculosis H37Rv
gccagcagcggcgag

SEQ ID NO: 3307765 - RNA, 17 nt, Mycobacterium tuberculosis H37Rv
gccagcagcggcgagcc

SEQ ID NO: 3307766 - RNA, 13 nt, Mycobacterium tuberculosis H37Rv
gccagcagcggcu

SEQ ID NO: 3307767 - RNA, 14 nt, Mycobacterium tuberculosis H37Rv
gccagcagcggcuc

SEQ ID NO: 3307768 - RNA, 20 nt, Mycobacterium tuberculosis H37Rv
gccagcagcuuguuuuccac

SEQ ID NO: 3307769 - RNA, 18 nt, Mycobacterium tuberculosis H37Rv
gccagcaggcggcugaac

SEQ ID NO: 3307770 - RNA, 23 nt, Mycobacterium tuberculosis H37Rv
gccagcaggcggcugaacggcag

SEQ ID NO: 3307771 - RNA, 13 nt, Mycobacterium tuberculosis H37Rv
gccagcagggcca

SEQ ID NO: 3307772 - RNA, 14 nt, Mycobacterium tuberculosis H37Rv
gccagcagggccac

SEQ ID NO: 3307773 - RNA, 15 nt, Mycobacterium tuberculosis H37Rv
gccagcagggccacc

SEQ ID NO: 3307774 - RNA, 22 nt, Mycobacterium tuberculosis H37Rv
gccagcagggccaccaccacgg

SEQ ID NO: 3307775 - RNA, 15 nt, Mycobacterium tuberculosis H37Rv
gccagcagggccaga

SEQ ID NO: 3307776 - RNA, 19 nt, Mycobacterium tuberculosis H37Rv
gccagcagguauuugccgu

SEQ ID NO: 3307777 - RNA, 18 nt, Mycobacterium tuberculosis H37Rv
gccagcagguuggucacc

SEQ ID NO: 3307778 - RNA, 20 nt, Mycobacterium tuberculosis H37Rv
gccagcagguuggucaccac

SEQ ID NO: 3307779 - RNA, 14 nt, Mycobacterium tuberculosis H37Rv
gccagcagugcggu

SEQ ID NO: 3307780 - RNA, 12 nt, Mycobacterium tuberculosis H37Rv
gccagcaucagc

SEQ ID NO: 3307781 - RNA, 20 nt, Mycobacterium tuberculosis H37Rv
gccagcaucagcgccagcga

SEQ ID NO: 3307782 - RNA, 22 nt, Mycobacterium tuberculosis H37Rv
gccagcaucagcgccagcgagc

SEQ ID NO: 3307783 - RNA, 16 nt, Mycobacterium tuberculosis H37Rv
gccagcaucaucaagc

SEQ ID NO: 3307784 - RNA, 12 nt, Mycobacterium tuberculosis H37Rv
gccagcaucgcg

SEQ ID NO: 3307785 - RNA, 19 nt, Mycobacterium tuberculosis H37Rv
gccagcaucggcagcagcg

SEQ ID NO: 3307786 - RNA, 12 nt, Mycobacterium tuberculosis H37Rv
gccagcaugaca

SEQ ID NO: 3307787 - RNA, 16 nt, Mycobacterium tuberculosis H37Rv
gccagcaugacaccgg

SEQ ID NO: 3307788 - RNA, 21 nt, Mycobacterium tuberculosis H37Rv
gccagcaugacaccggccacc

SEQ ID NO: 3307789 - RNA, 17 nt, Mycobacterium tuberculosis H37Rv
gccagcaugucgggccg

SEQ ID NO: 3307790 - RNA, 18 nt, Mycobacterium tuberculosis H37Rv
gccagcauugaagaagcc

SEQ ID NO: 3307791 - RNA, 15 nt, Mycobacterium tuberculosis H37Rv
gccagccaccacauc

SEQ ID NO: 3307792 - RNA, 22 nt, Mycobacterium tuberculosis H37Rv
gccagccaccacaucgcgggcg

SEQ ID NO: 3307793 - RNA, 16 nt, Mycobacterium tuberculosis H37Rv
gccagccaccgaucga

SEQ ID NO: 3307794 - RNA, 23 nt, Mycobacterium tuberculosis H37Rv
gccagccacgaacugaucgaccg

SEQ ID NO: 3307795 - RNA, 14 nt, Mycobacterium tuberculosis H37Rv
gccagccagcgggc

SEQ ID NO: 3307796 - RNA, 14 nt, Mycobacterium tuberculosis H37Rv
gccagccaggcgaa

SEQ ID NO: 3307797 - RNA, 12 nt, Mycobacterium tuberculosis H37Rv
gccagcccagca

SEQ ID NO: 3307798 - RNA, 15 nt, Mycobacterium tuberculosis H37Rv
gccagcccagcaggu

SEQ ID NO: 3307799 - RNA, 13 nt, Mycobacterium tuberculosis H37Rv
gccagcccagccg

SEQ ID NO: 3307800 - RNA, 15 nt, Mycobacterium tuberculosis H37Rv
gccagcccagccggg

SEQ ID NO: 3307801 - RNA, 13 nt, Mycobacterium tuberculosis H37Rv
gccagcccaggcc

SEQ ID NO: 3307802 - RNA, 16 nt, Mycobacterium tuberculosis H37Rv
gccagcccaggguguc

SEQ ID NO: 3307803 - RNA, 17 nt, Mycobacterium tuberculosis H37Rv
gccagcccagggugucc

SEQ ID NO: 3307804 - RNA, 19 nt, Mycobacterium tuberculosis H37Rv
gccagccccacccgcaugc

SEQ ID NO: 3307805 - RNA, 23 nt, Mycobacterium tuberculosis H37Rv
gccagccccagcguucccgccgg

SEQ ID NO: 3307806 - RNA, 22 nt, Mycobacterium tuberculosis H37Rv
gccagccccgccggggccgccg

SEQ ID NO: 3307807 - RNA, 13 nt, Mycobacterium tuberculosis H37Rv
gccagccccgcgc

SEQ ID NO: 3307808 - RNA, 22 nt, Mycobacterium tuberculosis H37Rv
gccagcccggucauggucagca

SEQ ID NO: 3307809 - RNA, 19 nt, Mycobacterium tuberculosis H37Rv
gccagccgaaacauugccc

SEQ ID NO: 3307810 - RNA, 16 nt, Mycobacterium tuberculosis H37Rv
gccagccgacgcggcg

SEQ ID NO: 3307811 - RNA, 15 nt, Mycobacterium tuberculosis H37Rv
gccagccgcgagccg

SEQ ID NO: 3307812 - RNA, 23 nt, Mycobacterium tuberculosis H37Rv
gccagccgcucacccggucgcac

SEQ ID NO: 3307813 - RNA, 21 nt, Mycobacterium tuberculosis H37Rv
gccagccggauguuggucggc

SEQ ID NO: 3307814 - RNA, 16 nt, Mycobacterium tuberculosis H37Rv
gccaggacauucccga

SEQ ID NO: 3307815 - RNA, 17 nt, Mycobacterium tuberculosis H37Rv
gccaggacauucccgag

SEQ ID NO: 3307816 - RNA, 16 nt, Mycobacterium tuberculosis H37Rv
gccaggacgacgccga

SEQ ID NO: 3307817 - RNA, 22 nt, Mycobacterium tuberculosis H37Rv
gccaggacgacgccgacgauga

SEQ ID NO: 3307818 - RNA, 22 nt, Mycobacterium tuberculosis H37Rv
gccaggacuggcaccgccagcc

SEQ ID NO: 3307819 - RNA, 21 nt, Mycobacterium tuberculosis H37Rv
gccaggaguuugaccaccugg

SEQ ID NO: 3307820 - RNA, 23 nt, Mycobacterium tuberculosis H37Rv
gccaggaguuugaccaccugguu

SEQ ID NO: 3307821 - RNA, 17 nt, Mycobacterium tuberculosis H37Rv
gccaggauccgaccccg

SEQ ID NO: 3307822 - RNA, 20 nt, Mycobacterium tuberculosis H37Rv
gccaggauccgaccccgcgc

SEQ ID NO: 3307823 - RNA, 22 nt, Mycobacterium tuberculosis H37Rv
gccaggaucgcuacgucgaccg

SEQ ID NO: 3307824 - RNA, 20 nt, Mycobacterium tuberculosis H37Rv
gccaggaugaauuuggugaa

SEQ ID NO: 3307825 - RNA, 15 nt, Mycobacterium tuberculosis H37Rv
gccaggauugccgcc

SEQ ID NO: 3307826 - RNA, 16 nt, Mycobacterium tuberculosis H37Rv
gccaggcaagccagca

SEQ ID NO: 3307827 - RNA, 14 nt, Mycobacterium tuberculosis H37Rv
gccaggcacguccg

SEQ ID NO: 3307828 - RNA, 15 nt, Mycobacterium tuberculosis H37Rv
gccaggcaugccgcc

SEQ ID NO: 3307829 - RNA, 17 nt, Mycobacterium tuberculosis H37Rv
gccaggccagugccacc

SEQ ID NO: 3307830 - RNA, 14 nt, Mycobacterium tuberculosis H37Rv
gccaggcccagcua

SEQ ID NO: 3307831 - RNA, 20 nt, Mycobacterium tuberculosis H37Rv
gccaggccgaccgcgcacau

SEQ ID NO: 3307832 - RNA, 16 nt, Mycobacterium tuberculosis H37Rv
gccaggccgcacagca

SEQ ID NO: 3307833 - RNA, 14 nt, Mycobacterium tuberculosis H37Rv
gccaggccggcggc

SEQ ID NO: 3307834 - RNA, 14 nt, Mycobacterium tuberculosis H37Rv
gccaggccgucggc

SEQ ID NO: 3307835 - RNA, 15 nt, Mycobacterium tuberculosis H37Rv
gccaggccgucggcg

SEQ ID NO: 3307836 - RNA, 22 nt, Mycobacterium tuberculosis H37Rv
gccaggcgaagucgacucgcca

SEQ ID NO: 3307837 - RNA, 19 nt, Mycobacterium tuberculosis H37Rv
gccaggcgauugcccgcgc

SEQ ID NO: 3307838 - RNA, 12 nt, Mycobacterium tuberculosis H37Rv
gccaggcgcagc

SEQ ID NO: 3307839 - RNA, 13 nt, Mycobacterium tuberculosis H37Rv
gccaggcgcagcu

SEQ ID NO: 3307840 - RNA, 14 nt, Mycobacterium tuberculosis H37Rv
gccaggcgcagcug

SEQ ID NO: 3307841 - RNA, 16 nt, Mycobacterium tuberculosis H37Rv
gccaggcgcgaucgcg

SEQ ID NO: 3307842 - RNA, 22 nt, Mycobacterium tuberculosis H37Rv
gccaggcggcaaggacggagcc

SEQ ID NO: 3307843 - RNA, 12 nt, Mycobacterium tuberculosis H37Rv
gccaggcggccg

SEQ ID NO: 3307844 - RNA, 22 nt, Mycobacterium tuberculosis H37Rv
gccaggcgugcacaggucagcg

SEQ ID NO: 3307845 - RNA, 17 nt, Mycobacterium tuberculosis H37Rv
gccaggcuugcggcacc

SEQ ID NO: 3307846 - RNA, 23 nt, Mycobacterium tuberculosis H37Rv
gccaggcuugcggcacccagucg

SEQ ID NO: 3307847 - RNA, 22 nt, Mycobacterium tuberculosis H37Rv
gccagggagcgcagcgccggca

SEQ ID NO: 3307848 - RNA, 19 nt, Mycobacterium tuberculosis H37Rv
gccagggcccuagccggcg

SEQ ID NO: 3307849 - RNA, 17 nt, Mycobacterium tuberculosis H37Rv
gccagggcuugccgggu

SEQ ID NO: 3307850 - RNA, 17 nt, Mycobacterium tuberculosis H37Rv
gccaggggacccggggc

SEQ ID NO: 3307851 - RNA, 14 nt, Mycobacterium tuberculosis H37Rv
gccaggggaucacc

SEQ ID NO: 3307852 - RNA, 14 nt, Mycobacterium tuberculosis H37Rv
gccaggggcgcagc

SEQ ID NO: 3307853 - RNA, 23 nt, Mycobacterium tuberculosis H37Rv
gccaggggugugccguggucgaa

SEQ ID NO: 3307854 - RNA, 20 nt, Mycobacterium tuberculosis H37Rv
gccagggucacaaacccagc

SEQ ID NO: 3307855 - RNA, 21 nt, Mycobacterium tuberculosis H37Rv
gccagggucacaaacccagca

SEQ ID NO: 3307856 - RNA, 17 nt, Mycobacterium tuberculosis H37Rv
gccagggucccgccgcc

SEQ ID NO: 3307857 - RNA, 17 nt, Mycobacterium tuberculosis H37Rv
gccagggucgcgagccc

SEQ ID NO: 3307858 - RNA, 17 nt, Mycobacterium tuberculosis H37Rv
gccagggugcccucggc

SEQ ID NO: 3307859 - RNA, 19 nt, Mycobacterium tuberculosis H37Rv
gccagguacucaguguucc

SEQ ID NO: 3307860 - RNA, 18 nt, Mycobacterium tuberculosis H37Rv
gccagguacucggugcac

SEQ ID NO: 3307861 - RNA, 16 nt, Mycobacterium tuberculosis H37Rv
gccaggucagccgcgc

SEQ ID NO: 3307862 - RNA, 12 nt, Mycobacterium tuberculosis H37Rv
gccaggucaucg

SEQ ID NO: 3307863 - RNA, 14 nt, Mycobacterium tuberculosis H37Rv
gccagguccgccgg

SEQ ID NO: 3307864 - RNA, 22 nt, Mycobacterium tuberculosis H37Rv
gccagguccgccggugccgccg

SEQ ID NO: 3307865 - RNA, 16 nt, Mycobacterium tuberculosis H37Rv
gccaggucgacgggca

SEQ ID NO: 3307866 - RNA, 17 nt, Mycobacterium tuberculosis H37Rv
gccaggucgccaccuuc

SEQ ID NO: 3307867 - RNA, 19 nt, Mycobacterium tuberculosis H37Rv
gccaggucgccaccuucga

SEQ ID NO: 3307868 - RNA, 20 nt, Mycobacterium tuberculosis H37Rv
gccaggucgcgauagccgcc

SEQ ID NO: 3307869 - RNA, 13 nt, Mycobacterium tuberculosis H37Rv
gccaggucggcca

SEQ ID NO: 3307870 - RNA, 14 nt, Mycobacterium tuberculosis H37Rv
gccaggucggccac

SEQ ID NO: 3307871 - RNA, 15 nt, Mycobacterium tuberculosis H37Rv
gccaggucggccacc

SEQ ID NO: 3307872 - RNA, 17 nt, Mycobacterium tuberculosis H37Rv
gccaggucggccaccgu

SEQ ID NO: 3307873 - RNA, 21 nt, Mycobacterium tuberculosis H37Rv
gccaggucggccaccguggau

SEQ ID NO: 3307874 - RNA, 14 nt, Mycobacterium tuberculosis H37Rv
gccaggucggcgau

SEQ ID NO: 3307875 - RNA, 18 nt, Mycobacterium tuberculosis H37Rv
gccaggucggcgaugaug

SEQ ID NO: 3307876 - RNA, 20 nt, Mycobacterium tuberculosis H37Rv
gccaggucggcgaugaugac

SEQ ID NO: 3307877 - RNA, 15 nt, Mycobacterium tuberculosis H37Rv
gccaggucggcgggc

SEQ ID NO: 3307878 - RNA, 21 nt, Mycobacterium tuberculosis H37Rv
gccaggucggcgggcgcgggu

SEQ ID NO: 3307879 - RNA, 19 nt, Mycobacterium tuberculosis H37Rv
gccaggucuccuugggcga

SEQ ID NO: 3307880 - RNA, 22 nt, Mycobacterium tuberculosis H37Rv
gccaggugaugccgccgugguu

SEQ ID NO: 3307881 - RNA, 13 nt, Mycobacterium tuberculosis H37Rv
gccaggugcagca

SEQ ID NO: 3307882 - RNA, 14 nt, Mycobacterium tuberculosis H37Rv
gccaggugcagcac

SEQ ID NO: 3307883 - RNA, 21 nt, Mycobacterium tuberculosis H37Rv
gccaggugcagggugagcacg

SEQ ID NO: 3307884 - RNA, 20 nt, Mycobacterium tuberculosis H37Rv
gccaggugcccaagcagucc

SEQ ID NO: 3307885 - RNA, 13 nt, Mycobacterium tuberculosis H37Rv
gccagguggccgc

SEQ ID NO: 3307886 - RNA, 17 nt, Mycobacterium tuberculosis H37Rv
gccagguggccgcaucg

SEQ ID NO: 3307887 - RNA, 21 nt, Mycobacterium tuberculosis H37Rv
gccagguguucgccggagacc

SEQ ID NO: 3307888 - RNA, 19 nt, Mycobacterium tuberculosis H37Rv
gccagguugaucguggcga

SEQ ID NO: 3307889 - RNA, 17 nt, Mycobacterium tuberculosis H37Rv
gccaguaacgcccacaa

SEQ ID NO: 3307890 - RNA, 12 nt, Mycobacterium tuberculosis H37Rv
gccaguacgucg

SEQ ID NO: 3307891 - RNA, 15 nt, Mycobacterium tuberculosis H37Rv
gccaguacucggcca

SEQ ID NO: 3307892 - RNA, 19 nt, Mycobacterium tuberculosis H37Rv
gccaguacucggccagcgc

SEQ ID NO: 3307893 - RNA, 14 nt, Mycobacterium tuberculosis H37Rv
gccaguagucgccg

SEQ ID NO: 3307894 - RNA, 18 nt, Mycobacterium tuberculosis H37Rv
gccaguagucgccgggcg

SEQ ID NO: 3307895 - RNA, 13 nt, Mycobacterium tuberculosis H37Rv
gccaguauggccg

SEQ ID NO: 3307896 - RNA, 13 nt, Mycobacterium tuberculosis H37Rv
gccaguccagcgc

SEQ ID NO: 3307897 - RNA, 22 nt, Mycobacterium tuberculosis H37Rv
gccaguccagcgcgccacccag

SEQ ID NO: 3307898 - RNA, 16 nt, Mycobacterium tuberculosis H37Rv
gccagucccccgcucg

SEQ ID NO: 3307899 - RNA, 15 nt, Mycobacterium tuberculosis H37Rv
gccagucccggcgca

SEQ ID NO: 3307900 - RNA, 16 nt, Mycobacterium tuberculosis H37Rv
gccagucccggcgcac

SEQ ID NO: 3307901 - RNA, 18 nt, Mycobacterium tuberculosis H37Rv
gccagucccggcgcacaa

SEQ ID NO: 3307902 - RNA, 19 nt, Mycobacterium tuberculosis H37Rv
gccaguccgaaagccgccg

SEQ ID NO: 3307903 - RNA, 21 nt, Mycobacterium tuberculosis H37Rv
gccaguccgcagcguccagcg

SEQ ID NO: 3307904 - RNA, 14 nt, Mycobacterium tuberculosis H37Rv
gccagucgagcacc

SEQ ID NO: 3307905 - RNA, 17 nt, Mycobacterium tuberculosis H37Rv
gccagucgaucgcggcc

SEQ ID NO: 3307906 - RNA, 23 nt, Mycobacterium tuberculosis H37Rv
gccagucgaucgcggcccgcagc

SEQ ID NO: 3307907 - RNA, 16 nt, Mycobacterium tuberculosis H37Rv
gccagucgcaggaucg

SEQ ID NO: 3307908 - RNA, 19 nt, Mycobacterium tuberculosis H37Rv
gccagucgcaggaucggcg

SEQ ID NO: 3307909 - RNA, 21 nt, Mycobacterium tuberculosis H37Rv
gccagucgugcuugcccgguu

SEQ ID NO: 3307910 - RNA, 19 nt, Mycobacterium tuberculosis H37Rv
gccauggcagcgccgcagc

SEQ ID NO: 3307911 - RNA, 18 nt, Mycobacterium tuberculosis H37Rv
gccauggccgccguuggc

SEQ ID NO: 3307912 - RNA, 19 nt, Mycobacterium tuberculosis H37Rv
gccaugggaguucaucgca

SEQ ID NO: 3307913 - RNA, 17 nt, Mycobacterium tuberculosis H37Rv
gccauggguagccgccc

SEQ ID NO: 3307914 - RNA, 11 nt, Mycobacterium tuberculosis H37Rv
gccauggucag

SEQ ID NO: 3307915 - RNA, 16 nt, Mycobacterium tuberculosis H37Rv
gccaugguggcgccga

SEQ ID NO: 3307916 - RNA, 15 nt, Mycobacterium tuberculosis H37Rv
gccaugguguucggc

SEQ ID NO: 3307917 - RNA, 20 nt, Mycobacterium tuberculosis H37Rv
gccauguagccguugccgcc

SEQ ID NO: 3307918 - RNA, 21 nt, Mycobacterium tuberculosis H37Rv
gccaugucuccgacauuggcc

SEQ ID NO: 3307919 - RNA, 19 nt, Mycobacterium tuberculosis H37Rv
gccauguugcccugcaacc

SEQ ID NO: 3307920 - RNA, 16 nt, Mycobacterium tuberculosis H37Rv
gccauuagcagcaccc

SEQ ID NO: 3307921 - RNA, 15 nt, Mycobacterium tuberculosis H37Rv
gccauuccagccggu

SEQ ID NO: 3307922 - RNA, 16 nt, Mycobacterium tuberculosis H37Rv
gccauucuucgaucag

SEQ ID NO: 3307923 - RNA, 18 nt, Mycobacterium tuberculosis H37Rv
gccauucuucgaucagcg

SEQ ID NO: 3307924 - RNA, 18 nt, Mycobacterium tuberculosis H37Rv
gccauucuuggugaucgc

SEQ ID NO: 3307925 - RNA, 15 nt, Mycobacterium tuberculosis H37Rv
gccauugcgggaacg

SEQ ID NO: 3307926 - RNA, 14 nt, Mycobacterium tuberculosis H37Rv
gccauuggacagcg

SEQ ID NO: 3307927 - RNA, 23 nt, Mycobacterium tuberculosis H37Rv
gccauuugggcccauggcgccug

SEQ ID NO: 3307928 - RNA, 16 nt, Mycobacterium tuberculosis H37Rv
gcccaaaagcgcggca

SEQ ID NO: 3307929 - RNA, 17 nt, Mycobacterium tuberculosis H37Rv
gcccaaaagcgcggcaa

SEQ ID NO: 3307930 - RNA, 18 nt, Mycobacterium tuberculosis H37Rv
gcccaaagcgccagcagc

SEQ ID NO: 3307931 - RNA, 17 nt, Mycobacterium tuberculosis H37Rv
gcccaaaucccagagca

SEQ ID NO: 3307932 - RNA, 18 nt, Mycobacterium tuberculosis H37Rv
gcccaacaacgcuucggc

SEQ ID NO: 3307933 - RNA, 15 nt, Mycobacterium tuberculosis H37Rv
gcccaacaccgccag

SEQ ID NO: 3307934 - RNA, 13 nt, Mycobacterium tuberculosis H37Rv
gcccaaccggucg

SEQ ID NO: 3307935 - RNA, 13 nt, Mycobacterium tuberculosis H37Rv
gcccaacgcgagc

SEQ ID NO: 3307936 - RNA, 17 nt, Mycobacterium tuberculosis H37Rv
gcccaacggaagaccgc

SEQ ID NO: 3307937 - RNA, 18 nt, Mycobacterium tuberculosis H37Rv
gcccaacggaagaccgcg

SEQ ID NO: 3307938 - RNA, 12 nt, Mycobacterium tuberculosis H37Rv
gcccaacgucgc

SEQ ID NO: 3307939 - RNA, 15 nt, Mycobacterium tuberculosis H37Rv
gcccaacgucgccag

SEQ ID NO: 3307940 - RNA, 17 nt, Mycobacterium tuberculosis H37Rv
gcccaacgucgccaggu

SEQ ID NO: 3307941 - RNA, 16 nt, Mycobacterium tuberculosis H37Rv
gcccaacucggccagc

SEQ ID NO: 3307942 - RNA, 19 nt, Mycobacterium tuberculosis H37Rv
gcccaagaucucgcgggcc

SEQ ID NO: 3307943 - RNA, 17 nt, Mycobacterium tuberculosis H37Rv
gcccaagcaguccacga

SEQ ID NO: 3307944 - RNA, 19 nt, Mycobacterium tuberculosis H37Rv
gcccaagcaguccacgagc

SEQ ID NO: 3307945 - RNA, 23 nt, Mycobacterium tuberculosis H37Rv
gcccaagcccucgacguccaucc

SEQ ID NO: 3307946 - RNA, 15 nt, Mycobacterium tuberculosis H37Rv
gcccaagccgccggc

SEQ ID NO: 3307947 - RNA, 22 nt, Mycobacterium tuberculosis H37Rv
gcccaaguucuaagcguuuggc

SEQ ID NO: 3307948 - RNA, 22 nt, Mycobacterium tuberculosis H37Rv
gcccaauccaccgauucggcga

SEQ ID NO: 3307949 - RNA, 20 nt, Mycobacterium tuberculosis H37Rv
gcccacaaauauccugcggu

SEQ ID NO: 3307950 - RNA, 19 nt, Mycobacterium tuberculosis H37Rv
gcccacaaugacucggccg

SEQ ID NO: 3307951 - RNA, 14 nt, Mycobacterium tuberculosis H37Rv
gcccacaccagcgc

SEQ ID NO: 3307952 - RNA, 19 nt, Mycobacterium tuberculosis H37Rv
gcccacaccagcgcagcau

SEQ ID NO: 3307953 - RNA, 21 nt, Mycobacterium tuberculosis H37Rv
gcccacaccagcgcagcauug

SEQ ID NO: 3307954 - RNA, 15 nt, Mycobacterium tuberculosis H37Rv
gcccacacggucguc

SEQ ID NO: 3307955 - RNA, 16 nt, Mycobacterium tuberculosis H37Rv
gcccacacggucgucg

SEQ ID NO: 3307956 - RNA, 21 nt, Mycobacterium tuberculosis H37Rv
gcccacacggucgucgcgagc

SEQ ID NO: 3307957 - RNA, 18 nt, Mycobacterium tuberculosis H37Rv
gcccacagcugacgagcc

SEQ ID NO: 3307958 - RNA, 22 nt, Mycobacterium tuberculosis H37Rv
gcccacagcugacgagccggug

SEQ ID NO: 3307959 - RNA, 16 nt, Mycobacterium tuberculosis H37Rv
gcccacaggcggcgcu

SEQ ID NO: 3307960 - RNA, 22 nt, Mycobacterium tuberculosis H37Rv
gcccacaggggcagcgcggcca

SEQ ID NO: 3307961 - RNA, 22 nt, Mycobacterium tuberculosis H37Rv
gcccacaucgucggcgggcggc

SEQ ID NO: 3307962 - RNA, 23 nt, Mycobacterium tuberculosis H37Rv
gcccacaucgucggcgggcggca

SEQ ID NO: 3307963 - RNA, 15 nt, Mycobacterium tuberculosis H37Rv
gcccacaugcucagg

SEQ ID NO: 3307964 - RNA, 19 nt, Mycobacterium tuberculosis H37Rv
gcccaccacacagccgcgc

SEQ ID NO: 3307965 - RNA, 21 nt, Mycobacterium tuberculosis H37Rv
gcccaccaccacugcggccgc

SEQ ID NO: 3307966 - RNA, 22 nt, Mycobacterium tuberculosis H37Rv
gcccaccacgaacacguucggg

SEQ ID NO: 3307967 - RNA, 19 nt, Mycobacterium tuberculosis H37Rv
gcccaccacgcgacgcggg

SEQ ID NO: 3307968 - RNA, 15 nt, Mycobacterium tuberculosis H37Rv
gcccaccagcgcagc

SEQ ID NO: 3307969 - RNA, 21 nt, Mycobacterium tuberculosis H37Rv
gcccacccgggugggccagug

SEQ ID NO: 3307970 - RNA, 20 nt, Mycobacterium tuberculosis H37Rv
gcccaccgcaacgcuucggc

SEQ ID NO: 3307971 - RNA, 22 nt, Mycobacterium tuberculosis H37Rv
gcccaccgcaacgcuucggcag

SEQ ID NO: 3307972 - RNA, 22 nt, Mycobacterium tuberculosis H37Rv
gcccaccgccguugggccgcgc

SEQ ID NO: 3307973 - RNA, 18 nt, Mycobacterium tuberculosis H37Rv
gcccaccgcugcggcacc

SEQ ID NO: 3307974 - RNA, 18 nt, Mycobacterium tuberculosis H37Rv
gcccaccgggcggcggcg

SEQ ID NO: 3307975 - RNA, 16 nt, Mycobacterium tuberculosis H37Rv
gcccaccggucgccgc

SEQ ID NO: 3307976 - RNA, 18 nt, Mycobacterium tuberculosis H37Rv
gcccaccggucgccgcga

SEQ ID NO: 3307977 - RNA, 17 nt, Mycobacterium tuberculosis H37Rv
gcccaccggugccgccc

SEQ ID NO: 3307978 - RNA, 19 nt, Mycobacterium tuberculosis H37Rv
gcccaccggugccgcccgc

SEQ ID NO: 3307979 - RNA, 23 nt, Mycobacterium tuberculosis H37Rv
gcccaccucaccgaucucgacca

SEQ ID NO: 3307980 - RNA, 13 nt, Mycobacterium tuberculosis H37Rv
gcccaccuccugg

SEQ ID NO: 3307981 - RNA, 21 nt, Mycobacterium tuberculosis H37Rv
gcccaccucgaucgcgccguc

SEQ ID NO: 3307982 - RNA, 20 nt, Mycobacterium tuberculosis H37Rv
gcccacggagggcaggagaa

SEQ ID NO: 3307983 - RNA, 15 nt, Mycobacterium tuberculosis H37Rv
gcccacggcgaccac

SEQ ID NO: 3307984 - RNA, 16 nt, Mycobacterium tuberculosis H37Rv
gcccacggcgaccagg

SEQ ID NO: 3307985 - RNA, 17 nt, Mycobacterium tuberculosis H37Rv
gcccacggcgaccagga

SEQ ID NO: 3307986 - RNA, 19 nt, Mycobacterium tuberculosis H37Rv
gcccacggcgaccaggagc

SEQ ID NO: 3307987 - RNA, 22 nt, Mycobacterium tuberculosis H37Rv
gcccacggugccggcacccgag

SEQ ID NO: 3307988 - RNA, 15 nt, Mycobacterium tuberculosis H37Rv
gcccacgugggcacu

SEQ ID NO: 3307989 - RNA, 18 nt, Mycobacterium tuberculosis H37Rv
gcccacgugggcacucau

SEQ ID NO: 3307990 - RNA, 15 nt, Mycobacterium tuberculosis H37Rv
gcccacguggggccg

SEQ ID NO: 3307991 - RNA, 18 nt, Mycobacterium tuberculosis H37Rv
gcccacguggggccgggg

SEQ ID NO: 3307992 - RNA, 21 nt, Mycobacterium tuberculosis H37Rv
gcccacguuggccaggcccga

SEQ ID NO: 3307993 - RNA, 23 nt, Mycobacterium tuberculosis H37Rv
gcccacguuggccaggcccgagu

SEQ ID NO: 3307994 - RNA, 15 nt, Mycobacterium tuberculosis H37Rv
gcccacuccagcagc

SEQ ID NO: 3307995 - RNA, 18 nt, Mycobacterium tuberculosis H37Rv
gcccacuugugacccggc

SEQ ID NO: 3307996 - RNA, 17 nt, Mycobacterium tuberculosis H37Rv
gcccagaaaaccgccgc

SEQ ID NO: 3307997 - RNA, 20 nt, Mycobacterium tuberculosis H37Rv
gcccagaaaaccgccgcaac

SEQ ID NO: 3307998 - RNA, 17 nt, Mycobacterium tuberculosis H37Rv
gcccagaccgccgacgc

SEQ ID NO: 3307999 - RNA, 15 nt, Mycobacterium tuberculosis H37Rv
gcccagagccgcugc

SEQ ID NO: 3308000 - RNA, 22 nt, Mycobacterium tuberculosis H37Rv
gcccagagccgcugcggcaccg

SEQ ID NO: 3308001 - RNA, 14 nt, Mycobacterium tuberculosis H37Rv
gcccagauagagcu

SEQ ID NO: 3308002 - RNA, 19 nt, Mycobacterium tuberculosis H37Rv
gcccagauagagcuggugc

SEQ ID NO: 3308003 - RNA, 20 nt, Mycobacterium tuberculosis H37Rv
gcccagauaucguacuggcu

SEQ ID NO: 3308004 - RNA, 16 nt, Mycobacterium tuberculosis H37Rv
gcccagauccagcaac

SEQ ID NO: 3308005 - RNA, 15 nt, Mycobacterium tuberculosis H37Rv
gcccauuucgagcuc

SEQ ID NO: 3308006 - RNA, 16 nt, Mycobacterium tuberculosis H37Rv
gcccauuucgagcucg

SEQ ID NO: 3308007 - RNA, 19 nt, Mycobacterium tuberculosis H37Rv
gccccaagcgugcugccgc

SEQ ID NO: 3308008 - RNA, 15 nt, Mycobacterium tuberculosis H37Rv
gccccacaacaugcu

SEQ ID NO: 3308009 - RNA, 19 nt, Mycobacterium tuberculosis H37Rv
gccccacaacaugcuggag

SEQ ID NO: 3308010 - RNA, 14 nt, Mycobacterium tuberculosis H37Rv
gccccacaccuugg

SEQ ID NO: 3308011 - RNA, 23 nt, Mycobacterium tuberculosis H37Rv
gccccacaccuuggcggucggca

SEQ ID NO: 3308012 - RNA, 17 nt, Mycobacterium tuberculosis H37Rv
gccccacccgcaugccc

SEQ ID NO: 3308013 - RNA, 18 nt, Mycobacterium tuberculosis H37Rv
gccccacccgcaugcccu

SEQ ID NO: 3308014 - RNA, 16 nt, Mycobacterium tuberculosis H37Rv
gccccacccgcggcgc

SEQ ID NO: 3308015 - RNA, 18 nt, Mycobacterium tuberculosis H37Rv
gccccaccgaacgugugg

SEQ ID NO: 3308016 - RNA, 14 nt, Mycobacterium tuberculosis H37Rv
gccccaccgacagc

SEQ ID NO: 3308017 - RNA, 15 nt, Mycobacterium tuberculosis H37Rv
gccccaccgacagcc

SEQ ID NO: 3308018 - RNA, 18 nt, Mycobacterium tuberculosis H37Rv
gccccaccgacagcccca

SEQ ID NO: 3308019 - RNA, 16 nt, Mycobacterium tuberculosis H37Rv
gccccaccgagcggug

SEQ ID NO: 3308020 - RNA, 13 nt, Mycobacterium tuberculosis H37Rv
gccccaccggccg

SEQ ID NO: 3308021 - RNA, 11 nt, Mycobacterium tuberculosis H37Rv
gccccaccggu

SEQ ID NO: 3308022 - RNA, 12 nt, Mycobacterium tuberculosis H37Rv
gccccaccggua

SEQ ID NO: 3308023 - RNA, 16 nt, Mycobacterium tuberculosis H37Rv
gccccacuggugcagc

SEQ ID NO: 3308024 - RNA, 18 nt, Mycobacterium tuberculosis H37Rv
gccccacuggugcagcgc

SEQ ID NO: 3308025 - RNA, 23 nt, Mycobacterium tuberculosis H37Rv
gccccagauauugaaccgggcca

SEQ ID NO: 3308026 - RNA, 23 nt, Mycobacterium tuberculosis H37Rv
gccccagcacauucugcagcguc

SEQ ID NO: 3308027 - RNA, 20 nt, Mycobacterium tuberculosis H37Rv
gccccagccaugcugcucga

SEQ ID NO: 3308028 - RNA, 16 nt, Mycobacterium tuberculosis H37Rv
gccccagcgacgucgc

SEQ ID NO: 3308029 - RNA, 20 nt, Mycobacterium tuberculosis H37Rv
gccccagcguucccgccggc

SEQ ID NO: 3308030 - RNA, 16 nt, Mycobacterium tuberculosis H37Rv
gccccaggacaccuug

SEQ ID NO: 3308031 - RNA, 15 nt, Mycobacterium tuberculosis H37Rv
gccccagggcagugc

SEQ ID NO: 3308032 - RNA, 19 nt, Mycobacterium tuberculosis H37Rv
gccccaggggcaccagcga

SEQ ID NO: 3308033 - RNA, 18 nt, Mycobacterium tuberculosis H37Rv
gccccagggugcgcuggc

SEQ ID NO: 3308034 - RNA, 19 nt, Mycobacterium tuberculosis H37Rv
gccccagggugcgcuggcc

SEQ ID NO: 3308035 - RNA, 16 nt, Mycobacterium tuberculosis H37Rv
gccccagguagucgac

SEQ ID NO: 3308036 - RNA, 19 nt, Mycobacterium tuberculosis H37Rv
gccccaggugguucaaccg

SEQ ID NO: 3308037 - RNA, 24 nt, Mycobacterium tuberculosis H37Rv
gccccaggugguucaaccggacga

SEQ ID NO: 3308038 - RNA, 15 nt, Mycobacterium tuberculosis H37Rv
gccccagguuccgcu

SEQ ID NO: 3308039 - RNA, 15 nt, Mycobacterium tuberculosis H37Rv
gccccaguccgaagc

SEQ ID NO: 3308040 - RNA, 18 nt, Mycobacterium tuberculosis H37Rv
gccccauacuugcgccga

SEQ ID NO: 3308041 - RNA, 16 nt, Mycobacterium tuberculosis H37Rv
gccccaucaccaccgg

SEQ ID NO: 3308042 - RNA, 13 nt, Mycobacterium tuberculosis H37Rv
gccccaucgcugg

SEQ ID NO: 3308043 - RNA, 17 nt, Mycobacterium tuberculosis H37Rv
gccccaucgcuggucga

SEQ ID NO: 3308044 - RNA, 21 nt, Mycobacterium tuberculosis H37Rv
gccccaugaucuggugcgcgg

SEQ ID NO: 3308045 - RNA, 15 nt, Mycobacterium tuberculosis H37Rv
gccccaugcgccagc

SEQ ID NO: 3308046 - RNA, 17 nt, Mycobacterium tuberculosis H37Rv
gccccaugcgccagcga

SEQ ID NO: 3308047 - RNA, 22 nt, Mycobacterium tuberculosis H37Rv
gcccccaacgcgguaaagcccc

SEQ ID NO: 3308048 - RNA, 23 nt, Mycobacterium tuberculosis H37Rv
gcccccaacgcgguaaagccccg

SEQ ID NO: 3308049 - RNA, 20 nt, Mycobacterium tuberculosis H37Rv
gcccccaaucagugcagcgu

SEQ ID NO: 3308050 - RNA, 17 nt, Mycobacterium tuberculosis H37Rv
gcccccauugccgccgu

SEQ ID NO: 3308051 - RNA, 21 nt, Mycobacterium tuberculosis H37Rv
gcccccauugccgccgucgcc

SEQ ID NO: 3308052 - RNA, 23 nt, Mycobacterium tuberculosis H37Rv
gccccccagugcagacaggcggc

SEQ ID NO: 3308053 - RNA, 15 nt, Mycobacterium tuberculosis H37Rv
gccccccgacuccgg

SEQ ID NO: 3308054 - RNA, 22 nt, Mycobacterium tuberculosis H37Rv
gccccccgacuccggcaggccc

SEQ ID NO: 3308055 - RNA, 17 nt, Mycobacterium tuberculosis H37Rv
gccccccgagcccgcca

SEQ ID NO: 3308056 - RNA, 20 nt, Mycobacterium tuberculosis H37Rv
gccccccgagcuguggucac

SEQ ID NO: 3308057 - RNA, 14 nt, Mycobacterium tuberculosis H37Rv
gccccccgcgccug

SEQ ID NO: 3308058 - RNA, 17 nt, Mycobacterium tuberculosis H37Rv
gccccccgcgccugccu

SEQ ID NO: 3308059 - RNA, 16 nt, Mycobacterium tuberculosis H37Rv
gccccccggcgacggc

SEQ ID NO: 3308060 - RNA, 18 nt, Mycobacterium tuberculosis H37Rv
gccccccggggccgcaac

SEQ ID NO: 3308061 - RNA, 15 nt, Mycobacterium tuberculosis H37Rv
gcccccgacgacggc

SEQ ID NO: 3308062 - RNA, 13 nt, Mycobacterium tuberculosis H37Rv
gcccccgcacgcu

SEQ ID NO: 3308063 - RNA, 17 nt, Mycobacterium tuberculosis H37Rv
gcccccgcacgcucggc

SEQ ID NO: 3308064 - RNA, 18 nt, Mycobacterium tuberculosis H37Rv
gcccccgcacgcucggcg

SEQ ID NO: 3308065 - RNA, 20 nt, Mycobacterium tuberculosis H37Rv
gcccccgccauugccgccgg

SEQ ID NO: 3308066 - RNA, 21 nt, Mycobacterium tuberculosis H37Rv
gcccccgccauugccgccggc

SEQ ID NO: 3308067 - RNA, 14 nt, Mycobacterium tuberculosis H37Rv
gcccccggcagcgu

SEQ ID NO: 3308068 - RNA, 14 nt, Mycobacterium tuberculosis H37Rv
gcccccggcgcggc

SEQ ID NO: 3308069 - RNA, 20 nt, Mycobacterium tuberculosis H37Rv
gcccccgguaccgcccgcac

SEQ ID NO: 3308070 - RNA, 16 nt, Mycobacterium tuberculosis H37Rv
gcccccggugccgccc

SEQ ID NO: 3308071 - RNA, 15 nt, Mycobacterium tuberculosis H37Rv
gcccccggugucugc

SEQ ID NO: 3308072 - RNA, 21 nt, Mycobacterium tuberculosis H37Rv
gcccccguagauggugguggc

SEQ ID NO: 3308073 - RNA, 20 nt, Mycobacterium tuberculosis H37Rv
gcccccguucuggaaccccg

SEQ ID NO: 3308074 - RNA, 21 nt, Mycobacterium tuberculosis H37Rv
gcccccguucuggaaccccga

SEQ ID NO: 3308075 - RNA, 20 nt, Mycobacterium tuberculosis H37Rv
gcccccguuuacggcccggc

SEQ ID NO: 3308076 - RNA, 16 nt, Mycobacterium tuberculosis H37Rv
gcccccuggauggcgc

SEQ ID NO: 3308077 - RNA, 16 nt, Mycobacterium tuberculosis H37Rv
gccccgaaacgauggc

SEQ ID NO: 3308078 - RNA, 22 nt, Mycobacterium tuberculosis H37Rv
gccccgacauacgucggggccg

SEQ ID NO: 3308079 - RNA, 14 nt, Mycobacterium tuberculosis H37Rv
gccccgaccagcag

SEQ ID NO: 3308080 - RNA, 15 nt, Mycobacterium tuberculosis H37Rv
gccccgaccagcaga

SEQ ID NO: 3308081 - RNA, 16 nt, Mycobacterium tuberculosis H37Rv
gccccgaccagcagac

SEQ ID NO: 3308082 - RNA, 23 nt, Mycobacterium tuberculosis H37Rv
gccccgaccgcguacaggccggc

SEQ ID NO: 3308083 - RNA, 12 nt, Mycobacterium tuberculosis H37Rv
gccccgagcugc

SEQ ID NO: 3308084 - RNA, 23 nt, Mycobacterium tuberculosis H37Rv
gccccgauaaaaaccacccccac

SEQ ID NO: 3308085 - RNA, 14 nt, Mycobacterium tuberculosis H37Rv
gccccgaucggcca

SEQ ID NO: 3308086 - RNA, 16 nt, Mycobacterium tuberculosis H37Rv
gccccgaucggugacg

SEQ ID NO: 3308087 - RNA, 19 nt, Mycobacterium tuberculosis H37Rv
gccccgaugaccgccuugg

SEQ ID NO: 3308088 - RNA, 12 nt, Mycobacterium tuberculosis H37Rv
gccccgcagcac

SEQ ID NO: 3308089 - RNA, 12 nt, Mycobacterium tuberculosis H37Rv
gccccgcagcug

SEQ ID NO: 3308090 - RNA, 12 nt, Mycobacterium tuberculosis H37Rv
gccccgcaucgc

SEQ ID NO: 3308091 - RNA, 16 nt, Mycobacterium tuberculosis H37Rv
gccccgcaucgcccaa

SEQ ID NO: 3308092 - RNA, 18 nt, Mycobacterium tuberculosis H37Rv
gccccgcaucgcccaagc

SEQ ID NO: 3308093 - RNA, 20 nt, Mycobacterium tuberculosis H37Rv
gccccgccaccucgccggcc

SEQ ID NO: 3308094 - RNA, 13 nt, Mycobacterium tuberculosis H37Rv
gccccgccagcgg

SEQ ID NO: 3308095 - RNA, 14 nt, Mycobacterium tuberculosis H37Rv
gccccgccagcggc

SEQ ID NO: 3308096 - RNA, 12 nt, Mycobacterium tuberculosis H37Rv
gccccgccgagc

SEQ ID NO: 3308097 - RNA, 15 nt, Mycobacterium tuberculosis H37Rv
gccccgccgagcacc

SEQ ID NO: 3308098 - RNA, 13 nt, Mycobacterium tuberculosis H37Rv
gccccgccgagcg

SEQ ID NO: 3308099 - RNA, 19 nt, Mycobacterium tuberculosis H37Rv
gccccgccgaugccgccgg

SEQ ID NO: 3308100 - RNA, 22 nt, Mycobacterium tuberculosis H37Rv
gccccgccgaugccgccggccc

SEQ ID NO: 3308101 - RNA, 20 nt, Mycobacterium tuberculosis H37Rv
gcccgagcaggacggugauc

SEQ ID NO: 3308102 - RNA, 14 nt, Mycobacterium tuberculosis H37Rv
gcccgagcccagcc

SEQ ID NO: 3308103 - RNA, 19 nt, Mycobacterium tuberculosis H37Rv
gcccgagcccagccgggca

SEQ ID NO: 3308104 - RNA, 15 nt, Mycobacterium tuberculosis H37Rv
gcccgagcccagcgc

SEQ ID NO: 3308105 - RNA, 16 nt, Mycobacterium tuberculosis H37Rv
gcccgagcccagcgcc

SEQ ID NO: 3308106 - RNA, 17 nt, Mycobacterium tuberculosis H37Rv
gcccgagcccagcgccu

SEQ ID NO: 3308107 - RNA, 21 nt, Mycobacterium tuberculosis H37Rv
gcccgagcccagcgccuccag

SEQ ID NO: 3308108 - RNA, 13 nt, Mycobacterium tuberculosis H37Rv
gcccgagccgcug

SEQ ID NO: 3308109 - RNA, 13 nt, Mycobacterium tuberculosis H37Rv
gcccgaggcgaga

SEQ ID NO: 3308110 - RNA, 15 nt, Mycobacterium tuberculosis H37Rv
gcccgaggcgagacg

SEQ ID NO: 3308111 - RNA, 17 nt, Mycobacterium tuberculosis H37Rv
gcccgaggcgagacgcu

SEQ ID NO: 3308112 - RNA, 17 nt, Mycobacterium tuberculosis H37Rv
gcccgaggcucgggccg

SEQ ID NO: 3308113 - RNA, 18 nt, Mycobacterium tuberculosis H37Rv
gcccgagucgaaaccgcc

SEQ ID NO: 3308114 - RNA, 21 nt, Mycobacterium tuberculosis H37Rv
gcccgagugugaaucgcacga

SEQ ID NO: 3308115 - RNA, 22 nt, Mycobacterium tuberculosis H37Rv
gcccgagugugaaucgcacgac

SEQ ID NO: 3308116 - RNA, 12 nt, Mycobacterium tuberculosis H37Rv
gcccgaguugaa

SEQ ID NO: 3308117 - RNA, 16 nt, Mycobacterium tuberculosis H37Rv
gcccgaguugaagaag

SEQ ID NO: 3308118 - RNA, 18 nt, Mycobacterium tuberculosis H37Rv
gcccgaguugaagaagcc

SEQ ID NO: 3308119 - RNA, 22 nt, Mycobacterium tuberculosis H37Rv
gcccgaguugaagaagccggug

SEQ ID NO: 3308120 - RNA, 16 nt, Mycobacterium tuberculosis H37Rv
gcccgaguugaaggug

SEQ ID NO: 3308121 - RNA, 19 nt, Mycobacterium tuberculosis H37Rv
gcccgaguuggcgaagccc

SEQ ID NO: 3308122 - RNA, 23 nt, Mycobacterium tuberculosis H37Rv
gcccgaguuguggacgcccgagu

SEQ ID NO: 3308123 - RNA, 22 nt, Mycobacterium tuberculosis H37Rv
gcccgaguuguucgugccggcg

SEQ ID NO: 3308124 - RNA, 19 nt, Mycobacterium tuberculosis H37Rv
gcccgaguuguugcugccc

SEQ ID NO: 3308125 - RNA, 15 nt, Mycobacterium tuberculosis H37Rv
gcccgaucaccagcc

SEQ ID NO: 3308126 - RNA, 14 nt, Mycobacterium tuberculosis H37Rv
gcccgaucagccgu

SEQ ID NO: 3308127 - RNA, 13 nt, Mycobacterium tuberculosis H37Rv
gcccgaucccgau

SEQ ID NO: 3308128 - RNA, 23 nt, Mycobacterium tuberculosis H37Rv
gcccgauccggaucccaccaccg

SEQ ID NO: 3308129 - RNA, 22 nt, Mycobacterium tuberculosis H37Rv
gcccgauccgguuaugcgguac

SEQ ID NO: 3308130 - RNA, 22 nt, Mycobacterium tuberculosis H37Rv
gcccgaucgaagaaacggcguc

SEQ ID NO: 3308131 - RNA, 14 nt, Mycobacterium tuberculosis H37Rv
gcccgaucgcuucc

SEQ ID NO: 3308132 - RNA, 22 nt, Mycobacterium tuberculosis H37Rv
gcccgaucggccagggugucca

SEQ ID NO: 3308133 - RNA, 21 nt, Mycobacterium tuberculosis H37Rv
gcccgaucguaggacucggcg

SEQ ID NO: 3308134 - RNA, 14 nt, Mycobacterium tuberculosis H37Rv
gcccgaucugagcu

SEQ ID NO: 3308135 - RNA, 15 nt, Mycobacterium tuberculosis H37Rv
gcccgaugaucccgc

SEQ ID NO: 3308136 - RNA, 19 nt, Mycobacterium tuberculosis H37Rv
gcccgaugcgccaccggcg

SEQ ID NO: 3308137 - RNA, 21 nt, Mycobacterium tuberculosis H37Rv
gcccgaugguacccgcgccgc

SEQ ID NO: 3308138 - RNA, 15 nt, Mycobacterium tuberculosis H37Rv
gcccgauggugccga

SEQ ID NO: 3308139 - RNA, 16 nt, Mycobacterium tuberculosis H37Rv
gcccgauggugccgac

SEQ ID NO: 3308140 - RNA, 20 nt, Mycobacterium tuberculosis H37Rv
gcccgauggugccgacccgc

SEQ ID NO: 3308141 - RNA, 20 nt, Mycobacterium tuberculosis H37Rv
gcccgaugguggugccgacc

SEQ ID NO: 3308142 - RNA, 19 nt, Mycobacterium tuberculosis H37Rv
gcccgauucagcgccccau

SEQ ID NO: 3308143 - RNA, 20 nt, Mycobacterium tuberculosis H37Rv
gcccgauugaguucggcggc

SEQ ID NO: 3308144 - RNA, 13 nt, Mycobacterium tuberculosis H37Rv
gcccgcaaacagu

SEQ ID NO: 3308145 - RNA, 15 nt, Mycobacterium tuberculosis H37Rv
gcccgcaacgccaac

SEQ ID NO: 3308146 - RNA, 21 nt, Mycobacterium tuberculosis H37Rv
gcccgcaauuguucgcggccg

SEQ ID NO: 3308147 - RNA, 15 nt, Mycobacterium tuberculosis H37Rv
gcccgcaccaccggc

SEQ ID NO: 3308148 - RNA, 19 nt, Mycobacterium tuberculosis H37Rv
gcccgcacccccgacaccg

SEQ ID NO: 3308149 - RNA, 22 nt, Mycobacterium tuberculosis H37Rv
gcccgcacccccgacaccgccg

SEQ ID NO: 3308150 - RNA, 18 nt, Mycobacterium tuberculosis H37Rv
gcccgcaccgcguucugg

SEQ ID NO: 3308151 - RNA, 18 nt, Mycobacterium tuberculosis H37Rv
gcccgcaccguggacacc

SEQ ID NO: 3308152 - RNA, 19 nt, Mycobacterium tuberculosis H37Rv
gcccgcacgaaccggucga

SEQ ID NO: 3308153 - RNA, 13 nt, Mycobacterium tuberculosis H37Rv
gcccgcacgacga

SEQ ID NO: 3308154 - RNA, 17 nt, Mycobacterium tuberculosis H37Rv
gcccgcacggccgcagc

SEQ ID NO: 3308155 - RNA, 18 nt, Mycobacterium tuberculosis H37Rv
gcccgcacggccgcagcc

SEQ ID NO: 3308156 - RNA, 16 nt, Mycobacterium tuberculosis H37Rv
gcccgcacugccgccg

SEQ ID NO: 3308157 - RNA, 17 nt, Mycobacterium tuberculosis H37Rv
gcccgcacugccgccgg

SEQ ID NO: 3308158 - RNA, 13 nt, Mycobacterium tuberculosis H37Rv
gcccgcagcagca

SEQ ID NO: 3308159 - RNA, 15 nt, Mycobacterium tuberculosis H37Rv
gcccgcagcagcauc

SEQ ID NO: 3308160 - RNA, 13 nt, Mycobacterium tuberculosis H37Rv
gcccgcagcccgc

SEQ ID NO: 3308161 - RNA, 16 nt, Mycobacterium tuberculosis H37Rv
gcccgcagcgcuucca

SEQ ID NO: 3308162 - RNA, 15 nt, Mycobacterium tuberculosis H37Rv
gcccgcagcgucagc

SEQ ID NO: 3308163 - RNA, 20 nt, Mycobacterium tuberculosis H37Rv
gcccgcagggccgccgcgaa

SEQ ID NO: 3308164 - RNA, 18 nt, Mycobacterium tuberculosis H37Rv
gcccgcaggucggccacc

SEQ ID NO: 3308165 - RNA, 17 nt, Mycobacterium tuberculosis H37Rv
gcccgcaucgcggcauc

SEQ ID NO: 3308166 - RNA, 19 nt, Mycobacterium tuberculosis H37Rv
gcccgcaucgucgccgacc

SEQ ID NO: 3308167 - RNA, 15 nt, Mycobacterium tuberculosis H37Rv
gcccgcauugaucuc

SEQ ID NO: 3308168 - RNA, 19 nt, Mycobacterium tuberculosis H37Rv
gcccgcauugccaacgccc

SEQ ID NO: 3308169 - RNA, 23 nt, Mycobacterium tuberculosis H37Rv
gcccgcauugccaacgcccacgu

SEQ ID NO: 3308170 - RNA, 15 nt, Mycobacterium tuberculosis H37Rv
gcccgccacagcccc

SEQ ID NO: 3308171 - RNA, 18 nt, Mycobacterium tuberculosis H37Rv
gcccgccacagccccagg

SEQ ID NO: 3308172 - RNA, 13 nt, Mycobacterium tuberculosis H37Rv
gcccgccaccccg

SEQ ID NO: 3308173 - RNA, 14 nt, Mycobacterium tuberculosis H37Rv
gcccgccaccggcg

SEQ ID NO: 3308174 - RNA, 17 nt, Mycobacterium tuberculosis H37Rv
gcccgccaccggcgcga

SEQ ID NO: 3308175 - RNA, 13 nt, Mycobacterium tuberculosis H37Rv
gcccgccaccggg

SEQ ID NO: 3308176 - RNA, 20 nt, Mycobacterium tuberculosis H37Rv
gcccgccaccggguucaccg

SEQ ID NO: 3308177 - RNA, 17 nt, Mycobacterium tuberculosis H37Rv
gcccgccacgcucgguu

SEQ ID NO: 3308178 - RNA, 16 nt, Mycobacterium tuberculosis H37Rv
gcccgccagaacggcg

SEQ ID NO: 3308179 - RNA, 13 nt, Mycobacterium tuberculosis H37Rv
gcccgccagccca

SEQ ID NO: 3308180 - RNA, 15 nt, Mycobacterium tuberculosis H37Rv
gcccgccagcccagc

SEQ ID NO: 3308181 - RNA, 13 nt, Mycobacterium tuberculosis H37Rv
gcccgccagcgcc

SEQ ID NO: 3308182 - RNA, 15 nt, Mycobacterium tuberculosis H37Rv
gcccgccagcgccgc

SEQ ID NO: 3308183 - RNA, 16 nt, Mycobacterium tuberculosis H37Rv
gcccgccagcgccgcu

SEQ ID NO: 3308184 - RNA, 12 nt, Mycobacterium tuberculosis H37Rv
gcccgccaggcc

SEQ ID NO: 3308185 - RNA, 17 nt, Mycobacterium tuberculosis H37Rv
gcccgccaucagcccgg

SEQ ID NO: 3308186 - RNA, 22 nt, Mycobacterium tuberculosis H37Rv
gcccgccauccgauggcccggc

SEQ ID NO: 3308187 - RNA, 16 nt, Mycobacterium tuberculosis H37Rv
gcccgccauccgccga

SEQ ID NO: 3308188 - RNA, 15 nt, Mycobacterium tuberculosis H37Rv
gcccgcccaccucga

SEQ ID NO: 3308189 - RNA, 16 nt, Mycobacterium tuberculosis H37Rv
gcccgcccagcccggc

SEQ ID NO: 3308190 - RNA, 13 nt, Mycobacterium tuberculosis H37Rv
gcccgccccgcgc

SEQ ID NO: 3308191 - RNA, 14 nt, Mycobacterium tuberculosis H37Rv
gcccgcccgcacga

SEQ ID NO: 3308192 - RNA, 15 nt, Mycobacterium tuberculosis H37Rv
gcccgcccgcacgac

SEQ ID NO: 3308193 - RNA, 16 nt, Mycobacterium tuberculosis H37Rv
gcccgcccugaccgcc

SEQ ID NO: 3308194 - RNA, 22 nt, Mycobacterium tuberculosis H37Rv
gcccgcccuggcaacgacacgc

SEQ ID NO: 3308195 - RNA, 14 nt, Mycobacterium tuberculosis H37Rv
gcccgccgaacgug

SEQ ID NO: 3308196 - RNA, 14 nt, Mycobacterium tuberculosis H37Rv
gcccgccgacgcca

SEQ ID NO: 3308197 - RNA, 15 nt, Mycobacterium tuberculosis H37Rv
gcccgccgacgccag

SEQ ID NO: 3308198 - RNA, 13 nt, Mycobacterium tuberculosis H37Rv
gcccggcaccccu

SEQ ID NO: 3308199 - RNA, 21 nt, Mycobacterium tuberculosis H37Rv
gcccggcacugaccgcgauga

SEQ ID NO: 3308200 - RNA, 13 nt, Mycobacterium tuberculosis H37Rv
gcccggcagcacg

SEQ ID NO: 3308201 - RNA, 14 nt, Mycobacterium tuberculosis H37Rv
gcccggcaggacuu

SEQ ID NO: 3308202 - RNA, 21 nt, Mycobacterium tuberculosis H37Rv
gcccggcauuaggccgggguc

SEQ ID NO: 3308203 - RNA, 16 nt, Mycobacterium tuberculosis H37Rv
gcccggccaagccggc

SEQ ID NO: 3308204 - RNA, 20 nt, Mycobacterium tuberculosis H37Rv
gcccggccacaggaagcgac

SEQ ID NO: 3308205 - RNA, 14 nt, Mycobacterium tuberculosis H37Rv
gcccggccagccgc

SEQ ID NO: 3308206 - RNA, 15 nt, Mycobacterium tuberculosis H37Rv
gcccggccagcucgg

SEQ ID NO: 3308207 - RNA, 16 nt, Mycobacterium tuberculosis H37Rv
gcccggccaggucgac

SEQ ID NO: 3308208 - RNA, 20 nt, Mycobacterium tuberculosis H37Rv
gcccggccaggucgacaccg

SEQ ID NO: 3308209 - RNA, 15 nt, Mycobacterium tuberculosis H37Rv
gcccggccaugauga

SEQ ID NO: 3308210 - RNA, 13 nt, Mycobacterium tuberculosis H37Rv
gcccggcccgccc

SEQ ID NO: 3308211 - RNA, 16 nt, Mycobacterium tuberculosis H37Rv
gcccggcccgcucagc

SEQ ID NO: 3308212 - RNA, 16 nt, Mycobacterium tuberculosis H37Rv
gcccggcccggcucgg

SEQ ID NO: 3308213 - RNA, 20 nt, Mycobacterium tuberculosis H37Rv
gcccggcccgggucagcgac

SEQ ID NO: 3308214 - RNA, 15 nt, Mycobacterium tuberculosis H37Rv
gcccggccgaacgcc

SEQ ID NO: 3308215 - RNA, 14 nt, Mycobacterium tuberculosis H37Rv
gcccggccgccacu

SEQ ID NO: 3308216 - RNA, 14 nt, Mycobacterium tuberculosis H37Rv
gcccggccgccagc

SEQ ID NO: 3308217 - RNA, 11 nt, Mycobacterium tuberculosis H37Rv
gcccggccgcg

SEQ ID NO: 3308218 - RNA, 13 nt, Mycobacterium tuberculosis H37Rv
gcccggccgcggc

SEQ ID NO: 3308219 - RNA, 14 nt, Mycobacterium tuberculosis H37Rv
gcccggccgcggcc

SEQ ID NO: 3308220 - RNA, 14 nt, Mycobacterium tuberculosis H37Rv
gcccggccggucga

SEQ ID NO: 3308221 - RNA, 16 nt, Mycobacterium tuberculosis H37Rv
gcccggccuugccgcc

SEQ ID NO: 3308222 - RNA, 19 nt, Mycobacterium tuberculosis H37Rv
gcccggccuugccgccggc

SEQ ID NO: 3308223 - RNA, 21 nt, Mycobacterium tuberculosis H37Rv
gcccggccuugccgccggcuc

SEQ ID NO: 3308224 - RNA, 23 nt, Mycobacterium tuberculosis H37Rv
gcccggcgagcagacgcauaagc

SEQ ID NO: 3308225 - RNA, 21 nt, Mycobacterium tuberculosis H37Rv
gcccggcgauaaacccgaggc

SEQ ID NO: 3308226 - RNA, 14 nt, Mycobacterium tuberculosis H37Rv
gcccggcgaucagc

SEQ ID NO: 3308227 - RNA, 16 nt, Mycobacterium tuberculosis H37Rv
gcccggcgcaagcgcc

SEQ ID NO: 3308228 - RNA, 18 nt, Mycobacterium tuberculosis H37Rv
gcccggcgcaagcgccgc

SEQ ID NO: 3308229 - RNA, 16 nt, Mycobacterium tuberculosis H37Rv
gcccggcgcaccaucg

SEQ ID NO: 3308230 - RNA, 22 nt, Mycobacterium tuberculosis H37Rv
gcccggcgcaccaucgcggccg

SEQ ID NO: 3308231 - RNA, 20 nt, Mycobacterium tuberculosis H37Rv
gcccggcgcgauccccgcgc

SEQ ID NO: 3308232 - RNA, 15 nt, Mycobacterium tuberculosis H37Rv
gcccggcgcggccgc

SEQ ID NO: 3308233 - RNA, 18 nt, Mycobacterium tuberculosis H37Rv
gcccggcgcuagcgccgc

SEQ ID NO: 3308234 - RNA, 22 nt, Mycobacterium tuberculosis H37Rv
gcccggcgcuagcgccgcgcuu

SEQ ID NO: 3308235 - RNA, 15 nt, Mycobacterium tuberculosis H37Rv
gcccggcggaucccg

SEQ ID NO: 3308236 - RNA, 19 nt, Mycobacterium tuberculosis H37Rv
gcccggcggaucccgaggc

SEQ ID NO: 3308237 - RNA, 21 nt, Mycobacterium tuberculosis H37Rv
gcccggcggccaacgacgacc

SEQ ID NO: 3308238 - RNA, 17 nt, Mycobacterium tuberculosis H37Rv
gcccggcggccagcucc

SEQ ID NO: 3308239 - RNA, 21 nt, Mycobacterium tuberculosis H37Rv
gcccggcggccagcuccagcg

SEQ ID NO: 3308240 - RNA, 13 nt, Mycobacterium tuberculosis H37Rv
gcccggcggccgc

SEQ ID NO: 3308241 - RNA, 14 nt, Mycobacterium tuberculosis H37Rv
gcccggcggccgcu

SEQ ID NO: 3308242 - RNA, 15 nt, Mycobacterium tuberculosis H37Rv
gcccggcggccgcuu

SEQ ID NO: 3308243 - RNA, 19 nt, Mycobacterium tuberculosis H37Rv
gcccggcgugucgccgcca

SEQ ID NO: 3308244 - RNA, 20 nt, Mycobacterium tuberculosis H37Rv
gcccggcgugucgccgccac

SEQ ID NO: 3308245 - RNA, 22 nt, Mycobacterium tuberculosis H37Rv
gcccggcgugucgccgccacca

SEQ ID NO: 3308246 - RNA, 23 nt, Mycobacterium tuberculosis H37Rv
gcccggcguuguugaccagcacg

SEQ ID NO: 3308247 - RNA, 16 nt, Mycobacterium tuberculosis H37Rv
gcccggcuacgacggc

SEQ ID NO: 3308248 - RNA, 19 nt, Mycobacterium tuberculosis H37Rv
gcccggcuaggagaucagc

SEQ ID NO: 3308249 - RNA, 23 nt, Mycobacterium tuberculosis H37Rv
gcccggcuaggagaucagcaccg

SEQ ID NO: 3308250 - RNA, 12 nt, Mycobacterium tuberculosis H37Rv
gcccggcucggu

SEQ ID NO: 3308251 - RNA, 22 nt, Mycobacterium tuberculosis H37Rv
gcccggcuuuugcgcccagcac

SEQ ID NO: 3308252 - RNA, 22 nt, Mycobacterium tuberculosis H37Rv
gcccgggaaauagauucccggc

SEQ ID NO: 3308253 - RNA, 16 nt, Mycobacterium tuberculosis H37Rv
gcccgggacaaguucg

SEQ ID NO: 3308254 - RNA, 21 nt, Mycobacterium tuberculosis H37Rv
gcccgggacaaguucgguagc

SEQ ID NO: 3308255 - RNA, 22 nt, Mycobacterium tuberculosis H37Rv
gcccgggauaguuuucggccgc

SEQ ID NO: 3308256 - RNA, 14 nt, Mycobacterium tuberculosis H37Rv
gcccgggcagcccc

SEQ ID NO: 3308257 - RNA, 23 nt, Mycobacterium tuberculosis H37Rv
gcccgggcagccccuccgcgccg

SEQ ID NO: 3308258 - RNA, 23 nt, Mycobacterium tuberculosis H37Rv
gcccgggcauccuucaccagcug

SEQ ID NO: 3308259 - RNA, 22 nt, Mycobacterium tuberculosis H37Rv
gcccgggcccgcgggaucagcg

SEQ ID NO: 3308260 - RNA, 13 nt, Mycobacterium tuberculosis H37Rv
gcccgggccgcgu

SEQ ID NO: 3308261 - RNA, 18 nt, Mycobacterium tuberculosis H37Rv
gcccgggcggaacgccgg

SEQ ID NO: 3308262 - RNA, 13 nt, Mycobacterium tuberculosis H37Rv
gcccgggcggcca

SEQ ID NO: 3308263 - RNA, 16 nt, Mycobacterium tuberculosis H37Rv
gcccgggcggccagcu

SEQ ID NO: 3308264 - RNA, 17 nt, Mycobacterium tuberculosis H37Rv
gcccgggcggccagcug

SEQ ID NO: 3308265 - RNA, 18 nt, Mycobacterium tuberculosis H37Rv
gcccgggcggccagcugc

SEQ ID NO: 3308266 - RNA, 22 nt, Mycobacterium tuberculosis H37Rv
gcccgggcgggagucgucgagc

SEQ ID NO: 3308267 - RNA, 21 nt, Mycobacterium tuberculosis H37Rv
gcccgggcgggauccacccag

SEQ ID NO: 3308268 - RNA, 14 nt, Mycobacterium tuberculosis H37Rv
gcccgggcucggcg

SEQ ID NO: 3308269 - RNA, 16 nt, Mycobacterium tuberculosis H37Rv
gcccgggcugccgccc

SEQ ID NO: 3308270 - RNA, 16 nt, Mycobacterium tuberculosis H37Rv
gcccggggcgcacagc

SEQ ID NO: 3308271 - RNA, 18 nt, Mycobacterium tuberculosis H37Rv
gcccggggcgcucgugau

SEQ ID NO: 3308272 - RNA, 23 nt, Mycobacterium tuberculosis H37Rv
gcccggguaucgccaguggugca

SEQ ID NO: 3308273 - RNA, 18 nt, Mycobacterium tuberculosis H37Rv
gcccgggucuccggcgca

SEQ ID NO: 3308274 - RNA, 20 nt, Mycobacterium tuberculosis H37Rv
gcccgggugacccgugcggc

SEQ ID NO: 3308275 - RNA, 16 nt, Mycobacterium tuberculosis H37Rv
gcccgggugacgggaa

SEQ ID NO: 3308276 - RNA, 19 nt, Mycobacterium tuberculosis H37Rv
gcccggguggcccggaaca

SEQ ID NO: 3308277 - RNA, 21 nt, Mycobacterium tuberculosis H37Rv
gcccggguggcccggaacacc

SEQ ID NO: 3308278 - RNA, 17 nt, Mycobacterium tuberculosis H37Rv
gcccgguaguacuagca

SEQ ID NO: 3308279 - RNA, 20 nt, Mycobacterium tuberculosis H37Rv
gcccgguaucgucccggcga

SEQ ID NO: 3308280 - RNA, 22 nt, Mycobacterium tuberculosis H37Rv
gcccgguaucgucccggcgacc

SEQ ID NO: 3308281 - RNA, 21 nt, Mycobacterium tuberculosis H37Rv
gcccggucauggucagcagaa

SEQ ID NO: 3308282 - RNA, 22 nt, Mycobacterium tuberculosis H37Rv
gcccggucauggucagcagaau

SEQ ID NO: 3308283 - RNA, 17 nt, Mycobacterium tuberculosis H37Rv
gcccgguccagccccau

SEQ ID NO: 3308284 - RNA, 22 nt, Mycobacterium tuberculosis H37Rv
gcccggucccuuuguggggccg

SEQ ID NO: 3308285 - RNA, 19 nt, Mycobacterium tuberculosis H37Rv
gcccgguccgccgcagacc

SEQ ID NO: 3308286 - RNA, 22 nt, Mycobacterium tuberculosis H37Rv
gcccggucgagccagcggagca

SEQ ID NO: 3308287 - RNA, 21 nt, Mycobacterium tuberculosis H37Rv
gcccggucgcugauccgggcg

SEQ ID NO: 3308288 - RNA, 22 nt, Mycobacterium tuberculosis H37Rv
gcccggucucgacggcggccgc

SEQ ID NO: 3308289 - RNA, 19 nt, Mycobacterium tuberculosis H37Rv
gcccggugauccacgcucg

SEQ ID NO: 3308290 - RNA, 15 nt, Mycobacterium tuberculosis H37Rv
gcccggugcagcagu

SEQ ID NO: 3308291 - RNA, 16 nt, Mycobacterium tuberculosis H37Rv
gcccggugcggugcac

SEQ ID NO: 3308292 - RNA, 22 nt, Mycobacterium tuberculosis H37Rv
gcccggugcuaaccgacgcuga

SEQ ID NO: 3308293 - RNA, 20 nt, Mycobacterium tuberculosis H37Rv
gcccugacgucacguucggc

SEQ ID NO: 3308294 - RNA, 21 nt, Mycobacterium tuberculosis H37Rv
gcccugacgucacguucggcg

SEQ ID NO: 3308295 - RNA, 20 nt, Mycobacterium tuberculosis H37Rv
gcccugagaacacguucggc

SEQ ID NO: 3308296 - RNA, 14 nt, Mycobacterium tuberculosis H37Rv
gcccugauugaagc

SEQ ID NO: 3308297 - RNA, 18 nt, Mycobacterium tuberculosis H37Rv
gcccugauugaagccccc

SEQ ID NO: 3308298 - RNA, 14 nt, Mycobacterium tuberculosis H37Rv
gcccugcaacccgg

SEQ ID NO: 3308299 - RNA, 14 nt, Mycobacterium tuberculosis H37Rv
gcccugcacagcag

SEQ ID NO: 3308300 - RNA, 20 nt, Mycobacterium tuberculosis H37Rv
gcccugccccggacuccaaa

SEQ ID NO: 3308301 - RNA, 17 nt, Mycobacterium tuberculosis H37Rv
gcccugcccgaaggugg

SEQ ID NO: 3308302 - RNA, 18 nt, Mycobacterium tuberculosis H37Rv
gcccugccgacgcuccag

SEQ ID NO: 3308303 - RNA, 20 nt, Mycobacterium tuberculosis H37Rv
gcccugccgacgcuccaggg

SEQ ID NO: 3308304 - RNA, 21 nt, Mycobacterium tuberculosis H37Rv
gcccugccgccggccccgccg

SEQ ID NO: 3308305 - RNA, 15 nt, Mycobacterium tuberculosis H37Rv
gcccugcgcagccgc

SEQ ID NO: 3308306 - RNA, 19 nt, Mycobacterium tuberculosis H37Rv
gcccugcgccacacccggc

SEQ ID NO: 3308307 - RNA, 20 nt, Mycobacterium tuberculosis H37Rv
gcccugcgccucggcggcca

SEQ ID NO: 3308308 - RNA, 13 nt, Mycobacterium tuberculosis H37Rv
gcccugcggccac

SEQ ID NO: 3308309 - RNA, 23 nt, Mycobacterium tuberculosis H37Rv
gcccugcuccucgcgggcggcgu

SEQ ID NO: 3308310 - RNA, 13 nt, Mycobacterium tuberculosis H37Rv
gcccugcucgccg

SEQ ID NO: 3308311 - RNA, 18 nt, Mycobacterium tuberculosis H37Rv
gcccuggaauccaggagc

SEQ ID NO: 3308312 - RNA, 13 nt, Mycobacterium tuberculosis H37Rv
gcccuggacgucg

SEQ ID NO: 3308313 - RNA, 15 nt, Mycobacterium tuberculosis H37Rv
gcccuggacgucggc

SEQ ID NO: 3308314 - RNA, 17 nt, Mycobacterium tuberculosis H37Rv
gcccuggcaacgacacg

SEQ ID NO: 3308315 - RNA, 20 nt, Mycobacterium tuberculosis H37Rv
gcccuggcaacgacacgccg

SEQ ID NO: 3308316 - RNA, 15 nt, Mycobacterium tuberculosis H37Rv
gcccuggccacccag

SEQ ID NO: 3308317 - RNA, 14 nt, Mycobacterium tuberculosis H37Rv
gcccuggccagccc

SEQ ID NO: 3308318 - RNA, 15 nt, Mycobacterium tuberculosis H37Rv
gcccuggccgcccug

SEQ ID NO: 3308319 - RNA, 19 nt, Mycobacterium tuberculosis H37Rv
gcccuggccgcccuggccg

SEQ ID NO: 3308320 - RNA, 14 nt, Mycobacterium tuberculosis H37Rv
gcccuggcggcccg

SEQ ID NO: 3308321 - RNA, 22 nt, Mycobacterium tuberculosis H37Rv
gcccugggugauggccgcgccc

SEQ ID NO: 3308322 - RNA, 14 nt, Mycobacterium tuberculosis H37Rv
gcccugggugguuc

SEQ ID NO: 3308323 - RNA, 19 nt, Mycobacterium tuberculosis H37Rv
gcccugguccaggcccugg

SEQ ID NO: 3308324 - RNA, 17 nt, Mycobacterium tuberculosis H37Rv
gcccuggugugccgcgu

SEQ ID NO: 3308325 - RNA, 14 nt, Mycobacterium tuberculosis H37Rv
gcccuguucuccgu

SEQ ID NO: 3308326 - RNA, 14 nt, Mycobacterium tuberculosis H37Rv
gcccuuaagccggc

SEQ ID NO: 3308327 - RNA, 17 nt, Mycobacterium tuberculosis H37Rv
gcccuuagggucgccgc

SEQ ID NO: 3308328 - RNA, 21 nt, Mycobacterium tuberculosis H37Rv
gcccuuaucuccggcuucggc

SEQ ID NO: 3308329 - RNA, 13 nt, Mycobacterium tuberculosis H37Rv
gcccuucagcacg

SEQ ID NO: 3308330 - RNA, 17 nt, Mycobacterium tuberculosis H37Rv
gcccuucagcacgguga

SEQ ID NO: 3308331 - RNA, 20 nt, Mycobacterium tuberculosis H37Rv
gcccuucagcguccugguga

SEQ ID NO: 3308332 - RNA, 18 nt, Mycobacterium tuberculosis H37Rv
gcccuucaguucgacggu

SEQ ID NO: 3308333 - RNA, 17 nt, Mycobacterium tuberculosis H37Rv
gcccuucgacgaggacg

SEQ ID NO: 3308334 - RNA, 15 nt, Mycobacterium tuberculosis H37Rv
gcccuucgucggcau

SEQ ID NO: 3308335 - RNA, 17 nt, Mycobacterium tuberculosis H37Rv
gcccuucuucgaccgcg

SEQ ID NO: 3308336 - RNA, 13 nt, Mycobacterium tuberculosis H37Rv
gcccuugaagaaa

SEQ ID NO: 3308337 - RNA, 16 nt, Mycobacterium tuberculosis H37Rv
gcccuugccgccgagg

SEQ ID NO: 3308338 - RNA, 15 nt, Mycobacterium tuberculosis H37Rv
gcccuugccgccggc

SEQ ID NO: 3308339 - RNA, 23 nt, Mycobacterium tuberculosis H37Rv
gcccuugccgccggccccgccgu

SEQ ID NO: 3308340 - RNA, 15 nt, Mycobacterium tuberculosis H37Rv
gcccuugccgccuug

SEQ ID NO: 3308341 - RNA, 18 nt, Mycobacterium tuberculosis H37Rv
gcccuugccgccuuggcc

SEQ ID NO: 3308342 - RNA, 20 nt, Mycobacterium tuberculosis H37Rv
gcccuugccuccggcgccgc

SEQ ID NO: 3308343 - RNA, 18 nt, Mycobacterium tuberculosis H37Rv
gcccuugccuuguuccag

SEQ ID NO: 3308344 - RNA, 19 nt, Mycobacterium tuberculosis H37Rv
gcccuugcggaagaagugc

SEQ ID NO: 3308345 - RNA, 14 nt, Mycobacterium tuberculosis H37Rv
gcccuuggccagca

SEQ ID NO: 3308346 - RNA, 20 nt, Mycobacterium tuberculosis H37Rv
gcccuugggacugcggacac

SEQ ID NO: 3308347 - RNA, 22 nt, Mycobacterium tuberculosis H37Rv
gccgaaaaagaccgacagcggc

SEQ ID NO: 3308348 - RNA, 22 nt, Mycobacterium tuberculosis H37Rv
gccgaaaacaacccgaacacgc

SEQ ID NO: 3308349 - RNA, 23 nt, Mycobacterium tuberculosis H37Rv
gccgaaaacaacccgaacacgcu

SEQ ID NO: 3308350 - RNA, 16 nt, Mycobacterium tuberculosis H37Rv
gccgaaaagggcgaca

SEQ ID NO: 3308351 - RNA, 16 nt, Mycobacterium tuberculosis H37Rv
gccgaaaaucgcagcc

SEQ ID NO: 3308352 - RNA, 22 nt, Mycobacterium tuberculosis H37Rv
gccgaaacucaccagcaccccg

SEQ ID NO: 3308353 - RNA, 19 nt, Mycobacterium tuberculosis H37Rv
gccgaaacuucgcccgggc

SEQ ID NO: 3308354 - RNA, 14 nt, Mycobacterium tuberculosis H37Rv
gccgaaagccuugc

SEQ ID NO: 3308355 - RNA, 20 nt, Mycobacterium tuberculosis H37Rv
gccgaaagccuugccgucga

SEQ ID NO: 3308356 - RNA, 23 nt, Mycobacterium tuberculosis H37Rv
gccgaaaucacugaggcugcggg

SEQ ID NO: 3308357 - RNA, 13 nt, Mycobacterium tuberculosis H37Rv
gccgaaauccaga

SEQ ID NO: 3308358 - RNA, 20 nt, Mycobacterium tuberculosis H37Rv
gccgaaaucggccagcuucc

SEQ ID NO: 3308359 - RNA, 21 nt, Mycobacterium tuberculosis H37Rv
gccgaacaauaaggccgcacg

SEQ ID NO: 3308360 - RNA, 23 nt, Mycobacterium tuberculosis H37Rv
gccgaacaauaaggccgcacggg

SEQ ID NO: 3308361 - RNA, 19 nt, Mycobacterium tuberculosis H37Rv
gccgaacaccacaccgagc

SEQ ID NO: 3308362 - RNA, 17 nt, Mycobacterium tuberculosis H37Rv
gccgaacaccgccgcgu

SEQ ID NO: 3308363 - RNA, 19 nt, Mycobacterium tuberculosis H37Rv
gccgaacaccgucagcguc

SEQ ID NO: 3308364 - RNA, 22 nt, Mycobacterium tuberculosis H37Rv
gccgaacaccgucagcgucuga

SEQ ID NO: 3308365 - RNA, 18 nt, Mycobacterium tuberculosis H37Rv
gccgaacacgcacacgau

SEQ ID NO: 3308366 - RNA, 19 nt, Mycobacterium tuberculosis H37Rv
gccgaacacgcacacgauc

SEQ ID NO: 3308367 - RNA, 15 nt, Mycobacterium tuberculosis H37Rv
gccgaacagcaggcc

SEQ ID NO: 3308368 - RNA, 20 nt, Mycobacterium tuberculosis H37Rv
gccgaacagcaggccuccaa

SEQ ID NO: 3308369 - RNA, 16 nt, Mycobacterium tuberculosis H37Rv
gccgaacagccgagcc

SEQ ID NO: 3308370 - RNA, 21 nt, Mycobacterium tuberculosis H37Rv
gccgaacagcgaaccgccggc

SEQ ID NO: 3308371 - RNA, 23 nt, Mycobacterium tuberculosis H37Rv
gccgaacagcugcccgccagcgc

SEQ ID NO: 3308372 - RNA, 18 nt, Mycobacterium tuberculosis H37Rv
gccgaacaguucggcgag

SEQ ID NO: 3308373 - RNA, 19 nt, Mycobacterium tuberculosis H37Rv
gccgaacaguucggcgagc

SEQ ID NO: 3308374 - RNA, 14 nt, Mycobacterium tuberculosis H37Rv
gccgaaccacgcgc

SEQ ID NO: 3308375 - RNA, 14 nt, Mycobacterium tuberculosis H37Rv
gccgaacccgccgu

SEQ ID NO: 3308376 - RNA, 19 nt, Mycobacterium tuberculosis H37Rv
gccgaacccgccgucaccg

SEQ ID NO: 3308377 - RNA, 21 nt, Mycobacterium tuberculosis H37Rv
gccgaacccgccgucaccgcg

SEQ ID NO: 3308378 - RNA, 22 nt, Mycobacterium tuberculosis H37Rv
gccgaacccgccgucaccgcgc

SEQ ID NO: 3308379 - RNA, 18 nt, Mycobacterium tuberculosis H37Rv
gccgaacccgguguugag

SEQ ID NO: 3308380 - RNA, 23 nt, Mycobacterium tuberculosis H37Rv
gccgaaccgcgcguaauccgagc

SEQ ID NO: 3308381 - RNA, 19 nt, Mycobacterium tuberculosis H37Rv
gccgaaccggcaccagcgg

SEQ ID NO: 3308382 - RNA, 20 nt, Mycobacterium tuberculosis H37Rv
gccgaaccggcaccagcggc

SEQ ID NO: 3308383 - RNA, 22 nt, Mycobacterium tuberculosis H37Rv
gccgaaccgguagucgccgucg

SEQ ID NO: 3308384 - RNA, 18 nt, Mycobacterium tuberculosis H37Rv
gccgaaccguucggcgac

SEQ ID NO: 3308385 - RNA, 17 nt, Mycobacterium tuberculosis H37Rv
gccgaaccugccgcagu

SEQ ID NO: 3308386 - RNA, 20 nt, Mycobacterium tuberculosis H37Rv
gccgaacgaggaaccgucga

SEQ ID NO: 3308387 - RNA, 20 nt, Mycobacterium tuberculosis H37Rv
gccgaacgccagaccgccga

SEQ ID NO: 3308388 - RNA, 22 nt, Mycobacterium tuberculosis H37Rv
gccgaccguuucuccgccgccc

SEQ ID NO: 3308389 - RNA, 14 nt, Mycobacterium tuberculosis H37Rv
gccgaccucacggc

SEQ ID NO: 3308390 - RNA, 21 nt, Mycobacterium tuberculosis H37Rv
gccgaccucaucggcaccguc

SEQ ID NO: 3308391 - RNA, 19 nt, Mycobacterium tuberculosis H37Rv
gccgaccucgaacggggug

SEQ ID NO: 3308392 - RNA, 13 nt, Mycobacterium tuberculosis H37Rv
gccgaccucgagu

SEQ ID NO: 3308393 - RNA, 22 nt, Mycobacterium tuberculosis H37Rv
gccgaccugguaugccgcccgc

SEQ ID NO: 3308394 - RNA, 19 nt, Mycobacterium tuberculosis H37Rv
gccgaccuguccgauaacg

SEQ ID NO: 3308395 - RNA, 13 nt, Mycobacterium tuberculosis H37Rv
gccgaccuucggc

SEQ ID NO: 3308396 - RNA, 16 nt, Mycobacterium tuberculosis H37Rv
gccgaccuucucggcg

SEQ ID NO: 3308397 - RNA, 19 nt, Mycobacterium tuberculosis H37Rv
gccgaccuucucggcguac

SEQ ID NO: 3308398 - RNA, 18 nt, Mycobacterium tuberculosis H37Rv
gccgacgaaaucgucggg

SEQ ID NO: 3308399 - RNA, 21 nt, Mycobacterium tuberculosis H37Rv
gccgacgaacgaaccgccgcc

SEQ ID NO: 3308400 - RNA, 17 nt, Mycobacterium tuberculosis H37Rv
gccgacgaacugcagcc

SEQ ID NO: 3308401 - RNA, 19 nt, Mycobacterium tuberculosis H37Rv
gccgacgaaggauugcgga

SEQ ID NO: 3308402 - RNA, 19 nt, Mycobacterium tuberculosis H37Rv
gccgacgacaacagccagc

SEQ ID NO: 3308403 - RNA, 13 nt, Mycobacterium tuberculosis H37Rv
gccgacgaccagc

SEQ ID NO: 3308404 - RNA, 14 nt, Mycobacterium tuberculosis H37Rv
gccgacgaccagca

SEQ ID NO: 3308405 - RNA, 17 nt, Mycobacterium tuberculosis H37Rv
gccgacgaccagcagau

SEQ ID NO: 3308406 - RNA, 18 nt, Mycobacterium tuberculosis H37Rv
gccgacgaccagcagauc

SEQ ID NO: 3308407 - RNA, 21 nt, Mycobacterium tuberculosis H37Rv
gccgacgaccgccugcaacac

SEQ ID NO: 3308408 - RNA, 18 nt, Mycobacterium tuberculosis H37Rv
gccgacgaucgacgccgc

SEQ ID NO: 3308409 - RNA, 22 nt, Mycobacterium tuberculosis H37Rv
gccgacgauuaccagcggcacc

SEQ ID NO: 3308410 - RNA, 14 nt, Mycobacterium tuberculosis H37Rv
gccgacgccaacgc

SEQ ID NO: 3308411 - RNA, 17 nt, Mycobacterium tuberculosis H37Rv
gccgacgccaacgccag

SEQ ID NO: 3308412 - RNA, 18 nt, Mycobacterium tuberculosis H37Rv
gccgacgccaacgccagc

SEQ ID NO: 3308413 - RNA, 12 nt, Mycobacterium tuberculosis H37Rv
gccgacgccgcc

SEQ ID NO: 3308414 - RNA, 16 nt, Mycobacterium tuberculosis H37Rv
gccgacgccgccggcc

SEQ ID NO: 3308415 - RNA, 18 nt, Mycobacterium tuberculosis H37Rv
gccgacgccguugcccac

SEQ ID NO: 3308416 - RNA, 16 nt, Mycobacterium tuberculosis H37Rv
gccgacgccuuccagc

SEQ ID NO: 3308417 - RNA, 15 nt, Mycobacterium tuberculosis H37Rv
gccgacgcgcggcca

SEQ ID NO: 3308418 - RNA, 16 nt, Mycobacterium tuberculosis H37Rv
gccgacgcgcggccag

SEQ ID NO: 3308419 - RNA, 22 nt, Mycobacterium tuberculosis H37Rv
gccgacggcaagggcauacagc

SEQ ID NO: 3308420 - RNA, 15 nt, Mycobacterium tuberculosis H37Rv
gccgacggcggcggc

SEQ ID NO: 3308421 - RNA, 12 nt, Mycobacterium tuberculosis H37Rv
gccgacgggaac

SEQ ID NO: 3308422 - RNA, 17 nt, Mycobacterium tuberculosis H37Rv
gccgacgggaaccucga

SEQ ID NO: 3308423 - RNA, 18 nt, Mycobacterium tuberculosis H37Rv
gccgacguauagaccagg

SEQ ID NO: 3308424 - RNA, 20 nt, Mycobacterium tuberculosis H37Rv
gccgacgucgacgccggcca

SEQ ID NO: 3308425 - RNA, 21 nt, Mycobacterium tuberculosis H37Rv
gccgacgucgacgccggccag

SEQ ID NO: 3308426 - RNA, 15 nt, Mycobacterium tuberculosis H37Rv
gccgacgucuaggcc

SEQ ID NO: 3308427 - RNA, 21 nt, Mycobacterium tuberculosis H37Rv
gccgacgucuaggccaaaccc

SEQ ID NO: 3308428 - RNA, 20 nt, Mycobacterium tuberculosis H37Rv
gccgacgugguugccccgca

SEQ ID NO: 3308429 - RNA, 17 nt, Mycobacterium tuberculosis H37Rv
gccgacuaucggccgcc

SEQ ID NO: 3308430 - RNA, 16 nt, Mycobacterium tuberculosis H37Rv
gccgacucaucggccg

SEQ ID NO: 3308431 - RNA, 16 nt, Mycobacterium tuberculosis H37Rv
gccgacuccccgccgg

SEQ ID NO: 3308432 - RNA, 14 nt, Mycobacterium tuberculosis H37Rv
gccgacugggcgcg

SEQ ID NO: 3308433 - RNA, 21 nt, Mycobacterium tuberculosis H37Rv
gccgacugggcgcgaccccag

SEQ ID NO: 3308434 - RNA, 20 nt, Mycobacterium tuberculosis H37Rv
gccgacuuccgcgucgccgg

SEQ ID NO: 3308435 - RNA, 13 nt, Mycobacterium tuberculosis H37Rv
gccgagaacaccg

SEQ ID NO: 3308436 - RNA, 24 nt, Mycobacterium tuberculosis H37Rv
gccgagaacgauguccgcgcgaac

SEQ ID NO: 3308437 - RNA, 18 nt, Mycobacterium tuberculosis H37Rv
gccgagaagugggcggua

SEQ ID NO: 3308438 - RNA, 17 nt, Mycobacterium tuberculosis H37Rv
gccgagaccgccgcugc

SEQ ID NO: 3308439 - RNA, 19 nt, Mycobacterium tuberculosis H37Rv
gccgagagcagccagccac

SEQ ID NO: 3308440 - RNA, 13 nt, Mycobacterium tuberculosis H37Rv
gccgagaucacgc

SEQ ID NO: 3308441 - RNA, 17 nt, Mycobacterium tuberculosis H37Rv
gccgagauccacgccag

SEQ ID NO: 3308442 - RNA, 21 nt, Mycobacterium tuberculosis H37Rv
gccgagaugcugcacccggag

SEQ ID NO: 3308443 - RNA, 21 nt, Mycobacterium tuberculosis H37Rv
gccgagaugcuggucggcgau

SEQ ID NO: 3308444 - RNA, 22 nt, Mycobacterium tuberculosis H37Rv
gccgagaugcuggucggcgaug

SEQ ID NO: 3308445 - RNA, 23 nt, Mycobacterium tuberculosis H37Rv
gccgagcaaacauccacccgcgg

SEQ ID NO: 3308446 - RNA, 20 nt, Mycobacterium tuberculosis H37Rv
gccgagcacgccgagcccgc

SEQ ID NO: 3308447 - RNA, 22 nt, Mycobacterium tuberculosis H37Rv
gccgagcacgccgagcccgccg

SEQ ID NO: 3308448 - RNA, 15 nt, Mycobacterium tuberculosis H37Rv
gccgagcacgggcag

SEQ ID NO: 3308449 - RNA, 22 nt, Mycobacterium tuberculosis H37Rv
gccgagcacucggccacgacga

SEQ ID NO: 3308450 - RNA, 18 nt, Mycobacterium tuberculosis H37Rv
gccgagcagacgcaaaau

SEQ ID NO: 3308451 - RNA, 18 nt, Mycobacterium tuberculosis H37Rv
gccgagcagacgcagaau

SEQ ID NO: 3308452 - RNA, 16 nt, Mycobacterium tuberculosis H37Rv
gccgagcagacgcgga

SEQ ID NO: 3308453 - RNA, 17 nt, Mycobacterium tuberculosis H37Rv
gccgagcagcccgcgga

SEQ ID NO: 3308454 - RNA, 11 nt, Mycobacterium tuberculosis H37Rv
gccgagcagcu

SEQ ID NO: 3308455 - RNA, 20 nt, Mycobacterium tuberculosis H37Rv
gccgagcagcuccuugaggu

SEQ ID NO: 3308456 - RNA, 17 nt, Mycobacterium tuberculosis H37Rv
gccgagcagggccggca

SEQ ID NO: 3308457 - RNA, 14 nt, Mycobacterium tuberculosis H37Rv
gccgagcauccgac

SEQ ID NO: 3308458 - RNA, 21 nt, Mycobacterium tuberculosis H37Rv
gccgagccagcuccggcgcuc

SEQ ID NO: 3308459 - RNA, 17 nt, Mycobacterium tuberculosis H37Rv
gccgagcccgucgauca

SEQ ID NO: 3308460 - RNA, 13 nt, Mycobacterium tuberculosis H37Rv
gccgagccgacau

SEQ ID NO: 3308461 - RNA, 18 nt, Mycobacterium tuberculosis H37Rv
gccgagccgauauaccag

SEQ ID NO: 3308462 - RNA, 21 nt, Mycobacterium tuberculosis H37Rv
gccgagccgauauaccagggc

SEQ ID NO: 3308463 - RNA, 15 nt, Mycobacterium tuberculosis H37Rv
gccgagcgaccgucc

SEQ ID NO: 3308464 - RNA, 19 nt, Mycobacterium tuberculosis H37Rv
gccgagcgaccgucccagc

SEQ ID NO: 3308465 - RNA, 23 nt, Mycobacterium tuberculosis H37Rv
gccgagcgcaacucccagcacgg

SEQ ID NO: 3308466 - RNA, 16 nt, Mycobacterium tuberculosis H37Rv
gccgagcgcaaggucg

SEQ ID NO: 3308467 - RNA, 17 nt, Mycobacterium tuberculosis H37Rv
gccgagcgcaccacggc

SEQ ID NO: 3308468 - RNA, 22 nt, Mycobacterium tuberculosis H37Rv
gccgagcgcacuggggaggcca

SEQ ID NO: 3308469 - RNA, 11 nt, Mycobacterium tuberculosis H37Rv
gccgagcgcga

SEQ ID NO: 3308470 - RNA, 15 nt, Mycobacterium tuberculosis H37Rv
gccgagcgcgccgaa

SEQ ID NO: 3308471 - RNA, 15 nt, Mycobacterium tuberculosis H37Rv
gccgagcggaccacc

SEQ ID NO: 3308472 - RNA, 16 nt, Mycobacterium tuberculosis H37Rv
gccgagcggaccaccg

SEQ ID NO: 3308473 - RNA, 15 nt, Mycobacterium tuberculosis H37Rv
gccgagcggucaacg

SEQ ID NO: 3308474 - RNA, 18 nt, Mycobacterium tuberculosis H37Rv
gccgagcgugaaccuggc

SEQ ID NO: 3308475 - RNA, 22 nt, Mycobacterium tuberculosis H37Rv
gccgagcgugaagucacggcgg

SEQ ID NO: 3308476 - RNA, 23 nt, Mycobacterium tuberculosis H37Rv
gccgagcguggccaauccggcgg

SEQ ID NO: 3308477 - RNA, 13 nt, Mycobacterium tuberculosis H37Rv
gccgagcuagauc

SEQ ID NO: 3308478 - RNA, 16 nt, Mycobacterium tuberculosis H37Rv
gccgagcuagaucacg

SEQ ID NO: 3308479 - RNA, 16 nt, Mycobacterium tuberculosis H37Rv
gccgagcucggucacc

SEQ ID NO: 3308480 - RNA, 19 nt, Mycobacterium tuberculosis H37Rv
gccgagcucggucaccacg

SEQ ID NO: 3308481 - RNA, 19 nt, Mycobacterium tuberculosis H37Rv
gccgagcucguaguguucc

SEQ ID NO: 3308482 - RNA, 23 nt, Mycobacterium tuberculosis H37Rv
gccgagcucguugaccaggaaug

SEQ ID NO: 3308483 - RNA, 19 nt, Mycobacterium tuberculosis H37Rv
gccgagcugguuggcgccg

SEQ ID NO: 3308484 - RNA, 17 nt, Mycobacterium tuberculosis H37Rv
gccgauggugauggggg

SEQ ID NO: 3308485 - RNA, 20 nt, Mycobacterium tuberculosis H37Rv
gccgauguagacgguggcgc

SEQ ID NO: 3308486 - RNA, 19 nt, Mycobacterium tuberculosis H37Rv
gccgauguggccggcgaug

SEQ ID NO: 3308487 - RNA, 22 nt, Mycobacterium tuberculosis H37Rv
gccgauguggccggcgauggcc

SEQ ID NO: 3308488 - RNA, 19 nt, Mycobacterium tuberculosis H37Rv
gccgauguggucggcuguc

SEQ ID NO: 3308489 - RNA, 17 nt, Mycobacterium tuberculosis H37Rv
gccgauguuggcagggc

SEQ ID NO: 3308490 - RNA, 23 nt, Mycobacterium tuberculosis H37Rv
gccgauguuggcagggccagcgg

SEQ ID NO: 3308491 - RNA, 21 nt, Mycobacterium tuberculosis H37Rv
gccgauguuguugacgcccga

SEQ ID NO: 3308492 - RNA, 16 nt, Mycobacterium tuberculosis H37Rv
gccgauuacggugauc

SEQ ID NO: 3308493 - RNA, 17 nt, Mycobacterium tuberculosis H37Rv
gccgauuacggugaucg

SEQ ID NO: 3308494 - RNA, 18 nt, Mycobacterium tuberculosis H37Rv
gccgauuacggugaucgc

SEQ ID NO: 3308495 - RNA, 17 nt, Mycobacterium tuberculosis H37Rv
gccgauuccaccgccga

SEQ ID NO: 3308496 - RNA, 23 nt, Mycobacterium tuberculosis H37Rv
gccgauugcuucuucgggccgcu

SEQ ID NO: 3308497 - RNA, 14 nt, Mycobacterium tuberculosis H37Rv
gccgauuggccugc

SEQ ID NO: 3308498 - RNA, 16 nt, Mycobacterium tuberculosis H37Rv
gccgauuggccugcca

SEQ ID NO: 3308499 - RNA, 17 nt, Mycobacterium tuberculosis H37Rv
gccgcaaacgcggcguc

SEQ ID NO: 3308500 - RNA, 19 nt, Mycobacterium tuberculosis H37Rv
gccgcaacaugggugaugc

SEQ ID NO: 3308501 - RNA, 13 nt, Mycobacterium tuberculosis H37Rv
gccgcaaccaugu

SEQ ID NO: 3308502 - RNA, 16 nt, Mycobacterium tuberculosis H37Rv
gccgcaaccggcgauc

SEQ ID NO: 3308503 - RNA, 17 nt, Mycobacterium tuberculosis H37Rv
gccgcaaccggcgaucg

SEQ ID NO: 3308504 - RNA, 21 nt, Mycobacterium tuberculosis H37Rv
gccgcaagugucuccggcaac

SEQ ID NO: 3308505 - RNA, 18 nt, Mycobacterium tuberculosis H37Rv
gccgcaaugacgucgucg

SEQ ID NO: 3308506 - RNA, 20 nt, Mycobacterium tuberculosis H37Rv
gccgcaaugcguugaccgau

SEQ ID NO: 3308507 - RNA, 19 nt, Mycobacterium tuberculosis H37Rv
gccgcaauggaccgaacga

SEQ ID NO: 3308508 - RNA, 22 nt, Mycobacterium tuberculosis H37Rv
gccgcacaaacgggcgugggcc

SEQ ID NO: 3308509 - RNA, 12 nt, Mycobacterium tuberculosis H37Rv
gccgcacacucu

SEQ ID NO: 3308510 - RNA, 20 nt, Mycobacterium tuberculosis H37Rv
gccgcacacucucggugaac

SEQ ID NO: 3308511 - RNA, 17 nt, Mycobacterium tuberculosis H37Rv
gccgcacaugagcugga

SEQ ID NO: 3308512 - RNA, 20 nt, Mycobacterium tuberculosis H37Rv
gccgcaccaagcagcgacca

SEQ ID NO: 3308513 - RNA, 22 nt, Mycobacterium tuberculosis H37Rv
gccgcaccaagcagcgaccagc

SEQ ID NO: 3308514 - RNA, 13 nt, Mycobacterium tuberculosis H37Rv
gccgcaccaaggc

SEQ ID NO: 3308515 - RNA, 18 nt, Mycobacterium tuberculosis H37Rv
gccgcaccaaggccgccu

SEQ ID NO: 3308516 - RNA, 19 nt, Mycobacterium tuberculosis H37Rv
gccgcaccagaucgucggg

SEQ ID NO: 3308517 - RNA, 18 nt, Mycobacterium tuberculosis H37Rv
gccgcacccgaucgacgg

SEQ ID NO: 3308518 - RNA, 14 nt, Mycobacterium tuberculosis H37Rv
gccgcacccguugc

SEQ ID NO: 3308519 - RNA, 23 nt, Mycobacterium tuberculosis H37Rv
gccgcacccguugcucccacggc

SEQ ID NO: 3308520 - RNA, 22 nt, Mycobacterium tuberculosis H37Rv
gccgcaccgauuuccucugggc

SEQ ID NO: 3308521 - RNA, 14 nt, Mycobacterium tuberculosis H37Rv
gccgcaccgccacc

SEQ ID NO: 3308522 - RNA, 13 nt, Mycobacterium tuberculosis H37Rv
gccgcaccgccgc

SEQ ID NO: 3308523 - RNA, 13 nt, Mycobacterium tuberculosis H37Rv
gccgcaccgcugu

SEQ ID NO: 3308524 - RNA, 12 nt, Mycobacterium tuberculosis H37Rv
gccgcaccggug

SEQ ID NO: 3308525 - RNA, 14 nt, Mycobacterium tuberculosis H37Rv
gccgcaccggugcu

SEQ ID NO: 3308526 - RNA, 19 nt, Mycobacterium tuberculosis H37Rv
gccgcaccggugcucgucg

SEQ ID NO: 3308527 - RNA, 18 nt, Mycobacterium tuberculosis H37Rv
gccgcacgauagccgaaa

SEQ ID NO: 3308528 - RNA, 13 nt, Mycobacterium tuberculosis H37Rv
gccgcacgaugcc

SEQ ID NO: 3308529 - RNA, 19 nt, Mycobacterium tuberculosis H37Rv
gccgcacgaugccgggaac

SEQ ID NO: 3308530 - RNA, 20 nt, Mycobacterium tuberculosis H37Rv
gccgcacgaugccgggaacg

SEQ ID NO: 3308531 - RNA, 14 nt, Mycobacterium tuberculosis H37Rv
gccgcacgauggcc

SEQ ID NO: 3308532 - RNA, 19 nt, Mycobacterium tuberculosis H37Rv
gccgcacgauggccgucga

SEQ ID NO: 3308533 - RNA, 14 nt, Mycobacterium tuberculosis H37Rv
gccgcacgccgacc

SEQ ID NO: 3308534 - RNA, 17 nt, Mycobacterium tuberculosis H37Rv
gccgcacgccgaccagc

SEQ ID NO: 3308535 - RNA, 20 nt, Mycobacterium tuberculosis H37Rv
gccgcacgccgaccagcacc

SEQ ID NO: 3308536 - RNA, 22 nt, Mycobacterium tuberculosis H37Rv
gccgcacgccggcaugccagcc

SEQ ID NO: 3308537 - RNA, 18 nt, Mycobacterium tuberculosis H37Rv
gccgcacgcuagccgaca

SEQ ID NO: 3308538 - RNA, 16 nt, Mycobacterium tuberculosis H37Rv
gccgcacgggcgaccu

SEQ ID NO: 3308539 - RNA, 17 nt, Mycobacterium tuberculosis H37Rv
gccgcacgggcgaccug

SEQ ID NO: 3308540 - RNA, 13 nt, Mycobacterium tuberculosis H37Rv
gccgcacgucgac

SEQ ID NO: 3308541 - RNA, 17 nt, Mycobacterium tuberculosis H37Rv
gccgcacgucgaccucg

SEQ ID NO: 3308542 - RNA, 15 nt, Mycobacterium tuberculosis H37Rv
gccgcacuuucuucc

SEQ ID NO: 3308543 - RNA, 21 nt, Mycobacterium tuberculosis H37Rv
gccgcagaaucccaacuccuc

SEQ ID NO: 3308544 - RNA, 22 nt, Mycobacterium tuberculosis H37Rv
gccgcagaaucccaacuccucc

SEQ ID NO: 3308545 - RNA, 14 nt, Mycobacterium tuberculosis H37Rv
gccgcagacguccu

SEQ ID NO: 3308546 - RNA, 18 nt, Mycobacterium tuberculosis H37Rv
gccgcagaucaccgccag

SEQ ID NO: 3308547 - RNA, 12 nt, Mycobacterium tuberculosis H37Rv
gccgcagcaggg

SEQ ID NO: 3308548 - RNA, 19 nt, Mycobacterium tuberculosis H37Rv
gccgcagcaggugcaucgc

SEQ ID NO: 3308549 - RNA, 13 nt, Mycobacterium tuberculosis H37Rv
gccgcagccacgu

SEQ ID NO: 3308550 - RNA, 13 nt, Mycobacterium tuberculosis H37Rv
gccgcagccagca

SEQ ID NO: 3308551 - RNA, 19 nt, Mycobacterium tuberculosis H37Rv
gccgcagcccgugacuggu

SEQ ID NO: 3308552 - RNA, 21 nt, Mycobacterium tuberculosis H37Rv
gccgcagcccgugacugguga

SEQ ID NO: 3308553 - RNA, 24 nt, Mycobacterium tuberculosis H37Rv
gccgcagcgaaaacccggucggcg

SEQ ID NO: 3308554 - RNA, 16 nt, Mycobacterium tuberculosis H37Rv
gccgcagcggccagcc

SEQ ID NO: 3308555 - RNA, 20 nt, Mycobacterium tuberculosis H37Rv
gccgcagcggccagcccagc

SEQ ID NO: 3308556 - RNA, 13 nt, Mycobacterium tuberculosis H37Rv
gccgcagcggccu

SEQ ID NO: 3308557 - RNA, 12 nt, Mycobacterium tuberculosis H37Rv
gccgcagcggcg

SEQ ID NO: 3308558 - RNA, 18 nt, Mycobacterium tuberculosis H37Rv
gccgcagcggcggcaacc

SEQ ID NO: 3308559 - RNA, 19 nt, Mycobacterium tuberculosis H37Rv
gccgcagcuccccgaccga

SEQ ID NO: 3308560 - RNA, 19 nt, Mycobacterium tuberculosis H37Rv
gccgcagcuuggccucagc

SEQ ID NO: 3308561 - RNA, 22 nt, Mycobacterium tuberculosis H37Rv
gccgcaggugggcguuggcgac

SEQ ID NO: 3308562 - RNA, 16 nt, Mycobacterium tuberculosis H37Rv
gccgcaguacugguag

SEQ ID NO: 3308563 - RNA, 17 nt, Mycobacterium tuberculosis H37Rv
gccgcaguacugguaga

SEQ ID NO: 3308564 - RNA, 23 nt, Mycobacterium tuberculosis H37Rv
gccgcaguacugguagaggcggc

SEQ ID NO: 3308565 - RNA, 22 nt, Mycobacterium tuberculosis H37Rv
gccgcaguccgcacgcggcaau

SEQ ID NO: 3308566 - RNA, 17 nt, Mycobacterium tuberculosis H37Rv
gccgcaguucaucgaga

SEQ ID NO: 3308567 - RNA, 20 nt, Mycobacterium tuberculosis H37Rv
gccgcauaccaguaccguca

SEQ ID NO: 3308568 - RNA, 20 nt, Mycobacterium tuberculosis H37Rv
gccgcaucauagacagggcc

SEQ ID NO: 3308569 - RNA, 17 nt, Mycobacterium tuberculosis H37Rv
gccgcauccagccgugc

SEQ ID NO: 3308570 - RNA, 23 nt, Mycobacterium tuberculosis H37Rv
gccgcaucgacgcucaucucggg

SEQ ID NO: 3308571 - RNA, 19 nt, Mycobacterium tuberculosis H37Rv
gccgcaucgccucaccacg

SEQ ID NO: 3308572 - RNA, 15 nt, Mycobacterium tuberculosis H37Rv
gccgcaucggcgaac

SEQ ID NO: 3308573 - RNA, 22 nt, Mycobacterium tuberculosis H37Rv
gccgcaucgggcguacauucgg

SEQ ID NO: 3308574 - RNA, 13 nt, Mycobacterium tuberculosis H37Rv
gccgcaucgguca

SEQ ID NO: 3308575 - RNA, 23 nt, Mycobacterium tuberculosis H37Rv
gccgcaucgucgccgcgcagaaa

SEQ ID NO: 3308576 - RNA, 21 nt, Mycobacterium tuberculosis H37Rv
gccgcaucguuuucgccgauc

SEQ ID NO: 3308577 - RNA, 14 nt, Mycobacterium tuberculosis H37Rv
gccgcaugcucagc

SEQ ID NO: 3308578 - RNA, 14 nt, Mycobacterium tuberculosis H37Rv
gccgcauucgcgac

SEQ ID NO: 3308579 - RNA, 15 nt, Mycobacterium tuberculosis H37Rv
gccgcauucggcgau

SEQ ID NO: 3308580 - RNA, 16 nt, Mycobacterium tuberculosis H37Rv
gccgccggcgccgccg

SEQ ID NO: 3308581 - RNA, 17 nt, Mycobacterium tuberculosis H37Rv
gccgccggcgccgccgg

SEQ ID NO: 3308582 - RNA, 19 nt, Mycobacterium tuberculosis H37Rv
gccgccggcgccgccggca

SEQ ID NO: 3308583 - RNA, 22 nt, Mycobacterium tuberculosis H37Rv
gccgccggcgccggagccgccc

SEQ ID NO: 3308584 - RNA, 15 nt, Mycobacterium tuberculosis H37Rv
gccgccggcgccggc

SEQ ID NO: 3308585 - RNA, 20 nt, Mycobacterium tuberculosis H37Rv
gccgccggcgccggcgcugc

SEQ ID NO: 3308586 - RNA, 12 nt, Mycobacterium tuberculosis H37Rv
gccgccggcgcu

SEQ ID NO: 3308587 - RNA, 15 nt, Mycobacterium tuberculosis H37Rv
gccgccggcgcuggc

SEQ ID NO: 3308588 - RNA, 15 nt, Mycobacterium tuberculosis H37Rv
gccgccggcggcggu

SEQ ID NO: 3308589 - RNA, 15 nt, Mycobacterium tuberculosis H37Rv
gccgccggcuccgcc

SEQ ID NO: 3308590 - RNA, 16 nt, Mycobacterium tuberculosis H37Rv
gccgccggcuccgcca

SEQ ID NO: 3308591 - RNA, 21 nt, Mycobacterium tuberculosis H37Rv
gccgccgggaaauaucucggu

SEQ ID NO: 3308592 - RNA, 20 nt, Mycobacterium tuberculosis H37Rv
gccgccgggauaacccagca

SEQ ID NO: 3308593 - RNA, 15 nt, Mycobacterium tuberculosis H37Rv
gccgccgggggacga

SEQ ID NO: 3308594 - RNA, 21 nt, Mycobacterium tuberculosis H37Rv
gccgccggguccuugcggccg

SEQ ID NO: 3308595 - RNA, 17 nt, Mycobacterium tuberculosis H37Rv
gccgccgggugcgccgu

SEQ ID NO: 3308596 - RNA, 11 nt, Mycobacterium tuberculosis H37Rv
gccgccgguca

SEQ ID NO: 3308597 - RNA, 19 nt, Mycobacterium tuberculosis H37Rv
gccgccggucaucccaagc

SEQ ID NO: 3308598 - RNA, 23 nt, Mycobacterium tuberculosis H37Rv
gccgccgguccccucggugccac

SEQ ID NO: 3308599 - RNA, 19 nt, Mycobacterium tuberculosis H37Rv
gccgccggugaggaucagc

SEQ ID NO: 3308600 - RNA, 15 nt, Mycobacterium tuberculosis H37Rv
gccgccggugccacc

SEQ ID NO: 3308601 - RNA, 16 nt, Mycobacterium tuberculosis H37Rv
gccgccggugccaccc

SEQ ID NO: 3308602 - RNA, 20 nt, Mycobacterium tuberculosis H37Rv
gccgccggugccaccgacgc

SEQ ID NO: 3308603 - RNA, 17 nt, Mycobacterium tuberculosis H37Rv
gccgccggugccgauca

SEQ ID NO: 3308604 - RNA, 14 nt, Mycobacterium tuberculosis H37Rv
gccgccggugccgc

SEQ ID NO: 3308605 - RNA, 16 nt, Mycobacterium tuberculosis H37Rv
gccgccggugccgcca

SEQ ID NO: 3308606 - RNA, 16 nt, Mycobacterium tuberculosis H37Rv
gccgccggugccgccc

SEQ ID NO: 3308607 - RNA, 17 nt, Mycobacterium tuberculosis H37Rv
gccgccggugccgccgg

SEQ ID NO: 3308608 - RNA, 16 nt, Mycobacterium tuberculosis H37Rv
gccgccggugccgccu

SEQ ID NO: 3308609 - RNA, 20 nt, Mycobacterium tuberculosis H37Rv
gccgccggugccgccugcgc

SEQ ID NO: 3308610 - RNA, 19 nt, Mycobacterium tuberculosis H37Rv
gccgccgguguaacccucg

SEQ ID NO: 3308611 - RNA, 16 nt, Mycobacterium tuberculosis H37Rv
gccgccggugucgggc

SEQ ID NO: 3308612 - RNA, 14 nt, Mycobacterium tuberculosis H37Rv
gccgccgguuccgc

SEQ ID NO: 3308613 - RNA, 18 nt, Mycobacterium tuberculosis H37Rv
gccgccgguuccgccggc

SEQ ID NO: 3308614 - RNA, 19 nt, Mycobacterium tuberculosis H37Rv
gccgccgguuccgccggcc

SEQ ID NO: 3308615 - RNA, 22 nt, Mycobacterium tuberculosis H37Rv
gccgccgguuccgccggcccca

SEQ ID NO: 3308616 - RNA, 17 nt, Mycobacterium tuberculosis H37Rv
gccgccgucaccgccga

SEQ ID NO: 3308617 - RNA, 23 nt, Mycobacterium tuberculosis H37Rv
gccgccgucaccgccguugccga

SEQ ID NO: 3308618 - RNA, 16 nt, Mycobacterium tuberculosis H37Rv
gccgccguccagcgcc

SEQ ID NO: 3308619 - RNA, 14 nt, Mycobacterium tuberculosis H37Rv
gccgccgucgauga

SEQ ID NO: 3308620 - RNA, 12 nt, Mycobacterium tuberculosis H37Rv
gccgccgucgcc

SEQ ID NO: 3308621 - RNA, 21 nt, Mycobacterium tuberculosis H37Rv
gccgccgucgccacgcccagc

SEQ ID NO: 3308622 - RNA, 14 nt, Mycobacterium tuberculosis H37Rv
gccgccgucgccgc

SEQ ID NO: 3308623 - RNA, 13 nt, Mycobacterium tuberculosis H37Rv
gccgccgucgucg

SEQ ID NO: 3308624 - RNA, 23 nt, Mycobacterium tuberculosis H37Rv
gccgccgucgucgucggcagcgu

SEQ ID NO: 3308625 - RNA, 21 nt, Mycobacterium tuberculosis H37Rv
gccgccguggcgucggcguca

SEQ ID NO: 3308626 - RNA, 15 nt, Mycobacterium tuberculosis H37Rv
gccgccguggugauc

SEQ ID NO: 3308627 - RNA, 14 nt, Mycobacterium tuberculosis H37Rv
gccgccgugguugc

SEQ ID NO: 3308628 - RNA, 19 nt, Mycobacterium tuberculosis H37Rv
gccgccguuaccgagcccg

SEQ ID NO: 3308629 - RNA, 18 nt, Mycobacterium tuberculosis H37Rv
gccgccguuaccgccggc

SEQ ID NO: 3308630 - RNA, 23 nt, Mycobacterium tuberculosis H37Rv
gccgccguuaccgccguugccga

SEQ ID NO: 3308631 - RNA, 19 nt, Mycobacterium tuberculosis H37Rv
gccgccguucccgccggcc

SEQ ID NO: 3308632 - RNA, 20 nt, Mycobacterium tuberculosis H37Rv
gccgccguucccgccggccc

SEQ ID NO: 3308633 - RNA, 16 nt, Mycobacterium tuberculosis H37Rv
gccgccguugccaccg

SEQ ID NO: 3308634 - RNA, 17 nt, Mycobacterium tuberculosis H37Rv
gccgccguugccaccgu

SEQ ID NO: 3308635 - RNA, 23 nt, Mycobacterium tuberculosis H37Rv
gccgccguugccaccguagccga

SEQ ID NO: 3308636 - RNA, 17 nt, Mycobacterium tuberculosis H37Rv
gccgccguugccgauca

SEQ ID NO: 3308637 - RNA, 15 nt, Mycobacterium tuberculosis H37Rv
gccgccguugccgcc

SEQ ID NO: 3308638 - RNA, 16 nt, Mycobacterium tuberculosis H37Rv
gccgccguugccgcca

SEQ ID NO: 3308639 - RNA, 17 nt, Mycobacterium tuberculosis H37Rv
gccgccguugccgccau

SEQ ID NO: 3308640 - RNA, 20 nt, Mycobacterium tuberculosis H37Rv
gccgccguugccgccaucac

SEQ ID NO: 3308641 - RNA, 16 nt, Mycobacterium tuberculosis H37Rv
gccgccguugccgccg

SEQ ID NO: 3308642 - RNA, 17 nt, Mycobacterium tuberculosis H37Rv
gccgccguugccgccga

SEQ ID NO: 3308643 - RNA, 18 nt, Mycobacterium tuberculosis H37Rv
gccgccguugccgccgaa

SEQ ID NO: 3308644 - RNA, 17 nt, Mycobacterium tuberculosis H37Rv
gccgccguugccgccgg

SEQ ID NO: 3308645 - RNA, 19 nt, Mycobacterium tuberculosis H37Rv
gccgccguugccgccggcg

SEQ ID NO: 3308646 - RNA, 16 nt, Mycobacterium tuberculosis H37Rv
gccgccguugccggcu

SEQ ID NO: 3308647 - RNA, 14 nt, Mycobacterium tuberculosis H37Rv
gccgccguugccgu

SEQ ID NO: 3308648 - RNA, 21 nt, Mycobacterium tuberculosis H37Rv
gccgccguuggcaccgggugc

SEQ ID NO: 3308649 - RNA, 16 nt, Mycobacterium tuberculosis H37Rv
gccgccguuuccugcg

SEQ ID NO: 3308650 - RNA, 18 nt, Mycobacterium tuberculosis H37Rv
gccgccucaaugaccacc

SEQ ID NO: 3308651 - RNA, 22 nt, Mycobacterium tuberculosis H37Rv
gccgccuccgccgaggccgccg

SEQ ID NO: 3308652 - RNA, 14 nt, Mycobacterium tuberculosis H37Rv
gccgccuccgccug

SEQ ID NO: 3308653 - RNA, 18 nt, Mycobacterium tuberculosis H37Rv
gccgccuccgccugcccc

SEQ ID NO: 3308654 - RNA, 16 nt, Mycobacterium tuberculosis H37Rv
gccgccuccgcggcau

SEQ ID NO: 3308655 - RNA, 16 nt, Mycobacterium tuberculosis H37Rv
gccgccucgggcaccu

SEQ ID NO: 3308656 - RNA, 17 nt, Mycobacterium tuberculosis H37Rv
gccgccugcgccgccag

SEQ ID NO: 3308657 - RNA, 20 nt, Mycobacterium tuberculosis H37Rv
gccgccugcgccgccagcgc

SEQ ID NO: 3308658 - RNA, 20 nt, Mycobacterium tuberculosis H37Rv
gccgccugcuccucggccag

SEQ ID NO: 3308659 - RNA, 21 nt, Mycobacterium tuberculosis H37Rv
gccgccugcuccucggccagc

SEQ ID NO: 3308660 - RNA, 23 nt, Mycobacterium tuberculosis H37Rv
gccgccugcuccucggccagcgu

SEQ ID NO: 3308661 - RNA, 21 nt, Mycobacterium tuberculosis H37Rv
gccgccugcuggagcagcuac

SEQ ID NO: 3308662 - RNA, 22 nt, Mycobacterium tuberculosis H37Rv
gccgccuggagcuguggcgggc

SEQ ID NO: 3308663 - RNA, 22 nt, Mycobacterium tuberculosis H37Rv
gccgccuuccuggcgggcgccu

SEQ ID NO: 3308664 - RNA, 14 nt, Mycobacterium tuberculosis H37Rv
gccgccuucgccgc

SEQ ID NO: 3308665 - RNA, 17 nt, Mycobacterium tuberculosis H37Rv
gccgccuucgccgccgc

SEQ ID NO: 3308666 - RNA, 15 nt, Mycobacterium tuberculosis H37Rv
gccgccuucucgcga

SEQ ID NO: 3308667 - RNA, 17 nt, Mycobacterium tuberculosis H37Rv
gccgccuucucgcgaag

SEQ ID NO: 3308668 - RNA, 22 nt, Mycobacterium tuberculosis H37Rv
gccgccuucuucucggcgagcu

SEQ ID NO: 3308669 - RNA, 17 nt, Mycobacterium tuberculosis H37Rv
gccgccuucuuggcggc

SEQ ID NO: 3308670 - RNA, 21 nt, Mycobacterium tuberculosis H37Rv
gccgccuugaggcccugcggc

SEQ ID NO: 3308671 - RNA, 14 nt, Mycobacterium tuberculosis H37Rv
gccgccuuggucgc

SEQ ID NO: 3308672 - RNA, 17 nt, Mycobacterium tuberculosis H37Rv
gccgcgaaacccugaaa

SEQ ID NO: 3308673 - RNA, 22 nt, Mycobacterium tuberculosis H37Rv
gccgcgaaacccugaaaagggc

SEQ ID NO: 3308674 - RNA, 23 nt, Mycobacterium tuberculosis H37Rv
gccgcgaaauuacuucggccaca

SEQ ID NO: 3308675 - RNA, 23 nt, Mycobacterium tuberculosis H37Rv
gccgcgaaggggugcccggcggc

SEQ ID NO: 3308676 - RNA, 17 nt, Mycobacterium tuberculosis H37Rv
gccgcggcacccggcuu

SEQ ID NO: 3308677 - RNA, 18 nt, Mycobacterium tuberculosis H37Rv
gccgcggcaccgccccgc

SEQ ID NO: 3308678 - RNA, 20 nt, Mycobacterium tuberculosis H37Rv
gccgcggcagcauccucgac

SEQ ID NO: 3308679 - RNA, 21 nt, Mycobacterium tuberculosis H37Rv
gccgcggcagggcggugccau

SEQ ID NO: 3308680 - RNA, 23 nt, Mycobacterium tuberculosis H37Rv
gccgcggccacaucgccagcagc

SEQ ID NO: 3308681 - RNA, 12 nt, Mycobacterium tuberculosis H37Rv
gccgcggccacc

SEQ ID NO: 3308682 - RNA, 13 nt, Mycobacterium tuberculosis H37Rv
gccgcggccaccg

SEQ ID NO: 3308683 - RNA, 19 nt, Mycobacterium tuberculosis H37Rv
gccgcggccaguacgucga

SEQ ID NO: 3308684 - RNA, 21 nt, Mycobacterium tuberculosis H37Rv
gccgcggcccgcucgaucggc

SEQ ID NO: 3308685 - RNA, 13 nt, Mycobacterium tuberculosis H37Rv
gccgcggccgccg

SEQ ID NO: 3308686 - RNA, 14 nt, Mycobacterium tuberculosis H37Rv
gccgcggccgccgu

SEQ ID NO: 3308687 - RNA, 12 nt, Mycobacterium tuberculosis H37Rv
gccgcggcgcca

SEQ ID NO: 3308688 - RNA, 15 nt, Mycobacterium tuberculosis H37Rv
gccgcggcgcccggc

SEQ ID NO: 3308689 - RNA, 17 nt, Mycobacterium tuberculosis H37Rv
gccgcggcgcgacggca

SEQ ID NO: 3308690 - RNA, 11 nt, Mycobacterium tuberculosis H37Rv
gccgcggcggc

SEQ ID NO: 3308691 - RNA, 16 nt, Mycobacterium tuberculosis H37Rv
gccgcggcggcagcac

SEQ ID NO: 3308692 - RNA, 14 nt, Mycobacterium tuberculosis H37Rv
gccgcggcggccag

SEQ ID NO: 3308693 - RNA, 15 nt, Mycobacterium tuberculosis H37Rv
gccgcggcggccagc

SEQ ID NO: 3308694 - RNA, 11 nt, Mycobacterium tuberculosis H37Rv
gccgcggcggu

SEQ ID NO: 3308695 - RNA, 14 nt, Mycobacterium tuberculosis H37Rv
gccgcggcggucug

SEQ ID NO: 3308696 - RNA, 23 nt, Mycobacterium tuberculosis H37Rv
gccgcggcuggugucgggcguca

SEQ ID NO: 3308697 - RNA, 20 nt, Mycobacterium tuberculosis H37Rv
gccgcggcuugucgccccau

SEQ ID NO: 3308698 - RNA, 17 nt, Mycobacterium tuberculosis H37Rv
gccgcgggacaccaccg

SEQ ID NO: 3308699 - RNA, 22 nt, Mycobacterium tuberculosis H37Rv
gccgcgggacaccaccgcccgc

SEQ ID NO: 3308700 - RNA, 13 nt, Mycobacterium tuberculosis H37Rv
gccgcgggcgccg

SEQ ID NO: 3308701 - RNA, 19 nt, Mycobacterium tuberculosis H37Rv
gccgcgggcgccgguuacc

SEQ ID NO: 3308702 - RNA, 12 nt, Mycobacterium tuberculosis H37Rv
gccgcgggcgcg

SEQ ID NO: 3308703 - RNA, 14 nt, Mycobacterium tuberculosis H37Rv
gccgcgggcgcggc

SEQ ID NO: 3308704 - RNA, 14 nt, Mycobacterium tuberculosis H37Rv
gccgcggggcaucg

SEQ ID NO: 3308705 - RNA, 15 nt, Mycobacterium tuberculosis H37Rv
gccgcgggucccggc

SEQ ID NO: 3308706 - RNA, 15 nt, Mycobacterium tuberculosis H37Rv
gccgcgggugcggca

SEQ ID NO: 3308707 - RNA, 17 nt, Mycobacterium tuberculosis H37Rv
gccgcgggugcggcaug

SEQ ID NO: 3308708 - RNA, 17 nt, Mycobacterium tuberculosis H37Rv
gccgcgguaggugcaug

SEQ ID NO: 3308709 - RNA, 17 nt, Mycobacterium tuberculosis H37Rv
gccgcggucggaccacc

SEQ ID NO: 3308710 - RNA, 14 nt, Mycobacterium tuberculosis H37Rv
gccgcggucggcca

SEQ ID NO: 3308711 - RNA, 15 nt, Mycobacterium tuberculosis H37Rv
gccgcggucggccac

SEQ ID NO: 3308712 - RNA, 16 nt, Mycobacterium tuberculosis H37Rv
gccgcggucggccacc

SEQ ID NO: 3308713 - RNA, 16 nt, Mycobacterium tuberculosis H37Rv
gccgcggucggcgacg

SEQ ID NO: 3308714 - RNA, 15 nt, Mycobacterium tuberculosis H37Rv
gccgcggucggcgug

SEQ ID NO: 3308715 - RNA, 17 nt, Mycobacterium tuberculosis H37Rv
gccgcggucggcgugca

SEQ ID NO: 3308716 - RNA, 19 nt, Mycobacterium tuberculosis H37Rv
gccgcggucggcgugcagg

SEQ ID NO: 3308717 - RNA, 20 nt, Mycobacterium tuberculosis H37Rv
gccgcggucggcgugcaggg

SEQ ID NO: 3308718 - RNA, 18 nt, Mycobacterium tuberculosis H37Rv
gccgcggucgugaucagc

SEQ ID NO: 3308719 - RNA, 21 nt, Mycobacterium tuberculosis H37Rv
gccgcggucgugaucagcagg

SEQ ID NO: 3308720 - RNA, 18 nt, Mycobacterium tuberculosis H37Rv
gccgcggugacggcggcu

SEQ ID NO: 3308721 - RNA, 21 nt, Mycobacterium tuberculosis H37Rv
gccgcggugaugggccaggcg

SEQ ID NO: 3308722 - RNA, 15 nt, Mycobacterium tuberculosis H37Rv
gccgcggugauugac

SEQ ID NO: 3308723 - RNA, 22 nt, Mycobacterium tuberculosis H37Rv
gccgcgguggaugcgaugcgcg

SEQ ID NO: 3308724 - RNA, 22 nt, Mycobacterium tuberculosis H37Rv
gccgcgguguauccgacgucgg

SEQ ID NO: 3308725 - RNA, 18 nt, Mycobacterium tuberculosis H37Rv
gccgcgguugugcugggu

SEQ ID NO: 3308726 - RNA, 17 nt, Mycobacterium tuberculosis H37Rv
gccgcguaaaccggcug

SEQ ID NO: 3308727 - RNA, 20 nt, Mycobacterium tuberculosis H37Rv
gccgcguaaaccggcugacc

SEQ ID NO: 3308728 - RNA, 22 nt, Mycobacterium tuberculosis H37Rv
gccgcguaggccuugcucagcc

SEQ ID NO: 3308729 - RNA, 21 nt, Mycobacterium tuberculosis H37Rv
gccgcguagugcuccguccga

SEQ ID NO: 3308730 - RNA, 13 nt, Mycobacterium tuberculosis H37Rv
gccgcgucaaccg

SEQ ID NO: 3308731 - RNA, 15 nt, Mycobacterium tuberculosis H37Rv
gccgcgucgagcacc

SEQ ID NO: 3308732 - RNA, 19 nt, Mycobacterium tuberculosis H37Rv
gccgcgucgagcaccuugg

SEQ ID NO: 3308733 - RNA, 21 nt, Mycobacterium tuberculosis H37Rv
gccgcgucgaucugugguugc

SEQ ID NO: 3308734 - RNA, 15 nt, Mycobacterium tuberculosis H37Rv
gccgcgucggccgcg

SEQ ID NO: 3308735 - RNA, 16 nt, Mycobacterium tuberculosis H37Rv
gccgcgucggccgcgc

SEQ ID NO: 3308736 - RNA, 16 nt, Mycobacterium tuberculosis H37Rv
gccgcgucucggugca

SEQ ID NO: 3308737 - RNA, 21 nt, Mycobacterium tuberculosis H37Rv
gccgcgucucggugcagcagc

SEQ ID NO: 3308738 - RNA, 22 nt, Mycobacterium tuberculosis H37Rv
gccgcgucucggugcagcagcg

SEQ ID NO: 3308739 - RNA, 13 nt, Mycobacterium tuberculosis H37Rv
gccgcgugcagcc

SEQ ID NO: 3308740 - RNA, 14 nt, Mycobacterium tuberculosis H37Rv
gccgcgugccgccc

SEQ ID NO: 3308741 - RNA, 16 nt, Mycobacterium tuberculosis H37Rv
gccgcgugccgcccgc

SEQ ID NO: 3308742 - RNA, 13 nt, Mycobacterium tuberculosis H37Rv
gccgcgugcucgc

SEQ ID NO: 3308743 - RNA, 15 nt, Mycobacterium tuberculosis H37Rv
gccgcgugcucgccg

SEQ ID NO: 3308744 - RNA, 16 nt, Mycobacterium tuberculosis H37Rv
gccgcgugcucgccgu

SEQ ID NO: 3308745 - RNA, 16 nt, Mycobacterium tuberculosis H37Rv
gccgcgugcugcggcu

SEQ ID NO: 3308746 - RNA, 17 nt, Mycobacterium tuberculosis H37Rv
gccgcguggcuggcggc

SEQ ID NO: 3308747 - RNA, 20 nt, Mycobacterium tuberculosis H37Rv
gccgcguggcuggcggcgac

SEQ ID NO: 3308748 - RNA, 23 nt, Mycobacterium tuberculosis H37Rv
gccgcguucacgcaauuggccgu

SEQ ID NO: 3308749 - RNA, 11 nt, Mycobacterium tuberculosis H37Rv
gccgcguucgc

SEQ ID NO: 3308750 - RNA, 23 nt, Mycobacterium tuberculosis H37Rv
gccgcguucgcgcaaaugccugc

SEQ ID NO: 3308751 - RNA, 18 nt, Mycobacterium tuberculosis H37Rv
gccgcguucguggaucuc

SEQ ID NO: 3308752 - RNA, 17 nt, Mycobacterium tuberculosis H37Rv
gccgcguugccggucgc

SEQ ID NO: 3308753 - RNA, 21 nt, Mycobacterium tuberculosis H37Rv
gccgcguugccggucgcaugg

SEQ ID NO: 3308754 - RNA, 20 nt, Mycobacterium tuberculosis H37Rv
gccgcguuuauaccucgccg

SEQ ID NO: 3308755 - RNA, 18 nt, Mycobacterium tuberculosis H37Rv
gccgcguuucccggaaua

SEQ ID NO: 3308756 - RNA, 16 nt, Mycobacterium tuberculosis H37Rv
gccgcuaacgcaccug

SEQ ID NO: 3308757 - RNA, 19 nt, Mycobacterium tuberculosis H37Rv
gccgcuacccccgauggcg

SEQ ID NO: 3308758 - RNA, 18 nt, Mycobacterium tuberculosis H37Rv
gccgcuaccgaacaguag

SEQ ID NO: 3308759 - RNA, 19 nt, Mycobacterium tuberculosis H37Rv
gccgcuaccgcccgcgcca

SEQ ID NO: 3308760 - RNA, 21 nt, Mycobacterium tuberculosis H37Rv
gccgcuaccgcccgcgccacc

SEQ ID NO: 3308761 - RNA, 13 nt, Mycobacterium tuberculosis H37Rv
gccgcuaccguca

SEQ ID NO: 3308762 - RNA, 20 nt, Mycobacterium tuberculosis H37Rv
gccgcuaggacggcgcgagc

SEQ ID NO: 3308763 - RNA, 23 nt, Mycobacterium tuberculosis H37Rv
gccgcuaucgaggaggcggucga

SEQ ID NO: 3308764 - RNA, 23 nt, Mycobacterium tuberculosis H37Rv
gccgcucacauacagcaggccgc

SEQ ID NO: 3308765 - RNA, 13 nt, Mycobacterium tuberculosis H37Rv
gccgcucaccccg

SEQ ID NO: 3308766 - RNA, 13 nt, Mycobacterium tuberculosis H37Rv
gccgcucauccag

SEQ ID NO: 3308767 - RNA, 14 nt, Mycobacterium tuberculosis H37Rv
gccgcucauccagc

SEQ ID NO: 3308768 - RNA, 18 nt, Mycobacterium tuberculosis H37Rv
gccgcucauccagcgcgu

SEQ ID NO: 3308769 - RNA, 23 nt, Mycobacterium tuberculosis H37Rv
gccgcuccacguacgcggcugcg

SEQ ID NO: 3308770 - RNA, 13 nt, Mycobacterium tuberculosis H37Rv
gccgcuccaugac

SEQ ID NO: 3308771 - RNA, 23 nt, Mycobacterium tuberculosis H37Rv
gccgcucccucuacacccggacu

SEQ ID NO: 3308772 - RNA, 17 nt, Mycobacterium tuberculosis H37Rv
gccggagucgacgacgu

SEQ ID NO: 3308773 - RNA, 20 nt, Mycobacterium tuberculosis H37Rv
gccggagucggggggccgga

SEQ ID NO: 3308774 - RNA, 13 nt, Mycobacterium tuberculosis H37Rv
gccggaguuccgc

SEQ ID NO: 3308775 - RNA, 21 nt, Mycobacterium tuberculosis H37Rv
gccggaguugaagaagcccga

SEQ ID NO: 3308776 - RNA, 24 nt, Mycobacterium tuberculosis H37Rv
gccggaguugaagaagcccgacga

SEQ ID NO: 3308777 - RNA, 19 nt, Mycobacterium tuberculosis H37Rv
gccggauacggcgacaccc

SEQ ID NO: 3308778 - RNA, 15 nt, Mycobacterium tuberculosis H37Rv
gccggauagcaccgg

SEQ ID NO: 3308779 - RNA, 17 nt, Mycobacterium tuberculosis H37Rv
gccggauagcaccggca

SEQ ID NO: 3308780 - RNA, 17 nt, Mycobacterium tuberculosis H37Rv
gccggauagcgcagcuc

SEQ ID NO: 3308781 - RNA, 14 nt, Mycobacterium tuberculosis H37Rv
gccggauaggucgg

SEQ ID NO: 3308782 - RNA, 19 nt, Mycobacterium tuberculosis H37Rv
gccggauaggucgggcaug

SEQ ID NO: 3308783 - RNA, 22 nt, Mycobacterium tuberculosis H37Rv
gccggaucccugugccagcagc

SEQ ID NO: 3308784 - RNA, 15 nt, Mycobacterium tuberculosis H37Rv
gccggauccgauccg

SEQ ID NO: 3308785 - RNA, 16 nt, Mycobacterium tuberculosis H37Rv
gccggauccgauccgc

SEQ ID NO: 3308786 - RNA, 18 nt, Mycobacterium tuberculosis H37Rv
gccggaucgaaacucagc

SEQ ID NO: 3308787 - RNA, 17 nt, Mycobacterium tuberculosis H37Rv
gccggaucgacguucgg

SEQ ID NO: 3308788 - RNA, 18 nt, Mycobacterium tuberculosis H37Rv
gccggaucgacguucggg

SEQ ID NO: 3308789 - RNA, 19 nt, Mycobacterium tuberculosis H37Rv
gccggaucucccguuuggc

SEQ ID NO: 3308790 - RNA, 17 nt, Mycobacterium tuberculosis H37Rv
gccggaugacaccgacc

SEQ ID NO: 3308791 - RNA, 21 nt, Mycobacterium tuberculosis H37Rv
gccggaugacaccgaccgggu

SEQ ID NO: 3308792 - RNA, 16 nt, Mycobacterium tuberculosis H37Rv
gccggaugagcgaacg

SEQ ID NO: 3308793 - RNA, 13 nt, Mycobacterium tuberculosis H37Rv
gccggaugcccgg

SEQ ID NO: 3308794 - RNA, 17 nt, Mycobacterium tuberculosis H37Rv
gccggauggguggccag

SEQ ID NO: 3308795 - RNA, 20 nt, Mycobacterium tuberculosis H37Rv
gccggaugucgacgagcacc

SEQ ID NO: 3308796 - RNA, 21 nt, Mycobacterium tuberculosis H37Rv
gccggaugucgacgagcaccg

SEQ ID NO: 3308797 - RNA, 16 nt, Mycobacterium tuberculosis H37Rv
gccggauucggcugcc

SEQ ID NO: 3308798 - RNA, 20 nt, Mycobacterium tuberculosis H37Rv
gccggauucggcugccaccg

SEQ ID NO: 3308799 - RNA, 22 nt, Mycobacterium tuberculosis H37Rv
gccggcaaaggacgucgaccug

SEQ ID NO: 3308800 - RNA, 23 nt, Mycobacterium tuberculosis H37Rv
gccggcaaaggacgucgaccugu

SEQ ID NO: 3308801 - RNA, 17 nt, Mycobacterium tuberculosis H37Rv
gccggcaacagcucgcc

SEQ ID NO: 3308802 - RNA, 16 nt, Mycobacterium tuberculosis H37Rv
gccggcaacaucgagc

SEQ ID NO: 3308803 - RNA, 17 nt, Mycobacterium tuberculosis H37Rv
gccggcaacaucgagcg

SEQ ID NO: 3308804 - RNA, 23 nt, Mycobacterium tuberculosis H37Rv
gccggcaacaucgagcgccagcc

SEQ ID NO: 3308805 - RNA, 22 nt, Mycobacterium tuberculosis H37Rv
gccggcaaccgggaggccaccg

SEQ ID NO: 3308806 - RNA, 16 nt, Mycobacterium tuberculosis H37Rv
gccggcaacggcgcgc

SEQ ID NO: 3308807 - RNA, 18 nt, Mycobacterium tuberculosis H37Rv
gccggcaacggcgcgccg

SEQ ID NO: 3308808 - RNA, 16 nt, Mycobacterium tuberculosis H37Rv
gccggcaagaccgaac

SEQ ID NO: 3308809 - RNA, 21 nt, Mycobacterium tuberculosis H37Rv
gccggcaagaccgaacagcgg

SEQ ID NO: 3308810 - RNA, 22 nt, Mycobacterium tuberculosis H37Rv
gccggcaagaccgaacagcggc

SEQ ID NO: 3308811 - RNA, 13 nt, Mycobacterium tuberculosis H37Rv
gccggcaagcagu

SEQ ID NO: 3308812 - RNA, 21 nt, Mycobacterium tuberculosis H37Rv
gccggcaauaccgccagcgcc

SEQ ID NO: 3308813 - RNA, 23 nt, Mycobacterium tuberculosis H37Rv
gccggcaauaccgccagcgccac

SEQ ID NO: 3308814 - RNA, 18 nt, Mycobacterium tuberculosis H37Rv
gccggcacauugaucgac

SEQ ID NO: 3308815 - RNA, 13 nt, Mycobacterium tuberculosis H37Rv
gccggcaccaccg

SEQ ID NO: 3308816 - RNA, 16 nt, Mycobacterium tuberculosis H37Rv
gccggcaccaccguug

SEQ ID NO: 3308817 - RNA, 17 nt, Mycobacterium tuberculosis H37Rv
gccggcacccaccagug

SEQ ID NO: 3308818 - RNA, 16 nt, Mycobacterium tuberculosis H37Rv
gccggcaccccacggc

SEQ ID NO: 3308819 - RNA, 20 nt, Mycobacterium tuberculosis H37Rv
gccggcacccgucgggugcu

SEQ ID NO: 3308820 - RNA, 21 nt, Mycobacterium tuberculosis H37Rv
gccggcaccgccagugcccgc

SEQ ID NO: 3308821 - RNA, 17 nt, Mycobacterium tuberculosis H37Rv
gccggcaccgccgcccc

SEQ ID NO: 3308822 - RNA, 14 nt, Mycobacterium tuberculosis H37Rv
gccggcaccgccgg

SEQ ID NO: 3308823 - RNA, 15 nt, Mycobacterium tuberculosis H37Rv
gccggcaccgccggc

SEQ ID NO: 3308824 - RNA, 16 nt, Mycobacterium tuberculosis H37Rv
gccggcaccgccggcg

SEQ ID NO: 3308825 - RNA, 20 nt, Mycobacterium tuberculosis H37Rv
gccggcaccgccggcgccgc

SEQ ID NO: 3308826 - RNA, 14 nt, Mycobacterium tuberculosis H37Rv
gccggcaccuccgg

SEQ ID NO: 3308827 - RNA, 16 nt, Mycobacterium tuberculosis H37Rv
gccggcaccuccggca

SEQ ID NO: 3308828 - RNA, 19 nt, Mycobacterium tuberculosis H37Rv
gccggcaccuccggcaccg

SEQ ID NO: 3308829 - RNA, 21 nt, Mycobacterium tuberculosis H37Rv
gccggcaccuccggcaccgcc

SEQ ID NO: 3308830 - RNA, 15 nt, Mycobacterium tuberculosis H37Rv
gccggcacggugaac

SEQ ID NO: 3308831 - RNA, 16 nt, Mycobacterium tuberculosis H37Rv
gccggcagcagcgggc

SEQ ID NO: 3308832 - RNA, 21 nt, Mycobacterium tuberculosis H37Rv
gccggcagcaucggcaccccg

SEQ ID NO: 3308833 - RNA, 15 nt, Mycobacterium tuberculosis H37Rv
gccggcagcggcgag

SEQ ID NO: 3308834 - RNA, 16 nt, Mycobacterium tuberculosis H37Rv
gccggcagcggcgcgc

SEQ ID NO: 3308835 - RNA, 15 nt, Mycobacterium tuberculosis H37Rv
gccggcagcgucggc

SEQ ID NO: 3308836 - RNA, 14 nt, Mycobacterium tuberculosis H37Rv
gccggcagugaguc

SEQ ID NO: 3308837 - RNA, 17 nt, Mycobacterium tuberculosis H37Rv
gccggcauacaccguga

SEQ ID NO: 3308838 - RNA, 17 nt, Mycobacterium tuberculosis H37Rv
gccggcaucgacguagc

SEQ ID NO: 3308839 - RNA, 15 nt, Mycobacterium tuberculosis H37Rv
gccggcaucgcgcaa

SEQ ID NO: 3308840 - RNA, 18 nt, Mycobacterium tuberculosis H37Rv
gccggcaucgcgcaaccg

SEQ ID NO: 3308841 - RNA, 18 nt, Mycobacterium tuberculosis H37Rv
gccggcaucgcgcgcggc

SEQ ID NO: 3308842 - RNA, 20 nt, Mycobacterium tuberculosis H37Rv
gccggcaucggucagcgcgg

SEQ ID NO: 3308843 - RNA, 14 nt, Mycobacterium tuberculosis H37Rv
gccggcaucgucga

SEQ ID NO: 3308844 - RNA, 15 nt, Mycobacterium tuberculosis H37Rv
gccggcaucgucgac

SEQ ID NO: 3308845 - RNA, 16 nt, Mycobacterium tuberculosis H37Rv
gccggcaucgucgacg

SEQ ID NO: 3308846 - RNA, 15 nt, Mycobacterium tuberculosis H37Rv
gccggcaucuccacc

SEQ ID NO: 3308847 - RNA, 16 nt, Mycobacterium tuberculosis H37Rv
gccggcaucuccaccg

SEQ ID NO: 3308848 - RNA, 14 nt, Mycobacterium tuberculosis H37Rv
gccggcaugccagc

SEQ ID NO: 3308849 - RNA, 16 nt, Mycobacterium tuberculosis H37Rv
gccggcauggcggcau

SEQ ID NO: 3308850 - RNA, 21 nt, Mycobacterium tuberculosis H37Rv
gccggcauugacccauccggc

SEQ ID NO: 3308851 - RNA, 14 nt, Mycobacterium tuberculosis H37Rv
gccggccaacuggg

SEQ ID NO: 3308852 - RNA, 19 nt, Mycobacterium tuberculosis H37Rv
gccggccaacugggccgag

SEQ ID NO: 3308853 - RNA, 13 nt, Mycobacterium tuberculosis H37Rv
gccggccaacuuc

SEQ ID NO: 3308854 - RNA, 17 nt, Mycobacterium tuberculosis H37Rv
gccggccaagaccgcgg

SEQ ID NO: 3308855 - RNA, 20 nt, Mycobacterium tuberculosis H37Rv
gccggccaagaccgcggccc

SEQ ID NO: 3308856 - RNA, 22 nt, Mycobacterium tuberculosis H37Rv
gccggccaauggccugcagcgc

SEQ ID NO: 3308857 - RNA, 19 nt, Mycobacterium tuberculosis H37Rv
gccggccaccaccgcgccg

SEQ ID NO: 3308858 - RNA, 22 nt, Mycobacterium tuberculosis H37Rv
gccggccacccgcgcgaugcug

SEQ ID NO: 3308859 - RNA, 14 nt, Mycobacterium tuberculosis H37Rv
gccggccaccguca

SEQ ID NO: 3308860 - RNA, 12 nt, Mycobacterium tuberculosis H37Rv
gccggccaccuc

SEQ ID NO: 3308861 - RNA, 14 nt, Mycobacterium tuberculosis H37Rv
gccggccaccucgg

SEQ ID NO: 3308862 - RNA, 17 nt, Mycobacterium tuberculosis H37Rv
gccggccaccucggugc

SEQ ID NO: 3308863 - RNA, 17 nt, Mycobacterium tuberculosis H37Rv
gccggccacgaccucuu

SEQ ID NO: 3308864 - RNA, 19 nt, Mycobacterium tuberculosis H37Rv
gccggccacgcauuccagc

SEQ ID NO: 3308865 - RNA, 14 nt, Mycobacterium tuberculosis H37Rv
gccggccacgucga

SEQ ID NO: 3308866 - RNA, 24 nt, Mycobacterium tuberculosis H37Rv
gccggccacuacggccuggccacc

SEQ ID NO: 3308867 - RNA, 13 nt, Mycobacterium tuberculosis H37Rv
gccggccagcggc

SEQ ID NO: 3308868 - RNA, 15 nt, Mycobacterium tuberculosis H37Rv
gccggcgcggucucg

SEQ ID NO: 3308869 - RNA, 21 nt, Mycobacterium tuberculosis H37Rv
gccggcgcguaguaaugcucg

SEQ ID NO: 3308870 - RNA, 23 nt, Mycobacterium tuberculosis H37Rv
gccggcgcguaguaaugcucgac

SEQ ID NO: 3308871 - RNA, 15 nt, Mycobacterium tuberculosis H37Rv
gccggcgcucgcggc

SEQ ID NO: 3308872 - RNA, 17 nt, Mycobacterium tuberculosis H37Rv
gccggcgcugccaaacu

SEQ ID NO: 3308873 - RNA, 22 nt, Mycobacterium tuberculosis H37Rv
gccggcgcugcugccauugccg

SEQ ID NO: 3308874 - RNA, 12 nt, Mycobacterium tuberculosis H37Rv
gccggcgcuggc

SEQ ID NO: 3308875 - RNA, 18 nt, Mycobacterium tuberculosis H37Rv
gccggcggaaucgucggc

SEQ ID NO: 3308876 - RNA, 21 nt, Mycobacterium tuberculosis H37Rv
gccggcggacgcccggcgcac

SEQ ID NO: 3308877 - RNA, 23 nt, Mycobacterium tuberculosis H37Rv
gccggcggcaaagagcagccggc

SEQ ID NO: 3308878 - RNA, 17 nt, Mycobacterium tuberculosis H37Rv
gccggcggccgcggugc

SEQ ID NO: 3308879 - RNA, 20 nt, Mycobacterium tuberculosis H37Rv
gccggcggccuugcgggcuc

SEQ ID NO: 3308880 - RNA, 12 nt, Mycobacterium tuberculosis H37Rv
gccggcggcgac

SEQ ID NO: 3308881 - RNA, 21 nt, Mycobacterium tuberculosis H37Rv
gccggcggcgcccaucgcgac

SEQ ID NO: 3308882 - RNA, 12 nt, Mycobacterium tuberculosis H37Rv
gccggcggcggc

SEQ ID NO: 3308883 - RNA, 13 nt, Mycobacterium tuberculosis H37Rv
gccggcggcggcc

SEQ ID NO: 3308884 - RNA, 14 nt, Mycobacterium tuberculosis H37Rv
gccggcggcggccg

SEQ ID NO: 3308885 - RNA, 15 nt, Mycobacterium tuberculosis H37Rv
gccggcggcggccgc

SEQ ID NO: 3308886 - RNA, 15 nt, Mycobacterium tuberculosis H37Rv
gccggcggcggcgcu

SEQ ID NO: 3308887 - RNA, 20 nt, Mycobacterium tuberculosis H37Rv
gccggcggcggcgcucggcc

SEQ ID NO: 3308888 - RNA, 22 nt, Mycobacterium tuberculosis H37Rv
gccggcggcgguaccggaaucg

SEQ ID NO: 3308889 - RNA, 23 nt, Mycobacterium tuberculosis H37Rv
gccggcggcucgggugcgcccgg

SEQ ID NO: 3308890 - RNA, 21 nt, Mycobacterium tuberculosis H37Rv
gccggcggcuguggucgcugc

SEQ ID NO: 3308891 - RNA, 16 nt, Mycobacterium tuberculosis H37Rv
gccggcgggcucgccc

SEQ ID NO: 3308892 - RNA, 18 nt, Mycobacterium tuberculosis H37Rv
gccggcgggcucgcccgc

SEQ ID NO: 3308893 - RNA, 18 nt, Mycobacterium tuberculosis H37Rv
gccggcgguaagcccaga

SEQ ID NO: 3308894 - RNA, 21 nt, Mycobacterium tuberculosis H37Rv
gccggcgguagucggccagcu

SEQ ID NO: 3308895 - RNA, 14 nt, Mycobacterium tuberculosis H37Rv
gccggcggucagca

SEQ ID NO: 3308896 - RNA, 22 nt, Mycobacterium tuberculosis H37Rv
gccggcggucccaugugcccgc

SEQ ID NO: 3308897 - RNA, 19 nt, Mycobacterium tuberculosis H37Rv
gccggcgguguuggcgcca

SEQ ID NO: 3308898 - RNA, 23 nt, Mycobacterium tuberculosis H37Rv
gccggcguacuucgacagcggcg

SEQ ID NO: 3308899 - RNA, 15 nt, Mycobacterium tuberculosis H37Rv
gccggcguagcggcg

SEQ ID NO: 3308900 - RNA, 19 nt, Mycobacterium tuberculosis H37Rv
gccggcguagcggcgauac

SEQ ID NO: 3308901 - RNA, 18 nt, Mycobacterium tuberculosis H37Rv
gccggcguaggcaggauc

SEQ ID NO: 3308902 - RNA, 13 nt, Mycobacterium tuberculosis H37Rv
gccggcgucagcc

SEQ ID NO: 3308903 - RNA, 23 nt, Mycobacterium tuberculosis H37Rv
gccggcgucgacccugcccagca

SEQ ID NO: 3308904 - RNA, 12 nt, Mycobacterium tuberculosis H37Rv
gccggcgucgag

SEQ ID NO: 3308905 - RNA, 14 nt, Mycobacterium tuberculosis H37Rv
gccggcgucgagcc

SEQ ID NO: 3308906 - RNA, 15 nt, Mycobacterium tuberculosis H37Rv
gccggcgucgagccg

SEQ ID NO: 3308907 - RNA, 14 nt, Mycobacterium tuberculosis H37Rv
gccggcgucgauga

SEQ ID NO: 3308908 - RNA, 21 nt, Mycobacterium tuberculosis H37Rv
gccggcgucggcgcccagcuc

SEQ ID NO: 3308909 - RNA, 16 nt, Mycobacterium tuberculosis H37Rv
gccggcgugcacuccc

SEQ ID NO: 3308910 - RNA, 16 nt, Mycobacterium tuberculosis H37Rv
gccggcgugcaugagc

SEQ ID NO: 3308911 - RNA, 15 nt, Mycobacterium tuberculosis H37Rv
gccggcgugucgcgu

SEQ ID NO: 3308912 - RNA, 20 nt, Mycobacterium tuberculosis H37Rv
gccggcgugucgcgucgugc

SEQ ID NO: 3308913 - RNA, 21 nt, Mycobacterium tuberculosis H37Rv
gccggcguuagcguagcccga

SEQ ID NO: 3308914 - RNA, 23 nt, Mycobacterium tuberculosis H37Rv
gccggcguuagcguagcccgagu

SEQ ID NO: 3308915 - RNA, 22 nt, Mycobacterium tuberculosis H37Rv
gccggcuaccgccuugucggcg

SEQ ID NO: 3308916 - RNA, 18 nt, Mycobacterium tuberculosis H37Rv
gccggcuaccgcgcuccc

SEQ ID NO: 3308917 - RNA, 12 nt, Mycobacterium tuberculosis H37Rv
gccggcuagggc

SEQ ID NO: 3308918 - RNA, 18 nt, Mycobacterium tuberculosis H37Rv
gccggcuagggcagcagc

SEQ ID NO: 3308919 - RNA, 23 nt, Mycobacterium tuberculosis H37Rv
gccggcuagggcccuggcggccc

SEQ ID NO: 3308920 - RNA, 17 nt, Mycobacterium tuberculosis H37Rv
gccggcucaucgcagcc

SEQ ID NO: 3308921 - RNA, 19 nt, Mycobacterium tuberculosis H37Rv
gccggcucaucgcagccgg

SEQ ID NO: 3308922 - RNA, 20 nt, Mycobacterium tuberculosis H37Rv
gccggcuccgccagcgccgc

SEQ ID NO: 3308923 - RNA, 16 nt, Mycobacterium tuberculosis H37Rv
gccggcuccgccguug

SEQ ID NO: 3308924 - RNA, 21 nt, Mycobacterium tuberculosis H37Rv
gccggcuccgccguugccgcc

SEQ ID NO: 3308925 - RNA, 14 nt, Mycobacterium tuberculosis H37Rv
gccggcugacaacg

SEQ ID NO: 3308926 - RNA, 17 nt, Mycobacterium tuberculosis H37Rv
gccggcugcauccuccu

SEQ ID NO: 3308927 - RNA, 18 nt, Mycobacterium tuberculosis H37Rv
gccggcugcauccuccuc

SEQ ID NO: 3308928 - RNA, 16 nt, Mycobacterium tuberculosis H37Rv
gccggcugcggaggcg

SEQ ID NO: 3308929 - RNA, 16 nt, Mycobacterium tuberculosis H37Rv
gccggcuucgcccaga

SEQ ID NO: 3308930 - RNA, 19 nt, Mycobacterium tuberculosis H37Rv
gccggcuucgcccagagcc

SEQ ID NO: 3308931 - RNA, 22 nt, Mycobacterium tuberculosis H37Rv
gccggcuucgcccagagccgcu

SEQ ID NO: 3308932 - RNA, 16 nt, Mycobacterium tuberculosis H37Rv
gccggcuucggcgagc

SEQ ID NO: 3308933 - RNA, 17 nt, Mycobacterium tuberculosis H37Rv
gccggcuucggcgagcg

SEQ ID NO: 3308934 - RNA, 20 nt, Mycobacterium tuberculosis H37Rv
gccggcuucggugagcgggc

SEQ ID NO: 3308935 - RNA, 23 nt, Mycobacterium tuberculosis H37Rv
gccggcuugcagugaggucaucg

SEQ ID NO: 3308936 - RNA, 22 nt, Mycobacterium tuberculosis H37Rv
gccggcuuggccuuugccgucg

SEQ ID NO: 3308937 - RNA, 15 nt, Mycobacterium tuberculosis H37Rv
gccggcuugucgacc

SEQ ID NO: 3308938 - RNA, 15 nt, Mycobacterium tuberculosis H37Rv
gccggcuuugagccg

SEQ ID NO: 3308939 - RNA, 19 nt, Mycobacterium tuberculosis H37Rv
gccggcuuugagccgcucg

SEQ ID NO: 3308940 - RNA, 17 nt, Mycobacterium tuberculosis H37Rv
gccggcuuuuccacgag

SEQ ID NO: 3308941 - RNA, 20 nt, Mycobacterium tuberculosis H37Rv
gccgggaaacaccggcuugg

SEQ ID NO: 3308942 - RNA, 14 nt, Mycobacterium tuberculosis H37Rv
gccgggaaccucgc

SEQ ID NO: 3308943 - RNA, 13 nt, Mycobacterium tuberculosis H37Rv
gccgggaagccgc

SEQ ID NO: 3308944 - RNA, 23 nt, Mycobacterium tuberculosis H37Rv
gccgggaaggauugcgcguucca

SEQ ID NO: 3308945 - RNA, 17 nt, Mycobacterium tuberculosis H37Rv
gccgggaccgccccggc

SEQ ID NO: 3308946 - RNA, 17 nt, Mycobacterium tuberculosis H37Rv
gccgggaguguguccga

SEQ ID NO: 3308947 - RNA, 22 nt, Mycobacterium tuberculosis H37Rv
gccgggauaacccagcaccaca

SEQ ID NO: 3308948 - RNA, 16 nt, Mycobacterium tuberculosis H37Rv
gccgggauaucgucga

SEQ ID NO: 3308949 - RNA, 19 nt, Mycobacterium tuberculosis H37Rv
gccgggauaucgucgacgc

SEQ ID NO: 3308950 - RNA, 13 nt, Mycobacterium tuberculosis H37Rv
gccgggaucaccg

SEQ ID NO: 3308951 - RNA, 16 nt, Mycobacterium tuberculosis H37Rv
gccgggaucaccgggg

SEQ ID NO: 3308952 - RNA, 14 nt, Mycobacterium tuberculosis H37Rv
gccgggaugccgcc

SEQ ID NO: 3308953 - RNA, 19 nt, Mycobacterium tuberculosis H37Rv
gccgggaugccgccgcuga

SEQ ID NO: 3308954 - RNA, 20 nt, Mycobacterium tuberculosis H37Rv
gccgggaugguuucgacucg

SEQ ID NO: 3308955 - RNA, 17 nt, Mycobacterium tuberculosis H37Rv
gccgggcaaccagcagc

SEQ ID NO: 3308956 - RNA, 19 nt, Mycobacterium tuberculosis H37Rv
gccgggcaaccagcagcag

SEQ ID NO: 3308957 - RNA, 16 nt, Mycobacterium tuberculosis H37Rv
gccgggcaccacccuu

SEQ ID NO: 3308958 - RNA, 20 nt, Mycobacterium tuberculosis H37Rv
gccgggcacgcgaggcgcuc

SEQ ID NO: 3308959 - RNA, 15 nt, Mycobacterium tuberculosis H37Rv
gccgggcagucaggc

SEQ ID NO: 3308960 - RNA, 17 nt, Mycobacterium tuberculosis H37Rv
gccgggcagucaggccu

SEQ ID NO: 3308961 - RNA, 20 nt, Mycobacterium tuberculosis H37Rv
gccgggcaguguggucauug

SEQ ID NO: 3308962 - RNA, 18 nt, Mycobacterium tuberculosis H37Rv
gccgggcaguuuggcggc

SEQ ID NO: 3308963 - RNA, 19 nt, Mycobacterium tuberculosis H37Rv
gccgggcaguuuggcggca

SEQ ID NO: 3308964 - RNA, 14 nt, Mycobacterium tuberculosis H37Rv
gccggucgcauggu

SEQ ID NO: 3308965 - RNA, 13 nt, Mycobacterium tuberculosis H37Rv
gccggucggaucg

SEQ ID NO: 3308966 - RNA, 16 nt, Mycobacterium tuberculosis H37Rv
gccggucggcgucgag

SEQ ID NO: 3308967 - RNA, 13 nt, Mycobacterium tuberculosis H37Rv
gccggucgggcag

SEQ ID NO: 3308968 - RNA, 21 nt, Mycobacterium tuberculosis H37Rv
gccggucgucgcgcaguucca

SEQ ID NO: 3308969 - RNA, 22 nt, Mycobacterium tuberculosis H37Rv
gccggucgugccggggcugccg

SEQ ID NO: 3308970 - RNA, 15 nt, Mycobacterium tuberculosis H37Rv
gccggugaacaggga

SEQ ID NO: 3308971 - RNA, 17 nt, Mycobacterium tuberculosis H37Rv
gccggugaacagggacu

SEQ ID NO: 3308972 - RNA, 18 nt, Mycobacterium tuberculosis H37Rv
gccggugacaaguggugc

SEQ ID NO: 3308973 - RNA, 12 nt, Mycobacterium tuberculosis H37Rv
gccggugaccgc

SEQ ID NO: 3308974 - RNA, 16 nt, Mycobacterium tuberculosis H37Rv
gccggugaccgcgaug

SEQ ID NO: 3308975 - RNA, 13 nt, Mycobacterium tuberculosis H37Rv
gccggugacggug

SEQ ID NO: 3308976 - RNA, 16 nt, Mycobacterium tuberculosis H37Rv
gccggugagcgagcgc

SEQ ID NO: 3308977 - RNA, 18 nt, Mycobacterium tuberculosis H37Rv
gccggugaggcgaccgga

SEQ ID NO: 3308978 - RNA, 19 nt, Mycobacterium tuberculosis H37Rv
gccggugaugaucgcgccg

SEQ ID NO: 3308979 - RNA, 12 nt, Mycobacterium tuberculosis H37Rv
gccggugccacc

SEQ ID NO: 3308980 - RNA, 13 nt, Mycobacterium tuberculosis H37Rv
gccggugccaccg

SEQ ID NO: 3308981 - RNA, 19 nt, Mycobacterium tuberculosis H37Rv
gccggugccaccggcuggu

SEQ ID NO: 3308982 - RNA, 19 nt, Mycobacterium tuberculosis H37Rv
gccggugccacugccguug

SEQ ID NO: 3308983 - RNA, 12 nt, Mycobacterium tuberculosis H37Rv
gccggugccgau

SEQ ID NO: 3308984 - RNA, 16 nt, Mycobacterium tuberculosis H37Rv
gccggugccgaucagc

SEQ ID NO: 3308985 - RNA, 15 nt, Mycobacterium tuberculosis H37Rv
gccggugccgccauc

SEQ ID NO: 3308986 - RNA, 17 nt, Mycobacterium tuberculosis H37Rv
gccggugccgccaucgc

SEQ ID NO: 3308987 - RNA, 21 nt, Mycobacterium tuberculosis H37Rv
gccggugccgccaucgccgcc

SEQ ID NO: 3308988 - RNA, 15 nt, Mycobacterium tuberculosis H37Rv
gccggugccgccauu

SEQ ID NO: 3308989 - RNA, 14 nt, Mycobacterium tuberculosis H37Rv
gccggugccgccgc

SEQ ID NO: 3308990 - RNA, 16 nt, Mycobacterium tuberculosis H37Rv
gccggugccgccgcgg

SEQ ID NO: 3308991 - RNA, 18 nt, Mycobacterium tuberculosis H37Rv
gccggugccgccgggugc

SEQ ID NO: 3308992 - RNA, 18 nt, Mycobacterium tuberculosis H37Rv
gccggugccgccggugcc

SEQ ID NO: 3308993 - RNA, 17 nt, Mycobacterium tuberculosis H37Rv
gccggugccgccgucgc

SEQ ID NO: 3308994 - RNA, 18 nt, Mycobacterium tuberculosis H37Rv
gccggugccgccuccgcc

SEQ ID NO: 3308995 - RNA, 17 nt, Mycobacterium tuberculosis H37Rv
gccggugccgccugcgc

SEQ ID NO: 3308996 - RNA, 16 nt, Mycobacterium tuberculosis H37Rv
gccggugccgcgguag

SEQ ID NO: 3308997 - RNA, 15 nt, Mycobacterium tuberculosis H37Rv
gccggugccgguaug

SEQ ID NO: 3308998 - RNA, 15 nt, Mycobacterium tuberculosis H37Rv
gccggugcgcccugc

SEQ ID NO: 3308999 - RNA, 14 nt, Mycobacterium tuberculosis H37Rv
gccggugcgcgcug

SEQ ID NO: 3309000 - RNA, 15 nt, Mycobacterium tuberculosis H37Rv
gccggugcgcugguu

SEQ ID NO: 3309001 - RNA, 19 nt, Mycobacterium tuberculosis H37Rv
gccggugcgcugguuucgc

SEQ ID NO: 3309002 - RNA, 15 nt, Mycobacterium tuberculosis H37Rv
gccggugcgguggug

SEQ ID NO: 3309003 - RNA, 16 nt, Mycobacterium tuberculosis H37Rv
gccggugcgguggugc

SEQ ID NO: 3309004 - RNA, 13 nt, Mycobacterium tuberculosis H37Rv
gccggugcgucac

SEQ ID NO: 3309005 - RNA, 20 nt, Mycobacterium tuberculosis H37Rv
gccggugcgucacagccggg

SEQ ID NO: 3309006 - RNA, 13 nt, Mycobacterium tuberculosis H37Rv
gccggugcuccuc

SEQ ID NO: 3309007 - RNA, 23 nt, Mycobacterium tuberculosis H37Rv
gccggugcuccucggcaggccga

SEQ ID NO: 3309008 - RNA, 23 nt, Mycobacterium tuberculosis H37Rv
gccgguggcacccgcgucgagug

SEQ ID NO: 3309009 - RNA, 13 nt, Mycobacterium tuberculosis H37Rv
gccgguggcccgc

SEQ ID NO: 3309010 - RNA, 22 nt, Mycobacterium tuberculosis H37Rv
gccgguggcccgccggcaguga

SEQ ID NO: 3309011 - RNA, 14 nt, Mycobacterium tuberculosis H37Rv
gccgguggccgcgc

SEQ ID NO: 3309012 - RNA, 18 nt, Mycobacterium tuberculosis H37Rv
gccgguggcgccgccgcc

SEQ ID NO: 3309013 - RNA, 17 nt, Mycobacterium tuberculosis H37Rv
gccggugggcgguccgc

SEQ ID NO: 3309014 - RNA, 23 nt, Mycobacterium tuberculosis H37Rv
gccggugggcgguccgcgucugg

SEQ ID NO: 3309015 - RNA, 18 nt, Mycobacterium tuberculosis H37Rv
gccgguggggucggucug

SEQ ID NO: 3309016 - RNA, 17 nt, Mycobacterium tuberculosis H37Rv
gccgguggugggcggga

SEQ ID NO: 3309017 - RNA, 17 nt, Mycobacterium tuberculosis H37Rv
gccgguguaacccucga

SEQ ID NO: 3309018 - RNA, 16 nt, Mycobacterium tuberculosis H37Rv
gccggugucggcuggu

SEQ ID NO: 3309019 - RNA, 20 nt, Mycobacterium tuberculosis H37Rv
gccggugucgggcugucagg

SEQ ID NO: 3309020 - RNA, 21 nt, Mycobacterium tuberculosis H37Rv
gccggugucucccuugccgcc

SEQ ID NO: 3309021 - RNA, 18 nt, Mycobacterium tuberculosis H37Rv
gccggugucuggguggac

SEQ ID NO: 3309022 - RNA, 19 nt, Mycobacterium tuberculosis H37Rv
gccggugugcccgccugga

SEQ ID NO: 3309023 - RNA, 19 nt, Mycobacterium tuberculosis H37Rv
gccgguguugccgccggug

SEQ ID NO: 3309024 - RNA, 21 nt, Mycobacterium tuberculosis H37Rv
gccgguguuuccgaaacccgc

SEQ ID NO: 3309025 - RNA, 16 nt, Mycobacterium tuberculosis H37Rv
gccgguucccgaucag

SEQ ID NO: 3309026 - RNA, 19 nt, Mycobacterium tuberculosis H37Rv
gccgguucccgaucaggcg

SEQ ID NO: 3309027 - RNA, 15 nt, Mycobacterium tuberculosis H37Rv
gccgguuccgccggc

SEQ ID NO: 3309028 - RNA, 18 nt, Mycobacterium tuberculosis H37Rv
gccgguuccgccggcccc

SEQ ID NO: 3309029 - RNA, 17 nt, Mycobacterium tuberculosis H37Rv
gccgguuccucagcggc

SEQ ID NO: 3309030 - RNA, 21 nt, Mycobacterium tuberculosis H37Rv
gccgguuccucagcggcccgc

SEQ ID NO: 3309031 - RNA, 22 nt, Mycobacterium tuberculosis H37Rv
gccgguuccucagcggcccgcu

SEQ ID NO: 3309032 - RNA, 16 nt, Mycobacterium tuberculosis H37Rv
gccgguucgcccagca

SEQ ID NO: 3309033 - RNA, 16 nt, Mycobacterium tuberculosis H37Rv
gccgguucgcccgagg

SEQ ID NO: 3309034 - RNA, 14 nt, Mycobacterium tuberculosis H37Rv
gccgguugccaccu

SEQ ID NO: 3309035 - RNA, 21 nt, Mycobacterium tuberculosis H37Rv
gccgguugcggcugcguuggc

SEQ ID NO: 3309036 - RNA, 19 nt, Mycobacterium tuberculosis H37Rv
gccgguuggccagugacuc

SEQ ID NO: 3309037 - RNA, 15 nt, Mycobacterium tuberculosis H37Rv
gccgguuggcugccg

SEQ ID NO: 3309038 - RNA, 16 nt, Mycobacterium tuberculosis H37Rv
gccgguugucgcagcg

SEQ ID NO: 3309039 - RNA, 17 nt, Mycobacterium tuberculosis H37Rv
gccgguugucgcagcgc

SEQ ID NO: 3309040 - RNA, 21 nt, Mycobacterium tuberculosis H37Rv
gccguaaagccaacuggucgc

SEQ ID NO: 3309041 - RNA, 15 nt, Mycobacterium tuberculosis H37Rv
gccguaacagccggc

SEQ ID NO: 3309042 - RNA, 15 nt, Mycobacterium tuberculosis H37Rv
gccguaacggcgaaa

SEQ ID NO: 3309043 - RNA, 17 nt, Mycobacterium tuberculosis H37Rv
gccguacaaccacccac

SEQ ID NO: 3309044 - RNA, 23 nt, Mycobacterium tuberculosis H37Rv
gccguacaaccacccacccgcac

SEQ ID NO: 3309045 - RNA, 14 nt, Mycobacterium tuberculosis H37Rv
gccguacacaccga

SEQ ID NO: 3309046 - RNA, 16 nt, Mycobacterium tuberculosis H37Rv
gccguacacaccgagc

SEQ ID NO: 3309047 - RNA, 13 nt, Mycobacterium tuberculosis H37Rv
gccguacagcggc

SEQ ID NO: 3309048 - RNA, 22 nt, Mycobacterium tuberculosis H37Rv
gccguaccaguuauucggugcg

SEQ ID NO: 3309049 - RNA, 12 nt, Mycobacterium tuberculosis H37Rv
gccguacgccgu

SEQ ID NO: 3309050 - RNA, 11 nt, Mycobacterium tuberculosis H37Rv
gccguagaaau

SEQ ID NO: 3309051 - RNA, 17 nt, Mycobacterium tuberculosis H37Rv
gccguagaccacuucga

SEQ ID NO: 3309052 - RNA, 15 nt, Mycobacterium tuberculosis H37Rv
gccguagaccagcag

SEQ ID NO: 3309053 - RNA, 14 nt, Mycobacterium tuberculosis H37Rv
gccguagaccagcc

SEQ ID NO: 3309054 - RNA, 23 nt, Mycobacterium tuberculosis H37Rv
gccguagaccagccgucguccgc

SEQ ID NO: 3309055 - RNA, 15 nt, Mycobacterium tuberculosis H37Rv
gccguagagccgcuc

SEQ ID NO: 3309056 - RNA, 18 nt, Mycobacterium tuberculosis H37Rv
gccguagagccgcucggc

SEQ ID NO: 3309057 - RNA, 22 nt, Mycobacterium tuberculosis H37Rv
gccguagagcuggugcgggacg

SEQ ID NO: 3309058 - RNA, 18 nt, Mycobacterium tuberculosis H37Rv
gccguagagucguuuggc

SEQ ID NO: 3309059 - RNA, 14 nt, Mycobacterium tuberculosis H37Rv
gccguagaucccga

SEQ ID NO: 3309060 - RNA, 17 nt, Mycobacterium tuberculosis H37Rv
gccguagcccacgacga

SEQ ID NO: 3309061 - RNA, 14 nt, Mycobacterium tuberculosis H37Rv
gccgucggugccgc

SEQ ID NO: 3309062 - RNA, 15 nt, Mycobacterium tuberculosis H37Rv
gccgucggugccgcc

SEQ ID NO: 3309063 - RNA, 17 nt, Mycobacterium tuberculosis H37Rv
gccgucggugccgccgc

SEQ ID NO: 3309064 - RNA, 18 nt, Mycobacterium tuberculosis H37Rv
gccgucggugccgccgcc

SEQ ID NO: 3309065 - RNA, 19 nt, Mycobacterium tuberculosis H37Rv
gccgucggugccgccgccg

SEQ ID NO: 3309066 - RNA, 21 nt, Mycobacterium tuberculosis H37Rv
gccgucggugccgccgccggc

SEQ ID NO: 3309067 - RNA, 23 nt, Mycobacterium tuberculosis H37Rv
gccgucguacucgaccgcgagca

SEQ ID NO: 3309068 - RNA, 16 nt, Mycobacterium tuberculosis H37Rv
gccgucgucgaccacg

SEQ ID NO: 3309069 - RNA, 20 nt, Mycobacterium tuberculosis H37Rv
gccgucgucgagccggaaca

SEQ ID NO: 3309070 - RNA, 14 nt, Mycobacterium tuberculosis H37Rv
gccgucgucgccgu

SEQ ID NO: 3309071 - RNA, 14 nt, Mycobacterium tuberculosis H37Rv
gccgucgucggcgu

SEQ ID NO: 3309072 - RNA, 15 nt, Mycobacterium tuberculosis H37Rv
gccgucgucgucgag

SEQ ID NO: 3309073 - RNA, 21 nt, Mycobacterium tuberculosis H37Rv
gccgucgucgucggcagcguc

SEQ ID NO: 3309074 - RNA, 13 nt, Mycobacterium tuberculosis H37Rv
gccgucgugaucg

SEQ ID NO: 3309075 - RNA, 15 nt, Mycobacterium tuberculosis H37Rv
gccgucgugccaccg

SEQ ID NO: 3309076 - RNA, 21 nt, Mycobacterium tuberculosis H37Rv
gccgucgugccaccguugggc

SEQ ID NO: 3309077 - RNA, 20 nt, Mycobacterium tuberculosis H37Rv
gccgucguugugccggucga

SEQ ID NO: 3309078 - RNA, 17 nt, Mycobacterium tuberculosis H37Rv
gccgucuagcacacgcu

SEQ ID NO: 3309079 - RNA, 19 nt, Mycobacterium tuberculosis H37Rv
gccgucuccuggucaaccg

SEQ ID NO: 3309080 - RNA, 14 nt, Mycobacterium tuberculosis H37Rv
gccgucucgcggug

SEQ ID NO: 3309081 - RNA, 19 nt, Mycobacterium tuberculosis H37Rv
gccgucucgcggugcggca

SEQ ID NO: 3309082 - RNA, 14 nt, Mycobacterium tuberculosis H37Rv
gccgucucgucggc

SEQ ID NO: 3309083 - RNA, 21 nt, Mycobacterium tuberculosis H37Rv
gccgucugcggggugagugac

SEQ ID NO: 3309084 - RNA, 21 nt, Mycobacterium tuberculosis H37Rv
gccgucuucgccgccaccggc

SEQ ID NO: 3309085 - RNA, 13 nt, Mycobacterium tuberculosis H37Rv
gccgucuuggccc

SEQ ID NO: 3309086 - RNA, 17 nt, Mycobacterium tuberculosis H37Rv
gccgugaccaggugcca

SEQ ID NO: 3309087 - RNA, 18 nt, Mycobacterium tuberculosis H37Rv
gccgugaccgagccgcga

SEQ ID NO: 3309088 - RNA, 19 nt, Mycobacterium tuberculosis H37Rv
gccgugacgauucgagcaa

SEQ ID NO: 3309089 - RNA, 18 nt, Mycobacterium tuberculosis H37Rv
gccgugagcccggcgauc

SEQ ID NO: 3309090 - RNA, 23 nt, Mycobacterium tuberculosis H37Rv
gccgugaguagguccacguucgg

SEQ ID NO: 3309091 - RNA, 16 nt, Mycobacterium tuberculosis H37Rv
gccgugaucagcucgc

SEQ ID NO: 3309092 - RNA, 23 nt, Mycobacterium tuberculosis H37Rv
gccgugaucagcucgcgcacguc

SEQ ID NO: 3309093 - RNA, 18 nt, Mycobacterium tuberculosis H37Rv
gccgugaucggcgcccgg

SEQ ID NO: 3309094 - RNA, 19 nt, Mycobacterium tuberculosis H37Rv
gccgugauugucggcgaaa

SEQ ID NO: 3309095 - RNA, 20 nt, Mycobacterium tuberculosis H37Rv
gccgugcccggugcggugca

SEQ ID NO: 3309096 - RNA, 17 nt, Mycobacterium tuberculosis H37Rv
gccgugccgaaguggag

SEQ ID NO: 3309097 - RNA, 13 nt, Mycobacterium tuberculosis H37Rv
gccgugccgcaca

SEQ ID NO: 3309098 - RNA, 15 nt, Mycobacterium tuberculosis H37Rv
gccgugccgcacagc

SEQ ID NO: 3309099 - RNA, 14 nt, Mycobacterium tuberculosis H37Rv
gccgugccgccagc

SEQ ID NO: 3309100 - RNA, 15 nt, Mycobacterium tuberculosis H37Rv
gccgugccgccagca

SEQ ID NO: 3309101 - RNA, 19 nt, Mycobacterium tuberculosis H37Rv
gccgugccgguuuggccga

SEQ ID NO: 3309102 - RNA, 16 nt, Mycobacterium tuberculosis H37Rv
gccgugccguggugaa

SEQ ID NO: 3309103 - RNA, 22 nt, Mycobacterium tuberculosis H37Rv
gccgugcgaucgucaacgacga

SEQ ID NO: 3309104 - RNA, 17 nt, Mycobacterium tuberculosis H37Rv
gccgugcgggccggucg

SEQ ID NO: 3309105 - RNA, 13 nt, Mycobacterium tuberculosis H37Rv
gccgugcggucgc

SEQ ID NO: 3309106 - RNA, 15 nt, Mycobacterium tuberculosis H37Rv
gccgugcggucgcgc

SEQ ID NO: 3309107 - RNA, 14 nt, Mycobacterium tuberculosis H37Rv
gccgugcgugcggg

SEQ ID NO: 3309108 - RNA, 22 nt, Mycobacterium tuberculosis H37Rv
gccgugcugaacuccgccgcga

SEQ ID NO: 3309109 - RNA, 14 nt, Mycobacterium tuberculosis H37Rv
gccgugcugcggcg

SEQ ID NO: 3309110 - RNA, 16 nt, Mycobacterium tuberculosis H37Rv
gccgugcugcggcgac

SEQ ID NO: 3309111 - RNA, 17 nt, Mycobacterium tuberculosis H37Rv
gccguggagcacagcac

SEQ ID NO: 3309112 - RNA, 20 nt, Mycobacterium tuberculosis H37Rv
gccguggagcacagcacggc

SEQ ID NO: 3309113 - RNA, 16 nt, Mycobacterium tuberculosis H37Rv
gccguggauacgcacg

SEQ ID NO: 3309114 - RNA, 17 nt, Mycobacterium tuberculosis H37Rv
gccguggauacgcacgg

SEQ ID NO: 3309115 - RNA, 17 nt, Mycobacterium tuberculosis H37Rv
gccguggcagucgcacg

SEQ ID NO: 3309116 - RNA, 19 nt, Mycobacterium tuberculosis H37Rv
gccguggcagucgcacggu

SEQ ID NO: 3309117 - RNA, 13 nt, Mycobacterium tuberculosis H37Rv
gccguggcaucgc

SEQ ID NO: 3309118 - RNA, 20 nt, Mycobacterium tuberculosis H37Rv
gccguggcaucgccuccagg

SEQ ID NO: 3309119 - RNA, 18 nt, Mycobacterium tuberculosis H37Rv
gccguggcauguugcgga

SEQ ID NO: 3309120 - RNA, 16 nt, Mycobacterium tuberculosis H37Rv
gccguggccgcacugc

SEQ ID NO: 3309121 - RNA, 20 nt, Mycobacterium tuberculosis H37Rv
gccguggcgaaugacggcca

SEQ ID NO: 3309122 - RNA, 16 nt, Mycobacterium tuberculosis H37Rv
gccguggcgucggcgu

SEQ ID NO: 3309123 - RNA, 17 nt, Mycobacterium tuberculosis H37Rv
gccguggcgucggcguc

SEQ ID NO: 3309124 - RNA, 21 nt, Mycobacterium tuberculosis H37Rv
gccguggcuggacccgcaugg

SEQ ID NO: 3309125 - RNA, 21 nt, Mycobacterium tuberculosis H37Rv
gccgugggugucgguggccgc

SEQ ID NO: 3309126 - RNA, 12 nt, Mycobacterium tuberculosis H37Rv
gccguggucgaa

SEQ ID NO: 3309127 - RNA, 12 nt, Mycobacterium tuberculosis H37Rv
gccguggucgag

SEQ ID NO: 3309128 - RNA, 19 nt, Mycobacterium tuberculosis H37Rv
gccguggugaaaugccgag

SEQ ID NO: 3309129 - RNA, 20 nt, Mycobacterium tuberculosis H37Rv
gccguggugaaaugccgaga

SEQ ID NO: 3309130 - RNA, 17 nt, Mycobacterium tuberculosis H37Rv
gccguggugcgcauggc

SEQ ID NO: 3309131 - RNA, 23 nt, Mycobacterium tuberculosis H37Rv
gccgugguggaugagccggucuu

SEQ ID NO: 3309132 - RNA, 20 nt, Mycobacterium tuberculosis H37Rv
gccgugguugcacguucggc

SEQ ID NO: 3309133 - RNA, 18 nt, Mycobacterium tuberculosis H37Rv
gccgugucaccgggugca

SEQ ID NO: 3309134 - RNA, 21 nt, Mycobacterium tuberculosis H37Rv
gccguguccagcaugcccgcc

SEQ ID NO: 3309135 - RNA, 14 nt, Mycobacterium tuberculosis H37Rv
gccguguccgccgg

SEQ ID NO: 3309136 - RNA, 14 nt, Mycobacterium tuberculosis H37Rv
gccgugucgggcgc

SEQ ID NO: 3309137 - RNA, 18 nt, Mycobacterium tuberculosis H37Rv
gccgugucgggcgcgaaa

SEQ ID NO: 3309138 - RNA, 19 nt, Mycobacterium tuberculosis H37Rv
gccgugugcaucggcgacc

SEQ ID NO: 3309139 - RNA, 20 nt, Mycobacterium tuberculosis H37Rv
gccgugugcaucggcgaccg

SEQ ID NO: 3309140 - RNA, 18 nt, Mycobacterium tuberculosis H37Rv
gccgugugugcgauccag

SEQ ID NO: 3309141 - RNA, 20 nt, Mycobacterium tuberculosis H37Rv
gccguguucagcacccaccg

SEQ ID NO: 3309142 - RNA, 17 nt, Mycobacterium tuberculosis H37Rv
gccguguuccagguaca

SEQ ID NO: 3309143 - RNA, 22 nt, Mycobacterium tuberculosis H37Rv
gccguguucgaccgcagggacc

SEQ ID NO: 3309144 - RNA, 18 nt, Mycobacterium tuberculosis H37Rv
gccguguucuaccugcac

SEQ ID NO: 3309145 - RNA, 17 nt, Mycobacterium tuberculosis H37Rv
gccguuaaucaagguga

SEQ ID NO: 3309146 - RNA, 23 nt, Mycobacterium tuberculosis H37Rv
gccguuaccgccaaacgcugcgc

SEQ ID NO: 3309147 - RNA, 21 nt, Mycobacterium tuberculosis H37Rv
gccguuaccgccguugccgau

SEQ ID NO: 3309148 - RNA, 21 nt, Mycobacterium tuberculosis H37Rv
gccguuaccgccguugccgcc

SEQ ID NO: 3309149 - RNA, 16 nt, Mycobacterium tuberculosis H37Rv
gccguucacccuggug

SEQ ID NO: 3309150 - RNA, 16 nt, Mycobacterium tuberculosis H37Rv
gccguucccaccacca

SEQ ID NO: 3309151 - RNA, 14 nt, Mycobacterium tuberculosis H37Rv
gccguucccgccgg

SEQ ID NO: 3309152 - RNA, 15 nt, Mycobacterium tuberculosis H37Rv
gccguucccgccggc

SEQ ID NO: 3309153 - RNA, 14 nt, Mycobacterium tuberculosis H37Rv
gccguucgcagcug

SEQ ID NO: 3309154 - RNA, 17 nt, Mycobacterium tuberculosis H37Rv
gccguucgcgucgccga

SEQ ID NO: 3309155 - RNA, 17 nt, Mycobacterium tuberculosis H37Rv
gccguucgcucccccgc

SEQ ID NO: 3309156 - RNA, 14 nt, Mycobacterium tuberculosis H37Rv
gccguucggcaucu

SEQ ID NO: 3309157 - RNA, 13 nt, Mycobacterium tuberculosis H37Rv
gccuccucgugca

SEQ ID NO: 3309158 - RNA, 18 nt, Mycobacterium tuberculosis H37Rv
gccuccucgugcaggacc

SEQ ID NO: 3309159 - RNA, 22 nt, Mycobacterium tuberculosis H37Rv
gccuccucuuggguccacaacg

SEQ ID NO: 3309160 - RNA, 17 nt, Mycobacterium tuberculosis H37Rv
gccuccugcuggcccug

SEQ ID NO: 3309161 - RNA, 18 nt, Mycobacterium tuberculosis H37Rv
gccucgaacgccgcccgc

SEQ ID NO: 3309162 - RNA, 14 nt, Mycobacterium tuberculosis H37Rv
gccucgacacccag

SEQ ID NO: 3309163 - RNA, 15 nt, Mycobacterium tuberculosis H37Rv
gccucgacacccagc

SEQ ID NO: 3309164 - RNA, 16 nt, Mycobacterium tuberculosis H37Rv
gccucgacacccagcc

SEQ ID NO: 3309165 - RNA, 18 nt, Mycobacterium tuberculosis H37Rv
gccucgacacccagccgc

SEQ ID NO: 3309166 - RNA, 14 nt, Mycobacterium tuberculosis H37Rv
gccucgacagcggc

SEQ ID NO: 3309167 - RNA, 18 nt, Mycobacterium tuberculosis H37Rv
gccucgacagcggcaauc

SEQ ID NO: 3309168 - RNA, 15 nt, Mycobacterium tuberculosis H37Rv
gccucgaccgccagc

SEQ ID NO: 3309169 - RNA, 21 nt, Mycobacterium tuberculosis H37Rv
gccucgaggguuuccauggcg

SEQ ID NO: 3309170 - RNA, 21 nt, Mycobacterium tuberculosis H37Rv
gccucgagguauucgcgcagc

SEQ ID NO: 3309171 - RNA, 18 nt, Mycobacterium tuberculosis H37Rv
gccucgaguaucucggcu

SEQ ID NO: 3309172 - RNA, 20 nt, Mycobacterium tuberculosis H37Rv
gccucgaguaucucggcucc

SEQ ID NO: 3309173 - RNA, 20 nt, Mycobacterium tuberculosis H37Rv
gccucgaguucgaccggcgg

SEQ ID NO: 3309174 - RNA, 23 nt, Mycobacterium tuberculosis H37Rv
gccucgauaggugagcgcgggcu

SEQ ID NO: 3309175 - RNA, 13 nt, Mycobacterium tuberculosis H37Rv
gccucgaucgacu

SEQ ID NO: 3309176 - RNA, 16 nt, Mycobacterium tuberculosis H37Rv
gccucgauggcggugg

SEQ ID NO: 3309177 - RNA, 15 nt, Mycobacterium tuberculosis H37Rv
gccucgauguccgau

SEQ ID NO: 3309178 - RNA, 23 nt, Mycobacterium tuberculosis H37Rv
gccucgaugucgcggucgcccgc

SEQ ID NO: 3309179 - RNA, 18 nt, Mycobacterium tuberculosis H37Rv
gccucgauuguggccagc

SEQ ID NO: 3309180 - RNA, 22 nt, Mycobacterium tuberculosis H37Rv
gccucgauuguggccagcgcuu

SEQ ID NO: 3309181 - RNA, 16 nt, Mycobacterium tuberculosis H37Rv
gccucgcagcgacacg

SEQ ID NO: 3309182 - RNA, 19 nt, Mycobacterium tuberculosis H37Rv
gccucgcccagcaaggccc

SEQ ID NO: 3309183 - RNA, 19 nt, Mycobacterium tuberculosis H37Rv
gccucgccgaaguggucuc

SEQ ID NO: 3309184 - RNA, 15 nt, Mycobacterium tuberculosis H37Rv
gccucgccggccacc

SEQ ID NO: 3309185 - RNA, 23 nt, Mycobacterium tuberculosis H37Rv
gccucgcgggaagucccgagugg

SEQ ID NO: 3309186 - RNA, 18 nt, Mycobacterium tuberculosis H37Rv
gccucgcguucgcugguc

SEQ ID NO: 3309187 - RNA, 21 nt, Mycobacterium tuberculosis H37Rv
gccucgcuaacuccccagaca

SEQ ID NO: 3309188 - RNA, 20 nt, Mycobacterium tuberculosis H37Rv
gccucggacaaagccgucgc

SEQ ID NO: 3309189 - RNA, 18 nt, Mycobacterium tuberculosis H37Rv
gccucggacacggcagcc

SEQ ID NO: 3309190 - RNA, 22 nt, Mycobacterium tuberculosis H37Rv
gccucggagaucgagaucaccu

SEQ ID NO: 3309191 - RNA, 12 nt, Mycobacterium tuberculosis H37Rv
gccucggcaugc

SEQ ID NO: 3309192 - RNA, 16 nt, Mycobacterium tuberculosis H37Rv
gccucggcaugcagcc

SEQ ID NO: 3309193 - RNA, 18 nt, Mycobacterium tuberculosis H37Rv
gccucggccagcgucagc

SEQ ID NO: 3309194 - RNA, 15 nt, Mycobacterium tuberculosis H37Rv
gccucggcgagccgc

SEQ ID NO: 3309195 - RNA, 15 nt, Mycobacterium tuberculosis H37Rv
gccucggcgauaccg

SEQ ID NO: 3309196 - RNA, 19 nt, Mycobacterium tuberculosis H37Rv
gccucggcgauaccgagga

SEQ ID NO: 3309197 - RNA, 12 nt, Mycobacterium tuberculosis H37Rv
gccucggcgaug

SEQ ID NO: 3309198 - RNA, 16 nt, Mycobacterium tuberculosis H37Rv
gccucggcgccgccca

SEQ ID NO: 3309199 - RNA, 19 nt, Mycobacterium tuberculosis H37Rv
gccucggcgccgcccagca

SEQ ID NO: 3309200 - RNA, 15 nt, Mycobacterium tuberculosis H37Rv
gccucggcgcugcgc

SEQ ID NO: 3309201 - RNA, 18 nt, Mycobacterium tuberculosis H37Rv
gccucgggacucccgcgc

SEQ ID NO: 3309202 - RNA, 18 nt, Mycobacterium tuberculosis H37Rv
gccucgggccggcguagc

SEQ ID NO: 3309203 - RNA, 18 nt, Mycobacterium tuberculosis H37Rv
gccucgggcucaaacgga

SEQ ID NO: 3309204 - RNA, 19 nt, Mycobacterium tuberculosis H37Rv
gccucgguggucuuggccc

SEQ ID NO: 3309205 - RNA, 14 nt, Mycobacterium tuberculosis H37Rv
gccucguacggacc

SEQ ID NO: 3309206 - RNA, 17 nt, Mycobacterium tuberculosis H37Rv
gccucguagucccacug

SEQ ID NO: 3309207 - RNA, 16 nt, Mycobacterium tuberculosis H37Rv
gccucguccagcucgg

SEQ ID NO: 3309208 - RNA, 22 nt, Mycobacterium tuberculosis H37Rv
gccucgucgauguucgccgcgc

SEQ ID NO: 3309209 - RNA, 23 nt, Mycobacterium tuberculosis H37Rv
gccucguuagaguaggccaccac

SEQ ID NO: 3309210 - RNA, 21 nt, Mycobacterium tuberculosis H37Rv
gccucuagcuugacaacccug

SEQ ID NO: 3309211 - RNA, 15 nt, Mycobacterium tuberculosis H37Rv
gccucucuucccaac

SEQ ID NO: 3309212 - RNA, 14 nt, Mycobacterium tuberculosis H37Rv
gccucugaccagcc

SEQ ID NO: 3309213 - RNA, 17 nt, Mycobacterium tuberculosis H37Rv
gccucugaccagccggu

SEQ ID NO: 3309214 - RNA, 20 nt, Mycobacterium tuberculosis H37Rv
gccucugaccagccggucuu

SEQ ID NO: 3309215 - RNA, 16 nt, Mycobacterium tuberculosis H37Rv
gccugaaacgauugcu

SEQ ID NO: 3309216 - RNA, 21 nt, Mycobacterium tuberculosis H37Rv
gccugaaacggcugcagaggc

SEQ ID NO: 3309217 - RNA, 14 nt, Mycobacterium tuberculosis H37Rv
gccugaaccgcccc

SEQ ID NO: 3309218 - RNA, 23 nt, Mycobacterium tuberculosis H37Rv
gccugaccgaagucugcagacgg

SEQ ID NO: 3309219 - RNA, 18 nt, Mycobacterium tuberculosis H37Rv
gccugaccgccaccguca

SEQ ID NO: 3309220 - RNA, 15 nt, Mycobacterium tuberculosis H37Rv
gccugaccggcucgc

SEQ ID NO: 3309221 - RNA, 17 nt, Mycobacterium tuberculosis H37Rv
gccugaccggcucgccg

SEQ ID NO: 3309222 - RNA, 18 nt, Mycobacterium tuberculosis H37Rv
gccugacgcgucagcggc

SEQ ID NO: 3309223 - RNA, 19 nt, Mycobacterium tuberculosis H37Rv
gccugacgcgucagcggcg

SEQ ID NO: 3309224 - RNA, 20 nt, Mycobacterium tuberculosis H37Rv
gccugacgcgucagcggcga

SEQ ID NO: 3309225 - RNA, 22 nt, Mycobacterium tuberculosis H37Rv
gccugacgcgucagcggcgagc

SEQ ID NO: 3309226 - RNA, 23 nt, Mycobacterium tuberculosis H37Rv
gccugacgcgucagcggcgagca

SEQ ID NO: 3309227 - RNA, 18 nt, Mycobacterium tuberculosis H37Rv
gccugagcgccgcggcgg

SEQ ID NO: 3309228 - RNA, 14 nt, Mycobacterium tuberculosis H37Rv
gccugagcggccuc

SEQ ID NO: 3309229 - RNA, 17 nt, Mycobacterium tuberculosis H37Rv
gccugauaaagcccggc

SEQ ID NO: 3309230 - RNA, 19 nt, Mycobacterium tuberculosis H37Rv
gccugauaaagcccggcgg

SEQ ID NO: 3309231 - RNA, 21 nt, Mycobacterium tuberculosis H37Rv
gccugauaaagcccggcggca

SEQ ID NO: 3309232 - RNA, 18 nt, Mycobacterium tuberculosis H37Rv
gccugauaugacuugcgc

SEQ ID NO: 3309233 - RNA, 14 nt, Mycobacterium tuberculosis H37Rv
gccugaugcggccg

SEQ ID NO: 3309234 - RNA, 20 nt, Mycobacterium tuberculosis H37Rv
gccugcaagcuaagcgccug

SEQ ID NO: 3309235 - RNA, 16 nt, Mycobacterium tuberculosis H37Rv
gccugcaccagcgagu

SEQ ID NO: 3309236 - RNA, 16 nt, Mycobacterium tuberculosis H37Rv
gccugcaccgccgccg

SEQ ID NO: 3309237 - RNA, 13 nt, Mycobacterium tuberculosis H37Rv
gccugcacgccgg

SEQ ID NO: 3309238 - RNA, 22 nt, Mycobacterium tuberculosis H37Rv
gccugcagcgaaacaccggcca

SEQ ID NO: 3309239 - RNA, 15 nt, Mycobacterium tuberculosis H37Rv
gccugcagcgcgacc

SEQ ID NO: 3309240 - RNA, 17 nt, Mycobacterium tuberculosis H37Rv
gccugcaggccgccggc

SEQ ID NO: 3309241 - RNA, 19 nt, Mycobacterium tuberculosis H37Rv
gccugcaggccgccggcca

SEQ ID NO: 3309242 - RNA, 19 nt, Mycobacterium tuberculosis H37Rv
gccugcagguuuccggccu

SEQ ID NO: 3309243 - RNA, 16 nt, Mycobacterium tuberculosis H37Rv
gccugcaguucggcgu

SEQ ID NO: 3309244 - RNA, 12 nt, Mycobacterium tuberculosis H37Rv
gccugccacagc

SEQ ID NO: 3309245 - RNA, 11 nt, Mycobacterium tuberculosis H37Rv
gccugccaccc

SEQ ID NO: 3309246 - RNA, 14 nt, Mycobacterium tuberculosis H37Rv
gccugccacccggc

SEQ ID NO: 3309247 - RNA, 14 nt, Mycobacterium tuberculosis H37Rv
gccugccaccggcg

SEQ ID NO: 3309248 - RNA, 19 nt, Mycobacterium tuberculosis H37Rv
gccugccauaggcccacgg

SEQ ID NO: 3309249 - RNA, 14 nt, Mycobacterium tuberculosis H37Rv
gccugcccaccuuc

SEQ ID NO: 3309250 - RNA, 15 nt, Mycobacterium tuberculosis H37Rv
gccugcccaccuucg

SEQ ID NO: 3309251 - RNA, 18 nt, Mycobacterium tuberculosis H37Rv
gccugcccaccuucgagu

SEQ ID NO: 3309252 - RNA, 12 nt, Mycobacterium tuberculosis H37Rv
gccugcccagca

SEQ ID NO: 3309253 - RNA, 20 nt, Mycobacterium tuberculosis H37Rv
gccuucguagcggccgcagg

SEQ ID NO: 3309254 - RNA, 21 nt, Mycobacterium tuberculosis H37Rv
gccuucgucgaugcgguaucg

SEQ ID NO: 3309255 - RNA, 21 nt, Mycobacterium tuberculosis H37Rv
gccuucucgcgaagaucagcg

SEQ ID NO: 3309256 - RNA, 18 nt, Mycobacterium tuberculosis H37Rv
gccuucuucgcggcgguc

SEQ ID NO: 3309257 - RNA, 19 nt, Mycobacterium tuberculosis H37Rv
gccuucuucgcuaccuucu

SEQ ID NO: 3309258 - RNA, 14 nt, Mycobacterium tuberculosis H37Rv
gccuugaccagcag

SEQ ID NO: 3309259 - RNA, 15 nt, Mycobacterium tuberculosis H37Rv
gccuugaccagcagc

SEQ ID NO: 3309260 - RNA, 15 nt, Mycobacterium tuberculosis H37Rv
gccuugacccuccgc

SEQ ID NO: 3309261 - RNA, 17 nt, Mycobacterium tuberculosis H37Rv
gccuugacccuccgcau

SEQ ID NO: 3309262 - RNA, 14 nt, Mycobacterium tuberculosis H37Rv
gccuugacgaucga

SEQ ID NO: 3309263 - RNA, 19 nt, Mycobacterium tuberculosis H37Rv
gccuugacugaacucaaca

SEQ ID NO: 3309264 - RNA, 15 nt, Mycobacterium tuberculosis H37Rv
gccuugagccgcccc

SEQ ID NO: 3309265 - RNA, 18 nt, Mycobacterium tuberculosis H37Rv
gccuugaggcccugcggc

SEQ ID NO: 3309266 - RNA, 16 nt, Mycobacterium tuberculosis H37Rv
gccuugaucgugcugg

SEQ ID NO: 3309267 - RNA, 18 nt, Mycobacterium tuberculosis H37Rv
gccuugaucugagcgcgg

SEQ ID NO: 3309268 - RNA, 14 nt, Mycobacterium tuberculosis H37Rv
gccuugauugccgc

SEQ ID NO: 3309269 - RNA, 22 nt, Mycobacterium tuberculosis H37Rv
gccuugcagcgcguucggcacc

SEQ ID NO: 3309270 - RNA, 12 nt, Mycobacterium tuberculosis H37Rv
gccuugccaccg

SEQ ID NO: 3309271 - RNA, 15 nt, Mycobacterium tuberculosis H37Rv
gccuugccaccggua

SEQ ID NO: 3309272 - RNA, 19 nt, Mycobacterium tuberculosis H37Rv
gccuugccgaucagcuggc

SEQ ID NO: 3309273 - RNA, 15 nt, Mycobacterium tuberculosis H37Rv
gccuugcgcacaggc

SEQ ID NO: 3309274 - RNA, 22 nt, Mycobacterium tuberculosis H37Rv
gccuugcgcacaggcgcgaucg

SEQ ID NO: 3309275 - RNA, 15 nt, Mycobacterium tuberculosis H37Rv
gccuugcgcgcgcag

SEQ ID NO: 3309276 - RNA, 17 nt, Mycobacterium tuberculosis H37Rv
gccuugcgucaucggcu

SEQ ID NO: 3309277 - RNA, 20 nt, Mycobacterium tuberculosis H37Rv
gccuugcguguaccagccca

SEQ ID NO: 3309278 - RNA, 16 nt, Mycobacterium tuberculosis H37Rv
gccuuggcagcccagu

SEQ ID NO: 3309279 - RNA, 17 nt, Mycobacterium tuberculosis H37Rv
gccuuggcaguccagcc

SEQ ID NO: 3309280 - RNA, 16 nt, Mycobacterium tuberculosis H37Rv
gccuuggccaccaucg

SEQ ID NO: 3309281 - RNA, 21 nt, Mycobacterium tuberculosis H37Rv
gccuuggccaccaucgccgcc

SEQ ID NO: 3309282 - RNA, 12 nt, Mycobacterium tuberculosis H37Rv
gccuuggccagc

SEQ ID NO: 3309283 - RNA, 14 nt, Mycobacterium tuberculosis H37Rv
gccuuggcccccgg

SEQ ID NO: 3309284 - RNA, 21 nt, Mycobacterium tuberculosis H37Rv
gccuuggcgaacgccacggca

SEQ ID NO: 3309285 - RNA, 14 nt, Mycobacterium tuberculosis H37Rv
gccuuggcgcggca

SEQ ID NO: 3309286 - RNA, 12 nt, Mycobacterium tuberculosis H37Rv
gccuuggcggcc

SEQ ID NO: 3309287 - RNA, 18 nt, Mycobacterium tuberculosis H37Rv
gccuuggcggccgcgacc

SEQ ID NO: 3309288 - RNA, 15 nt, Mycobacterium tuberculosis H37Rv
gccuuggcggcggca

SEQ ID NO: 3309289 - RNA, 18 nt, Mycobacterium tuberculosis H37Rv
gccuuggucaccuucuug

SEQ ID NO: 3309290 - RNA, 14 nt, Mycobacterium tuberculosis H37Rv
gccuuggucgccgc

SEQ ID NO: 3309291 - RNA, 15 nt, Mycobacterium tuberculosis H37Rv
gccuuggucgccgcc

SEQ ID NO: 3309292 - RNA, 18 nt, Mycobacterium tuberculosis H37Rv
gccuuggucgccgccuuc

SEQ ID NO: 3309293 - RNA, 21 nt, Mycobacterium tuberculosis H37Rv
gccuuggucgccgccuucuug

SEQ ID NO: 3309294 - RNA, 21 nt, Mycobacterium tuberculosis H37Rv
gccuuggucgccgcuuucuug

SEQ ID NO: 3309295 - RNA, 14 nt, Mycobacterium tuberculosis H37Rv
gccuugucggcgau

SEQ ID NO: 3309296 - RNA, 15 nt, Mycobacterium tuberculosis H37Rv
gccuugucggcgaug

SEQ ID NO: 3309297 - RNA, 24 nt, Mycobacterium tuberculosis H37Rv
gccuugucggcgugucgcgucgca

SEQ ID NO: 3309298 - RNA, 13 nt, Mycobacterium tuberculosis H37Rv
gccuugugcucga

SEQ ID NO: 3309299 - RNA, 23 nt, Mycobacterium tuberculosis H37Rv
gccuuguggaaccaucccugaaa

SEQ ID NO: 3309300 - RNA, 15 nt, Mycobacterium tuberculosis H37Rv
gccuuguucgcccac

SEQ ID NO: 3309301 - RNA, 17 nt, Mycobacterium tuberculosis H37Rv
gccuuguucuuggccac

SEQ ID NO: 3309302 - RNA, 20 nt, Mycobacterium tuberculosis H37Rv
gccuuguucuuggccacccc

SEQ ID NO: 3309303 - RNA, 13 nt, Mycobacterium tuberculosis H37Rv
gccuuguuguccu

SEQ ID NO: 3309304 - RNA, 18 nt, Mycobacterium tuberculosis H37Rv
gccuuguuguccuucagc

SEQ ID NO: 3309305 - RNA, 23 nt, Mycobacterium tuberculosis H37Rv
gccuuuccagcaccccgaucugg

SEQ ID NO: 3309306 - RNA, 14 nt, Mycobacterium tuberculosis H37Rv
gccuuugcccccgg

SEQ ID NO: 3309307 - RNA, 14 nt, Mycobacterium tuberculosis H37Rv
gcgaaaaucccgcu

SEQ ID NO: 3309308 - RNA, 16 nt, Mycobacterium tuberculosis H37Rv
gcgaaacaccggccag

SEQ ID NO: 3309309 - RNA, 15 nt, Mycobacterium tuberculosis H37Rv
gcgaaacaggccacu

SEQ ID NO: 3309310 - RNA, 16 nt, Mycobacterium tuberculosis H37Rv
gcgaaacaucucggcg

SEQ ID NO: 3309311 - RNA, 20 nt, Mycobacterium tuberculosis H37Rv
gcgaaacaucucggcgcagc

SEQ ID NO: 3309312 - RNA, 15 nt, Mycobacterium tuberculosis H37Rv
gcgaaacgcccgggc

SEQ ID NO: 3309313 - RNA, 13 nt, Mycobacterium tuberculosis H37Rv
gcgaaagagagcu

SEQ ID NO: 3309314 - RNA, 16 nt, Mycobacterium tuberculosis H37Rv
gcgaaagcaccgagca

SEQ ID NO: 3309315 - RNA, 20 nt, Mycobacterium tuberculosis H37Rv
gcgaaauaacggagcggccu

SEQ ID NO: 3309316 - RNA, 18 nt, Mycobacterium tuberculosis H37Rv
gcgaaauccgcgaucggc

SEQ ID NO: 3309317 - RNA, 20 nt, Mycobacterium tuberculosis H37Rv
gcgaaauuacuucggccaca

SEQ ID NO: 3309318 - RNA, 16 nt, Mycobacterium tuberculosis H37Rv
gcgaacaacgcggacu

SEQ ID NO: 3309319 - RNA, 18 nt, Mycobacterium tuberculosis H37Rv
gcgaacaaguggccagcg

SEQ ID NO: 3309320 - RNA, 22 nt, Mycobacterium tuberculosis H37Rv
gcgaacacccggucaucggccg

SEQ ID NO: 3309321 - RNA, 19 nt, Mycobacterium tuberculosis H37Rv
gcgaacacgcgaugacgag

SEQ ID NO: 3309322 - RNA, 19 nt, Mycobacterium tuberculosis H37Rv
gcgaacagacaugcgcacc

SEQ ID NO: 3309323 - RNA, 15 nt, Mycobacterium tuberculosis H37Rv
gcgaacagccccagg

SEQ ID NO: 3309324 - RNA, 12 nt, Mycobacterium tuberculosis H37Rv
gcgaacagcggc

SEQ ID NO: 3309325 - RNA, 13 nt, Mycobacterium tuberculosis H37Rv
gcgaacagcucgu

SEQ ID NO: 3309326 - RNA, 22 nt, Mycobacterium tuberculosis H37Rv
gcgaacaucaccgucgcccggg

SEQ ID NO: 3309327 - RNA, 14 nt, Mycobacterium tuberculosis H37Rv
gcgaacaucgccag

SEQ ID NO: 3309328 - RNA, 19 nt, Mycobacterium tuberculosis H37Rv
gcgaacaucgccagcgccg

SEQ ID NO: 3309329 - RNA, 18 nt, Mycobacterium tuberculosis H37Rv
gcgaaccacgccaucgag

SEQ ID NO: 3309330 - RNA, 19 nt, Mycobacterium tuberculosis H37Rv
gcgaaccagaguucggcca

SEQ ID NO: 3309331 - RNA, 20 nt, Mycobacterium tuberculosis H37Rv
gcgaacccgagccgccgugg

SEQ ID NO: 3309332 - RNA, 20 nt, Mycobacterium tuberculosis H37Rv
gcgaacccgaucgucgagcc

SEQ ID NO: 3309333 - RNA, 14 nt, Mycobacterium tuberculosis H37Rv
gcgaacccgccgau

SEQ ID NO: 3309334 - RNA, 15 nt, Mycobacterium tuberculosis H37Rv
gcgaacccgcguuga

SEQ ID NO: 3309335 - RNA, 12 nt, Mycobacterium tuberculosis H37Rv
gcgaacccgguc

SEQ ID NO: 3309336 - RNA, 14 nt, Mycobacterium tuberculosis H37Rv
gcgaaccgccggca

SEQ ID NO: 3309337 - RNA, 15 nt, Mycobacterium tuberculosis H37Rv
gcgaaccgccggcac

SEQ ID NO: 3309338 - RNA, 15 nt, Mycobacterium tuberculosis H37Rv
gcgaaccgcggaucg

SEQ ID NO: 3309339 - RNA, 14 nt, Mycobacterium tuberculosis H37Rv
gcgaaccgcuccga

SEQ ID NO: 3309340 - RNA, 17 nt, Mycobacterium tuberculosis H37Rv
gcgaaccgcuccgagca

SEQ ID NO: 3309341 - RNA, 17 nt, Mycobacterium tuberculosis H37Rv
gcgaaccggcccaccga

SEQ ID NO: 3309342 - RNA, 19 nt, Mycobacterium tuberculosis H37Rv
gcgaaccgucagcgcgccg

SEQ ID NO: 3309343 - RNA, 17 nt, Mycobacterium tuberculosis H37Rv
gcgaacgaagucgacga

SEQ ID NO: 3309344 - RNA, 18 nt, Mycobacterium tuberculosis H37Rv
gcgaacgaauccgcucga

SEQ ID NO: 3309345 - RNA, 16 nt, Mycobacterium tuberculosis H37Rv
gcgaacgaucccgccg

SEQ ID NO: 3309346 - RNA, 22 nt, Mycobacterium tuberculosis H37Rv
gcgaacgauuucggcccacucc

SEQ ID NO: 3309347 - RNA, 21 nt, Mycobacterium tuberculosis H37Rv
gcgaacgcguccagcgcggcc

SEQ ID NO: 3309348 - RNA, 22 nt, Mycobacterium tuberculosis H37Rv
gcgaacgcguccagcgcggccu

SEQ ID NO: 3309349 - RNA, 22 nt, Mycobacterium tuberculosis H37Rv
gcgaacgcuucaccucgucgac

SEQ ID NO: 3309350 - RNA, 22 nt, Mycobacterium tuberculosis H37Rv
gcgaacggauucccgcccagca

SEQ ID NO: 3309351 - RNA, 16 nt, Mycobacterium tuberculosis H37Rv
gcgaacggcgcaguug

SEQ ID NO: 3309352 - RNA, 15 nt, Mycobacterium tuberculosis H37Rv
gcgaacgggcuuccg

SEQ ID NO: 3309353 - RNA, 20 nt, Mycobacterium tuberculosis H37Rv
gcgaacgggcuuccgacaug

SEQ ID NO: 3309354 - RNA, 18 nt, Mycobacterium tuberculosis H37Rv
gcgaacucgcgccgagcc

SEQ ID NO: 3309355 - RNA, 20 nt, Mycobacterium tuberculosis H37Rv
gcgaacucgcgccgagccag

SEQ ID NO: 3309356 - RNA, 14 nt, Mycobacterium tuberculosis H37Rv
gcgaacucggcgau

SEQ ID NO: 3309357 - RNA, 16 nt, Mycobacterium tuberculosis H37Rv
gcgaacuuggccgagu

SEQ ID NO: 3309358 - RNA, 19 nt, Mycobacterium tuberculosis H37Rv
gcgaagaacaacaucgcca

SEQ ID NO: 3309359 - RNA, 19 nt, Mycobacterium tuberculosis H37Rv
gcgaagacuagcugcuagc

SEQ ID NO: 3309360 - RNA, 14 nt, Mycobacterium tuberculosis H37Rv
gcgaagagcccguu

SEQ ID NO: 3309361 - RNA, 13 nt, Mycobacterium tuberculosis H37Rv
gcgaagcaaguga

SEQ ID NO: 3309362 - RNA, 21 nt, Mycobacterium tuberculosis H37Rv
gcgaagcaagugaauacccca

SEQ ID NO: 3309363 - RNA, 13 nt, Mycobacterium tuberculosis H37Rv
gcgaagcacaccg

SEQ ID NO: 3309364 - RNA, 20 nt, Mycobacterium tuberculosis H37Rv
gcgaagcauucaggccgagg

SEQ ID NO: 3309365 - RNA, 21 nt, Mycobacterium tuberculosis H37Rv
gcgaagcauucaggccgagga

SEQ ID NO: 3309366 - RNA, 13 nt, Mycobacterium tuberculosis H37Rv
gcgaagccaccag

SEQ ID NO: 3309367 - RNA, 16 nt, Mycobacterium tuberculosis H37Rv
gcgaagccaccagguc

SEQ ID NO: 3309368 - RNA, 20 nt, Mycobacterium tuberculosis H37Rv
gcgaagcccgacaugaggcu

SEQ ID NO: 3309369 - RNA, 22 nt, Mycobacterium tuberculosis H37Rv
gcgaagcccgacaugaggcugc

SEQ ID NO: 3309370 - RNA, 13 nt, Mycobacterium tuberculosis H37Rv
gcgaagccgagca

SEQ ID NO: 3309371 - RNA, 17 nt, Mycobacterium tuberculosis H37Rv
gcgaagccgagcaucag

SEQ ID NO: 3309372 - RNA, 17 nt, Mycobacterium tuberculosis H37Rv
gcgaagccgggugcugg

SEQ ID NO: 3309373 - RNA, 18 nt, Mycobacterium tuberculosis H37Rv
gcgaagccgguucgccca

SEQ ID NO: 3309374 - RNA, 22 nt, Mycobacterium tuberculosis H37Rv
gcgaagccgguucgcccagcag

SEQ ID NO: 3309375 - RNA, 23 nt, Mycobacterium tuberculosis H37Rv
gcgaagccgguucgcccagcagg

SEQ ID NO: 3309376 - RNA, 12 nt, Mycobacterium tuberculosis H37Rv
gcgaagcgggcg

SEQ ID NO: 3309377 - RNA, 14 nt, Mycobacterium tuberculosis H37Rv
gcgaagcuagagcc

SEQ ID NO: 3309378 - RNA, 17 nt, Mycobacterium tuberculosis H37Rv
gcgaagcuagcgcccgc

SEQ ID NO: 3309379 - RNA, 18 nt, Mycobacterium tuberculosis H37Rv
gcgaagcugugcccggcg

SEQ ID NO: 3309380 - RNA, 19 nt, Mycobacterium tuberculosis H37Rv
gcgaaggauuugauaggcg

SEQ ID NO: 3309381 - RNA, 13 nt, Mycobacterium tuberculosis H37Rv
gcgaaggccagca

SEQ ID NO: 3309382 - RNA, 15 nt, Mycobacterium tuberculosis H37Rv
gcgaaggccagcaga

SEQ ID NO: 3309383 - RNA, 15 nt, Mycobacterium tuberculosis H37Rv
gcgaaggcgccgaac

SEQ ID NO: 3309384 - RNA, 13 nt, Mycobacterium tuberculosis H37Rv
gcgaagggcaccg

SEQ ID NO: 3309385 - RNA, 17 nt, Mycobacterium tuberculosis H37Rv
gcgaagggcaccggcga

SEQ ID NO: 3309386 - RNA, 15 nt, Mycobacterium tuberculosis H37Rv
gcgaaggucagcgac

SEQ ID NO: 3309387 - RNA, 17 nt, Mycobacterium tuberculosis H37Rv
gcgaagguccgugccga

SEQ ID NO: 3309388 - RNA, 16 nt, Mycobacterium tuberculosis H37Rv
gcgaagguguccucca

SEQ ID NO: 3309389 - RNA, 17 nt, Mycobacterium tuberculosis H37Rv
gcgaagucgagugccgc

SEQ ID NO: 3309390 - RNA, 21 nt, Mycobacterium tuberculosis H37Rv
gcgaagucuugaccgcaccgg

SEQ ID NO: 3309391 - RNA, 16 nt, Mycobacterium tuberculosis H37Rv
gcgaagugcgcgcugg

SEQ ID NO: 3309392 - RNA, 16 nt, Mycobacterium tuberculosis H37Rv
gcgaaguugcggguga

SEQ ID NO: 3309393 - RNA, 22 nt, Mycobacterium tuberculosis H37Rv
gcgaauacgaggacgacgauca

SEQ ID NO: 3309394 - RNA, 14 nt, Mycobacterium tuberculosis H37Rv
gcgaauagccacca

SEQ ID NO: 3309395 - RNA, 19 nt, Mycobacterium tuberculosis H37Rv
gcgaaucacguggaccacg

SEQ ID NO: 3309396 - RNA, 15 nt, Mycobacterium tuberculosis H37Rv
gcgaauccgcacagg

SEQ ID NO: 3309397 - RNA, 23 nt, Mycobacterium tuberculosis H37Rv
gcgaauccggcgggugccgagcu

SEQ ID NO: 3309398 - RNA, 21 nt, Mycobacterium tuberculosis H37Rv
gcgaaucggcccgugccacag

SEQ ID NO: 3309399 - RNA, 22 nt, Mycobacterium tuberculosis H37Rv
gcgaaucggcccgugccacagc

SEQ ID NO: 3309400 - RNA, 15 nt, Mycobacterium tuberculosis H37Rv
gcgaaucgguggucg

SEQ ID NO: 3309401 - RNA, 18 nt, Mycobacterium tuberculosis H37Rv
gcgaaugcgggccuccug

SEQ ID NO: 3309402 - RNA, 14 nt, Mycobacterium tuberculosis H37Rv
gcgaaugucgccgc

SEQ ID NO: 3309403 - RNA, 19 nt, Mycobacterium tuberculosis H37Rv
gcgaauugcaggacgcggg

SEQ ID NO: 3309404 - RNA, 21 nt, Mycobacterium tuberculosis H37Rv
gcgacaaacguguugaccggg

SEQ ID NO: 3309405 - RNA, 18 nt, Mycobacterium tuberculosis H37Rv
gcgacaacaccacggugc

SEQ ID NO: 3309406 - RNA, 22 nt, Mycobacterium tuberculosis H37Rv
gcgacaacaccacggugccgac

SEQ ID NO: 3309407 - RNA, 21 nt, Mycobacterium tuberculosis H37Rv
gcgacaacccggcgucgacga

SEQ ID NO: 3309408 - RNA, 16 nt, Mycobacterium tuberculosis H37Rv
gcgacaaggucgucga

SEQ ID NO: 3309409 - RNA, 17 nt, Mycobacterium tuberculosis H37Rv
gcgacacaacggguguc

SEQ ID NO: 3309410 - RNA, 21 nt, Mycobacterium tuberculosis H37Rv
gcgacacauagugcggcaccg

SEQ ID NO: 3309411 - RNA, 12 nt, Mycobacterium tuberculosis H37Rv
gcgacacaucgc

SEQ ID NO: 3309412 - RNA, 14 nt, Mycobacterium tuberculosis H37Rv
gcgacacaucgccc

SEQ ID NO: 3309413 - RNA, 16 nt, Mycobacterium tuberculosis H37Rv
gcgacaccacgaaucc

SEQ ID NO: 3309414 - RNA, 14 nt, Mycobacterium tuberculosis H37Rv
gcgacacgccggcg

SEQ ID NO: 3309415 - RNA, 16 nt, Mycobacterium tuberculosis H37Rv
gcgacagaugccgggc

SEQ ID NO: 3309416 - RNA, 17 nt, Mycobacterium tuberculosis H37Rv
gcgacagaugccgggcu

SEQ ID NO: 3309417 - RNA, 12 nt, Mycobacterium tuberculosis H37Rv
gcgacagcagcg

SEQ ID NO: 3309418 - RNA, 15 nt, Mycobacterium tuberculosis H37Rv
gcgacagcagcgcca

SEQ ID NO: 3309419 - RNA, 15 nt, Mycobacterium tuberculosis H37Rv
gcgacagccguggcg

SEQ ID NO: 3309420 - RNA, 16 nt, Mycobacterium tuberculosis H37Rv
gcgacagcgcggcggu

SEQ ID NO: 3309421 - RNA, 21 nt, Mycobacterium tuberculosis H37Rv
gcgacagcggcgacaugaucu

SEQ ID NO: 3309422 - RNA, 17 nt, Mycobacterium tuberculosis H37Rv
gcgacagcggcgucggu

SEQ ID NO: 3309423 - RNA, 22 nt, Mycobacterium tuberculosis H37Rv
gcgacagcgugccgaacaggga

SEQ ID NO: 3309424 - RNA, 16 nt, Mycobacterium tuberculosis H37Rv
gcgacaggacgucggc

SEQ ID NO: 3309425 - RNA, 22 nt, Mycobacterium tuberculosis H37Rv
gcgacaggagacgguacgccag

SEQ ID NO: 3309426 - RNA, 13 nt, Mycobacterium tuberculosis H37Rv
gcgacaggccgag

SEQ ID NO: 3309427 - RNA, 22 nt, Mycobacterium tuberculosis H37Rv
gcgacauccacaccgcggcggc

SEQ ID NO: 3309428 - RNA, 17 nt, Mycobacterium tuberculosis H37Rv
gcgacauccgcggcaug

SEQ ID NO: 3309429 - RNA, 18 nt, Mycobacterium tuberculosis H37Rv
gcgacaugaucugccacc

SEQ ID NO: 3309430 - RNA, 19 nt, Mycobacterium tuberculosis H37Rv
gcgacaugaucugccaccg

SEQ ID NO: 3309431 - RNA, 23 nt, Mycobacterium tuberculosis H37Rv
gcgacaugucgaacgccccccac

SEQ ID NO: 3309432 - RNA, 21 nt, Mycobacterium tuberculosis H37Rv
gcgacauuggucaccugcugc

SEQ ID NO: 3309433 - RNA, 19 nt, Mycobacterium tuberculosis H37Rv
gcgaccaauagguccccac

SEQ ID NO: 3309434 - RNA, 22 nt, Mycobacterium tuberculosis H37Rv
gcgaccaaugcguugacgucga

SEQ ID NO: 3309435 - RNA, 22 nt, Mycobacterium tuberculosis H37Rv
gcgaccacaucaugccagccgu

SEQ ID NO: 3309436 - RNA, 13 nt, Mycobacterium tuberculosis H37Rv
gcgaccaccaccg

SEQ ID NO: 3309437 - RNA, 14 nt, Mycobacterium tuberculosis H37Rv
gcgaccaccaccgc

SEQ ID NO: 3309438 - RNA, 20 nt, Mycobacterium tuberculosis H37Rv
gcgaccaccaccgccgccga

SEQ ID NO: 3309439 - RNA, 14 nt, Mycobacterium tuberculosis H37Rv
gcgaccaccagcgc

SEQ ID NO: 3309440 - RNA, 17 nt, Mycobacterium tuberculosis H37Rv
gcgaccaccagcgccga

SEQ ID NO: 3309441 - RNA, 19 nt, Mycobacterium tuberculosis H37Rv
gcgaccaccgcgucgggcc

SEQ ID NO: 3309442 - RNA, 20 nt, Mycobacterium tuberculosis H37Rv
gcgaccaccguuugagcggc

SEQ ID NO: 3309443 - RNA, 13 nt, Mycobacterium tuberculosis H37Rv
gcgaccacgauga

SEQ ID NO: 3309444 - RNA, 14 nt, Mycobacterium tuberculosis H37Rv
gcgaccacgcaccg

SEQ ID NO: 3309445 - RNA, 18 nt, Mycobacterium tuberculosis H37Rv
gcgaccacgccgccggcg

SEQ ID NO: 3309446 - RNA, 17 nt, Mycobacterium tuberculosis H37Rv
gcgacgcucgcugcagc

SEQ ID NO: 3309447 - RNA, 18 nt, Mycobacterium tuberculosis H37Rv
gcgacgcucgcugcagca

SEQ ID NO: 3309448 - RNA, 21 nt, Mycobacterium tuberculosis H37Rv
gcgacgcucgcugcagcaggg

SEQ ID NO: 3309449 - RNA, 14 nt, Mycobacterium tuberculosis H37Rv
gcgacgcugccgcc

SEQ ID NO: 3309450 - RNA, 17 nt, Mycobacterium tuberculosis H37Rv
gcgacggacucccucga

SEQ ID NO: 3309451 - RNA, 21 nt, Mycobacterium tuberculosis H37Rv
gcgacggacucccucgaucac

SEQ ID NO: 3309452 - RNA, 19 nt, Mycobacterium tuberculosis H37Rv
gcgacggccaagaucggcg

SEQ ID NO: 3309453 - RNA, 14 nt, Mycobacterium tuberculosis H37Rv
gcgacggccagcgc

SEQ ID NO: 3309454 - RNA, 18 nt, Mycobacterium tuberculosis H37Rv
gcgacggcccgaucccga

SEQ ID NO: 3309455 - RNA, 13 nt, Mycobacterium tuberculosis H37Rv
gcgacggccggca

SEQ ID NO: 3309456 - RNA, 13 nt, Mycobacterium tuberculosis H37Rv
gcgacggccggga

SEQ ID NO: 3309457 - RNA, 12 nt, Mycobacterium tuberculosis H37Rv
gcgacggcgccc

SEQ ID NO: 3309458 - RNA, 20 nt, Mycobacterium tuberculosis H37Rv
gcgacggcgcccauagcacc

SEQ ID NO: 3309459 - RNA, 23 nt, Mycobacterium tuberculosis H37Rv
gcgacggcgcccauagcaccucg

SEQ ID NO: 3309460 - RNA, 15 nt, Mycobacterium tuberculosis H37Rv
gcgacggcgccggca

SEQ ID NO: 3309461 - RNA, 14 nt, Mycobacterium tuberculosis H37Rv
gcgacggcgcucgg

SEQ ID NO: 3309462 - RNA, 16 nt, Mycobacterium tuberculosis H37Rv
gcgacggcgcucggcg

SEQ ID NO: 3309463 - RNA, 19 nt, Mycobacterium tuberculosis H37Rv
gcgacggcgcucggcgagc

SEQ ID NO: 3309464 - RNA, 21 nt, Mycobacterium tuberculosis H37Rv
gcgacggcggcgucgaugagg

SEQ ID NO: 3309465 - RNA, 20 nt, Mycobacterium tuberculosis H37Rv
gcgacggcucuaccgguccg

SEQ ID NO: 3309466 - RNA, 19 nt, Mycobacterium tuberculosis H37Rv
gcgacgggcacccgagccg

SEQ ID NO: 3309467 - RNA, 20 nt, Mycobacterium tuberculosis H37Rv
gcgacgggcacccgagccgc

SEQ ID NO: 3309468 - RNA, 15 nt, Mycobacterium tuberculosis H37Rv
gcgacgggucgggca

SEQ ID NO: 3309469 - RNA, 23 nt, Mycobacterium tuberculosis H37Rv
gcgacggucaaggugcgccgcca

SEQ ID NO: 3309470 - RNA, 21 nt, Mycobacterium tuberculosis H37Rv
gcgacggucccggcacgucga

SEQ ID NO: 3309471 - RNA, 22 nt, Mycobacterium tuberculosis H37Rv
gcgacggugagggcgucgucga

SEQ ID NO: 3309472 - RNA, 17 nt, Mycobacterium tuberculosis H37Rv
gcgacgguuucgaccac

SEQ ID NO: 3309473 - RNA, 22 nt, Mycobacterium tuberculosis H37Rv
gcgacguauuucgcccccugga

SEQ ID NO: 3309474 - RNA, 18 nt, Mycobacterium tuberculosis H37Rv
gcgacgucaaacgcaaag

SEQ ID NO: 3309475 - RNA, 21 nt, Mycobacterium tuberculosis H37Rv
gcgacgucaggguauccacgc

SEQ ID NO: 3309476 - RNA, 16 nt, Mycobacterium tuberculosis H37Rv
gcgacgucaucgccga

SEQ ID NO: 3309477 - RNA, 16 nt, Mycobacterium tuberculosis H37Rv
gcgacgucucgcaugc

SEQ ID NO: 3309478 - RNA, 17 nt, Mycobacterium tuberculosis H37Rv
gcgacgucugccaggcg

SEQ ID NO: 3309479 - RNA, 21 nt, Mycobacterium tuberculosis H37Rv
gcgacgucugccaggcgcagc

SEQ ID NO: 3309480 - RNA, 19 nt, Mycobacterium tuberculosis H37Rv
gcgacgugaaugguggugu

SEQ ID NO: 3309481 - RNA, 15 nt, Mycobacterium tuberculosis H37Rv
gcgacguuccgcucg

SEQ ID NO: 3309482 - RNA, 16 nt, Mycobacterium tuberculosis H37Rv
gcgacguuccgcucga

SEQ ID NO: 3309483 - RNA, 20 nt, Mycobacterium tuberculosis H37Rv
gcgacguugguugcguccgc

SEQ ID NO: 3309484 - RNA, 15 nt, Mycobacterium tuberculosis H37Rv
gcgacuaagggcacu

SEQ ID NO: 3309485 - RNA, 14 nt, Mycobacterium tuberculosis H37Rv
gcgacuaccaucgc

SEQ ID NO: 3309486 - RNA, 14 nt, Mycobacterium tuberculosis H37Rv
gcgacuacggccuc

SEQ ID NO: 3309487 - RNA, 22 nt, Mycobacterium tuberculosis H37Rv
gcgacuagacgccgccgcugcc

SEQ ID NO: 3309488 - RNA, 20 nt, Mycobacterium tuberculosis H37Rv
gcgacucgaggaccugcucg

SEQ ID NO: 3309489 - RNA, 13 nt, Mycobacterium tuberculosis H37Rv
gcgacucgccggc

SEQ ID NO: 3309490 - RNA, 15 nt, Mycobacterium tuberculosis H37Rv
gcgacucggccagga

SEQ ID NO: 3309491 - RNA, 12 nt, Mycobacterium tuberculosis H37Rv
gcgacucggugc

SEQ ID NO: 3309492 - RNA, 17 nt, Mycobacterium tuberculosis H37Rv
gcgacucggugcgguga

SEQ ID NO: 3309493 - RNA, 23 nt, Mycobacterium tuberculosis H37Rv
gcgacucgugucugccucggggc

SEQ ID NO: 3309494 - RNA, 18 nt, Mycobacterium tuberculosis H37Rv
gcgacucugugacgggca

SEQ ID NO: 3309495 - RNA, 17 nt, Mycobacterium tuberculosis H37Rv
gcgacugcagcggcgca

SEQ ID NO: 3309496 - RNA, 14 nt, Mycobacterium tuberculosis H37Rv
gcgacugcucgccg

SEQ ID NO: 3309497 - RNA, 18 nt, Mycobacterium tuberculosis H37Rv
gcgacugcucgccggacg

SEQ ID NO: 3309498 - RNA, 17 nt, Mycobacterium tuberculosis H37Rv
gcgacuuggugacaccg

SEQ ID NO: 3309499 - RNA, 19 nt, Mycobacterium tuberculosis H37Rv
gcgagaagcagggauucug

SEQ ID NO: 3309500 - RNA, 16 nt, Mycobacterium tuberculosis H37Rv
gcgagaaggugcugcg

SEQ ID NO: 3309501 - RNA, 20 nt, Mycobacterium tuberculosis H37Rv
gcgagaaggugcugcgcggg

SEQ ID NO: 3309502 - RNA, 19 nt, Mycobacterium tuberculosis H37Rv
gcgagaagucgcagcgagg

SEQ ID NO: 3309503 - RNA, 14 nt, Mycobacterium tuberculosis H37Rv
gcgagaaucccggg

SEQ ID NO: 3309504 - RNA, 16 nt, Mycobacterium tuberculosis H37Rv
gcgagaccucucugcg

SEQ ID NO: 3309505 - RNA, 23 nt, Mycobacterium tuberculosis H37Rv
gcgagaccucucugcgccaggcg

SEQ ID NO: 3309506 - RNA, 22 nt, Mycobacterium tuberculosis H37Rv
gcgagacgcuccaguggcgcca

SEQ ID NO: 3309507 - RNA, 14 nt, Mycobacterium tuberculosis H37Rv
gcgagacgucgaac

SEQ ID NO: 3309508 - RNA, 21 nt, Mycobacterium tuberculosis H37Rv
gcgagacuucgacgcggcgac

SEQ ID NO: 3309509 - RNA, 16 nt, Mycobacterium tuberculosis H37Rv
gcgagagccggcggcg

SEQ ID NO: 3309510 - RNA, 15 nt, Mycobacterium tuberculosis H37Rv
gcgagagccucggcc

SEQ ID NO: 3309511 - RNA, 15 nt, Mycobacterium tuberculosis H37Rv
gcgagagcgcggaga

SEQ ID NO: 3309512 - RNA, 17 nt, Mycobacterium tuberculosis H37Rv
gcgagaggugcugcacc

SEQ ID NO: 3309513 - RNA, 16 nt, Mycobacterium tuberculosis H37Rv
gcgagauccuucgcgu

SEQ ID NO: 3309514 - RNA, 16 nt, Mycobacterium tuberculosis H37Rv
gcgagaucgcggcgac

SEQ ID NO: 3309515 - RNA, 23 nt, Mycobacterium tuberculosis H37Rv
gcgagaucggauggugugucggg

SEQ ID NO: 3309516 - RNA, 14 nt, Mycobacterium tuberculosis H37Rv
gcgagcaacacgag

SEQ ID NO: 3309517 - RNA, 15 nt, Mycobacterium tuberculosis H37Rv
gcgagcaacacgagc

SEQ ID NO: 3309518 - RNA, 13 nt, Mycobacterium tuberculosis H37Rv
gcgagcaccaccc

SEQ ID NO: 3309519 - RNA, 20 nt, Mycobacterium tuberculosis H37Rv
gcgagcaccaccccagcggc

SEQ ID NO: 3309520 - RNA, 17 nt, Mycobacterium tuberculosis H37Rv
gcgagcacccgcugguc

SEQ ID NO: 3309521 - RNA, 21 nt, Mycobacterium tuberculosis H37Rv
gcgagcacccgcuggucgagc

SEQ ID NO: 3309522 - RNA, 19 nt, Mycobacterium tuberculosis H37Rv
gcgagcacccguugaucgc

SEQ ID NO: 3309523 - RNA, 20 nt, Mycobacterium tuberculosis H37Rv
gcgagcagacacagaaucgc

SEQ ID NO: 3309524 - RNA, 15 nt, Mycobacterium tuberculosis H37Rv
gcgagcagacgcaaa

SEQ ID NO: 3309525 - RNA, 22 nt, Mycobacterium tuberculosis H37Rv
gcgagcagacgcaaaagccacc

SEQ ID NO: 3309526 - RNA, 20 nt, Mycobacterium tuberculosis H37Rv
gcgagcagacgcaaaaucgc

SEQ ID NO: 3309527 - RNA, 15 nt, Mycobacterium tuberculosis H37Rv
gcgagcagacgcaga

SEQ ID NO: 3309528 - RNA, 21 nt, Mycobacterium tuberculosis H37Rv
gcgagcagacgcagagucgca

SEQ ID NO: 3309529 - RNA, 17 nt, Mycobacterium tuberculosis H37Rv
gcgagcagacgccgcgu

SEQ ID NO: 3309530 - RNA, 15 nt, Mycobacterium tuberculosis H37Rv
gcgagcagacgcgga

SEQ ID NO: 3309531 - RNA, 20 nt, Mycobacterium tuberculosis H37Rv
gcgagcagacgcggaaucgc

SEQ ID NO: 3309532 - RNA, 21 nt, Mycobacterium tuberculosis H37Rv
gcgagcagacgcggaaucgca

SEQ ID NO: 3309533 - RNA, 19 nt, Mycobacterium tuberculosis H37Rv
gcgagcagggcgucgaccg

SEQ ID NO: 3309534 - RNA, 14 nt, Mycobacterium tuberculosis H37Rv
gcgagcaggggagu

SEQ ID NO: 3309535 - RNA, 19 nt, Mycobacterium tuberculosis H37Rv
gcgagcauaccgccgcugc

SEQ ID NO: 3309536 - RNA, 16 nt, Mycobacterium tuberculosis H37Rv
gcgagcaucgacgaac

SEQ ID NO: 3309537 - RNA, 12 nt, Mycobacterium tuberculosis H37Rv
gcgagccaacuc

SEQ ID NO: 3309538 - RNA, 21 nt, Mycobacterium tuberculosis H37Rv
gcgagcccacguggggccggg

SEQ ID NO: 3309539 - RNA, 13 nt, Mycobacterium tuberculosis H37Rv
gcgagcccagcug

SEQ ID NO: 3309540 - RNA, 18 nt, Mycobacterium tuberculosis H37Rv
gcgagcccagcugcgccg

SEQ ID NO: 3309541 - RNA, 22 nt, Mycobacterium tuberculosis H37Rv
gcgagcccagcugcgccgaacg

SEQ ID NO: 3309542 - RNA, 19 nt, Mycobacterium tuberculosis H37Rv
gcgauccugaccagccagg

SEQ ID NO: 3309543 - RNA, 16 nt, Mycobacterium tuberculosis H37Rv
gcgaucgacaccguga

SEQ ID NO: 3309544 - RNA, 20 nt, Mycobacterium tuberculosis H37Rv
gcgaucgacaccgugaccgc

SEQ ID NO: 3309545 - RNA, 16 nt, Mycobacterium tuberculosis H37Rv
gcgaucgacgauccac

SEQ ID NO: 3309546 - RNA, 16 nt, Mycobacterium tuberculosis H37Rv
gcgaucgacgcucggc

SEQ ID NO: 3309547 - RNA, 17 nt, Mycobacterium tuberculosis H37Rv
gcgaucgauuccgcucg

SEQ ID NO: 3309548 - RNA, 16 nt, Mycobacterium tuberculosis H37Rv
gcgaucgccgacgcca

SEQ ID NO: 3309549 - RNA, 13 nt, Mycobacterium tuberculosis H37Rv
gcgaucgccuggg

SEQ ID NO: 3309550 - RNA, 22 nt, Mycobacterium tuberculosis H37Rv
gcgaucgccugggcuuggcgac

SEQ ID NO: 3309551 - RNA, 18 nt, Mycobacterium tuberculosis H37Rv
gcgaucgcgacacggcca

SEQ ID NO: 3309552 - RNA, 14 nt, Mycobacterium tuberculosis H37Rv
gcgaucgcgagcga

SEQ ID NO: 3309553 - RNA, 18 nt, Mycobacterium tuberculosis H37Rv
gcgaucgcgagcgagcca

SEQ ID NO: 3309554 - RNA, 20 nt, Mycobacterium tuberculosis H37Rv
gcgaucgcgcccgcugagcc

SEQ ID NO: 3309555 - RNA, 18 nt, Mycobacterium tuberculosis H37Rv
gcgaucgcguccuccucg

SEQ ID NO: 3309556 - RNA, 16 nt, Mycobacterium tuberculosis H37Rv
gcgaucgcuccgcggc

SEQ ID NO: 3309557 - RNA, 18 nt, Mycobacterium tuberculosis H37Rv
gcgaucggaggcccgcca

SEQ ID NO: 3309558 - RNA, 16 nt, Mycobacterium tuberculosis H37Rv
gcgaucggcacuuagc

SEQ ID NO: 3309559 - RNA, 19 nt, Mycobacterium tuberculosis H37Rv
gcgaucggcacuuagcccg

SEQ ID NO: 3309560 - RNA, 12 nt, Mycobacterium tuberculosis H37Rv
gcgaucggcaug

SEQ ID NO: 3309561 - RNA, 13 nt, Mycobacterium tuberculosis H37Rv
gcgaucggcguca

SEQ ID NO: 3309562 - RNA, 19 nt, Mycobacterium tuberculosis H37Rv
gcgaucggcgucacgagcc

SEQ ID NO: 3309563 - RNA, 16 nt, Mycobacterium tuberculosis H37Rv
gcgaucgggcccagca

SEQ ID NO: 3309564 - RNA, 18 nt, Mycobacterium tuberculosis H37Rv
gcgaucgggcccagcagc

SEQ ID NO: 3309565 - RNA, 15 nt, Mycobacterium tuberculosis H37Rv
gcgaucgggccggcg

SEQ ID NO: 3309566 - RNA, 16 nt, Mycobacterium tuberculosis H37Rv
gcgaucggggcgguga

SEQ ID NO: 3309567 - RNA, 19 nt, Mycobacterium tuberculosis H37Rv
gcgaucgucaagccgggca

SEQ ID NO: 3309568 - RNA, 16 nt, Mycobacterium tuberculosis H37Rv
gcgaucgucagccagc

SEQ ID NO: 3309569 - RNA, 17 nt, Mycobacterium tuberculosis H37Rv
gcgaucgucagccagcg

SEQ ID NO: 3309570 - RNA, 19 nt, Mycobacterium tuberculosis H37Rv
gcgaucgugcugcccgcaa

SEQ ID NO: 3309571 - RNA, 16 nt, Mycobacterium tuberculosis H37Rv
gcgaucuccggcggau

SEQ ID NO: 3309572 - RNA, 19 nt, Mycobacterium tuberculosis H37Rv
gcgaucuccuccaccagug

SEQ ID NO: 3309573 - RNA, 24 nt, Mycobacterium tuberculosis H37Rv
gcgaucucgaccguauugaccagc

SEQ ID NO: 3309574 - RNA, 15 nt, Mycobacterium tuberculosis H37Rv
gcgaucucgacggcc

SEQ ID NO: 3309575 - RNA, 17 nt, Mycobacterium tuberculosis H37Rv
gcgaucucggcgagcac

SEQ ID NO: 3309576 - RNA, 22 nt, Mycobacterium tuberculosis H37Rv
gcgaucucuugguagugacugc

SEQ ID NO: 3309577 - RNA, 13 nt, Mycobacterium tuberculosis H37Rv
gcgaucugcagcg

SEQ ID NO: 3309578 - RNA, 23 nt, Mycobacterium tuberculosis H37Rv
gcgaucugcgacaagaccggcgg

SEQ ID NO: 3309579 - RNA, 20 nt, Mycobacterium tuberculosis H37Rv
gcgaucugcgcgaugcccac

SEQ ID NO: 3309580 - RNA, 22 nt, Mycobacterium tuberculosis H37Rv
gcgaucugggcuuucagcaccg

SEQ ID NO: 3309581 - RNA, 23 nt, Mycobacterium tuberculosis H37Rv
gcgaucuugcgacgcccgccuuc

SEQ ID NO: 3309582 - RNA, 14 nt, Mycobacterium tuberculosis H37Rv
gcgaucuuggaucg

SEQ ID NO: 3309583 - RNA, 22 nt, Mycobacterium tuberculosis H37Rv
gcgaucuuggcgacaugcagcg

SEQ ID NO: 3309584 - RNA, 13 nt, Mycobacterium tuberculosis H37Rv
gcgaugaacagcg

SEQ ID NO: 3309585 - RNA, 16 nt, Mycobacterium tuberculosis H37Rv
gcgaugaacagcgacg

SEQ ID NO: 3309586 - RNA, 21 nt, Mycobacterium tuberculosis H37Rv
gcgaugaauucuuuggggcgc

SEQ ID NO: 3309587 - RNA, 18 nt, Mycobacterium tuberculosis H37Rv
gcgaugacaaucaccugg

SEQ ID NO: 3309588 - RNA, 16 nt, Mycobacterium tuberculosis H37Rv
gcgaugacacaccgcg

SEQ ID NO: 3309589 - RNA, 19 nt, Mycobacterium tuberculosis H37Rv
gcgaugaccacgccgacga

SEQ ID NO: 3309590 - RNA, 14 nt, Mycobacterium tuberculosis H37Rv
gcgaugaccgggcg

SEQ ID NO: 3309591 - RNA, 17 nt, Mycobacterium tuberculosis H37Rv
gcgaugaccucggcgau

SEQ ID NO: 3309592 - RNA, 13 nt, Mycobacterium tuberculosis H37Rv
gcgaugacgaccg

SEQ ID NO: 3309593 - RNA, 19 nt, Mycobacterium tuberculosis H37Rv
gcgaugacgaccgaucggc

SEQ ID NO: 3309594 - RNA, 23 nt, Mycobacterium tuberculosis H37Rv
gcgaugacgaccgaucggcgcgu

SEQ ID NO: 3309595 - RNA, 22 nt, Mycobacterium tuberculosis H37Rv
gcgaugacgaucgcguccgcgc

SEQ ID NO: 3309596 - RNA, 21 nt, Mycobacterium tuberculosis H37Rv
gcgaugacggugccgaccgcg

SEQ ID NO: 3309597 - RNA, 15 nt, Mycobacterium tuberculosis H37Rv
gcgaugagcgcgauc

SEQ ID NO: 3309598 - RNA, 22 nt, Mycobacterium tuberculosis H37Rv
gcgaugaggaacguuucgcugu

SEQ ID NO: 3309599 - RNA, 19 nt, Mycobacterium tuberculosis H37Rv
gcgaugaucgcaucgacgu

SEQ ID NO: 3309600 - RNA, 17 nt, Mycobacterium tuberculosis H37Rv
gcgaugaugcucgacaa

SEQ ID NO: 3309601 - RNA, 20 nt, Mycobacterium tuberculosis H37Rv
gcgaugauguugagcuggac

SEQ ID NO: 3309602 - RNA, 17 nt, Mycobacterium tuberculosis H37Rv
gcgaugcacgcccagcg

SEQ ID NO: 3309603 - RNA, 13 nt, Mycobacterium tuberculosis H37Rv
gcgaugccguuca

SEQ ID NO: 3309604 - RNA, 16 nt, Mycobacterium tuberculosis H37Rv
gcgaugcgcaccagcg

SEQ ID NO: 3309605 - RNA, 19 nt, Mycobacterium tuberculosis H37Rv
gcgaugcgcgggugguuca

SEQ ID NO: 3309606 - RNA, 16 nt, Mycobacterium tuberculosis H37Rv
gcgaugcggcccucga

SEQ ID NO: 3309607 - RNA, 23 nt, Mycobacterium tuberculosis H37Rv
gcgaugcggcccucgaauucggc

SEQ ID NO: 3309608 - RNA, 17 nt, Mycobacterium tuberculosis H37Rv
gcgaugcggucggccac

SEQ ID NO: 3309609 - RNA, 19 nt, Mycobacterium tuberculosis H37Rv
gcgaugcguccgcccagcc

SEQ ID NO: 3309610 - RNA, 22 nt, Mycobacterium tuberculosis H37Rv
gcgaugcucaaugugccgccgg

SEQ ID NO: 3309611 - RNA, 18 nt, Mycobacterium tuberculosis H37Rv
gcgaugcucacuacccgc

SEQ ID NO: 3309612 - RNA, 22 nt, Mycobacterium tuberculosis H37Rv
gcgaugcuucccggaugccgac

SEQ ID NO: 3309613 - RNA, 23 nt, Mycobacterium tuberculosis H37Rv
gcgauggcaccacuacaucgauc

SEQ ID NO: 3309614 - RNA, 16 nt, Mycobacterium tuberculosis H37Rv
gcgauggcaccgugga

SEQ ID NO: 3309615 - RNA, 19 nt, Mycobacterium tuberculosis H37Rv
gcgauggcgauagcggcgc

SEQ ID NO: 3309616 - RNA, 16 nt, Mycobacterium tuberculosis H37Rv
gcgauggcgguccacc

SEQ ID NO: 3309617 - RNA, 21 nt, Mycobacterium tuberculosis H37Rv
gcgaugggauaccgcguccuu

SEQ ID NO: 3309618 - RNA, 19 nt, Mycobacterium tuberculosis H37Rv
gcgaugggcccagcggccg

SEQ ID NO: 3309619 - RNA, 17 nt, Mycobacterium tuberculosis H37Rv
gcgaugggccgguccgg

SEQ ID NO: 3309620 - RNA, 21 nt, Mycobacterium tuberculosis H37Rv
gcgauggguguugcuggccgc

SEQ ID NO: 3309621 - RNA, 15 nt, Mycobacterium tuberculosis H37Rv
gcgaugguaucgccg

SEQ ID NO: 3309622 - RNA, 16 nt, Mycobacterium tuberculosis H37Rv
gcgaugguaucgccgc

SEQ ID NO: 3309623 - RNA, 18 nt, Mycobacterium tuberculosis H37Rv
gcgauggugcgccgggcg

SEQ ID NO: 3309624 - RNA, 14 nt, Mycobacterium tuberculosis H37Rv
gcgaugucgcgcau

SEQ ID NO: 3309625 - RNA, 21 nt, Mycobacterium tuberculosis H37Rv
gcgaugucggcugguggggga

SEQ ID NO: 3309626 - RNA, 16 nt, Mycobacterium tuberculosis H37Rv
gcgaugucguucgcgu

SEQ ID NO: 3309627 - RNA, 11 nt, Mycobacterium tuberculosis H37Rv
gcgaugugggc

SEQ ID NO: 3309628 - RNA, 19 nt, Mycobacterium tuberculosis H37Rv
gcgauuagcaaaccgaccg

SEQ ID NO: 3309629 - RNA, 20 nt, Mycobacterium tuberculosis H37Rv
gcgauuccacggcagcaccg

SEQ ID NO: 3309630 - RNA, 14 nt, Mycobacterium tuberculosis H37Rv
gcgauuccaggaug

SEQ ID NO: 3309631 - RNA, 22 nt, Mycobacterium tuberculosis H37Rv
gcgauuccggcggccacgccgg

SEQ ID NO: 3309632 - RNA, 18 nt, Mycobacterium tuberculosis H37Rv
gcgauucugcgucugcuc

SEQ ID NO: 3309633 - RNA, 19 nt, Mycobacterium tuberculosis H37Rv
gcgauucugcgucugcucg

SEQ ID NO: 3309634 - RNA, 23 nt, Mycobacterium tuberculosis H37Rv
gcgauucugcgucugcucgccag

SEQ ID NO: 3309635 - RNA, 22 nt, Mycobacterium tuberculosis H37Rv
gcgauucugcgucugcucgccg

SEQ ID NO: 3309636 - RNA, 18 nt, Mycobacterium tuberculosis H37Rv
gcgauucugggcuucauc

SEQ ID NO: 3309637 - RNA, 18 nt, Mycobacterium tuberculosis H37Rv
gcgauucugugucugcuc

SEQ ID NO: 3309638 - RNA, 23 nt, Mycobacterium tuberculosis H37Rv
gcgcacuggggaggccaacccug

SEQ ID NO: 3309639 - RNA, 17 nt, Mycobacterium tuberculosis H37Rv
gcgcacuugcguggcgu

SEQ ID NO: 3309640 - RNA, 19 nt, Mycobacterium tuberculosis H37Rv
gcgcacuugcguggcguug

SEQ ID NO: 3309641 - RNA, 22 nt, Mycobacterium tuberculosis H37Rv
gcgcagaaacgccgagcgccag

SEQ ID NO: 3309642 - RNA, 16 nt, Mycobacterium tuberculosis H37Rv
gcgcagaacaccaccg

SEQ ID NO: 3309643 - RNA, 15 nt, Mycobacterium tuberculosis H37Rv
gcgcagacaucggag

SEQ ID NO: 3309644 - RNA, 20 nt, Mycobacterium tuberculosis H37Rv
gcgcagagcguuccgcucga

SEQ ID NO: 3309645 - RNA, 17 nt, Mycobacterium tuberculosis H37Rv
gcgcagagucaacgucg

SEQ ID NO: 3309646 - RNA, 16 nt, Mycobacterium tuberculosis H37Rv
gcgcagauagcgcucg

SEQ ID NO: 3309647 - RNA, 22 nt, Mycobacterium tuberculosis H37Rv
gcgcagauagcgcucgaacucg

SEQ ID NO: 3309648 - RNA, 16 nt, Mycobacterium tuberculosis H37Rv
gcgcagaucguccacc

SEQ ID NO: 3309649 - RNA, 18 nt, Mycobacterium tuberculosis H37Rv
gcgcagauuugcuccagc

SEQ ID NO: 3309650 - RNA, 23 nt, Mycobacterium tuberculosis H37Rv
gcgcagcaacgcaaucgucgccu

SEQ ID NO: 3309651 - RNA, 18 nt, Mycobacterium tuberculosis H37Rv
gcgcagcaacugggcggc

SEQ ID NO: 3309652 - RNA, 23 nt, Mycobacterium tuberculosis H37Rv
gcgcagcacauccugcagcucgg

SEQ ID NO: 3309653 - RNA, 17 nt, Mycobacterium tuberculosis H37Rv
gcgcagcaccggcucga

SEQ ID NO: 3309654 - RNA, 17 nt, Mycobacterium tuberculosis H37Rv
gcgcagcaccggucagu

SEQ ID NO: 3309655 - RNA, 22 nt, Mycobacterium tuberculosis H37Rv
gcgcagcaccgucggcaccagc

SEQ ID NO: 3309656 - RNA, 14 nt, Mycobacterium tuberculosis H37Rv
gcgcagcacugcgg

SEQ ID NO: 3309657 - RNA, 18 nt, Mycobacterium tuberculosis H37Rv
gcgcagcacugcggcagc

SEQ ID NO: 3309658 - RNA, 20 nt, Mycobacterium tuberculosis H37Rv
gcgcagcacugcggcagcga

SEQ ID NO: 3309659 - RNA, 14 nt, Mycobacterium tuberculosis H37Rv
gcgcagcagcggca

SEQ ID NO: 3309660 - RNA, 15 nt, Mycobacterium tuberculosis H37Rv
gcgcagcagugccgu

SEQ ID NO: 3309661 - RNA, 20 nt, Mycobacterium tuberculosis H37Rv
gcgcagcauaaagaggucgg

SEQ ID NO: 3309662 - RNA, 21 nt, Mycobacterium tuberculosis H37Rv
gcgcagcaucuccgccggucc

SEQ ID NO: 3309663 - RNA, 16 nt, Mycobacterium tuberculosis H37Rv
gcgcagccaggcugcg

SEQ ID NO: 3309664 - RNA, 14 nt, Mycobacterium tuberculosis H37Rv
gcgcagccgcagcc

SEQ ID NO: 3309665 - RNA, 20 nt, Mycobacterium tuberculosis H37Rv
gcgcagccgcagccgguuaa

SEQ ID NO: 3309666 - RNA, 16 nt, Mycobacterium tuberculosis H37Rv
gcgcagccgcucgacg

SEQ ID NO: 3309667 - RNA, 14 nt, Mycobacterium tuberculosis H37Rv
gcgcagccggcccg

SEQ ID NO: 3309668 - RNA, 20 nt, Mycobacterium tuberculosis H37Rv
gcgcagccggcccgucgcgu

SEQ ID NO: 3309669 - RNA, 20 nt, Mycobacterium tuberculosis H37Rv
gcgcagccgggucuacagcg

SEQ ID NO: 3309670 - RNA, 14 nt, Mycobacterium tuberculosis H37Rv
gcgcagccugcagc

SEQ ID NO: 3309671 - RNA, 17 nt, Mycobacterium tuberculosis H37Rv
gcgcagccugccgauga

SEQ ID NO: 3309672 - RNA, 21 nt, Mycobacterium tuberculosis H37Rv
gcgcagcgaaucuccaaguag

SEQ ID NO: 3309673 - RNA, 13 nt, Mycobacterium tuberculosis H37Rv
gcgcagcgccggc

SEQ ID NO: 3309674 - RNA, 21 nt, Mycobacterium tuberculosis H37Rv
gcgcagcgccugcggcagcac

SEQ ID NO: 3309675 - RNA, 16 nt, Mycobacterium tuberculosis H37Rv
gcgcagcgcgaucgcg

SEQ ID NO: 3309676 - RNA, 14 nt, Mycobacterium tuberculosis H37Rv
gcgcagcggcaucc

SEQ ID NO: 3309677 - RNA, 19 nt, Mycobacterium tuberculosis H37Rv
gcgcagcggcauccacacc

SEQ ID NO: 3309678 - RNA, 19 nt, Mycobacterium tuberculosis H37Rv
gcgcagcguguugagggcu

SEQ ID NO: 3309679 - RNA, 22 nt, Mycobacterium tuberculosis H37Rv
gcgcagcuagcccucagcuagc

SEQ ID NO: 3309680 - RNA, 16 nt, Mycobacterium tuberculosis H37Rv
gcgcagcucaccgacg

SEQ ID NO: 3309681 - RNA, 21 nt, Mycobacterium tuberculosis H37Rv
gcgcagcugccgcacccccuc

SEQ ID NO: 3309682 - RNA, 16 nt, Mycobacterium tuberculosis H37Rv
gcgcagcugggugcgc

SEQ ID NO: 3309683 - RNA, 17 nt, Mycobacterium tuberculosis H37Rv
gcgcagcugggugcgcc

SEQ ID NO: 3309684 - RNA, 17 nt, Mycobacterium tuberculosis H37Rv
gcgcagcuuggccagcc

SEQ ID NO: 3309685 - RNA, 23 nt, Mycobacterium tuberculosis H37Rv
gcgcaggaagcccacgaucgcgu

SEQ ID NO: 3309686 - RNA, 22 nt, Mycobacterium tuberculosis H37Rv
gcgcaggagcgcgaugaccucg

SEQ ID NO: 3309687 - RNA, 22 nt, Mycobacterium tuberculosis H37Rv
gcgcaggauguucaaucccucc

SEQ ID NO: 3309688 - RNA, 13 nt, Mycobacterium tuberculosis H37Rv
gcgcaggccgaca

SEQ ID NO: 3309689 - RNA, 21 nt, Mycobacterium tuberculosis H37Rv
gcgcaggcuuccagccacagc

SEQ ID NO: 3309690 - RNA, 15 nt, Mycobacterium tuberculosis H37Rv
gcgcagggcgucggc

SEQ ID NO: 3309691 - RNA, 18 nt, Mycobacterium tuberculosis H37Rv
gcgcagggcgucggcgaa

SEQ ID NO: 3309692 - RNA, 16 nt, Mycobacterium tuberculosis H37Rv
gcgcaggggcggcgug

SEQ ID NO: 3309693 - RNA, 22 nt, Mycobacterium tuberculosis H37Rv
gcgcaggguucgucgggacgcc

SEQ ID NO: 3309694 - RNA, 22 nt, Mycobacterium tuberculosis H37Rv
gcgcagguagccaucggugcgc

SEQ ID NO: 3309695 - RNA, 19 nt, Mycobacterium tuberculosis H37Rv
gcgcagguagcgccgcacu

SEQ ID NO: 3309696 - RNA, 13 nt, Mycobacterium tuberculosis H37Rv
gcgcaggugcugg

SEQ ID NO: 3309697 - RNA, 21 nt, Mycobacterium tuberculosis H37Rv
gcgcagguuggcaagcacggc

SEQ ID NO: 3309698 - RNA, 22 nt, Mycobacterium tuberculosis H37Rv
gcgcagugacgccucgacaccc

SEQ ID NO: 3309699 - RNA, 15 nt, Mycobacterium tuberculosis H37Rv
gcgcagugcaccgcg

SEQ ID NO: 3309700 - RNA, 16 nt, Mycobacterium tuberculosis H37Rv
gcgcagugcaccgcgu

SEQ ID NO: 3309701 - RNA, 15 nt, Mycobacterium tuberculosis H37Rv
gcgcagugcagguca

SEQ ID NO: 3309702 - RNA, 17 nt, Mycobacterium tuberculosis H37Rv
gcgcaguuggcaccagc

SEQ ID NO: 3309703 - RNA, 18 nt, Mycobacterium tuberculosis H37Rv
gcgcaguuggcaccagcc

SEQ ID NO: 3309704 - RNA, 20 nt, Mycobacterium tuberculosis H37Rv
gcgcaguuggcaccagccgg

SEQ ID NO: 3309705 - RNA, 23 nt, Mycobacterium tuberculosis H37Rv
gcgcaguuggcaccagccgguga

SEQ ID NO: 3309706 - RNA, 16 nt, Mycobacterium tuberculosis H37Rv
gcgcauauccgcaggc

SEQ ID NO: 3309707 - RNA, 13 nt, Mycobacterium tuberculosis H37Rv
gcgcaucaacgga

SEQ ID NO: 3309708 - RNA, 17 nt, Mycobacterium tuberculosis H37Rv
gcgcaucaucgcccacc

SEQ ID NO: 3309709 - RNA, 14 nt, Mycobacterium tuberculosis H37Rv
gcgcauccacaauc

SEQ ID NO: 3309710 - RNA, 14 nt, Mycobacterium tuberculosis H37Rv
gcgcaucgagcacc

SEQ ID NO: 3309711 - RNA, 12 nt, Mycobacterium tuberculosis H37Rv
gcgcaucgccaa

SEQ ID NO: 3309712 - RNA, 20 nt, Mycobacterium tuberculosis H37Rv
gcgcaucgccaccaucaccg

SEQ ID NO: 3309713 - RNA, 17 nt, Mycobacterium tuberculosis H37Rv
gcgcaucgccgacagcg

SEQ ID NO: 3309714 - RNA, 18 nt, Mycobacterium tuberculosis H37Rv
gcgcaucgccgacagcgc

SEQ ID NO: 3309715 - RNA, 16 nt, Mycobacterium tuberculosis H37Rv
gcgcaucgccuccucg

SEQ ID NO: 3309716 - RNA, 14 nt, Mycobacterium tuberculosis H37Rv
gcgcaucgcgccuu

SEQ ID NO: 3309717 - RNA, 18 nt, Mycobacterium tuberculosis H37Rv
gcgcaucguugccgcaga

SEQ ID NO: 3309718 - RNA, 14 nt, Mycobacterium tuberculosis H37Rv
gcgcaucugcucgg

SEQ ID NO: 3309719 - RNA, 21 nt, Mycobacterium tuberculosis H37Rv
gcgcaucugucgcgcggcaau

SEQ ID NO: 3309720 - RNA, 18 nt, Mycobacterium tuberculosis H37Rv
gcgcaugccccgaccgcg

SEQ ID NO: 3309721 - RNA, 20 nt, Mycobacterium tuberculosis H37Rv
gcgcauggacaacagcuugg

SEQ ID NO: 3309722 - RNA, 21 nt, Mycobacterium tuberculosis H37Rv
gcgcaugugaaagacaacccg

SEQ ID NO: 3309723 - RNA, 13 nt, Mycobacterium tuberculosis H37Rv
gcgcauucgccgg

SEQ ID NO: 3309724 - RNA, 18 nt, Mycobacterium tuberculosis H37Rv
gcgcauucgccgggcggc

SEQ ID NO: 3309725 - RNA, 20 nt, Mycobacterium tuberculosis H37Rv
gcgcauucgccgggcggcau

SEQ ID NO: 3309726 - RNA, 20 nt, Mycobacterium tuberculosis H37Rv
gcgcauugccgacgcgcggc

SEQ ID NO: 3309727 - RNA, 21 nt, Mycobacterium tuberculosis H37Rv
gcgcauugccgacgcgcggcc

SEQ ID NO: 3309728 - RNA, 16 nt, Mycobacterium tuberculosis H37Rv
gcgcauugcgcuucca

SEQ ID NO: 3309729 - RNA, 18 nt, Mycobacterium tuberculosis H37Rv
gcgcauuucguggcgcgc

SEQ ID NO: 3309730 - RNA, 21 nt, Mycobacterium tuberculosis H37Rv
gcgcauuuguugcugcugccg

SEQ ID NO: 3309731 - RNA, 22 nt, Mycobacterium tuberculosis H37Rv
gcgccaaaaaggaucccgccgc

SEQ ID NO: 3309732 - RNA, 18 nt, Mycobacterium tuberculosis H37Rv
gcgccaaaauccgcccac

SEQ ID NO: 3309733 - RNA, 21 nt, Mycobacterium tuberculosis H37Rv
gcgcccacaucgucggcgggc

SEQ ID NO: 3309734 - RNA, 18 nt, Mycobacterium tuberculosis H37Rv
gcgcccaccccggccgca

SEQ ID NO: 3309735 - RNA, 19 nt, Mycobacterium tuberculosis H37Rv
gcgcccaccccggccgcau

SEQ ID NO: 3309736 - RNA, 15 nt, Mycobacterium tuberculosis H37Rv
gcgcccaccgaaacc

SEQ ID NO: 3309737 - RNA, 20 nt, Mycobacterium tuberculosis H37Rv
gcgcccaccggcuagcugug

SEQ ID NO: 3309738 - RNA, 16 nt, Mycobacterium tuberculosis H37Rv
gcgcccaccgggcggc

SEQ ID NO: 3309739 - RNA, 15 nt, Mycobacterium tuberculosis H37Rv
gcgcccagaucgccg

SEQ ID NO: 3309740 - RNA, 13 nt, Mycobacterium tuberculosis H37Rv
gcgcccagccgga

SEQ ID NO: 3309741 - RNA, 14 nt, Mycobacterium tuberculosis H37Rv
gcgcccagcgccuc

SEQ ID NO: 3309742 - RNA, 23 nt, Mycobacterium tuberculosis H37Rv
gcgcccagcgcuagccgggcgcg

SEQ ID NO: 3309743 - RNA, 17 nt, Mycobacterium tuberculosis H37Rv
gcgcccagcucgucgag

SEQ ID NO: 3309744 - RNA, 13 nt, Mycobacterium tuberculosis H37Rv
gcgcccaggaacu

SEQ ID NO: 3309745 - RNA, 19 nt, Mycobacterium tuberculosis H37Rv
gcgcccaggccgaucagcg

SEQ ID NO: 3309746 - RNA, 15 nt, Mycobacterium tuberculosis H37Rv
gcgcccauagcugcc

SEQ ID NO: 3309747 - RNA, 20 nt, Mycobacterium tuberculosis H37Rv
gcgcccaucgcgacggcccg

SEQ ID NO: 3309748 - RNA, 22 nt, Mycobacterium tuberculosis H37Rv
gcgcccaucgcgacggcccgau

SEQ ID NO: 3309749 - RNA, 16 nt, Mycobacterium tuberculosis H37Rv
gcgcccauggccacca

SEQ ID NO: 3309750 - RNA, 17 nt, Mycobacterium tuberculosis H37Rv
gcgcccauggccaccag

SEQ ID NO: 3309751 - RNA, 16 nt, Mycobacterium tuberculosis H37Rv
gcgccccaccgcgccg

SEQ ID NO: 3309752 - RNA, 15 nt, Mycobacterium tuberculosis H37Rv
gcgccccaugaugaa

SEQ ID NO: 3309753 - RNA, 17 nt, Mycobacterium tuberculosis H37Rv
gcgccccaugcaacaca

SEQ ID NO: 3309754 - RNA, 14 nt, Mycobacterium tuberculosis H37Rv
gcgcccccagcagc

SEQ ID NO: 3309755 - RNA, 14 nt, Mycobacterium tuberculosis H37Rv
gcgcccccggugcc

SEQ ID NO: 3309756 - RNA, 12 nt, Mycobacterium tuberculosis H37Rv
gcgccccgaugc

SEQ ID NO: 3309757 - RNA, 14 nt, Mycobacterium tuberculosis H37Rv
gcgccccgccgcac

SEQ ID NO: 3309758 - RNA, 14 nt, Mycobacterium tuberculosis H37Rv
gcgccccgcggucc

SEQ ID NO: 3309759 - RNA, 14 nt, Mycobacterium tuberculosis H37Rv
gcgccccuggcacc

SEQ ID NO: 3309760 - RNA, 16 nt, Mycobacterium tuberculosis H37Rv
gcgccccuggcaccuc

SEQ ID NO: 3309761 - RNA, 17 nt, Mycobacterium tuberculosis H37Rv
gcgcccgacgaacagcg

SEQ ID NO: 3309762 - RNA, 14 nt, Mycobacterium tuberculosis H37Rv
gcgcccgagccggu

SEQ ID NO: 3309763 - RNA, 15 nt, Mycobacterium tuberculosis H37Rv
gcgcccgcaccaccg

SEQ ID NO: 3309764 - RNA, 21 nt, Mycobacterium tuberculosis H37Rv
gcgcccgccaucagcccggcg

SEQ ID NO: 3309765 - RNA, 22 nt, Mycobacterium tuberculosis H37Rv
gcgcccgcccgagccgcugcga

SEQ ID NO: 3309766 - RNA, 23 nt, Mycobacterium tuberculosis H37Rv
gcgcccgccgcgaacuccagcag

SEQ ID NO: 3309767 - RNA, 14 nt, Mycobacterium tuberculosis H37Rv
gcgcccgccgcggc

SEQ ID NO: 3309768 - RNA, 21 nt, Mycobacterium tuberculosis H37Rv
gcgcccgccgcggcagcaucc

SEQ ID NO: 3309769 - RNA, 13 nt, Mycobacterium tuberculosis H37Rv
gcgcccgccggca

SEQ ID NO: 3309770 - RNA, 12 nt, Mycobacterium tuberculosis H37Rv
gcgcccgccuca

SEQ ID NO: 3309771 - RNA, 14 nt, Mycobacterium tuberculosis H37Rv
gcgcccgcgcgcuc

SEQ ID NO: 3309772 - RNA, 13 nt, Mycobacterium tuberculosis H37Rv
gcgcccgcgcggc

SEQ ID NO: 3309773 - RNA, 19 nt, Mycobacterium tuberculosis H37Rv
gcgcccgcguucagggcac

SEQ ID NO: 3309774 - RNA, 14 nt, Mycobacterium tuberculosis H37Rv
gcgcccgcucggcc

SEQ ID NO: 3309775 - RNA, 20 nt, Mycobacterium tuberculosis H37Rv
gcgcccgcucggccgcagcc

SEQ ID NO: 3309776 - RNA, 20 nt, Mycobacterium tuberculosis H37Rv
gcgcccgcugagccagcucc

SEQ ID NO: 3309777 - RNA, 19 nt, Mycobacterium tuberculosis H37Rv
gcgcccggccaagccggcg

SEQ ID NO: 3309778 - RNA, 12 nt, Mycobacterium tuberculosis H37Rv
gcgcccggccac

SEQ ID NO: 3309779 - RNA, 20 nt, Mycobacterium tuberculosis H37Rv
gcgcccggccacuccaguac

SEQ ID NO: 3309780 - RNA, 17 nt, Mycobacterium tuberculosis H37Rv
gcgcccggcccgccacc

SEQ ID NO: 3309781 - RNA, 20 nt, Mycobacterium tuberculosis H37Rv
gcgcccggcgcaagcgccgc

SEQ ID NO: 3309782 - RNA, 18 nt, Mycobacterium tuberculosis H37Rv
gcgcccggcggaucccga

SEQ ID NO: 3309783 - RNA, 13 nt, Mycobacterium tuberculosis H37Rv
gcgcccggcgugg

SEQ ID NO: 3309784 - RNA, 21 nt, Mycobacterium tuberculosis H37Rv
gcgcccgggcauccuucacca

SEQ ID NO: 3309785 - RNA, 23 nt, Mycobacterium tuberculosis H37Rv
gcgcccgggguguucgucgacca

SEQ ID NO: 3309786 - RNA, 16 nt, Mycobacterium tuberculosis H37Rv
gcgcccgggucccggc

SEQ ID NO: 3309787 - RNA, 19 nt, Mycobacterium tuberculosis H37Rv
gcgcccgggucccggcagc

SEQ ID NO: 3309788 - RNA, 18 nt, Mycobacterium tuberculosis H37Rv
gcgcccggucacgcugug

SEQ ID NO: 3309789 - RNA, 16 nt, Mycobacterium tuberculosis H37Rv
gcgcccguuggccaag

SEQ ID NO: 3309790 - RNA, 16 nt, Mycobacterium tuberculosis H37Rv
gcgcccucagccgcgg

SEQ ID NO: 3309791 - RNA, 17 nt, Mycobacterium tuberculosis H37Rv
gcgcccucagccgcggc

SEQ ID NO: 3309792 - RNA, 18 nt, Mycobacterium tuberculosis H37Rv
gcgcccucagccgcggcc

SEQ ID NO: 3309793 - RNA, 12 nt, Mycobacterium tuberculosis H37Rv
gcgcccuccucg

SEQ ID NO: 3309794 - RNA, 15 nt, Mycobacterium tuberculosis H37Rv
gcgcccuggccgccc

SEQ ID NO: 3309795 - RNA, 16 nt, Mycobacterium tuberculosis H37Rv
gcgcccuucagcacgg

SEQ ID NO: 3309796 - RNA, 16 nt, Mycobacterium tuberculosis H37Rv
gcgccgaaaccgccgg

SEQ ID NO: 3309797 - RNA, 16 nt, Mycobacterium tuberculosis H37Rv
gcgccgaacaccacac

SEQ ID NO: 3309798 - RNA, 23 nt, Mycobacterium tuberculosis H37Rv
gcgccgaacaccacaccgagcac

SEQ ID NO: 3309799 - RNA, 15 nt, Mycobacterium tuberculosis H37Rv
gcgccgaacgccagc

SEQ ID NO: 3309800 - RNA, 14 nt, Mycobacterium tuberculosis H37Rv
gcgccgaacucaac

SEQ ID NO: 3309801 - RNA, 18 nt, Mycobacterium tuberculosis H37Rv
gcgccgaaguagccgacc

SEQ ID NO: 3309802 - RNA, 19 nt, Mycobacterium tuberculosis H37Rv
gcgccgaaguagccgaccg

SEQ ID NO: 3309803 - RNA, 17 nt, Mycobacterium tuberculosis H37Rv
gcgccgaaucgcgggcu

SEQ ID NO: 3309804 - RNA, 24 nt, Mycobacterium tuberculosis H37Rv
gcgccgaaugccaccucgacgcac

SEQ ID NO: 3309805 - RNA, 19 nt, Mycobacterium tuberculosis H37Rv
gcgccgaauggcggugggc

SEQ ID NO: 3309806 - RNA, 23 nt, Mycobacterium tuberculosis H37Rv
gcgccgaauuggcccgggucucc

SEQ ID NO: 3309807 - RNA, 12 nt, Mycobacterium tuberculosis H37Rv
gcgccgacaccg

SEQ ID NO: 3309808 - RNA, 16 nt, Mycobacterium tuberculosis H37Rv
gcgccgacaccggcug

SEQ ID NO: 3309809 - RNA, 14 nt, Mycobacterium tuberculosis H37Rv
gcgccgacagccga

SEQ ID NO: 3309810 - RNA, 15 nt, Mycobacterium tuberculosis H37Rv
gcgccgacagccgau

SEQ ID NO: 3309811 - RNA, 17 nt, Mycobacterium tuberculosis H37Rv
gcgccgacagccgaucc

SEQ ID NO: 3309812 - RNA, 12 nt, Mycobacterium tuberculosis H37Rv
gcgccgaccaca

SEQ ID NO: 3309813 - RNA, 18 nt, Mycobacterium tuberculosis H37Rv
gcgccgacggccagcagg

SEQ ID NO: 3309814 - RNA, 15 nt, Mycobacterium tuberculosis H37Rv
gcgccgacuccaguu

SEQ ID NO: 3309815 - RNA, 20 nt, Mycobacterium tuberculosis H37Rv
gcgccgagagcaccgcucgg

SEQ ID NO: 3309816 - RNA, 16 nt, Mycobacterium tuberculosis H37Rv
gcgccgagauccacgc

SEQ ID NO: 3309817 - RNA, 23 nt, Mycobacterium tuberculosis H37Rv
gcgccgagauccacgccagagcg

SEQ ID NO: 3309818 - RNA, 18 nt, Mycobacterium tuberculosis H37Rv
gcgccgagcccgggccug

SEQ ID NO: 3309819 - RNA, 13 nt, Mycobacterium tuberculosis H37Rv
gcgccgaggucga

SEQ ID NO: 3309820 - RNA, 20 nt, Mycobacterium tuberculosis H37Rv
gcgccgaguugcccgggucg

SEQ ID NO: 3309821 - RNA, 18 nt, Mycobacterium tuberculosis H37Rv
gcgccgauacccagcggg

SEQ ID NO: 3309822 - RNA, 19 nt, Mycobacterium tuberculosis H37Rv
gcgccgauaccggcggcga

SEQ ID NO: 3309823 - RNA, 19 nt, Mycobacterium tuberculosis H37Rv
gcgccgaucacggugggcg

SEQ ID NO: 3309824 - RNA, 13 nt, Mycobacterium tuberculosis H37Rv
gcgccgaucggca

SEQ ID NO: 3309825 - RNA, 16 nt, Mycobacterium tuberculosis H37Rv
gcgccgaugccggcca

SEQ ID NO: 3309826 - RNA, 17 nt, Mycobacterium tuberculosis H37Rv
gcgccgauguggccggc

SEQ ID NO: 3309827 - RNA, 18 nt, Mycobacterium tuberculosis H37Rv
gcgccgcaaccgccgcgu

SEQ ID NO: 3309828 - RNA, 20 nt, Mycobacterium tuberculosis H37Rv
gcgccgcaaccgccgcguca

SEQ ID NO: 3309829 - RNA, 20 nt, Mycobacterium tuberculosis H37Rv
gcgccgcaaucagacggcga

SEQ ID NO: 3309830 - RNA, 16 nt, Mycobacterium tuberculosis H37Rv
gcgccggagaucgucg

SEQ ID NO: 3309831 - RNA, 17 nt, Mycobacterium tuberculosis H37Rv
gcgccggagaucgucgc

SEQ ID NO: 3309832 - RNA, 19 nt, Mycobacterium tuberculosis H37Rv
gcgccggagccgcccaagc

SEQ ID NO: 3309833 - RNA, 23 nt, Mycobacterium tuberculosis H37Rv
gcgccggagccgcccaagccgcc

SEQ ID NO: 3309834 - RNA, 20 nt, Mycobacterium tuberculosis H37Rv
gcgccggaguugaagaagcc

SEQ ID NO: 3309835 - RNA, 18 nt, Mycobacterium tuberculosis H37Rv
gcgccggaguuuccccua

SEQ ID NO: 3309836 - RNA, 15 nt, Mycobacterium tuberculosis H37Rv
gcgccggcacgggcg

SEQ ID NO: 3309837 - RNA, 13 nt, Mycobacterium tuberculosis H37Rv
gcgccggcaucgc

SEQ ID NO: 3309838 - RNA, 15 nt, Mycobacterium tuberculosis H37Rv
gcgccggcaucgcgc

SEQ ID NO: 3309839 - RNA, 17 nt, Mycobacterium tuberculosis H37Rv
gcgccggcaucuccacc

SEQ ID NO: 3309840 - RNA, 23 nt, Mycobacterium tuberculosis H37Rv
gcgccggcaucuccaccgucgcc

SEQ ID NO: 3309841 - RNA, 12 nt, Mycobacterium tuberculosis H37Rv
gcgccggccagg

SEQ ID NO: 3309842 - RNA, 14 nt, Mycobacterium tuberculosis H37Rv
gcgccggccaggcu

SEQ ID NO: 3309843 - RNA, 22 nt, Mycobacterium tuberculosis H37Rv
gcgccggccauaccgcucgccg

SEQ ID NO: 3309844 - RNA, 23 nt, Mycobacterium tuberculosis H37Rv
gcgccggccauaccgcucgccgu

SEQ ID NO: 3309845 - RNA, 22 nt, Mycobacterium tuberculosis H37Rv
gcgccggccaugccuucggugc

SEQ ID NO: 3309846 - RNA, 14 nt, Mycobacterium tuberculosis H37Rv
gcgccggcccgcag

SEQ ID NO: 3309847 - RNA, 17 nt, Mycobacterium tuberculosis H37Rv
gcgccggccgaucggcc

SEQ ID NO: 3309848 - RNA, 17 nt, Mycobacterium tuberculosis H37Rv
gcgccggccgcacgccg

SEQ ID NO: 3309849 - RNA, 14 nt, Mycobacterium tuberculosis H37Rv
gcgccggccgcugc

SEQ ID NO: 3309850 - RNA, 19 nt, Mycobacterium tuberculosis H37Rv
gcgccggcgacaccgcacc

SEQ ID NO: 3309851 - RNA, 14 nt, Mycobacterium tuberculosis H37Rv
gcgccggcgcugcu

SEQ ID NO: 3309852 - RNA, 21 nt, Mycobacterium tuberculosis H37Rv
gcgccggcggaccccucgacc

SEQ ID NO: 3309853 - RNA, 15 nt, Mycobacterium tuberculosis H37Rv
gcgccggcggccacc

SEQ ID NO: 3309854 - RNA, 14 nt, Mycobacterium tuberculosis H37Rv
gcgccggcggccgc

SEQ ID NO: 3309855 - RNA, 12 nt, Mycobacterium tuberculosis H37Rv
gcgccggcgggc

SEQ ID NO: 3309856 - RNA, 16 nt, Mycobacterium tuberculosis H37Rv
gcgccggcgggcgcgg

SEQ ID NO: 3309857 - RNA, 20 nt, Mycobacterium tuberculosis H37Rv
gcgccggcgguagucggcca

SEQ ID NO: 3309858 - RNA, 22 nt, Mycobacterium tuberculosis H37Rv
gcgccggcgguagucggccagc

SEQ ID NO: 3309859 - RNA, 14 nt, Mycobacterium tuberculosis H37Rv
gcgccggcgucggc

SEQ ID NO: 3309860 - RNA, 21 nt, Mycobacterium tuberculosis H37Rv
gcgccggcgucggcgcccagc

SEQ ID NO: 3309861 - RNA, 12 nt, Mycobacterium tuberculosis H37Rv
gcgccggcguuu

SEQ ID NO: 3309862 - RNA, 20 nt, Mycobacterium tuberculosis H37Rv
gcgccggcuagggcccuggc

SEQ ID NO: 3309863 - RNA, 14 nt, Mycobacterium tuberculosis H37Rv
gcgccggcugccac

SEQ ID NO: 3309864 - RNA, 17 nt, Mycobacterium tuberculosis H37Rv
gcgccggcugccacaca

SEQ ID NO: 3309865 - RNA, 12 nt, Mycobacterium tuberculosis H37Rv
gcgccggcuggc

SEQ ID NO: 3309866 - RNA, 16 nt, Mycobacterium tuberculosis H37Rv
gcgccggcuucgggug

SEQ ID NO: 3309867 - RNA, 16 nt, Mycobacterium tuberculosis H37Rv
gcgccgggcguccgcc

SEQ ID NO: 3309868 - RNA, 19 nt, Mycobacterium tuberculosis H37Rv
gcgccgggcguccgccggc

SEQ ID NO: 3309869 - RNA, 18 nt, Mycobacterium tuberculosis H37Rv
gcgccggggacacagcgu

SEQ ID NO: 3309870 - RNA, 17 nt, Mycobacterium tuberculosis H37Rv
gcgccggggccgccgau

SEQ ID NO: 3309871 - RNA, 14 nt, Mycobacterium tuberculosis H37Rv
gcgccggggcgcag

SEQ ID NO: 3309872 - RNA, 15 nt, Mycobacterium tuberculosis H37Rv
gcgccggggcgcagg

SEQ ID NO: 3309873 - RNA, 20 nt, Mycobacterium tuberculosis H37Rv
gcgccgggugaggcggugac

SEQ ID NO: 3309874 - RNA, 14 nt, Mycobacterium tuberculosis H37Rv
gcgccggucagggc

SEQ ID NO: 3309875 - RNA, 19 nt, Mycobacterium tuberculosis H37Rv
gcgccggucgccggcuggg

SEQ ID NO: 3309876 - RNA, 18 nt, Mycobacterium tuberculosis H37Rv
gcgccggucggaucggug

SEQ ID NO: 3309877 - RNA, 13 nt, Mycobacterium tuberculosis H37Rv
gcgccggugccgc

SEQ ID NO: 3309878 - RNA, 16 nt, Mycobacterium tuberculosis H37Rv
gcgccggugccgccgg

SEQ ID NO: 3309879 - RNA, 15 nt, Mycobacterium tuberculosis H37Rv
gcgccggugccgccu

SEQ ID NO: 3309880 - RNA, 18 nt, Mycobacterium tuberculosis H37Rv
gcgccggugccgccuccg

SEQ ID NO: 3309881 - RNA, 23 nt, Mycobacterium tuberculosis H37Rv
gcgccggugccggccaucgcccg

SEQ ID NO: 3309882 - RNA, 17 nt, Mycobacterium tuberculosis H37Rv
gcgccggugcggcgggc

SEQ ID NO: 3309883 - RNA, 18 nt, Mycobacterium tuberculosis H37Rv
gcgccgguuucgaggcga

SEQ ID NO: 3309884 - RNA, 19 nt, Mycobacterium tuberculosis H37Rv
gcgccguaacagccggccg

SEQ ID NO: 3309885 - RNA, 14 nt, Mycobacterium tuberculosis H37Rv
gcgccguacagcgg

SEQ ID NO: 3309886 - RNA, 16 nt, Mycobacterium tuberculosis H37Rv
gcgccguacagcggcg

SEQ ID NO: 3309887 - RNA, 15 nt, Mycobacterium tuberculosis H37Rv
gcgccguagagccgc

SEQ ID NO: 3309888 - RNA, 13 nt, Mycobacterium tuberculosis H37Rv
gcgccgucaacac

SEQ ID NO: 3309889 - RNA, 12 nt, Mycobacterium tuberculosis H37Rv
gcgccgucagcc

SEQ ID NO: 3309890 - RNA, 15 nt, Mycobacterium tuberculosis H37Rv
gcgccgucgcccagc

SEQ ID NO: 3309891 - RNA, 13 nt, Mycobacterium tuberculosis H37Rv
gcgccgucgccgu

SEQ ID NO: 3309892 - RNA, 19 nt, Mycobacterium tuberculosis H37Rv
gcgccgucggccgagucga

SEQ ID NO: 3309893 - RNA, 13 nt, Mycobacterium tuberculosis H37Rv
gcgccgucggcga

SEQ ID NO: 3309894 - RNA, 16 nt, Mycobacterium tuberculosis H37Rv
gcgccgucgucgacca

SEQ ID NO: 3309895 - RNA, 14 nt, Mycobacterium tuberculosis H37Rv
gcgccgucgucgag

SEQ ID NO: 3309896 - RNA, 17 nt, Mycobacterium tuberculosis H37Rv
gcgccgucgucgagcac

SEQ ID NO: 3309897 - RNA, 19 nt, Mycobacterium tuberculosis H37Rv
gcgccgucgucgagcacca

SEQ ID NO: 3309898 - RNA, 13 nt, Mycobacterium tuberculosis H37Rv
gcgccgucgucgc

SEQ ID NO: 3309899 - RNA, 21 nt, Mycobacterium tuberculosis H37Rv
gcgccgucguugugccggucg

SEQ ID NO: 3309900 - RNA, 22 nt, Mycobacterium tuberculosis H37Rv
gcgccgucguugugccggucga

SEQ ID NO: 3309901 - RNA, 14 nt, Mycobacterium tuberculosis H37Rv
gcgccgugacccau

SEQ ID NO: 3309902 - RNA, 23 nt, Mycobacterium tuberculosis H37Rv
gcgccgugcgaucgucaacgacg

SEQ ID NO: 3309903 - RNA, 13 nt, Mycobacterium tuberculosis H37Rv
gcgccguggauca

SEQ ID NO: 3309904 - RNA, 20 nt, Mycobacterium tuberculosis H37Rv
gcgccguggaucaucccgac

SEQ ID NO: 3309905 - RNA, 21 nt, Mycobacterium tuberculosis H37Rv
gcgccguggaucaucccgacc

SEQ ID NO: 3309906 - RNA, 15 nt, Mycobacterium tuberculosis H37Rv
gcgccguggcaucgc

SEQ ID NO: 3309907 - RNA, 20 nt, Mycobacterium tuberculosis H37Rv
gcgccgugucaccgggugca

SEQ ID NO: 3309908 - RNA, 16 nt, Mycobacterium tuberculosis H37Rv
gcgccguuaccgccgu

SEQ ID NO: 3309909 - RNA, 16 nt, Mycobacterium tuberculosis H37Rv
gcgccguucgcucccc

SEQ ID NO: 3309910 - RNA, 15 nt, Mycobacterium tuberculosis H37Rv
gcgccguucgucgug

SEQ ID NO: 3309911 - RNA, 18 nt, Mycobacterium tuberculosis H37Rv
gcgccguucgucguggau

SEQ ID NO: 3309912 - RNA, 16 nt, Mycobacterium tuberculosis H37Rv
gcgccguugcccccgu

SEQ ID NO: 3309913 - RNA, 13 nt, Mycobacterium tuberculosis H37Rv
gcgccguugccgc

SEQ ID NO: 3309914 - RNA, 15 nt, Mycobacterium tuberculosis H37Rv
gcgccguugccgccg

SEQ ID NO: 3309915 - RNA, 16 nt, Mycobacterium tuberculosis H37Rv
gcgccguugccgccgu

SEQ ID NO: 3309916 - RNA, 22 nt, Mycobacterium tuberculosis H37Rv
gcgccguugccgccgucgccgc

SEQ ID NO: 3309917 - RNA, 16 nt, Mycobacterium tuberculosis H37Rv
gcgccguuggcgccaa

SEQ ID NO: 3309918 - RNA, 15 nt, Mycobacterium tuberculosis H37Rv
gcgccuaccagcacc

SEQ ID NO: 3309919 - RNA, 17 nt, Mycobacterium tuberculosis H37Rv
gcgccuaccagcaccgg

SEQ ID NO: 3309920 - RNA, 18 nt, Mycobacterium tuberculosis H37Rv
gcgccucaucggacagcg

SEQ ID NO: 3309921 - RNA, 19 nt, Mycobacterium tuberculosis H37Rv
gcgccuccagcaccacggc

SEQ ID NO: 3309922 - RNA, 20 nt, Mycobacterium tuberculosis H37Rv
gcgccuccagcaccacggcg

SEQ ID NO: 3309923 - RNA, 19 nt, Mycobacterium tuberculosis H37Rv
gcgccuccguugcccccau

SEQ ID NO: 3309924 - RNA, 14 nt, Mycobacterium tuberculosis H37Rv
gcgccucgcccagc

SEQ ID NO: 3309925 - RNA, 17 nt, Mycobacterium tuberculosis H37Rv
gcgccucgcccagcaag

SEQ ID NO: 3309926 - RNA, 13 nt, Mycobacterium tuberculosis H37Rv
gcgccucgccggc

SEQ ID NO: 3309927 - RNA, 15 nt, Mycobacterium tuberculosis H37Rv
gcgcgcacggcgucg

SEQ ID NO: 3309928 - RNA, 19 nt, Mycobacterium tuberculosis H37Rv
gcgcgcagaucguccaccg

SEQ ID NO: 3309929 - RNA, 20 nt, Mycobacterium tuberculosis H37Rv
gcgcgcagaugagcgcggcg

SEQ ID NO: 3309930 - RNA, 19 nt, Mycobacterium tuberculosis H37Rv
gcgcgcagcaguuggucgc

SEQ ID NO: 3309931 - RNA, 15 nt, Mycobacterium tuberculosis H37Rv
gcgcgcagccgggca

SEQ ID NO: 3309932 - RNA, 15 nt, Mycobacterium tuberculosis H37Rv
gcgcgcagcgauucg

SEQ ID NO: 3309933 - RNA, 13 nt, Mycobacterium tuberculosis H37Rv
gcgcgcagcucgg

SEQ ID NO: 3309934 - RNA, 21 nt, Mycobacterium tuberculosis H37Rv
gcgcgcagcucgggcucgugu

SEQ ID NO: 3309935 - RNA, 17 nt, Mycobacterium tuberculosis H37Rv
gcgcgcauagggcuggu

SEQ ID NO: 3309936 - RNA, 15 nt, Mycobacterium tuberculosis H37Rv
gcgcgcaucugcucg

SEQ ID NO: 3309937 - RNA, 20 nt, Mycobacterium tuberculosis H37Rv
gcgcgcauuuuucgccagcu

SEQ ID NO: 3309938 - RNA, 22 nt, Mycobacterium tuberculosis H37Rv
gcgcgccaaucgcccagugugc

SEQ ID NO: 3309939 - RNA, 15 nt, Mycobacterium tuberculosis H37Rv
gcgcgccacccagca

SEQ ID NO: 3309940 - RNA, 22 nt, Mycobacterium tuberculosis H37Rv
gcgcgccacggugucgucgacc

SEQ ID NO: 3309941 - RNA, 15 nt, Mycobacterium tuberculosis H37Rv
gcgcgccauuggcgc

SEQ ID NO: 3309942 - RNA, 20 nt, Mycobacterium tuberculosis H37Rv
gcgcgccauuggcgccgccg

SEQ ID NO: 3309943 - RNA, 19 nt, Mycobacterium tuberculosis H37Rv
gcgcgccauuggcgguggu

SEQ ID NO: 3309944 - RNA, 20 nt, Mycobacterium tuberculosis H37Rv
gcgcgcccaccgggcggcgg

SEQ ID NO: 3309945 - RNA, 19 nt, Mycobacterium tuberculosis H37Rv
gcgcgccccaccgcgccga

SEQ ID NO: 3309946 - RNA, 15 nt, Mycobacterium tuberculosis H37Rv
gcgcgccccgccgca

SEQ ID NO: 3309947 - RNA, 12 nt, Mycobacterium tuberculosis H37Rv
gcgcgcccgaau

SEQ ID NO: 3309948 - RNA, 12 nt, Mycobacterium tuberculosis H37Rv
gcgcgcccgaca

SEQ ID NO: 3309949 - RNA, 13 nt, Mycobacterium tuberculosis H37Rv
gcgcgcccgacga

SEQ ID NO: 3309950 - RNA, 13 nt, Mycobacterium tuberculosis H37Rv
gcgcgcccgggcg

SEQ ID NO: 3309951 - RNA, 12 nt, Mycobacterium tuberculosis H37Rv
gcgcgccgaccg

SEQ ID NO: 3309952 - RNA, 14 nt, Mycobacterium tuberculosis H37Rv
gcgcgccgaguugc

SEQ ID NO: 3309953 - RNA, 20 nt, Mycobacterium tuberculosis H37Rv
gcgcgccgaucacggugggc

SEQ ID NO: 3309954 - RNA, 14 nt, Mycobacterium tuberculosis H37Rv
gcgcgccgaucgag

SEQ ID NO: 3309955 - RNA, 18 nt, Mycobacterium tuberculosis H37Rv
gcgcgccgaucggcaccg

SEQ ID NO: 3309956 - RNA, 16 nt, Mycobacterium tuberculosis H37Rv
gcgcgccgcagcgcgu

SEQ ID NO: 3309957 - RNA, 21 nt, Mycobacterium tuberculosis H37Rv
gcgcgccgcauccagccgugc

SEQ ID NO: 3309958 - RNA, 22 nt, Mycobacterium tuberculosis H37Rv
gcgcgccgcauccagccgugcg

SEQ ID NO: 3309959 - RNA, 11 nt, Mycobacterium tuberculosis H37Rv
gcgcgccgcga

SEQ ID NO: 3309960 - RNA, 17 nt, Mycobacterium tuberculosis H37Rv
gcgcgccggauacaccg

SEQ ID NO: 3309961 - RNA, 20 nt, Mycobacterium tuberculosis H37Rv
gcgcgccggauacaccggca

SEQ ID NO: 3309962 - RNA, 19 nt, Mycobacterium tuberculosis H37Rv
gcgcgccggcgacccgggu

SEQ ID NO: 3309963 - RNA, 23 nt, Mycobacterium tuberculosis H37Rv
gcgcgccggcgguagucggccag

SEQ ID NO: 3309964 - RNA, 14 nt, Mycobacterium tuberculosis H37Rv
gcgcgccggcgucg

SEQ ID NO: 3309965 - RNA, 13 nt, Mycobacterium tuberculosis H37Rv
gcgcgccggugcu

SEQ ID NO: 3309966 - RNA, 21 nt, Mycobacterium tuberculosis H37Rv
gcgcgccguagaccagcaggc

SEQ ID NO: 3309967 - RNA, 14 nt, Mycobacterium tuberculosis H37Rv
gcgcgccgucgggu

SEQ ID NO: 3309968 - RNA, 12 nt, Mycobacterium tuberculosis H37Rv
gcgcgccguuca

SEQ ID NO: 3309969 - RNA, 19 nt, Mycobacterium tuberculosis H37Rv
gcgcgccuucacgcuggcc

SEQ ID NO: 3309970 - RNA, 15 nt, Mycobacterium tuberculosis H37Rv
gcgcgcgccgcagcg

SEQ ID NO: 3309971 - RNA, 14 nt, Mycobacterium tuberculosis H37Rv
gcgcgcgcucgggc

SEQ ID NO: 3309972 - RNA, 23 nt, Mycobacterium tuberculosis H37Rv
gcgcgcggagucaagcagcagca

SEQ ID NO: 3309973 - RNA, 12 nt, Mycobacterium tuberculosis H37Rv
gcgcgcggcaac

SEQ ID NO: 3309974 - RNA, 13 nt, Mycobacterium tuberculosis H37Rv
gcgcgcggccgcg

SEQ ID NO: 3309975 - RNA, 21 nt, Mycobacterium tuberculosis H37Rv
gcgcgcggccgcgcugcagca

SEQ ID NO: 3309976 - RNA, 19 nt, Mycobacterium tuberculosis H37Rv
gcgcgcggcgaccauaagc

SEQ ID NO: 3309977 - RNA, 20 nt, Mycobacterium tuberculosis H37Rv
gcgcgcggcgacgacggccu

SEQ ID NO: 3309978 - RNA, 17 nt, Mycobacterium tuberculosis H37Rv
gcgcgcgggguggcggc

SEQ ID NO: 3309979 - RNA, 21 nt, Mycobacterium tuberculosis H37Rv
gcgcgcggucgagguggcggg

SEQ ID NO: 3309980 - RNA, 23 nt, Mycobacterium tuberculosis H37Rv
gcgcgcuacgcggccgaggucac

SEQ ID NO: 3309981 - RNA, 18 nt, Mycobacterium tuberculosis H37Rv
gcgcgcucaacggcgaaa

SEQ ID NO: 3309982 - RNA, 17 nt, Mycobacterium tuberculosis H37Rv
gcgcgcucaggucaucg

SEQ ID NO: 3309983 - RNA, 16 nt, Mycobacterium tuberculosis H37Rv
gcgcgcucaucgaccg

SEQ ID NO: 3309984 - RNA, 22 nt, Mycobacterium tuberculosis H37Rv
gcgcgcucaucgaccgcggccg

SEQ ID NO: 3309985 - RNA, 19 nt, Mycobacterium tuberculosis H37Rv
gcgcgcucgcggcuucagu

SEQ ID NO: 3309986 - RNA, 15 nt, Mycobacterium tuberculosis H37Rv
gcgcgcucgcucacc

SEQ ID NO: 3309987 - RNA, 22 nt, Mycobacterium tuberculosis H37Rv
gcgcgcucgcucaccggcuggu

SEQ ID NO: 3309988 - RNA, 14 nt, Mycobacterium tuberculosis H37Rv
gcgcgcucggccag

SEQ ID NO: 3309989 - RNA, 15 nt, Mycobacterium tuberculosis H37Rv
gcgcgcucggccagc

SEQ ID NO: 3309990 - RNA, 15 nt, Mycobacterium tuberculosis H37Rv
gcgcgcucggccggg

SEQ ID NO: 3309991 - RNA, 16 nt, Mycobacterium tuberculosis H37Rv
gcgcgcucggccgggg

SEQ ID NO: 3309992 - RNA, 15 nt, Mycobacterium tuberculosis H37Rv
gcgcgcucgggccca

SEQ ID NO: 3309993 - RNA, 17 nt, Mycobacterium tuberculosis H37Rv
gcgcgcucgggcccagc

SEQ ID NO: 3309994 - RNA, 19 nt, Mycobacterium tuberculosis H37Rv
gcgcgcugaaaugccgucg

SEQ ID NO: 3309995 - RNA, 18 nt, Mycobacterium tuberculosis H37Rv
gcgcgcugagcucgaugu

SEQ ID NO: 3309996 - RNA, 15 nt, Mycobacterium tuberculosis H37Rv
gcgcgcugauuucuu

SEQ ID NO: 3309997 - RNA, 13 nt, Mycobacterium tuberculosis H37Rv
gcgcgcugccgcu

SEQ ID NO: 3309998 - RNA, 13 nt, Mycobacterium tuberculosis H37Rv
gcgcgcugcgcag

SEQ ID NO: 3309999 - RNA, 15 nt, Mycobacterium tuberculosis H37Rv
gcgcgcuggccagcc

SEQ ID NO: 3310000 - RNA, 13 nt, Mycobacterium tuberculosis H37Rv
gcgcgcuggcggg

SEQ ID NO: 3310001 - RNA, 18 nt, Mycobacterium tuberculosis H37Rv
gcgcgcuggcgggcggcg

SEQ ID NO: 3310002 - RNA, 17 nt, Mycobacterium tuberculosis H37Rv
gcgcgcugggaggcggc

SEQ ID NO: 3310003 - RNA, 14 nt, Mycobacterium tuberculosis H37Rv
gcgcgcugggcccg

SEQ ID NO: 3310004 - RNA, 23 nt, Mycobacterium tuberculosis H37Rv
gcgcgcugggcccgagcgcgcgc

SEQ ID NO: 3310005 - RNA, 15 nt, Mycobacterium tuberculosis H37Rv
gcgcgcugggcgcgc

SEQ ID NO: 3310006 - RNA, 14 nt, Mycobacterium tuberculosis H37Rv
gcgcggacccagca

SEQ ID NO: 3310007 - RNA, 17 nt, Mycobacterium tuberculosis H37Rv
gcgcggacccagcaccc

SEQ ID NO: 3310008 - RNA, 14 nt, Mycobacterium tuberculosis H37Rv
gcgcggagagccug

SEQ ID NO: 3310009 - RNA, 19 nt, Mycobacterium tuberculosis H37Rv
gcgcggaucaacaggccgg

SEQ ID NO: 3310010 - RNA, 14 nt, Mycobacterium tuberculosis H37Rv
gcgcggaucggcgg

SEQ ID NO: 3310011 - RNA, 17 nt, Mycobacterium tuberculosis H37Rv
gcgcggaucggcggccg

SEQ ID NO: 3310012 - RNA, 14 nt, Mycobacterium tuberculosis H37Rv
gcgcggaucgucga

SEQ ID NO: 3310013 - RNA, 20 nt, Mycobacterium tuberculosis H37Rv
gcgcggauggccucggcgau

SEQ ID NO: 3310014 - RNA, 19 nt, Mycobacterium tuberculosis H37Rv
gcgcggcaaaguuggccgc

SEQ ID NO: 3310015 - RNA, 18 nt, Mycobacterium tuberculosis H37Rv
gcgcggcaagcucguccg

SEQ ID NO: 3310016 - RNA, 21 nt, Mycobacterium tuberculosis H37Rv
gcgcggcaccagcaccgucgg

SEQ ID NO: 3310017 - RNA, 18 nt, Mycobacterium tuberculosis H37Rv
gcgcggcacccggucggc

SEQ ID NO: 3310018 - RNA, 17 nt, Mycobacterium tuberculosis H37Rv
gcgcggcaccgauggcg

SEQ ID NO: 3310019 - RNA, 15 nt, Mycobacterium tuberculosis H37Rv
gcgcggcaucccgcc

SEQ ID NO: 3310020 - RNA, 20 nt, Mycobacterium tuberculosis H37Rv
gcgcggccaaucagcccgcc

SEQ ID NO: 3310021 - RNA, 20 nt, Mycobacterium tuberculosis H37Rv
gcgcggccaauugcgccgcc

SEQ ID NO: 3310022 - RNA, 15 nt, Mycobacterium tuberculosis H37Rv
gcgcggccacccgcg

SEQ ID NO: 3310023 - RNA, 18 nt, Mycobacterium tuberculosis H37Rv
gcgcggccacgccgauca

SEQ ID NO: 3310024 - RNA, 16 nt, Mycobacterium tuberculosis H37Rv
gcgcgucgcgugggau

SEQ ID NO: 3310025 - RNA, 17 nt, Mycobacterium tuberculosis H37Rv
gcgcgucggcaccgauc

SEQ ID NO: 3310026 - RNA, 13 nt, Mycobacterium tuberculosis H37Rv
gcgcgucggucac

SEQ ID NO: 3310027 - RNA, 15 nt, Mycobacterium tuberculosis H37Rv
gcgcgucggucaccg

SEQ ID NO: 3310028 - RNA, 16 nt, Mycobacterium tuberculosis H37Rv
gcgcgucucgagcgcg

SEQ ID NO: 3310029 - RNA, 16 nt, Mycobacterium tuberculosis H37Rv
gcgcgugacagugacc

SEQ ID NO: 3310030 - RNA, 13 nt, Mycobacterium tuberculosis H37Rv
gcgcgugacgacc

SEQ ID NO: 3310031 - RNA, 12 nt, Mycobacterium tuberculosis H37Rv
gcgcgugcagcc

SEQ ID NO: 3310032 - RNA, 16 nt, Mycobacterium tuberculosis H37Rv
gcgcguggaaaccggu

SEQ ID NO: 3310033 - RNA, 18 nt, Mycobacterium tuberculosis H37Rv
gcgcguggcagugcaggc

SEQ ID NO: 3310034 - RNA, 19 nt, Mycobacterium tuberculosis H37Rv
gcgcguggcagugcaggcg

SEQ ID NO: 3310035 - RNA, 18 nt, Mycobacterium tuberculosis H37Rv
gcgcgugggcgugcaggc

SEQ ID NO: 3310036 - RNA, 22 nt, Mycobacterium tuberculosis H37Rv
gcgcguggucgccccgaugacc

SEQ ID NO: 3310037 - RNA, 14 nt, Mycobacterium tuberculosis H37Rv
gcgcguuccagcac

SEQ ID NO: 3310038 - RNA, 16 nt, Mycobacterium tuberculosis H37Rv
gcgcguuccaucaggg

SEQ ID NO: 3310039 - RNA, 15 nt, Mycobacterium tuberculosis H37Rv
gcgcguucgaccucg

SEQ ID NO: 3310040 - RNA, 18 nt, Mycobacterium tuberculosis H37Rv
gcgcguucgaccucgacu

SEQ ID NO: 3310041 - RNA, 17 nt, Mycobacterium tuberculosis H37Rv
gcgcguucggcaccugg

SEQ ID NO: 3310042 - RNA, 17 nt, Mycobacterium tuberculosis H37Rv
gcgcguucggcgagcag

SEQ ID NO: 3310043 - RNA, 20 nt, Mycobacterium tuberculosis H37Rv
gcgcguucggcgcugaucgc

SEQ ID NO: 3310044 - RNA, 13 nt, Mycobacterium tuberculosis H37Rv
gcgcguucgucgu

SEQ ID NO: 3310045 - RNA, 19 nt, Mycobacterium tuberculosis H37Rv
gcgcguucgucgucgcuga

SEQ ID NO: 3310046 - RNA, 17 nt, Mycobacterium tuberculosis H37Rv
gcgcguugaagucgccg

SEQ ID NO: 3310047 - RNA, 14 nt, Mycobacterium tuberculosis H37Rv
gcgcguugcgguca

SEQ ID NO: 3310048 - RNA, 19 nt, Mycobacterium tuberculosis H37Rv
gcgcguugcguaucgaccc

SEQ ID NO: 3310049 - RNA, 18 nt, Mycobacterium tuberculosis H37Rv
gcgcguuggcgagguugc

SEQ ID NO: 3310050 - RNA, 21 nt, Mycobacterium tuberculosis H37Rv
gcgcuaaggugggcacagcga

SEQ ID NO: 3310051 - RNA, 18 nt, Mycobacterium tuberculosis H37Rv
gcgcuacagcaucaaccg

SEQ ID NO: 3310052 - RNA, 21 nt, Mycobacterium tuberculosis H37Rv
gcgcuaccuguguugagcggc

SEQ ID NO: 3310053 - RNA, 17 nt, Mycobacterium tuberculosis H37Rv
gcgcuagccgggcgcgc

SEQ ID NO: 3310054 - RNA, 18 nt, Mycobacterium tuberculosis H37Rv
gcgcuagccgggcgcgcc

SEQ ID NO: 3310055 - RNA, 17 nt, Mycobacterium tuberculosis H37Rv
gcgcuagcgccgcgcuu

SEQ ID NO: 3310056 - RNA, 13 nt, Mycobacterium tuberculosis H37Rv
gcgcuagcgguau

SEQ ID NO: 3310057 - RNA, 14 nt, Mycobacterium tuberculosis H37Rv
gcgcuaggaacgcc

SEQ ID NO: 3310058 - RNA, 20 nt, Mycobacterium tuberculosis H37Rv
gcgcucaaugaucgcggcgg

SEQ ID NO: 3310059 - RNA, 21 nt, Mycobacterium tuberculosis H37Rv
gcgcucaaugaucgcggcggc

SEQ ID NO: 3310060 - RNA, 13 nt, Mycobacterium tuberculosis H37Rv
gcgcucagccggg

SEQ ID NO: 3310061 - RNA, 14 nt, Mycobacterium tuberculosis H37Rv
gcgcucagcgcggc

SEQ ID NO: 3310062 - RNA, 17 nt, Mycobacterium tuberculosis H37Rv
gcgcucagcgcggccac

SEQ ID NO: 3310063 - RNA, 23 nt, Mycobacterium tuberculosis H37Rv
gcgcucagcuccggcgacucugu

SEQ ID NO: 3310064 - RNA, 15 nt, Mycobacterium tuberculosis H37Rv
gcgcucaucacccag

SEQ ID NO: 3310065 - RNA, 20 nt, Mycobacterium tuberculosis H37Rv
gcgcucaucacccagcgccg

SEQ ID NO: 3310066 - RNA, 17 nt, Mycobacterium tuberculosis H37Rv
gcgcucaucgaccgggg

SEQ ID NO: 3310067 - RNA, 15 nt, Mycobacterium tuberculosis H37Rv
gcgcucaucugcgcg

SEQ ID NO: 3310068 - RNA, 18 nt, Mycobacterium tuberculosis H37Rv
gcgcucaucugcgcgcgg

SEQ ID NO: 3310069 - RNA, 19 nt, Mycobacterium tuberculosis H37Rv
gcgcucaucugcgcgcgga

SEQ ID NO: 3310070 - RNA, 20 nt, Mycobacterium tuberculosis H37Rv
gcgcucauugcaucugccaa

SEQ ID NO: 3310071 - RNA, 19 nt, Mycobacterium tuberculosis H37Rv
gcgcuccaacaaugccagc

SEQ ID NO: 3310072 - RNA, 17 nt, Mycobacterium tuberculosis H37Rv
gcgcuccacugaccagg

SEQ ID NO: 3310073 - RNA, 20 nt, Mycobacterium tuberculosis H37Rv
gcgcuccagcacccgcgcga

SEQ ID NO: 3310074 - RNA, 24 nt, Mycobacterium tuberculosis H37Rv
gcgcucccacgcuucggccugugc

SEQ ID NO: 3310075 - RNA, 12 nt, Mycobacterium tuberculosis H37Rv
gcgcucccgccg

SEQ ID NO: 3310076 - RNA, 17 nt, Mycobacterium tuberculosis H37Rv
gcgcucccguacgccgg

SEQ ID NO: 3310077 - RNA, 19 nt, Mycobacterium tuberculosis H37Rv
gcgcuccggcgcgacgccc

SEQ ID NO: 3310078 - RNA, 18 nt, Mycobacterium tuberculosis H37Rv
gcgcucgaacucggcggc

SEQ ID NO: 3310079 - RNA, 15 nt, Mycobacterium tuberculosis H37Rv
gcgcucgacgagcac

SEQ ID NO: 3310080 - RNA, 13 nt, Mycobacterium tuberculosis H37Rv
gcgcucgaucacg

SEQ ID NO: 3310081 - RNA, 17 nt, Mycobacterium tuberculosis H37Rv
gcgcucgaucacuagcg

SEQ ID NO: 3310082 - RNA, 23 nt, Mycobacterium tuberculosis H37Rv
gcgcucgauggcggccaccagcg

SEQ ID NO: 3310083 - RNA, 14 nt, Mycobacterium tuberculosis H37Rv
gcgcucgcaccacc

SEQ ID NO: 3310084 - RNA, 17 nt, Mycobacterium tuberculosis H37Rv
gcgcucgcaccaccacg

SEQ ID NO: 3310085 - RNA, 20 nt, Mycobacterium tuberculosis H37Rv
gcgcucgcacccgcucggcg

SEQ ID NO: 3310086 - RNA, 17 nt, Mycobacterium tuberculosis H37Rv
gcgcucgcgcgguaguc

SEQ ID NO: 3310087 - RNA, 17 nt, Mycobacterium tuberculosis H37Rv
gcgcucgcggguucggc

SEQ ID NO: 3310088 - RNA, 18 nt, Mycobacterium tuberculosis H37Rv
gcgcucgcgguagcgccg

SEQ ID NO: 3310089 - RNA, 16 nt, Mycobacterium tuberculosis H37Rv
gcgcucgcucaccggc

SEQ ID NO: 3310090 - RNA, 16 nt, Mycobacterium tuberculosis H37Rv
gcgcucggcagccggc

SEQ ID NO: 3310091 - RNA, 16 nt, Mycobacterium tuberculosis H37Rv
gcgcucggccagcauc

SEQ ID NO: 3310092 - RNA, 17 nt, Mycobacterium tuberculosis H37Rv
gcgcucgggcccagcgc

SEQ ID NO: 3310093 - RNA, 15 nt, Mycobacterium tuberculosis H37Rv
gcgcucgggcugccg

SEQ ID NO: 3310094 - RNA, 18 nt, Mycobacterium tuberculosis H37Rv
gcgcucggucuccaccac

SEQ ID NO: 3310095 - RNA, 21 nt, Mycobacterium tuberculosis H37Rv
gcgcucggucuccaccaccga

SEQ ID NO: 3310096 - RNA, 19 nt, Mycobacterium tuberculosis H37Rv
gcgcucggugccgcccagg

SEQ ID NO: 3310097 - RNA, 18 nt, Mycobacterium tuberculosis H37Rv
gcgcucguagaaucggcu

SEQ ID NO: 3310098 - RNA, 13 nt, Mycobacterium tuberculosis H37Rv
gcgcucgucgcgg

SEQ ID NO: 3310099 - RNA, 23 nt, Mycobacterium tuberculosis H37Rv
gcgcucgucuaccccgagccuug

SEQ ID NO: 3310100 - RNA, 21 nt, Mycobacterium tuberculosis H37Rv
gcgcugaagccgacgauccac

SEQ ID NO: 3310101 - RNA, 22 nt, Mycobacterium tuberculosis H37Rv
gcgcugaaucaccccggcggcc

SEQ ID NO: 3310102 - RNA, 13 nt, Mycobacterium tuberculosis H37Rv
gcgcugacccgcc

SEQ ID NO: 3310103 - RNA, 15 nt, Mycobacterium tuberculosis H37Rv
gcgcugacccgccga

SEQ ID NO: 3310104 - RNA, 18 nt, Mycobacterium tuberculosis H37Rv
gcgcugacccgccgacga

SEQ ID NO: 3310105 - RNA, 21 nt, Mycobacterium tuberculosis H37Rv
gcgcugagcgacugcagcggc

SEQ ID NO: 3310106 - RNA, 17 nt, Mycobacterium tuberculosis H37Rv
gcgcugauccggucggc

SEQ ID NO: 3310107 - RNA, 21 nt, Mycobacterium tuberculosis H37Rv
gcgcugauccggucggccagc

SEQ ID NO: 3310108 - RNA, 22 nt, Mycobacterium tuberculosis H37Rv
gcgcugauccggucggccagca

SEQ ID NO: 3310109 - RNA, 14 nt, Mycobacterium tuberculosis H37Rv
gcgcugaucgcgcg

SEQ ID NO: 3310110 - RNA, 18 nt, Mycobacterium tuberculosis H37Rv
gcgcugaugacgcggggc

SEQ ID NO: 3310111 - RNA, 19 nt, Mycobacterium tuberculosis H37Rv
gcgcugcaccgggucaacg

SEQ ID NO: 3310112 - RNA, 20 nt, Mycobacterium tuberculosis H37Rv
gcgcugcagcacggcuucgc

SEQ ID NO: 3310113 - RNA, 14 nt, Mycobacterium tuberculosis H37Rv
gcgcugcagcaugg

SEQ ID NO: 3310114 - RNA, 13 nt, Mycobacterium tuberculosis H37Rv
gcgcugcagcgag

SEQ ID NO: 3310115 - RNA, 19 nt, Mycobacterium tuberculosis H37Rv
gcgcugccaauccgaucga

SEQ ID NO: 3310116 - RNA, 19 nt, Mycobacterium tuberculosis H37Rv
gcgcugccaccgcgguggc

SEQ ID NO: 3310117 - RNA, 14 nt, Mycobacterium tuberculosis H37Rv
gcgcugcccacgga

SEQ ID NO: 3310118 - RNA, 23 nt, Mycobacterium tuberculosis H37Rv
gcgcugccgccguuuccugcguc

SEQ ID NO: 3310119 - RNA, 14 nt, Mycobacterium tuberculosis H37Rv
gcgcugcgcaccgc

SEQ ID NO: 3310120 - RNA, 16 nt, Mycobacterium tuberculosis H37Rv
gcggacccgaccgucg

SEQ ID NO: 3310121 - RNA, 19 nt, Mycobacterium tuberculosis H37Rv
gcggacccgaccgucgucg

SEQ ID NO: 3310122 - RNA, 14 nt, Mycobacterium tuberculosis H37Rv
gcggacccgcagcu

SEQ ID NO: 3310123 - RNA, 15 nt, Mycobacterium tuberculosis H37Rv
gcggacccgccguga

SEQ ID NO: 3310124 - RNA, 20 nt, Mycobacterium tuberculosis H37Rv
gcggacccgccgugaguagg

SEQ ID NO: 3310125 - RNA, 19 nt, Mycobacterium tuberculosis H37Rv
gcggacccgcgcgucgccc

SEQ ID NO: 3310126 - RNA, 14 nt, Mycobacterium tuberculosis H37Rv
gcggacccgcucgc

SEQ ID NO: 3310127 - RNA, 22 nt, Mycobacterium tuberculosis H37Rv
gcggacccggugacccgcuggg

SEQ ID NO: 3310128 - RNA, 24 nt, Mycobacterium tuberculosis H37Rv
gcggacccggugacccgcugggcc

SEQ ID NO: 3310129 - RNA, 19 nt, Mycobacterium tuberculosis H37Rv
gcggacccuaacucccccg

SEQ ID NO: 3310130 - RNA, 17 nt, Mycobacterium tuberculosis H37Rv
gcggacccucgccgaag

SEQ ID NO: 3310131 - RNA, 20 nt, Mycobacterium tuberculosis H37Rv
gcggaccgauugucggcaac

SEQ ID NO: 3310132 - RNA, 17 nt, Mycobacterium tuberculosis H37Rv
gcggaccgcaacgacgg

SEQ ID NO: 3310133 - RNA, 19 nt, Mycobacterium tuberculosis H37Rv
gcggaccggcgucggcuga

SEQ ID NO: 3310134 - RNA, 13 nt, Mycobacterium tuberculosis H37Rv
gcggaccugcgag

SEQ ID NO: 3310135 - RNA, 18 nt, Mycobacterium tuberculosis H37Rv
gcggaccugcgagaucgg

SEQ ID NO: 3310136 - RNA, 13 nt, Mycobacterium tuberculosis H37Rv
gcggacgaccuug

SEQ ID NO: 3310137 - RNA, 15 nt, Mycobacterium tuberculosis H37Rv
gcggacgacgucggg

SEQ ID NO: 3310138 - RNA, 23 nt, Mycobacterium tuberculosis H37Rv
gcggacggcguugagcaggugcc

SEQ ID NO: 3310139 - RNA, 23 nt, Mycobacterium tuberculosis H37Rv
gcggacgguguacaggucgccgg

SEQ ID NO: 3310140 - RNA, 16 nt, Mycobacterium tuberculosis H37Rv
gcggacguggucggag

SEQ ID NO: 3310141 - RNA, 14 nt, Mycobacterium tuberculosis H37Rv
gcggacucagcggc

SEQ ID NO: 3310142 - RNA, 19 nt, Mycobacterium tuberculosis H37Rv
gcggacucgagucugcgca

SEQ ID NO: 3310143 - RNA, 21 nt, Mycobacterium tuberculosis H37Rv
gcggacucgagucugcgcaga

SEQ ID NO: 3310144 - RNA, 15 nt, Mycobacterium tuberculosis H37Rv
gcggacucgggcagg

SEQ ID NO: 3310145 - RNA, 22 nt, Mycobacterium tuberculosis H37Rv
gcggacugagagauggucgggc

SEQ ID NO: 3310146 - RNA, 14 nt, Mycobacterium tuberculosis H37Rv
gcggacuucgccgc

SEQ ID NO: 3310147 - RNA, 17 nt, Mycobacterium tuberculosis H37Rv
gcggagaacaucccccg

SEQ ID NO: 3310148 - RNA, 18 nt, Mycobacterium tuberculosis H37Rv
gcggagaacaucccccgg

SEQ ID NO: 3310149 - RNA, 18 nt, Mycobacterium tuberculosis H37Rv
gcggagaacgcgucgcgc

SEQ ID NO: 3310150 - RNA, 21 nt, Mycobacterium tuberculosis H37Rv
gcggagaacgcgucgcgcgcc

SEQ ID NO: 3310151 - RNA, 16 nt, Mycobacterium tuberculosis H37Rv
gcggagaaggcgcggg

SEQ ID NO: 3310152 - RNA, 18 nt, Mycobacterium tuberculosis H37Rv
gcggagaaggcgcgggcg

SEQ ID NO: 3310153 - RNA, 17 nt, Mycobacterium tuberculosis H37Rv
gcggagacgaucgccag

SEQ ID NO: 3310154 - RNA, 22 nt, Mycobacterium tuberculosis H37Rv
gcggagacgaucgccaggccga

SEQ ID NO: 3310155 - RNA, 17 nt, Mycobacterium tuberculosis H37Rv
gcggagagccugcucgc

SEQ ID NO: 3310156 - RNA, 19 nt, Mycobacterium tuberculosis H37Rv
gcggagcacuucgucgaac

SEQ ID NO: 3310157 - RNA, 18 nt, Mycobacterium tuberculosis H37Rv
gcggagccaggacgacgc

SEQ ID NO: 3310158 - RNA, 17 nt, Mycobacterium tuberculosis H37Rv
gcggagccgggugaggc

SEQ ID NO: 3310159 - RNA, 13 nt, Mycobacterium tuberculosis H37Rv
gcggaggccgccu

SEQ ID NO: 3310160 - RNA, 16 nt, Mycobacterium tuberculosis H37Rv
gcggaggcggccagcc

SEQ ID NO: 3310161 - RNA, 14 nt, Mycobacterium tuberculosis H37Rv
gcggaggcgggugc

SEQ ID NO: 3310162 - RNA, 13 nt, Mycobacterium tuberculosis H37Rv
gcggaggcugggc

SEQ ID NO: 3310163 - RNA, 16 nt, Mycobacterium tuberculosis H37Rv
gcggaggcugggcuga

SEQ ID NO: 3310164 - RNA, 13 nt, Mycobacterium tuberculosis H37Rv
gcggagggcgccu

SEQ ID NO: 3310165 - RNA, 16 nt, Mycobacterium tuberculosis H37Rv
gcggaggguucgccga

SEQ ID NO: 3310166 - RNA, 16 nt, Mycobacterium tuberculosis H37Rv
gcggaguagccgcagc

SEQ ID NO: 3310167 - RNA, 13 nt, Mycobacterium tuberculosis H37Rv
gcggagucaagca

SEQ ID NO: 3310168 - RNA, 17 nt, Mycobacterium tuberculosis H37Rv
gcggagucaagcagcag

SEQ ID NO: 3310169 - RNA, 14 nt, Mycobacterium tuberculosis H37Rv
gcggaguccgucga

SEQ ID NO: 3310170 - RNA, 19 nt, Mycobacterium tuberculosis H37Rv
gcggaguccgucgacaccg

SEQ ID NO: 3310171 - RNA, 21 nt, Mycobacterium tuberculosis H37Rv
gcggaguccgucgacaccgcg

SEQ ID NO: 3310172 - RNA, 14 nt, Mycobacterium tuberculosis H37Rv
gcggaguucgcuga

SEQ ID NO: 3310173 - RNA, 17 nt, Mycobacterium tuberculosis H37Rv
gcggaguucgcugacgg

SEQ ID NO: 3310174 - RNA, 20 nt, Mycobacterium tuberculosis H37Rv
gcggaguuuuucgggguggc

SEQ ID NO: 3310175 - RNA, 15 nt, Mycobacterium tuberculosis H37Rv
gcggauacagccgcc

SEQ ID NO: 3310176 - RNA, 17 nt, Mycobacterium tuberculosis H37Rv
gcggauacuguucugcu

SEQ ID NO: 3310177 - RNA, 19 nt, Mycobacterium tuberculosis H37Rv
gcggauagcaacggugcuc

SEQ ID NO: 3310178 - RNA, 21 nt, Mycobacterium tuberculosis H37Rv
gcggauagcggcaaagccggg

SEQ ID NO: 3310179 - RNA, 14 nt, Mycobacterium tuberculosis H37Rv
gcggaucaacaggc

SEQ ID NO: 3310180 - RNA, 18 nt, Mycobacterium tuberculosis H37Rv
gcggaucagaggacccgu

SEQ ID NO: 3310181 - RNA, 19 nt, Mycobacterium tuberculosis H37Rv
gcggaucauccuucgccgg

SEQ ID NO: 3310182 - RNA, 18 nt, Mycobacterium tuberculosis H37Rv
gcggauccgggcguggug

SEQ ID NO: 3310183 - RNA, 16 nt, Mycobacterium tuberculosis H37Rv
gcggaucgaccgccag

SEQ ID NO: 3310184 - RNA, 19 nt, Mycobacterium tuberculosis H37Rv
gcggaucgcgcugaucagc

SEQ ID NO: 3310185 - RNA, 17 nt, Mycobacterium tuberculosis H37Rv
gcggaucgcggucagcg

SEQ ID NO: 3310186 - RNA, 17 nt, Mycobacterium tuberculosis H37Rv
gcggaucgucgucgugu

SEQ ID NO: 3310187 - RNA, 22 nt, Mycobacterium tuberculosis H37Rv
gcggaucucaucgggccacagc

SEQ ID NO: 3310188 - RNA, 23 nt, Mycobacterium tuberculosis H37Rv
gcggaucucaucgggccacagca

SEQ ID NO: 3310189 - RNA, 13 nt, Mycobacterium tuberculosis H37Rv
gcggaucugaucg

SEQ ID NO: 3310190 - RNA, 16 nt, Mycobacterium tuberculosis H37Rv
gcggaucugggcggcc

SEQ ID NO: 3310191 - RNA, 17 nt, Mycobacterium tuberculosis H37Rv
gcggaucugggcggccu

SEQ ID NO: 3310192 - RNA, 10 nt, Mycobacterium tuberculosis H37Rv
gcggaucugu

SEQ ID NO: 3310193 - RNA, 23 nt, Mycobacterium tuberculosis H37Rv
gcggaucuucucgguaccaccgg

SEQ ID NO: 3310194 - RNA, 16 nt, Mycobacterium tuberculosis H37Rv
gcggaucuugguguug

SEQ ID NO: 3310195 - RNA, 17 nt, Mycobacterium tuberculosis H37Rv
gcggaugaaaucggcaa

SEQ ID NO: 3310196 - RNA, 20 nt, Mycobacterium tuberculosis H37Rv
gcggaugcaugucaaguucg

SEQ ID NO: 3310197 - RNA, 20 nt, Mycobacterium tuberculosis H37Rv
gcggaugcguuggccccagg

SEQ ID NO: 3310198 - RNA, 19 nt, Mycobacterium tuberculosis H37Rv
gcggaugcuguugacccgu

SEQ ID NO: 3310199 - RNA, 22 nt, Mycobacterium tuberculosis H37Rv
gcggauguacacuuugcccgcc

SEQ ID NO: 3310200 - RNA, 18 nt, Mycobacterium tuberculosis H37Rv
gcggaugucgucgaccag

SEQ ID NO: 3310201 - RNA, 19 nt, Mycobacterium tuberculosis H37Rv
gcggaugucgucgaccagg

SEQ ID NO: 3310202 - RNA, 17 nt, Mycobacterium tuberculosis H37Rv
gcggauuaagucggcgg

SEQ ID NO: 3310203 - RNA, 18 nt, Mycobacterium tuberculosis H37Rv
gcggauuaagucggcggc

SEQ ID NO: 3310204 - RNA, 19 nt, Mycobacterium tuberculosis H37Rv
gcggauuaagucggcggcc

SEQ ID NO: 3310205 - RNA, 20 nt, Mycobacterium tuberculosis H37Rv
gcggauuaagucggcggccu

SEQ ID NO: 3310206 - RNA, 17 nt, Mycobacterium tuberculosis H37Rv
gcggauucacgcaccgg

SEQ ID NO: 3310207 - RNA, 14 nt, Mycobacterium tuberculosis H37Rv
gcggauucggcguc

SEQ ID NO: 3310208 - RNA, 14 nt, Mycobacterium tuberculosis H37Rv
gcggauuucgccgu

SEQ ID NO: 3310209 - RNA, 17 nt, Mycobacterium tuberculosis H37Rv
gcggauuucucgcccug

SEQ ID NO: 3310210 - RNA, 16 nt, Mycobacterium tuberculosis H37Rv
gcggcaaagagcagcc

SEQ ID NO: 3310211 - RNA, 18 nt, Mycobacterium tuberculosis H37Rv
gcggcaaagagcagccgg

SEQ ID NO: 3310212 - RNA, 21 nt, Mycobacterium tuberculosis H37Rv
gcggcaaaguuggccgcccga

SEQ ID NO: 3310213 - RNA, 14 nt, Mycobacterium tuberculosis H37Rv
gcggcaaccgucga

SEQ ID NO: 3310214 - RNA, 17 nt, Mycobacterium tuberculosis H37Rv
gcggcaacgcggucugc

SEQ ID NO: 3310215 - RNA, 21 nt, Mycobacterium tuberculosis H37Rv
gcggcaagcucguccggugcg

SEQ ID NO: 3310216 - RNA, 17 nt, Mycobacterium tuberculosis H37Rv
gcggccacccgcgacga

SEQ ID NO: 3310217 - RNA, 15 nt, Mycobacterium tuberculosis H37Rv
gcggccaccgccgcc

SEQ ID NO: 3310218 - RNA, 21 nt, Mycobacterium tuberculosis H37Rv
gcggccaccgccgccgccacc

SEQ ID NO: 3310219 - RNA, 23 nt, Mycobacterium tuberculosis H37Rv
gcggccaccgccgccgccgacgc

SEQ ID NO: 3310220 - RNA, 16 nt, Mycobacterium tuberculosis H37Rv
gcggccaccugcuggc

SEQ ID NO: 3310221 - RNA, 15 nt, Mycobacterium tuberculosis H37Rv
gcggccacgccgauc

SEQ ID NO: 3310222 - RNA, 14 nt, Mycobacterium tuberculosis H37Rv
gcggccacggucag

SEQ ID NO: 3310223 - RNA, 14 nt, Mycobacterium tuberculosis H37Rv
gcggccacgguggc

SEQ ID NO: 3310224 - RNA, 16 nt, Mycobacterium tuberculosis H37Rv
gcggccacgguggcgc

SEQ ID NO: 3310225 - RNA, 17 nt, Mycobacterium tuberculosis H37Rv
gcggccacucgcccgau

SEQ ID NO: 3310226 - RNA, 22 nt, Mycobacterium tuberculosis H37Rv
gcggccacuuggaugcgacccg

SEQ ID NO: 3310227 - RNA, 23 nt, Mycobacterium tuberculosis H37Rv
gcggccacuuggaugcgacccgu

SEQ ID NO: 3310228 - RNA, 22 nt, Mycobacterium tuberculosis H37Rv
gcggccagauagguuccaccgg

SEQ ID NO: 3310229 - RNA, 23 nt, Mycobacterium tuberculosis H37Rv
gcggccagcagcaacgacccgaa

SEQ ID NO: 3310230 - RNA, 16 nt, Mycobacterium tuberculosis H37Rv
gcggccagcagugcgg

SEQ ID NO: 3310231 - RNA, 17 nt, Mycobacterium tuberculosis H37Rv
gcggccagcaucgcggu

SEQ ID NO: 3310232 - RNA, 19 nt, Mycobacterium tuberculosis H37Rv
gcggccagcaucgcggugg

SEQ ID NO: 3310233 - RNA, 20 nt, Mycobacterium tuberculosis H37Rv
gcggccagcaucgcgguggu

SEQ ID NO: 3310234 - RNA, 15 nt, Mycobacterium tuberculosis H37Rv
gcggccagccguuug

SEQ ID NO: 3310235 - RNA, 12 nt, Mycobacterium tuberculosis H37Rv
gcggccagcgau

SEQ ID NO: 3310236 - RNA, 20 nt, Mycobacterium tuberculosis H37Rv
gcggccagcgcgcgcgggug

SEQ ID NO: 3310237 - RNA, 16 nt, Mycobacterium tuberculosis H37Rv
gcggccagcgcgucgc

SEQ ID NO: 3310238 - RNA, 14 nt, Mycobacterium tuberculosis H37Rv
gcggccagcucaug

SEQ ID NO: 3310239 - RNA, 23 nt, Mycobacterium tuberculosis H37Rv
gcggccagcuccagcgccgcggu

SEQ ID NO: 3310240 - RNA, 13 nt, Mycobacterium tuberculosis H37Rv
gcggccagcuccc

SEQ ID NO: 3310241 - RNA, 23 nt, Mycobacterium tuberculosis H37Rv
gcggccaggaugccugccacccg

SEQ ID NO: 3310242 - RNA, 14 nt, Mycobacterium tuberculosis H37Rv
gcggccaggcgcga

SEQ ID NO: 3310243 - RNA, 13 nt, Mycobacterium tuberculosis H37Rv
gcggccaggcggu

SEQ ID NO: 3310244 - RNA, 17 nt, Mycobacterium tuberculosis H37Rv
gcggccaggcgguacgg

SEQ ID NO: 3310245 - RNA, 22 nt, Mycobacterium tuberculosis H37Rv
gcggccaggcgguacgggucgc

SEQ ID NO: 3310246 - RNA, 13 nt, Mycobacterium tuberculosis H37Rv
gcggccagggagc

SEQ ID NO: 3310247 - RNA, 20 nt, Mycobacterium tuberculosis H37Rv
gcggccagggagcggcuugc

SEQ ID NO: 3310248 - RNA, 15 nt, Mycobacterium tuberculosis H37Rv
gcggccagggcgucg

SEQ ID NO: 3310249 - RNA, 18 nt, Mycobacterium tuberculosis H37Rv
gcggccagggcgucgacc

SEQ ID NO: 3310250 - RNA, 16 nt, Mycobacterium tuberculosis H37Rv
gcggccaggucgccuu

SEQ ID NO: 3310251 - RNA, 23 nt, Mycobacterium tuberculosis H37Rv
gcggccaguacgucgaucaacag

SEQ ID NO: 3310252 - RNA, 15 nt, Mycobacterium tuberculosis H37Rv
gcggccagugcucgc

SEQ ID NO: 3310253 - RNA, 21 nt, Mycobacterium tuberculosis H37Rv
gcggccaguucggcggccgcc

SEQ ID NO: 3310254 - RNA, 19 nt, Mycobacterium tuberculosis H37Rv
gcggccaguugcacaucgg

SEQ ID NO: 3310255 - RNA, 18 nt, Mycobacterium tuberculosis H37Rv
gcggccaucccgcguucg

SEQ ID NO: 3310256 - RNA, 16 nt, Mycobacterium tuberculosis H37Rv
gcggccauccggcggc

SEQ ID NO: 3310257 - RNA, 17 nt, Mycobacterium tuberculosis H37Rv
gcggccauccggcggcg

SEQ ID NO: 3310258 - RNA, 15 nt, Mycobacterium tuberculosis H37Rv
gcggccaucgccgac

SEQ ID NO: 3310259 - RNA, 17 nt, Mycobacterium tuberculosis H37Rv
gcggccauuagcagcac

SEQ ID NO: 3310260 - RNA, 21 nt, Mycobacterium tuberculosis H37Rv
gcggccauuagcagcacccgg

SEQ ID NO: 3310261 - RNA, 14 nt, Mycobacterium tuberculosis H37Rv
gcggcccacaccag

SEQ ID NO: 3310262 - RNA, 20 nt, Mycobacterium tuberculosis H37Rv
gcggcccacaccagcgcagc

SEQ ID NO: 3310263 - RNA, 18 nt, Mycobacterium tuberculosis H37Rv
gcggcccaugggggaacc

SEQ ID NO: 3310264 - RNA, 20 nt, Mycobacterium tuberculosis H37Rv
gcggccccgacauacgucgg

SEQ ID NO: 3310265 - RNA, 21 nt, Mycobacterium tuberculosis H37Rv
gcggccccgacauacgucggg

SEQ ID NO: 3310266 - RNA, 19 nt, Mycobacterium tuberculosis H37Rv
gcggccccgacugccgcgg

SEQ ID NO: 3310267 - RNA, 13 nt, Mycobacterium tuberculosis H37Rv
gcggccccgccgu

SEQ ID NO: 3310268 - RNA, 18 nt, Mycobacterium tuberculosis H37Rv
gcggccccggcauugccc

SEQ ID NO: 3310269 - RNA, 18 nt, Mycobacterium tuberculosis H37Rv
gcggcccgaggcucgggc

SEQ ID NO: 3310270 - RNA, 20 nt, Mycobacterium tuberculosis H37Rv
gcggcccgaucugagcugcc

SEQ ID NO: 3310271 - RNA, 21 nt, Mycobacterium tuberculosis H37Rv
gcggcccgcacggccgcagcc

SEQ ID NO: 3310272 - RNA, 13 nt, Mycobacterium tuberculosis H37Rv
gcggcccgcagcc

SEQ ID NO: 3310273 - RNA, 22 nt, Mycobacterium tuberculosis H37Rv
gcggcccgcagcccgccgggcu

SEQ ID NO: 3310274 - RNA, 13 nt, Mycobacterium tuberculosis H37Rv
gcggcccgcaucg

SEQ ID NO: 3310275 - RNA, 21 nt, Mycobacterium tuberculosis H37Rv
gcggcccgcaucguugccgac

SEQ ID NO: 3310276 - RNA, 18 nt, Mycobacterium tuberculosis H37Rv
gcggcccgcgaauacgag

SEQ ID NO: 3310277 - RNA, 17 nt, Mycobacterium tuberculosis H37Rv
gcggcccgcgaucgggc

SEQ ID NO: 3310278 - RNA, 22 nt, Mycobacterium tuberculosis H37Rv
gcggcccgcuccacggucaggc

SEQ ID NO: 3310279 - RNA, 18 nt, Mycobacterium tuberculosis H37Rv
gcggcccggguuggccga

SEQ ID NO: 3310280 - RNA, 16 nt, Mycobacterium tuberculosis H37Rv
gcggcccgguggacag

SEQ ID NO: 3310281 - RNA, 20 nt, Mycobacterium tuberculosis H37Rv
gcggcccguuugccgguucg

SEQ ID NO: 3310282 - RNA, 21 nt, Mycobacterium tuberculosis H37Rv
gcggcccuaucuggcggccgg

SEQ ID NO: 3310283 - RNA, 21 nt, Mycobacterium tuberculosis H37Rv
gcggcccucgaauucggccgg

SEQ ID NO: 3310284 - RNA, 14 nt, Mycobacterium tuberculosis H37Rv
gcggcccucgagca

SEQ ID NO: 3310285 - RNA, 20 nt, Mycobacterium tuberculosis H37Rv
gcggcccugcuugcaggcga

SEQ ID NO: 3310286 - RNA, 14 nt, Mycobacterium tuberculosis H37Rv
gcggccgaccgcga

SEQ ID NO: 3310287 - RNA, 20 nt, Mycobacterium tuberculosis H37Rv
gcggccgagcgcaccgcuga

SEQ ID NO: 3310288 - RNA, 12 nt, Mycobacterium tuberculosis H37Rv
gcggccgagguc

SEQ ID NO: 3310289 - RNA, 13 nt, Mycobacterium tuberculosis H37Rv
gcggccgauuccg

SEQ ID NO: 3310290 - RNA, 14 nt, Mycobacterium tuberculosis H37Rv
gcggccgcagccag

SEQ ID NO: 3310291 - RNA, 13 nt, Mycobacterium tuberculosis H37Rv
gcggccgcagcgg

SEQ ID NO: 3310292 - RNA, 17 nt, Mycobacterium tuberculosis H37Rv
gcggccgcagcggccag

SEQ ID NO: 3310293 - RNA, 18 nt, Mycobacterium tuberculosis H37Rv
gcggccgcagcggccagc

SEQ ID NO: 3310294 - RNA, 21 nt, Mycobacterium tuberculosis H37Rv
gcggccgcaggcgaacaccag

SEQ ID NO: 3310295 - RNA, 14 nt, Mycobacterium tuberculosis H37Rv
gcggccgccacucc

SEQ ID NO: 3310296 - RNA, 20 nt, Mycobacterium tuberculosis H37Rv
gcggccgccaucagccgcug

SEQ ID NO: 3310297 - RNA, 22 nt, Mycobacterium tuberculosis H37Rv
gcggccgccccaggcugguccg

SEQ ID NO: 3310298 - RNA, 22 nt, Mycobacterium tuberculosis H37Rv
gcggccgcccggacccaaagca

SEQ ID NO: 3310299 - RNA, 11 nt, Mycobacterium tuberculosis H37Rv
gcggccgccgc

SEQ ID NO: 3310300 - RNA, 13 nt, Mycobacterium tuberculosis H37Rv
gcggccgccgcgg

SEQ ID NO: 3310301 - RNA, 13 nt, Mycobacterium tuberculosis H37Rv
gcggccgccgcgu

SEQ ID NO: 3310302 - RNA, 18 nt, Mycobacterium tuberculosis H37Rv
gcggccgccguccccgcc

SEQ ID NO: 3310303 - RNA, 20 nt, Mycobacterium tuberculosis H37Rv
gcggccgcgaccagcgccgc

SEQ ID NO: 3310304 - RNA, 24 nt, Mycobacterium tuberculosis H37Rv
gcggccgcgaccagcgccgcaccc

SEQ ID NO: 3310305 - RNA, 15 nt, Mycobacterium tuberculosis H37Rv
gcggccgcgagguga

SEQ ID NO: 3310306 - RNA, 16 nt, Mycobacterium tuberculosis H37Rv
gcggccgcgauggcgu

SEQ ID NO: 3310307 - RNA, 15 nt, Mycobacterium tuberculosis H37Rv
gcggccgcgcgcauc

SEQ ID NO: 3310308 - RNA, 20 nt, Mycobacterium tuberculosis H37Rv
gcggccgcgcugcagcacgg

SEQ ID NO: 3310309 - RNA, 14 nt, Mycobacterium tuberculosis H37Rv
gcggccgcggcagc

SEQ ID NO: 3310310 - RNA, 12 nt, Mycobacterium tuberculosis H37Rv
gcggccgcggcc

SEQ ID NO: 3310311 - RNA, 22 nt, Mycobacterium tuberculosis H37Rv
gcggccgcggcgcggcgggcag

SEQ ID NO: 3310312 - RNA, 15 nt, Mycobacterium tuberculosis H37Rv
gcggcgcagcgacgc

SEQ ID NO: 3310313 - RNA, 19 nt, Mycobacterium tuberculosis H37Rv
gcggcgccacccgcgccgc

SEQ ID NO: 3310314 - RNA, 23 nt, Mycobacterium tuberculosis H37Rv
gcggcgccauagccgcgacccgc

SEQ ID NO: 3310315 - RNA, 13 nt, Mycobacterium tuberculosis H37Rv
gcggcgcccagga

SEQ ID NO: 3310316 - RNA, 16 nt, Mycobacterium tuberculosis H37Rv
gcggcgcccaggaacu

SEQ ID NO: 3310317 - RNA, 19 nt, Mycobacterium tuberculosis H37Rv
gcggcgcccaucgcgacgg

SEQ ID NO: 3310318 - RNA, 15 nt, Mycobacterium tuberculosis H37Rv
gcggcgcccuggccg

SEQ ID NO: 3310319 - RNA, 19 nt, Mycobacterium tuberculosis H37Rv
gcggcgccgaaaccgccgg

SEQ ID NO: 3310320 - RNA, 18 nt, Mycobacterium tuberculosis H37Rv
gcggcgccgcagaucacc

SEQ ID NO: 3310321 - RNA, 14 nt, Mycobacterium tuberculosis H37Rv
gcggcgccgccauc

SEQ ID NO: 3310322 - RNA, 13 nt, Mycobacterium tuberculosis H37Rv
gcggcgccgcccu

SEQ ID NO: 3310323 - RNA, 12 nt, Mycobacterium tuberculosis H37Rv
gcggcgccgggg

SEQ ID NO: 3310324 - RNA, 15 nt, Mycobacterium tuberculosis H37Rv
gcggcgccggggggc

SEQ ID NO: 3310325 - RNA, 21 nt, Mycobacterium tuberculosis H37Rv
gcggcgccggggggcugcugc

SEQ ID NO: 3310326 - RNA, 22 nt, Mycobacterium tuberculosis H37Rv
gcggcgccggggggcugcugcu

SEQ ID NO: 3310327 - RNA, 17 nt, Mycobacterium tuberculosis H37Rv
gcggcgccggugggcgg

SEQ ID NO: 3310328 - RNA, 12 nt, Mycobacterium tuberculosis H37Rv
gcggcgccgucg

SEQ ID NO: 3310329 - RNA, 13 nt, Mycobacterium tuberculosis H37Rv
gcggcgccgucga

SEQ ID NO: 3310330 - RNA, 12 nt, Mycobacterium tuberculosis H37Rv
gcggcgccguuc

SEQ ID NO: 3310331 - RNA, 19 nt, Mycobacterium tuberculosis H37Rv
gcggcgccugaggugcugc

SEQ ID NO: 3310332 - RNA, 15 nt, Mycobacterium tuberculosis H37Rv
gcggcgcgaagucuu

SEQ ID NO: 3310333 - RNA, 17 nt, Mycobacterium tuberculosis H37Rv
gcggcgcgaccgucugg

SEQ ID NO: 3310334 - RNA, 22 nt, Mycobacterium tuberculosis H37Rv
gcggcgcgacggcauguaccga

SEQ ID NO: 3310335 - RNA, 13 nt, Mycobacterium tuberculosis H37Rv
gcggcgcgagcag

SEQ ID NO: 3310336 - RNA, 15 nt, Mycobacterium tuberculosis H37Rv
gcggcgcgaucgacg

SEQ ID NO: 3310337 - RNA, 17 nt, Mycobacterium tuberculosis H37Rv
gcggcgcgcaacacauc

SEQ ID NO: 3310338 - RNA, 21 nt, Mycobacterium tuberculosis H37Rv
gcggcgcgcaacacauccagu

SEQ ID NO: 3310339 - RNA, 16 nt, Mycobacterium tuberculosis H37Rv
gcggcgcgccgaucga

SEQ ID NO: 3310340 - RNA, 16 nt, Mycobacterium tuberculosis H37Rv
gcggcgcgcggggccu

SEQ ID NO: 3310341 - RNA, 13 nt, Mycobacterium tuberculosis H37Rv
gcggcgcggcggg

SEQ ID NO: 3310342 - RNA, 24 nt, Mycobacterium tuberculosis H37Rv
gcggcgcgggggugggcgugacgg

SEQ ID NO: 3310343 - RNA, 15 nt, Mycobacterium tuberculosis H37Rv
gcggcgcgggucggc

SEQ ID NO: 3310344 - RNA, 14 nt, Mycobacterium tuberculosis H37Rv
gcggcgcgggugcg

SEQ ID NO: 3310345 - RNA, 14 nt, Mycobacterium tuberculosis H37Rv
gcggcgcguggugc

SEQ ID NO: 3310346 - RNA, 15 nt, Mycobacterium tuberculosis H37Rv
gcggcgcuggcgggc

SEQ ID NO: 3310347 - RNA, 13 nt, Mycobacterium tuberculosis H37Rv
gcggcgcugggac

SEQ ID NO: 3310348 - RNA, 13 nt, Mycobacterium tuberculosis H37Rv
gcggcgcugguug

SEQ ID NO: 3310349 - RNA, 14 nt, Mycobacterium tuberculosis H37Rv
gcggcggaccgucc

SEQ ID NO: 3310350 - RNA, 16 nt, Mycobacterium tuberculosis H37Rv
gcggcggaccguccga

SEQ ID NO: 3310351 - RNA, 20 nt, Mycobacterium tuberculosis H37Rv
gcggcggaccguccgacggc

SEQ ID NO: 3310352 - RNA, 15 nt, Mycobacterium tuberculosis H37Rv
gcggcggagccgggu

SEQ ID NO: 3310353 - RNA, 19 nt, Mycobacterium tuberculosis H37Rv
gcggcggauggcgucgacc

SEQ ID NO: 3310354 - RNA, 21 nt, Mycobacterium tuberculosis H37Rv
gcggcggauggcgucgaccac

SEQ ID NO: 3310355 - RNA, 17 nt, Mycobacterium tuberculosis H37Rv
gcggcggcaaccccgag

SEQ ID NO: 3310356 - RNA, 14 nt, Mycobacterium tuberculosis H37Rv
gcggcggcaagugc

SEQ ID NO: 3310357 - RNA, 14 nt, Mycobacterium tuberculosis H37Rv
gcggcggcacgcuc

SEQ ID NO: 3310358 - RNA, 20 nt, Mycobacterium tuberculosis H37Rv
gcggcggcacuacgcagccg

SEQ ID NO: 3310359 - RNA, 13 nt, Mycobacterium tuberculosis H37Rv
gcggcggcagcgg

SEQ ID NO: 3310360 - RNA, 16 nt, Mycobacterium tuberculosis H37Rv
gcggcggcagcggcga

SEQ ID NO: 3310361 - RNA, 12 nt, Mycobacterium tuberculosis H37Rv
gcggcggcaucg

SEQ ID NO: 3310362 - RNA, 20 nt, Mycobacterium tuberculosis H37Rv
gcggcggcaucgaggccagc

SEQ ID NO: 3310363 - RNA, 23 nt, Mycobacterium tuberculosis H37Rv
gcggcggcaucgaggccagcagc

SEQ ID NO: 3310364 - RNA, 13 nt, Mycobacterium tuberculosis H37Rv
gcggcggccagcg

SEQ ID NO: 3310365 - RNA, 14 nt, Mycobacterium tuberculosis H37Rv
gcggcggcccgcag

SEQ ID NO: 3310366 - RNA, 15 nt, Mycobacterium tuberculosis H37Rv
gcggcggcccgcagc

SEQ ID NO: 3310367 - RNA, 21 nt, Mycobacterium tuberculosis H37Rv
gcggcggcccuaaacaccgcg

SEQ ID NO: 3310368 - RNA, 22 nt, Mycobacterium tuberculosis H37Rv
gcggcggcccuaaacaccgcga

SEQ ID NO: 3310369 - RNA, 14 nt, Mycobacterium tuberculosis H37Rv
gcggcggcgacgag

SEQ ID NO: 3310370 - RNA, 14 nt, Mycobacterium tuberculosis H37Rv
gcggcggcgcccgg

SEQ ID NO: 3310371 - RNA, 13 nt, Mycobacterium tuberculosis H37Rv
gcggcggcgccgg

SEQ ID NO: 3310372 - RNA, 14 nt, Mycobacterium tuberculosis H37Rv
gcggcggcgccggc

SEQ ID NO: 3310373 - RNA, 12 nt, Mycobacterium tuberculosis H37Rv
gcggcggcgccu

SEQ ID NO: 3310374 - RNA, 18 nt, Mycobacterium tuberculosis H37Rv
gcggcggcgcgaucgacg

SEQ ID NO: 3310375 - RNA, 15 nt, Mycobacterium tuberculosis H37Rv
gcggcggcgcucggc

SEQ ID NO: 3310376 - RNA, 13 nt, Mycobacterium tuberculosis H37Rv
gcggcggcgucgg

SEQ ID NO: 3310377 - RNA, 20 nt, Mycobacterium tuberculosis H37Rv
gcggcggcuuuggccgccgu

SEQ ID NO: 3310378 - RNA, 24 nt, Mycobacterium tuberculosis H37Rv
gcggcggcuuuggccgccguggcg

SEQ ID NO: 3310379 - RNA, 12 nt, Mycobacterium tuberculosis H37Rv
gcggcgggcacg

SEQ ID NO: 3310380 - RNA, 13 nt, Mycobacterium tuberculosis H37Rv
gcggcgggcagcg

SEQ ID NO: 3310381 - RNA, 12 nt, Mycobacterium tuberculosis H37Rv
gcggcgggcccg

SEQ ID NO: 3310382 - RNA, 14 nt, Mycobacterium tuberculosis H37Rv
gcggcgggcccgau

SEQ ID NO: 3310383 - RNA, 16 nt, Mycobacterium tuberculosis H37Rv
gcggcgggcucgcuuc

SEQ ID NO: 3310384 - RNA, 12 nt, Mycobacterium tuberculosis H37Rv
gcggcgggggcg

SEQ ID NO: 3310385 - RNA, 22 nt, Mycobacterium tuberculosis H37Rv
gcggcgggggcgucgccgccgg

SEQ ID NO: 3310386 - RNA, 19 nt, Mycobacterium tuberculosis H37Rv
gcggcgguaccggaaucgg

SEQ ID NO: 3310387 - RNA, 19 nt, Mycobacterium tuberculosis H37Rv
gcggcgguaugccacaggc

SEQ ID NO: 3310388 - RNA, 16 nt, Mycobacterium tuberculosis H37Rv
gcggcgguccgcgcga

SEQ ID NO: 3310389 - RNA, 18 nt, Mycobacterium tuberculosis H37Rv
gcggcgguccgcgcgacc

SEQ ID NO: 3310390 - RNA, 13 nt, Mycobacterium tuberculosis H37Rv
gcggcggucgagc

SEQ ID NO: 3310391 - RNA, 14 nt, Mycobacterium tuberculosis H37Rv
gcggcggucggcug

SEQ ID NO: 3310392 - RNA, 16 nt, Mycobacterium tuberculosis H37Rv
gcggcggucggcuggg

SEQ ID NO: 3310393 - RNA, 22 nt, Mycobacterium tuberculosis H37Rv
gcggcggucggcugggcgaagc

SEQ ID NO: 3310394 - RNA, 20 nt, Mycobacterium tuberculosis H37Rv
gcggcggucucgucaaccug

SEQ ID NO: 3310395 - RNA, 15 nt, Mycobacterium tuberculosis H37Rv
gcggcggucugggug

SEQ ID NO: 3310396 - RNA, 19 nt, Mycobacterium tuberculosis H37Rv
gcggcggugcagcagggcg

SEQ ID NO: 3310397 - RNA, 22 nt, Mycobacterium tuberculosis H37Rv
gcggcggugcagcagggcgcgc

SEQ ID NO: 3310398 - RNA, 17 nt, Mycobacterium tuberculosis H37Rv
gcggcgguggccagcgu

SEQ ID NO: 3310399 - RNA, 22 nt, Mycobacterium tuberculosis H37Rv
gcggcgguggccagcgucgcga

SEQ ID NO: 3310400 - RNA, 22 nt, Mycobacterium tuberculosis H37Rv
gcggcgguggcguuacgggcga

SEQ ID NO: 3310401 - RNA, 22 nt, Mycobacterium tuberculosis H37Rv
gcggcggugguaccggcgccac

SEQ ID NO: 3310402 - RNA, 16 nt, Mycobacterium tuberculosis H37Rv
gcggcgguggugucgc

SEQ ID NO: 3310403 - RNA, 18 nt, Mycobacterium tuberculosis H37Rv
gcggcguacucggcaucc

SEQ ID NO: 3310404 - RNA, 17 nt, Mycobacterium tuberculosis H37Rv
gcggcguauugcggccu

SEQ ID NO: 3310405 - RNA, 17 nt, Mycobacterium tuberculosis H37Rv
gcggcgucaaauccagc

SEQ ID NO: 3310406 - RNA, 12 nt, Mycobacterium tuberculosis H37Rv
gcggcguccagc

SEQ ID NO: 3310407 - RNA, 13 nt, Mycobacterium tuberculosis H37Rv
gcggcguccagca

SEQ ID NO: 3310408 - RNA, 16 nt, Mycobacterium tuberculosis H37Rv
gcggcguccagcagcg

SEQ ID NO: 3310409 - RNA, 13 nt, Mycobacterium tuberculosis H37Rv
gcgggacgucgcc

SEQ ID NO: 3310410 - RNA, 17 nt, Mycobacterium tuberculosis H37Rv
gcgggacgucgucguug

SEQ ID NO: 3310411 - RNA, 15 nt, Mycobacterium tuberculosis H37Rv
gcgggacucggcgag

SEQ ID NO: 3310412 - RNA, 17 nt, Mycobacterium tuberculosis H37Rv
gcgggacugacccugau

SEQ ID NO: 3310413 - RNA, 17 nt, Mycobacterium tuberculosis H37Rv
gcgggacugcagcgcgg

SEQ ID NO: 3310414 - RNA, 22 nt, Mycobacterium tuberculosis H37Rv
gcgggacugcagcgcggugguc

SEQ ID NO: 3310415 - RNA, 16 nt, Mycobacterium tuberculosis H37Rv
gcgggacuugucgggg

SEQ ID NO: 3310416 - RNA, 14 nt, Mycobacterium tuberculosis H37Rv
gcgggagaucgucg

SEQ ID NO: 3310417 - RNA, 19 nt, Mycobacterium tuberculosis H37Rv
gcgggaguucggggugcgc

SEQ ID NO: 3310418 - RNA, 13 nt, Mycobacterium tuberculosis H37Rv
gcgggaucaccau

SEQ ID NO: 3310419 - RNA, 15 nt, Mycobacterium tuberculosis H37Rv
gcgggaucgguggcg

SEQ ID NO: 3310420 - RNA, 20 nt, Mycobacterium tuberculosis H37Rv
gcgggaucgguggcggcacg

SEQ ID NO: 3310421 - RNA, 22 nt, Mycobacterium tuberculosis H37Rv
gcgggaucugagggcucggugg

SEQ ID NO: 3310422 - RNA, 12 nt, Mycobacterium tuberculosis H37Rv
gcgggaugacgg

SEQ ID NO: 3310423 - RNA, 14 nt, Mycobacterium tuberculosis H37Rv
gcgggaugacgguu

SEQ ID NO: 3310424 - RNA, 14 nt, Mycobacterium tuberculosis H37Rv
gcgggaugcgcgcc

SEQ ID NO: 3310425 - RNA, 13 nt, Mycobacterium tuberculosis H37Rv
gcgggauggacag

SEQ ID NO: 3310426 - RNA, 16 nt, Mycobacterium tuberculosis H37Rv
gcgggauggccgccga

SEQ ID NO: 3310427 - RNA, 16 nt, Mycobacterium tuberculosis H37Rv
gcgggauugcgcgcug

SEQ ID NO: 3310428 - RNA, 20 nt, Mycobacterium tuberculosis H37Rv
gcgggcaacugcagcauggc

SEQ ID NO: 3310429 - RNA, 16 nt, Mycobacterium tuberculosis H37Rv
gcgggcaagaugaucg

SEQ ID NO: 3310430 - RNA, 23 nt, Mycobacterium tuberculosis H37Rv
gcgggcaagucgcccagccgagc

SEQ ID NO: 3310431 - RNA, 16 nt, Mycobacterium tuberculosis H37Rv
gcgggcaaucaccgcc

SEQ ID NO: 3310432 - RNA, 19 nt, Mycobacterium tuberculosis H37Rv
gcgggcaaucaccgccggc

SEQ ID NO: 3310433 - RNA, 20 nt, Mycobacterium tuberculosis H37Rv
gcgggcaaucaccgccggcg

SEQ ID NO: 3310434 - RNA, 22 nt, Mycobacterium tuberculosis H37Rv
gcgggcaaucaccgccggcggc

SEQ ID NO: 3310435 - RNA, 21 nt, Mycobacterium tuberculosis H37Rv
gcgggcacaauaggcuccagc

SEQ ID NO: 3310436 - RNA, 22 nt, Mycobacterium tuberculosis H37Rv
gcgggcacaauaggcuccagcg

SEQ ID NO: 3310437 - RNA, 22 nt, Mycobacterium tuberculosis H37Rv
gcgggcaccuuccacgaucgag

SEQ ID NO: 3310438 - RNA, 18 nt, Mycobacterium tuberculosis H37Rv
gcgggcacgcacaaguuc

SEQ ID NO: 3310439 - RNA, 14 nt, Mycobacterium tuberculosis H37Rv
gcgggcacgccgcc

SEQ ID NO: 3310440 - RNA, 13 nt, Mycobacterium tuberculosis H37Rv
gcgggcagcaggc

SEQ ID NO: 3310441 - RNA, 19 nt, Mycobacterium tuberculosis H37Rv
gcgggcagccgcccgccag

SEQ ID NO: 3310442 - RNA, 21 nt, Mycobacterium tuberculosis H37Rv
gcgggcagcuguucggccaac

SEQ ID NO: 3310443 - RNA, 19 nt, Mycobacterium tuberculosis H37Rv
gcgggcaguagcuguggcc

SEQ ID NO: 3310444 - RNA, 17 nt, Mycobacterium tuberculosis H37Rv
gcgggcaguugacccau

SEQ ID NO: 3310445 - RNA, 20 nt, Mycobacterium tuberculosis H37Rv
gcgggcaguuguugacagac

SEQ ID NO: 3310446 - RNA, 20 nt, Mycobacterium tuberculosis H37Rv
gcgggcauaacccgcaccgg

SEQ ID NO: 3310447 - RNA, 16 nt, Mycobacterium tuberculosis H37Rv
gcgggcaugauccccg

SEQ ID NO: 3310448 - RNA, 16 nt, Mycobacterium tuberculosis H37Rv
gcgggcaugauguuga

SEQ ID NO: 3310449 - RNA, 15 nt, Mycobacterium tuberculosis H37Rv
gcgggcaugccggcg

SEQ ID NO: 3310450 - RNA, 19 nt, Mycobacterium tuberculosis H37Rv
gcgggccaccacgcgccgc

SEQ ID NO: 3310451 - RNA, 17 nt, Mycobacterium tuberculosis H37Rv
gcgggccacgaucggcu

SEQ ID NO: 3310452 - RNA, 21 nt, Mycobacterium tuberculosis H37Rv
gcgggccacgaucggcugguu

SEQ ID NO: 3310453 - RNA, 22 nt, Mycobacterium tuberculosis H37Rv
gcgggccacgaucggcugguua

SEQ ID NO: 3310454 - RNA, 12 nt, Mycobacterium tuberculosis H37Rv
gcgggcccacgc

SEQ ID NO: 3310455 - RNA, 13 nt, Mycobacterium tuberculosis H37Rv
gcgggcccgauga

SEQ ID NO: 3310456 - RNA, 17 nt, Mycobacterium tuberculosis H37Rv
gcgggcccgaugaggac

SEQ ID NO: 3310457 - RNA, 19 nt, Mycobacterium tuberculosis H37Rv
gcgggcccgccggccccgc

SEQ ID NO: 3310458 - RNA, 12 nt, Mycobacterium tuberculosis H37Rv
gcgggcccgcgc

SEQ ID NO: 3310459 - RNA, 16 nt, Mycobacterium tuberculosis H37Rv
gcgggcccgcgcggcg

SEQ ID NO: 3310460 - RNA, 17 nt, Mycobacterium tuberculosis H37Rv
gcgggcccgcgcggcgg

SEQ ID NO: 3310461 - RNA, 15 nt, Mycobacterium tuberculosis H37Rv
gcgggcccggcggcc

SEQ ID NO: 3310462 - RNA, 18 nt, Mycobacterium tuberculosis H37Rv
gcgggcccggcggccagc

SEQ ID NO: 3310463 - RNA, 21 nt, Mycobacterium tuberculosis H37Rv
gcgggccgaacacaccgggcg

SEQ ID NO: 3310464 - RNA, 23 nt, Mycobacterium tuberculosis H37Rv
gcgggccgagaucacgccgggcg

SEQ ID NO: 3310465 - RNA, 15 nt, Mycobacterium tuberculosis H37Rv
gcgggccgcgcggcg

SEQ ID NO: 3310466 - RNA, 15 nt, Mycobacterium tuberculosis H37Rv
gcgggccggucgugc

SEQ ID NO: 3310467 - RNA, 14 nt, Mycobacterium tuberculosis H37Rv
gcgggccggugaac

SEQ ID NO: 3310468 - RNA, 22 nt, Mycobacterium tuberculosis H37Rv
gcgggccguagaucccgaagcg

SEQ ID NO: 3310469 - RNA, 14 nt, Mycobacterium tuberculosis H37Rv
gcgggccuccugcu

SEQ ID NO: 3310470 - RNA, 15 nt, Mycobacterium tuberculosis H37Rv
gcgggccucggcgac

SEQ ID NO: 3310471 - RNA, 22 nt, Mycobacterium tuberculosis H37Rv
gcgggccucggcgaccaucuga

SEQ ID NO: 3310472 - RNA, 23 nt, Mycobacterium tuberculosis H37Rv
gcgggccugcccgggaugcuccc

SEQ ID NO: 3310473 - RNA, 16 nt, Mycobacterium tuberculosis H37Rv
gcgggcgaccaccgcg

SEQ ID NO: 3310474 - RNA, 19 nt, Mycobacterium tuberculosis H37Rv
gcgggcgaccaccgcggca

SEQ ID NO: 3310475 - RNA, 22 nt, Mycobacterium tuberculosis H37Rv
gcgggcgacccguucucgguga

SEQ ID NO: 3310476 - RNA, 21 nt, Mycobacterium tuberculosis H37Rv
gcgggcgagaacccacgcaug

SEQ ID NO: 3310477 - RNA, 17 nt, Mycobacterium tuberculosis H37Rv
gcgggcgaucucggcga

SEQ ID NO: 3310478 - RNA, 16 nt, Mycobacterium tuberculosis H37Rv
gcgggcgaugagcgcg

SEQ ID NO: 3310479 - RNA, 15 nt, Mycobacterium tuberculosis H37Rv
gcgggcgauggccag

SEQ ID NO: 3310480 - RNA, 14 nt, Mycobacterium tuberculosis H37Rv
gcgggcgccccacc

SEQ ID NO: 3310481 - RNA, 17 nt, Mycobacterium tuberculosis H37Rv
gcgggcgccgcuaggug

SEQ ID NO: 3310482 - RNA, 14 nt, Mycobacterium tuberculosis H37Rv
gcgggcgccgggaa

SEQ ID NO: 3310483 - RNA, 22 nt, Mycobacterium tuberculosis H37Rv
gcgggcgccuuccaggcgggcg

SEQ ID NO: 3310484 - RNA, 12 nt, Mycobacterium tuberculosis H37Rv
gcgggcgccuug

SEQ ID NO: 3310485 - RNA, 20 nt, Mycobacterium tuberculosis H37Rv
gcgggcgccuuggucgccgc

SEQ ID NO: 3310486 - RNA, 13 nt, Mycobacterium tuberculosis H37Rv
gcgggcgcgggug

SEQ ID NO: 3310487 - RNA, 14 nt, Mycobacterium tuberculosis H37Rv
gcgggcgcgggugg

SEQ ID NO: 3310488 - RNA, 18 nt, Mycobacterium tuberculosis H37Rv
gcgggcggaucgccgggg

SEQ ID NO: 3310489 - RNA, 19 nt, Mycobacterium tuberculosis H37Rv
gcgggcggcagcgagucga

SEQ ID NO: 3310490 - RNA, 14 nt, Mycobacterium tuberculosis H37Rv
gcgggcggcccugg

SEQ ID NO: 3310491 - RNA, 13 nt, Mycobacterium tuberculosis H37Rv
gcgggcggccgau

SEQ ID NO: 3310492 - RNA, 12 nt, Mycobacterium tuberculosis H37Rv
gcgggcggcgcu

SEQ ID NO: 3310493 - RNA, 22 nt, Mycobacterium tuberculosis H37Rv
gcgggcgguccaaaacaccgcc

SEQ ID NO: 3310494 - RNA, 18 nt, Mycobacterium tuberculosis H37Rv
gcgggcggugcacaccgu

SEQ ID NO: 3310495 - RNA, 12 nt, Mycobacterium tuberculosis H37Rv
gcgggcgguggg

SEQ ID NO: 3310496 - RNA, 14 nt, Mycobacterium tuberculosis H37Rv
gcgggcggugggca

SEQ ID NO: 3310497 - RNA, 16 nt, Mycobacterium tuberculosis H37Rv
gcgggcggugggcagc

SEQ ID NO: 3310498 - RNA, 19 nt, Mycobacterium tuberculosis H37Rv
gcgggcggugggcagcagc

SEQ ID NO: 3310499 - RNA, 14 nt, Mycobacterium tuberculosis H37Rv
gcgggcguccacgc

SEQ ID NO: 3310500 - RNA, 13 nt, Mycobacterium tuberculosis H37Rv
gcgggcgugagug

SEQ ID NO: 3310501 - RNA, 16 nt, Mycobacterium tuberculosis H37Rv
gcgggcuccccgcaca

SEQ ID NO: 3310502 - RNA, 14 nt, Mycobacterium tuberculosis H37Rv
gcgggcucgcccgc

SEQ ID NO: 3310503 - RNA, 22 nt, Mycobacterium tuberculosis H37Rv
gcgggcucggucccgcuacacc

SEQ ID NO: 3310504 - RNA, 18 nt, Mycobacterium tuberculosis H37Rv
gcgggcucgguggcggac

SEQ ID NO: 3310505 - RNA, 16 nt, Mycobacterium tuberculosis H37Rv
gcgggcucguguccgc

SEQ ID NO: 3310506 - RNA, 17 nt, Mycobacterium tuberculosis H37Rv
gcgguaccaucaccgcg

SEQ ID NO: 3310507 - RNA, 23 nt, Mycobacterium tuberculosis H37Rv
gcgguaccaucaccgcgccagcc

SEQ ID NO: 3310508 - RNA, 14 nt, Mycobacterium tuberculosis H37Rv
gcgguacccgaugu

SEQ ID NO: 3310509 - RNA, 21 nt, Mycobacterium tuberculosis H37Rv
gcgguaccgccgcggucggac

SEQ ID NO: 3310510 - RNA, 23 nt, Mycobacterium tuberculosis H37Rv
gcgguaccggaaucggcggcgga

SEQ ID NO: 3310511 - RNA, 17 nt, Mycobacterium tuberculosis H37Rv
gcgguaccuagccgcag

SEQ ID NO: 3310512 - RNA, 18 nt, Mycobacterium tuberculosis H37Rv
gcgguaccuagccgcaga

SEQ ID NO: 3310513 - RNA, 18 nt, Mycobacterium tuberculosis H37Rv
gcgguacgcccgaaucgc

SEQ ID NO: 3310514 - RNA, 20 nt, Mycobacterium tuberculosis H37Rv
gcgguacgccggucggugcg

SEQ ID NO: 3310515 - RNA, 20 nt, Mycobacterium tuberculosis H37Rv
gcgguacguaaucgagcgcg

SEQ ID NO: 3310516 - RNA, 18 nt, Mycobacterium tuberculosis H37Rv
gcgguagccgacgacacg

SEQ ID NO: 3310517 - RNA, 12 nt, Mycobacterium tuberculosis H37Rv
gcgguagcgccg

SEQ ID NO: 3310518 - RNA, 23 nt, Mycobacterium tuberculosis H37Rv
gcgguagcggaccugcgagaucg

SEQ ID NO: 3310519 - RNA, 17 nt, Mycobacterium tuberculosis H37Rv
gcgguagcucauugccg

SEQ ID NO: 3310520 - RNA, 17 nt, Mycobacterium tuberculosis H37Rv
gcgguagcuuccgcgac

SEQ ID NO: 3310521 - RNA, 21 nt, Mycobacterium tuberculosis H37Rv
gcgguagcuuccgcgacgcuc

SEQ ID NO: 3310522 - RNA, 13 nt, Mycobacterium tuberculosis H37Rv
gcgguaggcguug

SEQ ID NO: 3310523 - RNA, 20 nt, Mycobacterium tuberculosis H37Rv
gcgguaggcuugcaaggucg

SEQ ID NO: 3310524 - RNA, 16 nt, Mycobacterium tuberculosis H37Rv
gcgguagucgccgagg

SEQ ID NO: 3310525 - RNA, 15 nt, Mycobacterium tuberculosis H37Rv
gcgguaucggucagc

SEQ ID NO: 3310526 - RNA, 16 nt, Mycobacterium tuberculosis H37Rv
gcgguaucggucagcc

SEQ ID NO: 3310527 - RNA, 13 nt, Mycobacterium tuberculosis H37Rv
gcgguaucggucg

SEQ ID NO: 3310528 - RNA, 19 nt, Mycobacterium tuberculosis H37Rv
gcggucaaauccagcagcc

SEQ ID NO: 3310529 - RNA, 23 nt, Mycobacterium tuberculosis H37Rv
gcggucaacuucuuggugcccau

SEQ ID NO: 3310530 - RNA, 20 nt, Mycobacterium tuberculosis H37Rv
gcggucaauguggcgcuucg

SEQ ID NO: 3310531 - RNA, 19 nt, Mycobacterium tuberculosis H37Rv
gcggucaccgcgucaccgg

SEQ ID NO: 3310532 - RNA, 19 nt, Mycobacterium tuberculosis H37Rv
gcggucaccggagagccgg

SEQ ID NO: 3310533 - RNA, 22 nt, Mycobacterium tuberculosis H37Rv
gcggucagacgccggccgccga

SEQ ID NO: 3310534 - RNA, 22 nt, Mycobacterium tuberculosis H37Rv
gcggucagcagcgccgucagca

SEQ ID NO: 3310535 - RNA, 15 nt, Mycobacterium tuberculosis H37Rv
gcggucagcggcugg

SEQ ID NO: 3310536 - RNA, 19 nt, Mycobacterium tuberculosis H37Rv
gcggucagcucggcagcau

SEQ ID NO: 3310537 - RNA, 18 nt, Mycobacterium tuberculosis H37Rv
gcggucaucgcguccaug

SEQ ID NO: 3310538 - RNA, 17 nt, Mycobacterium tuberculosis H37Rv
gcggucaucggcgccaa

SEQ ID NO: 3310539 - RNA, 13 nt, Mycobacterium tuberculosis H37Rv
gcggucaugggcg

SEQ ID NO: 3310540 - RNA, 20 nt, Mycobacterium tuberculosis H37Rv
gcgguccaacagcgccagua

SEQ ID NO: 3310541 - RNA, 22 nt, Mycobacterium tuberculosis H37Rv
gcgguccaccggcccucgccag

SEQ ID NO: 3310542 - RNA, 13 nt, Mycobacterium tuberculosis H37Rv
gcgguccagaaug

SEQ ID NO: 3310543 - RNA, 20 nt, Mycobacterium tuberculosis H37Rv
gcgguccagacaucagugcg

SEQ ID NO: 3310544 - RNA, 15 nt, Mycobacterium tuberculosis H37Rv
gcgguccagccaccg

SEQ ID NO: 3310545 - RNA, 17 nt, Mycobacterium tuberculosis H37Rv
gcgguccagccaccgcc

SEQ ID NO: 3310546 - RNA, 15 nt, Mycobacterium tuberculosis H37Rv
gcgguccaggccggc

SEQ ID NO: 3310547 - RNA, 18 nt, Mycobacterium tuberculosis H37Rv
gcgguccaggccggcacc

SEQ ID NO: 3310548 - RNA, 17 nt, Mycobacterium tuberculosis H37Rv
gcggucccacggccggc

SEQ ID NO: 3310549 - RNA, 17 nt, Mycobacterium tuberculosis H37Rv
gcggucccaugugcccg

SEQ ID NO: 3310550 - RNA, 19 nt, Mycobacterium tuberculosis H37Rv
gcggucccugaagccagcg

SEQ ID NO: 3310551 - RNA, 13 nt, Mycobacterium tuberculosis H37Rv
gcgguccgagcgg

SEQ ID NO: 3310552 - RNA, 18 nt, Mycobacterium tuberculosis H37Rv
gcgguccgagcggcaucg

SEQ ID NO: 3310553 - RNA, 19 nt, Mycobacterium tuberculosis H37Rv
gcgguccggcuucggcgaa

SEQ ID NO: 3310554 - RNA, 15 nt, Mycobacterium tuberculosis H37Rv
gcgguccucgagccg

SEQ ID NO: 3310555 - RNA, 18 nt, Mycobacterium tuberculosis H37Rv
gcgguccucgaucggugg

SEQ ID NO: 3310556 - RNA, 19 nt, Mycobacterium tuberculosis H37Rv
gcggucgaagaccaagagc

SEQ ID NO: 3310557 - RNA, 18 nt, Mycobacterium tuberculosis H37Rv
gcggucgagaugucgaag

SEQ ID NO: 3310558 - RNA, 17 nt, Mycobacterium tuberculosis H37Rv
gcggucgagccacccac

SEQ ID NO: 3310559 - RNA, 13 nt, Mycobacterium tuberculosis H37Rv
gcggucgagcucg

SEQ ID NO: 3310560 - RNA, 18 nt, Mycobacterium tuberculosis H37Rv
gcggucgagguggcgggc

SEQ ID NO: 3310561 - RNA, 13 nt, Mycobacterium tuberculosis H37Rv
gcggucgaucaca

SEQ ID NO: 3310562 - RNA, 19 nt, Mycobacterium tuberculosis H37Rv
gcggucgauguccgcagca

SEQ ID NO: 3310563 - RNA, 22 nt, Mycobacterium tuberculosis H37Rv
gcggucgauguccgcagcaccg

SEQ ID NO: 3310564 - RNA, 19 nt, Mycobacterium tuberculosis H37Rv
gcggucgcagcagaccaca

SEQ ID NO: 3310565 - RNA, 16 nt, Mycobacterium tuberculosis H37Rv
gcggucgccaagaucg

SEQ ID NO: 3310566 - RNA, 12 nt, Mycobacterium tuberculosis H37Rv
gcggucgcccag

SEQ ID NO: 3310567 - RNA, 13 nt, Mycobacterium tuberculosis H37Rv
gcggucgccgcgc

SEQ ID NO: 3310568 - RNA, 21 nt, Mycobacterium tuberculosis H37Rv
gcggucgcgcccucagccgcg

SEQ ID NO: 3310569 - RNA, 23 nt, Mycobacterium tuberculosis H37Rv
gcggucgcgguagcagccgcuga

SEQ ID NO: 3310570 - RNA, 13 nt, Mycobacterium tuberculosis H37Rv
gcggucgcuaucc

SEQ ID NO: 3310571 - RNA, 18 nt, Mycobacterium tuberculosis H37Rv
gcggucggaaugccgucg

SEQ ID NO: 3310572 - RNA, 22 nt, Mycobacterium tuberculosis H37Rv
gcggucggaaugccgucgccgg

SEQ ID NO: 3310573 - RNA, 15 nt, Mycobacterium tuberculosis H37Rv
gcggucggcagaccg

SEQ ID NO: 3310574 - RNA, 16 nt, Mycobacterium tuberculosis H37Rv
gcggucggcagcgacg

SEQ ID NO: 3310575 - RNA, 22 nt, Mycobacterium tuberculosis H37Rv
gcggucggcagcgacgccggcc

SEQ ID NO: 3310576 - RNA, 17 nt, Mycobacterium tuberculosis H37Rv
gcggucggccaccaacu

SEQ ID NO: 3310577 - RNA, 20 nt, Mycobacterium tuberculosis H37Rv
gcggucggcgaccaccagcg

SEQ ID NO: 3310578 - RNA, 16 nt, Mycobacterium tuberculosis H37Rv
gcggucggucaccaug

SEQ ID NO: 3310579 - RNA, 22 nt, Mycobacterium tuberculosis H37Rv
gcggucgucacggaccgccacc

SEQ ID NO: 3310580 - RNA, 15 nt, Mycobacterium tuberculosis H37Rv
gcggucgugaucagc

SEQ ID NO: 3310581 - RNA, 19 nt, Mycobacterium tuberculosis H37Rv
gcggucgugaucagcagga

SEQ ID NO: 3310582 - RNA, 22 nt, Mycobacterium tuberculosis H37Rv
gcggucgugaucagcaggacga

SEQ ID NO: 3310583 - RNA, 22 nt, Mycobacterium tuberculosis H37Rv
gcggucgugccccgcggucucg

SEQ ID NO: 3310584 - RNA, 18 nt, Mycobacterium tuberculosis H37Rv
gcggucucagugcucgcc

SEQ ID NO: 3310585 - RNA, 19 nt, Mycobacterium tuberculosis H37Rv
gcggucucggugccgagca

SEQ ID NO: 3310586 - RNA, 21 nt, Mycobacterium tuberculosis H37Rv
gcggucucggugccgagcacu

SEQ ID NO: 3310587 - RNA, 17 nt, Mycobacterium tuberculosis H37Rv
gcggucugcagugcagc

SEQ ID NO: 3310588 - RNA, 18 nt, Mycobacterium tuberculosis H37Rv
gcggucugcgccuucgcc

SEQ ID NO: 3310589 - RNA, 16 nt, Mycobacterium tuberculosis H37Rv
gcggucugcgcgucgc

SEQ ID NO: 3310590 - RNA, 19 nt, Mycobacterium tuberculosis H37Rv
gcggucugcgcgucgcgug

SEQ ID NO: 3310591 - RNA, 12 nt, Mycobacterium tuberculosis H37Rv
gcggucugcucc

SEQ ID NO: 3310592 - RNA, 19 nt, Mycobacterium tuberculosis H37Rv
gcggucugcuccaggcgcg

SEQ ID NO: 3310593 - RNA, 14 nt, Mycobacterium tuberculosis H37Rv
gcggucugguuguc

SEQ ID NO: 3310594 - RNA, 17 nt, Mycobacterium tuberculosis H37Rv
gcggucuuggcgcgccc

SEQ ID NO: 3310595 - RNA, 23 nt, Mycobacterium tuberculosis H37Rv
gcggucuuuuugggcuugcccca

SEQ ID NO: 3310596 - RNA, 17 nt, Mycobacterium tuberculosis H37Rv
gcggugaacaccgccag

SEQ ID NO: 3310597 - RNA, 18 nt, Mycobacterium tuberculosis H37Rv
gcggugaacaccgccagc

SEQ ID NO: 3310598 - RNA, 19 nt, Mycobacterium tuberculosis H37Rv
gcggugaacuucuccacca

SEQ ID NO: 3310599 - RNA, 22 nt, Mycobacterium tuberculosis H37Rv
gcggugaacuucuccaccagcg

SEQ ID NO: 3310600 - RNA, 15 nt, Mycobacterium tuberculosis H37Rv
gcggugacgccagcc

SEQ ID NO: 3310601 - RNA, 14 nt, Mycobacterium tuberculosis H37Rv
gcggugacguggug

SEQ ID NO: 3310602 - RNA, 14 nt, Mycobacterium tuberculosis H37Rv
gcguaggccagcga

SEQ ID NO: 3310603 - RNA, 15 nt, Mycobacterium tuberculosis H37Rv
gcguaggcgauggcg

SEQ ID NO: 3310604 - RNA, 17 nt, Mycobacterium tuberculosis H37Rv
gcguagguggccagcgc

SEQ ID NO: 3310605 - RNA, 16 nt, Mycobacterium tuberculosis H37Rv
gcguaguccaggccgu

SEQ ID NO: 3310606 - RNA, 20 nt, Mycobacterium tuberculosis H37Rv
gcguaguccgcauccgcgac

SEQ ID NO: 3310607 - RNA, 18 nt, Mycobacterium tuberculosis H37Rv
gcguagucggcggugcag

SEQ ID NO: 3310608 - RNA, 22 nt, Mycobacterium tuberculosis H37Rv
gcguauagcaugccgcggcgga

SEQ ID NO: 3310609 - RNA, 15 nt, Mycobacterium tuberculosis H37Rv
gcguaugcacaugau

SEQ ID NO: 3310610 - RNA, 22 nt, Mycobacterium tuberculosis H37Rv
gcguaugccaggacuggcaccg

SEQ ID NO: 3310611 - RNA, 21 nt, Mycobacterium tuberculosis H37Rv
gcgucaaccgaucggucgucc

SEQ ID NO: 3310612 - RNA, 15 nt, Mycobacterium tuberculosis H37Rv
gcgucaacgcuguug

SEQ ID NO: 3310613 - RNA, 18 nt, Mycobacterium tuberculosis H37Rv
gcgucaagggcuggguca

SEQ ID NO: 3310614 - RNA, 18 nt, Mycobacterium tuberculosis H37Rv
gcgucacaccacgacgcg

SEQ ID NO: 3310615 - RNA, 14 nt, Mycobacterium tuberculosis H37Rv
gcgucacaccagcg

SEQ ID NO: 3310616 - RNA, 21 nt, Mycobacterium tuberculosis H37Rv
gcgucaccccggucccgccga

SEQ ID NO: 3310617 - RNA, 15 nt, Mycobacterium tuberculosis H37Rv
gcgucacccugucgc

SEQ ID NO: 3310618 - RNA, 18 nt, Mycobacterium tuberculosis H37Rv
gcgucacccugucgcgca

SEQ ID NO: 3310619 - RNA, 19 nt, Mycobacterium tuberculosis H37Rv
gcgucacccugucgcgcac

SEQ ID NO: 3310620 - RNA, 15 nt, Mycobacterium tuberculosis H37Rv
gcgucaccgccggug

SEQ ID NO: 3310621 - RNA, 19 nt, Mycobacterium tuberculosis H37Rv
gcgucaccgccggugcuga

SEQ ID NO: 3310622 - RNA, 22 nt, Mycobacterium tuberculosis H37Rv
gcgucaccucaccgaacggcag

SEQ ID NO: 3310623 - RNA, 20 nt, Mycobacterium tuberculosis H37Rv
gcgucacggugcguucgugc

SEQ ID NO: 3310624 - RNA, 19 nt, Mycobacterium tuberculosis H37Rv
gcgucacguaauuccccag

SEQ ID NO: 3310625 - RNA, 15 nt, Mycobacterium tuberculosis H37Rv
gcgucagccccgacu

SEQ ID NO: 3310626 - RNA, 21 nt, Mycobacterium tuberculosis H37Rv
gcgucagccgcaccccgcccg

SEQ ID NO: 3310627 - RNA, 22 nt, Mycobacterium tuberculosis H37Rv
gcgucagccgcaccccgcccga

SEQ ID NO: 3310628 - RNA, 13 nt, Mycobacterium tuberculosis H37Rv
gcgucagcgcggc

SEQ ID NO: 3310629 - RNA, 16 nt, Mycobacterium tuberculosis H37Rv
gcgucagcgcggcguc

SEQ ID NO: 3310630 - RNA, 15 nt, Mycobacterium tuberculosis H37Rv
gcgucagcggcgagc

SEQ ID NO: 3310631 - RNA, 18 nt, Mycobacterium tuberculosis H37Rv
gcgucaggccagagucgc

SEQ ID NO: 3310632 - RNA, 20 nt, Mycobacterium tuberculosis H37Rv
gcgucaggccagagucgccc

SEQ ID NO: 3310633 - RNA, 15 nt, Mycobacterium tuberculosis H37Rv
gcgucaggccagcgc

SEQ ID NO: 3310634 - RNA, 17 nt, Mycobacterium tuberculosis H37Rv
gcgucaggugcgcgacc

SEQ ID NO: 3310635 - RNA, 20 nt, Mycobacterium tuberculosis H37Rv
gcgucaggugcgcgaccagg

SEQ ID NO: 3310636 - RNA, 15 nt, Mycobacterium tuberculosis H37Rv
gcgucaguccucauc

SEQ ID NO: 3310637 - RNA, 19 nt, Mycobacterium tuberculosis H37Rv
gcgucaguccucaucgagc

SEQ ID NO: 3310638 - RNA, 16 nt, Mycobacterium tuberculosis H37Rv
gcgucagugcagaaga

SEQ ID NO: 3310639 - RNA, 13 nt, Mycobacterium tuberculosis H37Rv
gcgucaucaccgg

SEQ ID NO: 3310640 - RNA, 15 nt, Mycobacterium tuberculosis H37Rv
gcgucaucaggucgu

SEQ ID NO: 3310641 - RNA, 17 nt, Mycobacterium tuberculosis H37Rv
gcgucaucaggucgucg

SEQ ID NO: 3310642 - RNA, 21 nt, Mycobacterium tuberculosis H37Rv
gcgucauucaccgcguugaug

SEQ ID NO: 3310643 - RNA, 16 nt, Mycobacterium tuberculosis H37Rv
gcguccaccacgcaaa

SEQ ID NO: 3310644 - RNA, 23 nt, Mycobacterium tuberculosis H37Rv
gcguccacccacgaucagcagcg

SEQ ID NO: 3310645 - RNA, 19 nt, Mycobacterium tuberculosis H37Rv
gcguccaccugcuccgcug

SEQ ID NO: 3310646 - RNA, 20 nt, Mycobacterium tuberculosis H37Rv
gcguccagcaaaugcggcgc

SEQ ID NO: 3310647 - RNA, 13 nt, Mycobacterium tuberculosis H37Rv
gcguccagcagcg

SEQ ID NO: 3310648 - RNA, 23 nt, Mycobacterium tuberculosis H37Rv
gcguccaucagagacagcagcgu

SEQ ID NO: 3310649 - RNA, 14 nt, Mycobacterium tuberculosis H37Rv
gcguccauccgcag

SEQ ID NO: 3310650 - RNA, 16 nt, Mycobacterium tuberculosis H37Rv
gcguccauccgcagca

SEQ ID NO: 3310651 - RNA, 14 nt, Mycobacterium tuberculosis H37Rv
gcguccaucgccac

SEQ ID NO: 3310652 - RNA, 18 nt, Mycobacterium tuberculosis H37Rv
gcguccaucgccaccgcg

SEQ ID NO: 3310653 - RNA, 16 nt, Mycobacterium tuberculosis H37Rv
gcguccaucgcgcgcc

SEQ ID NO: 3310654 - RNA, 18 nt, Mycobacterium tuberculosis H37Rv
gcgucccaaucgggaucg

SEQ ID NO: 3310655 - RNA, 17 nt, Mycobacterium tuberculosis H37Rv
gcguccccagcgccacc

SEQ ID NO: 3310656 - RNA, 14 nt, Mycobacterium tuberculosis H37Rv
gcgucccgccgcac

SEQ ID NO: 3310657 - RNA, 16 nt, Mycobacterium tuberculosis H37Rv
gcguccgcccagcacc

SEQ ID NO: 3310658 - RNA, 19 nt, Mycobacterium tuberculosis H37Rv
gcguccgcccagccgcagc

SEQ ID NO: 3310659 - RNA, 18 nt, Mycobacterium tuberculosis H37Rv
gcguccgcgaucugcagc

SEQ ID NO: 3310660 - RNA, 20 nt, Mycobacterium tuberculosis H37Rv
gcguccgggcucgcgcucga

SEQ ID NO: 3310661 - RNA, 17 nt, Mycobacterium tuberculosis H37Rv
gcguccggugcaccagg

SEQ ID NO: 3310662 - RNA, 13 nt, Mycobacterium tuberculosis H37Rv
gcguccggugcug

SEQ ID NO: 3310663 - RNA, 18 nt, Mycobacterium tuberculosis H37Rv
gcguccguagcgauucug

SEQ ID NO: 3310664 - RNA, 16 nt, Mycobacterium tuberculosis H37Rv
gcguccgucgucggcg

SEQ ID NO: 3310665 - RNA, 17 nt, Mycobacterium tuberculosis H37Rv
gcguccgucucgcaggc

SEQ ID NO: 3310666 - RNA, 17 nt, Mycobacterium tuberculosis H37Rv
gcguccuccucgguguc

SEQ ID NO: 3310667 - RNA, 16 nt, Mycobacterium tuberculosis H37Rv
gcguccucgcccuggc

SEQ ID NO: 3310668 - RNA, 15 nt, Mycobacterium tuberculosis H37Rv
gcguccucgccgcac

SEQ ID NO: 3310669 - RNA, 19 nt, Mycobacterium tuberculosis H37Rv
gcguccugguggcgggauc

SEQ ID NO: 3310670 - RNA, 16 nt, Mycobacterium tuberculosis H37Rv
gcguccuugggcgucg

SEQ ID NO: 3310671 - RNA, 20 nt, Mycobacterium tuberculosis H37Rv
gcguccuuuuccgccgggcu

SEQ ID NO: 3310672 - RNA, 13 nt, Mycobacterium tuberculosis H37Rv
gcgucgaacacgu

SEQ ID NO: 3310673 - RNA, 18 nt, Mycobacterium tuberculosis H37Rv
gcgucgaacugccggacu

SEQ ID NO: 3310674 - RNA, 17 nt, Mycobacterium tuberculosis H37Rv
gcgucgaagacggcaag

SEQ ID NO: 3310675 - RNA, 18 nt, Mycobacterium tuberculosis H37Rv
gcgucgaaggugaccagg

SEQ ID NO: 3310676 - RNA, 19 nt, Mycobacterium tuberculosis H37Rv
gcgucgaaggugaccaggc

SEQ ID NO: 3310677 - RNA, 22 nt, Mycobacterium tuberculosis H37Rv
gcgucgaccaagguguccagca

SEQ ID NO: 3310678 - RNA, 13 nt, Mycobacterium tuberculosis H37Rv
gcgucgaccacgc

SEQ ID NO: 3310679 - RNA, 15 nt, Mycobacterium tuberculosis H37Rv
gcgucgaccgcggcc

SEQ ID NO: 3310680 - RNA, 14 nt, Mycobacterium tuberculosis H37Rv
gcgucgacggcucc

SEQ ID NO: 3310681 - RNA, 19 nt, Mycobacterium tuberculosis H37Rv
gcgucgacgucgacggcga

SEQ ID NO: 3310682 - RNA, 15 nt, Mycobacterium tuberculosis H37Rv
gcgucgagcaccuug
